United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 137

SEQ ID NO: 5811661 - DNA, 21 bp, Homo sapiens
ttctgcctttaattttcttgt

SEQ ID NO: 5811662 - DNA, 19 bp, Homo sapiens
ttctgcctttgcagaaaca

SEQ ID NO: 5811663 - DNA, 20 bp, Homo sapiens
ttctgcctttgcagaaacag

SEQ ID NO: 5811664 - DNA, 13 bp, Homo sapiens
ttctgcctttgcc

SEQ ID NO: 5811665 - DNA, 14 bp, Homo sapiens
ttctgcctttgcca

SEQ ID NO: 5811666 - DNA, 15 bp, Homo sapiens
ttctgcctttgccag

SEQ ID NO: 5811667 - DNA, 21 bp, Homo sapiens
ttctgcctttgccaggtgact

SEQ ID NO: 5811668 - DNA, 22 bp, Homo sapiens
ttctgcctttggggacttttct

SEQ ID NO: 5811669 - DNA, 18 bp, Homo sapiens
ttctgcgccacttccttt

SEQ ID NO: 5811670 - DNA, 23 bp, Homo sapiens
ttctgcgccacttcctttgtgtt

SEQ ID NO: 5811671 - DNA, 14 bp, Homo sapiens
ttctgcgctgtgta

SEQ ID NO: 5811672 - DNA, 20 bp, Homo sapiens
ttctgcgctgtgtacaatgt

SEQ ID NO: 5811673 - DNA, 22 bp, Homo sapiens
ttctgcggagcttctccagcca

SEQ ID NO: 5811674 - DNA, 17 bp, Homo sapiens
ttctgcgggctccctcc

SEQ ID NO: 5811675 - DNA, 16 bp, Homo sapiens
ttctgcggggctgaga

SEQ ID NO: 5811676 - DNA, 16 bp, Homo sapiens
ttctgcggtgaggcag

SEQ ID NO: 5811677 - DNA, 13 bp, Homo sapiens
ttctgcgtccacc

SEQ ID NO: 5811678 - DNA, 15 bp, Homo sapiens
ttctgctaaatatca

SEQ ID NO: 5811679 - DNA, 17 bp, Homo sapiens
ttctgctaagattcctt

SEQ ID NO: 5811680 - DNA, 17 bp, Homo sapiens
ttctgctaagttctccc

SEQ ID NO: 5811681 - DNA, 21 bp, Homo sapiens
ttctgctacctcactggggtc

SEQ ID NO: 5811682 - DNA, 19 bp, Homo sapiens
ttctgctactggcaaaagg

SEQ ID NO: 5811683 - DNA, 22 bp, Homo sapiens
ttctgctacttcactgtcatct

SEQ ID NO: 5811684 - DNA, 18 bp, Homo sapiens
ttctgctcacattccctc

SEQ ID NO: 5811685 - DNA, 21 bp, Homo sapiens
ttctgctcacattccctctca

SEQ ID NO: 5811686 - DNA, 12 bp, Homo sapiens
ttctgctcagct

SEQ ID NO: 5811687 - DNA, 13 bp, Homo sapiens
ttctgctcatcat

SEQ ID NO: 5811688 - DNA, 9 bp, Homo sapiens
ttctgctcc

SEQ ID NO: 5811689 - DNA, 15 bp, Homo sapiens
ttctgctccaccctt

SEQ ID NO: 5811690 - DNA, 16 bp, Homo sapiens
ttctgctccagacagg

SEQ ID NO: 5811691 - DNA, 17 bp, Homo sapiens
ttctgctcctgcttttc

SEQ ID NO: 5811692 - DNA, 16 bp, Homo sapiens
ttctgctccttcccca

SEQ ID NO: 5811693 - DNA, 17 bp, Homo sapiens
ttctgctctatactgtg

SEQ ID NO: 5811694 - DNA, 15 bp, Homo sapiens
ttctgctctgcccat

SEQ ID NO: 5811695 - DNA, 13 bp, Homo sapiens
ttctgctctggaa

SEQ ID NO: 5811696 - DNA, 17 bp, Homo sapiens
ttctgctctggaataaa

SEQ ID NO: 5811697 - DNA, 17 bp, Homo sapiens
ttctgctctggttgttt

SEQ ID NO: 5811698 - DNA, 15 bp, Homo sapiens
ttctgctgcccccag

SEQ ID NO: 5811699 - DNA, 17 bp, Homo sapiens
ttctgctgcctctacac

SEQ ID NO: 5811700 - DNA, 20 bp, Homo sapiens
ttctgctgcctctacacagg

SEQ ID NO: 5811701 - DNA, 18 bp, Homo sapiens
ttctgctggaaacagact

SEQ ID NO: 5811702 - DNA, 12 bp, Homo sapiens
ttctgctggaag

SEQ ID NO: 5811703 - DNA, 15 bp, Homo sapiens
ttctgctggaggagg

SEQ ID NO: 5811704 - DNA, 15 bp, Homo sapiens
ttctgctggcctctg

SEQ ID NO: 5811705 - DNA, 13 bp, Homo sapiens
ttctgctggcctg

SEQ ID NO: 5811706 - DNA, 13 bp, Homo sapiens
ttctgctggctga

SEQ ID NO: 5811707 - DNA, 20 bp, Homo sapiens
ttctgctggggcctgggaca

SEQ ID NO: 5811708 - DNA, 19 bp, Homo sapiens
ttctgctgtggtctataaa

SEQ ID NO: 5811709 - DNA, 19 bp, Homo sapiens
ttctgctgttcttcacttc

SEQ ID NO: 5811710 - DNA, 18 bp, Homo sapiens
ttctgctgtttacaacat

SEQ ID NO: 5811711 - DNA, 16 bp, Homo sapiens
ttctgcttaggagaga

SEQ ID NO: 5811712 - DNA, 16 bp, Homo sapiens
ttctgcttcaataaat

SEQ ID NO: 5811713 - DNA, 19 bp, Homo sapiens
ttctgcttcagcctcccga

SEQ ID NO: 5811714 - DNA, 23 bp, Homo sapiens
ttctgcttgctcccaagcccctg

SEQ ID NO: 5811715 - DNA, 15 bp, Homo sapiens
ttctgcttgtgacat

SEQ ID NO: 5811716 - DNA, 18 bp, Homo sapiens
ttctgcttgtgttaagta

SEQ ID NO: 5811717 - DNA, 19 bp, Homo sapiens
ttctgctttatcttttcat

SEQ ID NO: 5811718 - DNA, 13 bp, Homo sapiens
ttctgctttctga

SEQ ID NO: 5811719 - DNA, 15 bp, Homo sapiens
ttctgctttctttga

SEQ ID NO: 5811720 - DNA, 11 bp, Homo sapiens
ttctgctttgt

SEQ ID NO: 5811721 - DNA, 23 bp, Homo sapiens
ttctgctttgttgtgtgcctcta

SEQ ID NO: 5811722 - DNA, 16 bp, Homo sapiens
ttctgcttttaagttt

SEQ ID NO: 5811723 - DNA, 17 bp, Homo sapiens
ttctgcttttaagtttt

SEQ ID NO: 5811724 - DNA, 17 bp, Homo sapiens
ttctgcttttctgccct

SEQ ID NO: 5811725 - DNA, 19 bp, Homo sapiens
ttctgcttttctgccctgg

SEQ ID NO: 5811726 - DNA, 16 bp, Homo sapiens
ttctggaaaaacagga

SEQ ID NO: 5811727 - DNA, 18 bp, Homo sapiens
ttctggaaaaacaggata

SEQ ID NO: 5811728 - DNA, 13 bp, Homo sapiens
ttctggaaaatgc

SEQ ID NO: 5811729 - DNA, 18 bp, Homo sapiens
ttctggaaaatgcttctt

SEQ ID NO: 5811730 - DNA, 15 bp, Homo sapiens
ttctggaactgtctg

SEQ ID NO: 5811731 - DNA, 23 bp, Homo sapiens
ttctggaactgtctgaatattct

SEQ ID NO: 5811732 - DNA, 20 bp, Homo sapiens
ttctggaagattcttactgt

SEQ ID NO: 5811733 - DNA, 16 bp, Homo sapiens
ttctggaatactgaaa

SEQ ID NO: 5811734 - DNA, 18 bp, Homo sapiens
ttctggaatactgaaaaa

SEQ ID NO: 5811735 - DNA, 15 bp, Homo sapiens
ttctggaatggaatt

SEQ ID NO: 5811736 - DNA, 15 bp, Homo sapiens
ttctggaatgtaatc

SEQ ID NO: 5811737 - DNA, 16 bp, Homo sapiens
ttctggaatgtaatca

SEQ ID NO: 5811738 - DNA, 17 bp, Homo sapiens
ttctggaatttgttcaa

SEQ ID NO: 5811739 - DNA, 12 bp, Homo sapiens
ttctggacattc

SEQ ID NO: 5811740 - DNA, 21 bp, Homo sapiens
ttctggaccttgttgttgtta

SEQ ID NO: 5811741 - DNA, 17 bp, Homo sapiens
ttctggactatagctgt

SEQ ID NO: 5811742 - DNA, 11 bp, Homo sapiens
ttctggactgg

SEQ ID NO: 5811743 - DNA, 18 bp, Homo sapiens
ttctggacttggtcttga

SEQ ID NO: 5811744 - DNA, 17 bp, Homo sapiens
ttctggagatggaagct

SEQ ID NO: 5811745 - DNA, 17 bp, Homo sapiens
ttctggagatggatcct

SEQ ID NO: 5811746 - DNA, 14 bp, Homo sapiens
ttctggagctgctg

SEQ ID NO: 5811747 - DNA, 22 bp, Homo sapiens
ttctggagctgggagacaaagg

SEQ ID NO: 5811748 - DNA, 23 bp, Homo sapiens
ttctggagtcacatcagtgagga

SEQ ID NO: 5811749 - DNA, 20 bp, Homo sapiens
ttctggagtgattctagagg

SEQ ID NO: 5811750 - DNA, 10 bp, Homo sapiens
ttctggagtt

SEQ ID NO: 5811751 - DNA, 15 bp, Homo sapiens
ttctggagtttctct

SEQ ID NO: 5811752 - DNA, 16 bp, Homo sapiens
ttctggagtttctcta

SEQ ID NO: 5811753 - DNA, 18 bp, Homo sapiens
ttctggataaagccactg

SEQ ID NO: 5811754 - DNA, 19 bp, Homo sapiens
ttctggataaagccactga

SEQ ID NO: 5811755 - DNA, 16 bp, Homo sapiens
ttctggatctcctgct

SEQ ID NO: 5811756 - DNA, 22 bp, Homo sapiens
ttctggatctgaccctcccagt

SEQ ID NO: 5811757 - DNA, 17 bp, Homo sapiens
ttcttcagcatttactt

SEQ ID NO: 5811758 - DNA, 23 bp, Homo sapiens
ttcttcagccacctctctttttc

SEQ ID NO: 5811759 - DNA, 20 bp, Homo sapiens
ttcttcagcgtaaaatggtg

SEQ ID NO: 5811760 - DNA, 20 bp, Homo sapiens
ttcttcaggaaaataaatat

SEQ ID NO: 5811761 - DNA, 19 bp, Homo sapiens
ttcttcaggtaacactaca

SEQ ID NO: 5811762 - DNA, 15 bp, Homo sapiens
ttcttcagtcctttg

SEQ ID NO: 5811763 - DNA, 18 bp, Homo sapiens
ttcttcagtgtaatgtga

SEQ ID NO: 5811764 - DNA, 15 bp, Homo sapiens
ttcttcatattctaa

SEQ ID NO: 5811765 - DNA, 20 bp, Homo sapiens
ttcttcatccatagacacag

SEQ ID NO: 5811766 - DNA, 21 bp, Homo sapiens
ttcttcatccatagacacagt

SEQ ID NO: 5811767 - DNA, 18 bp, Homo sapiens
ttcttcatctgtgactcc

SEQ ID NO: 5811768 - DNA, 14 bp, Homo sapiens
ttcttcatcttgac

SEQ ID NO: 5811769 - DNA, 20 bp, Homo sapiens
ttcttcatctttgccatatg

SEQ ID NO: 5811770 - DNA, 19 bp, Homo sapiens
ttcttcatgtgatgtcatg

SEQ ID NO: 5811771 - DNA, 22 bp, Homo sapiens
ttcttcattatagtaaatctat

SEQ ID NO: 5811772 - DNA, 15 bp, Homo sapiens
ttcttcatttctata

SEQ ID NO: 5811773 - DNA, 17 bp, Homo sapiens
ttcttcatttggaggaa

SEQ ID NO: 5811774 - DNA, 14 bp, Homo sapiens
ttcttccaaagcag

SEQ ID NO: 5811775 - DNA, 20 bp, Homo sapiens
ttcttccaggtgcccagcta

SEQ ID NO: 5811776 - DNA, 19 bp, Homo sapiens
ttcttccatcatcactgta

SEQ ID NO: 5811777 - DNA, 22 bp, Homo sapiens
ttcttccatcatcactgtaaag

SEQ ID NO: 5811778 - DNA, 23 bp, Homo sapiens
ttcttccatcatcactgtaaaga

SEQ ID NO: 5811779 - DNA, 17 bp, Homo sapiens
ttcttccatcccaggac

SEQ ID NO: 5811780 - DNA, 21 bp, Homo sapiens
ttcttcccaaatcaaaataaa

SEQ ID NO: 5811781 - DNA, 21 bp, Homo sapiens
ttcttcccacccccttgccct

SEQ ID NO: 5811782 - DNA, 17 bp, Homo sapiens
ttcttcccactttcatc

SEQ ID NO: 5811783 - DNA, 21 bp, Homo sapiens
ttcttcccagaatctctgagc

SEQ ID NO: 5811784 - DNA, 15 bp, Homo sapiens
ttcttcccagtaagt

SEQ ID NO: 5811785 - DNA, 13 bp, Homo sapiens
ttcttcccattct

SEQ ID NO: 5811786 - DNA, 15 bp, Homo sapiens
ttcttcccatttgta

SEQ ID NO: 5811787 - DNA, 20 bp, Homo sapiens
ttcttcccatttgtaatgta

SEQ ID NO: 5811788 - DNA, 14 bp, Homo sapiens
ttcttccccaagct

SEQ ID NO: 5811789 - DNA, 22 bp, Homo sapiens
ttcttccccaaggcactgagcg

SEQ ID NO: 5811790 - DNA, 21 bp, Homo sapiens
ttcttccccaggtccttcctt

SEQ ID NO: 5811791 - DNA, 18 bp, Homo sapiens
ttcttccccttcctctct

SEQ ID NO: 5811792 - DNA, 19 bp, Homo sapiens
ttcttcccctttgtcctgc

SEQ ID NO: 5811793 - DNA, 17 bp, Homo sapiens
ttcttcccgctccccac

SEQ ID NO: 5811794 - DNA, 17 bp, Homo sapiens
ttcttcccttaactcca

SEQ ID NO: 5811795 - DNA, 13 bp, Homo sapiens
ttcttccgccaac

SEQ ID NO: 5811796 - DNA, 15 bp, Homo sapiens
ttcttcctaatgtca

SEQ ID NO: 5811797 - DNA, 18 bp, Homo sapiens
ttcttcctaccaagtcaa

SEQ ID NO: 5811798 - DNA, 11 bp, Homo sapiens
ttcttcctcac

SEQ ID NO: 5811799 - DNA, 15 bp, Homo sapiens
ttcttcctcactatg

SEQ ID NO: 5811800 - DNA, 16 bp, Homo sapiens
ttcttcctcactatga

SEQ ID NO: 5811801 - DNA, 14 bp, Homo sapiens
ttcttcctcagcca

SEQ ID NO: 5811802 - DNA, 17 bp, Homo sapiens
ttcttcctcagccagcc

SEQ ID NO: 5811803 - DNA, 14 bp, Homo sapiens
ttcttcctcagctg

SEQ ID NO: 5811804 - DNA, 14 bp, Homo sapiens
ttcttcctcccctc

SEQ ID NO: 5811805 - DNA, 13 bp, Homo sapiens
ttcttcctctgca

SEQ ID NO: 5811806 - DNA, 11 bp, Homo sapiens
ttcttcctgga

SEQ ID NO: 5811807 - DNA, 18 bp, Homo sapiens
ttcttcctgttaatgtat

SEQ ID NO: 5811808 - DNA, 10 bp, Homo sapiens
ttcttccttc

SEQ ID NO: 5811809 - DNA, 14 bp, Homo sapiens
ttcttccttccttt

SEQ ID NO: 5811810 - DNA, 12 bp, Homo sapiens
ttcttccttgat

SEQ ID NO: 5811811 - DNA, 12 bp, Homo sapiens
ttcttccttgcc

SEQ ID NO: 5811812 - DNA, 17 bp, Homo sapiens
ttcttcctttactttcc

SEQ ID NO: 5811813 - DNA, 18 bp, Homo sapiens
ttcttcctttactttccc

SEQ ID NO: 5811814 - DNA, 14 bp, Homo sapiens
ttcttcctttctgt

SEQ ID NO: 5811815 - DNA, 23 bp, Homo sapiens
ttcttcgggtgtgatcatatatc

SEQ ID NO: 5811816 - DNA, 23 bp, Homo sapiens
ttcttcgttaatagattatttca

SEQ ID NO: 5811817 - DNA, 23 bp, Homo sapiens
ttcttctaaagaggaagccttgc

SEQ ID NO: 5811818 - DNA, 12 bp, Homo sapiens
ttcttctaagaa

SEQ ID NO: 5811819 - DNA, 18 bp, Homo sapiens
ttcttctaagaagacatt

SEQ ID NO: 5811820 - DNA, 15 bp, Homo sapiens
ttcttctagagttca

SEQ ID NO: 5811821 - DNA, 12 bp, Homo sapiens
ttcttctagctt

SEQ ID NO: 5811822 - DNA, 18 bp, Homo sapiens
ttcttctaggttctaaaa

SEQ ID NO: 5811823 - DNA, 17 bp, Homo sapiens
ttcttctatagtgatga

SEQ ID NO: 5811824 - DNA, 23 bp, Homo sapiens
ttcttctatgtaggaaaaaaata

SEQ ID NO: 5811825 - DNA, 20 bp, Homo sapiens
ttcttctattgcctctgaga

SEQ ID NO: 5811826 - DNA, 22 bp, Homo sapiens
ttcttctccactttctagccag

SEQ ID NO: 5811827 - DNA, 20 bp, Homo sapiens
ttcttctcccctttcaaatt

SEQ ID NO: 5811828 - DNA, 17 bp, Homo sapiens
ttcttctcctatgtgta

SEQ ID NO: 5811829 - DNA, 12 bp, Homo sapiens
ttcttctccttt

SEQ ID NO: 5811830 - DNA, 16 bp, Homo sapiens
ttcttctctctgtgct

SEQ ID NO: 5811831 - DNA, 13 bp, Homo sapiens
ttcttctctgcct

SEQ ID NO: 5811832 - DNA, 12 bp, Homo sapiens
ttcttctctgga

SEQ ID NO: 5811833 - DNA, 13 bp, Homo sapiens
ttcttctgaagat

SEQ ID NO: 5811834 - DNA, 19 bp, Homo sapiens
ttcttctgaagattcttaa

SEQ ID NO: 5811835 - DNA, 20 bp, Homo sapiens
ttcttctgatcactgaaata

SEQ ID NO: 5811836 - DNA, 12 bp, Homo sapiens
ttcttctgccct

SEQ ID NO: 5811837 - DNA, 15 bp, Homo sapiens
ttcttctgcttcagc

SEQ ID NO: 5811838 - DNA, 14 bp, Homo sapiens
ttcttctggtgcta

SEQ ID NO: 5811839 - DNA, 13 bp, Homo sapiens
ttcttcttacatt

SEQ ID NO: 5811840 - DNA, 14 bp, Homo sapiens
ttcttcttcctgaa

SEQ ID NO: 5811841 - DNA, 15 bp, Homo sapiens
ttcttcttgaaaata

SEQ ID NO: 5811842 - DNA, 12 bp, Homo sapiens
ttcttcttggct

SEQ ID NO: 5811843 - DNA, 15 bp, Homo sapiens
ttcttcttggtgcta

SEQ ID NO: 5811844 - DNA, 21 bp, Homo sapiens
ttcttcttgtgtctccttatg

SEQ ID NO: 5811845 - DNA, 23 bp, Homo sapiens
ttcttcttgtgtctccttatggt

SEQ ID NO: 5811846 - DNA, 16 bp, Homo sapiens
ttcttctttaattttt

SEQ ID NO: 5811847 - DNA, 12 bp, Homo sapiens
ttcttctttccc

SEQ ID NO: 5811848 - DNA, 14 bp, Homo sapiens
ttcttctttccctg

SEQ ID NO: 5811849 - DNA, 12 bp, Homo sapiens
ttcttctttcta

SEQ ID NO: 5811850 - DNA, 14 bp, Homo sapiens
ttcttctttctaga

SEQ ID NO: 5811851 - DNA, 19 bp, Homo sapiens
ttcttctttctttcttttg

SEQ ID NO: 5811852 - DNA, 14 bp, Homo sapiens
ttcttcttttactt

SEQ ID NO: 5811853 - DNA, 13 bp, Homo sapiens
ttcttgaaaaaga

SEQ ID NO: 5811854 - DNA, 16 bp, Homo sapiens
ttcttgaaagaagaat

SEQ ID NO: 5811855 - DNA, 14 bp, Homo sapiens
ttcttgaaagctgt

SEQ ID NO: 5811856 - DNA, 22 bp, Homo sapiens
ttcttgaaaggtccaaatgttt

SEQ ID NO: 5811857 - DNA, 20 bp, Homo sapiens
ttcttgaatcctctattaat

SEQ ID NO: 5811858 - DNA, 14 bp, Homo sapiens
ttcttgaattgtta

SEQ ID NO: 5811859 - DNA, 21 bp, Homo sapiens
ttcttgaatttaataatctgt

SEQ ID NO: 5811860 - DNA, 13 bp, Homo sapiens
ttcttgaattttt

SEQ ID NO: 5811861 - DNA, 21 bp, Homo sapiens
ttcttgaatttttttctgcac

SEQ ID NO: 5811862 - DNA, 19 bp, Homo sapiens
ttcttgacaagctgacttg

SEQ ID NO: 5811863 - DNA, 23 bp, Homo sapiens
ttcttgacaagctgacttggcac

SEQ ID NO: 5811864 - DNA, 18 bp, Homo sapiens
ttcttgagaagtaactgt

SEQ ID NO: 5811865 - DNA, 19 bp, Homo sapiens
ttcttgagaagtaactgtc

SEQ ID NO: 5811866 - DNA, 17 bp, Homo sapiens
ttcttgagatctgctga

SEQ ID NO: 5811867 - DNA, 15 bp, Homo sapiens
ttcttgagattttgt

SEQ ID NO: 5811868 - DNA, 21 bp, Homo sapiens
ttcttgagtcaaaaaacatga

SEQ ID NO: 5811869 - DNA, 23 bp, Homo sapiens
ttcttgagtttacatcaataata

SEQ ID NO: 5811870 - DNA, 17 bp, Homo sapiens
ttcttgatctctaatga

SEQ ID NO: 5811871 - DNA, 13 bp, Homo sapiens
ttcttgatcttaa

SEQ ID NO: 5811872 - DNA, 22 bp, Homo sapiens
ttcttgatgactggaattttta

SEQ ID NO: 5811873 - DNA, 15 bp, Homo sapiens
ttcttgatgtaaaat

SEQ ID NO: 5811874 - DNA, 15 bp, Homo sapiens
ttcttgatgtcatgt

SEQ ID NO: 5811875 - DNA, 18 bp, Homo sapiens
ttcttgattaaagtgatt

SEQ ID NO: 5811876 - DNA, 12 bp, Homo sapiens
ttcttgcaaagt

SEQ ID NO: 5811877 - DNA, 13 bp, Homo sapiens
ttcttgcaaagta

SEQ ID NO: 5811878 - DNA, 21 bp, Homo sapiens
ttcttgcaagcaacaagctat

SEQ ID NO: 5811879 - DNA, 15 bp, Homo sapiens
ttcttgcaagcatgc

SEQ ID NO: 5811880 - DNA, 18 bp, Homo sapiens
ttcttgcaagctccagta

SEQ ID NO: 5811881 - DNA, 12 bp, Homo sapiens
ttcttgcaataa

SEQ ID NO: 5811882 - DNA, 14 bp, Homo sapiens
ttcttgcaataaga

SEQ ID NO: 5811883 - DNA, 14 bp, Homo sapiens
ttcttgcaatttga

SEQ ID NO: 5811884 - DNA, 14 bp, Homo sapiens
ttcttgcactgaat

SEQ ID NO: 5811885 - DNA, 18 bp, Homo sapiens
ttcttgcagtcatcagaa

SEQ ID NO: 5811886 - DNA, 18 bp, Homo sapiens
ttcttgccaccctctggg

SEQ ID NO: 5811887 - DNA, 16 bp, Homo sapiens
ttcttgccagctcagc

SEQ ID NO: 5811888 - DNA, 23 bp, Homo sapiens
ttcttgccagttagactgggcct

SEQ ID NO: 5811889 - DNA, 20 bp, Homo sapiens
ttcttgccatcactggtcca

SEQ ID NO: 5811890 - DNA, 14 bp, Homo sapiens
ttcttgccccttgg

SEQ ID NO: 5811891 - DNA, 15 bp, Homo sapiens
ttcttgccccttggg

SEQ ID NO: 5811892 - DNA, 21 bp, Homo sapiens
ttcttgcctactatgccagat

SEQ ID NO: 5811893 - DNA, 18 bp, Homo sapiens
ttcttgcctctgtcccct

SEQ ID NO: 5811894 - DNA, 17 bp, Homo sapiens
ttcttgcctgctgggct

SEQ ID NO: 5811895 - DNA, 17 bp, Homo sapiens
ttcttgctagtattcgc

SEQ ID NO: 5811896 - DNA, 22 bp, Homo sapiens
ttcttgctcccttcagccccca

SEQ ID NO: 5811897 - DNA, 20 bp, Homo sapiens
ttcttgctctatctctcaaa

SEQ ID NO: 5811898 - DNA, 14 bp, Homo sapiens
ttcttgctctgctc

SEQ ID NO: 5811899 - DNA, 19 bp, Homo sapiens
ttcttgctgccatgatgta

SEQ ID NO: 5811900 - DNA, 15 bp, Homo sapiens
ttcttgctgccctgc

SEQ ID NO: 5811901 - DNA, 13 bp, Homo sapiens
ttcttgctgctag

SEQ ID NO: 5811902 - DNA, 14 bp, Homo sapiens
ttcttgctgctaga

SEQ ID NO: 5811903 - DNA, 23 bp, Homo sapiens
ttcttgctggttgtcatttttgc

SEQ ID NO: 5811904 - DNA, 14 bp, Homo sapiens
ttcttgctgttcag

SEQ ID NO: 5811905 - DNA, 20 bp, Homo sapiens
ttcttgctgttcagtgcttt

SEQ ID NO: 5811906 - DNA, 20 bp, Homo sapiens
ttcttgcttaccttgactgt

SEQ ID NO: 5811907 - DNA, 17 bp, Homo sapiens
ttcttgcttcagtcatc

SEQ ID NO: 5811908 - DNA, 12 bp, Homo sapiens
ttcttgcttgta

SEQ ID NO: 5811909 - DNA, 12 bp, Homo sapiens
ttcttgctttca

SEQ ID NO: 5811910 - DNA, 14 bp, Homo sapiens
ttcttgctttcaca

SEQ ID NO: 5811911 - DNA, 18 bp, Homo sapiens
ttcttgctttctctctca

SEQ ID NO: 5811912 - DNA, 23 bp, Homo sapiens
ttcttgctttctctctcatgcct

SEQ ID NO: 5811913 - DNA, 18 bp, Homo sapiens
ttcttgctttggggaaaa

SEQ ID NO: 5811914 - DNA, 20 bp, Homo sapiens
ttcttggaaaaaaattacaa

SEQ ID NO: 5811915 - DNA, 22 bp, Homo sapiens
ttcttggaattttgtaaaaaga

SEQ ID NO: 5811916 - DNA, 20 bp, Homo sapiens
ttcttggaccagtttgcaga

SEQ ID NO: 5811917 - DNA, 15 bp, Homo sapiens
ttcttggacccctga

SEQ ID NO: 5811918 - DNA, 18 bp, Homo sapiens
ttcttggagctttggaat

SEQ ID NO: 5811919 - DNA, 20 bp, Homo sapiens
ttcttggagtgccaagtttg

SEQ ID NO: 5811920 - DNA, 19 bp, Homo sapiens
ttcttggcaaaagccttgt

SEQ ID NO: 5811921 - DNA, 20 bp, Homo sapiens
ttcttggcaaaagccttgtg

SEQ ID NO: 5811922 - DNA, 18 bp, Homo sapiens
ttcttggcccagcactgc

SEQ ID NO: 5811923 - DNA, 22 bp, Homo sapiens
ttcttggcctgctagcggctga

SEQ ID NO: 5811924 - DNA, 17 bp, Homo sapiens
ttcttggcgttcctgcc

SEQ ID NO: 5811925 - DNA, 14 bp, Homo sapiens
ttcttggcttcctg

SEQ ID NO: 5811926 - DNA, 15 bp, Homo sapiens
ttcttggcttctggg

SEQ ID NO: 5811927 - DNA, 19 bp, Homo sapiens
ttcttggcttctgggacct

SEQ ID NO: 5811928 - DNA, 22 bp, Homo sapiens
ttcttgggaaaatatcactttg

SEQ ID NO: 5811929 - DNA, 17 bp, Homo sapiens
ttcttgggaattgaaaa

SEQ ID NO: 5811930 - DNA, 20 bp, Homo sapiens
ttcttgggagtatgttgtca

SEQ ID NO: 5811931 - DNA, 21 bp, Homo sapiens
ttcttgggagtatgttgtcat

SEQ ID NO: 5811932 - DNA, 22 bp, Homo sapiens
ttcttgggagtatgttgtcata

SEQ ID NO: 5811933 - DNA, 23 bp, Homo sapiens
ttcttgggcccggtccacaggtc

SEQ ID NO: 5811934 - DNA, 22 bp, Homo sapiens
ttcttgggcctcaggctctgca

SEQ ID NO: 5811935 - DNA, 23 bp, Homo sapiens
ttcttgggcctcaggctctgcac

SEQ ID NO: 5811936 - DNA, 17 bp, Homo sapiens
ttgaaaatgtttatgcc

SEQ ID NO: 5811937 - DNA, 21 bp, Homo sapiens
ttgaaaattcaaaaagtgttt

SEQ ID NO: 5811938 - DNA, 23 bp, Homo sapiens
ttgaaaattgtataccaatgtgt

SEQ ID NO: 5811939 - DNA, 14 bp, Homo sapiens
ttgaaaattttact

SEQ ID NO: 5811940 - DNA, 18 bp, Homo sapiens
ttgaaacacacagtgacc

SEQ ID NO: 5811941 - DNA, 19 bp, Homo sapiens
ttgaaacacttttttgggg

SEQ ID NO: 5811942 - DNA, 13 bp, Homo sapiens
ttgaaacagaaaa

SEQ ID NO: 5811943 - DNA, 14 bp, Homo sapiens
ttgaaacagcagtc

SEQ ID NO: 5811944 - DNA, 11 bp, Homo sapiens
ttgaaacattg

SEQ ID NO: 5811945 - DNA, 14 bp, Homo sapiens
ttgaaacattgctt

SEQ ID NO: 5811946 - DNA, 19 bp, Homo sapiens
ttgaaacattgcttttaaa

SEQ ID NO: 5811947 - DNA, 20 bp, Homo sapiens
ttgaaaccaagttgaaaaat

SEQ ID NO: 5811948 - DNA, 14 bp, Homo sapiens
ttgaaacctgctct

SEQ ID NO: 5811949 - DNA, 18 bp, Homo sapiens
ttgaaacctttctacttt

SEQ ID NO: 5811950 - DNA, 23 bp, Homo sapiens
ttgaaactagaaatctgtcctgt

SEQ ID NO: 5811951 - DNA, 14 bp, Homo sapiens
ttgaaactgcttga

SEQ ID NO: 5811952 - DNA, 13 bp, Homo sapiens
ttgaaactgtatt

SEQ ID NO: 5811953 - DNA, 14 bp, Homo sapiens
ttgaaactgtattt

SEQ ID NO: 5811954 - DNA, 17 bp, Homo sapiens
ttgaaactgtatttact

SEQ ID NO: 5811955 - DNA, 20 bp, Homo sapiens
ttgaaacttggttcccagaa

SEQ ID NO: 5811956 - DNA, 15 bp, Homo sapiens
ttgaaagaaaatatg

SEQ ID NO: 5811957 - DNA, 12 bp, Homo sapiens
ttgaaagaaagt

SEQ ID NO: 5811958 - DNA, 18 bp, Homo sapiens
ttgaaagaacttaagtct

SEQ ID NO: 5811959 - DNA, 15 bp, Homo sapiens
ttgaaagaagcaaga

SEQ ID NO: 5811960 - DNA, 19 bp, Homo sapiens
ttgaaagaagtcaaatgaa

SEQ ID NO: 5811961 - DNA, 14 bp, Homo sapiens
ttgaaagaatagaa

SEQ ID NO: 5811962 - DNA, 16 bp, Homo sapiens
ttgaaagaatgtaaag

SEQ ID NO: 5811963 - DNA, 21 bp, Homo sapiens
ttgaaagaattctattttgct

SEQ ID NO: 5811964 - DNA, 13 bp, Homo sapiens
ttgaaagacatca

SEQ ID NO: 5811965 - DNA, 15 bp, Homo sapiens
ttgaaagacatcaat

SEQ ID NO: 5811966 - DNA, 16 bp, Homo sapiens
ttgaaagacatcaatg

SEQ ID NO: 5811967 - DNA, 19 bp, Homo sapiens
ttgaaagagttaagaatgt

SEQ ID NO: 5811968 - DNA, 19 bp, Homo sapiens
ttgaaagatggtaatcttt

SEQ ID NO: 5811969 - DNA, 12 bp, Homo sapiens
ttgaaagatgta

SEQ ID NO: 5811970 - DNA, 14 bp, Homo sapiens
ttgaaagcaaaaat

SEQ ID NO: 5811971 - DNA, 18 bp, Homo sapiens
ttgaaagcaaaaatgcta

SEQ ID NO: 5811972 - DNA, 19 bp, Homo sapiens
ttgaaagccaacaactctg

SEQ ID NO: 5811973 - DNA, 23 bp, Homo sapiens
ttgaaagccaacaactctgcctt

SEQ ID NO: 5811974 - DNA, 17 bp, Homo sapiens
ttgaaagccaagtgttt

SEQ ID NO: 5811975 - DNA, 17 bp, Homo sapiens
ttgaaagcgaaatactt

SEQ ID NO: 5811976 - DNA, 18 bp, Homo sapiens
ttgaaagggacaagtatc

SEQ ID NO: 5811977 - DNA, 21 bp, Homo sapiens
ttgaaaggtatatgactgagc

SEQ ID NO: 5811978 - DNA, 17 bp, Homo sapiens
ttgaaaggtcagaattt

SEQ ID NO: 5811979 - DNA, 13 bp, Homo sapiens
ttgaaagtattca

SEQ ID NO: 5811980 - DNA, 17 bp, Homo sapiens
ttgaaagtattcagaaa

SEQ ID NO: 5811981 - DNA, 21 bp, Homo sapiens
ttgaaagtattcagaaattaa

SEQ ID NO: 5811982 - DNA, 11 bp, Homo sapiens
ttgaaagtgtt

SEQ ID NO: 5811983 - DNA, 21 bp, Homo sapiens
ttgaaagttagagattttaca

SEQ ID NO: 5811984 - DNA, 15 bp, Homo sapiens
ttgaaagttgctttt

SEQ ID NO: 5811985 - DNA, 21 bp, Homo sapiens
ttgaaagttgtacatgataag

SEQ ID NO: 5811986 - DNA, 16 bp, Homo sapiens
ttgaaagtttacagga

SEQ ID NO: 5811987 - DNA, 16 bp, Homo sapiens
ttgaaagtttccttat

SEQ ID NO: 5811988 - DNA, 15 bp, Homo sapiens
ttgaaataaaaatgg

SEQ ID NO: 5811989 - DNA, 15 bp, Homo sapiens
ttgaaataaaataac

SEQ ID NO: 5811990 - DNA, 14 bp, Homo sapiens
ttgaaataaagcta

SEQ ID NO: 5811991 - DNA, 17 bp, Homo sapiens
ttgaaataacagcctta

SEQ ID NO: 5811992 - DNA, 18 bp, Homo sapiens
ttgaaataagttgtttca

SEQ ID NO: 5811993 - DNA, 16 bp, Homo sapiens
ttgaaataattttcaa

SEQ ID NO: 5811994 - DNA, 22 bp, Homo sapiens
ttgaaatacctcatgtttatga

SEQ ID NO: 5811995 - DNA, 20 bp, Homo sapiens
ttgaaatacctttgtagtta

SEQ ID NO: 5811996 - DNA, 22 bp, Homo sapiens
ttgaaatacgtttgtgtttcta

SEQ ID NO: 5811997 - DNA, 14 bp, Homo sapiens
ttgaaatacttgaa

SEQ ID NO: 5811998 - DNA, 16 bp, Homo sapiens
ttgaaatataatgcaa

SEQ ID NO: 5811999 - DNA, 19 bp, Homo sapiens
ttgaaatataatgcaaacc

SEQ ID NO: 5812000 - DNA, 11 bp, Homo sapiens
ttgaaatatag

SEQ ID NO: 5812001 - DNA, 13 bp, Homo sapiens
ttgaaatatagtt

SEQ ID NO: 5812002 - DNA, 15 bp, Homo sapiens
ttgaaatatagttga

SEQ ID NO: 5812003 - DNA, 18 bp, Homo sapiens
ttgaaatatataatattc

SEQ ID NO: 5812004 - DNA, 20 bp, Homo sapiens
ttgaaatatatggtctaatg

SEQ ID NO: 5812005 - DNA, 22 bp, Homo sapiens
ttgaaatatatggtctaatgtt

SEQ ID NO: 5812006 - DNA, 18 bp, Homo sapiens
ttgaaatatcctgcttga

SEQ ID NO: 5812007 - DNA, 16 bp, Homo sapiens
ttgaaatatgcatact

SEQ ID NO: 5812008 - DNA, 18 bp, Homo sapiens
ttgaaatatgcatgtact

SEQ ID NO: 5812009 - DNA, 14 bp, Homo sapiens
ttgaaatcaaatgt

SEQ ID NO: 5812010 - DNA, 21 bp, Homo sapiens
ttgaaatcagaagcctacttt

SEQ ID NO: 5812011 - DNA, 14 bp, Homo sapiens
ttgaaatccaggaa

SEQ ID NO: 5812012 - DNA, 13 bp, Homo sapiens
ttgaaatcttaaa

SEQ ID NO: 5812013 - DNA, 14 bp, Homo sapiens
ttgaaatgaaaggg

SEQ ID NO: 5812014 - DNA, 21 bp, Homo sapiens
ttgaaatgaaagtataactga

SEQ ID NO: 5812015 - DNA, 23 bp, Homo sapiens
ttgaaatgaactttgtcagtgtt

SEQ ID NO: 5812016 - DNA, 21 bp, Homo sapiens
ttgaaatgacatgttccttta

SEQ ID NO: 5812017 - DNA, 19 bp, Homo sapiens
ttgaaatgaggtctgttta

SEQ ID NO: 5812018 - DNA, 20 bp, Homo sapiens
ttgaaatgaggtctgtttaa

SEQ ID NO: 5812019 - DNA, 21 bp, Homo sapiens
ttgaaatgagtaaaaactaga

SEQ ID NO: 5812020 - DNA, 23 bp, Homo sapiens
ttgaaatgattcatctttcagaa

SEQ ID NO: 5812021 - DNA, 18 bp, Homo sapiens
ttgaaatgctaaacttgg

SEQ ID NO: 5812022 - DNA, 20 bp, Homo sapiens
ttgaaatgctcttttgcaca

SEQ ID NO: 5812023 - DNA, 13 bp, Homo sapiens
ttgaaatgctgaa

SEQ ID NO: 5812024 - DNA, 17 bp, Homo sapiens
ttgaaatgctgaaaatt

SEQ ID NO: 5812025 - DNA, 16 bp, Homo sapiens
ttgaaatgtaatttca

SEQ ID NO: 5812026 - DNA, 19 bp, Homo sapiens
ttgaaatgtaatttcagtt

SEQ ID NO: 5812027 - DNA, 11 bp, Homo sapiens
ttgaaatgtac

SEQ ID NO: 5812028 - DNA, 16 bp, Homo sapiens
ttgaaatgttctgtca

SEQ ID NO: 5812029 - DNA, 22 bp, Homo sapiens
ttgaaatgtttaataaagcttt

SEQ ID NO: 5812030 - DNA, 11 bp, Homo sapiens
ttgaaattaaa

SEQ ID NO: 5812031 - DNA, 20 bp, Homo sapiens
ttgaaattaaaattgccaga

SEQ ID NO: 5812032 - DNA, 11 bp, Homo sapiens
ttgaaattata

SEQ ID NO: 5812033 - DNA, 19 bp, Homo sapiens
ttgaaattatgtatgttta

SEQ ID NO: 5812034 - DNA, 20 bp, Homo sapiens
ttgaaattatgtgacatttt

SEQ ID NO: 5812035 - DNA, 14 bp, Homo sapiens
ttgaaattctattt

SEQ ID NO: 5812036 - DNA, 15 bp, Homo sapiens
ttgaaattctgaatt

SEQ ID NO: 5812037 - DNA, 18 bp, Homo sapiens
ttgaaattgaacctttgt

SEQ ID NO: 5812038 - DNA, 13 bp, Homo sapiens
ttgaaattgtaat

SEQ ID NO: 5812039 - DNA, 13 bp, Homo sapiens
ttgaaatttacac

SEQ ID NO: 5812040 - DNA, 15 bp, Homo sapiens
ttgaaatttacacag

SEQ ID NO: 5812041 - DNA, 17 bp, Homo sapiens
ttgaaatttacacagtg

SEQ ID NO: 5812042 - DNA, 18 bp, Homo sapiens
ttgaaatttacacagtga

SEQ ID NO: 5812043 - DNA, 16 bp, Homo sapiens
ttgaaatttactgtga

SEQ ID NO: 5812044 - DNA, 15 bp, Homo sapiens
ttgaaatttctcagc

SEQ ID NO: 5812045 - DNA, 12 bp, Homo sapiens
ttgaaattttaa

SEQ ID NO: 5812046 - DNA, 22 bp, Homo sapiens
ttgaaattttccattacatgat

SEQ ID NO: 5812047 - DNA, 18 bp, Homo sapiens
ttgaaattttgcaaatat

SEQ ID NO: 5812048 - DNA, 22 bp, Homo sapiens
ttgaaattttgcaaatataaac

SEQ ID NO: 5812049 - DNA, 17 bp, Homo sapiens
ttgaacaaaatctgttg

SEQ ID NO: 5812050 - DNA, 13 bp, Homo sapiens
ttgaacaaagaca

SEQ ID NO: 5812051 - DNA, 15 bp, Homo sapiens
ttgaacaaattttct

SEQ ID NO: 5812052 - DNA, 23 bp, Homo sapiens
ttgaacaatgaagttgaaaatca

SEQ ID NO: 5812053 - DNA, 14 bp, Homo sapiens
ttgaacacaaactg

SEQ ID NO: 5812054 - DNA, 20 bp, Homo sapiens
ttgaacacaaactgtaaata

SEQ ID NO: 5812055 - DNA, 14 bp, Homo sapiens
ttgaacacagtatt

SEQ ID NO: 5812056 - DNA, 20 bp, Homo sapiens
ttgaacacagtattttccca

SEQ ID NO: 5812057 - DNA, 20 bp, Homo sapiens
ttgaacactagtctgtgtaa

SEQ ID NO: 5812058 - DNA, 23 bp, Homo sapiens
ttgaacactagtctgtgtaactt

SEQ ID NO: 5812059 - DNA, 20 bp, Homo sapiens
ttgaacacttggtgctggga

SEQ ID NO: 5812060 - DNA, 21 bp, Homo sapiens
ttgaacagactagaagtattt

SEQ ID NO: 5812061 - DNA, 16 bp, Homo sapiens
ttgaacagctatcacg

SEQ ID NO: 5812062 - DNA, 14 bp, Homo sapiens
ttgaacagctgtga

SEQ ID NO: 5812063 - DNA, 24 bp, Homo sapiens
ttgaacagctgtgagccatgcctc

SEQ ID NO: 5812064 - DNA, 22 bp, Homo sapiens
ttgaacagttggctgtatgact

SEQ ID NO: 5812065 - DNA, 19 bp, Homo sapiens
ttgaacattaatgttgaaa

SEQ ID NO: 5812066 - DNA, 15 bp, Homo sapiens
ttgaacattcattca

SEQ ID NO: 5812067 - DNA, 15 bp, Homo sapiens
ttgaaccaaaacatt

SEQ ID NO: 5812068 - DNA, 16 bp, Homo sapiens
ttgaaccaacatcttt

SEQ ID NO: 5812069 - DNA, 17 bp, Homo sapiens
ttgaaccaggccttctg

SEQ ID NO: 5812070 - DNA, 14 bp, Homo sapiens
ttgaaccataaaat

SEQ ID NO: 5812071 - DNA, 16 bp, Homo sapiens
ttgaaccataaaatgt

SEQ ID NO: 5812072 - DNA, 15 bp, Homo sapiens
ttgaaccatccactt

SEQ ID NO: 5812073 - DNA, 16 bp, Homo sapiens
ttgaaccatccactta

SEQ ID NO: 5812074 - DNA, 21 bp, Homo sapiens
ttgaaccatccacttacatat

SEQ ID NO: 5812075 - DNA, 17 bp, Homo sapiens
ttgaaccattatacttt

SEQ ID NO: 5812076 - DNA, 16 bp, Homo sapiens
ttgaacccaaattgag

SEQ ID NO: 5812077 - DNA, 12 bp, Homo sapiens
ttgaacccagga

SEQ ID NO: 5812078 - DNA, 13 bp, Homo sapiens
ttgaacccaggag

SEQ ID NO: 5812079 - DNA, 22 bp, Homo sapiens
ttgaacccaggagagtggaaga

SEQ ID NO: 5812080 - DNA, 16 bp, Homo sapiens
ttgaaccccaaatgct

SEQ ID NO: 5812081 - DNA, 23 bp, Homo sapiens
ttgaaccccaaatgctctctctt

SEQ ID NO: 5812082 - DNA, 19 bp, Homo sapiens
ttgaacccgggaggcagag

SEQ ID NO: 5812083 - DNA, 19 bp, Homo sapiens
ttgaacctgatgagcaaga

SEQ ID NO: 5812084 - DNA, 17 bp, Homo sapiens
ttgaacctgcttcctgg

SEQ ID NO: 5812085 - DNA, 13 bp, Homo sapiens
ttgaacctgggag

SEQ ID NO: 5812086 - DNA, 18 bp, Homo sapiens
ttgaacctgggaggcaga

SEQ ID NO: 5812087 - DNA, 23 bp, Homo sapiens
ttgaacctggggttttgacttgc

SEQ ID NO: 5812088 - DNA, 18 bp, Homo sapiens
ttgaacgtgccagcagcc

SEQ ID NO: 5812089 - DNA, 20 bp, Homo sapiens
ttgaacgttttctaattgct

SEQ ID NO: 5812090 - DNA, 14 bp, Homo sapiens
ttgaactaagaaac

SEQ ID NO: 5812091 - DNA, 18 bp, Homo sapiens
ttgaactaagaaactttt

SEQ ID NO: 5812092 - DNA, 18 bp, Homo sapiens
ttgaactatgaacactgt

SEQ ID NO: 5812093 - DNA, 14 bp, Homo sapiens
ttgaactctgggct

SEQ ID NO: 5812094 - DNA, 23 bp, Homo sapiens
ttgaactctgttcccccaccctc

SEQ ID NO: 5812095 - DNA, 21 bp, Homo sapiens
ttgaactcttctcattacttg

SEQ ID NO: 5812096 - DNA, 22 bp, Homo sapiens
ttgaactgagccaaacacactg

SEQ ID NO: 5812097 - DNA, 13 bp, Homo sapiens
ttgaactgagccg

SEQ ID NO: 5812098 - DNA, 16 bp, Homo sapiens
ttgaactgaggccctg

SEQ ID NO: 5812099 - DNA, 15 bp, Homo sapiens
ttgaactgatagtta

SEQ ID NO: 5812100 - DNA, 19 bp, Homo sapiens
ttgaactgatagttactgt

SEQ ID NO: 5812101 - DNA, 22 bp, Homo sapiens
ttgaactgatagttactgttgt

SEQ ID NO: 5812102 - DNA, 13 bp, Homo sapiens
ttgaactgattca

SEQ ID NO: 5812103 - DNA, 15 bp, Homo sapiens
ttgaactgccaagaa

SEQ ID NO: 5812104 - DNA, 20 bp, Homo sapiens
ttgaactggcaattgtctat

SEQ ID NO: 5812105 - DNA, 16 bp, Homo sapiens
ttgaactgtggccacc

SEQ ID NO: 5812106 - DNA, 14 bp, Homo sapiens
ttgaactgttagaa

SEQ ID NO: 5812107 - DNA, 14 bp, Homo sapiens
ttgaacttagatgt

SEQ ID NO: 5812108 - DNA, 21 bp, Homo sapiens
ttgaacttagatgttaaatgt

SEQ ID NO: 5812109 - DNA, 22 bp, Homo sapiens
ttgaacttagatgttaaatgtt

SEQ ID NO: 5812110 - DNA, 16 bp, Homo sapiens
ttgaacttcacctgca

SEQ ID NO: 5812111 - DNA, 13 bp, Homo sapiens
ttgaacttcttta

SEQ ID NO: 5812112 - DNA, 15 bp, Homo sapiens
ttgaactttccaaaa

SEQ ID NO: 5812113 - DNA, 15 bp, Homo sapiens
ttgaactttgacctc

SEQ ID NO: 5812114 - DNA, 18 bp, Homo sapiens
ttgaactttgacctctgc

SEQ ID NO: 5812115 - DNA, 12 bp, Homo sapiens
ttgagacagagt

SEQ ID NO: 5812116 - DNA, 10 bp, Homo sapiens
ttgagacagg

SEQ ID NO: 5812117 - DNA, 13 bp, Homo sapiens
ttgagacagtttc

SEQ ID NO: 5812118 - DNA, 16 bp, Homo sapiens
ttgagaccaaaattta

SEQ ID NO: 5812119 - DNA, 20 bp, Homo sapiens
ttgagaccaacttttcaatg

SEQ ID NO: 5812120 - DNA, 23 bp, Homo sapiens
ttgagaccaagccggtgcccacc

SEQ ID NO: 5812121 - DNA, 21 bp, Homo sapiens
ttgagaccagcccgaccaaca

SEQ ID NO: 5812122 - DNA, 13 bp, Homo sapiens
ttgagaccagcct

SEQ ID NO: 5812123 - DNA, 15 bp, Homo sapiens
ttgagaccagcctgc

SEQ ID NO: 5812124 - DNA, 16 bp, Homo sapiens
ttgagaccagcctgcc

SEQ ID NO: 5812125 - DNA, 17 bp, Homo sapiens
ttgagaccagcctgcca

SEQ ID NO: 5812126 - DNA, 16 bp, Homo sapiens
ttgagaccagcctggg

SEQ ID NO: 5812127 - DNA, 18 bp, Homo sapiens
ttgagacccccaagcttc

SEQ ID NO: 5812128 - DNA, 16 bp, Homo sapiens
ttgagaccgtgaagat

SEQ ID NO: 5812129 - DNA, 21 bp, Homo sapiens
ttgagaccgtgaagatacttt

SEQ ID NO: 5812130 - DNA, 22 bp, Homo sapiens
ttgagaccgtgaagatactttg

SEQ ID NO: 5812131 - DNA, 18 bp, Homo sapiens
ttgagacctacaggctga

SEQ ID NO: 5812132 - DNA, 15 bp, Homo sapiens
ttgagacctcagcca

SEQ ID NO: 5812133 - DNA, 23 bp, Homo sapiens
ttgagacctcagcttggcactca

SEQ ID NO: 5812134 - DNA, 21 bp, Homo sapiens
ttgagacgcaccatgtgggca

SEQ ID NO: 5812135 - DNA, 22 bp, Homo sapiens
ttgagacggcgcacctatcacc

SEQ ID NO: 5812136 - DNA, 23 bp, Homo sapiens
ttgagacggtgtctcgctgcatc

SEQ ID NO: 5812137 - DNA, 14 bp, Homo sapiens
ttgagactagtttt

SEQ ID NO: 5812138 - DNA, 23 bp, Homo sapiens
ttgagactatttaaacttataaa

SEQ ID NO: 5812139 - DNA, 19 bp, Homo sapiens
ttgagactgaaagaaacta

SEQ ID NO: 5812140 - DNA, 22 bp, Homo sapiens
ttgagactgaaagaaactaaga

SEQ ID NO: 5812141 - DNA, 13 bp, Homo sapiens
ttgagactgctag

SEQ ID NO: 5812142 - DNA, 12 bp, Homo sapiens
ttgagacttttt

SEQ ID NO: 5812143 - DNA, 19 bp, Homo sapiens
ttgagagaaaagaaaaata

SEQ ID NO: 5812144 - DNA, 17 bp, Homo sapiens
ttgagagaagagacaaa

SEQ ID NO: 5812145 - DNA, 18 bp, Homo sapiens
ttgagagaagccacgctg

SEQ ID NO: 5812146 - DNA, 19 bp, Homo sapiens
ttgagagactgccatacat

SEQ ID NO: 5812147 - DNA, 19 bp, Homo sapiens
ttgagagagagaacctttc

SEQ ID NO: 5812148 - DNA, 13 bp, Homo sapiens
ttgagagagatgt

SEQ ID NO: 5812149 - DNA, 14 bp, Homo sapiens
ttgagagagatgtg

SEQ ID NO: 5812150 - DNA, 18 bp, Homo sapiens
ttgagagagatgtgtaat

SEQ ID NO: 5812151 - DNA, 16 bp, Homo sapiens
ttgagagagcagccag

SEQ ID NO: 5812152 - DNA, 15 bp, Homo sapiens
ttgagagcagcctct

SEQ ID NO: 5812153 - DNA, 18 bp, Homo sapiens
ttgagagcgctggcctct

SEQ ID NO: 5812154 - DNA, 12 bp, Homo sapiens
ttgagagctgct

SEQ ID NO: 5812155 - DNA, 16 bp, Homo sapiens
ttgagagcttggcctt

SEQ ID NO: 5812156 - DNA, 16 bp, Homo sapiens
ttgagaggaacaagaa

SEQ ID NO: 5812157 - DNA, 18 bp, Homo sapiens
ttgagaggcatgacagct

SEQ ID NO: 5812158 - DNA, 19 bp, Homo sapiens
ttgagaggccctggggttc

SEQ ID NO: 5812159 - DNA, 23 bp, Homo sapiens
ttgagagtgggggagaatggcat

SEQ ID NO: 5812160 - DNA, 15 bp, Homo sapiens
ttgagataaagtcaa

SEQ ID NO: 5812161 - DNA, 16 bp, Homo sapiens
ttgagataaagtcaaa

SEQ ID NO: 5812162 - DNA, 16 bp, Homo sapiens
ttgagataaggtttta

SEQ ID NO: 5812163 - DNA, 20 bp, Homo sapiens
ttgagataagttttgtttca

SEQ ID NO: 5812164 - DNA, 21 bp, Homo sapiens
ttgagataagttttgtttcaa

SEQ ID NO: 5812165 - DNA, 14 bp, Homo sapiens
ttgagataatgtca

SEQ ID NO: 5812166 - DNA, 19 bp, Homo sapiens
ttgagatactattttcatt

SEQ ID NO: 5812167 - DNA, 20 bp, Homo sapiens
ttgagatactattttcattt

SEQ ID NO: 5812168 - DNA, 12 bp, Homo sapiens
ttgagatccagt

SEQ ID NO: 5812169 - DNA, 16 bp, Homo sapiens
ttgagatcctgatagc

SEQ ID NO: 5812170 - DNA, 21 bp, Homo sapiens
ttgagatgcccccccaggcca

SEQ ID NO: 5812171 - DNA, 11 bp, Homo sapiens
ttgagatggag

SEQ ID NO: 5812172 - DNA, 21 bp, Homo sapiens
ttgagatggagtcttgctctg

SEQ ID NO: 5812173 - DNA, 23 bp, Homo sapiens
ttgagatggagtttctctcttgt

SEQ ID NO: 5812174 - DNA, 17 bp, Homo sapiens
ttgagatgtatttcaac

SEQ ID NO: 5812175 - DNA, 18 bp, Homo sapiens
ttgagatgtgttcctcct

SEQ ID NO: 5812176 - DNA, 21 bp, Homo sapiens
ttgagattcaaacccaggctg

SEQ ID NO: 5812177 - DNA, 18 bp, Homo sapiens
ttgagattcaagacaaga

SEQ ID NO: 5812178 - DNA, 19 bp, Homo sapiens
ttgagattgccccaggtct

SEQ ID NO: 5812179 - DNA, 20 bp, Homo sapiens
ttgagattgccccaggtctg

SEQ ID NO: 5812180 - DNA, 20 bp, Homo sapiens
ttgagatttttaagaacttc

SEQ ID NO: 5812181 - DNA, 17 bp, Homo sapiens
ttgagattttttttccg

SEQ ID NO: 5812182 - DNA, 19 bp, Homo sapiens
ttgagatttttttttctct

SEQ ID NO: 5812183 - DNA, 13 bp, Homo sapiens
ttgagcaaacatt

SEQ ID NO: 5812184 - DNA, 14 bp, Homo sapiens
ttgagcaactaact

SEQ ID NO: 5812185 - DNA, 14 bp, Homo sapiens
ttgagcaatgtttt

SEQ ID NO: 5812186 - DNA, 16 bp, Homo sapiens
ttgagcaattcatttc

SEQ ID NO: 5812187 - DNA, 20 bp, Homo sapiens
ttgagcaattcatttcactt

SEQ ID NO: 5812188 - DNA, 19 bp, Homo sapiens
ttgagcacaggcaacatta

SEQ ID NO: 5812189 - DNA, 23 bp, Homo sapiens
ttgagcacaggcaacattacaaa

SEQ ID NO: 5812190 - DNA, 14 bp, Homo sapiens
ttgagcagaattca

SEQ ID NO: 5812191 - DNA, 23 bp, Homo sapiens
ttgagcagcaggtagcctgctgg

SEQ ID NO: 5812192 - DNA, 13 bp, Homo sapiens
ttgagcaggagca

SEQ ID NO: 5812193 - DNA, 18 bp, Homo sapiens
ttgagcaggagcagaaag

SEQ ID NO: 5812194 - DNA, 23 bp, Homo sapiens
ttgagcaggagcagaaagattaa

SEQ ID NO: 5812195 - DNA, 14 bp, Homo sapiens
ttgagcaggtatca

SEQ ID NO: 5812196 - DNA, 22 bp, Homo sapiens
ttgagcagtaaatgtatattga

SEQ ID NO: 5812197 - DNA, 21 bp, Homo sapiens
ttgagcagtggcctacaaatc

SEQ ID NO: 5812198 - DNA, 13 bp, Homo sapiens
ttgagcatatttt

SEQ ID NO: 5812199 - DNA, 19 bp, Homo sapiens
ttgagcatattttcttact

SEQ ID NO: 5812200 - DNA, 14 bp, Homo sapiens
ttgagcatcaatct

SEQ ID NO: 5812201 - DNA, 12 bp, Homo sapiens
ttgagcatctgg

SEQ ID NO: 5812202 - DNA, 15 bp, Homo sapiens
ttgagcatctgtccc

SEQ ID NO: 5812203 - DNA, 20 bp, Homo sapiens
ttgagcatgacagcctgcag

SEQ ID NO: 5812204 - DNA, 21 bp, Homo sapiens
ttgagcatgacagcctgcagc

SEQ ID NO: 5812205 - DNA, 20 bp, Homo sapiens
ttgagcatgcacagctgctt

SEQ ID NO: 5812206 - DNA, 15 bp, Homo sapiens
ttgagcatgcccaaa

SEQ ID NO: 5812207 - DNA, 22 bp, Homo sapiens
ttgagccaagcttcaaccctca

SEQ ID NO: 5812208 - DNA, 18 bp, Homo sapiens
ttgagccagcagacattg

SEQ ID NO: 5812209 - DNA, 19 bp, Homo sapiens
ttgagccagcagacattgt

SEQ ID NO: 5812210 - DNA, 20 bp, Homo sapiens
ttgagccagcagacattgtc

SEQ ID NO: 5812211 - DNA, 17 bp, Homo sapiens
ttgagccaggcctgggt

SEQ ID NO: 5812212 - DNA, 17 bp, Homo sapiens
ttgagccagtaatcttt

SEQ ID NO: 5812213 - DNA, 18 bp, Homo sapiens
ttgagccagtaatcttta

SEQ ID NO: 5812214 - DNA, 23 bp, Homo sapiens
ttgagccagtaatctttatactg

SEQ ID NO: 5812215 - DNA, 14 bp, Homo sapiens
ttgagccatttaaa

SEQ ID NO: 5812216 - DNA, 11 bp, Homo sapiens
ttgagcccagg

SEQ ID NO: 5812217 - DNA, 12 bp, Homo sapiens
ttgagcccagga

SEQ ID NO: 5812218 - DNA, 19 bp, Homo sapiens
ttgagcccattcttctggg

SEQ ID NO: 5812219 - DNA, 18 bp, Homo sapiens
ttgagccccaagtcctga

SEQ ID NO: 5812220 - DNA, 22 bp, Homo sapiens
ttgagccctccccaggaatttg

SEQ ID NO: 5812221 - DNA, 22 bp, Homo sapiens
ttgagccctcctggaatggagc

SEQ ID NO: 5812222 - DNA, 14 bp, Homo sapiens
ttgagccctggctg

SEQ ID NO: 5812223 - DNA, 18 bp, Homo sapiens
ttgagcccttgtttcagg

SEQ ID NO: 5812224 - DNA, 19 bp, Homo sapiens
ttgagccgggcccctgggc

SEQ ID NO: 5812225 - DNA, 14 bp, Homo sapiens
ttgagcctaaaaat

SEQ ID NO: 5812226 - DNA, 21 bp, Homo sapiens
ttgagcctaaaaataaagcac

SEQ ID NO: 5812227 - DNA, 17 bp, Homo sapiens
ttgagcctccatttctg

SEQ ID NO: 5812228 - DNA, 13 bp, Homo sapiens
ttgagcctgtcac

SEQ ID NO: 5812229 - DNA, 21 bp, Homo sapiens
ttgagccttattaaaatattt

SEQ ID NO: 5812230 - DNA, 15 bp, Homo sapiens
ttgagccttcaggcc

SEQ ID NO: 5812231 - DNA, 14 bp, Homo sapiens
ttgagccttgaact

SEQ ID NO: 5812232 - DNA, 22 bp, Homo sapiens
ttgagcgctatgggtgttaacg

SEQ ID NO: 5812233 - DNA, 17 bp, Homo sapiens
ttgagcgtattcttgaa

SEQ ID NO: 5812234 - DNA, 19 bp, Homo sapiens
ttgagctactggattctta

SEQ ID NO: 5812235 - DNA, 20 bp, Homo sapiens
ttgagctactggattcttat

SEQ ID NO: 5812236 - DNA, 11 bp, Homo sapiens
ttgagctatga

SEQ ID NO: 5812237 - DNA, 15 bp, Homo sapiens
ttgagctatgatatg

SEQ ID NO: 5812238 - DNA, 13 bp, Homo sapiens
ttgagctcagccc

SEQ ID NO: 5812239 - DNA, 19 bp, Homo sapiens
ttgagctcatgagggccca

SEQ ID NO: 5812240 - DNA, 19 bp, Homo sapiens
ttgagctcccctggagcca

SEQ ID NO: 5812241 - DNA, 18 bp, Homo sapiens
ttgagctctctcattgtc

SEQ ID NO: 5812242 - DNA, 19 bp, Homo sapiens
ttgagctctgcagcccagg

SEQ ID NO: 5812243 - DNA, 19 bp, Homo sapiens
ttgagctctgctctcagca

SEQ ID NO: 5812244 - DNA, 16 bp, Homo sapiens
ttgagctcttcattta

SEQ ID NO: 5812245 - DNA, 14 bp, Homo sapiens
ttgagctgaaatgc

SEQ ID NO: 5812246 - DNA, 16 bp, Homo sapiens
ttgagctgatataaat

SEQ ID NO: 5812247 - DNA, 12 bp, Homo sapiens
ttgagctgcctc

SEQ ID NO: 5812248 - DNA, 20 bp, Homo sapiens
ttgagctgcctgctctgcag

SEQ ID NO: 5812249 - DNA, 14 bp, Homo sapiens
ttgagctgccttcc

SEQ ID NO: 5812250 - DNA, 21 bp, Homo sapiens
ttgagctgctttttttgaaac

SEQ ID NO: 5812251 - DNA, 14 bp, Homo sapiens
ttgagctggtaaca

SEQ ID NO: 5812252 - DNA, 16 bp, Homo sapiens
ttgagctggttttctc

SEQ ID NO: 5812253 - DNA, 23 bp, Homo sapiens
ttgagctgtatatatatatgtgt

SEQ ID NO: 5812254 - DNA, 14 bp, Homo sapiens
ttgagctgtcatca

SEQ ID NO: 5812255 - DNA, 20 bp, Homo sapiens
ttgagctgttgtgagctttg

SEQ ID NO: 5812256 - DNA, 14 bp, Homo sapiens
ttgagcttctcctc

SEQ ID NO: 5812257 - DNA, 15 bp, Homo sapiens
ttgagcttgcttctt

SEQ ID NO: 5812258 - DNA, 21 bp, Homo sapiens
ttgagctttccatgttgctgc

SEQ ID NO: 5812259 - DNA, 16 bp, Homo sapiens
ttgagctttctgtgca

SEQ ID NO: 5812260 - DNA, 17 bp, Homo sapiens
ttgagctttctgtgcat

SEQ ID NO: 5812261 - DNA, 21 bp, Homo sapiens
ttgagctttctgtgcatgtgc

SEQ ID NO: 5812262 - DNA, 16 bp, Homo sapiens
ttgagctttgcattta

SEQ ID NO: 5812263 - DNA, 17 bp, Homo sapiens
ttgaggaaaaatatgtg

SEQ ID NO: 5812264 - DNA, 14 bp, Homo sapiens
ttgaggaaactcat

SEQ ID NO: 5812265 - DNA, 19 bp, Homo sapiens
ttgaggaagttttgtctaa

SEQ ID NO: 5812266 - DNA, 15 bp, Homo sapiens
ttgaggacaaagaga

SEQ ID NO: 5812267 - DNA, 17 bp, Homo sapiens
ttgaggaccctcccagg

SEQ ID NO: 5812268 - DNA, 15 bp, Homo sapiens
ttgaggacttcttgc

SEQ ID NO: 5812269 - DNA, 24 bp, Homo sapiens
ttgaggacttgttaaagagcactg

SEQ ID NO: 5812270 - DNA, 19 bp, Homo sapiens
ttgaggagacgaagtgaaa

SEQ ID NO: 5812271 - DNA, 16 bp, Homo sapiens
ttgaggagcactgaaa

SEQ ID NO: 5812272 - DNA, 19 bp, Homo sapiens
ttgaggagcagcttcagtt

SEQ ID NO: 5812273 - DNA, 15 bp, Homo sapiens
ttgaggagcatgttt

SEQ ID NO: 5812274 - DNA, 18 bp, Homo sapiens
ttgaggagcatgttttgt

SEQ ID NO: 5812275 - DNA, 23 bp, Homo sapiens
ttgaggagcatgttttgtataca

SEQ ID NO: 5812276 - DNA, 12 bp, Homo sapiens
ttgaggagcccc

SEQ ID NO: 5812277 - DNA, 16 bp, Homo sapiens
ttgaggagccccagct

SEQ ID NO: 5812278 - DNA, 12 bp, Homo sapiens
ttgaggaggaag

SEQ ID NO: 5812279 - DNA, 17 bp, Homo sapiens
ttgaggaggggcacctg

SEQ ID NO: 5812280 - DNA, 21 bp, Homo sapiens
ttgaggaggggcacctgccac

SEQ ID NO: 5812281 - DNA, 16 bp, Homo sapiens
ttgaggagtggttttt

SEQ ID NO: 5812282 - DNA, 22 bp, Homo sapiens
ttgaggatatattttcactttg

SEQ ID NO: 5812283 - DNA, 13 bp, Homo sapiens
ttgaggatctatt

SEQ ID NO: 5812284 - DNA, 19 bp, Homo sapiens
ttgaggatgggatgtattt

SEQ ID NO: 5812285 - DNA, 18 bp, Homo sapiens
ttgaggattagtttagaa

SEQ ID NO: 5812286 - DNA, 19 bp, Homo sapiens
ttgaggattagtttagaac

SEQ ID NO: 5812287 - DNA, 15 bp, Homo sapiens
ttgaggattgtggaa

SEQ ID NO: 5812288 - DNA, 18 bp, Homo sapiens
ttgaggcaaattaactgt

SEQ ID NO: 5812289 - DNA, 19 bp, Homo sapiens
ttgaggcaaattaactgta

SEQ ID NO: 5812290 - DNA, 14 bp, Homo sapiens
ttgaggcacaaatc

SEQ ID NO: 5812291 - DNA, 13 bp, Homo sapiens
ttgaggcagagtc

SEQ ID NO: 5812292 - DNA, 23 bp, Homo sapiens
ttgaggcagggtctcactctgtt

SEQ ID NO: 5812293 - DNA, 15 bp, Homo sapiens
ttgatataattactt

SEQ ID NO: 5812294 - DNA, 16 bp, Homo sapiens
ttgatatacattgtgt

SEQ ID NO: 5812295 - DNA, 19 bp, Homo sapiens
ttgatatacattgtgtgaa

SEQ ID NO: 5812296 - DNA, 22 bp, Homo sapiens
ttgatatagaacagtgcttgcc

SEQ ID NO: 5812297 - DNA, 16 bp, Homo sapiens
ttgatatatgtatctt

SEQ ID NO: 5812298 - DNA, 15 bp, Homo sapiens
ttgatatattctttc

SEQ ID NO: 5812299 - DNA, 16 bp, Homo sapiens
ttgatatattctttcc

SEQ ID NO: 5812300 - DNA, 17 bp, Homo sapiens
ttgatatattctttcca

SEQ ID NO: 5812301 - DNA, 21 bp, Homo sapiens
ttgatatatttcattctctta

SEQ ID NO: 5812302 - DNA, 17 bp, Homo sapiens
ttgatatctataaaata

SEQ ID NO: 5812303 - DNA, 21 bp, Homo sapiens
ttgatatctttcctccctctt

SEQ ID NO: 5812304 - DNA, 22 bp, Homo sapiens
ttgatatgaaaaatatgatatt

SEQ ID NO: 5812305 - DNA, 17 bp, Homo sapiens
ttgatatgattgtaaca

SEQ ID NO: 5812306 - DNA, 12 bp, Homo sapiens
ttgatatgtaac

SEQ ID NO: 5812307 - DNA, 17 bp, Homo sapiens
ttgatatgtaagtactt

SEQ ID NO: 5812308 - DNA, 16 bp, Homo sapiens
ttgatatgtgaacagt

SEQ ID NO: 5812309 - DNA, 21 bp, Homo sapiens
ttgatatgttttatttcattg

SEQ ID NO: 5812310 - DNA, 14 bp, Homo sapiens
ttgatattgtgaac

SEQ ID NO: 5812311 - DNA, 17 bp, Homo sapiens
ttgatattgtgaacatt

SEQ ID NO: 5812312 - DNA, 14 bp, Homo sapiens
ttgatatttccttc

SEQ ID NO: 5812313 - DNA, 15 bp, Homo sapiens
ttgatatttctagct

SEQ ID NO: 5812314 - DNA, 12 bp, Homo sapiens
ttgatatttggt

SEQ ID NO: 5812315 - DNA, 13 bp, Homo sapiens
ttgatatttgtat

SEQ ID NO: 5812316 - DNA, 18 bp, Homo sapiens
ttgatatttgtgcatttt

SEQ ID NO: 5812317 - DNA, 14 bp, Homo sapiens
ttgatatttttcca

SEQ ID NO: 5812318 - DNA, 17 bp, Homo sapiens
ttgatattttttctctc

SEQ ID NO: 5812319 - DNA, 21 bp, Homo sapiens
ttgatcaaatatagaaagttg

SEQ ID NO: 5812320 - DNA, 17 bp, Homo sapiens
ttgatcaacatcttttc

SEQ ID NO: 5812321 - DNA, 15 bp, Homo sapiens
ttgatcacacagtgt

SEQ ID NO: 5812322 - DNA, 13 bp, Homo sapiens
ttgatcacagtgg

SEQ ID NO: 5812323 - DNA, 20 bp, Homo sapiens
ttgatcacagtggcgagagg

SEQ ID NO: 5812324 - DNA, 14 bp, Homo sapiens
ttgatcacattgtt

SEQ ID NO: 5812325 - DNA, 17 bp, Homo sapiens
ttgatcagatcttacaa

SEQ ID NO: 5812326 - DNA, 18 bp, Homo sapiens
ttgatcagatcttacaag

SEQ ID NO: 5812327 - DNA, 20 bp, Homo sapiens
ttgatcagccccaccctggc

SEQ ID NO: 5812328 - DNA, 18 bp, Homo sapiens
ttgatcagttaagaaatt

SEQ ID NO: 5812329 - DNA, 13 bp, Homo sapiens
ttgatcatcatgt

SEQ ID NO: 5812330 - DNA, 19 bp, Homo sapiens
ttgatcatgcaggaactga

SEQ ID NO: 5812331 - DNA, 14 bp, Homo sapiens
ttgatcatttcttg

SEQ ID NO: 5812332 - DNA, 17 bp, Homo sapiens
ttgatccatctcagtca

SEQ ID NO: 5812333 - DNA, 15 bp, Homo sapiens
ttgatccatttctaa

SEQ ID NO: 5812334 - DNA, 18 bp, Homo sapiens
ttgatccatttctaatta

SEQ ID NO: 5812335 - DNA, 20 bp, Homo sapiens
ttgatcccacttcactgtga

SEQ ID NO: 5812336 - DNA, 21 bp, Homo sapiens
ttgatcccttctcctgccctt

SEQ ID NO: 5812337 - DNA, 17 bp, Homo sapiens
ttgatccttaaccaata

SEQ ID NO: 5812338 - DNA, 12 bp, Homo sapiens
ttgatccttgga

SEQ ID NO: 5812339 - DNA, 16 bp, Homo sapiens
ttgatccttggaaacc

SEQ ID NO: 5812340 - DNA, 21 bp, Homo sapiens
ttgatcgtcacgctcgcatct

SEQ ID NO: 5812341 - DNA, 14 bp, Homo sapiens
ttgatctaaggcat

SEQ ID NO: 5812342 - DNA, 19 bp, Homo sapiens
ttgatctaaggcatgctcc

SEQ ID NO: 5812343 - DNA, 22 bp, Homo sapiens
ttgatctaatgaagtgtttcct

SEQ ID NO: 5812344 - DNA, 19 bp, Homo sapiens
ttgatctacccgtgcctgg

SEQ ID NO: 5812345 - DNA, 15 bp, Homo sapiens
ttgatctatctacaa

SEQ ID NO: 5812346 - DNA, 16 bp, Homo sapiens
ttgatctatgggaaat

SEQ ID NO: 5812347 - DNA, 12 bp, Homo sapiens
ttgatctctctt

SEQ ID NO: 5812348 - DNA, 14 bp, Homo sapiens
ttgatctctcttgt

SEQ ID NO: 5812349 - DNA, 22 bp, Homo sapiens
ttgatctctcttgtcctcttct

SEQ ID NO: 5812350 - DNA, 14 bp, Homo sapiens
ttgatctgaaattc

SEQ ID NO: 5812351 - DNA, 20 bp, Homo sapiens
ttgatctgctcagccctgga

SEQ ID NO: 5812352 - DNA, 12 bp, Homo sapiens
ttgatctgctct

SEQ ID NO: 5812353 - DNA, 14 bp, Homo sapiens
ttgatctgctctgt

SEQ ID NO: 5812354 - DNA, 14 bp, Homo sapiens
ttgatctggaaccc

SEQ ID NO: 5812355 - DNA, 20 bp, Homo sapiens
ttgatctggtgcgtgtggcc

SEQ ID NO: 5812356 - DNA, 22 bp, Homo sapiens
ttgatctgttgcaagcccctct

SEQ ID NO: 5812357 - DNA, 13 bp, Homo sapiens
ttgatcttcaaca

SEQ ID NO: 5812358 - DNA, 16 bp, Homo sapiens
ttgatcttcaacaaat

SEQ ID NO: 5812359 - DNA, 15 bp, Homo sapiens
ttgatcttcaggatg

SEQ ID NO: 5812360 - DNA, 17 bp, Homo sapiens
ttgatcttgtaaaaata

SEQ ID NO: 5812361 - DNA, 22 bp, Homo sapiens
ttgatcttgtgctatgaaacaa

SEQ ID NO: 5812362 - DNA, 16 bp, Homo sapiens
ttgatctttgagccca

SEQ ID NO: 5812363 - DNA, 21 bp, Homo sapiens
ttgatctttgtttaaatgcca

SEQ ID NO: 5812364 - DNA, 15 bp, Homo sapiens
ttgatctttttatca

SEQ ID NO: 5812365 - DNA, 20 bp, Homo sapiens
ttgatgaaaagatttaagca

SEQ ID NO: 5812366 - DNA, 15 bp, Homo sapiens
ttgatgaaaagcttt

SEQ ID NO: 5812367 - DNA, 18 bp, Homo sapiens
ttgatgaaattcttgaag

SEQ ID NO: 5812368 - DNA, 12 bp, Homo sapiens
ttgatgaagaag

SEQ ID NO: 5812369 - DNA, 17 bp, Homo sapiens
ttgatgaagtatacttt

SEQ ID NO: 5812370 - DNA, 17 bp, Homo sapiens
ttgatgaataaacactt

SEQ ID NO: 5812371 - DNA, 13 bp, Homo sapiens
ttgatgaatgttg

SEQ ID NO: 5812372 - DNA, 19 bp, Homo sapiens
ttgatgaccaatctctgtg

SEQ ID NO: 5812373 - DNA, 18 bp, Homo sapiens
ttgatgactatatataaa

SEQ ID NO: 5812374 - DNA, 23 bp, Homo sapiens
ttgatgactcgaaactgacagta

SEQ ID NO: 5812375 - DNA, 11 bp, Homo sapiens
ttgatgactgc

SEQ ID NO: 5812376 - DNA, 14 bp, Homo sapiens
ttgatgactgcctt

SEQ ID NO: 5812377 - DNA, 18 bp, Homo sapiens
ttgatgactggaattttt

SEQ ID NO: 5812378 - DNA, 16 bp, Homo sapiens
ttgatgactggcattt

SEQ ID NO: 5812379 - DNA, 22 bp, Homo sapiens
ttgatgactggcattttataga

SEQ ID NO: 5812380 - DNA, 17 bp, Homo sapiens
ttgatgacttcagtgaa

SEQ ID NO: 5812381 - DNA, 19 bp, Homo sapiens
ttgatgaggacccagagct

SEQ ID NO: 5812382 - DNA, 22 bp, Homo sapiens
ttgatgataaaaggagaataag

SEQ ID NO: 5812383 - DNA, 18 bp, Homo sapiens
ttgatgataacacttaaa

SEQ ID NO: 5812384 - DNA, 17 bp, Homo sapiens
ttgatgatcactgtgaa

SEQ ID NO: 5812385 - DNA, 14 bp, Homo sapiens
ttgatgatgcagtt

SEQ ID NO: 5812386 - DNA, 20 bp, Homo sapiens
ttgatgatgtctacagaaaa

SEQ ID NO: 5812387 - DNA, 14 bp, Homo sapiens
ttgatgcacagaga

SEQ ID NO: 5812388 - DNA, 18 bp, Homo sapiens
ttgatgcacagagaagct

SEQ ID NO: 5812389 - DNA, 18 bp, Homo sapiens
ttgatgcaggcacttatt

SEQ ID NO: 5812390 - DNA, 19 bp, Homo sapiens
ttgatgcattaaaagaaaa

SEQ ID NO: 5812391 - DNA, 15 bp, Homo sapiens
ttgatgcatttccac

SEQ ID NO: 5812392 - DNA, 22 bp, Homo sapiens
ttgatgccaaaatgactttata

SEQ ID NO: 5812393 - DNA, 12 bp, Homo sapiens
ttgatgccaaag

SEQ ID NO: 5812394 - DNA, 16 bp, Homo sapiens
ttgatgccagagggcc

SEQ ID NO: 5812395 - DNA, 17 bp, Homo sapiens
ttgatgccagagggcca

SEQ ID NO: 5812396 - DNA, 15 bp, Homo sapiens
ttgatgccaggacac

SEQ ID NO: 5812397 - DNA, 17 bp, Homo sapiens
ttgatgcccaatatatt

SEQ ID NO: 5812398 - DNA, 16 bp, Homo sapiens
ttgatgctatttatgc

SEQ ID NO: 5812399 - DNA, 13 bp, Homo sapiens
ttgatgctccctt

SEQ ID NO: 5812400 - DNA, 15 bp, Homo sapiens
ttgatgctggagagg

SEQ ID NO: 5812401 - DNA, 18 bp, Homo sapiens
ttgatgctggagaggtta

SEQ ID NO: 5812402 - DNA, 15 bp, Homo sapiens
ttgatgcttttctct

SEQ ID NO: 5812403 - DNA, 17 bp, Homo sapiens
ttgatgcttttctctca

SEQ ID NO: 5812404 - DNA, 15 bp, Homo sapiens
ttgatggaaaaagaa

SEQ ID NO: 5812405 - DNA, 19 bp, Homo sapiens
ttgatggaaaaagaatata

SEQ ID NO: 5812406 - DNA, 19 bp, Homo sapiens
ttgatggaagtgggccagt

SEQ ID NO: 5812407 - DNA, 22 bp, Homo sapiens
ttgatggaagtgggccagtcct

SEQ ID NO: 5812408 - DNA, 16 bp, Homo sapiens
ttgatggagaaggaaa

SEQ ID NO: 5812409 - DNA, 22 bp, Homo sapiens
ttgatggagatccaactatttc

SEQ ID NO: 5812410 - DNA, 15 bp, Homo sapiens
ttgatggagccccag

SEQ ID NO: 5812411 - DNA, 16 bp, Homo sapiens
ttgatggagccccagg

SEQ ID NO: 5812412 - DNA, 17 bp, Homo sapiens
ttgatggagccccaggg

SEQ ID NO: 5812413 - DNA, 12 bp, Homo sapiens
ttgatggaggag

SEQ ID NO: 5812414 - DNA, 23 bp, Homo sapiens
ttgatggccccatctggatgtaa

SEQ ID NO: 5812415 - DNA, 14 bp, Homo sapiens
ttgatggggagaaa

SEQ ID NO: 5812416 - DNA, 16 bp, Homo sapiens
ttgatggggagaaagg

SEQ ID NO: 5812417 - DNA, 19 bp, Homo sapiens
ttgatggggtccagagagc

SEQ ID NO: 5812418 - DNA, 18 bp, Homo sapiens
ttgatgggtgctgccctc

SEQ ID NO: 5812419 - DNA, 23 bp, Homo sapiens
ttgatggtagaaattttatctct

SEQ ID NO: 5812420 - DNA, 15 bp, Homo sapiens
ttgatggtatttctt

SEQ ID NO: 5812421 - DNA, 19 bp, Homo sapiens
ttgatggtatttctttctc

SEQ ID NO: 5812422 - DNA, 19 bp, Homo sapiens
ttgatggtcaggaagtttg

SEQ ID NO: 5812423 - DNA, 15 bp, Homo sapiens
ttgatggtgaatatt

SEQ ID NO: 5812424 - DNA, 19 bp, Homo sapiens
ttgatggtgacagctgcaa

SEQ ID NO: 5812425 - DNA, 17 bp, Homo sapiens
ttgatggtggactaagc

SEQ ID NO: 5812426 - DNA, 18 bp, Homo sapiens
ttgatggtggtatgtttt

SEQ ID NO: 5812427 - DNA, 13 bp, Homo sapiens
ttgatgtaaaatc

SEQ ID NO: 5812428 - DNA, 15 bp, Homo sapiens
ttgatgtaaaatctt

SEQ ID NO: 5812429 - DNA, 20 bp, Homo sapiens
ttgatgtaaggatgggcatg

SEQ ID NO: 5812430 - DNA, 19 bp, Homo sapiens
ttgatgtaagttactgaca

SEQ ID NO: 5812431 - DNA, 16 bp, Homo sapiens
ttgatgtacagatttt

SEQ ID NO: 5812432 - DNA, 19 bp, Homo sapiens
ttgatgtacagtctgtcat

SEQ ID NO: 5812433 - DNA, 11 bp, Homo sapiens
ttgatgtacat

SEQ ID NO: 5812434 - DNA, 22 bp, Homo sapiens
ttgatgtactgattgagaagtt

SEQ ID NO: 5812435 - DNA, 13 bp, Homo sapiens
ttgatgtatctga

SEQ ID NO: 5812436 - DNA, 23 bp, Homo sapiens
ttgatgtatgtgtgaaacaatgt

SEQ ID NO: 5812437 - DNA, 13 bp, Homo sapiens
ttgatgtcagcct

SEQ ID NO: 5812438 - DNA, 17 bp, Homo sapiens
ttgatgtcagccttgca

SEQ ID NO: 5812439 - DNA, 20 bp, Homo sapiens
ttgatgtcagtatttcaact

SEQ ID NO: 5812440 - DNA, 22 bp, Homo sapiens
ttgatgtctagataacattcat

SEQ ID NO: 5812441 - DNA, 23 bp, Homo sapiens
ttgatgtgccttaaattatacca

SEQ ID NO: 5812442 - DNA, 20 bp, Homo sapiens
ttgatgtgcttacataacca

SEQ ID NO: 5812443 - DNA, 13 bp, Homo sapiens
ttgatgtggccct

SEQ ID NO: 5812444 - DNA, 21 bp, Homo sapiens
ttgatgtggtgaaaagcaggt

SEQ ID NO: 5812445 - DNA, 15 bp, Homo sapiens
ttgatgtgtatgtgt

SEQ ID NO: 5812446 - DNA, 22 bp, Homo sapiens
ttgatgtgtatgtgtttataat

SEQ ID NO: 5812447 - DNA, 12 bp, Homo sapiens
ttgatgtgttgt

SEQ ID NO: 5812448 - DNA, 14 bp, Homo sapiens
ttgatgtgttgttc

SEQ ID NO: 5812449 - DNA, 13 bp, Homo sapiens
ttgatgttacaag

SEQ ID NO: 5812450 - DNA, 14 bp, Homo sapiens
ttgatgttacagat

SEQ ID NO: 5812451 - DNA, 23 bp, Homo sapiens
ttgatgttcagacatttatgtgt

SEQ ID NO: 5812452 - DNA, 17 bp, Homo sapiens
ttgatgttccttccaga

SEQ ID NO: 5812453 - DNA, 19 bp, Homo sapiens
ttgatgttccttccagtgt

SEQ ID NO: 5812454 - DNA, 16 bp, Homo sapiens
ttgatgttgatgcaat

SEQ ID NO: 5812455 - DNA, 17 bp, Homo sapiens
ttgatgtttccagaaaa

SEQ ID NO: 5812456 - DNA, 18 bp, Homo sapiens
ttgatgtttcctggaagc

SEQ ID NO: 5812457 - DNA, 22 bp, Homo sapiens
ttgatgtttctatatgtaactt

SEQ ID NO: 5812458 - DNA, 19 bp, Homo sapiens
ttgatgtttgtggcctcag

SEQ ID NO: 5812459 - DNA, 14 bp, Homo sapiens
ttgatgttttcaca

SEQ ID NO: 5812460 - DNA, 13 bp, Homo sapiens
ttgatgttttcta

SEQ ID NO: 5812461 - DNA, 18 bp, Homo sapiens
ttgatgttttttctgtaa

SEQ ID NO: 5812462 - DNA, 17 bp, Homo sapiens
ttgattaaaaatgcttt

SEQ ID NO: 5812463 - DNA, 14 bp, Homo sapiens
ttgattaaaaatgt

SEQ ID NO: 5812464 - DNA, 16 bp, Homo sapiens
ttgattaaaatctctt

SEQ ID NO: 5812465 - DNA, 23 bp, Homo sapiens
ttgattaaacagcaaagccatat

SEQ ID NO: 5812466 - DNA, 21 bp, Homo sapiens
ttgattaaactgtatgtctta

SEQ ID NO: 5812467 - DNA, 14 bp, Homo sapiens
ttgattaaagatga

SEQ ID NO: 5812468 - DNA, 15 bp, Homo sapiens
ttgattaaattcttg

SEQ ID NO: 5812469 - DNA, 16 bp, Homo sapiens
ttgattaaattcttgc

SEQ ID NO: 5812470 - DNA, 20 bp, Homo sapiens
ttgattaaattcttgcaaag

SEQ ID NO: 5812471 - DNA, 13 bp, Homo sapiens
ttgattaaattgc

SEQ ID NO: 5812472 - DNA, 22 bp, Homo sapiens
ttgccaaaataatgtcttgtta

SEQ ID NO: 5812473 - DNA, 14 bp, Homo sapiens
ttgccaaaatacca

SEQ ID NO: 5812474 - DNA, 15 bp, Homo sapiens
ttgccaaaataccac

SEQ ID NO: 5812475 - DNA, 13 bp, Homo sapiens
ttgccaaaatggt

SEQ ID NO: 5812476 - DNA, 19 bp, Homo sapiens
ttgccaaaattcatttcta

SEQ ID NO: 5812477 - DNA, 20 bp, Homo sapiens
ttgccaaacattaatgttga

SEQ ID NO: 5812478 - DNA, 11 bp, Homo sapiens
ttgccaaagct

SEQ ID NO: 5812479 - DNA, 22 bp, Homo sapiens
ttgccaaagttttgctgtctct

SEQ ID NO: 5812480 - DNA, 21 bp, Homo sapiens
ttgccaaataaagttaaaagt

SEQ ID NO: 5812481 - DNA, 17 bp, Homo sapiens
ttgccaaatatgtcctg

SEQ ID NO: 5812482 - DNA, 15 bp, Homo sapiens
ttgccaaattgctgc

SEQ ID NO: 5812483 - DNA, 17 bp, Homo sapiens
ttgccaaattgctgcat

SEQ ID NO: 5812484 - DNA, 21 bp, Homo sapiens
ttgccaaattgctgcatattt

SEQ ID NO: 5812485 - DNA, 23 bp, Homo sapiens
ttgccaaattgctgcatatttgt

SEQ ID NO: 5812486 - DNA, 15 bp, Homo sapiens
ttgccaacagttgta

SEQ ID NO: 5812487 - DNA, 20 bp, Homo sapiens
ttgccaacagttgtatgttt

SEQ ID NO: 5812488 - DNA, 19 bp, Homo sapiens
ttgccaacctgtaataaat

SEQ ID NO: 5812489 - DNA, 21 bp, Homo sapiens
ttgccaacctgtaataaatat

SEQ ID NO: 5812490 - DNA, 22 bp, Homo sapiens
ttgccaacctgtaataaatatg

SEQ ID NO: 5812491 - DNA, 17 bp, Homo sapiens
ttgccaactaagccctc

SEQ ID NO: 5812492 - DNA, 17 bp, Homo sapiens
ttgccaactaattttaa

SEQ ID NO: 5812493 - DNA, 20 bp, Homo sapiens
ttgccaagaactgaaaacat

SEQ ID NO: 5812494 - DNA, 20 bp, Homo sapiens
ttgccaagaatatagttatt

SEQ ID NO: 5812495 - DNA, 23 bp, Homo sapiens
ttgccaagaatatagttattatt

SEQ ID NO: 5812496 - DNA, 12 bp, Homo sapiens
ttgccaagacaa

SEQ ID NO: 5812497 - DNA, 17 bp, Homo sapiens
ttgccaagacctttcaa

SEQ ID NO: 5812498 - DNA, 20 bp, Homo sapiens
ttgccaagccccccgagtga

SEQ ID NO: 5812499 - DNA, 13 bp, Homo sapiens
ttgccaagccctt

SEQ ID NO: 5812500 - DNA, 16 bp, Homo sapiens
ttgccaagccctttgc

SEQ ID NO: 5812501 - DNA, 17 bp, Homo sapiens
ttgccaagccctttgct

SEQ ID NO: 5812502 - DNA, 19 bp, Homo sapiens
ttgccaagccctttgctgt

SEQ ID NO: 5812503 - DNA, 20 bp, Homo sapiens
ttgccaagccctttgctgtt

SEQ ID NO: 5812504 - DNA, 19 bp, Homo sapiens
ttgccaagctaatctgcct

SEQ ID NO: 5812505 - DNA, 16 bp, Homo sapiens
ttgccaagctgaagct

SEQ ID NO: 5812506 - DNA, 17 bp, Homo sapiens
ttgccaagctttcttct

SEQ ID NO: 5812507 - DNA, 16 bp, Homo sapiens
ttgccaagttgctgtc

SEQ ID NO: 5812508 - DNA, 22 bp, Homo sapiens
ttgccaagttgctgtcactgtt

SEQ ID NO: 5812509 - DNA, 20 bp, Homo sapiens
ttgccaataaagcttttgga

SEQ ID NO: 5812510 - DNA, 18 bp, Homo sapiens
ttgccaatctaaaatggc

SEQ ID NO: 5812511 - DNA, 23 bp, Homo sapiens
ttgccaatgaactctttccccag

SEQ ID NO: 5812512 - DNA, 14 bp, Homo sapiens
ttgccaattttcct

SEQ ID NO: 5812513 - DNA, 18 bp, Homo sapiens
ttgccaatttttgttttc

SEQ ID NO: 5812514 - DNA, 15 bp, Homo sapiens
ttgccacaaccctgt

SEQ ID NO: 5812515 - DNA, 17 bp, Homo sapiens
ttgccacaatgcctctc

SEQ ID NO: 5812516 - DNA, 19 bp, Homo sapiens
ttgccacaatgcctctccc

SEQ ID NO: 5812517 - DNA, 20 bp, Homo sapiens
ttgccacaccaatcagagag

SEQ ID NO: 5812518 - DNA, 21 bp, Homo sapiens
ttgccacaccaatcagagagc

SEQ ID NO: 5812519 - DNA, 19 bp, Homo sapiens
ttgccacactttcactggg

SEQ ID NO: 5812520 - DNA, 13 bp, Homo sapiens
ttgccacagctct

SEQ ID NO: 5812521 - DNA, 14 bp, Homo sapiens
ttgccacagctttt

SEQ ID NO: 5812522 - DNA, 18 bp, Homo sapiens
ttgccacagcttttgcaa

SEQ ID NO: 5812523 - DNA, 17 bp, Homo sapiens
ttgccacagtagaactg

SEQ ID NO: 5812524 - DNA, 20 bp, Homo sapiens
ttgccacagtagaactgtct

SEQ ID NO: 5812525 - DNA, 15 bp, Homo sapiens
ttgccacatcttgaa

SEQ ID NO: 5812526 - DNA, 16 bp, Homo sapiens
ttgccacatcttgaaa

SEQ ID NO: 5812527 - DNA, 22 bp, Homo sapiens
ttgccacatcttgaaaatgcca

SEQ ID NO: 5812528 - DNA, 12 bp, Homo sapiens
ttgccacatttc

SEQ ID NO: 5812529 - DNA, 22 bp, Homo sapiens
ttgccacatttctgatcagagg

SEQ ID NO: 5812530 - DNA, 23 bp, Homo sapiens
ttgccacatttctgatcagaggt

SEQ ID NO: 5812531 - DNA, 22 bp, Homo sapiens
ttgccaccaccagatgagaagt

SEQ ID NO: 5812532 - DNA, 17 bp, Homo sapiens
ttgccaccacctctgtg

SEQ ID NO: 5812533 - DNA, 14 bp, Homo sapiens
ttgccaccaggaga

SEQ ID NO: 5812534 - DNA, 19 bp, Homo sapiens
ttgccacccattcttcccg

SEQ ID NO: 5812535 - DNA, 15 bp, Homo sapiens
ttgccaccctctggg

SEQ ID NO: 5812536 - DNA, 16 bp, Homo sapiens
ttgccaccctctggga

SEQ ID NO: 5812537 - DNA, 20 bp, Homo sapiens
ttgccacctctaacagcacc

SEQ ID NO: 5812538 - DNA, 12 bp, Homo sapiens
ttgccactaagt

SEQ ID NO: 5812539 - DNA, 14 bp, Homo sapiens
ttgccactctcctc

SEQ ID NO: 5812540 - DNA, 17 bp, Homo sapiens
ttgccactctcctcccc

SEQ ID NO: 5812541 - DNA, 22 bp, Homo sapiens
ttgccactgagagatctgctgt

SEQ ID NO: 5812542 - DNA, 19 bp, Homo sapiens
ttgccactgatattcagaa

SEQ ID NO: 5812543 - DNA, 13 bp, Homo sapiens
ttgccactgcaaa

SEQ ID NO: 5812544 - DNA, 15 bp, Homo sapiens
ttgccactgcaaaca

SEQ ID NO: 5812545 - DNA, 21 bp, Homo sapiens
ttgccactgcaaacaataaac

SEQ ID NO: 5812546 - DNA, 14 bp, Homo sapiens
ttgccactgctgta

SEQ ID NO: 5812547 - DNA, 15 bp, Homo sapiens
ttgccactgtgtttc

SEQ ID NO: 5812548 - DNA, 22 bp, Homo sapiens
ttgccactttggcttctcctgt

SEQ ID NO: 5812549 - DNA, 12 bp, Homo sapiens
ttgccagactct

SEQ ID NO: 5812550 - DNA, 11 bp, Homo sapiens
ttgccagagca

SEQ ID NO: 5812551 - DNA, 16 bp, Homo sapiens
ttgccagaggccctgg

SEQ ID NO: 5812552 - DNA, 12 bp, Homo sapiens
ttgccagcacag

SEQ ID NO: 5812553 - DNA, 17 bp, Homo sapiens
ttgccagcagagccagg

SEQ ID NO: 5812554 - DNA, 16 bp, Homo sapiens
ttgccagcatcactgg

SEQ ID NO: 5812555 - DNA, 13 bp, Homo sapiens
ttgccagccagaa

SEQ ID NO: 5812556 - DNA, 15 bp, Homo sapiens
ttgccagcccatttg

SEQ ID NO: 5812557 - DNA, 21 bp, Homo sapiens
ttgccagcctccttgctgacc

SEQ ID NO: 5812558 - DNA, 14 bp, Homo sapiens
ttgccagctcagca

SEQ ID NO: 5812559 - DNA, 18 bp, Homo sapiens
ttgccagctgacatcttg

SEQ ID NO: 5812560 - DNA, 20 bp, Homo sapiens
ttgccagctgctgagccgca

SEQ ID NO: 5812561 - DNA, 19 bp, Homo sapiens
ttgccagctgctgctggat

SEQ ID NO: 5812562 - DNA, 18 bp, Homo sapiens
ttgccagcttttcctccc

SEQ ID NO: 5812563 - DNA, 22 bp, Homo sapiens
ttgccagcttttcctcccttgg

SEQ ID NO: 5812564 - DNA, 15 bp, Homo sapiens
ttgccaggaagatgg

SEQ ID NO: 5812565 - DNA, 17 bp, Homo sapiens
ttgccaggaatgtttca

SEQ ID NO: 5812566 - DNA, 16 bp, Homo sapiens
ttgccaggacatgcaa

SEQ ID NO: 5812567 - DNA, 19 bp, Homo sapiens
ttgccaggctggagtgcag

SEQ ID NO: 5812568 - DNA, 22 bp, Homo sapiens
ttgccagggatgggcagcccaa

SEQ ID NO: 5812569 - DNA, 15 bp, Homo sapiens
ttgccagggcagggt

SEQ ID NO: 5812570 - DNA, 14 bp, Homo sapiens
ttgccaggttgcag

SEQ ID NO: 5812571 - DNA, 20 bp, Homo sapiens
ttgccagtatataagctgtt

SEQ ID NO: 5812572 - DNA, 13 bp, Homo sapiens
ttgccagtcaccc

SEQ ID NO: 5812573 - DNA, 21 bp, Homo sapiens
ttgccagtgtctttctttggt

SEQ ID NO: 5812574 - DNA, 19 bp, Homo sapiens
ttgccataactttatgaag

SEQ ID NO: 5812575 - DNA, 23 bp, Homo sapiens
ttgccatattgcacatgtcttaa

SEQ ID NO: 5812576 - DNA, 17 bp, Homo sapiens
ttgccatcaccatttgg

SEQ ID NO: 5812577 - DNA, 19 bp, Homo sapiens
ttgccatcccaagcccagt

SEQ ID NO: 5812578 - DNA, 17 bp, Homo sapiens
ttgccatccctccctcc

SEQ ID NO: 5812579 - DNA, 19 bp, Homo sapiens
ttgccatccgcacagaaaa

SEQ ID NO: 5812580 - DNA, 22 bp, Homo sapiens
ttgccatcctgatggacctgcc

SEQ ID NO: 5812581 - DNA, 17 bp, Homo sapiens
ttgccatcgggtgccaa

SEQ ID NO: 5812582 - DNA, 23 bp, Homo sapiens
ttgccatctgcgtgacaataaaa

SEQ ID NO: 5812583 - DNA, 17 bp, Homo sapiens
ttgccatgaaggcacct

SEQ ID NO: 5812584 - DNA, 16 bp, Homo sapiens
ttgccatgaatttcta

SEQ ID NO: 5812585 - DNA, 20 bp, Homo sapiens
ttgccatgacaacttctaat

SEQ ID NO: 5812586 - DNA, 21 bp, Homo sapiens
ttgccatgacatttcatctgg

SEQ ID NO: 5812587 - DNA, 23 bp, Homo sapiens
ttgccatgacatttcatctgggt

SEQ ID NO: 5812588 - DNA, 16 bp, Homo sapiens
ttgccatgaggccttt

SEQ ID NO: 5812589 - DNA, 14 bp, Homo sapiens
ttgccatgcaggaa

SEQ ID NO: 5812590 - DNA, 14 bp, Homo sapiens
ttgccatgggagga

SEQ ID NO: 5812591 - DNA, 18 bp, Homo sapiens
ttgccatgggcctgctgc

SEQ ID NO: 5812592 - DNA, 13 bp, Homo sapiens
ttgccatgtgctt

SEQ ID NO: 5812593 - DNA, 22 bp, Homo sapiens
ttgccattcaaggcttatttat

SEQ ID NO: 5812594 - DNA, 23 bp, Homo sapiens
ttgccattgaaggcttaattgac

SEQ ID NO: 5812595 - DNA, 18 bp, Homo sapiens
ttgccattggacagttgt

SEQ ID NO: 5812596 - DNA, 13 bp, Homo sapiens
ttgccatttagcg

SEQ ID NO: 5812597 - DNA, 15 bp, Homo sapiens
ttgccatttctctgc

SEQ ID NO: 5812598 - DNA, 14 bp, Homo sapiens
ttgccatttcttcc

SEQ ID NO: 5812599 - DNA, 17 bp, Homo sapiens
ttgccatttcttcccaa

SEQ ID NO: 5812600 - DNA, 14 bp, Homo sapiens
ttgccatttcttct

SEQ ID NO: 5812601 - DNA, 13 bp, Homo sapiens
ttgccatttcttt

SEQ ID NO: 5812602 - DNA, 15 bp, Homo sapiens
ttgccatttctttat

SEQ ID NO: 5812603 - DNA, 13 bp, Homo sapiens
ttgccatttgata

SEQ ID NO: 5812604 - DNA, 18 bp, Homo sapiens
ttgccatttgtagctttg

SEQ ID NO: 5812605 - DNA, 18 bp, Homo sapiens
ttgcccaacaccagcccc

SEQ ID NO: 5812606 - DNA, 21 bp, Homo sapiens
ttgcccaacaccagcccctgc

SEQ ID NO: 5812607 - DNA, 19 bp, Homo sapiens
ttgcccaacctcagcaacc

SEQ ID NO: 5812608 - DNA, 23 bp, Homo sapiens
ttgcccacacacactccttcccc

SEQ ID NO: 5812609 - DNA, 18 bp, Homo sapiens
ttgcccacaccgagggcg

SEQ ID NO: 5812610 - DNA, 12 bp, Homo sapiens
ttgcccacccct

SEQ ID NO: 5812611 - DNA, 13 bp, Homo sapiens
ttgcccacccctc

SEQ ID NO: 5812612 - DNA, 14 bp, Homo sapiens
ttgcccacccctca

SEQ ID NO: 5812613 - DNA, 21 bp, Homo sapiens
ttgcccacccctcactcccca

SEQ ID NO: 5812614 - DNA, 15 bp, Homo sapiens
ttgcccactcctgct

SEQ ID NO: 5812615 - DNA, 16 bp, Homo sapiens
ttgcccactcctgctc

SEQ ID NO: 5812616 - DNA, 13 bp, Homo sapiens
ttgcccacttctg

SEQ ID NO: 5812617 - DNA, 12 bp, Homo sapiens
ttgcccagagat

SEQ ID NO: 5812618 - DNA, 22 bp, Homo sapiens
ttgcccagagatgcctccaccg

SEQ ID NO: 5812619 - DNA, 14 bp, Homo sapiens
ttgcccagatagag

SEQ ID NO: 5812620 - DNA, 12 bp, Homo sapiens
ttgcccagcctc

SEQ ID NO: 5812621 - DNA, 11 bp, Homo sapiens
ttgcccaggca

SEQ ID NO: 5812622 - DNA, 17 bp, Homo sapiens
ttgcccaggcctcccca

SEQ ID NO: 5812623 - DNA, 14 bp, Homo sapiens
ttgcccaggctggc

SEQ ID NO: 5812624 - DNA, 23 bp, Homo sapiens
ttgcccaggctggcgtgcagtgg

SEQ ID NO: 5812625 - DNA, 17 bp, Homo sapiens
ttgcccagtcctgggtt

SEQ ID NO: 5812626 - DNA, 14 bp, Homo sapiens
ttgcccatcagcca

SEQ ID NO: 5812627 - DNA, 16 bp, Homo sapiens
ttgcccatcagccatt

SEQ ID NO: 5812628 - DNA, 17 bp, Homo sapiens
ttgcccatcctgactga

SEQ ID NO: 5812629 - DNA, 18 bp, Homo sapiens
ttgcccatgcctccagct

SEQ ID NO: 5812630 - DNA, 16 bp, Homo sapiens
ttgcccatttacactt

SEQ ID NO: 5812631 - DNA, 17 bp, Homo sapiens
ttgccccaacccttctt

SEQ ID NO: 5812632 - DNA, 12 bp, Homo sapiens
ttgccccacagt

SEQ ID NO: 5812633 - DNA, 11 bp, Homo sapiens
ttgccccactc

SEQ ID NO: 5812634 - DNA, 13 bp, Homo sapiens
ttgccccactcct

SEQ ID NO: 5812635 - DNA, 16 bp, Homo sapiens
ttgccccactcctctc

SEQ ID NO: 5812636 - DNA, 18 bp, Homo sapiens
ttgccccagacctggaag

SEQ ID NO: 5812637 - DNA, 18 bp, Homo sapiens
ttgccccagagccccact

SEQ ID NO: 5812638 - DNA, 19 bp, Homo sapiens
ttgccccaggactctggca

SEQ ID NO: 5812639 - DNA, 21 bp, Homo sapiens
ttgccccaggactctggcact

SEQ ID NO: 5812640 - DNA, 15 bp, Homo sapiens
ttgccccaggccagg

SEQ ID NO: 5812641 - DNA, 13 bp, Homo sapiens
ttgccccagtttg

SEQ ID NO: 5812642 - DNA, 22 bp, Homo sapiens
ttgccccatccagacctggctc

SEQ ID NO: 5812643 - DNA, 20 bp, Homo sapiens
ttgccccatgataaaataag

SEQ ID NO: 5812644 - DNA, 21 bp, Homo sapiens
ttgccccatgataaaataagt

SEQ ID NO: 5812645 - DNA, 12 bp, Homo sapiens
ttgcccccacct

SEQ ID NO: 5812646 - DNA, 22 bp, Homo sapiens
ttgcccccagggcacttcacag

SEQ ID NO: 5812647 - DNA, 20 bp, Homo sapiens
ttgcccccagtgcctcacct

SEQ ID NO: 5812648 - DNA, 13 bp, Homo sapiens
ttgccccccaggg

SEQ ID NO: 5812649 - DNA, 13 bp, Homo sapiens
ttgccccccatca

SEQ ID NO: 5812650 - DNA, 18 bp, Homo sapiens
ttgctcatgagctcctga

SEQ ID NO: 5812651 - DNA, 18 bp, Homo sapiens
ttgctccaataaaggaac

SEQ ID NO: 5812652 - DNA, 19 bp, Homo sapiens
ttgctccaataaaggaaca

SEQ ID NO: 5812653 - DNA, 16 bp, Homo sapiens
ttgctccaccccactc

SEQ ID NO: 5812654 - DNA, 20 bp, Homo sapiens
ttgctccaccccactcacag

SEQ ID NO: 5812655 - DNA, 18 bp, Homo sapiens
ttgctccagacctgcccc

SEQ ID NO: 5812656 - DNA, 12 bp, Homo sapiens
ttgctccagcct

SEQ ID NO: 5812657 - DNA, 15 bp, Homo sapiens
ttgctccagcctgac

SEQ ID NO: 5812658 - DNA, 11 bp, Homo sapiens
ttgctccaggc

SEQ ID NO: 5812659 - DNA, 15 bp, Homo sapiens
ttgctccaggcatca

SEQ ID NO: 5812660 - DNA, 14 bp, Homo sapiens
ttgctccagggtct

SEQ ID NO: 5812661 - DNA, 20 bp, Homo sapiens
ttgctccagtataaattaca

SEQ ID NO: 5812662 - DNA, 21 bp, Homo sapiens
ttgctcccaatggtgcttgga

SEQ ID NO: 5812663 - DNA, 13 bp, Homo sapiens
ttgctcccaggat

SEQ ID NO: 5812664 - DNA, 14 bp, Homo sapiens
ttgctcccaggatc

SEQ ID NO: 5812665 - DNA, 17 bp, Homo sapiens
ttgctcccagtgccaaa

SEQ ID NO: 5812666 - DNA, 20 bp, Homo sapiens
ttgctcccccattttaactt

SEQ ID NO: 5812667 - DNA, 17 bp, Homo sapiens
ttgctccccttcccctt

SEQ ID NO: 5812668 - DNA, 22 bp, Homo sapiens
ttgctccccttccccttccttc

SEQ ID NO: 5812669 - DNA, 21 bp, Homo sapiens
ttgctcccgccccagggtctg

SEQ ID NO: 5812670 - DNA, 16 bp, Homo sapiens
ttgctccgcctggcct

SEQ ID NO: 5812671 - DNA, 19 bp, Homo sapiens
ttgctccgctcccaccgcc

SEQ ID NO: 5812672 - DNA, 19 bp, Homo sapiens
ttgctcctaactccaccgc

SEQ ID NO: 5812673 - DNA, 11 bp, Homo sapiens
ttgctcctacc

SEQ ID NO: 5812674 - DNA, 12 bp, Homo sapiens
ttgctcctaccc

SEQ ID NO: 5812675 - DNA, 15 bp, Homo sapiens
ttgctcctagaactg

SEQ ID NO: 5812676 - DNA, 14 bp, Homo sapiens
ttgctcctagcaga

SEQ ID NO: 5812677 - DNA, 21 bp, Homo sapiens
ttgctcctagcagacagaaac

SEQ ID NO: 5812678 - DNA, 23 bp, Homo sapiens
ttgctcctcagggtccctcagga

SEQ ID NO: 5812679 - DNA, 20 bp, Homo sapiens
ttgctcctcccacttctcaa

SEQ ID NO: 5812680 - DNA, 19 bp, Homo sapiens
ttgctcctggaacctggca

SEQ ID NO: 5812681 - DNA, 14 bp, Homo sapiens
ttgctcctggggag

SEQ ID NO: 5812682 - DNA, 20 bp, Homo sapiens
ttgctcctggggagaaagag

SEQ ID NO: 5812683 - DNA, 20 bp, Homo sapiens
ttgctcctttccatcagctt

SEQ ID NO: 5812684 - DNA, 18 bp, Homo sapiens
ttgctctaaaatatttat

SEQ ID NO: 5812685 - DNA, 20 bp, Homo sapiens
ttgctctaaaatatttatga

SEQ ID NO: 5812686 - DNA, 20 bp, Homo sapiens
ttgctctaattcttttcaaa

SEQ ID NO: 5812687 - DNA, 14 bp, Homo sapiens
ttgctctacaatga

SEQ ID NO: 5812688 - DNA, 14 bp, Homo sapiens
ttgctctaccaaat

SEQ ID NO: 5812689 - DNA, 18 bp, Homo sapiens
ttgctctatgctttccaa

SEQ ID NO: 5812690 - DNA, 21 bp, Homo sapiens
ttgctctccctcccttctttc

SEQ ID NO: 5812691 - DNA, 23 bp, Homo sapiens
ttgctctccctcttctcaagtgc

SEQ ID NO: 5812692 - DNA, 13 bp, Homo sapiens
ttgctctcctgga

SEQ ID NO: 5812693 - DNA, 18 bp, Homo sapiens
ttgctctctcattcccag

SEQ ID NO: 5812694 - DNA, 12 bp, Homo sapiens
ttgctctctgag

SEQ ID NO: 5812695 - DNA, 15 bp, Homo sapiens
ttgctctctgttctc

SEQ ID NO: 5812696 - DNA, 18 bp, Homo sapiens
ttgctctcttcaataaac

SEQ ID NO: 5812697 - DNA, 18 bp, Homo sapiens
ttgctctgacctcctctg

SEQ ID NO: 5812698 - DNA, 13 bp, Homo sapiens
ttgctctgcaccc

SEQ ID NO: 5812699 - DNA, 20 bp, Homo sapiens
ttgctctgccaacttcttca

SEQ ID NO: 5812700 - DNA, 19 bp, Homo sapiens
ttgctctggaagcctgctg

SEQ ID NO: 5812701 - DNA, 14 bp, Homo sapiens
ttgctctggacctg

SEQ ID NO: 5812702 - DNA, 16 bp, Homo sapiens
ttgctctggacctgcc

SEQ ID NO: 5812703 - DNA, 24 bp, Homo sapiens
ttgctctggaggaagttctccagc

SEQ ID NO: 5812704 - DNA, 23 bp, Homo sapiens
ttgctctgggagacttactgcat

SEQ ID NO: 5812705 - DNA, 14 bp, Homo sapiens
ttgctctgggtgga

SEQ ID NO: 5812706 - DNA, 15 bp, Homo sapiens
ttgctctgttcacag

SEQ ID NO: 5812707 - DNA, 14 bp, Homo sapiens
ttgctcttctcctt

SEQ ID NO: 5812708 - DNA, 12 bp, Homo sapiens
ttgctcttctgt

SEQ ID NO: 5812709 - DNA, 13 bp, Homo sapiens
ttgctcttgggga

SEQ ID NO: 5812710 - DNA, 16 bp, Homo sapiens
ttgctctttctactct

SEQ ID NO: 5812711 - DNA, 16 bp, Homo sapiens
ttgctgaaaaacacaa

SEQ ID NO: 5812712 - DNA, 21 bp, Homo sapiens
ttgctgaaagccaaggcagct

SEQ ID NO: 5812713 - DNA, 15 bp, Homo sapiens
ttgctgaacacacac

SEQ ID NO: 5812714 - DNA, 23 bp, Homo sapiens
ttgctgaacaggaaagagctagg

SEQ ID NO: 5812715 - DNA, 22 bp, Homo sapiens
ttgctgaacatggatatctaca

SEQ ID NO: 5812716 - DNA, 18 bp, Homo sapiens
ttgctgaacattggagaa

SEQ ID NO: 5812717 - DNA, 24 bp, Homo sapiens
ttgctgaactcagcacattcggga

SEQ ID NO: 5812718 - DNA, 19 bp, Homo sapiens
ttgctgaagatgccttgag

SEQ ID NO: 5812719 - DNA, 14 bp, Homo sapiens
ttgctgaaggagaa

SEQ ID NO: 5812720 - DNA, 23 bp, Homo sapiens
ttgctgaaggctaaattcacagc

SEQ ID NO: 5812721 - DNA, 18 bp, Homo sapiens
ttgctgaagtctccccgc

SEQ ID NO: 5812722 - DNA, 21 bp, Homo sapiens
ttgctgaatgtcattatttga

SEQ ID NO: 5812723 - DNA, 16 bp, Homo sapiens
ttgctgaatgttgcat

SEQ ID NO: 5812724 - DNA, 11 bp, Homo sapiens
ttgctgaattc

SEQ ID NO: 5812725 - DNA, 15 bp, Homo sapiens
ttgctgaattcatct

SEQ ID NO: 5812726 - DNA, 17 bp, Homo sapiens
ttgctgaattcatctat

SEQ ID NO: 5812727 - DNA, 19 bp, Homo sapiens
ttgctgaattcctttacaa

SEQ ID NO: 5812728 - DNA, 14 bp, Homo sapiens
ttgctgacaataaa

SEQ ID NO: 5812729 - DNA, 13 bp, Homo sapiens
ttgctgacagagc

SEQ ID NO: 5812730 - DNA, 20 bp, Homo sapiens
ttgctgaccccacttggact

SEQ ID NO: 5812731 - DNA, 20 bp, Homo sapiens
ttgctgaccccaggtcagcc

SEQ ID NO: 5812732 - DNA, 22 bp, Homo sapiens
ttgctgaccccaggtcagccct

SEQ ID NO: 5812733 - DNA, 22 bp, Homo sapiens
ttgctgacctcagcggttgcca

SEQ ID NO: 5812734 - DNA, 14 bp, Homo sapiens
ttgctgacttagaa

SEQ ID NO: 5812735 - DNA, 14 bp, Homo sapiens
ttgctgactttaaa

SEQ ID NO: 5812736 - DNA, 14 bp, Homo sapiens
ttgctgagacttac

SEQ ID NO: 5812737 - DNA, 12 bp, Homo sapiens
ttgctgaggcac

SEQ ID NO: 5812738 - DNA, 17 bp, Homo sapiens
ttgctgagtgaaggaaa

SEQ ID NO: 5812739 - DNA, 16 bp, Homo sapiens
ttgctgatattgcagt

SEQ ID NO: 5812740 - DNA, 21 bp, Homo sapiens
ttgctgatcagagttcctcct

SEQ ID NO: 5812741 - DNA, 14 bp, Homo sapiens
ttgctgatgctcct

SEQ ID NO: 5812742 - DNA, 20 bp, Homo sapiens
ttgctgatggctgctagatt

SEQ ID NO: 5812743 - DNA, 15 bp, Homo sapiens
ttgctgatggcttga

SEQ ID NO: 5812744 - DNA, 19 bp, Homo sapiens
ttgctgatggtgcaatgac

SEQ ID NO: 5812745 - DNA, 19 bp, Homo sapiens
ttgctgatgtttataaact

SEQ ID NO: 5812746 - DNA, 19 bp, Homo sapiens
ttgctgattcaagaaacag

SEQ ID NO: 5812747 - DNA, 15 bp, Homo sapiens
ttgctgattcttgag

SEQ ID NO: 5812748 - DNA, 13 bp, Homo sapiens
ttgctgatttcta

SEQ ID NO: 5812749 - DNA, 20 bp, Homo sapiens
ttgctgatttctagtgtata

SEQ ID NO: 5812750 - DNA, 22 bp, Homo sapiens
ttgctgatttctagtgtatact

SEQ ID NO: 5812751 - DNA, 16 bp, Homo sapiens
ttgctgattttaatgg

SEQ ID NO: 5812752 - DNA, 19 bp, Homo sapiens
ttgctgattttattcttga

SEQ ID NO: 5812753 - DNA, 18 bp, Homo sapiens
ttgctgattttgaccttg

SEQ ID NO: 5812754 - DNA, 21 bp, Homo sapiens
ttgctgattttgaccttgtat

SEQ ID NO: 5812755 - DNA, 15 bp, Homo sapiens
ttgctgcaaacctga

SEQ ID NO: 5812756 - DNA, 13 bp, Homo sapiens
ttgctgcaaagag

SEQ ID NO: 5812757 - DNA, 16 bp, Homo sapiens
ttgctgcaaagagaaa

SEQ ID NO: 5812758 - DNA, 17 bp, Homo sapiens
ttgctgcaaagagaaac

SEQ ID NO: 5812759 - DNA, 21 bp, Homo sapiens
ttgctgcaccaatgcactgag

SEQ ID NO: 5812760 - DNA, 21 bp, Homo sapiens
ttgctgcagagaaacttaagc

SEQ ID NO: 5812761 - DNA, 17 bp, Homo sapiens
ttgctgcaggccctccc

SEQ ID NO: 5812762 - DNA, 20 bp, Homo sapiens
ttgctgcaggccctccctct

SEQ ID NO: 5812763 - DNA, 21 bp, Homo sapiens
ttgctgcaggccctccctcta

SEQ ID NO: 5812764 - DNA, 12 bp, Homo sapiens
ttgctgcagtgt

SEQ ID NO: 5812765 - DNA, 17 bp, Homo sapiens
ttgctgcataaaattct

SEQ ID NO: 5812766 - DNA, 17 bp, Homo sapiens
ttgctgcataaatttgt

SEQ ID NO: 5812767 - DNA, 19 bp, Homo sapiens
ttgctgcataaatttgtaa

SEQ ID NO: 5812768 - DNA, 15 bp, Homo sapiens
ttgctgcatggcagg

SEQ ID NO: 5812769 - DNA, 16 bp, Homo sapiens
ttgctgcatggcaggg

SEQ ID NO: 5812770 - DNA, 20 bp, Homo sapiens
ttgctgcattttaagcataa

SEQ ID NO: 5812771 - DNA, 21 bp, Homo sapiens
ttgctgcattttaagcataat

SEQ ID NO: 5812772 - DNA, 23 bp, Homo sapiens
ttgctgcattttaccttcaaaat

SEQ ID NO: 5812773 - DNA, 15 bp, Homo sapiens
ttgctgccaaaacca

SEQ ID NO: 5812774 - DNA, 16 bp, Homo sapiens
ttgctgccaaaaccac

SEQ ID NO: 5812775 - DNA, 17 bp, Homo sapiens
ttgctgccaaaaccaca

SEQ ID NO: 5812776 - DNA, 18 bp, Homo sapiens
ttgctgccaaccatacct

SEQ ID NO: 5812777 - DNA, 20 bp, Homo sapiens
ttgctgccactttttaacta

SEQ ID NO: 5812778 - DNA, 14 bp, Homo sapiens
ttgctgccagagaa

SEQ ID NO: 5812779 - DNA, 19 bp, Homo sapiens
ttgctgccccatcagtgct

SEQ ID NO: 5812780 - DNA, 13 bp, Homo sapiens
ttgctgcccctgt

SEQ ID NO: 5812781 - DNA, 18 bp, Homo sapiens
ttgctgcccgcgggagac

SEQ ID NO: 5812782 - DNA, 13 bp, Homo sapiens
ttgctgccctggg

SEQ ID NO: 5812783 - DNA, 15 bp, Homo sapiens
ttgctgcctcatgct

SEQ ID NO: 5812784 - DNA, 21 bp, Homo sapiens
ttgctgcctgaagaacagtaa

SEQ ID NO: 5812785 - DNA, 18 bp, Homo sapiens
ttgctgccttctgtctct

SEQ ID NO: 5812786 - DNA, 11 bp, Homo sapiens
ttgctgccttt

SEQ ID NO: 5812787 - DNA, 19 bp, Homo sapiens
ttgctgcgcaccaatgccc

SEQ ID NO: 5812788 - DNA, 20 bp, Homo sapiens
ttgctgctaatcctgaggct

SEQ ID NO: 5812789 - DNA, 21 bp, Homo sapiens
ttgctgctaccgccctgggct

SEQ ID NO: 5812790 - DNA, 16 bp, Homo sapiens
ttgctgctagaacttt

SEQ ID NO: 5812791 - DNA, 17 bp, Homo sapiens
ttgctgctagaactttt

SEQ ID NO: 5812792 - DNA, 23 bp, Homo sapiens
ttgctgctataattctatactgt

SEQ ID NO: 5812793 - DNA, 19 bp, Homo sapiens
ttgctgctccttagctgcc

SEQ ID NO: 5812794 - DNA, 21 bp, Homo sapiens
ttgctgctccttagctgccaa

SEQ ID NO: 5812795 - DNA, 19 bp, Homo sapiens
ttgctgctgatttaaacac

SEQ ID NO: 5812796 - DNA, 15 bp, Homo sapiens
ttgctgctgcctctt

SEQ ID NO: 5812797 - DNA, 14 bp, Homo sapiens
ttgctgctgctacc

SEQ ID NO: 5812798 - DNA, 16 bp, Homo sapiens
ttgctgctgctaccag

SEQ ID NO: 5812799 - DNA, 16 bp, Homo sapiens
ttgctgctgctctcag

SEQ ID NO: 5812800 - DNA, 21 bp, Homo sapiens
ttgctgctgctctcaggcgct

SEQ ID NO: 5812801 - DNA, 14 bp, Homo sapiens
ttgctgctgctgct

SEQ ID NO: 5812802 - DNA, 10 bp, Homo sapiens
ttgctgctgt

SEQ ID NO: 5812803 - DNA, 19 bp, Homo sapiens
ttgctgctgtccagtgcct

SEQ ID NO: 5812804 - DNA, 12 bp, Homo sapiens
ttgctgctgtct

SEQ ID NO: 5812805 - DNA, 20 bp, Homo sapiens
ttgctgctgtgaatctgaaa

SEQ ID NO: 5812806 - DNA, 18 bp, Homo sapiens
ttgctgctgtgcgtggaa

SEQ ID NO: 5812807 - DNA, 19 bp, Homo sapiens
ttgctgctgtgcgtggaaa

SEQ ID NO: 5812808 - DNA, 11 bp, Homo sapiens
ttgctgctgtt

SEQ ID NO: 5812809 - DNA, 16 bp, Homo sapiens
ttgctgcttctcccag

SEQ ID NO: 5812810 - DNA, 17 bp, Homo sapiens
ttgctgcttctcccagg

SEQ ID NO: 5812811 - DNA, 15 bp, Homo sapiens
ttgctgcttgatgat

SEQ ID NO: 5812812 - DNA, 15 bp, Homo sapiens
ttgctgcttggattt

SEQ ID NO: 5812813 - DNA, 18 bp, Homo sapiens
ttgctgcttttccttggg

SEQ ID NO: 5812814 - DNA, 12 bp, Homo sapiens
ttgctgcttttt

SEQ ID NO: 5812815 - DNA, 19 bp, Homo sapiens
ttgctggaaaactgccaca

SEQ ID NO: 5812816 - DNA, 23 bp, Homo sapiens
ttgctggaaaccaagtcaggcca

SEQ ID NO: 5812817 - DNA, 14 bp, Homo sapiens
ttgctggaacacag

SEQ ID NO: 5812818 - DNA, 23 bp, Homo sapiens
ttgctggactgtcatagaaatta

SEQ ID NO: 5812819 - DNA, 19 bp, Homo sapiens
ttgctggaggggctgtcct

SEQ ID NO: 5812820 - DNA, 21 bp, Homo sapiens
ttgctggaggggctgtcctcc

SEQ ID NO: 5812821 - DNA, 21 bp, Homo sapiens
ttgctggagtcctgttctcag

SEQ ID NO: 5812822 - DNA, 17 bp, Homo sapiens
ttgctggagtgctggct

SEQ ID NO: 5812823 - DNA, 20 bp, Homo sapiens
ttgctggagtgctggctcca

SEQ ID NO: 5812824 - DNA, 17 bp, Homo sapiens
ttgctggatgcattttt

SEQ ID NO: 5812825 - DNA, 18 bp, Homo sapiens
ttgctggatgcattttta

SEQ ID NO: 5812826 - DNA, 21 bp, Homo sapiens
ttgctggattaatgttttgta

SEQ ID NO: 5812827 - DNA, 15 bp, Homo sapiens
ttgctggcagggcct

SEQ ID NO: 5812828 - DNA, 18 bp, Homo sapiens
ttggaattaaaacaatgt

SEQ ID NO: 5812829 - DNA, 18 bp, Homo sapiens
ttggaattaacctggtgc

SEQ ID NO: 5812830 - DNA, 15 bp, Homo sapiens
ttggaattactgaaa

SEQ ID NO: 5812831 - DNA, 15 bp, Homo sapiens
ttggaattcaatggg

SEQ ID NO: 5812832 - DNA, 19 bp, Homo sapiens
ttggaattctactggaaaa

SEQ ID NO: 5812833 - DNA, 13 bp, Homo sapiens
ttggaattctgct

SEQ ID NO: 5812834 - DNA, 21 bp, Homo sapiens
ttggaattctgttcatttgtt

SEQ ID NO: 5812835 - DNA, 13 bp, Homo sapiens
ttggaattgacat

SEQ ID NO: 5812836 - DNA, 20 bp, Homo sapiens
ttggaattgacattctctat

SEQ ID NO: 5812837 - DNA, 15 bp, Homo sapiens
ttggaattgtcttta

SEQ ID NO: 5812838 - DNA, 13 bp, Homo sapiens
ttggaatttaaga

SEQ ID NO: 5812839 - DNA, 13 bp, Homo sapiens
ttggaatttacca

SEQ ID NO: 5812840 - DNA, 18 bp, Homo sapiens
ttggacaaaatggaatac

SEQ ID NO: 5812841 - DNA, 19 bp, Homo sapiens
ttggacaaatcacatattt

SEQ ID NO: 5812842 - DNA, 17 bp, Homo sapiens
ttggacaaatgtgaaga

SEQ ID NO: 5812843 - DNA, 19 bp, Homo sapiens
ttggacaaatgtgaagatg

SEQ ID NO: 5812844 - DNA, 15 bp, Homo sapiens
ttggacaagcttctg

SEQ ID NO: 5812845 - DNA, 23 bp, Homo sapiens
ttggacaatcatgaaatatgcat

SEQ ID NO: 5812846 - DNA, 13 bp, Homo sapiens
ttggacacactgt

SEQ ID NO: 5812847 - DNA, 14 bp, Homo sapiens
ttggacacagtgtt

SEQ ID NO: 5812848 - DNA, 19 bp, Homo sapiens
ttggacacttaattctgtt

SEQ ID NO: 5812849 - DNA, 20 bp, Homo sapiens
ttggacagaaaatgcaatga

SEQ ID NO: 5812850 - DNA, 16 bp, Homo sapiens
ttggacagatttcagt

SEQ ID NO: 5812851 - DNA, 23 bp, Homo sapiens
ttggacagatttcagtaatgtct

SEQ ID NO: 5812852 - DNA, 13 bp, Homo sapiens
ttggacagcaaaa

SEQ ID NO: 5812853 - DNA, 22 bp, Homo sapiens
ttggacagcaaaaccattgctt

SEQ ID NO: 5812854 - DNA, 19 bp, Homo sapiens
ttggacaggagtcagtgtc

SEQ ID NO: 5812855 - DNA, 20 bp, Homo sapiens
ttggacaggagtcagtgtct

SEQ ID NO: 5812856 - DNA, 13 bp, Homo sapiens
ttggacaggagtt

SEQ ID NO: 5812857 - DNA, 16 bp, Homo sapiens
ttggacaggggattgg

SEQ ID NO: 5812858 - DNA, 21 bp, Homo sapiens
ttggacataactgacttagtt

SEQ ID NO: 5812859 - DNA, 13 bp, Homo sapiens
ttggacatcagtg

SEQ ID NO: 5812860 - DNA, 16 bp, Homo sapiens
ttggacatctctctgg

SEQ ID NO: 5812861 - DNA, 18 bp, Homo sapiens
ttggacatggaaagaaaa

SEQ ID NO: 5812862 - DNA, 20 bp, Homo sapiens
ttggacatggaaagaaaagt

SEQ ID NO: 5812863 - DNA, 15 bp, Homo sapiens
ttggacattttatgt

SEQ ID NO: 5812864 - DNA, 16 bp, Homo sapiens
ttggacattttatgtc

SEQ ID NO: 5812865 - DNA, 17 bp, Homo sapiens
ttggacattttatgtct

SEQ ID NO: 5812866 - DNA, 21 bp, Homo sapiens
ttggaccaaaaaccagtattg

SEQ ID NO: 5812867 - DNA, 14 bp, Homo sapiens
ttggaccattttcc

SEQ ID NO: 5812868 - DNA, 14 bp, Homo sapiens
ttggaccccagctg

SEQ ID NO: 5812869 - DNA, 15 bp, Homo sapiens
ttggaccccagctgg

SEQ ID NO: 5812870 - DNA, 17 bp, Homo sapiens
ttggaccccagctggga

SEQ ID NO: 5812871 - DNA, 20 bp, Homo sapiens
ttggaccccagctgggaggc

SEQ ID NO: 5812872 - DNA, 15 bp, Homo sapiens
ttggacccgctctgg

SEQ ID NO: 5812873 - DNA, 14 bp, Homo sapiens
ttggaccctgggag

SEQ ID NO: 5812874 - DNA, 22 bp, Homo sapiens
ttggaccctggtgacctcctgt

SEQ ID NO: 5812875 - DNA, 19 bp, Homo sapiens
ttggacctaaatggcctca

SEQ ID NO: 5812876 - DNA, 21 bp, Homo sapiens
ttggacctaaatggcctcatg

SEQ ID NO: 5812877 - DNA, 14 bp, Homo sapiens
ttggacctccaggg

SEQ ID NO: 5812878 - DNA, 22 bp, Homo sapiens
ttggacctccaggggctcctgg

SEQ ID NO: 5812879 - DNA, 23 bp, Homo sapiens
ttggacctccaggggctcctggg

SEQ ID NO: 5812880 - DNA, 20 bp, Homo sapiens
ttggacgggatgacctccag

SEQ ID NO: 5812881 - DNA, 20 bp, Homo sapiens
ttggacggtttctagcctct

SEQ ID NO: 5812882 - DNA, 15 bp, Homo sapiens
ttggactacacaata

SEQ ID NO: 5812883 - DNA, 17 bp, Homo sapiens
ttggactacacaataca

SEQ ID NO: 5812884 - DNA, 18 bp, Homo sapiens
ttggactacctataaatg

SEQ ID NO: 5812885 - DNA, 19 bp, Homo sapiens
ttggactccctccccaccc

SEQ ID NO: 5812886 - DNA, 19 bp, Homo sapiens
ttggactcgaaattagaag

SEQ ID NO: 5812887 - DNA, 18 bp, Homo sapiens
ttggactctcccctctta

SEQ ID NO: 5812888 - DNA, 15 bp, Homo sapiens
ttggactgacattta

SEQ ID NO: 5812889 - DNA, 18 bp, Homo sapiens
ttggactgagatttctta

SEQ ID NO: 5812890 - DNA, 19 bp, Homo sapiens
ttggactgagatttcttaa

SEQ ID NO: 5812891 - DNA, 20 bp, Homo sapiens
ttggactgagatttcttaaa

SEQ ID NO: 5812892 - DNA, 19 bp, Homo sapiens
ttggactgtggcctcagga

SEQ ID NO: 5812893 - DNA, 18 bp, Homo sapiens
ttggactgttagtgttaa

SEQ ID NO: 5812894 - DNA, 22 bp, Homo sapiens
ttggacttcagtcttgcctagg

SEQ ID NO: 5812895 - DNA, 20 bp, Homo sapiens
ttggacttcctggggccccg

SEQ ID NO: 5812896 - DNA, 12 bp, Homo sapiens
ttggacttcctt

SEQ ID NO: 5812897 - DNA, 11 bp, Homo sapiens
ttggagaaaaa

SEQ ID NO: 5812898 - DNA, 15 bp, Homo sapiens
ttggagaaaagcaca

SEQ ID NO: 5812899 - DNA, 20 bp, Homo sapiens
ttggagaaaagcacaatcaa

SEQ ID NO: 5812900 - DNA, 19 bp, Homo sapiens
ttggagaaatgtcataaat

SEQ ID NO: 5812901 - DNA, 20 bp, Homo sapiens
ttggagaaatgtcataaatt

SEQ ID NO: 5812902 - DNA, 20 bp, Homo sapiens
ttggagaacaacaaggacaa

SEQ ID NO: 5812903 - DNA, 19 bp, Homo sapiens
ttggagaacgccagtctcc

SEQ ID NO: 5812904 - DNA, 22 bp, Homo sapiens
ttggagaagaactgaaatcata

SEQ ID NO: 5812905 - DNA, 16 bp, Homo sapiens
ttggagaagatttatg

SEQ ID NO: 5812906 - DNA, 21 bp, Homo sapiens
ttggagaaggagattttaagg

SEQ ID NO: 5812907 - DNA, 18 bp, Homo sapiens
ttggagaaggttatcaaa

SEQ ID NO: 5812908 - DNA, 16 bp, Homo sapiens
ttggagaatactttgc

SEQ ID NO: 5812909 - DNA, 20 bp, Homo sapiens
ttggagacacaactattttt

SEQ ID NO: 5812910 - DNA, 19 bp, Homo sapiens
ttggagacaggattctgac

SEQ ID NO: 5812911 - DNA, 13 bp, Homo sapiens
ttggagacataca

SEQ ID NO: 5812912 - DNA, 23 bp, Homo sapiens
ttggagaccctgcaaacagaaca

SEQ ID NO: 5812913 - DNA, 15 bp, Homo sapiens
ttggagaccttaccc

SEQ ID NO: 5812914 - DNA, 22 bp, Homo sapiens
ttggagactgtctggcccccct

SEQ ID NO: 5812915 - DNA, 16 bp, Homo sapiens
ttggagactttcttta

SEQ ID NO: 5812916 - DNA, 11 bp, Homo sapiens
ttggagagaaa

SEQ ID NO: 5812917 - DNA, 22 bp, Homo sapiens
ttggagagagattcagaagtta

SEQ ID NO: 5812918 - DNA, 21 bp, Homo sapiens
ttggagagagcaatcttgctg

SEQ ID NO: 5812919 - DNA, 22 bp, Homo sapiens
ttggagagcagcaggtgctgtg

SEQ ID NO: 5812920 - DNA, 17 bp, Homo sapiens
ttggagagcagctggct

SEQ ID NO: 5812921 - DNA, 22 bp, Homo sapiens
ttggagagctagaacctggaga

SEQ ID NO: 5812922 - DNA, 19 bp, Homo sapiens
ttggagaggaggtgtggag

SEQ ID NO: 5812923 - DNA, 21 bp, Homo sapiens
ttggagagggacgaagaaagg

SEQ ID NO: 5812924 - DNA, 22 bp, Homo sapiens
ttggagagggcccaggtcccaa

SEQ ID NO: 5812925 - DNA, 18 bp, Homo sapiens
ttggagagtaaaaactga

SEQ ID NO: 5812926 - DNA, 20 bp, Homo sapiens
ttggagagtaaaaactgaat

SEQ ID NO: 5812927 - DNA, 22 bp, Homo sapiens
ttggagagtgggctgacatcaa

SEQ ID NO: 5812928 - DNA, 23 bp, Homo sapiens
ttggagatacgtaaagccttgtt

SEQ ID NO: 5812929 - DNA, 23 bp, Homo sapiens
ttggagatcaaaatcctacagat

SEQ ID NO: 5812930 - DNA, 14 bp, Homo sapiens
ttggagatcaagga

SEQ ID NO: 5812931 - DNA, 20 bp, Homo sapiens
ttggagatgacagaaatatg

SEQ ID NO: 5812932 - DNA, 16 bp, Homo sapiens
ttggagatgcagcctt

SEQ ID NO: 5812933 - DNA, 14 bp, Homo sapiens
ttggagcaagcttg

SEQ ID NO: 5812934 - DNA, 23 bp, Homo sapiens
ttggagcacatgttactgcttca

SEQ ID NO: 5812935 - DNA, 13 bp, Homo sapiens
ttggagcacctgg

SEQ ID NO: 5812936 - DNA, 17 bp, Homo sapiens
ttggagcacctgggccc

SEQ ID NO: 5812937 - DNA, 19 bp, Homo sapiens
ttggagcagagacggcagc

SEQ ID NO: 5812938 - DNA, 22 bp, Homo sapiens
ttggagcagagacggcagcccc

SEQ ID NO: 5812939 - DNA, 16 bp, Homo sapiens
ttggagcagcaggcct

SEQ ID NO: 5812940 - DNA, 23 bp, Homo sapiens
ttggagcattaactaaatgctca

SEQ ID NO: 5812941 - DNA, 24 bp, Homo sapiens
ttggagcattaactaaatgctcat

SEQ ID NO: 5812942 - DNA, 11 bp, Homo sapiens
ttggagcattg

SEQ ID NO: 5812943 - DNA, 11 bp, Homo sapiens
ttggagcattt

SEQ ID NO: 5812944 - DNA, 19 bp, Homo sapiens
ttggagcatttatgtagac

SEQ ID NO: 5812945 - DNA, 19 bp, Homo sapiens
ttggagccccctggcggca

SEQ ID NO: 5812946 - DNA, 15 bp, Homo sapiens
ttggagcctgcagag

SEQ ID NO: 5812947 - DNA, 12 bp, Homo sapiens
ttggagccttcc

SEQ ID NO: 5812948 - DNA, 20 bp, Homo sapiens
ttggagctatcagtgctttg

SEQ ID NO: 5812949 - DNA, 20 bp, Homo sapiens
ttggagcttacatagtttta

SEQ ID NO: 5812950 - DNA, 20 bp, Homo sapiens
ttggagctttgcaattcttt

SEQ ID NO: 5812951 - DNA, 19 bp, Homo sapiens
ttggaggaccaaaaaaata

SEQ ID NO: 5812952 - DNA, 15 bp, Homo sapiens
ttggaggagactggg

SEQ ID NO: 5812953 - DNA, 19 bp, Homo sapiens
ttggaggagcaaagttaaa

SEQ ID NO: 5812954 - DNA, 24 bp, Homo sapiens
ttggaggcccttttctggctcctg

SEQ ID NO: 5812955 - DNA, 13 bp, Homo sapiens
ttggaggcctcag

SEQ ID NO: 5812956 - DNA, 11 bp, Homo sapiens
ttggaggctga

SEQ ID NO: 5812957 - DNA, 15 bp, Homo sapiens
ttggaggctgctgcc

SEQ ID NO: 5812958 - DNA, 16 bp, Homo sapiens
ttggaggctgctgccc

SEQ ID NO: 5812959 - DNA, 18 bp, Homo sapiens
ttggagggaaaaaacaag

SEQ ID NO: 5812960 - DNA, 19 bp, Homo sapiens
ttggagggaaagccagcct

SEQ ID NO: 5812961 - DNA, 22 bp, Homo sapiens
ttggagggaaagccagcctggg

SEQ ID NO: 5812962 - DNA, 21 bp, Homo sapiens
ttggagggagaggtggcagga

SEQ ID NO: 5812963 - DNA, 12 bp, Homo sapiens
ttggagggatgg

SEQ ID NO: 5812964 - DNA, 14 bp, Homo sapiens
ttggagggcctggg

SEQ ID NO: 5812965 - DNA, 15 bp, Homo sapiens
ttggagggcctgggc

SEQ ID NO: 5812966 - DNA, 17 bp, Homo sapiens
ttggaggggcaggcctt

SEQ ID NO: 5812967 - DNA, 16 bp, Homo sapiens
ttggagggggaagaga

SEQ ID NO: 5812968 - DNA, 17 bp, Homo sapiens
ttggagggtcccaagct

SEQ ID NO: 5812969 - DNA, 22 bp, Homo sapiens
ttggagggtcccaagctgggcc

SEQ ID NO: 5812970 - DNA, 11 bp, Homo sapiens
ttggagggtct

SEQ ID NO: 5812971 - DNA, 15 bp, Homo sapiens
ttggaggtgcttgat

SEQ ID NO: 5812972 - DNA, 23 bp, Homo sapiens
ttggagtattattgaagatgtga

SEQ ID NO: 5812973 - DNA, 13 bp, Homo sapiens
ttggagtcactct

SEQ ID NO: 5812974 - DNA, 21 bp, Homo sapiens
ttggagtcactcttatgctgt

SEQ ID NO: 5812975 - DNA, 23 bp, Homo sapiens
ttggagtcccaggggcagccaca

SEQ ID NO: 5812976 - DNA, 22 bp, Homo sapiens
ttggagtgagtgtggctcccct

SEQ ID NO: 5812977 - DNA, 17 bp, Homo sapiens
ttggagtgcttaaaaat

SEQ ID NO: 5812978 - DNA, 14 bp, Homo sapiens
ttggagtgtttcta

SEQ ID NO: 5812979 - DNA, 16 bp, Homo sapiens
ttggagttcattcata

SEQ ID NO: 5812980 - DNA, 18 bp, Homo sapiens
ttggagttcattcatatt

SEQ ID NO: 5812981 - DNA, 19 bp, Homo sapiens
ttggagtttgcattcttat

SEQ ID NO: 5812982 - DNA, 20 bp, Homo sapiens
ttggagtttgggctggagct

SEQ ID NO: 5812983 - DNA, 15 bp, Homo sapiens
ttggataataaaaat

SEQ ID NO: 5812984 - DNA, 18 bp, Homo sapiens
ttggataataaaaattgt

SEQ ID NO: 5812985 - DNA, 19 bp, Homo sapiens
ttggataataaggaaaagt

SEQ ID NO: 5812986 - DNA, 21 bp, Homo sapiens
ttggataataaggaaaagttt

SEQ ID NO: 5812987 - DNA, 21 bp, Homo sapiens
ttggatacaaggatcagaatg

SEQ ID NO: 5812988 - DNA, 13 bp, Homo sapiens
ttggatacatctg

SEQ ID NO: 5812989 - DNA, 17 bp, Homo sapiens
ttggatacatctgctgt

SEQ ID NO: 5812990 - DNA, 18 bp, Homo sapiens
ttggatacatctgctgtg

SEQ ID NO: 5812991 - DNA, 17 bp, Homo sapiens
ttggataccagctcagg

SEQ ID NO: 5812992 - DNA, 18 bp, Homo sapiens
ttggataccagctcaggg

SEQ ID NO: 5812993 - DNA, 19 bp, Homo sapiens
ttggatacttggatttagt

SEQ ID NO: 5812994 - DNA, 19 bp, Homo sapiens
ttggatatattattgtaag

SEQ ID NO: 5812995 - DNA, 19 bp, Homo sapiens
ttggatatgtaaaacattt

SEQ ID NO: 5812996 - DNA, 20 bp, Homo sapiens
ttggatatgtaaaacattta

SEQ ID NO: 5812997 - DNA, 18 bp, Homo sapiens
ttggatattcaagccttt

SEQ ID NO: 5812998 - DNA, 12 bp, Homo sapiens
ttggatatttgg

SEQ ID NO: 5812999 - DNA, 19 bp, Homo sapiens
ttggatatttttgtacttg

SEQ ID NO: 5813000 - DNA, 19 bp, Homo sapiens
ttggatattttttacttta

SEQ ID NO: 5813001 - DNA, 14 bp, Homo sapiens
ttggatcaaaagga

SEQ ID NO: 5813002 - DNA, 17 bp, Homo sapiens
ttggatcaagcagaaaa

SEQ ID NO: 5813003 - DNA, 15 bp, Homo sapiens
ttggatcaagtatta

SEQ ID NO: 5813004 - DNA, 21 bp, Homo sapiens
ttgggacccaaaacacaggaa

SEQ ID NO: 5813005 - DNA, 15 bp, Homo sapiens
ttgggacccagtggc

SEQ ID NO: 5813006 - DNA, 22 bp, Homo sapiens
ttgggacccagtggcagggcac

SEQ ID NO: 5813007 - DNA, 17 bp, Homo sapiens
ttgggacctgctgctcc

SEQ ID NO: 5813008 - DNA, 18 bp, Homo sapiens
ttgggactgagtgctgag

SEQ ID NO: 5813009 - DNA, 18 bp, Homo sapiens
ttgggactggggctgaag

SEQ ID NO: 5813010 - DNA, 12 bp, Homo sapiens
ttgggacttcta

SEQ ID NO: 5813011 - DNA, 13 bp, Homo sapiens
ttgggagaaatca

SEQ ID NO: 5813012 - DNA, 19 bp, Homo sapiens
ttgggagaagcaaatatag

SEQ ID NO: 5813013 - DNA, 22 bp, Homo sapiens
ttgggagacaattagcagaatg

SEQ ID NO: 5813014 - DNA, 18 bp, Homo sapiens
ttgggagacatggaccag

SEQ ID NO: 5813015 - DNA, 21 bp, Homo sapiens
ttgggagcaaaataaggaaga

SEQ ID NO: 5813016 - DNA, 22 bp, Homo sapiens
ttgggagcaaactagtagagtt

SEQ ID NO: 5813017 - DNA, 22 bp, Homo sapiens
ttgggagcactggagtgcaggg

SEQ ID NO: 5813018 - DNA, 11 bp, Homo sapiens
ttgggagcagg

SEQ ID NO: 5813019 - DNA, 13 bp, Homo sapiens
ttgggagccagga

SEQ ID NO: 5813020 - DNA, 16 bp, Homo sapiens
ttgggagccaggactc

SEQ ID NO: 5813021 - DNA, 20 bp, Homo sapiens
ttgggagccaggactcccag

SEQ ID NO: 5813022 - DNA, 22 bp, Homo sapiens
ttgggagccaggactcccagaa

SEQ ID NO: 5813023 - DNA, 20 bp, Homo sapiens
ttgggagcctgtggccagca

SEQ ID NO: 5813024 - DNA, 18 bp, Homo sapiens
ttgggagctgctgggcta

SEQ ID NO: 5813025 - DNA, 15 bp, Homo sapiens
ttgggaggaagcaga

SEQ ID NO: 5813026 - DNA, 21 bp, Homo sapiens
ttgggaggaagcagaataaag

SEQ ID NO: 5813027 - DNA, 16 bp, Homo sapiens
ttgggaggaggaaaag

SEQ ID NO: 5813028 - DNA, 22 bp, Homo sapiens
ttgggaggcaggtcgggctgcc

SEQ ID NO: 5813029 - DNA, 11 bp, Homo sapiens
ttgggaggctg

SEQ ID NO: 5813030 - DNA, 12 bp, Homo sapiens
ttgggaggctga

SEQ ID NO: 5813031 - DNA, 19 bp, Homo sapiens
ttgggagggaaaagggaag

SEQ ID NO: 5813032 - DNA, 18 bp, Homo sapiens
ttgggagggacagggctt

SEQ ID NO: 5813033 - DNA, 22 bp, Homo sapiens
ttgggaggggatggcagacagt

SEQ ID NO: 5813034 - DNA, 19 bp, Homo sapiens
ttgggaggtccaggcagga

SEQ ID NO: 5813035 - DNA, 22 bp, Homo sapiens
ttgggaggttttattctgactt

SEQ ID NO: 5813036 - DNA, 23 bp, Homo sapiens
ttgggagtacatatggtagacaa

SEQ ID NO: 5813037 - DNA, 14 bp, Homo sapiens
ttgggagtccaggc

SEQ ID NO: 5813038 - DNA, 17 bp, Homo sapiens
ttgggataagagtgtga

SEQ ID NO: 5813039 - DNA, 14 bp, Homo sapiens
ttgggatactgctt

SEQ ID NO: 5813040 - DNA, 20 bp, Homo sapiens
ttgggatagtgttctgctcc

SEQ ID NO: 5813041 - DNA, 15 bp, Homo sapiens
ttgggatcaggagcc

SEQ ID NO: 5813042 - DNA, 16 bp, Homo sapiens
ttgggatcaggagccc

SEQ ID NO: 5813043 - DNA, 21 bp, Homo sapiens
ttgggatccaggcccctccct

SEQ ID NO: 5813044 - DNA, 18 bp, Homo sapiens
ttgggatcccaccctggg

SEQ ID NO: 5813045 - DNA, 15 bp, Homo sapiens
ttgggatctaactgt

SEQ ID NO: 5813046 - DNA, 16 bp, Homo sapiens
ttgggatctaactgtt

SEQ ID NO: 5813047 - DNA, 17 bp, Homo sapiens
ttgggatgcggggcaga

SEQ ID NO: 5813048 - DNA, 13 bp, Homo sapiens
ttgggatgtctta

SEQ ID NO: 5813049 - DNA, 18 bp, Homo sapiens
ttgggatgtgagccccag

SEQ ID NO: 5813050 - DNA, 21 bp, Homo sapiens
ttgggatgtgagccccagggg

SEQ ID NO: 5813051 - DNA, 16 bp, Homo sapiens
ttgggattcctgaccc

SEQ ID NO: 5813052 - DNA, 18 bp, Homo sapiens
ttgggattcctgacccag

SEQ ID NO: 5813053 - DNA, 21 bp, Homo sapiens
ttgggattcctgacccaggcc

SEQ ID NO: 5813054 - DNA, 14 bp, Homo sapiens
ttgggattgggggc

SEQ ID NO: 5813055 - DNA, 15 bp, Homo sapiens
ttgggattgggggga

SEQ ID NO: 5813056 - DNA, 17 bp, Homo sapiens
ttgggatttatatctat

SEQ ID NO: 5813057 - DNA, 21 bp, Homo sapiens
ttgggattttaaaaacatgag

SEQ ID NO: 5813058 - DNA, 18 bp, Homo sapiens
ttgggcaaaacccaggac

SEQ ID NO: 5813059 - DNA, 23 bp, Homo sapiens
ttgggcaagcagaaaaattaaat

SEQ ID NO: 5813060 - DNA, 19 bp, Homo sapiens
ttgggcaatattctctgta

SEQ ID NO: 5813061 - DNA, 20 bp, Homo sapiens
ttgggcacccccagcctggg

SEQ ID NO: 5813062 - DNA, 21 bp, Homo sapiens
ttgggcacccccagcctgggc

SEQ ID NO: 5813063 - DNA, 22 bp, Homo sapiens
ttgggcacccccagcctgggcc

SEQ ID NO: 5813064 - DNA, 23 bp, Homo sapiens
ttgggcacccccagcctgggcct

SEQ ID NO: 5813065 - DNA, 17 bp, Homo sapiens
ttgggcagagctggctc

SEQ ID NO: 5813066 - DNA, 23 bp, Homo sapiens
ttgggcagccagaccagcaggct

SEQ ID NO: 5813067 - DNA, 21 bp, Homo sapiens
ttgggcagcgcccttcctctc

SEQ ID NO: 5813068 - DNA, 12 bp, Homo sapiens
ttgggcaggagg

SEQ ID NO: 5813069 - DNA, 17 bp, Homo sapiens
ttgggcaggcagagagt

SEQ ID NO: 5813070 - DNA, 23 bp, Homo sapiens
ttgggcagggtctctgctccagc

SEQ ID NO: 5813071 - DNA, 19 bp, Homo sapiens
ttgggcagtctttcttgaa

SEQ ID NO: 5813072 - DNA, 23 bp, Homo sapiens
ttgggcagtctttcttgaaattg

SEQ ID NO: 5813073 - DNA, 16 bp, Homo sapiens
ttgggcagtgccccag

SEQ ID NO: 5813074 - DNA, 17 bp, Homo sapiens
ttgggcagtgccccagg

SEQ ID NO: 5813075 - DNA, 16 bp, Homo sapiens
ttgggccaagccagct

SEQ ID NO: 5813076 - DNA, 18 bp, Homo sapiens
ttgggccaagccagctgc

SEQ ID NO: 5813077 - DNA, 17 bp, Homo sapiens
ttgggccaaggtgtttc

SEQ ID NO: 5813078 - DNA, 22 bp, Homo sapiens
ttgggccacgctcttgaggaag

SEQ ID NO: 5813079 - DNA, 21 bp, Homo sapiens
ttgggccagaagtaccagact

SEQ ID NO: 5813080 - DNA, 13 bp, Homo sapiens
ttgggccagacat

SEQ ID NO: 5813081 - DNA, 20 bp, Homo sapiens
ttgggccagctgtcgcatct

SEQ ID NO: 5813082 - DNA, 17 bp, Homo sapiens
ttgggccatactggcct

SEQ ID NO: 5813083 - DNA, 18 bp, Homo sapiens
ttgggccatactggcctc

SEQ ID NO: 5813084 - DNA, 19 bp, Homo sapiens
ttgggccatactggcctcg

SEQ ID NO: 5813085 - DNA, 23 bp, Homo sapiens
ttgggccatggctttcatcctgt

SEQ ID NO: 5813086 - DNA, 13 bp, Homo sapiens
ttgggccattacc

SEQ ID NO: 5813087 - DNA, 18 bp, Homo sapiens
ttgggccattaccccata

SEQ ID NO: 5813088 - DNA, 19 bp, Homo sapiens
ttgggcccaagaactgcag

SEQ ID NO: 5813089 - DNA, 22 bp, Homo sapiens
ttgggcccacacctccttccct

SEQ ID NO: 5813090 - DNA, 11 bp, Homo sapiens
ttgggcccagg

SEQ ID NO: 5813091 - DNA, 13 bp, Homo sapiens
ttgggcccaggga

SEQ ID NO: 5813092 - DNA, 18 bp, Homo sapiens
ttgggccccagaccccag

SEQ ID NO: 5813093 - DNA, 14 bp, Homo sapiens
ttgggcccctgagg

SEQ ID NO: 5813094 - DNA, 18 bp, Homo sapiens
ttgggcccggtccacagg

SEQ ID NO: 5813095 - DNA, 12 bp, Homo sapiens
ttgggccctcct

SEQ ID NO: 5813096 - DNA, 13 bp, Homo sapiens
ttgggccctgcac

SEQ ID NO: 5813097 - DNA, 14 bp, Homo sapiens
ttgggccctgcaca

SEQ ID NO: 5813098 - DNA, 13 bp, Homo sapiens
ttgggccctgcat

SEQ ID NO: 5813099 - DNA, 11 bp, Homo sapiens
ttgggccctgg

SEQ ID NO: 5813100 - DNA, 18 bp, Homo sapiens
ttgggcccttagaatgtg

SEQ ID NO: 5813101 - DNA, 18 bp, Homo sapiens
ttgggccgaatcccccag

SEQ ID NO: 5813102 - DNA, 20 bp, Homo sapiens
ttgggccgaatcccccaggg

SEQ ID NO: 5813103 - DNA, 23 bp, Homo sapiens
ttgggccggtgctgggggcacag

SEQ ID NO: 5813104 - DNA, 13 bp, Homo sapiens
ttgggcctcccac

SEQ ID NO: 5813105 - DNA, 16 bp, Homo sapiens
ttgggcctcccactcc

SEQ ID NO: 5813106 - DNA, 21 bp, Homo sapiens
ttgggcctcccataattgctt

SEQ ID NO: 5813107 - DNA, 12 bp, Homo sapiens
ttgggcctcccc

SEQ ID NO: 5813108 - DNA, 20 bp, Homo sapiens
ttgggcctccccccagcccc

SEQ ID NO: 5813109 - DNA, 22 bp, Homo sapiens
ttgggcctccttcccatgcctg

SEQ ID NO: 5813110 - DNA, 11 bp, Homo sapiens
ttgggcctctt

SEQ ID NO: 5813111 - DNA, 20 bp, Homo sapiens
ttgggcctgctccagacctg

SEQ ID NO: 5813112 - DNA, 19 bp, Homo sapiens
ttgggcctggccagtcttc

SEQ ID NO: 5813113 - DNA, 20 bp, Homo sapiens
ttgggcctggccagtcttcc

SEQ ID NO: 5813114 - DNA, 20 bp, Homo sapiens
ttgggcctgggcctctgccc

SEQ ID NO: 5813115 - DNA, 17 bp, Homo sapiens
ttgggccttgctgctgc

SEQ ID NO: 5813116 - DNA, 17 bp, Homo sapiens
ttgggcgatttgggggc

SEQ ID NO: 5813117 - DNA, 19 bp, Homo sapiens
ttgggcgccgtgctgggca

SEQ ID NO: 5813118 - DNA, 21 bp, Homo sapiens
ttgggcgccgtgctgggcagc

SEQ ID NO: 5813119 - DNA, 18 bp, Homo sapiens
ttgggcggctgagagccc

SEQ ID NO: 5813120 - DNA, 15 bp, Homo sapiens
ttgggcggggcttct

SEQ ID NO: 5813121 - DNA, 17 bp, Homo sapiens
ttgggcgtctcccccag

SEQ ID NO: 5813122 - DNA, 15 bp, Homo sapiens
ttgggctactggcag

SEQ ID NO: 5813123 - DNA, 20 bp, Homo sapiens
ttgggctactggcagctcct

SEQ ID NO: 5813124 - DNA, 22 bp, Homo sapiens
ttgggctataaaatatttctgt

SEQ ID NO: 5813125 - DNA, 20 bp, Homo sapiens
ttgggctcagggttggccat

SEQ ID NO: 5813126 - DNA, 20 bp, Homo sapiens
ttgggctcctggctgccagg

SEQ ID NO: 5813127 - DNA, 12 bp, Homo sapiens
ttgggctctgat

SEQ ID NO: 5813128 - DNA, 15 bp, Homo sapiens
ttgggctgagactgg

SEQ ID NO: 5813129 - DNA, 21 bp, Homo sapiens
ttgggctgagtgcagccaaag

SEQ ID NO: 5813130 - DNA, 16 bp, Homo sapiens
ttgggctggagctcct

SEQ ID NO: 5813131 - DNA, 14 bp, Homo sapiens
ttgggctggcgggc

SEQ ID NO: 5813132 - DNA, 14 bp, Homo sapiens
ttgggctggctctg

SEQ ID NO: 5813133 - DNA, 12 bp, Homo sapiens
ttgggctgtctt

SEQ ID NO: 5813134 - DNA, 20 bp, Homo sapiens
ttgggcttcaacagccaagc

SEQ ID NO: 5813135 - DNA, 18 bp, Homo sapiens
ttgggcttcagctgccag

SEQ ID NO: 5813136 - DNA, 20 bp, Homo sapiens
ttgggcttctgcggtgaggc

SEQ ID NO: 5813137 - DNA, 14 bp, Homo sapiens
ttgggctttaacat

SEQ ID NO: 5813138 - DNA, 18 bp, Homo sapiens
ttgggctttgcaggctct

SEQ ID NO: 5813139 - DNA, 23 bp, Homo sapiens
ttggggaaaaaagcacatacatt

SEQ ID NO: 5813140 - DNA, 13 bp, Homo sapiens
ttggggaagaaaa

SEQ ID NO: 5813141 - DNA, 23 bp, Homo sapiens
ttggggaagagagcctgcaggat

SEQ ID NO: 5813142 - DNA, 14 bp, Homo sapiens
ttggggaaggggca

SEQ ID NO: 5813143 - DNA, 16 bp, Homo sapiens
ttggggaagttcaagt

SEQ ID NO: 5813144 - DNA, 15 bp, Homo sapiens
ttggggaatttcctc

SEQ ID NO: 5813145 - DNA, 23 bp, Homo sapiens
ttggggacaggggcaggaggaag

SEQ ID NO: 5813146 - DNA, 18 bp, Homo sapiens
ttggggaccagagctgcc

SEQ ID NO: 5813147 - DNA, 12 bp, Homo sapiens
ttggggactcag

SEQ ID NO: 5813148 - DNA, 22 bp, Homo sapiens
ttggggagacttggggccagcg

SEQ ID NO: 5813149 - DNA, 21 bp, Homo sapiens
ttggggagagataatgaggca

SEQ ID NO: 5813150 - DNA, 14 bp, Homo sapiens
ttggggaggactag

SEQ ID NO: 5813151 - DNA, 14 bp, Homo sapiens
ttggggagggaggg

SEQ ID NO: 5813152 - DNA, 21 bp, Homo sapiens
ttggggagggaggggaaatgt

SEQ ID NO: 5813153 - DNA, 12 bp, Homo sapiens
ttggggaggggg

SEQ ID NO: 5813154 - DNA, 19 bp, Homo sapiens
ttggggagttaagacctgg

SEQ ID NO: 5813155 - DNA, 20 bp, Homo sapiens
ttggggagttaagacctggc

SEQ ID NO: 5813156 - DNA, 14 bp, Homo sapiens
ttggggatattttt

SEQ ID NO: 5813157 - DNA, 17 bp, Homo sapiens
ttggggatgtttgcccc

SEQ ID NO: 5813158 - DNA, 16 bp, Homo sapiens
ttggggatgtttttct

SEQ ID NO: 5813159 - DNA, 15 bp, Homo sapiens
ttggggattcttaaa

SEQ ID NO: 5813160 - DNA, 15 bp, Homo sapiens
ttggggattgtacac

SEQ ID NO: 5813161 - DNA, 15 bp, Homo sapiens
ttggggcaaaaatcc

SEQ ID NO: 5813162 - DNA, 16 bp, Homo sapiens
ttggggcatcctggat

SEQ ID NO: 5813163 - DNA, 21 bp, Homo sapiens
ttggggccaccaaagctgccc

SEQ ID NO: 5813164 - DNA, 21 bp, Homo sapiens
ttggggccatggtggagggca

SEQ ID NO: 5813165 - DNA, 24 bp, Homo sapiens
ttggggccctcttgccagcctcct

SEQ ID NO: 5813166 - DNA, 13 bp, Homo sapiens
ttggggccctgcc

SEQ ID NO: 5813167 - DNA, 18 bp, Homo sapiens
ttggggcctcacccagaa

SEQ ID NO: 5813168 - DNA, 21 bp, Homo sapiens
ttggggccttgatgactgcct

SEQ ID NO: 5813169 - DNA, 16 bp, Homo sapiens
ttggggctatttgtgt

SEQ ID NO: 5813170 - DNA, 11 bp, Homo sapiens
ttggggctcct

SEQ ID NO: 5813171 - DNA, 11 bp, Homo sapiens
ttggggctggg

SEQ ID NO: 5813172 - DNA, 19 bp, Homo sapiens
ttggggctgtcgggggctg

SEQ ID NO: 5813173 - DNA, 15 bp, Homo sapiens
ttggggcttattttt

SEQ ID NO: 5813174 - DNA, 18 bp, Homo sapiens
ttgggggaaaaaaaagaa

SEQ ID NO: 5813175 - DNA, 19 bp, Homo sapiens
ttgggggaaaaaaaagaaa

SEQ ID NO: 5813176 - DNA, 20 bp, Homo sapiens
ttgggggaaatgttgtgggg

SEQ ID NO: 5813177 - DNA, 13 bp, Homo sapiens
ttgggggaatgca

SEQ ID NO: 5813178 - DNA, 18 bp, Homo sapiens
ttgggggacagggctggc

SEQ ID NO: 5813179 - DNA, 11 bp, Homo sapiens
ttgggggaggc

SEQ ID NO: 5813180 - DNA, 22 bp, Homo sapiens
ttgggggaggggagactttgat

SEQ ID NO: 5813181 - DNA, 16 bp, Homo sapiens
ttgtaaaccattgtaa

SEQ ID NO: 5813182 - DNA, 15 bp, Homo sapiens
ttgtaaacctggagg

SEQ ID NO: 5813183 - DNA, 16 bp, Homo sapiens
ttgtaaacgtttcagt

SEQ ID NO: 5813184 - DNA, 18 bp, Homo sapiens
ttgtaaacgtttcagtaa

SEQ ID NO: 5813185 - DNA, 22 bp, Homo sapiens
ttgtaaactcaaaatatttgta

SEQ ID NO: 5813186 - DNA, 14 bp, Homo sapiens
ttgtaaactgtact

SEQ ID NO: 5813187 - DNA, 15 bp, Homo sapiens
ttgtaaactgtacta

SEQ ID NO: 5813188 - DNA, 14 bp, Homo sapiens
ttgtaaacttctga

SEQ ID NO: 5813189 - DNA, 15 bp, Homo sapiens
ttgtaaacttctgaa

SEQ ID NO: 5813190 - DNA, 13 bp, Homo sapiens
ttgtaaactttga

SEQ ID NO: 5813191 - DNA, 14 bp, Homo sapiens
ttgtaaactttgaa

SEQ ID NO: 5813192 - DNA, 17 bp, Homo sapiens
ttgtaaactttgaaata

SEQ ID NO: 5813193 - DNA, 18 bp, Homo sapiens
ttgtaaactttgaaatat

SEQ ID NO: 5813194 - DNA, 21 bp, Homo sapiens
ttgtaaactttttcaatggtt

SEQ ID NO: 5813195 - DNA, 21 bp, Homo sapiens
ttgtaaagaaatttactatat

SEQ ID NO: 5813196 - DNA, 12 bp, Homo sapiens
ttgtaaagaagg

SEQ ID NO: 5813197 - DNA, 13 bp, Homo sapiens
ttgtaaagactgg

SEQ ID NO: 5813198 - DNA, 20 bp, Homo sapiens
ttgtaaagatattgtatctc

SEQ ID NO: 5813199 - DNA, 16 bp, Homo sapiens
ttgtaaagatttctgt

SEQ ID NO: 5813200 - DNA, 12 bp, Homo sapiens
ttgtaaaggaaa

SEQ ID NO: 5813201 - DNA, 18 bp, Homo sapiens
ttgtaaaggaaataattg

SEQ ID NO: 5813202 - DNA, 16 bp, Homo sapiens
ttgtaaaggaatttaa

SEQ ID NO: 5813203 - DNA, 17 bp, Homo sapiens
ttgtaaaggcattctat

SEQ ID NO: 5813204 - DNA, 18 bp, Homo sapiens
ttgtaaaggtaggtgcat

SEQ ID NO: 5813205 - DNA, 14 bp, Homo sapiens
ttgtaaaggtcaga

SEQ ID NO: 5813206 - DNA, 20 bp, Homo sapiens
ttgtaaaggtcagagtcaaa

SEQ ID NO: 5813207 - DNA, 13 bp, Homo sapiens
ttgtaaagtatgt

SEQ ID NO: 5813208 - DNA, 17 bp, Homo sapiens
ttgtaaagtatgtatta

SEQ ID NO: 5813209 - DNA, 17 bp, Homo sapiens
ttgtaaagtatgtgagt

SEQ ID NO: 5813210 - DNA, 16 bp, Homo sapiens
ttgtaaagtccccaga

SEQ ID NO: 5813211 - DNA, 22 bp, Homo sapiens
ttgtaaagtgtggtcccaacag

SEQ ID NO: 5813212 - DNA, 23 bp, Homo sapiens
ttgtaaagtgtggtcccaacagg

SEQ ID NO: 5813213 - DNA, 12 bp, Homo sapiens
ttgtaaagtttc

SEQ ID NO: 5813214 - DNA, 22 bp, Homo sapiens
ttgtaaataaattttgtgcaaa

SEQ ID NO: 5813215 - DNA, 13 bp, Homo sapiens
ttgtaaataacca

SEQ ID NO: 5813216 - DNA, 21 bp, Homo sapiens
ttgtaaataaccacactgaaa

SEQ ID NO: 5813217 - DNA, 14 bp, Homo sapiens
ttgtaaataagaga

SEQ ID NO: 5813218 - DNA, 11 bp, Homo sapiens
ttgtaaataca

SEQ ID NO: 5813219 - DNA, 13 bp, Homo sapiens
ttgtaaatacaat

SEQ ID NO: 5813220 - DNA, 12 bp, Homo sapiens
ttgtaaatacac

SEQ ID NO: 5813221 - DNA, 14 bp, Homo sapiens
ttgtaaatacacca

SEQ ID NO: 5813222 - DNA, 20 bp, Homo sapiens
ttgtaaatacataaaacaaa

SEQ ID NO: 5813223 - DNA, 15 bp, Homo sapiens
ttgtaaataccagga

SEQ ID NO: 5813224 - DNA, 12 bp, Homo sapiens
ttgtaaatactc

SEQ ID NO: 5813225 - DNA, 14 bp, Homo sapiens
ttgtaaatactgga

SEQ ID NO: 5813226 - DNA, 15 bp, Homo sapiens
ttgtaaatagtttaa

SEQ ID NO: 5813227 - DNA, 11 bp, Homo sapiens
ttgtaaatata

SEQ ID NO: 5813228 - DNA, 16 bp, Homo sapiens
ttgtaaatataaagac

SEQ ID NO: 5813229 - DNA, 12 bp, Homo sapiens
ttgtaaatatag

SEQ ID NO: 5813230 - DNA, 15 bp, Homo sapiens
ttgtaaatatataaa

SEQ ID NO: 5813231 - DNA, 17 bp, Homo sapiens
ttgtaaatatataaata

SEQ ID NO: 5813232 - DNA, 21 bp, Homo sapiens
ttgtaaatatataaatatata

SEQ ID NO: 5813233 - DNA, 13 bp, Homo sapiens
ttgtaaatattgt

SEQ ID NO: 5813234 - DNA, 13 bp, Homo sapiens
ttgtaaatattta

SEQ ID NO: 5813235 - DNA, 14 bp, Homo sapiens
ttgtaaatcacatc

SEQ ID NO: 5813236 - DNA, 11 bp, Homo sapiens
ttgtaaatctg

SEQ ID NO: 5813237 - DNA, 17 bp, Homo sapiens
ttgtaaatctgaagaaa

SEQ ID NO: 5813238 - DNA, 12 bp, Homo sapiens
ttgtaaatctgt

SEQ ID NO: 5813239 - DNA, 24 bp, Homo sapiens
ttgtaaatctttgtgaacattctg

SEQ ID NO: 5813240 - DNA, 21 bp, Homo sapiens
ttgtaaatctttttgcttcta

SEQ ID NO: 5813241 - DNA, 18 bp, Homo sapiens
ttgtaaatgaaacttaag

SEQ ID NO: 5813242 - DNA, 14 bp, Homo sapiens
ttgtaaatgacttt

SEQ ID NO: 5813243 - DNA, 14 bp, Homo sapiens
ttgtaaatgatttt

SEQ ID NO: 5813244 - DNA, 17 bp, Homo sapiens
ttgtaaatgattttaat

SEQ ID NO: 5813245 - DNA, 20 bp, Homo sapiens
ttgtaaatgattttaatttt

SEQ ID NO: 5813246 - DNA, 16 bp, Homo sapiens
ttgtaaatgctattat

SEQ ID NO: 5813247 - DNA, 19 bp, Homo sapiens
ttgtaaatgctgtaaatat

SEQ ID NO: 5813248 - DNA, 13 bp, Homo sapiens
ttgtaaatgtact

SEQ ID NO: 5813249 - DNA, 23 bp, Homo sapiens
ttgtaaatgtactggtaattgta

SEQ ID NO: 5813250 - DNA, 12 bp, Homo sapiens
ttgtaaatgtta

SEQ ID NO: 5813251 - DNA, 14 bp, Homo sapiens
ttgtaaatgttatt

SEQ ID NO: 5813252 - DNA, 19 bp, Homo sapiens
ttgtaaatgttatttctgc

SEQ ID NO: 5813253 - DNA, 22 bp, Homo sapiens
ttgtaaatgtttcttttccctt

SEQ ID NO: 5813254 - DNA, 18 bp, Homo sapiens
ttgtaaattaacttttat

SEQ ID NO: 5813255 - DNA, 23 bp, Homo sapiens
ttgtaaattaatacttcatttgg

SEQ ID NO: 5813256 - DNA, 11 bp, Homo sapiens
ttgtaaattat

SEQ ID NO: 5813257 - DNA, 15 bp, Homo sapiens
ttgtaaattatttgc

SEQ ID NO: 5813258 - DNA, 22 bp, Homo sapiens
ttgtaaattatttgctaagcat

SEQ ID NO: 5813259 - DNA, 15 bp, Homo sapiens
ttgtaaattatttta

SEQ ID NO: 5813260 - DNA, 16 bp, Homo sapiens
ttgtaaattccccttc

SEQ ID NO: 5813261 - DNA, 17 bp, Homo sapiens
ttgtaaattccccttcc

SEQ ID NO: 5813262 - DNA, 15 bp, Homo sapiens
ttgtaaatttagtgt

SEQ ID NO: 5813263 - DNA, 16 bp, Homo sapiens
ttgtaaatttagtgtt

SEQ ID NO: 5813264 - DNA, 21 bp, Homo sapiens
ttgtaaatttggatttacgac

SEQ ID NO: 5813265 - DNA, 14 bp, Homo sapiens
ttgtaacaaattga

SEQ ID NO: 5813266 - DNA, 19 bp, Homo sapiens
ttgtaacacagtcattcta

SEQ ID NO: 5813267 - DNA, 14 bp, Homo sapiens
ttgtaacagacatt

SEQ ID NO: 5813268 - DNA, 15 bp, Homo sapiens
ttgtaacagacattg

SEQ ID NO: 5813269 - DNA, 16 bp, Homo sapiens
ttgtaacagacattgt

SEQ ID NO: 5813270 - DNA, 15 bp, Homo sapiens
ttgtaacattgtaaa

SEQ ID NO: 5813271 - DNA, 20 bp, Homo sapiens
ttgtaacattgtaaagtatg

SEQ ID NO: 5813272 - DNA, 21 bp, Homo sapiens
ttgtaaccagaattatacagt

SEQ ID NO: 5813273 - DNA, 23 bp, Homo sapiens
ttgtaaccagtgcagaaatgaaa

SEQ ID NO: 5813274 - DNA, 15 bp, Homo sapiens
ttgtaacctcagctc

SEQ ID NO: 5813275 - DNA, 18 bp, Homo sapiens
ttgtaacctcagctctgg

SEQ ID NO: 5813276 - DNA, 19 bp, Homo sapiens
ttgtaacctcagctctggg

SEQ ID NO: 5813277 - DNA, 20 bp, Homo sapiens
ttgtaacctcagctctggga

SEQ ID NO: 5813278 - DNA, 12 bp, Homo sapiens
ttgtaacctgct

SEQ ID NO: 5813279 - DNA, 19 bp, Homo sapiens
ttgtaacgttgctgtggga

SEQ ID NO: 5813280 - DNA, 12 bp, Homo sapiens
ttgtaactaaag

SEQ ID NO: 5813281 - DNA, 21 bp, Homo sapiens
ttgtaactaaagtatttaaag

SEQ ID NO: 5813282 - DNA, 22 bp, Homo sapiens
ttgtaactacaaagctttgcta

SEQ ID NO: 5813283 - DNA, 16 bp, Homo sapiens
ttgtaactattaacct

SEQ ID NO: 5813284 - DNA, 20 bp, Homo sapiens
ttgtaactattaaccttttt

SEQ ID NO: 5813285 - DNA, 12 bp, Homo sapiens
ttgtaactcaca

SEQ ID NO: 5813286 - DNA, 12 bp, Homo sapiens
ttgtaactcttt

SEQ ID NO: 5813287 - DNA, 21 bp, Homo sapiens
ttgtaactctttggctattgt

SEQ ID NO: 5813288 - DNA, 13 bp, Homo sapiens
ttgtaactgtaaa

SEQ ID NO: 5813289 - DNA, 14 bp, Homo sapiens
ttgtaacttagctt

SEQ ID NO: 5813290 - DNA, 19 bp, Homo sapiens
ttgtaacttatattgaaga

SEQ ID NO: 5813291 - DNA, 13 bp, Homo sapiens
ttgtaacttcaaa

SEQ ID NO: 5813292 - DNA, 14 bp, Homo sapiens
ttgtaacttcaaat

SEQ ID NO: 5813293 - DNA, 15 bp, Homo sapiens
ttgtaacttcaaata

SEQ ID NO: 5813294 - DNA, 16 bp, Homo sapiens
ttgtaacttcaaatat

SEQ ID NO: 5813295 - DNA, 19 bp, Homo sapiens
ttgtaacttgggctgtaaa

SEQ ID NO: 5813296 - DNA, 20 bp, Homo sapiens
ttgtaactttttacattaca

SEQ ID NO: 5813297 - DNA, 15 bp, Homo sapiens
ttgtaagaaaaccaa

SEQ ID NO: 5813298 - DNA, 23 bp, Homo sapiens
ttgtaagaaaaccaaaataaaaa

SEQ ID NO: 5813299 - DNA, 13 bp, Homo sapiens
ttgtaagaaggca

SEQ ID NO: 5813300 - DNA, 19 bp, Homo sapiens
ttgtaagaaggcaatatta

SEQ ID NO: 5813301 - DNA, 21 bp, Homo sapiens
ttgtaagacaaaggttttcct

SEQ ID NO: 5813302 - DNA, 21 bp, Homo sapiens
ttgtaagacacacagcctttc

SEQ ID NO: 5813303 - DNA, 17 bp, Homo sapiens
ttgtaagagctatacag

SEQ ID NO: 5813304 - DNA, 20 bp, Homo sapiens
ttgtaagagtggaaccaaca

SEQ ID NO: 5813305 - DNA, 22 bp, Homo sapiens
ttgtaagagtgtagaagcattc

SEQ ID NO: 5813306 - DNA, 20 bp, Homo sapiens
ttgtaagcaattctaagtga

SEQ ID NO: 5813307 - DNA, 22 bp, Homo sapiens
ttgtaagcatgcacaaattctg

SEQ ID NO: 5813308 - DNA, 18 bp, Homo sapiens
ttgtaagccagagtcaac

SEQ ID NO: 5813309 - DNA, 12 bp, Homo sapiens
ttgtaagccatc

SEQ ID NO: 5813310 - DNA, 14 bp, Homo sapiens
ttgtaagccatcag

SEQ ID NO: 5813311 - DNA, 18 bp, Homo sapiens
ttgtaagctcctcactgg

SEQ ID NO: 5813312 - DNA, 14 bp, Homo sapiens
ttgtaaggtactga

SEQ ID NO: 5813313 - DNA, 18 bp, Homo sapiens
ttgtaaggtattgcaagg

SEQ ID NO: 5813314 - DNA, 14 bp, Homo sapiens
ttgtaaggtctttg

SEQ ID NO: 5813315 - DNA, 17 bp, Homo sapiens
ttgtaaggtctttgtaa

SEQ ID NO: 5813316 - DNA, 19 bp, Homo sapiens
ttgtaagtaaactgccctg

SEQ ID NO: 5813317 - DNA, 16 bp, Homo sapiens
ttgtaagtaacacagt

SEQ ID NO: 5813318 - DNA, 21 bp, Homo sapiens
ttgtaagtataagaaatttta

SEQ ID NO: 5813319 - DNA, 19 bp, Homo sapiens
ttgtaagtcagtgttgaga

SEQ ID NO: 5813320 - DNA, 20 bp, Homo sapiens
ttgtaagtcagtgttgagat

SEQ ID NO: 5813321 - DNA, 13 bp, Homo sapiens
ttgtaagtttcag

SEQ ID NO: 5813322 - DNA, 18 bp, Homo sapiens
ttgtaagtttcaggtgac

SEQ ID NO: 5813323 - DNA, 19 bp, Homo sapiens
ttgtaataaaactatttgt

SEQ ID NO: 5813324 - DNA, 23 bp, Homo sapiens
ttgtaataaacccttaactggca

SEQ ID NO: 5813325 - DNA, 13 bp, Homo sapiens
ttgtaataaactc

SEQ ID NO: 5813326 - DNA, 16 bp, Homo sapiens
ttgtaataaactctct

SEQ ID NO: 5813327 - DNA, 20 bp, Homo sapiens
ttgtaataaagtatataatt

SEQ ID NO: 5813328 - DNA, 13 bp, Homo sapiens
ttgtaataagcaa

SEQ ID NO: 5813329 - DNA, 13 bp, Homo sapiens
ttgtaatacttta

SEQ ID NO: 5813330 - DNA, 16 bp, Homo sapiens
ttgtaatataagacaa

SEQ ID NO: 5813331 - DNA, 21 bp, Homo sapiens
ttgtaatatatcctgtttgta

SEQ ID NO: 5813332 - DNA, 19 bp, Homo sapiens
ttgtaatatcagttacagt

SEQ ID NO: 5813333 - DNA, 13 bp, Homo sapiens
ttgtaatatctaa

SEQ ID NO: 5813334 - DNA, 15 bp, Homo sapiens
ttgtaatatgtaaat

SEQ ID NO: 5813335 - DNA, 13 bp, Homo sapiens
ttgtaatattaaa

SEQ ID NO: 5813336 - DNA, 16 bp, Homo sapiens
ttgtaatattgaggga

SEQ ID NO: 5813337 - DNA, 15 bp, Homo sapiens
ttgtaatatttcttc

SEQ ID NO: 5813338 - DNA, 18 bp, Homo sapiens
ttgtaatcactcccattt

SEQ ID NO: 5813339 - DNA, 18 bp, Homo sapiens
ttgtaatctgcaaaatgt

SEQ ID NO: 5813340 - DNA, 18 bp, Homo sapiens
ttgtaatgaattcctaga

SEQ ID NO: 5813341 - DNA, 14 bp, Homo sapiens
ttgtaatgagcacc

SEQ ID NO: 5813342 - DNA, 22 bp, Homo sapiens
ttgtaatgattttggaactgtg

SEQ ID NO: 5813343 - DNA, 13 bp, Homo sapiens
ttgtaatgctgca

SEQ ID NO: 5813344 - DNA, 14 bp, Homo sapiens
ttgtaatgctgcac

SEQ ID NO: 5813345 - DNA, 16 bp, Homo sapiens
ttgtaatgctgcactt

SEQ ID NO: 5813346 - DNA, 16 bp, Homo sapiens
ttgtaatggtgaaaac

SEQ ID NO: 5813347 - DNA, 18 bp, Homo sapiens
ttgtaatggtgcttatta

SEQ ID NO: 5813348 - DNA, 13 bp, Homo sapiens
ttgtaatgtaact

SEQ ID NO: 5813349 - DNA, 14 bp, Homo sapiens
ttgtaatgtaactg

SEQ ID NO: 5813350 - DNA, 20 bp, Homo sapiens
ttgtaatgtaactgctcttg

SEQ ID NO: 5813351 - DNA, 23 bp, Homo sapiens
ttgtaatgttgtgaataattaca

SEQ ID NO: 5813352 - DNA, 15 bp, Homo sapiens
ttgtaattaaatttt

SEQ ID NO: 5813353 - DNA, 17 bp, Homo sapiens
ttgtaattaaattttta

SEQ ID NO: 5813354 - DNA, 11 bp, Homo sapiens
ttgtaattatg

SEQ ID NO: 5813355 - DNA, 12 bp, Homo sapiens
ttgtaattattg

SEQ ID NO: 5813356 - DNA, 21 bp, Homo sapiens
ttgtaattcctctagctacca

SEQ ID NO: 5813357 - DNA, 16 bp, Homo sapiens
ttgtaattcttcagtt

SEQ ID NO: 5813358 - DNA, 17 bp, Homo sapiens
ttgtaattcttcagttg

SEQ ID NO: 5813359 - DNA, 17 bp, Homo sapiens
ttgtaattgcttacatt

SEQ ID NO: 5813360 - DNA, 12 bp, Homo sapiens
ttgtaattgtgg

SEQ ID NO: 5813361 - DNA, 22 bp, Homo sapiens
ttgtaatttaaaaagtgctata

SEQ ID NO: 5813362 - DNA, 13 bp, Homo sapiens
ttgtccctgctcc

SEQ ID NO: 5813363 - DNA, 14 bp, Homo sapiens
ttgtccctgctcct

SEQ ID NO: 5813364 - DNA, 10 bp, Homo sapiens
ttgtccctgg

SEQ ID NO: 5813365 - DNA, 19 bp, Homo sapiens
ttgtccctggcttccttac

SEQ ID NO: 5813366 - DNA, 13 bp, Homo sapiens
ttgtccctggggc

SEQ ID NO: 5813367 - DNA, 16 bp, Homo sapiens
ttgtccctgtgttgtc

SEQ ID NO: 5813368 - DNA, 15 bp, Homo sapiens
ttgtcctaagtgtca

SEQ ID NO: 5813369 - DNA, 23 bp, Homo sapiens
ttgtcctagagtgagagtttgga

SEQ ID NO: 5813370 - DNA, 17 bp, Homo sapiens
ttgtcctattagtgtta

SEQ ID NO: 5813371 - DNA, 19 bp, Homo sapiens
ttgtcctattagtgttata

SEQ ID NO: 5813372 - DNA, 22 bp, Homo sapiens
ttgtcctcatgtgagaaagcag

SEQ ID NO: 5813373 - DNA, 16 bp, Homo sapiens
ttgtcctcccaggctc

SEQ ID NO: 5813374 - DNA, 19 bp, Homo sapiens
ttgtcctcccctattttaa

SEQ ID NO: 5813375 - DNA, 13 bp, Homo sapiens
ttgtcctcccctt

SEQ ID NO: 5813376 - DNA, 16 bp, Homo sapiens
ttgtcctcctgctgcc

SEQ ID NO: 5813377 - DNA, 15 bp, Homo sapiens
ttgtcctcttctgct

SEQ ID NO: 5813378 - DNA, 19 bp, Homo sapiens
ttgtcctgaatggctttgt

SEQ ID NO: 5813379 - DNA, 18 bp, Homo sapiens
ttgtcctgatttcttatt

SEQ ID NO: 5813380 - DNA, 13 bp, Homo sapiens
ttgtcctgccagc

SEQ ID NO: 5813381 - DNA, 18 bp, Homo sapiens
ttgtcctgccagctgcct

SEQ ID NO: 5813382 - DNA, 14 bp, Homo sapiens
ttgtcctgcctctt

SEQ ID NO: 5813383 - DNA, 13 bp, Homo sapiens
ttgtcctggccct

SEQ ID NO: 5813384 - DNA, 17 bp, Homo sapiens
ttgtcctgggcctgccc

SEQ ID NO: 5813385 - DNA, 18 bp, Homo sapiens
ttgtcctgggttctgggg

SEQ ID NO: 5813386 - DNA, 20 bp, Homo sapiens
ttgtcctgggttctggggca

SEQ ID NO: 5813387 - DNA, 13 bp, Homo sapiens
ttgtcctgtagct

SEQ ID NO: 5813388 - DNA, 15 bp, Homo sapiens
ttgtcctgtgaaata

SEQ ID NO: 5813389 - DNA, 19 bp, Homo sapiens
ttgtcctgtttcttcatat

SEQ ID NO: 5813390 - DNA, 16 bp, Homo sapiens
ttgtccttcagagctc

SEQ ID NO: 5813391 - DNA, 15 bp, Homo sapiens
ttgtccttgaaagta

SEQ ID NO: 5813392 - DNA, 21 bp, Homo sapiens
ttgtccttgaagcttgtatct

SEQ ID NO: 5813393 - DNA, 14 bp, Homo sapiens
ttgtccttgctggt

SEQ ID NO: 5813394 - DNA, 18 bp, Homo sapiens
ttgtcctttatgtattct

SEQ ID NO: 5813395 - DNA, 17 bp, Homo sapiens
ttgtcctttgagaaaga

SEQ ID NO: 5813396 - DNA, 19 bp, Homo sapiens
ttgtccttttgcaaagaaa

SEQ ID NO: 5813397 - DNA, 18 bp, Homo sapiens
ttgtcctttttcaggaga

SEQ ID NO: 5813398 - DNA, 19 bp, Homo sapiens
ttgtcgcgcgtctcccatc

SEQ ID NO: 5813399 - DNA, 21 bp, Homo sapiens
ttgtcggccccaccagtgcct

SEQ ID NO: 5813400 - DNA, 20 bp, Homo sapiens
ttgtcggctccagtccccag

SEQ ID NO: 5813401 - DNA, 17 bp, Homo sapiens
ttgtcgtaaagatttgg

SEQ ID NO: 5813402 - DNA, 14 bp, Homo sapiens
ttgtcgtttttagc

SEQ ID NO: 5813403 - DNA, 13 bp, Homo sapiens
ttgtctaaagatc

SEQ ID NO: 5813404 - DNA, 13 bp, Homo sapiens
ttgtctaagaaat

SEQ ID NO: 5813405 - DNA, 19 bp, Homo sapiens
ttgtctacaccattatgtg

SEQ ID NO: 5813406 - DNA, 20 bp, Homo sapiens
ttgtctacaccattatgtgc

SEQ ID NO: 5813407 - DNA, 22 bp, Homo sapiens
ttgtctacagctccagatgttt

SEQ ID NO: 5813408 - DNA, 19 bp, Homo sapiens
ttgtctactcctagaagaa

SEQ ID NO: 5813409 - DNA, 15 bp, Homo sapiens
ttgtctagtgaaact

SEQ ID NO: 5813410 - DNA, 21 bp, Homo sapiens
ttgtctatgaagttgctgttt

SEQ ID NO: 5813411 - DNA, 18 bp, Homo sapiens
ttgtctattacctgttag

SEQ ID NO: 5813412 - DNA, 15 bp, Homo sapiens
ttgtctattctccag

SEQ ID NO: 5813413 - DNA, 16 bp, Homo sapiens
ttgtctattctgagcc

SEQ ID NO: 5813414 - DNA, 23 bp, Homo sapiens
ttgtctcaacgcctccccctccc

SEQ ID NO: 5813415 - DNA, 18 bp, Homo sapiens
ttgtctcaatgctcataa

SEQ ID NO: 5813416 - DNA, 17 bp, Homo sapiens
ttgtctcacgattccag

SEQ ID NO: 5813417 - DNA, 20 bp, Homo sapiens
ttgtctcacgattccagtgc

SEQ ID NO: 5813418 - DNA, 13 bp, Homo sapiens
ttgtctcactttt

SEQ ID NO: 5813419 - DNA, 11 bp, Homo sapiens
ttgtctcagaa

SEQ ID NO: 5813420 - DNA, 11 bp, Homo sapiens
ttgtctcagat

SEQ ID NO: 5813421 - DNA, 13 bp, Homo sapiens
ttgtctcagattt

SEQ ID NO: 5813422 - DNA, 22 bp, Homo sapiens
ttgtctcagattttattatgta

SEQ ID NO: 5813423 - DNA, 14 bp, Homo sapiens
ttgtctcattgcca

SEQ ID NO: 5813424 - DNA, 16 bp, Homo sapiens
ttgtctcattgccagt

SEQ ID NO: 5813425 - DNA, 15 bp, Homo sapiens
ttgtctccaaagaag

SEQ ID NO: 5813426 - DNA, 17 bp, Homo sapiens
ttgtctccaaagaagat

SEQ ID NO: 5813427 - DNA, 23 bp, Homo sapiens
ttgtctccactaaatgagctcct

SEQ ID NO: 5813428 - DNA, 22 bp, Homo sapiens
ttgtctcccctgttcccctctc

SEQ ID NO: 5813429 - DNA, 23 bp, Homo sapiens
ttgtctcccctgttcccctctcc

SEQ ID NO: 5813430 - DNA, 12 bp, Homo sapiens
ttgtctccctgg

SEQ ID NO: 5813431 - DNA, 21 bp, Homo sapiens
ttgtctccctggcaaggagaa

SEQ ID NO: 5813432 - DNA, 14 bp, Homo sapiens
ttgtctccctggcc

SEQ ID NO: 5813433 - DNA, 17 bp, Homo sapiens
ttgtctccctggccctc

SEQ ID NO: 5813434 - DNA, 23 bp, Homo sapiens
ttgtctccctggttgcctctctt

SEQ ID NO: 5813435 - DNA, 16 bp, Homo sapiens
ttgtctcctaaattgt

SEQ ID NO: 5813436 - DNA, 22 bp, Homo sapiens
ttgtctcctaaattgttgtaat

SEQ ID NO: 5813437 - DNA, 23 bp, Homo sapiens
ttgtctcctacctgctgctgcta

SEQ ID NO: 5813438 - DNA, 16 bp, Homo sapiens
ttgtctcctactctgt

SEQ ID NO: 5813439 - DNA, 15 bp, Homo sapiens
ttgtctcctcccagg

SEQ ID NO: 5813440 - DNA, 19 bp, Homo sapiens
ttgtctcctttctgactgt

SEQ ID NO: 5813441 - DNA, 16 bp, Homo sapiens
ttgtctctcctggctg

SEQ ID NO: 5813442 - DNA, 16 bp, Homo sapiens
ttgtctctccttttct

SEQ ID NO: 5813443 - DNA, 22 bp, Homo sapiens
ttgtctctccttttcttttgtt

SEQ ID NO: 5813444 - DNA, 17 bp, Homo sapiens
ttgtctctgatgcagct

SEQ ID NO: 5813445 - DNA, 20 bp, Homo sapiens
ttgtctctgcaaactgcctt

SEQ ID NO: 5813446 - DNA, 24 bp, Homo sapiens
ttgtctctgttggtccactgtgtt

SEQ ID NO: 5813447 - DNA, 12 bp, Homo sapiens
ttgtctctgttt

SEQ ID NO: 5813448 - DNA, 16 bp, Homo sapiens
ttgtctcttacatctc

SEQ ID NO: 5813449 - DNA, 22 bp, Homo sapiens
ttgtctgaaaagtgaagacaga

SEQ ID NO: 5813450 - DNA, 17 bp, Homo sapiens
ttgtctgaaacatttca

SEQ ID NO: 5813451 - DNA, 16 bp, Homo sapiens
ttgtctgaaattttct

SEQ ID NO: 5813452 - DNA, 15 bp, Homo sapiens
ttgtctgaacccagg

SEQ ID NO: 5813453 - DNA, 18 bp, Homo sapiens
ttgtctgaagtcactgca

SEQ ID NO: 5813454 - DNA, 18 bp, Homo sapiens
ttgtctgaatgtatttat

SEQ ID NO: 5813455 - DNA, 12 bp, Homo sapiens
ttgtctgagcct

SEQ ID NO: 5813456 - DNA, 13 bp, Homo sapiens
ttgtctgaggcct

SEQ ID NO: 5813457 - DNA, 19 bp, Homo sapiens
ttgtctgaggcctcatccc

SEQ ID NO: 5813458 - DNA, 23 bp, Homo sapiens
ttgtctgatttttaaagtacttt

SEQ ID NO: 5813459 - DNA, 14 bp, Homo sapiens
ttgtctgcagctgt

SEQ ID NO: 5813460 - DNA, 20 bp, Homo sapiens
ttgtctgccccaagttttgt

SEQ ID NO: 5813461 - DNA, 14 bp, Homo sapiens
ttgtctgcctcctg

SEQ ID NO: 5813462 - DNA, 19 bp, Homo sapiens
ttgtctgcctcctgctttg

SEQ ID NO: 5813463 - DNA, 15 bp, Homo sapiens
ttgtctgcgcctgaa

SEQ ID NO: 5813464 - DNA, 12 bp, Homo sapiens
ttgtctgctgct

SEQ ID NO: 5813465 - DNA, 17 bp, Homo sapiens
ttgtctggatgcacact

SEQ ID NO: 5813466 - DNA, 20 bp, Homo sapiens
ttgtctggcaaggactttgt

SEQ ID NO: 5813467 - DNA, 13 bp, Homo sapiens
ttgtctggcctca

SEQ ID NO: 5813468 - DNA, 16 bp, Homo sapiens
ttgtctgggaattgtg

SEQ ID NO: 5813469 - DNA, 16 bp, Homo sapiens
ttgtctgggattgttt

SEQ ID NO: 5813470 - DNA, 23 bp, Homo sapiens
ttgtctgtaaaaaatgtatgcta

SEQ ID NO: 5813471 - DNA, 16 bp, Homo sapiens
ttgtctgtacatactg

SEQ ID NO: 5813472 - DNA, 22 bp, Homo sapiens
ttgtctgtacatactggcctct

SEQ ID NO: 5813473 - DNA, 16 bp, Homo sapiens
ttgtctgtcaaatgtt

SEQ ID NO: 5813474 - DNA, 22 bp, Homo sapiens
ttgtctgtcaaatgtttcctta

SEQ ID NO: 5813475 - DNA, 17 bp, Homo sapiens
ttgtctgtccaggccct

SEQ ID NO: 5813476 - DNA, 13 bp, Homo sapiens
ttgtctgtcctgg

SEQ ID NO: 5813477 - DNA, 18 bp, Homo sapiens
ttgtctgtctacatttct

SEQ ID NO: 5813478 - DNA, 17 bp, Homo sapiens
ttgtctgtgatctctgc

SEQ ID NO: 5813479 - DNA, 19 bp, Homo sapiens
ttgtctgtgcatccggggg

SEQ ID NO: 5813480 - DNA, 11 bp, Homo sapiens
ttgtctgtgtg

SEQ ID NO: 5813481 - DNA, 13 bp, Homo sapiens
ttgtctgtgtgct

SEQ ID NO: 5813482 - DNA, 19 bp, Homo sapiens
ttgtctgtgttgctgttta

SEQ ID NO: 5813483 - DNA, 21 bp, Homo sapiens
ttgtctgtgttgctgtttaga

SEQ ID NO: 5813484 - DNA, 22 bp, Homo sapiens
ttgtctgtgttttcttcttgtg

SEQ ID NO: 5813485 - DNA, 18 bp, Homo sapiens
ttgtctgttggcaaattt

SEQ ID NO: 5813486 - DNA, 17 bp, Homo sapiens
ttgtctgtttgtttcaa

SEQ ID NO: 5813487 - DNA, 20 bp, Homo sapiens
ttgtctgtttgtttcaagaa

SEQ ID NO: 5813488 - DNA, 21 bp, Homo sapiens
ttgtctgttttccttcttccc

SEQ ID NO: 5813489 - DNA, 23 bp, Homo sapiens
ttgtcttaagatggaaatacagt

SEQ ID NO: 5813490 - DNA, 17 bp, Homo sapiens
ttgtcttaatattgtgg

SEQ ID NO: 5813491 - DNA, 17 bp, Homo sapiens
ttgtcttaatggatgaa

SEQ ID NO: 5813492 - DNA, 19 bp, Homo sapiens
ttgtcttaatggatgaaat

SEQ ID NO: 5813493 - DNA, 16 bp, Homo sapiens
ttgtcttagagagaga

SEQ ID NO: 5813494 - DNA, 16 bp, Homo sapiens
ttgtcttataaacaaa

SEQ ID NO: 5813495 - DNA, 20 bp, Homo sapiens
ttgtcttatgtgaaaaatta

SEQ ID NO: 5813496 - DNA, 13 bp, Homo sapiens
ttgtcttattcct

SEQ ID NO: 5813497 - DNA, 13 bp, Homo sapiens
ttgtcttattctt

SEQ ID NO: 5813498 - DNA, 12 bp, Homo sapiens
ttgtcttccaac

SEQ ID NO: 5813499 - DNA, 13 bp, Homo sapiens
ttgtcttccaacc

SEQ ID NO: 5813500 - DNA, 14 bp, Homo sapiens
ttgtcttcccccct

SEQ ID NO: 5813501 - DNA, 15 bp, Homo sapiens
ttgtcttcccccctc

SEQ ID NO: 5813502 - DNA, 19 bp, Homo sapiens
ttgtcttcccccctctcct

SEQ ID NO: 5813503 - DNA, 23 bp, Homo sapiens
ttgtcttcccttctttgcacttt

SEQ ID NO: 5813504 - DNA, 12 bp, Homo sapiens
ttgtcttgaaaa

SEQ ID NO: 5813505 - DNA, 14 bp, Homo sapiens
ttgtcttgaaagat

SEQ ID NO: 5813506 - DNA, 15 bp, Homo sapiens
ttgtcttgaatgtct

SEQ ID NO: 5813507 - DNA, 22 bp, Homo sapiens
ttgtcttgaatgtcttttgaat

SEQ ID NO: 5813508 - DNA, 16 bp, Homo sapiens
ttgtcttgatgttttt

SEQ ID NO: 5813509 - DNA, 13 bp, Homo sapiens
ttgtcttgcattt

SEQ ID NO: 5813510 - DNA, 14 bp, Homo sapiens
ttgtcttgcatttt

SEQ ID NO: 5813511 - DNA, 14 bp, Homo sapiens
ttgtcttgtacttc

SEQ ID NO: 5813512 - DNA, 16 bp, Homo sapiens
ttgtcttgtacttctg

SEQ ID NO: 5813513 - DNA, 14 bp, Homo sapiens
ttgtcttgttctgt

SEQ ID NO: 5813514 - DNA, 13 bp, Homo sapiens
ttgtctttatatg

SEQ ID NO: 5813515 - DNA, 23 bp, Homo sapiens
ttgtctttatgagctaaaaatat

SEQ ID NO: 5813516 - DNA, 12 bp, Homo sapiens
ttgtctttcaaa

SEQ ID NO: 5813517 - DNA, 17 bp, Homo sapiens
ttgtctttcaaaagaca

SEQ ID NO: 5813518 - DNA, 17 bp, Homo sapiens
ttgtctttctgcagaaa

SEQ ID NO: 5813519 - DNA, 19 bp, Homo sapiens
ttgtctttctgcagaaaat

SEQ ID NO: 5813520 - DNA, 12 bp, Homo sapiens
ttgtctttctgg

SEQ ID NO: 5813521 - DNA, 11 bp, Homo sapiens
ttgtctttctt

SEQ ID NO: 5813522 - DNA, 13 bp, Homo sapiens
ttgtctttctttg

SEQ ID NO: 5813523 - DNA, 14 bp, Homo sapiens
ttgtctttgaacgt

SEQ ID NO: 5813524 - DNA, 20 bp, Homo sapiens
ttgtctttggaccctgaggc

SEQ ID NO: 5813525 - DNA, 24 bp, Homo sapiens
ttgtctttggaccctgaggcccag

SEQ ID NO: 5813526 - DNA, 19 bp, Homo sapiens
ttgtcttttaatgcttcat

SEQ ID NO: 5813527 - DNA, 20 bp, Homo sapiens
ttgtcttttagacaactaga

SEQ ID NO: 5813528 - DNA, 20 bp, Homo sapiens
ttgtcttttcaagtaatttt

SEQ ID NO: 5813529 - DNA, 22 bp, Homo sapiens
ttgtcttttcaatcttctactt

SEQ ID NO: 5813530 - DNA, 13 bp, Homo sapiens
ttgtcttttcaga

SEQ ID NO: 5813531 - DNA, 14 bp, Homo sapiens
ttgtcttttcccct

SEQ ID NO: 5813532 - DNA, 16 bp, Homo sapiens
ttgtcttttctgctga

SEQ ID NO: 5813533 - DNA, 14 bp, Homo sapiens
ttgtctttttataa

SEQ ID NO: 5813534 - DNA, 17 bp, Homo sapiens
ttgtctttttataaaaa

SEQ ID NO: 5813535 - DNA, 12 bp, Homo sapiens
ttgtctttttcc

SEQ ID NO: 5813536 - DNA, 14 bp, Homo sapiens
ttgtctttttccta

SEQ ID NO: 5813537 - DNA, 20 bp, Homo sapiens
ttgtcttttttttcatcctt

SEQ ID NO: 5813538 - DNA, 20 bp, Homo sapiens
ttgtgaaaaaatttacttta

SEQ ID NO: 5813539 - DNA, 19 bp, Homo sapiens
ttgtgaaaagagtatgtag

SEQ ID NO: 5813540 - DNA, 23 bp, Homo sapiens
ttgtgaaaatgaatatcatgcaa

SEQ ID NO: 5813541 - DNA, 22 bp, Homo sapiens
ttgtgttctgttgaaggtgcca

SEQ ID NO: 5813542 - DNA, 13 bp, Homo sapiens
ttgtgttgaagaa

SEQ ID NO: 5813543 - DNA, 17 bp, Homo sapiens
ttgtgttgaaggaactt

SEQ ID NO: 5813544 - DNA, 16 bp, Homo sapiens
ttgtgttgacattaag

SEQ ID NO: 5813545 - DNA, 19 bp, Homo sapiens
ttgtgttgggggaaatgtt

SEQ ID NO: 5813546 - DNA, 19 bp, Homo sapiens
ttgtgttggtatttactgc

SEQ ID NO: 5813547 - DNA, 14 bp, Homo sapiens
ttgtgttgtaattc

SEQ ID NO: 5813548 - DNA, 21 bp, Homo sapiens
ttgtgttgtaattcttcagtt

SEQ ID NO: 5813549 - DNA, 11 bp, Homo sapiens
ttgtgttgtac

SEQ ID NO: 5813550 - DNA, 21 bp, Homo sapiens
ttgtgttgttgttgctgctgt

SEQ ID NO: 5813551 - DNA, 12 bp, Homo sapiens
ttgtgtttacat

SEQ ID NO: 5813552 - DNA, 13 bp, Homo sapiens
ttgtgtttagatt

SEQ ID NO: 5813553 - DNA, 23 bp, Homo sapiens
ttgtgtttagctacctttttata

SEQ ID NO: 5813554 - DNA, 13 bp, Homo sapiens
ttgtgtttatgaa

SEQ ID NO: 5813555 - DNA, 16 bp, Homo sapiens
ttgtgtttattcttga

SEQ ID NO: 5813556 - DNA, 20 bp, Homo sapiens
ttgtgtttctcgtgctgcat

SEQ ID NO: 5813557 - DNA, 14 bp, Homo sapiens
ttgtgtttgaaaca

SEQ ID NO: 5813558 - DNA, 11 bp, Homo sapiens
ttgtgtttgct

SEQ ID NO: 5813559 - DNA, 17 bp, Homo sapiens
ttgtgtttgcttaaaca

SEQ ID NO: 5813560 - DNA, 20 bp, Homo sapiens
ttgtgtttgcttaaacaaag

SEQ ID NO: 5813561 - DNA, 15 bp, Homo sapiens
ttgtgtttggatttg

SEQ ID NO: 5813562 - DNA, 16 bp, Homo sapiens
ttgtgtttggttcaat

SEQ ID NO: 5813563 - DNA, 16 bp, Homo sapiens
ttgtgtttggtttaca

SEQ ID NO: 5813564 - DNA, 18 bp, Homo sapiens
ttgtgttttaaaaaaact

SEQ ID NO: 5813565 - DNA, 22 bp, Homo sapiens
ttgtgttttaaaaaaactgaag

SEQ ID NO: 5813566 - DNA, 17 bp, Homo sapiens
ttgtgttttactgtcag

SEQ ID NO: 5813567 - DNA, 18 bp, Homo sapiens
ttgtgttttgcaagccag

SEQ ID NO: 5813568 - DNA, 17 bp, Homo sapiens
ttgtgtttttaatttat

SEQ ID NO: 5813569 - DNA, 21 bp, Homo sapiens
ttgtgttttttaagatagtgt

SEQ ID NO: 5813570 - DNA, 18 bp, Homo sapiens
ttgtgttttttttccttt

SEQ ID NO: 5813571 - DNA, 13 bp, Homo sapiens
ttgttaaaaataa

SEQ ID NO: 5813572 - DNA, 17 bp, Homo sapiens
ttgttaaaaatattttc

SEQ ID NO: 5813573 - DNA, 20 bp, Homo sapiens
ttgttaaaacacaaaatgaa

SEQ ID NO: 5813574 - DNA, 14 bp, Homo sapiens
ttgttaaaactggc

SEQ ID NO: 5813575 - DNA, 16 bp, Homo sapiens
ttgttaaaataactag

SEQ ID NO: 5813576 - DNA, 20 bp, Homo sapiens
ttgttaaaattatgaatctg

SEQ ID NO: 5813577 - DNA, 16 bp, Homo sapiens
ttgttaaacaaatgat

SEQ ID NO: 5813578 - DNA, 12 bp, Homo sapiens
ttgttaaacacg

SEQ ID NO: 5813579 - DNA, 12 bp, Homo sapiens
ttgttaaatgct

SEQ ID NO: 5813580 - DNA, 11 bp, Homo sapiens
ttgttaaatgt

SEQ ID NO: 5813581 - DNA, 19 bp, Homo sapiens
ttgttaaatgtatacacca

SEQ ID NO: 5813582 - DNA, 20 bp, Homo sapiens
ttgttaacaatggcaggttt

SEQ ID NO: 5813583 - DNA, 13 bp, Homo sapiens
ttgttaacagagc

SEQ ID NO: 5813584 - DNA, 17 bp, Homo sapiens
ttgttaaccacagctgt

SEQ ID NO: 5813585 - DNA, 14 bp, Homo sapiens
ttgttaaccttaaa

SEQ ID NO: 5813586 - DNA, 18 bp, Homo sapiens
ttgttaaccttaaataca

SEQ ID NO: 5813587 - DNA, 16 bp, Homo sapiens
ttgttaacctttctaa

SEQ ID NO: 5813588 - DNA, 18 bp, Homo sapiens
ttgttaacctttctaacc

SEQ ID NO: 5813589 - DNA, 14 bp, Homo sapiens
ttgttaagaaaaat

SEQ ID NO: 5813590 - DNA, 17 bp, Homo sapiens
ttgttaagagtatcatg

SEQ ID NO: 5813591 - DNA, 18 bp, Homo sapiens
ttgttaagggcattttta

SEQ ID NO: 5813592 - DNA, 22 bp, Homo sapiens
ttgttaagtctaaatatttcct

SEQ ID NO: 5813593 - DNA, 21 bp, Homo sapiens
ttgttaataaaagtacatgtt

SEQ ID NO: 5813594 - DNA, 15 bp, Homo sapiens
ttgttaatacaaggt

SEQ ID NO: 5813595 - DNA, 19 bp, Homo sapiens
ttgttaatatatataatac

SEQ ID NO: 5813596 - DNA, 18 bp, Homo sapiens
ttgttaatatcactcatt

SEQ ID NO: 5813597 - DNA, 20 bp, Homo sapiens
ttgttaatatcactcattaa

SEQ ID NO: 5813598 - DNA, 22 bp, Homo sapiens
ttgttaatctctgttatgtact

SEQ ID NO: 5813599 - DNA, 17 bp, Homo sapiens
ttgttaatgaaaatgat

SEQ ID NO: 5813600 - DNA, 16 bp, Homo sapiens
ttgttaatgcattgtt

SEQ ID NO: 5813601 - DNA, 23 bp, Homo sapiens
ttgttaatgcattgttgtaaagt

SEQ ID NO: 5813602 - DNA, 11 bp, Homo sapiens
ttgttaatgtt

SEQ ID NO: 5813603 - DNA, 21 bp, Homo sapiens
ttgttaatttagaaaacttta

SEQ ID NO: 5813604 - DNA, 20 bp, Homo sapiens
ttgttaatttatctgttgtc

SEQ ID NO: 5813605 - DNA, 12 bp, Homo sapiens
ttgttaatttct

SEQ ID NO: 5813606 - DNA, 14 bp, Homo sapiens
ttgttacaagtgtt

SEQ ID NO: 5813607 - DNA, 21 bp, Homo sapiens
ttgttacataaggatgacttt

SEQ ID NO: 5813608 - DNA, 22 bp, Homo sapiens
ttgttacatagaaagagtctga

SEQ ID NO: 5813609 - DNA, 22 bp, Homo sapiens
ttgttaccaaatacacatttca

SEQ ID NO: 5813610 - DNA, 12 bp, Homo sapiens
ttgttacccatg

SEQ ID NO: 5813611 - DNA, 16 bp, Homo sapiens
ttgttacccatttgaa

SEQ ID NO: 5813612 - DNA, 24 bp, Homo sapiens
ttgttaccttaaaactaggcattt

SEQ ID NO: 5813613 - DNA, 21 bp, Homo sapiens
ttgttactagagttagatatg

SEQ ID NO: 5813614 - DNA, 18 bp, Homo sapiens
ttgttactccctgttatt

SEQ ID NO: 5813615 - DNA, 17 bp, Homo sapiens
ttgttactctggttctt

SEQ ID NO: 5813616 - DNA, 15 bp, Homo sapiens
ttgttactgcctgga

SEQ ID NO: 5813617 - DNA, 19 bp, Homo sapiens
ttgttactgctgattcttg

SEQ ID NO: 5813618 - DNA, 24 bp, Homo sapiens
ttgttactgctgattcttgtaaat

SEQ ID NO: 5813619 - DNA, 10 bp, Homo sapiens
ttgttactgt

SEQ ID NO: 5813620 - DNA, 15 bp, Homo sapiens
ttgttactgtatcct

SEQ ID NO: 5813621 - DNA, 13 bp, Homo sapiens
ttgttactgtcca

SEQ ID NO: 5813622 - DNA, 19 bp, Homo sapiens
ttgttactgtctgtagtgt

SEQ ID NO: 5813623 - DNA, 12 bp, Homo sapiens
ttgttactgttc

SEQ ID NO: 5813624 - DNA, 13 bp, Homo sapiens
ttgttactgttct

SEQ ID NO: 5813625 - DNA, 13 bp, Homo sapiens
ttgttacttgcag

SEQ ID NO: 5813626 - DNA, 14 bp, Homo sapiens
ttgttactttaggt

SEQ ID NO: 5813627 - DNA, 12 bp, Homo sapiens
ttgttactttga

SEQ ID NO: 5813628 - DNA, 14 bp, Homo sapiens
ttgttactttgaat

SEQ ID NO: 5813629 - DNA, 15 bp, Homo sapiens
ttgttactttgaata

SEQ ID NO: 5813630 - DNA, 19 bp, Homo sapiens
ttgttagagaaaaatgctt

SEQ ID NO: 5813631 - DNA, 21 bp, Homo sapiens
ttgttagggctgcttttctta

SEQ ID NO: 5813632 - DNA, 23 bp, Homo sapiens
ttgttagggctgcttttcttaag

SEQ ID NO: 5813633 - DNA, 19 bp, Homo sapiens
ttgttagggtcagccattt

SEQ ID NO: 5813634 - DNA, 16 bp, Homo sapiens
ttgttaggttacagat

SEQ ID NO: 5813635 - DNA, 12 bp, Homo sapiens
ttgttagtttac

SEQ ID NO: 5813636 - DNA, 22 bp, Homo sapiens
ttgttagtttcttttattttca

SEQ ID NO: 5813637 - DNA, 16 bp, Homo sapiens
ttgttataattagagt

SEQ ID NO: 5813638 - DNA, 17 bp, Homo sapiens
ttgttatagattgtctt

SEQ ID NO: 5813639 - DNA, 13 bp, Homo sapiens
ttgttatataatc

SEQ ID NO: 5813640 - DNA, 16 bp, Homo sapiens
ttgttatataatcatt

SEQ ID NO: 5813641 - DNA, 15 bp, Homo sapiens
ttgttatatataata

SEQ ID NO: 5813642 - DNA, 20 bp, Homo sapiens
ttgttatatataataaatac

SEQ ID NO: 5813643 - DNA, 13 bp, Homo sapiens
ttgttatattata

SEQ ID NO: 5813644 - DNA, 15 bp, Homo sapiens
ttgttatattgtcct

SEQ ID NO: 5813645 - DNA, 14 bp, Homo sapiens
ttgttatcaaaata

SEQ ID NO: 5813646 - DNA, 16 bp, Homo sapiens
ttgttatcaaaatagt

SEQ ID NO: 5813647 - DNA, 16 bp, Homo sapiens
ttgttatcagtacaat

SEQ ID NO: 5813648 - DNA, 16 bp, Homo sapiens
ttgttatcagtcaata

SEQ ID NO: 5813649 - DNA, 14 bp, Homo sapiens
ttgttatcatttaa

SEQ ID NO: 5813650 - DNA, 13 bp, Homo sapiens
ttgttatctgttt

SEQ ID NO: 5813651 - DNA, 19 bp, Homo sapiens
ttgttatgataaaaggaag

SEQ ID NO: 5813652 - DNA, 18 bp, Homo sapiens
ttgttatgatgtgcttaa

SEQ ID NO: 5813653 - DNA, 14 bp, Homo sapiens
ttgttatgctatta

SEQ ID NO: 5813654 - DNA, 15 bp, Homo sapiens
ttgttatgtaaaact

SEQ ID NO: 5813655 - DNA, 22 bp, Homo sapiens
ttgttatgtaaacatcataaat

SEQ ID NO: 5813656 - DNA, 16 bp, Homo sapiens
ttgttatgtacaaact

SEQ ID NO: 5813657 - DNA, 17 bp, Homo sapiens
ttgttatgtacaaacta

SEQ ID NO: 5813658 - DNA, 21 bp, Homo sapiens
ttgttatgtatatagatgtgc

SEQ ID NO: 5813659 - DNA, 20 bp, Homo sapiens
ttgttatgtctagaaagtaa

SEQ ID NO: 5813660 - DNA, 19 bp, Homo sapiens
ttgttatgtgtctggaaga

SEQ ID NO: 5813661 - DNA, 15 bp, Homo sapiens
ttgttattaaatgta

SEQ ID NO: 5813662 - DNA, 14 bp, Homo sapiens
ttgttattaatgtt

SEQ ID NO: 5813663 - DNA, 22 bp, Homo sapiens
ttgttattacatccttgtggca

SEQ ID NO: 5813664 - DNA, 21 bp, Homo sapiens
ttgttattattagataatatt

SEQ ID NO: 5813665 - DNA, 17 bp, Homo sapiens
ttgttattcttttccag

SEQ ID NO: 5813666 - DNA, 19 bp, Homo sapiens
ttgttattgatgttgctgt

SEQ ID NO: 5813667 - DNA, 12 bp, Homo sapiens
ttgttattgtga

SEQ ID NO: 5813668 - DNA, 14 bp, Homo sapiens
ttgttatttataac

SEQ ID NO: 5813669 - DNA, 20 bp, Homo sapiens
ttgttatttattgaaatgat

SEQ ID NO: 5813670 - DNA, 15 bp, Homo sapiens
ttgttatttgtacag

SEQ ID NO: 5813671 - DNA, 15 bp, Homo sapiens
ttgttatttttaatc

SEQ ID NO: 5813672 - DNA, 20 bp, Homo sapiens
ttgttcaaaatatgttcttt

SEQ ID NO: 5813673 - DNA, 16 bp, Homo sapiens
ttgttcaaacaatatc

SEQ ID NO: 5813674 - DNA, 17 bp, Homo sapiens
ttgttcaaacaatatca

SEQ ID NO: 5813675 - DNA, 14 bp, Homo sapiens
ttgttcaacagttt

SEQ ID NO: 5813676 - DNA, 16 bp, Homo sapiens
ttgttcaacagtttct

SEQ ID NO: 5813677 - DNA, 13 bp, Homo sapiens
ttgttcaagtttt

SEQ ID NO: 5813678 - DNA, 17 bp, Homo sapiens
ttgttcacacaaagcct

SEQ ID NO: 5813679 - DNA, 14 bp, Homo sapiens
ttgttcacactcct

SEQ ID NO: 5813680 - DNA, 19 bp, Homo sapiens
ttgttcaccattataatga

SEQ ID NO: 5813681 - DNA, 15 bp, Homo sapiens
ttgttcactgaaggt

SEQ ID NO: 5813682 - DNA, 21 bp, Homo sapiens
ttgttcactgaaggtgattca

SEQ ID NO: 5813683 - DNA, 19 bp, Homo sapiens
ttgttcacttctaaaccaa

SEQ ID NO: 5813684 - DNA, 13 bp, Homo sapiens
ttgttcagctccc

SEQ ID NO: 5813685 - DNA, 22 bp, Homo sapiens
ttgttcagctcccccaggctgt

SEQ ID NO: 5813686 - DNA, 12 bp, Homo sapiens
ttgttcataata

SEQ ID NO: 5813687 - DNA, 17 bp, Homo sapiens
ttgttcatcatccagat

SEQ ID NO: 5813688 - DNA, 21 bp, Homo sapiens
ttgttcatgttaccaaagcaa

SEQ ID NO: 5813689 - DNA, 18 bp, Homo sapiens
ttgttcatgttttgctaa

SEQ ID NO: 5813690 - DNA, 18 bp, Homo sapiens
ttgttcattcttgttcaa

SEQ ID NO: 5813691 - DNA, 21 bp, Homo sapiens
ttgttcatttcatcctttcac

SEQ ID NO: 5813692 - DNA, 17 bp, Homo sapiens
ttgttcattttgagtat

SEQ ID NO: 5813693 - DNA, 15 bp, Homo sapiens
ttgttcatttttctc

SEQ ID NO: 5813694 - DNA, 16 bp, Homo sapiens
ttgttccaagacattg

SEQ ID NO: 5813695 - DNA, 21 bp, Homo sapiens
ttgttccacaagttaaataaa

SEQ ID NO: 5813696 - DNA, 19 bp, Homo sapiens
ttgttccagagctgcttct

SEQ ID NO: 5813697 - DNA, 23 bp, Homo sapiens
ttgttccataataaacttctggt

SEQ ID NO: 5813698 - DNA, 12 bp, Homo sapiens
ttgttcccacac

SEQ ID NO: 5813699 - DNA, 16 bp, Homo sapiens
ttgttcccactgaaat

SEQ ID NO: 5813700 - DNA, 19 bp, Homo sapiens
ttgttcccattttccttca

SEQ ID NO: 5813701 - DNA, 16 bp, Homo sapiens
ttgttccccactggag

SEQ ID NO: 5813702 - DNA, 19 bp, Homo sapiens
ttgttccccatcatctgtg

SEQ ID NO: 5813703 - DNA, 13 bp, Homo sapiens
ttgttcccctcct

SEQ ID NO: 5813704 - DNA, 15 bp, Homo sapiens
ttgttccccttttct

SEQ ID NO: 5813705 - DNA, 23 bp, Homo sapiens
ttgttccctatttttctctcctg

SEQ ID NO: 5813706 - DNA, 19 bp, Homo sapiens
ttgttcccttcctcttcct

SEQ ID NO: 5813707 - DNA, 13 bp, Homo sapiens
ttgttcctggagt

SEQ ID NO: 5813708 - DNA, 12 bp, Homo sapiens
ttgttcctgtgt

SEQ ID NO: 5813709 - DNA, 18 bp, Homo sapiens
ttgttcctgtgtattctc

SEQ ID NO: 5813710 - DNA, 14 bp, Homo sapiens
ttgttcctgtttat

SEQ ID NO: 5813711 - DNA, 23 bp, Homo sapiens
ttgttcctgtttatttttaaatt

SEQ ID NO: 5813712 - DNA, 16 bp, Homo sapiens
ttgttccttcacattt

SEQ ID NO: 5813713 - DNA, 14 bp, Homo sapiens
ttgttccttctgct

SEQ ID NO: 5813714 - DNA, 17 bp, Homo sapiens
ttgttccttctgcttct

SEQ ID NO: 5813715 - DNA, 15 bp, Homo sapiens
ttgttcctttgaaga

SEQ ID NO: 5813716 - DNA, 23 bp, Homo sapiens
ttgttcgatcgtttcacatctgt

SEQ ID NO: 5813717 - DNA, 20 bp, Homo sapiens
ttgttctaaaggctgttaaa

SEQ ID NO: 5813718 - DNA, 17 bp, Homo sapiens
ttgttctactccttccc

SEQ ID NO: 5813719 - DNA, 22 bp, Homo sapiens
ttgttctagacttccccatccc

SEQ ID NO: 5813720 - DNA, 11 bp, Homo sapiens
ttgttctagag

SEQ ID NO: 5813721 - DNA, 20 bp, Homo sapiens
tttaaacaaaatttcacagt

SEQ ID NO: 5813722 - DNA, 18 bp, Homo sapiens
tttaaacaaacattgtgt

SEQ ID NO: 5813723 - DNA, 13 bp, Homo sapiens
tttaaacaaatga

SEQ ID NO: 5813724 - DNA, 15 bp, Homo sapiens
tttaaacaaatgagt

SEQ ID NO: 5813725 - DNA, 13 bp, Homo sapiens
tttaaacaaatgt

SEQ ID NO: 5813726 - DNA, 23 bp, Homo sapiens
tttaaacaaattcatattctgtc

SEQ ID NO: 5813727 - DNA, 14 bp, Homo sapiens
tttaaacaatcttt

SEQ ID NO: 5813728 - DNA, 13 bp, Homo sapiens
tttaaacacacag

SEQ ID NO: 5813729 - DNA, 23 bp, Homo sapiens
tttaaacacacagatacacacac

SEQ ID NO: 5813730 - DNA, 20 bp, Homo sapiens
tttaaacactaatcacaaac

SEQ ID NO: 5813731 - DNA, 21 bp, Homo sapiens
tttaaacacttatcttctgga

SEQ ID NO: 5813732 - DNA, 14 bp, Homo sapiens
tttaaacagatgtc

SEQ ID NO: 5813733 - DNA, 23 bp, Homo sapiens
tttaaacagatgtccatcagatg

SEQ ID NO: 5813734 - DNA, 21 bp, Homo sapiens
tttaaacaggcccagcattgc

SEQ ID NO: 5813735 - DNA, 12 bp, Homo sapiens
tttaaacatcta

SEQ ID NO: 5813736 - DNA, 15 bp, Homo sapiens
tttaaacatgattat

SEQ ID NO: 5813737 - DNA, 14 bp, Homo sapiens
tttaaacatgtaaa

SEQ ID NO: 5813738 - DNA, 13 bp, Homo sapiens
tttaaacattaaa

SEQ ID NO: 5813739 - DNA, 16 bp, Homo sapiens
tttaaacattaaaaat

SEQ ID NO: 5813740 - DNA, 12 bp, Homo sapiens
tttaaaccagca

SEQ ID NO: 5813741 - DNA, 22 bp, Homo sapiens
tttaaaccagcagaaaagtgct

SEQ ID NO: 5813742 - DNA, 17 bp, Homo sapiens
tttaaacccaaaatata

SEQ ID NO: 5813743 - DNA, 15 bp, Homo sapiens
tttaaacccatttta

SEQ ID NO: 5813744 - DNA, 23 bp, Homo sapiens
tttaaaccgctaaaagaaacttt

SEQ ID NO: 5813745 - DNA, 22 bp, Homo sapiens
tttaaacctcacctttgtgggg

SEQ ID NO: 5813746 - DNA, 16 bp, Homo sapiens
tttaaacctttcataa

SEQ ID NO: 5813747 - DNA, 15 bp, Homo sapiens
tttaaacctttttct

SEQ ID NO: 5813748 - DNA, 21 bp, Homo sapiens
tttaaacgtgatttttaaatt

SEQ ID NO: 5813749 - DNA, 21 bp, Homo sapiens
tttaaactacatcttgaaaat

SEQ ID NO: 5813750 - DNA, 19 bp, Homo sapiens
tttaaactacctcaaaaca

SEQ ID NO: 5813751 - DNA, 21 bp, Homo sapiens
tttaaactagatgacctcatt

SEQ ID NO: 5813752 - DNA, 13 bp, Homo sapiens
tttaaactctgcc

SEQ ID NO: 5813753 - DNA, 17 bp, Homo sapiens
tttaaactgatgtatag

SEQ ID NO: 5813754 - DNA, 23 bp, Homo sapiens
tttaaactgatgtatagctttaa

SEQ ID NO: 5813755 - DNA, 13 bp, Homo sapiens
tttaaactgtaca

SEQ ID NO: 5813756 - DNA, 15 bp, Homo sapiens
tttaaactgtgtaca

SEQ ID NO: 5813757 - DNA, 21 bp, Homo sapiens
tttaaactgtgtacataactg

SEQ ID NO: 5813758 - DNA, 22 bp, Homo sapiens
tttaaactgtgtacataactga

SEQ ID NO: 5813759 - DNA, 15 bp, Homo sapiens
tttaaacttcagttt

SEQ ID NO: 5813760 - DNA, 20 bp, Homo sapiens
tttaaacttgaaatatataa

SEQ ID NO: 5813761 - DNA, 20 bp, Homo sapiens
tttaaacttttatgcgcaaa

SEQ ID NO: 5813762 - DNA, 19 bp, Homo sapiens
tttaaagaaaaaaattgaa

SEQ ID NO: 5813763 - DNA, 22 bp, Homo sapiens
tttaaagaaaaaaattgaaatg

SEQ ID NO: 5813764 - DNA, 20 bp, Homo sapiens
tttaaagaaaaatcagtttt

SEQ ID NO: 5813765 - DNA, 21 bp, Homo sapiens
tttaaagaaaagatgaaaggc

SEQ ID NO: 5813766 - DNA, 21 bp, Homo sapiens
tttaaagaaaagttcttaaaa

SEQ ID NO: 5813767 - DNA, 17 bp, Homo sapiens
tttaaagaaaagttttg

SEQ ID NO: 5813768 - DNA, 12 bp, Homo sapiens
tttaaagaaagt

SEQ ID NO: 5813769 - DNA, 14 bp, Homo sapiens
tttaaagaagcttt

SEQ ID NO: 5813770 - DNA, 20 bp, Homo sapiens
tttaaagaagggggctttct

SEQ ID NO: 5813771 - DNA, 12 bp, Homo sapiens
tttaaagaagta

SEQ ID NO: 5813772 - DNA, 14 bp, Homo sapiens
tttaaagaagtaaa

SEQ ID NO: 5813773 - DNA, 20 bp, Homo sapiens
tttaaagaagtgcatgaaaa

SEQ ID NO: 5813774 - DNA, 17 bp, Homo sapiens
tttaaagaatcattatt

SEQ ID NO: 5813775 - DNA, 14 bp, Homo sapiens
tttaaagaatccaa

SEQ ID NO: 5813776 - DNA, 23 bp, Homo sapiens
tttaaagaatccaagacaaacta

SEQ ID NO: 5813777 - DNA, 18 bp, Homo sapiens
tttaaagacctgacagct

SEQ ID NO: 5813778 - DNA, 16 bp, Homo sapiens
tttaaagaggctgtgt

SEQ ID NO: 5813779 - DNA, 17 bp, Homo sapiens
tttaaagagtctagatt

SEQ ID NO: 5813780 - DNA, 18 bp, Homo sapiens
tttaaagagtctagattc

SEQ ID NO: 5813781 - DNA, 23 bp, Homo sapiens
tttaaagagtctagattcaaagg

SEQ ID NO: 5813782 - DNA, 17 bp, Homo sapiens
tttaaagatgtagacag

SEQ ID NO: 5813783 - DNA, 12 bp, Homo sapiens
tttaaagatttt

SEQ ID NO: 5813784 - DNA, 15 bp, Homo sapiens
tttaaagcaggttct

SEQ ID NO: 5813785 - DNA, 20 bp, Homo sapiens
tttaaagcattgctgttatg

SEQ ID NO: 5813786 - DNA, 16 bp, Homo sapiens
tttaaagcctgaaaat

SEQ ID NO: 5813787 - DNA, 18 bp, Homo sapiens
tttaaagcttactctgtc

SEQ ID NO: 5813788 - DNA, 16 bp, Homo sapiens
tttaaagcttccattg

SEQ ID NO: 5813789 - DNA, 17 bp, Homo sapiens
tttaaaggaatgtgaaa

SEQ ID NO: 5813790 - DNA, 13 bp, Homo sapiens
tttaaaggacaaa

SEQ ID NO: 5813791 - DNA, 20 bp, Homo sapiens
tttaaaggataatggtgaac

SEQ ID NO: 5813792 - DNA, 13 bp, Homo sapiens
tttaaaggcagag

SEQ ID NO: 5813793 - DNA, 16 bp, Homo sapiens
tttaaaggggcagaaa

SEQ ID NO: 5813794 - DNA, 22 bp, Homo sapiens
tttaaaggggcagaaaaactct

SEQ ID NO: 5813795 - DNA, 14 bp, Homo sapiens
tttaaaggtagaga

SEQ ID NO: 5813796 - DNA, 19 bp, Homo sapiens
tttaaaggtagagatgtgt

SEQ ID NO: 5813797 - DNA, 21 bp, Homo sapiens
tttaaaggtcgcacctccttg

SEQ ID NO: 5813798 - DNA, 21 bp, Homo sapiens
tttaaaggtttctattttctc

SEQ ID NO: 5813799 - DNA, 18 bp, Homo sapiens
tttaaagtaaacttgtgt

SEQ ID NO: 5813800 - DNA, 16 bp, Homo sapiens
tttaaagtactttctt

SEQ ID NO: 5813801 - DNA, 19 bp, Homo sapiens
tttaaagtctaaactgtta

SEQ ID NO: 5813802 - DNA, 22 bp, Homo sapiens
tttaaagtgactaatggcatga

SEQ ID NO: 5813803 - DNA, 17 bp, Homo sapiens
tttaaagtgattaaacg

SEQ ID NO: 5813804 - DNA, 18 bp, Homo sapiens
tttaaagtggcaatctca

SEQ ID NO: 5813805 - DNA, 20 bp, Homo sapiens
tttaaagtgtttctgttatt

SEQ ID NO: 5813806 - DNA, 23 bp, Homo sapiens
tttaaagttcttattttagtata

SEQ ID NO: 5813807 - DNA, 15 bp, Homo sapiens
tttaaagttgtataa

SEQ ID NO: 5813808 - DNA, 18 bp, Homo sapiens
tttaaagtttaaatacca

SEQ ID NO: 5813809 - DNA, 17 bp, Homo sapiens
tttaaagtttaatgcct

SEQ ID NO: 5813810 - DNA, 13 bp, Homo sapiens
tttaaagtttgtt

SEQ ID NO: 5813811 - DNA, 19 bp, Homo sapiens
tttaaagttttatatgcat

SEQ ID NO: 5813812 - DNA, 21 bp, Homo sapiens
tttaaataaaaataagtcatt

SEQ ID NO: 5813813 - DNA, 16 bp, Homo sapiens
tttaaataaaaccctt

SEQ ID NO: 5813814 - DNA, 22 bp, Homo sapiens
tttaaataaaactttccaaata

SEQ ID NO: 5813815 - DNA, 23 bp, Homo sapiens
tttaaataaaagaaaaaatatct

SEQ ID NO: 5813816 - DNA, 16 bp, Homo sapiens
tttaaataaaatcacc

SEQ ID NO: 5813817 - DNA, 15 bp, Homo sapiens
tttaaataaaattta

SEQ ID NO: 5813818 - DNA, 13 bp, Homo sapiens
tttaaataaacac

SEQ ID NO: 5813819 - DNA, 19 bp, Homo sapiens
tttaaataaacctataata

SEQ ID NO: 5813820 - DNA, 13 bp, Homo sapiens
tttaaataaactt

SEQ ID NO: 5813821 - DNA, 14 bp, Homo sapiens
tttaaataaacttt

SEQ ID NO: 5813822 - DNA, 15 bp, Homo sapiens
tttaaataaactttt

SEQ ID NO: 5813823 - DNA, 20 bp, Homo sapiens
tttaaataaactttttttca

SEQ ID NO: 5813824 - DNA, 21 bp, Homo sapiens
tttaaataaactttttttcaa

SEQ ID NO: 5813825 - DNA, 21 bp, Homo sapiens
tttaaataaagtatcatgcat

SEQ ID NO: 5813826 - DNA, 22 bp, Homo sapiens
tttaaataaagtatcatgcatt

SEQ ID NO: 5813827 - DNA, 23 bp, Homo sapiens
tttaaataaagtatcatgcattc

SEQ ID NO: 5813828 - DNA, 15 bp, Homo sapiens
tttaaataaagtttg

SEQ ID NO: 5813829 - DNA, 13 bp, Homo sapiens
tttaaataaatta

SEQ ID NO: 5813830 - DNA, 19 bp, Homo sapiens
tttaaataaattatgaata

SEQ ID NO: 5813831 - DNA, 19 bp, Homo sapiens
tttaaataatgtatttact

SEQ ID NO: 5813832 - DNA, 12 bp, Homo sapiens
tttaaataattg

SEQ ID NO: 5813833 - DNA, 21 bp, Homo sapiens
tttaaatacttcatgagcatt

SEQ ID NO: 5813834 - DNA, 14 bp, Homo sapiens
tttaaatagcctaa

SEQ ID NO: 5813835 - DNA, 16 bp, Homo sapiens
tttaaatagcctaaat

SEQ ID NO: 5813836 - DNA, 19 bp, Homo sapiens
tttaaatataaatagctaa

SEQ ID NO: 5813837 - DNA, 18 bp, Homo sapiens
tttaaatataattctgta

SEQ ID NO: 5813838 - DNA, 13 bp, Homo sapiens
tttaaatatatat

SEQ ID NO: 5813839 - DNA, 18 bp, Homo sapiens
tttaaatatatgctaagt

SEQ ID NO: 5813840 - DNA, 16 bp, Homo sapiens
tttaaatatattttca

SEQ ID NO: 5813841 - DNA, 13 bp, Homo sapiens
tttaaatatcatt

SEQ ID NO: 5813842 - DNA, 24 bp, Homo sapiens
tttaaatatcattctttgtatctt

SEQ ID NO: 5813843 - DNA, 13 bp, Homo sapiens
tttaaatatttgt

SEQ ID NO: 5813844 - DNA, 13 bp, Homo sapiens
tttaaatattttc

SEQ ID NO: 5813845 - DNA, 17 bp, Homo sapiens
tttaaatattttctatt

SEQ ID NO: 5813846 - DNA, 19 bp, Homo sapiens
tttaaatattttctatttt

SEQ ID NO: 5813847 - DNA, 18 bp, Homo sapiens
tttaaatcaaaagctgct

SEQ ID NO: 5813848 - DNA, 22 bp, Homo sapiens
tttaaatcaaggaaaggctcat

SEQ ID NO: 5813849 - DNA, 21 bp, Homo sapiens
tttaaatcaggcccaatatca

SEQ ID NO: 5813850 - DNA, 20 bp, Homo sapiens
tttaaatcatgtatgttatg

SEQ ID NO: 5813851 - DNA, 12 bp, Homo sapiens
tttaaatcctgt

SEQ ID NO: 5813852 - DNA, 12 bp, Homo sapiens
tttaaatctgtt

SEQ ID NO: 5813853 - DNA, 19 bp, Homo sapiens
tttaaatcttcaatatgaa

SEQ ID NO: 5813854 - DNA, 20 bp, Homo sapiens
tttaaatctttgttaaaata

SEQ ID NO: 5813855 - DNA, 12 bp, Homo sapiens
tttaaatctttt

SEQ ID NO: 5813856 - DNA, 17 bp, Homo sapiens
tttaaatgaaaggagtt

SEQ ID NO: 5813857 - DNA, 23 bp, Homo sapiens
tttaaatgaacaagagaagcatt

SEQ ID NO: 5813858 - DNA, 20 bp, Homo sapiens
tttaaatgaattaaatattg

SEQ ID NO: 5813859 - DNA, 15 bp, Homo sapiens
tttaaatgcaacagt

SEQ ID NO: 5813860 - DNA, 19 bp, Homo sapiens
tttaaatgcaatctctttt

SEQ ID NO: 5813861 - DNA, 21 bp, Homo sapiens
tttaaatgctttgttttccca

SEQ ID NO: 5813862 - DNA, 22 bp, Homo sapiens
tttaaatgcttttaaatctgca

SEQ ID NO: 5813863 - DNA, 16 bp, Homo sapiens
tttaaatggaataatt

SEQ ID NO: 5813864 - DNA, 17 bp, Homo sapiens
tttaaatggaataatta

SEQ ID NO: 5813865 - DNA, 20 bp, Homo sapiens
tttaaatggaataattagct

SEQ ID NO: 5813866 - DNA, 17 bp, Homo sapiens
tttaaatggcagtattt

SEQ ID NO: 5813867 - DNA, 16 bp, Homo sapiens
tttaaatgtaaaacat

SEQ ID NO: 5813868 - DNA, 20 bp, Homo sapiens
tttaaatgtacagtttgggg

SEQ ID NO: 5813869 - DNA, 22 bp, Homo sapiens
tttaaatgtacttatattaaga

SEQ ID NO: 5813870 - DNA, 16 bp, Homo sapiens
tttaaatgtgaatttt

SEQ ID NO: 5813871 - DNA, 24 bp, Homo sapiens
tttaaatgtgaatttttatttctt

SEQ ID NO: 5813872 - DNA, 19 bp, Homo sapiens
tttaaatgtgcagtacaca

SEQ ID NO: 5813873 - DNA, 17 bp, Homo sapiens
tttaaatgtgtacaatg

SEQ ID NO: 5813874 - DNA, 19 bp, Homo sapiens
tttaaatgtgtacaatgta

SEQ ID NO: 5813875 - DNA, 13 bp, Homo sapiens
tttaaatgtttac

SEQ ID NO: 5813876 - DNA, 20 bp, Homo sapiens
tttaaatgtttactatagac

SEQ ID NO: 5813877 - DNA, 13 bp, Homo sapiens
tttaaatgtttat

SEQ ID NO: 5813878 - DNA, 17 bp, Homo sapiens
tttaaatgtttatatta

SEQ ID NO: 5813879 - DNA, 16 bp, Homo sapiens
tttaaattaatatctt

SEQ ID NO: 5813880 - DNA, 20 bp, Homo sapiens
tttaaattaatatctttctg

SEQ ID NO: 5813881 - DNA, 15 bp, Homo sapiens
tttaaattaatcaga

SEQ ID NO: 5813882 - DNA, 22 bp, Homo sapiens
tttaaattacctttacatatat

SEQ ID NO: 5813883 - DNA, 15 bp, Homo sapiens
tttaaattagaaaat

SEQ ID NO: 5813884 - DNA, 15 bp, Homo sapiens
tttaaattataagga

SEQ ID NO: 5813885 - DNA, 16 bp, Homo sapiens
tttaaattataaggac

SEQ ID NO: 5813886 - DNA, 17 bp, Homo sapiens
tttaaattataaggact

SEQ ID NO: 5813887 - DNA, 20 bp, Homo sapiens
tttaaattataaggactgca

SEQ ID NO: 5813888 - DNA, 14 bp, Homo sapiens
tttaaattatatga

SEQ ID NO: 5813889 - DNA, 16 bp, Homo sapiens
tttaaattatatgata

SEQ ID NO: 5813890 - DNA, 21 bp, Homo sapiens
tttaaattatatgatatgcat

SEQ ID NO: 5813891 - DNA, 22 bp, Homo sapiens
tttaaattatgtataaacataa

SEQ ID NO: 5813892 - DNA, 21 bp, Homo sapiens
tttaaattattatcttcttaa

SEQ ID NO: 5813893 - DNA, 19 bp, Homo sapiens
tttaaattcacaatagaaa

SEQ ID NO: 5813894 - DNA, 21 bp, Homo sapiens
tttaaattcacaatagaaact

SEQ ID NO: 5813895 - DNA, 13 bp, Homo sapiens
tttaaatttcttt

SEQ ID NO: 5813896 - DNA, 12 bp, Homo sapiens
tttaaatttgaa

SEQ ID NO: 5813897 - DNA, 13 bp, Homo sapiens
tttaaatttgatt

SEQ ID NO: 5813898 - DNA, 21 bp, Homo sapiens
tttaatatttatagagttcat

SEQ ID NO: 5813899 - DNA, 14 bp, Homo sapiens
tttaatatttccaa

SEQ ID NO: 5813900 - DNA, 19 bp, Homo sapiens
tttaatatttccaatgtga

SEQ ID NO: 5813901 - DNA, 18 bp, Homo sapiens
tttaatattttgtaatat

SEQ ID NO: 5813902 - DNA, 16 bp, Homo sapiens
tttaatatttttcaaa

SEQ ID NO: 5813903 - DNA, 20 bp, Homo sapiens
tttaatatttttcaaaatca

SEQ ID NO: 5813904 - DNA, 12 bp, Homo sapiens
tttaatcactta

SEQ ID NO: 5813905 - DNA, 21 bp, Homo sapiens
tttaatcacttaacattccta

SEQ ID NO: 5813906 - DNA, 12 bp, Homo sapiens
tttaatcagaaa

SEQ ID NO: 5813907 - DNA, 17 bp, Homo sapiens
tttaatcagttctgtgt

SEQ ID NO: 5813908 - DNA, 19 bp, Homo sapiens
tttaatcagttgtttaata

SEQ ID NO: 5813909 - DNA, 22 bp, Homo sapiens
tttaatcatagttactgtgtaa

SEQ ID NO: 5813910 - DNA, 13 bp, Homo sapiens
tttaatcatataa

SEQ ID NO: 5813911 - DNA, 18 bp, Homo sapiens
tttaatcatataaataga

SEQ ID NO: 5813912 - DNA, 23 bp, Homo sapiens
tttaatcatataaatagaatgta

SEQ ID NO: 5813913 - DNA, 12 bp, Homo sapiens
tttaatcatgaa

SEQ ID NO: 5813914 - DNA, 20 bp, Homo sapiens
tttaatcatgagcctgttta

SEQ ID NO: 5813915 - DNA, 10 bp, Homo sapiens
tttaatcatt

SEQ ID NO: 5813916 - DNA, 22 bp, Homo sapiens
tttaatccacagtatgttacat

SEQ ID NO: 5813917 - DNA, 16 bp, Homo sapiens
tttaatccagatctgg

SEQ ID NO: 5813918 - DNA, 14 bp, Homo sapiens
tttaatccatttca

SEQ ID NO: 5813919 - DNA, 17 bp, Homo sapiens
tttaatccatttcagga

SEQ ID NO: 5813920 - DNA, 20 bp, Homo sapiens
tttaatcccattgcaaacat

SEQ ID NO: 5813921 - DNA, 15 bp, Homo sapiens
tttaatccccagtaa

SEQ ID NO: 5813922 - DNA, 16 bp, Homo sapiens
tttaatccccagtaaa

SEQ ID NO: 5813923 - DNA, 15 bp, Homo sapiens
tttaatcctgtacca

SEQ ID NO: 5813924 - DNA, 18 bp, Homo sapiens
tttaatcctgtaccaaat

SEQ ID NO: 5813925 - DNA, 22 bp, Homo sapiens
tttaatcctgtaccaaatctga

SEQ ID NO: 5813926 - DNA, 23 bp, Homo sapiens
tttaatccttctagtttcccaca

SEQ ID NO: 5813927 - DNA, 16 bp, Homo sapiens
tttaatccttctttgt

SEQ ID NO: 5813928 - DNA, 22 bp, Homo sapiens
tttaatctactttttgtattta

SEQ ID NO: 5813929 - DNA, 23 bp, Homo sapiens
tttaatctcctgagttgtataaa

SEQ ID NO: 5813930 - DNA, 13 bp, Homo sapiens
tttaatctcttgt

SEQ ID NO: 5813931 - DNA, 14 bp, Homo sapiens
tttaatctcttgtc

SEQ ID NO: 5813932 - DNA, 13 bp, Homo sapiens
tttaatcttagct

SEQ ID NO: 5813933 - DNA, 16 bp, Homo sapiens
tttaatcttatgctta

SEQ ID NO: 5813934 - DNA, 13 bp, Homo sapiens
tttaatcttcagt

SEQ ID NO: 5813935 - DNA, 17 bp, Homo sapiens
tttaatctttgtgacag

SEQ ID NO: 5813936 - DNA, 13 bp, Homo sapiens
tttaatgaaatca

SEQ ID NO: 5813937 - DNA, 23 bp, Homo sapiens
tttaatgaaatcaaatgtatgta

SEQ ID NO: 5813938 - DNA, 19 bp, Homo sapiens
tttaatgaagatctaaata

SEQ ID NO: 5813939 - DNA, 16 bp, Homo sapiens
tttaatgaatgcttaa

SEQ ID NO: 5813940 - DNA, 22 bp, Homo sapiens
tttaatgaatgcttaaagaatt

SEQ ID NO: 5813941 - DNA, 15 bp, Homo sapiens
tttaatgacttttta

SEQ ID NO: 5813942 - DNA, 16 bp, Homo sapiens
tttaatgagaatagaa

SEQ ID NO: 5813943 - DNA, 19 bp, Homo sapiens
tttaatgagtgcacctgcc

SEQ ID NO: 5813944 - DNA, 22 bp, Homo sapiens
tttaatgatgtgtcatatgagt

SEQ ID NO: 5813945 - DNA, 18 bp, Homo sapiens
tttaatgatttttgtgta

SEQ ID NO: 5813946 - DNA, 22 bp, Homo sapiens
tttaatgatttttgtgtatcca

SEQ ID NO: 5813947 - DNA, 11 bp, Homo sapiens
tttaatgcaaa

SEQ ID NO: 5813948 - DNA, 12 bp, Homo sapiens
tttaatgcaaat

SEQ ID NO: 5813949 - DNA, 20 bp, Homo sapiens
tttaatgcaagagaacattt

SEQ ID NO: 5813950 - DNA, 22 bp, Homo sapiens
tttaatgcaagagaacatttta

SEQ ID NO: 5813951 - DNA, 21 bp, Homo sapiens
tttaatgcaatgcatatctgt

SEQ ID NO: 5813952 - DNA, 20 bp, Homo sapiens
tttaatgcattaaacctgtc

SEQ ID NO: 5813953 - DNA, 21 bp, Homo sapiens
tttaatgcattaaacctgtct

SEQ ID NO: 5813954 - DNA, 22 bp, Homo sapiens
tttaatgcctgcccattagaga

SEQ ID NO: 5813955 - DNA, 15 bp, Homo sapiens
tttaatgctatttga

SEQ ID NO: 5813956 - DNA, 19 bp, Homo sapiens
tttaatgcttcattcaata

SEQ ID NO: 5813957 - DNA, 19 bp, Homo sapiens
tttaatggaaagtttgtag

SEQ ID NO: 5813958 - DNA, 17 bp, Homo sapiens
tttaatggactgtgaat

SEQ ID NO: 5813959 - DNA, 22 bp, Homo sapiens
tttaatggacttatttcttcaa

SEQ ID NO: 5813960 - DNA, 20 bp, Homo sapiens
tttaatggatatttctcagc

SEQ ID NO: 5813961 - DNA, 23 bp, Homo sapiens
tttaatggattgttaatttcagt

SEQ ID NO: 5813962 - DNA, 19 bp, Homo sapiens
tttaatggcagcagaaaac

SEQ ID NO: 5813963 - DNA, 14 bp, Homo sapiens
tttaatggcagcta

SEQ ID NO: 5813964 - DNA, 20 bp, Homo sapiens
tttaatgggggtagcagctg

SEQ ID NO: 5813965 - DNA, 23 bp, Homo sapiens
tttaatggggtctgtaaatactg

SEQ ID NO: 5813966 - DNA, 21 bp, Homo sapiens
tttaatggtatgtacaagttg

SEQ ID NO: 5813967 - DNA, 18 bp, Homo sapiens
tttaatgtactaatattt

SEQ ID NO: 5813968 - DNA, 20 bp, Homo sapiens
tttaatgtatagtaaatcac

SEQ ID NO: 5813969 - DNA, 21 bp, Homo sapiens
tttaatgtatatttgctgcaa

SEQ ID NO: 5813970 - DNA, 22 bp, Homo sapiens
tttaatgtatctatttgtacaa

SEQ ID NO: 5813971 - DNA, 16 bp, Homo sapiens
tttaatgtatcttaaa

SEQ ID NO: 5813972 - DNA, 19 bp, Homo sapiens
tttaatgtatcttaaagga

SEQ ID NO: 5813973 - DNA, 21 bp, Homo sapiens
tttaatgtatcttaaaggaca

SEQ ID NO: 5813974 - DNA, 17 bp, Homo sapiens
tttaatgtattaatctg

SEQ ID NO: 5813975 - DNA, 13 bp, Homo sapiens
tttaatgtctgtt

SEQ ID NO: 5813976 - DNA, 20 bp, Homo sapiens
tttaatgtgaactctcccct

SEQ ID NO: 5813977 - DNA, 15 bp, Homo sapiens
tttaatgtgaacttg

SEQ ID NO: 5813978 - DNA, 21 bp, Homo sapiens
tttaatgtgaacttgtagctg

SEQ ID NO: 5813979 - DNA, 13 bp, Homo sapiens
tttaatgtgaaga

SEQ ID NO: 5813980 - DNA, 13 bp, Homo sapiens
tttaatgtgatga

SEQ ID NO: 5813981 - DNA, 22 bp, Homo sapiens
tttaatgtgatgatgtaattga

SEQ ID NO: 5813982 - DNA, 15 bp, Homo sapiens
tttaatgtgctctgt

SEQ ID NO: 5813983 - DNA, 19 bp, Homo sapiens
tttaatgtgctctgtacct

SEQ ID NO: 5813984 - DNA, 21 bp, Homo sapiens
tttaatgtgctgtgtaaagtt

SEQ ID NO: 5813985 - DNA, 12 bp, Homo sapiens
tttaatgttaca

SEQ ID NO: 5813986 - DNA, 15 bp, Homo sapiens
tttaatgttcacatt

SEQ ID NO: 5813987 - DNA, 16 bp, Homo sapiens
tttaatgttcacattt

SEQ ID NO: 5813988 - DNA, 13 bp, Homo sapiens
tttaatgttgaac

SEQ ID NO: 5813989 - DNA, 18 bp, Homo sapiens
tttaatgttgaacaaaat

SEQ ID NO: 5813990 - DNA, 16 bp, Homo sapiens
tttaatgtttaaaaca

SEQ ID NO: 5813991 - DNA, 12 bp, Homo sapiens
tttaatgtttat

SEQ ID NO: 5813992 - DNA, 15 bp, Homo sapiens
tttaatgtttataca

SEQ ID NO: 5813993 - DNA, 21 bp, Homo sapiens
tttaatgtttattatttacat

SEQ ID NO: 5813994 - DNA, 14 bp, Homo sapiens
tttaatgtttctga

SEQ ID NO: 5813995 - DNA, 19 bp, Homo sapiens
tttaatgttttaaatgtac

SEQ ID NO: 5813996 - DNA, 21 bp, Homo sapiens
tttaattaaaaactagtagtt

SEQ ID NO: 5813997 - DNA, 19 bp, Homo sapiens
tttaattaaaaactttaaa

SEQ ID NO: 5813998 - DNA, 17 bp, Homo sapiens
tttaattaaaattggta

SEQ ID NO: 5813999 - DNA, 13 bp, Homo sapiens
tttaattaaagca

SEQ ID NO: 5814000 - DNA, 20 bp, Homo sapiens
tttaattaactatgtgatgt

SEQ ID NO: 5814001 - DNA, 19 bp, Homo sapiens
tttaattaagcagaaacag

SEQ ID NO: 5814002 - DNA, 16 bp, Homo sapiens
tttaattaatatgttc

SEQ ID NO: 5814003 - DNA, 19 bp, Homo sapiens
tttaattaatcatgaatgt

SEQ ID NO: 5814004 - DNA, 22 bp, Homo sapiens
tttaattaatcatgaatgtgta

SEQ ID NO: 5814005 - DNA, 17 bp, Homo sapiens
tttaattaatgaaatat

SEQ ID NO: 5814006 - DNA, 20 bp, Homo sapiens
tttaattaattgggccagct

SEQ ID NO: 5814007 - DNA, 17 bp, Homo sapiens
tttaattacaaacaata

SEQ ID NO: 5814008 - DNA, 18 bp, Homo sapiens
tttaattacaaacaataa

SEQ ID NO: 5814009 - DNA, 21 bp, Homo sapiens
tttaattacaaacaataagaa

SEQ ID NO: 5814010 - DNA, 23 bp, Homo sapiens
tttaattacaaacaataagaaca

SEQ ID NO: 5814011 - DNA, 14 bp, Homo sapiens
tttaattacagaag

SEQ ID NO: 5814012 - DNA, 16 bp, Homo sapiens
tttaattactactagg

SEQ ID NO: 5814013 - DNA, 23 bp, Homo sapiens
tttaattattattcttcataaca

SEQ ID NO: 5814014 - DNA, 23 bp, Homo sapiens
tttaattattatttatatatgta

SEQ ID NO: 5814015 - DNA, 18 bp, Homo sapiens
tttaattatttaagattt

SEQ ID NO: 5814016 - DNA, 12 bp, Homo sapiens
tttaattatttt

SEQ ID NO: 5814017 - DNA, 17 bp, Homo sapiens
tttaattcaccaaagta

SEQ ID NO: 5814018 - DNA, 19 bp, Homo sapiens
tttaattcacctcagcctg

SEQ ID NO: 5814019 - DNA, 14 bp, Homo sapiens
tttaattcagcaga

SEQ ID NO: 5814020 - DNA, 12 bp, Homo sapiens
tttaattcaggt

SEQ ID NO: 5814021 - DNA, 12 bp, Homo sapiens
tttaattcagtt

SEQ ID NO: 5814022 - DNA, 13 bp, Homo sapiens
tttaattcataat

SEQ ID NO: 5814023 - DNA, 18 bp, Homo sapiens
tttaattccaagtgtttc

SEQ ID NO: 5814024 - DNA, 16 bp, Homo sapiens
tttaattccaatatga

SEQ ID NO: 5814025 - DNA, 17 bp, Homo sapiens
tttaattccatgaatgt

SEQ ID NO: 5814026 - DNA, 22 bp, Homo sapiens
tttaattccccttcccttattt

SEQ ID NO: 5814027 - DNA, 13 bp, Homo sapiens
tttaattctcttg

SEQ ID NO: 5814028 - DNA, 13 bp, Homo sapiens
tttaattctgaaa

SEQ ID NO: 5814029 - DNA, 20 bp, Homo sapiens
tttaattcttaccgaaatga

SEQ ID NO: 5814030 - DNA, 21 bp, Homo sapiens
tttaattcttaccgaaatgaa

SEQ ID NO: 5814031 - DNA, 22 bp, Homo sapiens
tttaattcttaccgaaatgaaa

SEQ ID NO: 5814032 - DNA, 17 bp, Homo sapiens
tttaattcttcaccttt

SEQ ID NO: 5814033 - DNA, 18 bp, Homo sapiens
tttaattctttctatttt

SEQ ID NO: 5814034 - DNA, 22 bp, Homo sapiens
tttaattctttctattttcaca

SEQ ID NO: 5814035 - DNA, 13 bp, Homo sapiens
tttaattgaaact

SEQ ID NO: 5814036 - DNA, 17 bp, Homo sapiens
tttaattgaaactagtt

SEQ ID NO: 5814037 - DNA, 17 bp, Homo sapiens
tttaattgaaagaatgt

SEQ ID NO: 5814038 - DNA, 12 bp, Homo sapiens
tttaattgcaac

SEQ ID NO: 5814039 - DNA, 17 bp, Homo sapiens
tttaattgcaacaatgc

SEQ ID NO: 5814040 - DNA, 16 bp, Homo sapiens
tttaattgcatttaaa

SEQ ID NO: 5814041 - DNA, 12 bp, Homo sapiens
tttaattgtaaa

SEQ ID NO: 5814042 - DNA, 21 bp, Homo sapiens
tttaattgtaaagtaaaagct

SEQ ID NO: 5814043 - DNA, 22 bp, Homo sapiens
tttaattgtagttctgtgtact

SEQ ID NO: 5814044 - DNA, 13 bp, Homo sapiens
tttaattgtataa

SEQ ID NO: 5814045 - DNA, 14 bp, Homo sapiens
tttaattgtataag

SEQ ID NO: 5814046 - DNA, 19 bp, Homo sapiens
tttaattgtgcaaaggata

SEQ ID NO: 5814047 - DNA, 18 bp, Homo sapiens
tttaattgtgtggtgctt

SEQ ID NO: 5814048 - DNA, 18 bp, Homo sapiens
tttaattgttaagatatg

SEQ ID NO: 5814049 - DNA, 16 bp, Homo sapiens
tttaattgttgtttct

SEQ ID NO: 5814050 - DNA, 18 bp, Homo sapiens
tttaattgttgtttcttt

SEQ ID NO: 5814051 - DNA, 21 bp, Homo sapiens
tttaattgttgtttctttcta

SEQ ID NO: 5814052 - DNA, 22 bp, Homo sapiens
tttaattgttgtttctttctag

SEQ ID NO: 5814053 - DNA, 23 bp, Homo sapiens
tttaattgttgtttctttctagt

SEQ ID NO: 5814054 - DNA, 13 bp, Homo sapiens
tttaattgtttaa

SEQ ID NO: 5814055 - DNA, 13 bp, Homo sapiens
tttaatttaacaa

SEQ ID NO: 5814056 - DNA, 16 bp, Homo sapiens
tttaatttagatattt

SEQ ID NO: 5814057 - DNA, 16 bp, Homo sapiens
tttaatttagtaaatg

SEQ ID NO: 5814058 - DNA, 18 bp, Homo sapiens
tttaatttagtaaatgtt

SEQ ID NO: 5814059 - DNA, 17 bp, Homo sapiens
tttaatttatatttgaa

SEQ ID NO: 5814060 - DNA, 22 bp, Homo sapiens
tttaatttattaattgctttga

SEQ ID NO: 5814061 - DNA, 20 bp, Homo sapiens
tttaatttatttattaagat

SEQ ID NO: 5814062 - DNA, 16 bp, Homo sapiens
tttaatttcaaatgta

SEQ ID NO: 5814063 - DNA, 23 bp, Homo sapiens
tttaatttcaagcttattttgga

SEQ ID NO: 5814064 - DNA, 19 bp, Homo sapiens
tttaatttcaggtctcagg

SEQ ID NO: 5814065 - DNA, 12 bp, Homo sapiens
tttaatttcata

SEQ ID NO: 5814066 - DNA, 14 bp, Homo sapiens
tttaatttccaaaa

SEQ ID NO: 5814067 - DNA, 21 bp, Homo sapiens
tttaatttccaaaataatcta

SEQ ID NO: 5814068 - DNA, 12 bp, Homo sapiens
tttaatttctac

SEQ ID NO: 5814069 - DNA, 21 bp, Homo sapiens
tttaatttgatatcacagtct

SEQ ID NO: 5814070 - DNA, 12 bp, Homo sapiens
tttaatttgatg

SEQ ID NO: 5814071 - DNA, 19 bp, Homo sapiens
tttaatttgatgaaagctg

SEQ ID NO: 5814072 - DNA, 21 bp, Homo sapiens
tttaatttgatgaaagctgat

SEQ ID NO: 5814073 - DNA, 21 bp, Homo sapiens
tttaatttgccaaaataatgt

SEQ ID NO: 5814074 - DNA, 19 bp, Homo sapiens
tttaatttggtagatgaca

SEQ ID NO: 5814075 - DNA, 18 bp, Homo sapiens
tttacccctgcacagttt

SEQ ID NO: 5814076 - DNA, 19 bp, Homo sapiens
tttaccctaatgtcttcat

SEQ ID NO: 5814077 - DNA, 13 bp, Homo sapiens
tttaccctccctg

SEQ ID NO: 5814078 - DNA, 16 bp, Homo sapiens
tttaccctctttgctg

SEQ ID NO: 5814079 - DNA, 21 bp, Homo sapiens
tttacccttgagccctcccca

SEQ ID NO: 5814080 - DNA, 18 bp, Homo sapiens
tttacccttttccccctt

SEQ ID NO: 5814081 - DNA, 18 bp, Homo sapiens
tttaccgtttcttccctg

SEQ ID NO: 5814082 - DNA, 11 bp, Homo sapiens
tttacctaatc

SEQ ID NO: 5814083 - DNA, 14 bp, Homo sapiens
tttacctagagaac

SEQ ID NO: 5814084 - DNA, 22 bp, Homo sapiens
tttacctagctggtagcataaa

SEQ ID NO: 5814085 - DNA, 12 bp, Homo sapiens
tttacctcagcc

SEQ ID NO: 5814086 - DNA, 22 bp, Homo sapiens
tttacctcatccatgcacttta

SEQ ID NO: 5814087 - DNA, 18 bp, Homo sapiens
tttacctgaagtctttgt

SEQ ID NO: 5814088 - DNA, 22 bp, Homo sapiens
tttacctgaagtctttgtacag

SEQ ID NO: 5814089 - DNA, 16 bp, Homo sapiens
tttacctgagaccagt

SEQ ID NO: 5814090 - DNA, 21 bp, Homo sapiens
tttacctgcaccgttgactca

SEQ ID NO: 5814091 - DNA, 23 bp, Homo sapiens
tttacctggcagtggctctcaga

SEQ ID NO: 5814092 - DNA, 12 bp, Homo sapiens
tttacctggcct

SEQ ID NO: 5814093 - DNA, 18 bp, Homo sapiens
tttacctgggatatgaca

SEQ ID NO: 5814094 - DNA, 17 bp, Homo sapiens
tttacctggtactaaac

SEQ ID NO: 5814095 - DNA, 14 bp, Homo sapiens
tttacctggtgctc

SEQ ID NO: 5814096 - DNA, 15 bp, Homo sapiens
tttacctgtgaaata

SEQ ID NO: 5814097 - DNA, 16 bp, Homo sapiens
tttacctgtgaaatag

SEQ ID NO: 5814098 - DNA, 23 bp, Homo sapiens
tttacctgttctgaaatgttctt

SEQ ID NO: 5814099 - DNA, 13 bp, Homo sapiens
tttacctgtttaa

SEQ ID NO: 5814100 - DNA, 13 bp, Homo sapiens
tttaccttctaaa

SEQ ID NO: 5814101 - DNA, 14 bp, Homo sapiens
tttaccttctaaaa

SEQ ID NO: 5814102 - DNA, 16 bp, Homo sapiens
tttaccttttaattaa

SEQ ID NO: 5814103 - DNA, 17 bp, Homo sapiens
tttacctttttgcttat

SEQ ID NO: 5814104 - DNA, 19 bp, Homo sapiens
tttaccttttttatacata

SEQ ID NO: 5814105 - DNA, 20 bp, Homo sapiens
tttaccttttttatacataa

SEQ ID NO: 5814106 - DNA, 16 bp, Homo sapiens
tttacgactgaagaag

SEQ ID NO: 5814107 - DNA, 20 bp, Homo sapiens
tttacgatctgtttccaaat

SEQ ID NO: 5814108 - DNA, 16 bp, Homo sapiens
tttacggaattccaat

SEQ ID NO: 5814109 - DNA, 13 bp, Homo sapiens
tttacgtagctat

SEQ ID NO: 5814110 - DNA, 15 bp, Homo sapiens
tttacgtagctattt

SEQ ID NO: 5814111 - DNA, 21 bp, Homo sapiens
tttacgtagctatttttatac

SEQ ID NO: 5814112 - DNA, 19 bp, Homo sapiens
tttacgtagtaaaagtcat

SEQ ID NO: 5814113 - DNA, 21 bp, Homo sapiens
tttacgtatatttcattgaat

SEQ ID NO: 5814114 - DNA, 15 bp, Homo sapiens
tttacgtgcaaacaa

SEQ ID NO: 5814115 - DNA, 17 bp, Homo sapiens
tttactaaaatggactg

SEQ ID NO: 5814116 - DNA, 13 bp, Homo sapiens
tttactaaacata

SEQ ID NO: 5814117 - DNA, 15 bp, Homo sapiens
tttactaaagaaaga

SEQ ID NO: 5814118 - DNA, 24 bp, Homo sapiens
tttactaaagagacatatttatca

SEQ ID NO: 5814119 - DNA, 16 bp, Homo sapiens
tttactaacactggct

SEQ ID NO: 5814120 - DNA, 21 bp, Homo sapiens
tttactaacagtaactgccat

SEQ ID NO: 5814121 - DNA, 21 bp, Homo sapiens
tttactaagatcacacaaata

SEQ ID NO: 5814122 - DNA, 15 bp, Homo sapiens
tttactaagtaaaag

SEQ ID NO: 5814123 - DNA, 17 bp, Homo sapiens
tttactaagtaatctca

SEQ ID NO: 5814124 - DNA, 12 bp, Homo sapiens
tttactaatata

SEQ ID NO: 5814125 - DNA, 14 bp, Homo sapiens
tttactaatatata

SEQ ID NO: 5814126 - DNA, 17 bp, Homo sapiens
tttactaatgatactta

SEQ ID NO: 5814127 - DNA, 19 bp, Homo sapiens
tttactaattttctagatt

SEQ ID NO: 5814128 - DNA, 13 bp, Homo sapiens
tttactacagttt

SEQ ID NO: 5814129 - DNA, 22 bp, Homo sapiens
tttactacataattaaatttta

SEQ ID NO: 5814130 - DNA, 17 bp, Homo sapiens
tttactaccaatgccaa

SEQ ID NO: 5814131 - DNA, 21 bp, Homo sapiens
tttactacccaaatctaaata

SEQ ID NO: 5814132 - DNA, 17 bp, Homo sapiens
tttactactattctgtt

SEQ ID NO: 5814133 - DNA, 18 bp, Homo sapiens
tttactactattctgtta

SEQ ID NO: 5814134 - DNA, 17 bp, Homo sapiens
tttactactgcaagttc

SEQ ID NO: 5814135 - DNA, 21 bp, Homo sapiens
tttactactgtggaaaaatat

SEQ ID NO: 5814136 - DNA, 14 bp, Homo sapiens
tttactacttatgc

SEQ ID NO: 5814137 - DNA, 14 bp, Homo sapiens
tttactacttgtta

SEQ ID NO: 5814138 - DNA, 22 bp, Homo sapiens
tttactagaaatgggaatcatg

SEQ ID NO: 5814139 - DNA, 20 bp, Homo sapiens
tttactagaacacagaaagc

SEQ ID NO: 5814140 - DNA, 23 bp, Homo sapiens
tttactataagactataaataaa

SEQ ID NO: 5814141 - DNA, 21 bp, Homo sapiens
tttactatatagaatttcctg

SEQ ID NO: 5814142 - DNA, 14 bp, Homo sapiens
tttactatatatat

SEQ ID NO: 5814143 - DNA, 15 bp, Homo sapiens
tttactatatatata

SEQ ID NO: 5814144 - DNA, 12 bp, Homo sapiens
tttactatcatt

SEQ ID NO: 5814145 - DNA, 15 bp, Homo sapiens
tttactatgcctgtg

SEQ ID NO: 5814146 - DNA, 16 bp, Homo sapiens
tttactatgcctgttg

SEQ ID NO: 5814147 - DNA, 15 bp, Homo sapiens
tttactattaacatg

SEQ ID NO: 5814148 - DNA, 16 bp, Homo sapiens
tttactattaacatga

SEQ ID NO: 5814149 - DNA, 22 bp, Homo sapiens
tttactattaacatgatgtact

SEQ ID NO: 5814150 - DNA, 10 bp, Homo sapiens
tttactattt

SEQ ID NO: 5814151 - DNA, 16 bp, Homo sapiens
tttactcaaaatctgt

SEQ ID NO: 5814152 - DNA, 17 bp, Homo sapiens
tttactcaaccctctca

SEQ ID NO: 5814153 - DNA, 21 bp, Homo sapiens
tttactcaaccctctcaggtg

SEQ ID NO: 5814154 - DNA, 14 bp, Homo sapiens
tttactcacagcac

SEQ ID NO: 5814155 - DNA, 21 bp, Homo sapiens
tttactcaccatatttgaatt

SEQ ID NO: 5814156 - DNA, 18 bp, Homo sapiens
tttactcagtgaaatcat

SEQ ID NO: 5814157 - DNA, 14 bp, Homo sapiens
tttactcattgaaa

SEQ ID NO: 5814158 - DNA, 15 bp, Homo sapiens
tttactcattgaaat

SEQ ID NO: 5814159 - DNA, 16 bp, Homo sapiens
tttactcattgaaatg

SEQ ID NO: 5814160 - DNA, 18 bp, Homo sapiens
tttactcattgaaatgtc

SEQ ID NO: 5814161 - DNA, 22 bp, Homo sapiens
tttactccaggttattgcaata

SEQ ID NO: 5814162 - DNA, 21 bp, Homo sapiens
tttactccagtggtgaagaaa

SEQ ID NO: 5814163 - DNA, 20 bp, Homo sapiens
tttactcccttcctggcctc

SEQ ID NO: 5814164 - DNA, 21 bp, Homo sapiens
tttactcctcacacttactgt

SEQ ID NO: 5814165 - DNA, 18 bp, Homo sapiens
tttactcctttttattca

SEQ ID NO: 5814166 - DNA, 18 bp, Homo sapiens
tttactctcttcatccgt

SEQ ID NO: 5814167 - DNA, 22 bp, Homo sapiens
tttactctgctctatgccaggc

SEQ ID NO: 5814168 - DNA, 23 bp, Homo sapiens
tttactctgggagtaatactttt

SEQ ID NO: 5814169 - DNA, 14 bp, Homo sapiens
tttactctgtgtaa

SEQ ID NO: 5814170 - DNA, 14 bp, Homo sapiens
tttactctttgcaa

SEQ ID NO: 5814171 - DNA, 17 bp, Homo sapiens
tttactgaatgatctat

SEQ ID NO: 5814172 - DNA, 20 bp, Homo sapiens
tttactgaatgatctattcc

SEQ ID NO: 5814173 - DNA, 14 bp, Homo sapiens
tttactgacaagaa

SEQ ID NO: 5814174 - DNA, 17 bp, Homo sapiens
tttactgacatggtgct

SEQ ID NO: 5814175 - DNA, 18 bp, Homo sapiens
tttactgagagaaggtga

SEQ ID NO: 5814176 - DNA, 17 bp, Homo sapiens
tttactgagcttctctg

SEQ ID NO: 5814177 - DNA, 21 bp, Homo sapiens
tttactgagcttctctgtgaa

SEQ ID NO: 5814178 - DNA, 20 bp, Homo sapiens
tttactgatgagagaatgtg

SEQ ID NO: 5814179 - DNA, 21 bp, Homo sapiens
tttactgattaacaaataaat

SEQ ID NO: 5814180 - DNA, 16 bp, Homo sapiens
tttactgcaatgtctg

SEQ ID NO: 5814181 - DNA, 19 bp, Homo sapiens
tttactgcactcagattta

SEQ ID NO: 5814182 - DNA, 18 bp, Homo sapiens
tttactgcattcttctga

SEQ ID NO: 5814183 - DNA, 14 bp, Homo sapiens
tttactgcattttc

SEQ ID NO: 5814184 - DNA, 12 bp, Homo sapiens
tttactgcctgt

SEQ ID NO: 5814185 - DNA, 17 bp, Homo sapiens
tttactgctctgagaat

SEQ ID NO: 5814186 - DNA, 12 bp, Homo sapiens
tttactgctgtc

SEQ ID NO: 5814187 - DNA, 19 bp, Homo sapiens
tttactgctttttctctgc

SEQ ID NO: 5814188 - DNA, 19 bp, Homo sapiens
tttactggacaaagaattc

SEQ ID NO: 5814189 - DNA, 17 bp, Homo sapiens
tttactggacctgaaat

SEQ ID NO: 5814190 - DNA, 18 bp, Homo sapiens
tttactggtgatttctga

SEQ ID NO: 5814191 - DNA, 16 bp, Homo sapiens
tttactggttgcatgg

SEQ ID NO: 5814192 - DNA, 15 bp, Homo sapiens
tttactgtactaatt

SEQ ID NO: 5814193 - DNA, 12 bp, Homo sapiens
tttactgtatca

SEQ ID NO: 5814194 - DNA, 19 bp, Homo sapiens
tttactgtatcaatttcta

SEQ ID NO: 5814195 - DNA, 14 bp, Homo sapiens
tttactgtatgttt

SEQ ID NO: 5814196 - DNA, 20 bp, Homo sapiens
tttactgtcaaaataatttt

SEQ ID NO: 5814197 - DNA, 11 bp, Homo sapiens
tttactgtcag

SEQ ID NO: 5814198 - DNA, 19 bp, Homo sapiens
tttactgtcagattaaatt

SEQ ID NO: 5814199 - DNA, 13 bp, Homo sapiens
tttactgtctgta

SEQ ID NO: 5814200 - DNA, 19 bp, Homo sapiens
tttactgtgaaaaaaaatt

SEQ ID NO: 5814201 - DNA, 22 bp, Homo sapiens
tttactgtgaaaaaaaatttgt

SEQ ID NO: 5814202 - DNA, 16 bp, Homo sapiens
tttactgtgaagagaa

SEQ ID NO: 5814203 - DNA, 21 bp, Homo sapiens
tttactgttatttaattgaaa

SEQ ID NO: 5814204 - DNA, 15 bp, Homo sapiens
tttactgttgtacaa

SEQ ID NO: 5814205 - DNA, 22 bp, Homo sapiens
tttactgttgtacaatcatgtt

SEQ ID NO: 5814206 - DNA, 19 bp, Homo sapiens
tttactgtttctcaagtgt

SEQ ID NO: 5814207 - DNA, 14 bp, Homo sapiens
tttactgtttgtta

SEQ ID NO: 5814208 - DNA, 22 bp, Homo sapiens
tttactgttttgaaatcaatgc

SEQ ID NO: 5814209 - DNA, 22 bp, Homo sapiens
tttacttaaagatttatcaaat

SEQ ID NO: 5814210 - DNA, 23 bp, Homo sapiens
tttacttaaagatttatcaaatc

SEQ ID NO: 5814211 - DNA, 23 bp, Homo sapiens
tttacttaacaaccaacttgttg

SEQ ID NO: 5814212 - DNA, 15 bp, Homo sapiens
tttacttaactgttt

SEQ ID NO: 5814213 - DNA, 12 bp, Homo sapiens
tttacttaagac

SEQ ID NO: 5814214 - DNA, 18 bp, Homo sapiens
tttacttaagtgttcatt

SEQ ID NO: 5814215 - DNA, 16 bp, Homo sapiens
tttacttcacttcaaa

SEQ ID NO: 5814216 - DNA, 14 bp, Homo sapiens
tttacttccacaga

SEQ ID NO: 5814217 - DNA, 20 bp, Homo sapiens
tttacttccatgatacttta

SEQ ID NO: 5814218 - DNA, 15 bp, Homo sapiens
tttacttcctttctt

SEQ ID NO: 5814219 - DNA, 22 bp, Homo sapiens
tttacttctcgaattgaagcaa

SEQ ID NO: 5814220 - DNA, 19 bp, Homo sapiens
tttacttgaggatcatatg

SEQ ID NO: 5814221 - DNA, 21 bp, Homo sapiens
tttacttgcattgaatatatt

SEQ ID NO: 5814222 - DNA, 18 bp, Homo sapiens
tttacttgccattactca

SEQ ID NO: 5814223 - DNA, 17 bp, Homo sapiens
tttacttgtttcagagt

SEQ ID NO: 5814224 - DNA, 17 bp, Homo sapiens
tttactttaaatcctta

SEQ ID NO: 5814225 - DNA, 11 bp, Homo sapiens
tttactttcaa

SEQ ID NO: 5814226 - DNA, 18 bp, Homo sapiens
tttactttcaagtaatat

SEQ ID NO: 5814227 - DNA, 16 bp, Homo sapiens
tttactttcccttgct

SEQ ID NO: 5814228 - DNA, 17 bp, Homo sapiens
tttactttcttcaccaa

SEQ ID NO: 5814229 - DNA, 13 bp, Homo sapiens
tttactttgaatt

SEQ ID NO: 5814230 - DNA, 12 bp, Homo sapiens
tttactttggcc

SEQ ID NO: 5814231 - DNA, 12 bp, Homo sapiens
tttactttgttt

SEQ ID NO: 5814232 - DNA, 20 bp, Homo sapiens
tttactttgtttttattctg

SEQ ID NO: 5814233 - DNA, 16 bp, Homo sapiens
tttacttttaaactgt

SEQ ID NO: 5814234 - DNA, 16 bp, Homo sapiens
tttacttttaaatgtc

SEQ ID NO: 5814235 - DNA, 14 bp, Homo sapiens
tttacttttacagt

SEQ ID NO: 5814236 - DNA, 16 bp, Homo sapiens
tttacttttacagtca

SEQ ID NO: 5814237 - DNA, 17 bp, Homo sapiens
tttacttttcacactgt

SEQ ID NO: 5814238 - DNA, 19 bp, Homo sapiens
tttacttttcacactgtct

SEQ ID NO: 5814239 - DNA, 22 bp, Homo sapiens
tttacttttcacactgtcttcc

SEQ ID NO: 5814240 - DNA, 18 bp, Homo sapiens
tttacttttctgccaaaa

SEQ ID NO: 5814241 - DNA, 14 bp, Homo sapiens
tttacttttcttct

SEQ ID NO: 5814242 - DNA, 15 bp, Homo sapiens
tttactttttggaaa

SEQ ID NO: 5814243 - DNA, 21 bp, Homo sapiens
tttacttttttaaaattgtgt

SEQ ID NO: 5814244 - DNA, 23 bp, Homo sapiens
tttactttttttagtaagttaat

SEQ ID NO: 5814245 - DNA, 16 bp, Homo sapiens
tttagaaaaaaacatg

SEQ ID NO: 5814246 - DNA, 13 bp, Homo sapiens
tttagaaaaaaca

SEQ ID NO: 5814247 - DNA, 23 bp, Homo sapiens
tttagaaaaaatggatgcccaga

SEQ ID NO: 5814248 - DNA, 16 bp, Homo sapiens
tttagaaaaacattta

SEQ ID NO: 5814249 - DNA, 20 bp, Homo sapiens
tttagaaaaagaacatgcag

SEQ ID NO: 5814250 - DNA, 21 bp, Homo sapiens
tttagaaaaagaacatgcagt

SEQ ID NO: 5814251 - DNA, 12 bp, Homo sapiens
tttagaaaactt

SEQ ID NO: 5814252 - DNA, 16 bp, Homo sapiens
tttagaaaactttaaa

SEQ ID NO: 5814253 - DNA, 17 bp, Homo sapiens
tttatatttcctgtatt

SEQ ID NO: 5814254 - DNA, 17 bp, Homo sapiens
tttatatttcctttatg

SEQ ID NO: 5814255 - DNA, 15 bp, Homo sapiens
tttatatttctcgta

SEQ ID NO: 5814256 - DNA, 17 bp, Homo sapiens
tttatatttgaaaaaat

SEQ ID NO: 5814257 - DNA, 13 bp, Homo sapiens
tttatatttgtct

SEQ ID NO: 5814258 - DNA, 20 bp, Homo sapiens
tttatattttagaaataata

SEQ ID NO: 5814259 - DNA, 16 bp, Homo sapiens
tttatattttatactg

SEQ ID NO: 5814260 - DNA, 14 bp, Homo sapiens
tttatattttctat

SEQ ID NO: 5814261 - DNA, 15 bp, Homo sapiens
tttatattttctata

SEQ ID NO: 5814262 - DNA, 23 bp, Homo sapiens
tttatatttttgtacatattgtt

SEQ ID NO: 5814263 - DNA, 13 bp, Homo sapiens
tttatcaagaagt

SEQ ID NO: 5814264 - DNA, 21 bp, Homo sapiens
tttatcaaggaagtcttcaaa

SEQ ID NO: 5814265 - DNA, 22 bp, Homo sapiens
tttatcaaggaagtcttcaaat

SEQ ID NO: 5814266 - DNA, 21 bp, Homo sapiens
tttatcaatcagtataattct

SEQ ID NO: 5814267 - DNA, 23 bp, Homo sapiens
tttatcaattatattatgtttaa

SEQ ID NO: 5814268 - DNA, 18 bp, Homo sapiens
tttatcacacttctgtga

SEQ ID NO: 5814269 - DNA, 14 bp, Homo sapiens
tttatcacatgtat

SEQ ID NO: 5814270 - DNA, 19 bp, Homo sapiens
tttatcacatgtatgtttt

SEQ ID NO: 5814271 - DNA, 16 bp, Homo sapiens
tttatcagaactatgt

SEQ ID NO: 5814272 - DNA, 18 bp, Homo sapiens
tttatcagaactatgttt

SEQ ID NO: 5814273 - DNA, 14 bp, Homo sapiens
tttatcagaattct

SEQ ID NO: 5814274 - DNA, 14 bp, Homo sapiens
tttatcagatacat

SEQ ID NO: 5814275 - DNA, 20 bp, Homo sapiens
tttatcagatacatcactgc

SEQ ID NO: 5814276 - DNA, 17 bp, Homo sapiens
tttatcagatattttca

SEQ ID NO: 5814277 - DNA, 22 bp, Homo sapiens
tttatcagcagttgttattaca

SEQ ID NO: 5814278 - DNA, 16 bp, Homo sapiens
tttatcagccatgttt

SEQ ID NO: 5814279 - DNA, 21 bp, Homo sapiens
tttatcagtgacagagttcac

SEQ ID NO: 5814280 - DNA, 21 bp, Homo sapiens
tttatcagtgcttaatgtgaa

SEQ ID NO: 5814281 - DNA, 22 bp, Homo sapiens
tttatcagtttccagtctcaaa

SEQ ID NO: 5814282 - DNA, 21 bp, Homo sapiens
tttatcatgaattccctttta

SEQ ID NO: 5814283 - DNA, 22 bp, Homo sapiens
tttatcatgtcgtaggtaaact

SEQ ID NO: 5814284 - DNA, 18 bp, Homo sapiens
tttatcatgtgaaatcat

SEQ ID NO: 5814285 - DNA, 15 bp, Homo sapiens
tttatcattaaaaat

SEQ ID NO: 5814286 - DNA, 14 bp, Homo sapiens
tttatcattaaaca

SEQ ID NO: 5814287 - DNA, 21 bp, Homo sapiens
tttatcattaatttttaattg

SEQ ID NO: 5814288 - DNA, 17 bp, Homo sapiens
tttatcattcctttcca

SEQ ID NO: 5814289 - DNA, 13 bp, Homo sapiens
tttatcattctgc

SEQ ID NO: 5814290 - DNA, 12 bp, Homo sapiens
tttatcattgca

SEQ ID NO: 5814291 - DNA, 12 bp, Homo sapiens
tttatcatttta

SEQ ID NO: 5814292 - DNA, 16 bp, Homo sapiens
tttatccaatcctcag

SEQ ID NO: 5814293 - DNA, 20 bp, Homo sapiens
tttatccacaggaaagtgtt

SEQ ID NO: 5814294 - DNA, 15 bp, Homo sapiens
tttatccacattgta

SEQ ID NO: 5814295 - DNA, 14 bp, Homo sapiens
tttatccatttctt

SEQ ID NO: 5814296 - DNA, 15 bp, Homo sapiens
tttatccatttgtaa

SEQ ID NO: 5814297 - DNA, 17 bp, Homo sapiens
tttatccctgcttatct

SEQ ID NO: 5814298 - DNA, 15 bp, Homo sapiens
tttatcccttaagaa

SEQ ID NO: 5814299 - DNA, 22 bp, Homo sapiens
tttatcccttcctgtctgaaca

SEQ ID NO: 5814300 - DNA, 20 bp, Homo sapiens
tttatccctttacaatgtga

SEQ ID NO: 5814301 - DNA, 22 bp, Homo sapiens
tttatcctagtcattcttccct

SEQ ID NO: 5814302 - DNA, 16 bp, Homo sapiens
tttatcctatctctcc

SEQ ID NO: 5814303 - DNA, 14 bp, Homo sapiens
tttatcctgtattc

SEQ ID NO: 5814304 - DNA, 23 bp, Homo sapiens
tttatcctttattttaaatgatc

SEQ ID NO: 5814305 - DNA, 14 bp, Homo sapiens
tttatcgcaacatg

SEQ ID NO: 5814306 - DNA, 17 bp, Homo sapiens
tttatcgcaacatgaat

SEQ ID NO: 5814307 - DNA, 16 bp, Homo sapiens
tttatcgcagaccttt

SEQ ID NO: 5814308 - DNA, 16 bp, Homo sapiens
tttatcgtcactgctt

SEQ ID NO: 5814309 - DNA, 18 bp, Homo sapiens
tttatcgtttattgctta

SEQ ID NO: 5814310 - DNA, 12 bp, Homo sapiens
tttatctaaatt

SEQ ID NO: 5814311 - DNA, 21 bp, Homo sapiens
tttatctaaggaaacattggc

SEQ ID NO: 5814312 - DNA, 24 bp, Homo sapiens
tttatctaaggtccccagcagaat

SEQ ID NO: 5814313 - DNA, 15 bp, Homo sapiens
tttatctatataaaa

SEQ ID NO: 5814314 - DNA, 17 bp, Homo sapiens
tttatctatcggaagaa

SEQ ID NO: 5814315 - DNA, 18 bp, Homo sapiens
tttatctccatactttgg

SEQ ID NO: 5814316 - DNA, 17 bp, Homo sapiens
tttatctctatttaata

SEQ ID NO: 5814317 - DNA, 21 bp, Homo sapiens
tttatctgagcaataacttct

SEQ ID NO: 5814318 - DNA, 13 bp, Homo sapiens
tttatctgattaa

SEQ ID NO: 5814319 - DNA, 15 bp, Homo sapiens
tttatctgcagaaca

SEQ ID NO: 5814320 - DNA, 16 bp, Homo sapiens
tttatctgcagaacat

SEQ ID NO: 5814321 - DNA, 14 bp, Homo sapiens
tttatctgcctctc

SEQ ID NO: 5814322 - DNA, 20 bp, Homo sapiens
tttatctgcctctcttgtaa

SEQ ID NO: 5814323 - DNA, 14 bp, Homo sapiens
tttatctgcggctt

SEQ ID NO: 5814324 - DNA, 13 bp, Homo sapiens
tttatctgtataa

SEQ ID NO: 5814325 - DNA, 23 bp, Homo sapiens
tttatctgtctgagccctgccct

SEQ ID NO: 5814326 - DNA, 22 bp, Homo sapiens
tttatctgtgttgtctctctaa

SEQ ID NO: 5814327 - DNA, 15 bp, Homo sapiens
tttatctgttcatat

SEQ ID NO: 5814328 - DNA, 14 bp, Homo sapiens
tttatctgtttcct

SEQ ID NO: 5814329 - DNA, 13 bp, Homo sapiens
tttatcttcatgt

SEQ ID NO: 5814330 - DNA, 20 bp, Homo sapiens
tttatcttccatatgctctt

SEQ ID NO: 5814331 - DNA, 19 bp, Homo sapiens
tttatcttctgtttttctc

SEQ ID NO: 5814332 - DNA, 20 bp, Homo sapiens
tttatcttctgtttttctca

SEQ ID NO: 5814333 - DNA, 18 bp, Homo sapiens
tttatcttggtagtacat

SEQ ID NO: 5814334 - DNA, 14 bp, Homo sapiens
tttatctttaccaa

SEQ ID NO: 5814335 - DNA, 14 bp, Homo sapiens
tttatctttataca

SEQ ID NO: 5814336 - DNA, 11 bp, Homo sapiens
tttatctttga

SEQ ID NO: 5814337 - DNA, 16 bp, Homo sapiens
tttatctttgataaca

SEQ ID NO: 5814338 - DNA, 13 bp, Homo sapiens
tttatctttgtgt

SEQ ID NO: 5814339 - DNA, 22 bp, Homo sapiens
tttatcttttagctagaatcca

SEQ ID NO: 5814340 - DNA, 12 bp, Homo sapiens
tttatcttttct

SEQ ID NO: 5814341 - DNA, 15 bp, Homo sapiens
tttatcttttctaca

SEQ ID NO: 5814342 - DNA, 21 bp, Homo sapiens
tttatcttttctacagcaaat

SEQ ID NO: 5814343 - DNA, 20 bp, Homo sapiens
tttatgaaaaaaaaagaaat

SEQ ID NO: 5814344 - DNA, 18 bp, Homo sapiens
tttatgaaaaaaatatat

SEQ ID NO: 5814345 - DNA, 19 bp, Homo sapiens
tttatgaaaaagaagaatc

SEQ ID NO: 5814346 - DNA, 13 bp, Homo sapiens
tttatgaaaagag

SEQ ID NO: 5814347 - DNA, 18 bp, Homo sapiens
tttatgaaaataaatagc

SEQ ID NO: 5814348 - DNA, 19 bp, Homo sapiens
tttatgaaaataaatagct

SEQ ID NO: 5814349 - DNA, 14 bp, Homo sapiens
tttatgaacattgt

SEQ ID NO: 5814350 - DNA, 15 bp, Homo sapiens
tttatgaacattgta

SEQ ID NO: 5814351 - DNA, 21 bp, Homo sapiens
tttatgaacattgtactgttg

SEQ ID NO: 5814352 - DNA, 14 bp, Homo sapiens
tttatgaactgcat

SEQ ID NO: 5814353 - DNA, 15 bp, Homo sapiens
tttatgaagaaaata

SEQ ID NO: 5814354 - DNA, 17 bp, Homo sapiens
tttatgaagaaagatac

SEQ ID NO: 5814355 - DNA, 12 bp, Homo sapiens
tttatgaagttt

SEQ ID NO: 5814356 - DNA, 15 bp, Homo sapiens
tttatgaagtttaaa

SEQ ID NO: 5814357 - DNA, 17 bp, Homo sapiens
tttatgaatatcattga

SEQ ID NO: 5814358 - DNA, 18 bp, Homo sapiens
tttatgaattaaagtaat

SEQ ID NO: 5814359 - DNA, 22 bp, Homo sapiens
tttatgaattattttgataaat

SEQ ID NO: 5814360 - DNA, 18 bp, Homo sapiens
tttatgactaatccttaa

SEQ ID NO: 5814361 - DNA, 21 bp, Homo sapiens
tttatgactgtaaacatagat

SEQ ID NO: 5814362 - DNA, 22 bp, Homo sapiens
tttatgagaaactggcaaagca

SEQ ID NO: 5814363 - DNA, 12 bp, Homo sapiens
tttatgagaaat

SEQ ID NO: 5814364 - DNA, 16 bp, Homo sapiens
tttatgagctcatgta

SEQ ID NO: 5814365 - DNA, 23 bp, Homo sapiens
tttatgagctcatgtagcaatca

SEQ ID NO: 5814366 - DNA, 12 bp, Homo sapiens
tttatgaggaaa

SEQ ID NO: 5814367 - DNA, 21 bp, Homo sapiens
tttatgagtaactattattat

SEQ ID NO: 5814368 - DNA, 22 bp, Homo sapiens
tttatgagtaactattattata

SEQ ID NO: 5814369 - DNA, 20 bp, Homo sapiens
tttatgagtcagtctctctc

SEQ ID NO: 5814370 - DNA, 19 bp, Homo sapiens
tttatgagtgttaataaaa

SEQ ID NO: 5814371 - DNA, 13 bp, Homo sapiens
tttatgagttctt

SEQ ID NO: 5814372 - DNA, 19 bp, Homo sapiens
tttatgataatagattctc

SEQ ID NO: 5814373 - DNA, 17 bp, Homo sapiens
tttatgatcaaggaaaa

SEQ ID NO: 5814374 - DNA, 17 bp, Homo sapiens
tttatgatgatgaaaat

SEQ ID NO: 5814375 - DNA, 17 bp, Homo sapiens
tttatgatgcaaatctg

SEQ ID NO: 5814376 - DNA, 15 bp, Homo sapiens
tttatgatgctattt

SEQ ID NO: 5814377 - DNA, 20 bp, Homo sapiens
tttatgatggagcaactgaa

SEQ ID NO: 5814378 - DNA, 18 bp, Homo sapiens
tttatgatttaataaaat

SEQ ID NO: 5814379 - DNA, 12 bp, Homo sapiens
tttatgatttca

SEQ ID NO: 5814380 - DNA, 16 bp, Homo sapiens
tttatgatttcaacat

SEQ ID NO: 5814381 - DNA, 17 bp, Homo sapiens
tttatgatttcatgatt

SEQ ID NO: 5814382 - DNA, 17 bp, Homo sapiens
tttatgattttcataac

SEQ ID NO: 5814383 - DNA, 17 bp, Homo sapiens
tttatgcaaggaaggaa

SEQ ID NO: 5814384 - DNA, 18 bp, Homo sapiens
tttatgcaaggaaggaaa

SEQ ID NO: 5814385 - DNA, 18 bp, Homo sapiens
tttatgcaaggtcttgca

SEQ ID NO: 5814386 - DNA, 13 bp, Homo sapiens
tttatgcaataaa

SEQ ID NO: 5814387 - DNA, 14 bp, Homo sapiens
tttatgcacagcct

SEQ ID NO: 5814388 - DNA, 19 bp, Homo sapiens
tttatgcacttataaggtg

SEQ ID NO: 5814389 - DNA, 17 bp, Homo sapiens
tttatgcagaaggtatt

SEQ ID NO: 5814390 - DNA, 12 bp, Homo sapiens
tttatgcagaca

SEQ ID NO: 5814391 - DNA, 14 bp, Homo sapiens
tttatgcagacagt

SEQ ID NO: 5814392 - DNA, 14 bp, Homo sapiens
tttatgcagcaaat

SEQ ID NO: 5814393 - DNA, 17 bp, Homo sapiens
tttatgcagcaaatata

SEQ ID NO: 5814394 - DNA, 14 bp, Homo sapiens
tttatgcagtgctg

SEQ ID NO: 5814395 - DNA, 16 bp, Homo sapiens
tttatgcagtgctgct

SEQ ID NO: 5814396 - DNA, 19 bp, Homo sapiens
tttatgcagtgctgctttg

SEQ ID NO: 5814397 - DNA, 23 bp, Homo sapiens
tttatgcatgagaactaaataga

SEQ ID NO: 5814398 - DNA, 10 bp, Homo sapiens
tttatgcatt

SEQ ID NO: 5814399 - DNA, 14 bp, Homo sapiens
tttatgccacctga

SEQ ID NO: 5814400 - DNA, 13 bp, Homo sapiens
tttatgccatgtt

SEQ ID NO: 5814401 - DNA, 23 bp, Homo sapiens
tttatgcgcaaatacaaaatgat

SEQ ID NO: 5814402 - DNA, 21 bp, Homo sapiens
tttatgctactgaactgaaag

SEQ ID NO: 5814403 - DNA, 17 bp, Homo sapiens
tttatgctataaatttt

SEQ ID NO: 5814404 - DNA, 21 bp, Homo sapiens
tttatgctataaattttttga

SEQ ID NO: 5814405 - DNA, 16 bp, Homo sapiens
tttatgcttgcttggg

SEQ ID NO: 5814406 - DNA, 20 bp, Homo sapiens
tttatggaaaaattgacaaa

SEQ ID NO: 5814407 - DNA, 22 bp, Homo sapiens
tttatggaaaaattgacaaaaa

SEQ ID NO: 5814408 - DNA, 22 bp, Homo sapiens
tttatggagtttgtgggaaata

SEQ ID NO: 5814409 - DNA, 20 bp, Homo sapiens
tttatggatcccaattcatt

SEQ ID NO: 5814410 - DNA, 15 bp, Homo sapiens
tttatggatgattaa

SEQ ID NO: 5814411 - DNA, 16 bp, Homo sapiens
tttatggcatgattta

SEQ ID NO: 5814412 - DNA, 22 bp, Homo sapiens
tttatggcatgatttatatatg

SEQ ID NO: 5814413 - DNA, 22 bp, Homo sapiens
tttatggcctcagctgcctcac

SEQ ID NO: 5814414 - DNA, 15 bp, Homo sapiens
tttatggccttgaag

SEQ ID NO: 5814415 - DNA, 19 bp, Homo sapiens
tttatggccttgaagtgtt

SEQ ID NO: 5814416 - DNA, 16 bp, Homo sapiens
tttatggctagacagg

SEQ ID NO: 5814417 - DNA, 18 bp, Homo sapiens
tttatggcttataaatgt

SEQ ID NO: 5814418 - DNA, 22 bp, Homo sapiens
tttatggggctgaacggggaga

SEQ ID NO: 5814419 - DNA, 17 bp, Homo sapiens
tttatgggtttcttcca

SEQ ID NO: 5814420 - DNA, 20 bp, Homo sapiens
tttatgggtttcttccagca

SEQ ID NO: 5814421 - DNA, 19 bp, Homo sapiens
tttatggtaaaaaatttat

SEQ ID NO: 5814422 - DNA, 21 bp, Homo sapiens
tttatggtaactgctttctgt

SEQ ID NO: 5814423 - DNA, 18 bp, Homo sapiens
tttatggtattgtattgt

SEQ ID NO: 5814424 - DNA, 19 bp, Homo sapiens
tttatggtattttcgtgca

SEQ ID NO: 5814425 - DNA, 21 bp, Homo sapiens
tttatggtggatgaggcttct

SEQ ID NO: 5814426 - DNA, 22 bp, Homo sapiens
tttatggtgtgttcctaacata

SEQ ID NO: 5814427 - DNA, 15 bp, Homo sapiens
tttatggttatgttt

SEQ ID NO: 5814428 - DNA, 19 bp, Homo sapiens
tttatggttatgtttttct

SEQ ID NO: 5814429 - DNA, 22 bp, Homo sapiens
tttatggtttctgtctgaatta

SEQ ID NO: 5814430 - DNA, 19 bp, Homo sapiens
tttatgtaaaatcaataaa

SEQ ID NO: 5814431 - DNA, 17 bp, Homo sapiens
tttcaaagccctgcctc

SEQ ID NO: 5814432 - DNA, 20 bp, Homo sapiens
tttcaaagccctgcctctgt

SEQ ID NO: 5814433 - DNA, 21 bp, Homo sapiens
tttcaaagccctgcctctgtg

SEQ ID NO: 5814434 - DNA, 18 bp, Homo sapiens
tttcaaaggaacattgtg

SEQ ID NO: 5814435 - DNA, 19 bp, Homo sapiens
tttcaaagtaaaggcctcc

SEQ ID NO: 5814436 - DNA, 20 bp, Homo sapiens
tttcaaagtaaaggcctcct

SEQ ID NO: 5814437 - DNA, 23 bp, Homo sapiens
tttcaaagtaaaggcctcctccc

SEQ ID NO: 5814438 - DNA, 16 bp, Homo sapiens
tttcaaagtgcacaca

SEQ ID NO: 5814439 - DNA, 21 bp, Homo sapiens
tttcaaagttttgttgtactt

SEQ ID NO: 5814440 - DNA, 15 bp, Homo sapiens
tttcaaataactgca

SEQ ID NO: 5814441 - DNA, 16 bp, Homo sapiens
tttcaaataatgcttt

SEQ ID NO: 5814442 - DNA, 23 bp, Homo sapiens
tttcaaataatgcttttctaatt

SEQ ID NO: 5814443 - DNA, 19 bp, Homo sapiens
tttcaaatagggtctaact

SEQ ID NO: 5814444 - DNA, 13 bp, Homo sapiens
tttcaaatattga

SEQ ID NO: 5814445 - DNA, 19 bp, Homo sapiens
tttcaaatcatgttttttc

SEQ ID NO: 5814446 - DNA, 21 bp, Homo sapiens
tttcaaatcattccttagata

SEQ ID NO: 5814447 - DNA, 21 bp, Homo sapiens
tttcaaatcatttttgagact

SEQ ID NO: 5814448 - DNA, 13 bp, Homo sapiens
tttcaaatccact

SEQ ID NO: 5814449 - DNA, 14 bp, Homo sapiens
tttcaaatccttat

SEQ ID NO: 5814450 - DNA, 14 bp, Homo sapiens
tttcaaatgattat

SEQ ID NO: 5814451 - DNA, 12 bp, Homo sapiens
tttcaaatgcag

SEQ ID NO: 5814452 - DNA, 23 bp, Homo sapiens
tttcaaatggactcatggcttag

SEQ ID NO: 5814453 - DNA, 10 bp, Homo sapiens
tttcaaatgt

SEQ ID NO: 5814454 - DNA, 13 bp, Homo sapiens
tttcaaattataa

SEQ ID NO: 5814455 - DNA, 13 bp, Homo sapiens
tttcaaattatat

SEQ ID NO: 5814456 - DNA, 16 bp, Homo sapiens
tttcaaattgagagaa

SEQ ID NO: 5814457 - DNA, 21 bp, Homo sapiens
tttcaaattggagcttcatgg

SEQ ID NO: 5814458 - DNA, 14 bp, Homo sapiens
tttcaaatttagaa

SEQ ID NO: 5814459 - DNA, 23 bp, Homo sapiens
tttcaaatttagaaactaattga

SEQ ID NO: 5814460 - DNA, 14 bp, Homo sapiens
tttcaaatttcaca

SEQ ID NO: 5814461 - DNA, 23 bp, Homo sapiens
tttcaacaaatatcttgtgttgt

SEQ ID NO: 5814462 - DNA, 20 bp, Homo sapiens
tttcaacaaatttcattgca

SEQ ID NO: 5814463 - DNA, 15 bp, Homo sapiens
tttcaacaaggcaaa

SEQ ID NO: 5814464 - DNA, 12 bp, Homo sapiens
tttcaacaattt

SEQ ID NO: 5814465 - DNA, 21 bp, Homo sapiens
tttcaacatgtacaggaagtt

SEQ ID NO: 5814466 - DNA, 13 bp, Homo sapiens
tttcaacattgat

SEQ ID NO: 5814467 - DNA, 14 bp, Homo sapiens
tttcaaccagcatt

SEQ ID NO: 5814468 - DNA, 19 bp, Homo sapiens
tttcaaccataaaagaagt

SEQ ID NO: 5814469 - DNA, 15 bp, Homo sapiens
tttcaacctctagaa

SEQ ID NO: 5814470 - DNA, 23 bp, Homo sapiens
tttcaacggaaagtgctgtctta

SEQ ID NO: 5814471 - DNA, 15 bp, Homo sapiens
tttcaactatgtagg

SEQ ID NO: 5814472 - DNA, 23 bp, Homo sapiens
tttcaactcaggaactatggcaa

SEQ ID NO: 5814473 - DNA, 13 bp, Homo sapiens
tttcaactcattg

SEQ ID NO: 5814474 - DNA, 14 bp, Homo sapiens
tttcaacttaaatc

SEQ ID NO: 5814475 - DNA, 23 bp, Homo sapiens
tttcaacttaaatcactgaggca

SEQ ID NO: 5814476 - DNA, 18 bp, Homo sapiens
tttcaacttatttctgaa

SEQ ID NO: 5814477 - DNA, 19 bp, Homo sapiens
tttcaacttcaagatgaag

SEQ ID NO: 5814478 - DNA, 19 bp, Homo sapiens
tttcaacttcagtactcaa

SEQ ID NO: 5814479 - DNA, 15 bp, Homo sapiens
tttcaacttcttcta

SEQ ID NO: 5814480 - DNA, 18 bp, Homo sapiens
tttcaagaaaaaataaat

SEQ ID NO: 5814481 - DNA, 18 bp, Homo sapiens
tttcaagaaaactggaaa

SEQ ID NO: 5814482 - DNA, 16 bp, Homo sapiens
tttcaagaaaatcttt

SEQ ID NO: 5814483 - DNA, 20 bp, Homo sapiens
tttcaagaaaattttgcaga

SEQ ID NO: 5814484 - DNA, 17 bp, Homo sapiens
tttcaagaaactgagga

SEQ ID NO: 5814485 - DNA, 15 bp, Homo sapiens
tttcaagaacctgga

SEQ ID NO: 5814486 - DNA, 16 bp, Homo sapiens
tttcaagaacttgttt

SEQ ID NO: 5814487 - DNA, 17 bp, Homo sapiens
tttcaagaatgtttcag

SEQ ID NO: 5814488 - DNA, 18 bp, Homo sapiens
tttcaagactgaattcca

SEQ ID NO: 5814489 - DNA, 16 bp, Homo sapiens
tttcaagacttgatac

SEQ ID NO: 5814490 - DNA, 22 bp, Homo sapiens
tttcaagagtctaatagtcttt

SEQ ID NO: 5814491 - DNA, 22 bp, Homo sapiens
tttcaagataaggagaaagaaa

SEQ ID NO: 5814492 - DNA, 12 bp, Homo sapiens
tttcaagattct

SEQ ID NO: 5814493 - DNA, 16 bp, Homo sapiens
tttcaagcaaaacagt

SEQ ID NO: 5814494 - DNA, 20 bp, Homo sapiens
tttcaagcatctcctgagga

SEQ ID NO: 5814495 - DNA, 14 bp, Homo sapiens
tttcaagctaattt

SEQ ID NO: 5814496 - DNA, 22 bp, Homo sapiens
tttcaagctcatgtcattatga

SEQ ID NO: 5814497 - DNA, 12 bp, Homo sapiens
tttcaagctgca

SEQ ID NO: 5814498 - DNA, 19 bp, Homo sapiens
tttcaagctggaagaagtg

SEQ ID NO: 5814499 - DNA, 18 bp, Homo sapiens
tttcaagctttcaaatcc

SEQ ID NO: 5814500 - DNA, 17 bp, Homo sapiens
tttcaaggaaggttcat

SEQ ID NO: 5814501 - DNA, 20 bp, Homo sapiens
tttcaaggaaggttcatgta

SEQ ID NO: 5814502 - DNA, 19 bp, Homo sapiens
tttcaaggaagtagaaaca

SEQ ID NO: 5814503 - DNA, 15 bp, Homo sapiens
tttcaaggactattt

SEQ ID NO: 5814504 - DNA, 15 bp, Homo sapiens
tttcaaggcacattg

SEQ ID NO: 5814505 - DNA, 15 bp, Homo sapiens
tttcaaggcactcta

SEQ ID NO: 5814506 - DNA, 17 bp, Homo sapiens
tttcaaggcactctaga

SEQ ID NO: 5814507 - DNA, 21 bp, Homo sapiens
tttcaaggcatttattgccat

SEQ ID NO: 5814508 - DNA, 18 bp, Homo sapiens
tttcaaggccctcagcat

SEQ ID NO: 5814509 - DNA, 12 bp, Homo sapiens
tttcaaggcctt

SEQ ID NO: 5814510 - DNA, 14 bp, Homo sapiens
tttcaaggccttca

SEQ ID NO: 5814511 - DNA, 15 bp, Homo sapiens
tttcaaggccttcag

SEQ ID NO: 5814512 - DNA, 21 bp, Homo sapiens
tttcaaggccttcagtttatt

SEQ ID NO: 5814513 - DNA, 18 bp, Homo sapiens
tttcaagggaattaaata

SEQ ID NO: 5814514 - DNA, 13 bp, Homo sapiens
tttcaaggttcta

SEQ ID NO: 5814515 - DNA, 16 bp, Homo sapiens
tttcaagtaataaaac

SEQ ID NO: 5814516 - DNA, 16 bp, Homo sapiens
tttcaagtagctggga

SEQ ID NO: 5814517 - DNA, 17 bp, Homo sapiens
tttcaagtatttaagcc

SEQ ID NO: 5814518 - DNA, 18 bp, Homo sapiens
tttcaagtcaaattaata

SEQ ID NO: 5814519 - DNA, 12 bp, Homo sapiens
tttcaagtgcct

SEQ ID NO: 5814520 - DNA, 15 bp, Homo sapiens
tttcaagtgcctaga

SEQ ID NO: 5814521 - DNA, 21 bp, Homo sapiens
tttcaagtgcctagactgtta

SEQ ID NO: 5814522 - DNA, 21 bp, Homo sapiens
tttcaagttaaataaattatg

SEQ ID NO: 5814523 - DNA, 19 bp, Homo sapiens
tttcaagttattcagaaat

SEQ ID NO: 5814524 - DNA, 20 bp, Homo sapiens
tttcaagttattcagaaata

SEQ ID NO: 5814525 - DNA, 22 bp, Homo sapiens
tttcaagttccaagttgctaat

SEQ ID NO: 5814526 - DNA, 22 bp, Homo sapiens
tttcaataaaagataaattatt

SEQ ID NO: 5814527 - DNA, 19 bp, Homo sapiens
tttcaataaagcatttata

SEQ ID NO: 5814528 - DNA, 20 bp, Homo sapiens
tttcaataaagcatttataa

SEQ ID NO: 5814529 - DNA, 19 bp, Homo sapiens
tttcaataaagttgttgca

SEQ ID NO: 5814530 - DNA, 20 bp, Homo sapiens
tttcaataaagttgttgcat

SEQ ID NO: 5814531 - DNA, 22 bp, Homo sapiens
tttcaataaagttgttgcattc

SEQ ID NO: 5814532 - DNA, 14 bp, Homo sapiens
tttcaataaagttt

SEQ ID NO: 5814533 - DNA, 19 bp, Homo sapiens
tttcaataaatctttcaaa

SEQ ID NO: 5814534 - DNA, 21 bp, Homo sapiens
tttcaataacaaaacgaaact

SEQ ID NO: 5814535 - DNA, 21 bp, Homo sapiens
tttcaataacgaagttgggca

SEQ ID NO: 5814536 - DNA, 22 bp, Homo sapiens
tttcaataacgaagttgggcaa

SEQ ID NO: 5814537 - DNA, 21 bp, Homo sapiens
tttcaatacttacatatctga

SEQ ID NO: 5814538 - DNA, 14 bp, Homo sapiens
tttcaatagccact

SEQ ID NO: 5814539 - DNA, 21 bp, Homo sapiens
tttcaatagccactaaccttg

SEQ ID NO: 5814540 - DNA, 19 bp, Homo sapiens
tttcaataggaaaaactga

SEQ ID NO: 5814541 - DNA, 20 bp, Homo sapiens
tttcaataggaaaaactgat

SEQ ID NO: 5814542 - DNA, 17 bp, Homo sapiens
tttcaatatattgaact

SEQ ID NO: 5814543 - DNA, 22 bp, Homo sapiens
tttcaatatattgaacttttgt

SEQ ID NO: 5814544 - DNA, 13 bp, Homo sapiens
tttcaatatgcaa

SEQ ID NO: 5814545 - DNA, 21 bp, Homo sapiens
tttcaatatgcaagcagcttt

SEQ ID NO: 5814546 - DNA, 18 bp, Homo sapiens
tttcaatattttaacttt

SEQ ID NO: 5814547 - DNA, 17 bp, Homo sapiens
tttcaatattttccttc

SEQ ID NO: 5814548 - DNA, 16 bp, Homo sapiens
tttcaatcaaccaaag

SEQ ID NO: 5814549 - DNA, 18 bp, Homo sapiens
tttcaatcaactttactg

SEQ ID NO: 5814550 - DNA, 19 bp, Homo sapiens
tttcaatcaactttactgt

SEQ ID NO: 5814551 - DNA, 13 bp, Homo sapiens
tttcaatcccaat

SEQ ID NO: 5814552 - DNA, 22 bp, Homo sapiens
tttcaatcgtaaaatttcccat

SEQ ID NO: 5814553 - DNA, 13 bp, Homo sapiens
tttcaatctcgta

SEQ ID NO: 5814554 - DNA, 12 bp, Homo sapiens
tttcaatgattg

SEQ ID NO: 5814555 - DNA, 21 bp, Homo sapiens
tttcaatgattgtttaattgt

SEQ ID NO: 5814556 - DNA, 15 bp, Homo sapiens
tttcaatgcaatgca

SEQ ID NO: 5814557 - DNA, 19 bp, Homo sapiens
tttcaatgcatacaataaa

SEQ ID NO: 5814558 - DNA, 19 bp, Homo sapiens
tttcaatgcttcttttagt

SEQ ID NO: 5814559 - DNA, 20 bp, Homo sapiens
tttcaatgcttcttttagtc

SEQ ID NO: 5814560 - DNA, 22 bp, Homo sapiens
tttcaatgggttttaattttca

SEQ ID NO: 5814561 - DNA, 19 bp, Homo sapiens
tttcaatgtctaaaaacat

SEQ ID NO: 5814562 - DNA, 13 bp, Homo sapiens
tttcaatgtgaaa

SEQ ID NO: 5814563 - DNA, 23 bp, Homo sapiens
tttcaatgtgatataaacagctt

SEQ ID NO: 5814564 - DNA, 14 bp, Homo sapiens
tttcaatgtgattc

SEQ ID NO: 5814565 - DNA, 21 bp, Homo sapiens
tttcaatgtgattcttctaaa

SEQ ID NO: 5814566 - DNA, 15 bp, Homo sapiens
tttcaattaaacgga

SEQ ID NO: 5814567 - DNA, 19 bp, Homo sapiens
tttcaattaaacggattat

SEQ ID NO: 5814568 - DNA, 23 bp, Homo sapiens
tttcaattaatattaattttcta

SEQ ID NO: 5814569 - DNA, 19 bp, Homo sapiens
tttcaattagaaaaggaaa

SEQ ID NO: 5814570 - DNA, 19 bp, Homo sapiens
tttcaattagatttaaaat

SEQ ID NO: 5814571 - DNA, 12 bp, Homo sapiens
tttcaattatac

SEQ ID NO: 5814572 - DNA, 20 bp, Homo sapiens
tttcaattatgtttgaaaat

SEQ ID NO: 5814573 - DNA, 17 bp, Homo sapiens
tttcaattatttcaatg

SEQ ID NO: 5814574 - DNA, 14 bp, Homo sapiens
tttcaattcagatt

SEQ ID NO: 5814575 - DNA, 15 bp, Homo sapiens
tttcaattgagtaat

SEQ ID NO: 5814576 - DNA, 17 bp, Homo sapiens
tttcaattgagtaattc

SEQ ID NO: 5814577 - DNA, 13 bp, Homo sapiens
tttcaattgcttt

SEQ ID NO: 5814578 - DNA, 20 bp, Homo sapiens
tttcaattgctttgtgactt

SEQ ID NO: 5814579 - DNA, 18 bp, Homo sapiens
tttcaattgtattttata

SEQ ID NO: 5814580 - DNA, 21 bp, Homo sapiens
tttcaattgtattttatatga

SEQ ID NO: 5814581 - DNA, 17 bp, Homo sapiens
tttcaattgtttatatg

SEQ ID NO: 5814582 - DNA, 13 bp, Homo sapiens
tttcaatttactt

SEQ ID NO: 5814583 - DNA, 12 bp, Homo sapiens
tttcacaaatat

SEQ ID NO: 5814584 - DNA, 18 bp, Homo sapiens
tttcacaaatattaaaaa

SEQ ID NO: 5814585 - DNA, 13 bp, Homo sapiens
tttcacaacagat

SEQ ID NO: 5814586 - DNA, 23 bp, Homo sapiens
tttcacaacagcctgacaacatt

SEQ ID NO: 5814587 - DNA, 15 bp, Homo sapiens
tttcacaatgtgaaa

SEQ ID NO: 5814588 - DNA, 23 bp, Homo sapiens
tttcacaattccatttccagttc

SEQ ID NO: 5814589 - DNA, 23 bp, Homo sapiens
tttcacacaatgcccaacttact

SEQ ID NO: 5814590 - DNA, 13 bp, Homo sapiens
tttcacactggat

SEQ ID NO: 5814591 - DNA, 16 bp, Homo sapiens
tttcacagataacata

SEQ ID NO: 5814592 - DNA, 17 bp, Homo sapiens
tttcacagataacataa

SEQ ID NO: 5814593 - DNA, 21 bp, Homo sapiens
tttcacagatggaagaagttt

SEQ ID NO: 5814594 - DNA, 22 bp, Homo sapiens
tttcacagatggaagaagtttt

SEQ ID NO: 5814595 - DNA, 14 bp, Homo sapiens
tttcacagcttctt

SEQ ID NO: 5814596 - DNA, 15 bp, Homo sapiens
tttcacaggctgtaa

SEQ ID NO: 5814597 - DNA, 13 bp, Homo sapiens
tttcacagtattt

SEQ ID NO: 5814598 - DNA, 22 bp, Homo sapiens
tttcacagtatttacaagctat

SEQ ID NO: 5814599 - DNA, 16 bp, Homo sapiens
tttcacagtgtgattt

SEQ ID NO: 5814600 - DNA, 22 bp, Homo sapiens
tttcacagtgtgtggtcaacat

SEQ ID NO: 5814601 - DNA, 19 bp, Homo sapiens
tttcacagtgtgtttgtga

SEQ ID NO: 5814602 - DNA, 19 bp, Homo sapiens
tttcacagttctgtaatgt

SEQ ID NO: 5814603 - DNA, 19 bp, Homo sapiens
tttcacagttggcacttct

SEQ ID NO: 5814604 - DNA, 17 bp, Homo sapiens
tttcacagtttgaaata

SEQ ID NO: 5814605 - DNA, 21 bp, Homo sapiens
tttcacatatctagtatgaaa

SEQ ID NO: 5814606 - DNA, 16 bp, Homo sapiens
tttcacatctctgtag

SEQ ID NO: 5814607 - DNA, 14 bp, Homo sapiens
tttcacatctgtat

SEQ ID NO: 5814608 - DNA, 18 bp, Homo sapiens
tttcagctcttaaaaaga

SEQ ID NO: 5814609 - DNA, 23 bp, Homo sapiens
tttcagctcttaaaaagacactt

SEQ ID NO: 5814610 - DNA, 13 bp, Homo sapiens
tttcagctgagcc

SEQ ID NO: 5814611 - DNA, 19 bp, Homo sapiens
tttcagctggagatactga

SEQ ID NO: 5814612 - DNA, 14 bp, Homo sapiens
tttcagcttacaca

SEQ ID NO: 5814613 - DNA, 15 bp, Homo sapiens
tttcagcttctctgc

SEQ ID NO: 5814614 - DNA, 17 bp, Homo sapiens
tttcagcttctctgcta

SEQ ID NO: 5814615 - DNA, 19 bp, Homo sapiens
tttcagcttctgctgggct

SEQ ID NO: 5814616 - DNA, 23 bp, Homo sapiens
tttcaggaaaatgtattgattca

SEQ ID NO: 5814617 - DNA, 18 bp, Homo sapiens
tttcaggaagggagagga

SEQ ID NO: 5814618 - DNA, 22 bp, Homo sapiens
tttcaggaagttgctgagaaat

SEQ ID NO: 5814619 - DNA, 15 bp, Homo sapiens
tttcaggaatttaaa

SEQ ID NO: 5814620 - DNA, 16 bp, Homo sapiens
tttcaggacatggggc

SEQ ID NO: 5814621 - DNA, 16 bp, Homo sapiens
tttcaggaccttttga

SEQ ID NO: 5814622 - DNA, 22 bp, Homo sapiens
tttcaggaggaatactgaacat

SEQ ID NO: 5814623 - DNA, 18 bp, Homo sapiens
tttcaggagggtccccag

SEQ ID NO: 5814624 - DNA, 22 bp, Homo sapiens
tttcaggagggtccccagctgg

SEQ ID NO: 5814625 - DNA, 13 bp, Homo sapiens
tttcaggatctat

SEQ ID NO: 5814626 - DNA, 23 bp, Homo sapiens
tttcaggattaactaaagaagag

SEQ ID NO: 5814627 - DNA, 19 bp, Homo sapiens
tttcaggcattggatattt

SEQ ID NO: 5814628 - DNA, 19 bp, Homo sapiens
tttcaggccagtgtggtgt

SEQ ID NO: 5814629 - DNA, 21 bp, Homo sapiens
tttcaggctcgccaaggccta

SEQ ID NO: 5814630 - DNA, 16 bp, Homo sapiens
tttcaggcttttatga

SEQ ID NO: 5814631 - DNA, 15 bp, Homo sapiens
tttcagggacctcag

SEQ ID NO: 5814632 - DNA, 20 bp, Homo sapiens
tttcagggacctcaggggca

SEQ ID NO: 5814633 - DNA, 15 bp, Homo sapiens
tttcagggagaaact

SEQ ID NO: 5814634 - DNA, 22 bp, Homo sapiens
tttcagggaggtggctgggttt

SEQ ID NO: 5814635 - DNA, 18 bp, Homo sapiens
tttcagggcagcccctgc

SEQ ID NO: 5814636 - DNA, 15 bp, Homo sapiens
tttcagggctggctc

SEQ ID NO: 5814637 - DNA, 24 bp, Homo sapiens
tttcaggtatttttattcatgtga

SEQ ID NO: 5814638 - DNA, 13 bp, Homo sapiens
tttcaggtgacat

SEQ ID NO: 5814639 - DNA, 19 bp, Homo sapiens
tttcaggtgctcaaaatgc

SEQ ID NO: 5814640 - DNA, 22 bp, Homo sapiens
tttcaggtgctcaaaatgcaaa

SEQ ID NO: 5814641 - DNA, 18 bp, Homo sapiens
tttcaggttatatccaat

SEQ ID NO: 5814642 - DNA, 19 bp, Homo sapiens
tttcaggttttagttttta

SEQ ID NO: 5814643 - DNA, 19 bp, Homo sapiens
tttcagtaaacctgtctga

SEQ ID NO: 5814644 - DNA, 18 bp, Homo sapiens
tttcagtaataaaacatc

SEQ ID NO: 5814645 - DNA, 21 bp, Homo sapiens
tttcagtaatagctgaacctg

SEQ ID NO: 5814646 - DNA, 15 bp, Homo sapiens
tttcagtaccaaaga

SEQ ID NO: 5814647 - DNA, 23 bp, Homo sapiens
tttcagtacttcagcaagagaga

SEQ ID NO: 5814648 - DNA, 14 bp, Homo sapiens
tttcagtagaattt

SEQ ID NO: 5814649 - DNA, 21 bp, Homo sapiens
tttcagtagaattttagtcct

SEQ ID NO: 5814650 - DNA, 14 bp, Homo sapiens
tttcagtagtttct

SEQ ID NO: 5814651 - DNA, 16 bp, Homo sapiens
tttcagtagtttctaa

SEQ ID NO: 5814652 - DNA, 17 bp, Homo sapiens
tttcagtatactgtgtg

SEQ ID NO: 5814653 - DNA, 23 bp, Homo sapiens
tttcagtatgtccccataagaca

SEQ ID NO: 5814654 - DNA, 20 bp, Homo sapiens
tttcagtattagtgatgtca

SEQ ID NO: 5814655 - DNA, 14 bp, Homo sapiens
tttcagtattatat

SEQ ID NO: 5814656 - DNA, 16 bp, Homo sapiens
tttcagtattatatgt

SEQ ID NO: 5814657 - DNA, 21 bp, Homo sapiens
tttcagtattttggagaaatt

SEQ ID NO: 5814658 - DNA, 15 bp, Homo sapiens
tttcagtcaaaactt

SEQ ID NO: 5814659 - DNA, 15 bp, Homo sapiens
tttcagtcttgtagt

SEQ ID NO: 5814660 - DNA, 20 bp, Homo sapiens
tttcagtgaagatgctgtaa

SEQ ID NO: 5814661 - DNA, 19 bp, Homo sapiens
tttcagtgaatatgcctgt

SEQ ID NO: 5814662 - DNA, 11 bp, Homo sapiens
tttcagtgagg

SEQ ID NO: 5814663 - DNA, 19 bp, Homo sapiens
tttcagtgataatgttcat

SEQ ID NO: 5814664 - DNA, 19 bp, Homo sapiens
tttcagtgatcttcactgt

SEQ ID NO: 5814665 - DNA, 20 bp, Homo sapiens
tttcagtgcagtaatttctg

SEQ ID NO: 5814666 - DNA, 15 bp, Homo sapiens
tttcagtgcctgctg

SEQ ID NO: 5814667 - DNA, 19 bp, Homo sapiens
tttcagtggaatagatgtc

SEQ ID NO: 5814668 - DNA, 14 bp, Homo sapiens
tttcagtgggaaat

SEQ ID NO: 5814669 - DNA, 19 bp, Homo sapiens
tttcagtgggtctctgtgt

SEQ ID NO: 5814670 - DNA, 19 bp, Homo sapiens
tttcagtgtagcgggagga

SEQ ID NO: 5814671 - DNA, 21 bp, Homo sapiens
tttcagtgtcaaataaacact

SEQ ID NO: 5814672 - DNA, 22 bp, Homo sapiens
tttcagtgtcaaataaacactg

SEQ ID NO: 5814673 - DNA, 17 bp, Homo sapiens
tttcagtgttacctgtg

SEQ ID NO: 5814674 - DNA, 18 bp, Homo sapiens
tttcagttataatttcaa

SEQ ID NO: 5814675 - DNA, 19 bp, Homo sapiens
tttcagttataatttcaat

SEQ ID NO: 5814676 - DNA, 20 bp, Homo sapiens
tttcagttattgtccctggc

SEQ ID NO: 5814677 - DNA, 14 bp, Homo sapiens
tttcagttcaaagt

SEQ ID NO: 5814678 - DNA, 20 bp, Homo sapiens
tttcagttccctcctgccca

SEQ ID NO: 5814679 - DNA, 18 bp, Homo sapiens
tttcagttctaggaaaat

SEQ ID NO: 5814680 - DNA, 13 bp, Homo sapiens
tttcagttctatt

SEQ ID NO: 5814681 - DNA, 20 bp, Homo sapiens
tttcagttctttctttttct

SEQ ID NO: 5814682 - DNA, 21 bp, Homo sapiens
tttcagttgatcactggcaat

SEQ ID NO: 5814683 - DNA, 15 bp, Homo sapiens
tttcagtttaattct

SEQ ID NO: 5814684 - DNA, 21 bp, Homo sapiens
tttcagtttatttgaaccaat

SEQ ID NO: 5814685 - DNA, 17 bp, Homo sapiens
tttcagtttgtttactt

SEQ ID NO: 5814686 - DNA, 17 bp, Homo sapiens
tttcagtttttcatttg

SEQ ID NO: 5814687 - DNA, 19 bp, Homo sapiens
tttcagtttttcatttgtt

SEQ ID NO: 5814688 - DNA, 17 bp, Homo sapiens
tttcagtttttttaaat

SEQ ID NO: 5814689 - DNA, 14 bp, Homo sapiens
tttcataaacaagt

SEQ ID NO: 5814690 - DNA, 17 bp, Homo sapiens
tttcataaacaagttcg

SEQ ID NO: 5814691 - DNA, 14 bp, Homo sapiens
tttcataaactgag

SEQ ID NO: 5814692 - DNA, 15 bp, Homo sapiens
tttcataaagggttg

SEQ ID NO: 5814693 - DNA, 18 bp, Homo sapiens
tttcataaatcatgttgt

SEQ ID NO: 5814694 - DNA, 14 bp, Homo sapiens
tttcataaattggc

SEQ ID NO: 5814695 - DNA, 15 bp, Homo sapiens
tttcataacaaacca

SEQ ID NO: 5814696 - DNA, 22 bp, Homo sapiens
tttcataacttattgctgattt

SEQ ID NO: 5814697 - DNA, 23 bp, Homo sapiens
tttcataagaggttctaacttct

SEQ ID NO: 5814698 - DNA, 18 bp, Homo sapiens
tttcataagatattttat

SEQ ID NO: 5814699 - DNA, 19 bp, Homo sapiens
tttcataagatattttatt

SEQ ID NO: 5814700 - DNA, 21 bp, Homo sapiens
tttcataagctttgtaattca

SEQ ID NO: 5814701 - DNA, 18 bp, Homo sapiens
tttcataagtatttcaaa

SEQ ID NO: 5814702 - DNA, 16 bp, Homo sapiens
tttcataataaataga

SEQ ID NO: 5814703 - DNA, 14 bp, Homo sapiens
tttcataatctttg

SEQ ID NO: 5814704 - DNA, 12 bp, Homo sapiens
tttcataattca

SEQ ID NO: 5814705 - DNA, 17 bp, Homo sapiens
tttcataattcatttaa

SEQ ID NO: 5814706 - DNA, 18 bp, Homo sapiens
tttcataattcatttaag

SEQ ID NO: 5814707 - DNA, 19 bp, Homo sapiens
tttcataattctgaaacaa

SEQ ID NO: 5814708 - DNA, 16 bp, Homo sapiens
tttcataatttttaaa

SEQ ID NO: 5814709 - DNA, 18 bp, Homo sapiens
tttcatacaaaactgttc

SEQ ID NO: 5814710 - DNA, 14 bp, Homo sapiens
tttcatacacttat

SEQ ID NO: 5814711 - DNA, 12 bp, Homo sapiens
tttcatacatta

SEQ ID NO: 5814712 - DNA, 15 bp, Homo sapiens
tttcatacattatat

SEQ ID NO: 5814713 - DNA, 17 bp, Homo sapiens
tttcatacattatattc

SEQ ID NO: 5814714 - DNA, 16 bp, Homo sapiens
tttcatactgtacaca

SEQ ID NO: 5814715 - DNA, 23 bp, Homo sapiens
tttcatactgtacacatttctta

SEQ ID NO: 5814716 - DNA, 14 bp, Homo sapiens
tttcatagaagtgt

SEQ ID NO: 5814717 - DNA, 20 bp, Homo sapiens
tttcatagataccattttga

SEQ ID NO: 5814718 - DNA, 17 bp, Homo sapiens
tttcatagcctacattt

SEQ ID NO: 5814719 - DNA, 15 bp, Homo sapiens
tttcatagctaaaaa

SEQ ID NO: 5814720 - DNA, 15 bp, Homo sapiens
tttcatagttcagaa

SEQ ID NO: 5814721 - DNA, 22 bp, Homo sapiens
tttcatagtttcaaatctgtaa

SEQ ID NO: 5814722 - DNA, 17 bp, Homo sapiens
tttcatagttttctaaa

SEQ ID NO: 5814723 - DNA, 14 bp, Homo sapiens
tttcatataaatgg

SEQ ID NO: 5814724 - DNA, 21 bp, Homo sapiens
tttcatataggaatagaaaca

SEQ ID NO: 5814725 - DNA, 13 bp, Homo sapiens
tttcatatccaag

SEQ ID NO: 5814726 - DNA, 18 bp, Homo sapiens
tttcatatctaactttgt

SEQ ID NO: 5814727 - DNA, 21 bp, Homo sapiens
tttcatatctggtcaagttga

SEQ ID NO: 5814728 - DNA, 15 bp, Homo sapiens
tttcatatgtggaaa

SEQ ID NO: 5814729 - DNA, 19 bp, Homo sapiens
tttcatatgtggaaatata

SEQ ID NO: 5814730 - DNA, 22 bp, Homo sapiens
tttcatatgttgctcagtctcc

SEQ ID NO: 5814731 - DNA, 16 bp, Homo sapiens
tttcatattctttcaa

SEQ ID NO: 5814732 - DNA, 13 bp, Homo sapiens
tttcatattgtaa

SEQ ID NO: 5814733 - DNA, 12 bp, Homo sapiens
tttcatattgtg

SEQ ID NO: 5814734 - DNA, 14 bp, Homo sapiens
tttcatattgtgcc

SEQ ID NO: 5814735 - DNA, 15 bp, Homo sapiens
tttcatatttctacc

SEQ ID NO: 5814736 - DNA, 14 bp, Homo sapiens
tttcatattttaaa

SEQ ID NO: 5814737 - DNA, 18 bp, Homo sapiens
tttcatattttaatttca

SEQ ID NO: 5814738 - DNA, 22 bp, Homo sapiens
tttcatattttaatttcaagct

SEQ ID NO: 5814739 - DNA, 12 bp, Homo sapiens
tttcatcaaaaa

SEQ ID NO: 5814740 - DNA, 18 bp, Homo sapiens
tttcatcaagattaatta

SEQ ID NO: 5814741 - DNA, 12 bp, Homo sapiens
tttcatcactgg

SEQ ID NO: 5814742 - DNA, 14 bp, Homo sapiens
tttcatcagcccta

SEQ ID NO: 5814743 - DNA, 16 bp, Homo sapiens
tttcatcatattatac

SEQ ID NO: 5814744 - DNA, 17 bp, Homo sapiens
tttcatcatattataca

SEQ ID NO: 5814745 - DNA, 22 bp, Homo sapiens
tttcatcattcacttcactgtg

SEQ ID NO: 5814746 - DNA, 13 bp, Homo sapiens
tttcatcatttca

SEQ ID NO: 5814747 - DNA, 15 bp, Homo sapiens
tttcatcatttcagc

SEQ ID NO: 5814748 - DNA, 17 bp, Homo sapiens
tttcatcatttcagcca

SEQ ID NO: 5814749 - DNA, 16 bp, Homo sapiens
tttcatccaccaatat

SEQ ID NO: 5814750 - DNA, 17 bp, Homo sapiens
tttcatccagtttgttc

SEQ ID NO: 5814751 - DNA, 21 bp, Homo sapiens
tttcatccagtttgttctccg

SEQ ID NO: 5814752 - DNA, 22 bp, Homo sapiens
tttcatcccatactcaaaatac

SEQ ID NO: 5814753 - DNA, 22 bp, Homo sapiens
tttcatcctaaagaacaaagta

SEQ ID NO: 5814754 - DNA, 13 bp, Homo sapiens
tttcatcctcagc

SEQ ID NO: 5814755 - DNA, 17 bp, Homo sapiens
tttcatcctggcctcct

SEQ ID NO: 5814756 - DNA, 12 bp, Homo sapiens
tttcatcctgtg

SEQ ID NO: 5814757 - DNA, 14 bp, Homo sapiens
tttcatcctgtgtc

SEQ ID NO: 5814758 - DNA, 23 bp, Homo sapiens
tttcatcctgttggctgctgcca

SEQ ID NO: 5814759 - DNA, 15 bp, Homo sapiens
tttcatccttcccca

SEQ ID NO: 5814760 - DNA, 18 bp, Homo sapiens
tttcatccttctttcctt

SEQ ID NO: 5814761 - DNA, 17 bp, Homo sapiens
tttcatcgtgttaacca

SEQ ID NO: 5814762 - DNA, 16 bp, Homo sapiens
tttcatctaaatgaaa

SEQ ID NO: 5814763 - DNA, 14 bp, Homo sapiens
tttcatctaccttt

SEQ ID NO: 5814764 - DNA, 19 bp, Homo sapiens
tttcatctcagagtccact

SEQ ID NO: 5814765 - DNA, 22 bp, Homo sapiens
tttcatctcattaattcaatta

SEQ ID NO: 5814766 - DNA, 21 bp, Homo sapiens
tttcatctcatttaagggaaa

SEQ ID NO: 5814767 - DNA, 23 bp, Homo sapiens
tttcatctcatttaagggaaaaa

SEQ ID NO: 5814768 - DNA, 19 bp, Homo sapiens
tttcatctctctacctcca

SEQ ID NO: 5814769 - DNA, 15 bp, Homo sapiens
tttcatctgaaaagc

SEQ ID NO: 5814770 - DNA, 16 bp, Homo sapiens
tttcatctgaaaagca

SEQ ID NO: 5814771 - DNA, 16 bp, Homo sapiens
tttcatctgctctcct

SEQ ID NO: 5814772 - DNA, 22 bp, Homo sapiens
tttcatctgctgctgaaactgt

SEQ ID NO: 5814773 - DNA, 18 bp, Homo sapiens
tttcatctgggaaagaca

SEQ ID NO: 5814774 - DNA, 19 bp, Homo sapiens
tttcatctgggaaagacat

SEQ ID NO: 5814775 - DNA, 12 bp, Homo sapiens
tttcatctggtt

SEQ ID NO: 5814776 - DNA, 18 bp, Homo sapiens
tttcatctgttctatgct

SEQ ID NO: 5814777 - DNA, 14 bp, Homo sapiens
tttcatcttaaact

SEQ ID NO: 5814778 - DNA, 15 bp, Homo sapiens
tttcatcttctggaa

SEQ ID NO: 5814779 - DNA, 19 bp, Homo sapiens
tttcatgaaaataccattt

SEQ ID NO: 5814780 - DNA, 16 bp, Homo sapiens
tttcatgaatgtgctg

SEQ ID NO: 5814781 - DNA, 13 bp, Homo sapiens
tttcatgacagaa

SEQ ID NO: 5814782 - DNA, 19 bp, Homo sapiens
tttcatgacataataaagt

SEQ ID NO: 5814783 - DNA, 20 bp, Homo sapiens
tttcatgacataataaagta

SEQ ID NO: 5814784 - DNA, 24 bp, Homo sapiens
tttcatgaccagtaaaggctgctg

SEQ ID NO: 5814785 - DNA, 21 bp, Homo sapiens
tttcccctgtggggatctcag

SEQ ID NO: 5814786 - DNA, 13 bp, Homo sapiens
tttcccctgttaa

SEQ ID NO: 5814787 - DNA, 14 bp, Homo sapiens
tttccccttcctca

SEQ ID NO: 5814788 - DNA, 16 bp, Homo sapiens
tttcccctttcctgtc

SEQ ID NO: 5814789 - DNA, 14 bp, Homo sapiens
tttcccctttctct

SEQ ID NO: 5814790 - DNA, 18 bp, Homo sapiens
tttcccctttttctttcc

SEQ ID NO: 5814791 - DNA, 17 bp, Homo sapiens
tttcccgccttgggctt

SEQ ID NO: 5814792 - DNA, 14 bp, Homo sapiens
tttcccgggctgtc

SEQ ID NO: 5814793 - DNA, 21 bp, Homo sapiens
tttcccgtataataaaaccaa

SEQ ID NO: 5814794 - DNA, 18 bp, Homo sapiens
tttcccgtggccccagcc

SEQ ID NO: 5814795 - DNA, 20 bp, Homo sapiens
tttcccgtggccccagcctg

SEQ ID NO: 5814796 - DNA, 14 bp, Homo sapiens
tttccctaatttat

SEQ ID NO: 5814797 - DNA, 20 bp, Homo sapiens
tttccctactgaaccctgcc

SEQ ID NO: 5814798 - DNA, 13 bp, Homo sapiens
tttccctatctgc

SEQ ID NO: 5814799 - DNA, 14 bp, Homo sapiens
tttccctatcttct

SEQ ID NO: 5814800 - DNA, 15 bp, Homo sapiens
tttccctcaccccct

SEQ ID NO: 5814801 - DNA, 17 bp, Homo sapiens
tttccctccagagaaag

SEQ ID NO: 5814802 - DNA, 22 bp, Homo sapiens
tttccctcccaacagagctggg

SEQ ID NO: 5814803 - DNA, 18 bp, Homo sapiens
tttccctccccagaatca

SEQ ID NO: 5814804 - DNA, 20 bp, Homo sapiens
tttccctcctgacaaatatt

SEQ ID NO: 5814805 - DNA, 11 bp, Homo sapiens
tttccctcctt

SEQ ID NO: 5814806 - DNA, 14 bp, Homo sapiens
tttccctcgctggg

SEQ ID NO: 5814807 - DNA, 13 bp, Homo sapiens
tttccctctcttg

SEQ ID NO: 5814808 - DNA, 13 bp, Homo sapiens
tttccctcttgtg

SEQ ID NO: 5814809 - DNA, 16 bp, Homo sapiens
tttccctcttgtgctc

SEQ ID NO: 5814810 - DNA, 22 bp, Homo sapiens
tttccctcttttcttactcctc

SEQ ID NO: 5814811 - DNA, 13 bp, Homo sapiens
tttccctgaacag

SEQ ID NO: 5814812 - DNA, 13 bp, Homo sapiens
tttccctgaggaa

SEQ ID NO: 5814813 - DNA, 18 bp, Homo sapiens
tttccctgcaccactctc

SEQ ID NO: 5814814 - DNA, 16 bp, Homo sapiens
tttccctgcagacctc

SEQ ID NO: 5814815 - DNA, 14 bp, Homo sapiens
tttccctgcatccc

SEQ ID NO: 5814816 - DNA, 14 bp, Homo sapiens
tttccctgcccctg

SEQ ID NO: 5814817 - DNA, 12 bp, Homo sapiens
tttccctgctga

SEQ ID NO: 5814818 - DNA, 14 bp, Homo sapiens
tttccctggaactc

SEQ ID NO: 5814819 - DNA, 13 bp, Homo sapiens
tttccctggacag

SEQ ID NO: 5814820 - DNA, 22 bp, Homo sapiens
tttccctggctaacagtctagt

SEQ ID NO: 5814821 - DNA, 12 bp, Homo sapiens
tttccctggctc

SEQ ID NO: 5814822 - DNA, 14 bp, Homo sapiens
tttccctggctcag

SEQ ID NO: 5814823 - DNA, 14 bp, Homo sapiens
tttccctggtgccc

SEQ ID NO: 5814824 - DNA, 12 bp, Homo sapiens
tttccctgtgct

SEQ ID NO: 5814825 - DNA, 14 bp, Homo sapiens
tttccctgtttgcc

SEQ ID NO: 5814826 - DNA, 14 bp, Homo sapiens
tttcccttatcaaa

SEQ ID NO: 5814827 - DNA, 14 bp, Homo sapiens
tttcccttcatctg

SEQ ID NO: 5814828 - DNA, 21 bp, Homo sapiens
tttcccttcatttaaactaaa

SEQ ID NO: 5814829 - DNA, 16 bp, Homo sapiens
tttcccttctcttcta

SEQ ID NO: 5814830 - DNA, 15 bp, Homo sapiens
tttcccttgaggaaa

SEQ ID NO: 5814831 - DNA, 19 bp, Homo sapiens
tttcccttgccctttccat

SEQ ID NO: 5814832 - DNA, 20 bp, Homo sapiens
tttcccttgcttttccctct

SEQ ID NO: 5814833 - DNA, 15 bp, Homo sapiens
tttccctttgccttc

SEQ ID NO: 5814834 - DNA, 17 bp, Homo sapiens
tttccctttgcttccca

SEQ ID NO: 5814835 - DNA, 17 bp, Homo sapiens
tttcccttttctgttta

SEQ ID NO: 5814836 - DNA, 16 bp, Homo sapiens
tttccctttttaaaaa

SEQ ID NO: 5814837 - DNA, 18 bp, Homo sapiens
tttccctttttaaaaaat

SEQ ID NO: 5814838 - DNA, 22 bp, Homo sapiens
tttccgacacatttaccaaatt

SEQ ID NO: 5814839 - DNA, 14 bp, Homo sapiens
tttccgactgccca

SEQ ID NO: 5814840 - DNA, 16 bp, Homo sapiens
tttccgactgcccaga

SEQ ID NO: 5814841 - DNA, 13 bp, Homo sapiens
tttccgagtcaag

SEQ ID NO: 5814842 - DNA, 13 bp, Homo sapiens
tttccgcggcggc

SEQ ID NO: 5814843 - DNA, 21 bp, Homo sapiens
tttccggccaaggtgccacca

SEQ ID NO: 5814844 - DNA, 13 bp, Homo sapiens
tttccggctgctg

SEQ ID NO: 5814845 - DNA, 22 bp, Homo sapiens
tttccgtaaaaatgatttcagt

SEQ ID NO: 5814846 - DNA, 20 bp, Homo sapiens
tttccgtaaatgtctgcact

SEQ ID NO: 5814847 - DNA, 22 bp, Homo sapiens
tttccgtaataacacccttcct

SEQ ID NO: 5814848 - DNA, 20 bp, Homo sapiens
tttccgtccccccccaggcc

SEQ ID NO: 5814849 - DNA, 17 bp, Homo sapiens
tttccgtgtgtttattt

SEQ ID NO: 5814850 - DNA, 21 bp, Homo sapiens
tttcctaaaaataagctttat

SEQ ID NO: 5814851 - DNA, 14 bp, Homo sapiens
tttcctaaaagttc

SEQ ID NO: 5814852 - DNA, 22 bp, Homo sapiens
tttcctaaacataattgtggat

SEQ ID NO: 5814853 - DNA, 13 bp, Homo sapiens
tttcctaaagcca

SEQ ID NO: 5814854 - DNA, 14 bp, Homo sapiens
tttcctaaatgttt

SEQ ID NO: 5814855 - DNA, 16 bp, Homo sapiens
tttcctaacaaaagat

SEQ ID NO: 5814856 - DNA, 22 bp, Homo sapiens
tttcctaacaggattagacagt

SEQ ID NO: 5814857 - DNA, 21 bp, Homo sapiens
tttcctaagacatttttcatt

SEQ ID NO: 5814858 - DNA, 15 bp, Homo sapiens
tttcctaaggaaact

SEQ ID NO: 5814859 - DNA, 12 bp, Homo sapiens
tttcctaaggcc

SEQ ID NO: 5814860 - DNA, 12 bp, Homo sapiens
tttcctaatact

SEQ ID NO: 5814861 - DNA, 14 bp, Homo sapiens
tttcctaatatgat

SEQ ID NO: 5814862 - DNA, 20 bp, Homo sapiens
tttcctaattaaaataagaa

SEQ ID NO: 5814863 - DNA, 13 bp, Homo sapiens
tttcctaatttat

SEQ ID NO: 5814864 - DNA, 23 bp, Homo sapiens
tttcctacagaaatactgctctg

SEQ ID NO: 5814865 - DNA, 23 bp, Homo sapiens
tttcctactatcatctcttaaat

SEQ ID NO: 5814866 - DNA, 19 bp, Homo sapiens
tttcctactccgttcctgg

SEQ ID NO: 5814867 - DNA, 24 bp, Homo sapiens
tttcctactctcaggatcaagaaa

SEQ ID NO: 5814868 - DNA, 14 bp, Homo sapiens
tttcctactgtcct

SEQ ID NO: 5814869 - DNA, 16 bp, Homo sapiens
tttcctactgtcctca

SEQ ID NO: 5814870 - DNA, 19 bp, Homo sapiens
tttcctactgtcctcagag

SEQ ID NO: 5814871 - DNA, 15 bp, Homo sapiens
tttcctacttttcct

SEQ ID NO: 5814872 - DNA, 20 bp, Homo sapiens
tttcctacttttccttccct

SEQ ID NO: 5814873 - DNA, 17 bp, Homo sapiens
tttcctagccctctcac

SEQ ID NO: 5814874 - DNA, 20 bp, Homo sapiens
tttcctagtgaggaaagcct

SEQ ID NO: 5814875 - DNA, 18 bp, Homo sapiens
tttcctagtggtgtcatt

SEQ ID NO: 5814876 - DNA, 21 bp, Homo sapiens
tttcctagttctgtagaaatg

SEQ ID NO: 5814877 - DNA, 23 bp, Homo sapiens
tttcctatagctacatgttcttt

SEQ ID NO: 5814878 - DNA, 16 bp, Homo sapiens
tttcctatatgatgat

SEQ ID NO: 5814879 - DNA, 17 bp, Homo sapiens
tttcctatctgtatgtc

SEQ ID NO: 5814880 - DNA, 15 bp, Homo sapiens
tttcctatgctattg

SEQ ID NO: 5814881 - DNA, 16 bp, Homo sapiens
tttcctattctgttgc

SEQ ID NO: 5814882 - DNA, 18 bp, Homo sapiens
tttcctattctgttgcca

SEQ ID NO: 5814883 - DNA, 18 bp, Homo sapiens
tttcctatttaatacagc

SEQ ID NO: 5814884 - DNA, 13 bp, Homo sapiens
tttcctattttaa

SEQ ID NO: 5814885 - DNA, 15 bp, Homo sapiens
tttcctattttaaaa

SEQ ID NO: 5814886 - DNA, 15 bp, Homo sapiens
tttcctcaaatgttg

SEQ ID NO: 5814887 - DNA, 23 bp, Homo sapiens
tttcctcacacccacctgctgct

SEQ ID NO: 5814888 - DNA, 21 bp, Homo sapiens
tttcctcaccagtcccatgct

SEQ ID NO: 5814889 - DNA, 13 bp, Homo sapiens
tttcctcactgcc

SEQ ID NO: 5814890 - DNA, 13 bp, Homo sapiens
tttcctcagaaca

SEQ ID NO: 5814891 - DNA, 21 bp, Homo sapiens
tttcctcaggctgctggagga

SEQ ID NO: 5814892 - DNA, 19 bp, Homo sapiens
tttcctcagggtgtcctga

SEQ ID NO: 5814893 - DNA, 18 bp, Homo sapiens
tttcctcatcctttccct

SEQ ID NO: 5814894 - DNA, 19 bp, Homo sapiens
tttcctcatcctttccctc

SEQ ID NO: 5814895 - DNA, 20 bp, Homo sapiens
tttcctcatcctttccctct

SEQ ID NO: 5814896 - DNA, 16 bp, Homo sapiens
tttcctcatgtaacat

SEQ ID NO: 5814897 - DNA, 18 bp, Homo sapiens
tttcctcatgtaacattg

SEQ ID NO: 5814898 - DNA, 21 bp, Homo sapiens
tttcctcattaatagctgcct

SEQ ID NO: 5814899 - DNA, 14 bp, Homo sapiens
tttcctcattttga

SEQ ID NO: 5814900 - DNA, 19 bp, Homo sapiens
tttcctcattttgaattat

SEQ ID NO: 5814901 - DNA, 22 bp, Homo sapiens
tttcctccaaactcctgcctgt

SEQ ID NO: 5814902 - DNA, 17 bp, Homo sapiens
tttcctccagacagata

SEQ ID NO: 5814903 - DNA, 13 bp, Homo sapiens
tttcctcccagtg

SEQ ID NO: 5814904 - DNA, 14 bp, Homo sapiens
tttcctccccacct

SEQ ID NO: 5814905 - DNA, 14 bp, Homo sapiens
tttcctccccagca

SEQ ID NO: 5814906 - DNA, 16 bp, Homo sapiens
tttcctccccagcagg

SEQ ID NO: 5814907 - DNA, 19 bp, Homo sapiens
tttcctccccatacacaca

SEQ ID NO: 5814908 - DNA, 13 bp, Homo sapiens
tttcctccctcag

SEQ ID NO: 5814909 - DNA, 12 bp, Homo sapiens
tttcctccctgg

SEQ ID NO: 5814910 - DNA, 12 bp, Homo sapiens
tttcctcccttc

SEQ ID NO: 5814911 - DNA, 13 bp, Homo sapiens
tttcctcccttct

SEQ ID NO: 5814912 - DNA, 19 bp, Homo sapiens
tttcctcccttctgctact

SEQ ID NO: 5814913 - DNA, 15 bp, Homo sapiens
tttcctcccttgggt

SEQ ID NO: 5814914 - DNA, 22 bp, Homo sapiens
tttcctcccttgggttctgata

SEQ ID NO: 5814915 - DNA, 17 bp, Homo sapiens
tttcctccggagcctca

SEQ ID NO: 5814916 - DNA, 22 bp, Homo sapiens
tttcctccgtcacctcagagac

SEQ ID NO: 5814917 - DNA, 22 bp, Homo sapiens
tttcctcctaccttttgtctct

SEQ ID NO: 5814918 - DNA, 20 bp, Homo sapiens
tttcctcctcccaacagttt

SEQ ID NO: 5814919 - DNA, 17 bp, Homo sapiens
tttcctccttgtcactg

SEQ ID NO: 5814920 - DNA, 15 bp, Homo sapiens
tttcctcctttctct

SEQ ID NO: 5814921 - DNA, 12 bp, Homo sapiens
tttcctcgagag

SEQ ID NO: 5814922 - DNA, 19 bp, Homo sapiens
tttcctcgcagatgataaa

SEQ ID NO: 5814923 - DNA, 18 bp, Homo sapiens
tttcctcggtctcccttc

SEQ ID NO: 5814924 - DNA, 11 bp, Homo sapiens
tttcctctaaa

SEQ ID NO: 5814925 - DNA, 21 bp, Homo sapiens
tttcctctaatccagcaaagt

SEQ ID NO: 5814926 - DNA, 17 bp, Homo sapiens
tttcctctagcttttct

SEQ ID NO: 5814927 - DNA, 14 bp, Homo sapiens
tttcctctccctca

SEQ ID NO: 5814928 - DNA, 17 bp, Homo sapiens
tttcctctcctgggtac

SEQ ID NO: 5814929 - DNA, 15 bp, Homo sapiens
tttcctctctatctt

SEQ ID NO: 5814930 - DNA, 13 bp, Homo sapiens
tttcctctctctc

SEQ ID NO: 5814931 - DNA, 20 bp, Homo sapiens
tttcctctctgtctgtctct

SEQ ID NO: 5814932 - DNA, 12 bp, Homo sapiens
tttcctctgagc

SEQ ID NO: 5814933 - DNA, 22 bp, Homo sapiens
tttcctctgagcccagctgcct

SEQ ID NO: 5814934 - DNA, 23 bp, Homo sapiens
tttcctctgagcccagctgcctg

SEQ ID NO: 5814935 - DNA, 16 bp, Homo sapiens
tttcctctgagctgtt

SEQ ID NO: 5814936 - DNA, 14 bp, Homo sapiens
tttcctctgcagca

SEQ ID NO: 5814937 - DNA, 13 bp, Homo sapiens
tttcctctgcctt

SEQ ID NO: 5814938 - DNA, 15 bp, Homo sapiens
tttcctctgctggaa

SEQ ID NO: 5814939 - DNA, 23 bp, Homo sapiens
tttcctctgttcaaagctgcctg

SEQ ID NO: 5814940 - DNA, 24 bp, Homo sapiens
tttcctcttaatgtctcaaaataa

SEQ ID NO: 5814941 - DNA, 20 bp, Homo sapiens
tttcctcttactttcagttt

SEQ ID NO: 5814942 - DNA, 15 bp, Homo sapiens
tttcctcttccaaag

SEQ ID NO: 5814943 - DNA, 12 bp, Homo sapiens
tttcctcttcct

SEQ ID NO: 5814944 - DNA, 21 bp, Homo sapiens
tttcctcttctattttgtaaa

SEQ ID NO: 5814945 - DNA, 22 bp, Homo sapiens
tttcctcttctattttgtaaac

SEQ ID NO: 5814946 - DNA, 12 bp, Homo sapiens
tttcctcttgaa

SEQ ID NO: 5814947 - DNA, 18 bp, Homo sapiens
tttcctcttgtcctggcc

SEQ ID NO: 5814948 - DNA, 21 bp, Homo sapiens
tttcctctttggtctacactg

SEQ ID NO: 5814949 - DNA, 13 bp, Homo sapiens
tttcctgaaagtg

SEQ ID NO: 5814950 - DNA, 23 bp, Homo sapiens
tttcctgaaagttggggcccagt

SEQ ID NO: 5814951 - DNA, 13 bp, Homo sapiens
tttcctgaaatat

SEQ ID NO: 5814952 - DNA, 15 bp, Homo sapiens
tttcctgaaatcaag

SEQ ID NO: 5814953 - DNA, 18 bp, Homo sapiens
tttcctgaacctggaaat

SEQ ID NO: 5814954 - DNA, 20 bp, Homo sapiens
tttcctgagaccacagagag

SEQ ID NO: 5814955 - DNA, 18 bp, Homo sapiens
tttcctgaggtcatctgt

SEQ ID NO: 5814956 - DNA, 21 bp, Homo sapiens
tttcctgataaagcacagctg

SEQ ID NO: 5814957 - DNA, 12 bp, Homo sapiens
tttcctgcaggc

SEQ ID NO: 5814958 - DNA, 14 bp, Homo sapiens
tttcctgcatctct

SEQ ID NO: 5814959 - DNA, 16 bp, Homo sapiens
tttcctgcatctttca

SEQ ID NO: 5814960 - DNA, 12 bp, Homo sapiens
tttcctgcatgt

SEQ ID NO: 5814961 - DNA, 22 bp, Homo sapiens
tttcctgccataaaagctatga

SEQ ID NO: 5814962 - DNA, 18 bp, Homo sapiens
tttcctgccgagtgctct

SEQ ID NO: 5814963 - DNA, 13 bp, Homo sapiens
tttcctgccttca

SEQ ID NO: 5814964 - DNA, 13 bp, Homo sapiens
tttcctgctccct

SEQ ID NO: 5814965 - DNA, 14 bp, Homo sapiens
tttctaaaaagtca

SEQ ID NO: 5814966 - DNA, 15 bp, Homo sapiens
tttctaaaaagtcaa

SEQ ID NO: 5814967 - DNA, 20 bp, Homo sapiens
tttctaaaaagtcagatgtt

SEQ ID NO: 5814968 - DNA, 21 bp, Homo sapiens
tttctaaaacagacaataatt

SEQ ID NO: 5814969 - DNA, 23 bp, Homo sapiens
tttctaaaacccttggtctgtgt

SEQ ID NO: 5814970 - DNA, 12 bp, Homo sapiens
tttctaaaagaa

SEQ ID NO: 5814971 - DNA, 20 bp, Homo sapiens
tttctaaaagaatattcaga

SEQ ID NO: 5814972 - DNA, 12 bp, Homo sapiens
tttctaaaatct

SEQ ID NO: 5814973 - DNA, 23 bp, Homo sapiens
tttctaaacagttgagtttcttc

SEQ ID NO: 5814974 - DNA, 19 bp, Homo sapiens
tttctaaaccacaaaagtt

SEQ ID NO: 5814975 - DNA, 17 bp, Homo sapiens
tttctaaacctgtgcct

SEQ ID NO: 5814976 - DNA, 19 bp, Homo sapiens
tttctaaacctgtgcctcc

SEQ ID NO: 5814977 - DNA, 14 bp, Homo sapiens
tttctaaactccct

SEQ ID NO: 5814978 - DNA, 20 bp, Homo sapiens
tttctaaactggagactgtg

SEQ ID NO: 5814979 - DNA, 12 bp, Homo sapiens
tttctaaactgt

SEQ ID NO: 5814980 - DNA, 18 bp, Homo sapiens
tttctaaagccttaagtc

SEQ ID NO: 5814981 - DNA, 16 bp, Homo sapiens
tttctaaaggagttta

SEQ ID NO: 5814982 - DNA, 22 bp, Homo sapiens
tttctaaagtaaaaacaaagaa

SEQ ID NO: 5814983 - DNA, 16 bp, Homo sapiens
tttctaaagtaaaatt

SEQ ID NO: 5814984 - DNA, 17 bp, Homo sapiens
tttctaaagtgttggtc

SEQ ID NO: 5814985 - DNA, 18 bp, Homo sapiens
tttctaaagttgtagtga

SEQ ID NO: 5814986 - DNA, 21 bp, Homo sapiens
tttctaaataaaaatatgtaa

SEQ ID NO: 5814987 - DNA, 22 bp, Homo sapiens
tttctaaataaggaatttcctc

SEQ ID NO: 5814988 - DNA, 21 bp, Homo sapiens
tttctaaatgttggaatgtta

SEQ ID NO: 5814989 - DNA, 17 bp, Homo sapiens
tttctaaatgtttcttt

SEQ ID NO: 5814990 - DNA, 19 bp, Homo sapiens
tttctaaatgtttcttttt

SEQ ID NO: 5814991 - DNA, 19 bp, Homo sapiens
tttctaaatttatattcat

SEQ ID NO: 5814992 - DNA, 20 bp, Homo sapiens
tttctaaatttatattcata

SEQ ID NO: 5814993 - DNA, 18 bp, Homo sapiens
tttctaacaattttcaga

SEQ ID NO: 5814994 - DNA, 21 bp, Homo sapiens
tttctaacaattttcagacct

SEQ ID NO: 5814995 - DNA, 22 bp, Homo sapiens
tttctaacactagtctgtgtgc

SEQ ID NO: 5814996 - DNA, 22 bp, Homo sapiens
tttctaacagtatttgtacaaa

SEQ ID NO: 5814997 - DNA, 18 bp, Homo sapiens
tttctaacagtccttgct

SEQ ID NO: 5814998 - DNA, 16 bp, Homo sapiens
tttctaacatatgtat

SEQ ID NO: 5814999 - DNA, 19 bp, Homo sapiens
tttctaaccaagaggctgg

SEQ ID NO: 5815000 - DNA, 14 bp, Homo sapiens
tttctaaccttgaa

SEQ ID NO: 5815001 - DNA, 15 bp, Homo sapiens
tttctaaccttgaat

SEQ ID NO: 5815002 - DNA, 20 bp, Homo sapiens
tttctaaccttgaatgctgc

SEQ ID NO: 5815003 - DNA, 18 bp, Homo sapiens
tttctaactctgatgtaa

SEQ ID NO: 5815004 - DNA, 18 bp, Homo sapiens
tttctaactgtaaatcac

SEQ ID NO: 5815005 - DNA, 19 bp, Homo sapiens
tttctaactgtaaatcact

SEQ ID NO: 5815006 - DNA, 15 bp, Homo sapiens
tttctaagaaaatgt

SEQ ID NO: 5815007 - DNA, 22 bp, Homo sapiens
tttctaagaaatagagccaact

SEQ ID NO: 5815008 - DNA, 16 bp, Homo sapiens
tttctaagagaagtta

SEQ ID NO: 5815009 - DNA, 17 bp, Homo sapiens
tttctaagagacctgaa

SEQ ID NO: 5815010 - DNA, 20 bp, Homo sapiens
tttctaagagacctgaactg

SEQ ID NO: 5815011 - DNA, 23 bp, Homo sapiens
tttctaagcgatcctcctgtcta

SEQ ID NO: 5815012 - DNA, 18 bp, Homo sapiens
tttctaaggatagccttt

SEQ ID NO: 5815013 - DNA, 22 bp, Homo sapiens
tttctaaggatagcctttgtag

SEQ ID NO: 5815014 - DNA, 20 bp, Homo sapiens
tttctaaggtaacaagatga

SEQ ID NO: 5815015 - DNA, 16 bp, Homo sapiens
tttctaagtctgttat

SEQ ID NO: 5815016 - DNA, 18 bp, Homo sapiens
tttctaagtgtaacctca

SEQ ID NO: 5815017 - DNA, 21 bp, Homo sapiens
tttctaagttattttgtacat

SEQ ID NO: 5815018 - DNA, 18 bp, Homo sapiens
tttctaatagagagatta

SEQ ID NO: 5815019 - DNA, 19 bp, Homo sapiens
tttctaatccttttcctta

SEQ ID NO: 5815020 - DNA, 19 bp, Homo sapiens
tttctaatgaggagagaaa

SEQ ID NO: 5815021 - DNA, 20 bp, Homo sapiens
tttctaatggaatggtttgg

SEQ ID NO: 5815022 - DNA, 19 bp, Homo sapiens
tttctaatggccttccata

SEQ ID NO: 5815023 - DNA, 13 bp, Homo sapiens
tttctaatgtggt

SEQ ID NO: 5815024 - DNA, 13 bp, Homo sapiens
tttctaatgttta

SEQ ID NO: 5815025 - DNA, 14 bp, Homo sapiens
tttctaatgtttac

SEQ ID NO: 5815026 - DNA, 18 bp, Homo sapiens
tttctaatgtttactata

SEQ ID NO: 5815027 - DNA, 14 bp, Homo sapiens
tttctaattatgta

SEQ ID NO: 5815028 - DNA, 18 bp, Homo sapiens
tttctaattatgtagctc

SEQ ID NO: 5815029 - DNA, 22 bp, Homo sapiens
tttctaattcctgttgctctgt

SEQ ID NO: 5815030 - DNA, 13 bp, Homo sapiens
tttctaatttcaa

SEQ ID NO: 5815031 - DNA, 23 bp, Homo sapiens
tttctaattttaagttattttaa

SEQ ID NO: 5815032 - DNA, 12 bp, Homo sapiens
tttctaattttt

SEQ ID NO: 5815033 - DNA, 18 bp, Homo sapiens
tttctacaactgattgca

SEQ ID NO: 5815034 - DNA, 22 bp, Homo sapiens
tttctacagaaataacagctgg

SEQ ID NO: 5815035 - DNA, 22 bp, Homo sapiens
tttctacagcaaatttataatt

SEQ ID NO: 5815036 - DNA, 16 bp, Homo sapiens
tttctacagtacatga

SEQ ID NO: 5815037 - DNA, 15 bp, Homo sapiens
tttctacatgactgg

SEQ ID NO: 5815038 - DNA, 19 bp, Homo sapiens
tttctacatgactgggcct

SEQ ID NO: 5815039 - DNA, 23 bp, Homo sapiens
tttctacatgcaaatctggctta

SEQ ID NO: 5815040 - DNA, 18 bp, Homo sapiens
tttctacattacagccat

SEQ ID NO: 5815041 - DNA, 20 bp, Homo sapiens
tttctacattattgcttatt

SEQ ID NO: 5815042 - DNA, 18 bp, Homo sapiens
tttctaccacacacagcc

SEQ ID NO: 5815043 - DNA, 18 bp, Homo sapiens
tttctacccagcgagccc

SEQ ID NO: 5815044 - DNA, 13 bp, Homo sapiens
tttctacctccca

SEQ ID NO: 5815045 - DNA, 17 bp, Homo sapiens
tttctaccttaaaggga

SEQ ID NO: 5815046 - DNA, 15 bp, Homo sapiens
tttctacctttctga

SEQ ID NO: 5815047 - DNA, 22 bp, Homo sapiens
tttctacgtcatgtattttatg

SEQ ID NO: 5815048 - DNA, 18 bp, Homo sapiens
tttctactatatacatat

SEQ ID NO: 5815049 - DNA, 23 bp, Homo sapiens
tttctactcgagttacagacaaa

SEQ ID NO: 5815050 - DNA, 15 bp, Homo sapiens
tttctactctgaact

SEQ ID NO: 5815051 - DNA, 17 bp, Homo sapiens
tttctactctgaactaa

SEQ ID NO: 5815052 - DNA, 20 bp, Homo sapiens
tttctactgtcaaatgatgt

SEQ ID NO: 5815053 - DNA, 17 bp, Homo sapiens
tttctacttatcctcat

SEQ ID NO: 5815054 - DNA, 16 bp, Homo sapiens
tttctacttcccctgg

SEQ ID NO: 5815055 - DNA, 19 bp, Homo sapiens
tttctacttgttataaact

SEQ ID NO: 5815056 - DNA, 12 bp, Homo sapiens
tttctactttgc

SEQ ID NO: 5815057 - DNA, 17 bp, Homo sapiens
tttctactttgtttatt

SEQ ID NO: 5815058 - DNA, 22 bp, Homo sapiens
tttctactttttctgtactttt

SEQ ID NO: 5815059 - DNA, 19 bp, Homo sapiens
tttctagaaaagcttccta

SEQ ID NO: 5815060 - DNA, 13 bp, Homo sapiens
tttctagaaagag

SEQ ID NO: 5815061 - DNA, 22 bp, Homo sapiens
tttctagaaataaaatcaccct

SEQ ID NO: 5815062 - DNA, 14 bp, Homo sapiens
tttctagaaatgtt

SEQ ID NO: 5815063 - DNA, 21 bp, Homo sapiens
tttctagaaatgtttaggtta

SEQ ID NO: 5815064 - DNA, 20 bp, Homo sapiens
tttctagaacatccctgcca

SEQ ID NO: 5815065 - DNA, 19 bp, Homo sapiens
tttctagaagtttcccttc

SEQ ID NO: 5815066 - DNA, 20 bp, Homo sapiens
tttctagaagtttcccttcc

SEQ ID NO: 5815067 - DNA, 23 bp, Homo sapiens
tttctagaagtttcccttcctcc

SEQ ID NO: 5815068 - DNA, 22 bp, Homo sapiens
tttctagaatactaataaaata

SEQ ID NO: 5815069 - DNA, 21 bp, Homo sapiens
tttctagaatttatcacactt

SEQ ID NO: 5815070 - DNA, 17 bp, Homo sapiens
tttctagaattttatat

SEQ ID NO: 5815071 - DNA, 18 bp, Homo sapiens
tttctagacactttttct

SEQ ID NO: 5815072 - DNA, 13 bp, Homo sapiens
tttctagaccaat

SEQ ID NO: 5815073 - DNA, 15 bp, Homo sapiens
tttctagagacacat

SEQ ID NO: 5815074 - DNA, 18 bp, Homo sapiens
tttctagagcctgctgga

SEQ ID NO: 5815075 - DNA, 17 bp, Homo sapiens
tttctagagttcctacc

SEQ ID NO: 5815076 - DNA, 15 bp, Homo sapiens
tttctagcaattgct

SEQ ID NO: 5815077 - DNA, 16 bp, Homo sapiens
tttctagcaattgctt

SEQ ID NO: 5815078 - DNA, 17 bp, Homo sapiens
tttctagcagtatgtgt

SEQ ID NO: 5815079 - DNA, 20 bp, Homo sapiens
tttctagcccgaatacaaac

SEQ ID NO: 5815080 - DNA, 17 bp, Homo sapiens
tttctagccctctccct

SEQ ID NO: 5815081 - DNA, 19 bp, Homo sapiens
tttctagccctctccctca

SEQ ID NO: 5815082 - DNA, 19 bp, Homo sapiens
tttctagcctggggcttga

SEQ ID NO: 5815083 - DNA, 22 bp, Homo sapiens
tttctagcctggggcttgaatt

SEQ ID NO: 5815084 - DNA, 22 bp, Homo sapiens
tttctagcgaacgtatttctcc

SEQ ID NO: 5815085 - DNA, 22 bp, Homo sapiens
tttctaggactgaattatgaaa

SEQ ID NO: 5815086 - DNA, 19 bp, Homo sapiens
tttctaggcaaaattgtga

SEQ ID NO: 5815087 - DNA, 20 bp, Homo sapiens
tttctaggcctacatgcttt

SEQ ID NO: 5815088 - DNA, 14 bp, Homo sapiens
tttctagggaaatg

SEQ ID NO: 5815089 - DNA, 17 bp, Homo sapiens
tttctaggtaggaaatg

SEQ ID NO: 5815090 - DNA, 23 bp, Homo sapiens
tttctaggtcaaggcctgtccct

SEQ ID NO: 5815091 - DNA, 20 bp, Homo sapiens
tttctagtacctgtgactct

SEQ ID NO: 5815092 - DNA, 16 bp, Homo sapiens
tttctagtatctattg

SEQ ID NO: 5815093 - DNA, 19 bp, Homo sapiens
tttctagtatctattgtgt

SEQ ID NO: 5815094 - DNA, 16 bp, Homo sapiens
tttctagtctgtcttc

SEQ ID NO: 5815095 - DNA, 14 bp, Homo sapiens
tttctagttaactt

SEQ ID NO: 5815096 - DNA, 14 bp, Homo sapiens
tttctagttgagga

SEQ ID NO: 5815097 - DNA, 14 bp, Homo sapiens
tttctataaatcag

SEQ ID NO: 5815098 - DNA, 15 bp, Homo sapiens
tttctataaatcagt

SEQ ID NO: 5815099 - DNA, 15 bp, Homo sapiens
tttctataaatgact

SEQ ID NO: 5815100 - DNA, 13 bp, Homo sapiens
tttctataaattt

SEQ ID NO: 5815101 - DNA, 19 bp, Homo sapiens
tttctataaatttaagaaa

SEQ ID NO: 5815102 - DNA, 23 bp, Homo sapiens
tttctataaatttaagaaaacaa

SEQ ID NO: 5815103 - DNA, 16 bp, Homo sapiens
tttctataacagatat

SEQ ID NO: 5815104 - DNA, 16 bp, Homo sapiens
tttctataacctggat

SEQ ID NO: 5815105 - DNA, 14 bp, Homo sapiens
tttctataagttgt

SEQ ID NO: 5815106 - DNA, 15 bp, Homo sapiens
tttctataagttgta

SEQ ID NO: 5815107 - DNA, 19 bp, Homo sapiens
tttctataagttgtaccaa

SEQ ID NO: 5815108 - DNA, 13 bp, Homo sapiens
tttctatacaaat

SEQ ID NO: 5815109 - DNA, 18 bp, Homo sapiens
tttctatacagtagcttg

SEQ ID NO: 5815110 - DNA, 14 bp, Homo sapiens
tttctatactgttt

SEQ ID NO: 5815111 - DNA, 20 bp, Homo sapiens
tttctatagccaaagctgtt

SEQ ID NO: 5815112 - DNA, 21 bp, Homo sapiens
tttctatagccaactgctaat

SEQ ID NO: 5815113 - DNA, 15 bp, Homo sapiens
tttctatataaaatg

SEQ ID NO: 5815114 - DNA, 21 bp, Homo sapiens
tttctatataaaatgtattca

SEQ ID NO: 5815115 - DNA, 16 bp, Homo sapiens
tttctatatagttcct

SEQ ID NO: 5815116 - DNA, 15 bp, Homo sapiens
tttctatattcctcc

SEQ ID NO: 5815117 - DNA, 17 bp, Homo sapiens
tttctatattcctccag

SEQ ID NO: 5815118 - DNA, 21 bp, Homo sapiens
tttctatattcctccagctgg

SEQ ID NO: 5815119 - DNA, 13 bp, Homo sapiens
tttctatattttc

SEQ ID NO: 5815120 - DNA, 15 bp, Homo sapiens
tttctatattttcat

SEQ ID NO: 5815121 - DNA, 22 bp, Homo sapiens
tttctatcatggaatatttata

SEQ ID NO: 5815122 - DNA, 17 bp, Homo sapiens
tttctatcgttctctct

SEQ ID NO: 5815123 - DNA, 12 bp, Homo sapiens
tttctatgaaag

SEQ ID NO: 5815124 - DNA, 23 bp, Homo sapiens
tttctatgaaggatccatctttg

SEQ ID NO: 5815125 - DNA, 15 bp, Homo sapiens
tttctatgacaaatt

SEQ ID NO: 5815126 - DNA, 22 bp, Homo sapiens
tttctatgcttgtaactgtctt

SEQ ID NO: 5815127 - DNA, 17 bp, Homo sapiens
tttctatggattcactt

SEQ ID NO: 5815128 - DNA, 13 bp, Homo sapiens
tttctatggcttt

SEQ ID NO: 5815129 - DNA, 19 bp, Homo sapiens
tttctatggctttcaaagc

SEQ ID NO: 5815130 - DNA, 15 bp, Homo sapiens
tttctatgtagaact

SEQ ID NO: 5815131 - DNA, 17 bp, Homo sapiens
tttctatgtcattttta

SEQ ID NO: 5815132 - DNA, 20 bp, Homo sapiens
tttctatgtcatttttaatg

SEQ ID NO: 5815133 - DNA, 22 bp, Homo sapiens
tttctatgtcatttttaatgta

SEQ ID NO: 5815134 - DNA, 14 bp, Homo sapiens
tttctattaaaaga

SEQ ID NO: 5815135 - DNA, 18 bp, Homo sapiens
tttctattaaaagactca

SEQ ID NO: 5815136 - DNA, 23 bp, Homo sapiens
tttctattaaaagactcatccgt

SEQ ID NO: 5815137 - DNA, 13 bp, Homo sapiens
tttctattaaagg

SEQ ID NO: 5815138 - DNA, 17 bp, Homo sapiens
tttctattaatatttat

SEQ ID NO: 5815139 - DNA, 22 bp, Homo sapiens
tttctattcataataaactaga

SEQ ID NO: 5815140 - DNA, 22 bp, Homo sapiens
tttctattctgtcagtgttaaa

SEQ ID NO: 5815141 - DNA, 12 bp, Homo sapiens
tttctctttgaa

SEQ ID NO: 5815142 - DNA, 13 bp, Homo sapiens
tttctctttgaaa

SEQ ID NO: 5815143 - DNA, 15 bp, Homo sapiens
tttctctttgccatt

SEQ ID NO: 5815144 - DNA, 23 bp, Homo sapiens
tttctctttgtctgccttcccaa

SEQ ID NO: 5815145 - DNA, 19 bp, Homo sapiens
tttctcttttattctgtta

SEQ ID NO: 5815146 - DNA, 15 bp, Homo sapiens
tttctcttttctaaa

SEQ ID NO: 5815147 - DNA, 15 bp, Homo sapiens
tttctcttttctagt

SEQ ID NO: 5815148 - DNA, 19 bp, Homo sapiens
tttctcttttgctttctgt

SEQ ID NO: 5815149 - DNA, 22 bp, Homo sapiens
tttctctttttttaaaaagttg

SEQ ID NO: 5815150 - DNA, 16 bp, Homo sapiens
tttctgaaaagaaata

SEQ ID NO: 5815151 - DNA, 13 bp, Homo sapiens
tttctgaaaagat

SEQ ID NO: 5815152 - DNA, 16 bp, Homo sapiens
tttctgaaaatataac

SEQ ID NO: 5815153 - DNA, 21 bp, Homo sapiens
tttctgaaaatgtttaagtat

SEQ ID NO: 5815154 - DNA, 18 bp, Homo sapiens
tttctgaaaattccagaa

SEQ ID NO: 5815155 - DNA, 21 bp, Homo sapiens
tttctgaaaattccagaaagg

SEQ ID NO: 5815156 - DNA, 14 bp, Homo sapiens
tttctgaaacacac

SEQ ID NO: 5815157 - DNA, 20 bp, Homo sapiens
tttctgaaagtatcaccaaa

SEQ ID NO: 5815158 - DNA, 12 bp, Homo sapiens
tttctgaaattt

SEQ ID NO: 5815159 - DNA, 14 bp, Homo sapiens
tttctgaacaaaga

SEQ ID NO: 5815160 - DNA, 16 bp, Homo sapiens
tttctgaacagctggt

SEQ ID NO: 5815161 - DNA, 15 bp, Homo sapiens
tttctgaagcctcta

SEQ ID NO: 5815162 - DNA, 21 bp, Homo sapiens
tttctgaagcctctaacaaat

SEQ ID NO: 5815163 - DNA, 17 bp, Homo sapiens
tttctgaaggctttgtg

SEQ ID NO: 5815164 - DNA, 17 bp, Homo sapiens
tttctgaagtgcttgta

SEQ ID NO: 5815165 - DNA, 10 bp, Homo sapiens
tttctgaata

SEQ ID NO: 5815166 - DNA, 19 bp, Homo sapiens
tttctgaataaaaaagatt

SEQ ID NO: 5815167 - DNA, 19 bp, Homo sapiens
tttctgaatctagagaaca

SEQ ID NO: 5815168 - DNA, 19 bp, Homo sapiens
tttctgaatgcctacctgg

SEQ ID NO: 5815169 - DNA, 19 bp, Homo sapiens
tttctgaatgtttgtgtct

SEQ ID NO: 5815170 - DNA, 14 bp, Homo sapiens
tttctgaattgttg

SEQ ID NO: 5815171 - DNA, 12 bp, Homo sapiens
tttctgacacaa

SEQ ID NO: 5815172 - DNA, 13 bp, Homo sapiens
tttctgacagttt

SEQ ID NO: 5815173 - DNA, 16 bp, Homo sapiens
tttctgacatacctta

SEQ ID NO: 5815174 - DNA, 15 bp, Homo sapiens
tttctgacatgcatt

SEQ ID NO: 5815175 - DNA, 16 bp, Homo sapiens
tttctgacatgcattg

SEQ ID NO: 5815176 - DNA, 12 bp, Homo sapiens
tttctgactgtc

SEQ ID NO: 5815177 - DNA, 15 bp, Homo sapiens
tttctgactgtccct

SEQ ID NO: 5815178 - DNA, 15 bp, Homo sapiens
tttctgagaaaagaa

SEQ ID NO: 5815179 - DNA, 20 bp, Homo sapiens
tttctgagattttagttcac

SEQ ID NO: 5815180 - DNA, 23 bp, Homo sapiens
tttctgagatttttgatatctca

SEQ ID NO: 5815181 - DNA, 11 bp, Homo sapiens
tttctgagccc

SEQ ID NO: 5815182 - DNA, 12 bp, Homo sapiens
tttctgagcccg

SEQ ID NO: 5815183 - DNA, 15 bp, Homo sapiens
tttctgagcccgggc

SEQ ID NO: 5815184 - DNA, 21 bp, Homo sapiens
tttctgagcccgggctgcctg

SEQ ID NO: 5815185 - DNA, 15 bp, Homo sapiens
tttctgagctgctct

SEQ ID NO: 5815186 - DNA, 14 bp, Homo sapiens
tttctgagggcccg

SEQ ID NO: 5815187 - DNA, 19 bp, Homo sapiens
tttctgaggtttagcgttt

SEQ ID NO: 5815188 - DNA, 18 bp, Homo sapiens
tttctgagtgacatgggt

SEQ ID NO: 5815189 - DNA, 21 bp, Homo sapiens
tttctgagtgagttttactct

SEQ ID NO: 5815190 - DNA, 23 bp, Homo sapiens
tttctgagtgagttttactctta

SEQ ID NO: 5815191 - DNA, 16 bp, Homo sapiens
tttctgagttcctgca

SEQ ID NO: 5815192 - DNA, 16 bp, Homo sapiens
tttctgagttttacca

SEQ ID NO: 5815193 - DNA, 21 bp, Homo sapiens
tttctgatagtagtctttaaa

SEQ ID NO: 5815194 - DNA, 15 bp, Homo sapiens
tttctgatcaaggcc

SEQ ID NO: 5815195 - DNA, 17 bp, Homo sapiens
tttctgatcaaggcctt

SEQ ID NO: 5815196 - DNA, 16 bp, Homo sapiens
tttctgatcagaggtg

SEQ ID NO: 5815197 - DNA, 21 bp, Homo sapiens
tttctgatcagaggtgtacac

SEQ ID NO: 5815198 - DNA, 22 bp, Homo sapiens
tttctgatccagttttgtttgg

SEQ ID NO: 5815199 - DNA, 18 bp, Homo sapiens
tttctgatcgtctcggcc

SEQ ID NO: 5815200 - DNA, 13 bp, Homo sapiens
tttctgatgatgt

SEQ ID NO: 5815201 - DNA, 21 bp, Homo sapiens
tttctgatggccaaaatacca

SEQ ID NO: 5815202 - DNA, 13 bp, Homo sapiens
tttctgatgtatt

SEQ ID NO: 5815203 - DNA, 19 bp, Homo sapiens
tttctgatgtattacatga

SEQ ID NO: 5815204 - DNA, 23 bp, Homo sapiens
tttctgatgtattacatgactgt

SEQ ID NO: 5815205 - DNA, 23 bp, Homo sapiens
tttctgattaatatatttaatat

SEQ ID NO: 5815206 - DNA, 14 bp, Homo sapiens
tttctgattagctt

SEQ ID NO: 5815207 - DNA, 10 bp, Homo sapiens
tttctgattc

SEQ ID NO: 5815208 - DNA, 22 bp, Homo sapiens
tttctgattcactattagagaa

SEQ ID NO: 5815209 - DNA, 14 bp, Homo sapiens
tttctgattctgat

SEQ ID NO: 5815210 - DNA, 21 bp, Homo sapiens
tttctgattctgattgctatc

SEQ ID NO: 5815211 - DNA, 15 bp, Homo sapiens
tttctgattggtgat

SEQ ID NO: 5815212 - DNA, 20 bp, Homo sapiens
tttctgatttctgaagtgct

SEQ ID NO: 5815213 - DNA, 15 bp, Homo sapiens
tttctgcaatgactg

SEQ ID NO: 5815214 - DNA, 14 bp, Homo sapiens
tttctgcacagctt

SEQ ID NO: 5815215 - DNA, 20 bp, Homo sapiens
tttctgcacagcttttccaa

SEQ ID NO: 5815216 - DNA, 22 bp, Homo sapiens
tttctgcacagcttttccaaaa

SEQ ID NO: 5815217 - DNA, 19 bp, Homo sapiens
tttctgcacaggtctctgt

SEQ ID NO: 5815218 - DNA, 17 bp, Homo sapiens
tttctgcaccccaattg

SEQ ID NO: 5815219 - DNA, 14 bp, Homo sapiens
tttctgcactatat

SEQ ID NO: 5815220 - DNA, 17 bp, Homo sapiens
tttctgcactgagcaga

SEQ ID NO: 5815221 - DNA, 22 bp, Homo sapiens
tttctgcagaaatttgcaactc

SEQ ID NO: 5815222 - DNA, 18 bp, Homo sapiens
tttctgcagactggcagt

SEQ ID NO: 5815223 - DNA, 14 bp, Homo sapiens
tttctgcagctgtt

SEQ ID NO: 5815224 - DNA, 19 bp, Homo sapiens
tttctgcagtagtctctgt

SEQ ID NO: 5815225 - DNA, 14 bp, Homo sapiens
tttctgcatcagct

SEQ ID NO: 5815226 - DNA, 13 bp, Homo sapiens
tttctgcatctcc

SEQ ID NO: 5815227 - DNA, 21 bp, Homo sapiens
tttctgcatgaccaaagtgat

SEQ ID NO: 5815228 - DNA, 13 bp, Homo sapiens
tttctgcattttg

SEQ ID NO: 5815229 - DNA, 18 bp, Homo sapiens
tttctgcattttgctatt

SEQ ID NO: 5815230 - DNA, 19 bp, Homo sapiens
tttctgccaagtcagttct

SEQ ID NO: 5815231 - DNA, 20 bp, Homo sapiens
tttctgccaataaattctaa

SEQ ID NO: 5815232 - DNA, 17 bp, Homo sapiens
tttctgccactgaggag

SEQ ID NO: 5815233 - DNA, 19 bp, Homo sapiens
tttctgccactgaggagac

SEQ ID NO: 5815234 - DNA, 21 bp, Homo sapiens
tttctgcccagccctctgtgg

SEQ ID NO: 5815235 - DNA, 21 bp, Homo sapiens
tttctgcccggctacatcagc

SEQ ID NO: 5815236 - DNA, 17 bp, Homo sapiens
tttctgccctgagccct

SEQ ID NO: 5815237 - DNA, 12 bp, Homo sapiens
tttctgccctgg

SEQ ID NO: 5815238 - DNA, 20 bp, Homo sapiens
tttctgccctggctgctgcc

SEQ ID NO: 5815239 - DNA, 14 bp, Homo sapiens
tttctgccctgggt

SEQ ID NO: 5815240 - DNA, 14 bp, Homo sapiens
tttctgccgcagcc

SEQ ID NO: 5815241 - DNA, 11 bp, Homo sapiens
tttctgcctcg

SEQ ID NO: 5815242 - DNA, 22 bp, Homo sapiens
tttctgcctggagtgtatgact

SEQ ID NO: 5815243 - DNA, 15 bp, Homo sapiens
tttctgccttccttg

SEQ ID NO: 5815244 - DNA, 17 bp, Homo sapiens
tttctgctacctggttt

SEQ ID NO: 5815245 - DNA, 15 bp, Homo sapiens
tttctgctcagcttc

SEQ ID NO: 5815246 - DNA, 19 bp, Homo sapiens
tttctgctctatactgtgg

SEQ ID NO: 5815247 - DNA, 16 bp, Homo sapiens
tttctgctctcagctc

SEQ ID NO: 5815248 - DNA, 14 bp, Homo sapiens
tttctgctctgcca

SEQ ID NO: 5815249 - DNA, 15 bp, Homo sapiens
tttctgctctggaat

SEQ ID NO: 5815250 - DNA, 11 bp, Homo sapiens
tttctgctgtt

SEQ ID NO: 5815251 - DNA, 17 bp, Homo sapiens
tttctgctgtttacaac

SEQ ID NO: 5815252 - DNA, 18 bp, Homo sapiens
tttctgctgtttacaaca

SEQ ID NO: 5815253 - DNA, 17 bp, Homo sapiens
tttctgctttagacttg

SEQ ID NO: 5815254 - DNA, 15 bp, Homo sapiens
tttctggaaatgttc

SEQ ID NO: 5815255 - DNA, 22 bp, Homo sapiens
tttctggaaattcttccctggg

SEQ ID NO: 5815256 - DNA, 14 bp, Homo sapiens
tttctggaagaaag

SEQ ID NO: 5815257 - DNA, 20 bp, Homo sapiens
tttctggaagggcagcatat

SEQ ID NO: 5815258 - DNA, 18 bp, Homo sapiens
tttctggaatggaattgg

SEQ ID NO: 5815259 - DNA, 23 bp, Homo sapiens
tttctggaattgatgtttacatg

SEQ ID NO: 5815260 - DNA, 16 bp, Homo sapiens
tttctggacaagaaga

SEQ ID NO: 5815261 - DNA, 21 bp, Homo sapiens
tttctggactcccactctttg

SEQ ID NO: 5815262 - DNA, 17 bp, Homo sapiens
tttctggactctggact

SEQ ID NO: 5815263 - DNA, 16 bp, Homo sapiens
tttctggagcaagaga

SEQ ID NO: 5815264 - DNA, 21 bp, Homo sapiens
tttctggaggttgataacttt

SEQ ID NO: 5815265 - DNA, 18 bp, Homo sapiens
tttctggagtgaaccaga

SEQ ID NO: 5815266 - DNA, 11 bp, Homo sapiens
tttctggcaaa

SEQ ID NO: 5815267 - DNA, 22 bp, Homo sapiens
tttctggcaaacgtttctcaaa

SEQ ID NO: 5815268 - DNA, 12 bp, Homo sapiens
tttctggcaccg

SEQ ID NO: 5815269 - DNA, 21 bp, Homo sapiens
tttctggcaggtcctcccctc

SEQ ID NO: 5815270 - DNA, 16 bp, Homo sapiens
tttctggcatatgttt

SEQ ID NO: 5815271 - DNA, 11 bp, Homo sapiens
tttctggcctg

SEQ ID NO: 5815272 - DNA, 16 bp, Homo sapiens
tttctggccttgactt

SEQ ID NO: 5815273 - DNA, 16 bp, Homo sapiens
tttctggctatgcatt

SEQ ID NO: 5815274 - DNA, 19 bp, Homo sapiens
tttctggctggagcctaga

SEQ ID NO: 5815275 - DNA, 20 bp, Homo sapiens
tttctggctgtgatcttaaa

SEQ ID NO: 5815276 - DNA, 15 bp, Homo sapiens
tttctggcttctgct

SEQ ID NO: 5815277 - DNA, 17 bp, Homo sapiens
tttctggcttctgcttc

SEQ ID NO: 5815278 - DNA, 19 bp, Homo sapiens
tttctggctttttgaatta

SEQ ID NO: 5815279 - DNA, 23 bp, Homo sapiens
tttctgggagacagaaaacatgt

SEQ ID NO: 5815280 - DNA, 16 bp, Homo sapiens
tttctgggataagtaa

SEQ ID NO: 5815281 - DNA, 23 bp, Homo sapiens
tttctgggatgcaatactaggaa

SEQ ID NO: 5815282 - DNA, 16 bp, Homo sapiens
tttctgggctctggac

SEQ ID NO: 5815283 - DNA, 18 bp, Homo sapiens
tttctgggctgatgggtg

SEQ ID NO: 5815284 - DNA, 19 bp, Homo sapiens
tttctgggctttctcctgg

SEQ ID NO: 5815285 - DNA, 22 bp, Homo sapiens
tttctggggaaagacactgcct

SEQ ID NO: 5815286 - DNA, 17 bp, Homo sapiens
tttctggggaaagggga

SEQ ID NO: 5815287 - DNA, 21 bp, Homo sapiens
tttctggggggatatttccta

SEQ ID NO: 5815288 - DNA, 23 bp, Homo sapiens
tttctgggtccctgctccccttt

SEQ ID NO: 5815289 - DNA, 15 bp, Homo sapiens
tttctgggtcctgaa

SEQ ID NO: 5815290 - DNA, 14 bp, Homo sapiens
tttctgggtgctag

SEQ ID NO: 5815291 - DNA, 23 bp, Homo sapiens
tttctggtaggaagatggaggtt

SEQ ID NO: 5815292 - DNA, 17 bp, Homo sapiens
tttctggtaggttctgt

SEQ ID NO: 5815293 - DNA, 16 bp, Homo sapiens
tttctggtataaagct

SEQ ID NO: 5815294 - DNA, 17 bp, Homo sapiens
tttctggtatgaaacaa

SEQ ID NO: 5815295 - DNA, 16 bp, Homo sapiens
tttctggtcaacccca

SEQ ID NO: 5815296 - DNA, 12 bp, Homo sapiens
tttctggtccct

SEQ ID NO: 5815297 - DNA, 17 bp, Homo sapiens
tttctggtgccatttct

SEQ ID NO: 5815298 - DNA, 22 bp, Homo sapiens
tttctggtgcctatttattcat

SEQ ID NO: 5815299 - DNA, 15 bp, Homo sapiens
tttctggtgctgtct

SEQ ID NO: 5815300 - DNA, 21 bp, Homo sapiens
tttctggtggcaaatgaattt

SEQ ID NO: 5815301 - DNA, 23 bp, Homo sapiens
tttctggtggggctgtcctgctg

SEQ ID NO: 5815302 - DNA, 20 bp, Homo sapiens
tttctggtggtctgttggca

SEQ ID NO: 5815303 - DNA, 22 bp, Homo sapiens
tttctggttcttgtgttggctg

SEQ ID NO: 5815304 - DNA, 21 bp, Homo sapiens
tttctggttgttatgtgatca

SEQ ID NO: 5815305 - DNA, 15 bp, Homo sapiens
tttctggtttgcctg

SEQ ID NO: 5815306 - DNA, 20 bp, Homo sapiens
tttctgtaaaagttactaat

SEQ ID NO: 5815307 - DNA, 15 bp, Homo sapiens
tttctgtaaactctg

SEQ ID NO: 5815308 - DNA, 14 bp, Homo sapiens
tttctgtaaataac

SEQ ID NO: 5815309 - DNA, 22 bp, Homo sapiens
tttctgtaagaaacctactgcc

SEQ ID NO: 5815310 - DNA, 22 bp, Homo sapiens
tttctgtaagagaaaatattac

SEQ ID NO: 5815311 - DNA, 19 bp, Homo sapiens
tttctgtaatgtaaataaa

SEQ ID NO: 5815312 - DNA, 23 bp, Homo sapiens
tttctgtaattcaggtttttcct

SEQ ID NO: 5815313 - DNA, 15 bp, Homo sapiens
tttctgtacacagaa

SEQ ID NO: 5815314 - DNA, 20 bp, Homo sapiens
tttctgtactaaacatttcc

SEQ ID NO: 5815315 - DNA, 18 bp, Homo sapiens
tttctgtacttcagtatg

SEQ ID NO: 5815316 - DNA, 20 bp, Homo sapiens
tttctgtactttttggcata

SEQ ID NO: 5815317 - DNA, 22 bp, Homo sapiens
tttctgtagaaaagaaaacatt

SEQ ID NO: 5815318 - DNA, 14 bp, Homo sapiens
tttctgtagaatgc

SEQ ID NO: 5815319 - DNA, 17 bp, Homo sapiens
tttgaaagaattctatt

SEQ ID NO: 5815320 - DNA, 23 bp, Homo sapiens
tttgaaagacttccaaagaatgt

SEQ ID NO: 5815321 - DNA, 20 bp, Homo sapiens
tttgaaagatggtaatcttt

SEQ ID NO: 5815322 - DNA, 21 bp, Homo sapiens
tttgaaaggagatgtcttgga

SEQ ID NO: 5815323 - DNA, 22 bp, Homo sapiens
tttgaaagggatcatcatgcag

SEQ ID NO: 5815324 - DNA, 18 bp, Homo sapiens
tttgaaaggtcagaattt

SEQ ID NO: 5815325 - DNA, 23 bp, Homo sapiens
tttgaaagtaaaaacctgcttgg

SEQ ID NO: 5815326 - DNA, 17 bp, Homo sapiens
tttgaaagtagagctag

SEQ ID NO: 5815327 - DNA, 23 bp, Homo sapiens
tttgaaagtagagctagctgcca

SEQ ID NO: 5815328 - DNA, 17 bp, Homo sapiens
tttgaaagtctgtcctt

SEQ ID NO: 5815329 - DNA, 14 bp, Homo sapiens
tttgaaagtgcctt

SEQ ID NO: 5815330 - DNA, 21 bp, Homo sapiens
tttgaaagtgcctttgcagct

SEQ ID NO: 5815331 - DNA, 21 bp, Homo sapiens
tttgaaagtgggtttcaattt

SEQ ID NO: 5815332 - DNA, 21 bp, Homo sapiens
tttgaaagtgtttttctttaa

SEQ ID NO: 5815333 - DNA, 16 bp, Homo sapiens
tttgaaagttgtacat

SEQ ID NO: 5815334 - DNA, 19 bp, Homo sapiens
tttgaaagttgtacatgat

SEQ ID NO: 5815335 - DNA, 20 bp, Homo sapiens
tttgaaagttgtacatgata

SEQ ID NO: 5815336 - DNA, 17 bp, Homo sapiens
tttgaaagtttaacaaa

SEQ ID NO: 5815337 - DNA, 20 bp, Homo sapiens
tttgaaagtttaacaaatga

SEQ ID NO: 5815338 - DNA, 22 bp, Homo sapiens
tttgaaataaagaaccagtccc

SEQ ID NO: 5815339 - DNA, 17 bp, Homo sapiens
tttgaaataacagcctt

SEQ ID NO: 5815340 - DNA, 16 bp, Homo sapiens
tttgaaataagctatt

SEQ ID NO: 5815341 - DNA, 19 bp, Homo sapiens
tttgaaataagctatttga

SEQ ID NO: 5815342 - DNA, 14 bp, Homo sapiens
tttgaaataataaa

SEQ ID NO: 5815343 - DNA, 19 bp, Homo sapiens
tttgaaatacctcatgttt

SEQ ID NO: 5815344 - DNA, 19 bp, Homo sapiens
tttgaaatacctttgtagt

SEQ ID NO: 5815345 - DNA, 14 bp, Homo sapiens
tttgaaatagaaaa

SEQ ID NO: 5815346 - DNA, 22 bp, Homo sapiens
tttgaaatatatggtctaatgt

SEQ ID NO: 5815347 - DNA, 16 bp, Homo sapiens
tttgaaatatgcatgt

SEQ ID NO: 5815348 - DNA, 17 bp, Homo sapiens
tttgaaatatgcatgta

SEQ ID NO: 5815349 - DNA, 22 bp, Homo sapiens
tttgaaatatggaactgtaata

SEQ ID NO: 5815350 - DNA, 14 bp, Homo sapiens
tttgaaatcagtaa

SEQ ID NO: 5815351 - DNA, 21 bp, Homo sapiens
tttgaaatcagtaaacactgt

SEQ ID NO: 5815352 - DNA, 16 bp, Homo sapiens
tttgaaatccaaacta

SEQ ID NO: 5815353 - DNA, 14 bp, Homo sapiens
tttgaaatgaaatt

SEQ ID NO: 5815354 - DNA, 17 bp, Homo sapiens
tttgaaatgaaatttaa

SEQ ID NO: 5815355 - DNA, 22 bp, Homo sapiens
tttgaaatgaaatttaaacatt

SEQ ID NO: 5815356 - DNA, 21 bp, Homo sapiens
tttgaaatgattcatctttca

SEQ ID NO: 5815357 - DNA, 19 bp, Homo sapiens
tttgaaatgccacgtgcca

SEQ ID NO: 5815358 - DNA, 18 bp, Homo sapiens
tttgaaattaacctctca

SEQ ID NO: 5815359 - DNA, 15 bp, Homo sapiens
tttgaaattatgtga

SEQ ID NO: 5815360 - DNA, 11 bp, Homo sapiens
tttgaaattct

SEQ ID NO: 5815361 - DNA, 17 bp, Homo sapiens
tttgaaattctgaattt

SEQ ID NO: 5815362 - DNA, 17 bp, Homo sapiens
tttgaaattgtagtgca

SEQ ID NO: 5815363 - DNA, 12 bp, Homo sapiens
tttgaacaaaaa

SEQ ID NO: 5815364 - DNA, 22 bp, Homo sapiens
tttgaacaactaggcttcagca

SEQ ID NO: 5815365 - DNA, 22 bp, Homo sapiens
tttgaacaactcgaatcactca

SEQ ID NO: 5815366 - DNA, 21 bp, Homo sapiens
tttgaacaatgaagttgaaaa

SEQ ID NO: 5815367 - DNA, 20 bp, Homo sapiens
tttgaacacgaaagaaatgt

SEQ ID NO: 5815368 - DNA, 12 bp, Homo sapiens
tttgaacactgg

SEQ ID NO: 5815369 - DNA, 23 bp, Homo sapiens
tttgaacactggctaaagataat

SEQ ID NO: 5815370 - DNA, 16 bp, Homo sapiens
tttgaacacttactgt

SEQ ID NO: 5815371 - DNA, 14 bp, Homo sapiens
tttgaacagttggc

SEQ ID NO: 5815372 - DNA, 14 bp, Homo sapiens
tttgaaccaaaaca

SEQ ID NO: 5815373 - DNA, 16 bp, Homo sapiens
tttgaaccaacatctt

SEQ ID NO: 5815374 - DNA, 22 bp, Homo sapiens
tttgaacccaggagagtggaag

SEQ ID NO: 5815375 - DNA, 18 bp, Homo sapiens
tttgaacctccaaatgga

SEQ ID NO: 5815376 - DNA, 23 bp, Homo sapiens
tttgaacgcttaagtcatcatta

SEQ ID NO: 5815377 - DNA, 13 bp, Homo sapiens
tttgaacgtatgt

SEQ ID NO: 5815378 - DNA, 13 bp, Homo sapiens
tttgaacgtgctt

SEQ ID NO: 5815379 - DNA, 14 bp, Homo sapiens
tttgaacgtgcttc

SEQ ID NO: 5815380 - DNA, 13 bp, Homo sapiens
tttgaactaattt

SEQ ID NO: 5815381 - DNA, 11 bp, Homo sapiens
tttgaactcac

SEQ ID NO: 5815382 - DNA, 16 bp, Homo sapiens
tttgaactcagatctg

SEQ ID NO: 5815383 - DNA, 19 bp, Homo sapiens
tttgaactcctcaagggca

SEQ ID NO: 5815384 - DNA, 21 bp, Homo sapiens
tttgaactgaaacttttctaa

SEQ ID NO: 5815385 - DNA, 19 bp, Homo sapiens
tttgaactgataaagatga

SEQ ID NO: 5815386 - DNA, 18 bp, Homo sapiens
tttgaactgccaagaaaa

SEQ ID NO: 5815387 - DNA, 22 bp, Homo sapiens
tttgaactggcaattgtctatt

SEQ ID NO: 5815388 - DNA, 19 bp, Homo sapiens
tttgaactggtattgttta

SEQ ID NO: 5815389 - DNA, 17 bp, Homo sapiens
tttgaactgttagatgc

SEQ ID NO: 5815390 - DNA, 21 bp, Homo sapiens
tttgaactgttagatgctgaa

SEQ ID NO: 5815391 - DNA, 14 bp, Homo sapiens
tttgaactttggaa

SEQ ID NO: 5815392 - DNA, 12 bp, Homo sapiens
tttgaacttttt

SEQ ID NO: 5815393 - DNA, 14 bp, Homo sapiens
tttgaactttttat

SEQ ID NO: 5815394 - DNA, 19 bp, Homo sapiens
tttgaagaaaacacaacat

SEQ ID NO: 5815395 - DNA, 20 bp, Homo sapiens
tttgaagaaaacacaacatt

SEQ ID NO: 5815396 - DNA, 11 bp, Homo sapiens
tttgaagaagg

SEQ ID NO: 5815397 - DNA, 17 bp, Homo sapiens
tttgaagaagggaaatt

SEQ ID NO: 5815398 - DNA, 21 bp, Homo sapiens
tttgaagaaggtggacctttt

SEQ ID NO: 5815399 - DNA, 21 bp, Homo sapiens
tttgaagacacagcctccccc

SEQ ID NO: 5815400 - DNA, 17 bp, Homo sapiens
tttgaagacttcaaaat

SEQ ID NO: 5815401 - DNA, 21 bp, Homo sapiens
tttgaagagttccaagttgaa

SEQ ID NO: 5815402 - DNA, 20 bp, Homo sapiens
tttgaagataataatcttgg

SEQ ID NO: 5815403 - DNA, 16 bp, Homo sapiens
tttgaagatctgattt

SEQ ID NO: 5815404 - DNA, 19 bp, Homo sapiens
tttgaagatctgatttata

SEQ ID NO: 5815405 - DNA, 22 bp, Homo sapiens
tttgaagatgccgcatttggat

SEQ ID NO: 5815406 - DNA, 15 bp, Homo sapiens
tttgaagcaaataca

SEQ ID NO: 5815407 - DNA, 17 bp, Homo sapiens
tttgaagcaaatacaat

SEQ ID NO: 5815408 - DNA, 19 bp, Homo sapiens
tttgaagcacaactccctt

SEQ ID NO: 5815409 - DNA, 18 bp, Homo sapiens
tttgaagcacagtgatca

SEQ ID NO: 5815410 - DNA, 14 bp, Homo sapiens
tttgaagcagctct

SEQ ID NO: 5815411 - DNA, 19 bp, Homo sapiens
tttgaagcagctctgcctt

SEQ ID NO: 5815412 - DNA, 18 bp, Homo sapiens
tttgaagcagttgtgtca

SEQ ID NO: 5815413 - DNA, 15 bp, Homo sapiens
tttgaagcctgccct

SEQ ID NO: 5815414 - DNA, 20 bp, Homo sapiens
tttgaagcctgctaaatgaa

SEQ ID NO: 5815415 - DNA, 14 bp, Homo sapiens
tttgaagcctgtgc

SEQ ID NO: 5815416 - DNA, 15 bp, Homo sapiens
tttgaagcctgtgcc

SEQ ID NO: 5815417 - DNA, 16 bp, Homo sapiens
tttgaagcctgtgcct

SEQ ID NO: 5815418 - DNA, 18 bp, Homo sapiens
tttgaagctaattatttt

SEQ ID NO: 5815419 - DNA, 23 bp, Homo sapiens
tttgaagctaattattttaatta

SEQ ID NO: 5815420 - DNA, 16 bp, Homo sapiens
tttgaagctactgtgt

SEQ ID NO: 5815421 - DNA, 11 bp, Homo sapiens
tttgaagctga

SEQ ID NO: 5815422 - DNA, 20 bp, Homo sapiens
tttgaaggaaacagttaata

SEQ ID NO: 5815423 - DNA, 13 bp, Homo sapiens
tttgaaggaaacc

SEQ ID NO: 5815424 - DNA, 16 bp, Homo sapiens
tttgaaggagaatggc

SEQ ID NO: 5815425 - DNA, 19 bp, Homo sapiens
tttgaaggaggtgagggat

SEQ ID NO: 5815426 - DNA, 12 bp, Homo sapiens
tttgaaggcaaa

SEQ ID NO: 5815427 - DNA, 13 bp, Homo sapiens
tttgaaggcaaaa

SEQ ID NO: 5815428 - DNA, 21 bp, Homo sapiens
tttgaaggtaataaatacaca

SEQ ID NO: 5815429 - DNA, 18 bp, Homo sapiens
tttgaaggtttcagatga

SEQ ID NO: 5815430 - DNA, 19 bp, Homo sapiens
tttgaaggtttcagatgag

SEQ ID NO: 5815431 - DNA, 17 bp, Homo sapiens
tttgaaggttttaagtg

SEQ ID NO: 5815432 - DNA, 20 bp, Homo sapiens
tttgaagtaacttatttgac

SEQ ID NO: 5815433 - DNA, 22 bp, Homo sapiens
tttgaagtaatcccgccaccta

SEQ ID NO: 5815434 - DNA, 12 bp, Homo sapiens
tttgaagtatta

SEQ ID NO: 5815435 - DNA, 22 bp, Homo sapiens
tttgaagtcataccaatgaaaa

SEQ ID NO: 5815436 - DNA, 14 bp, Homo sapiens
tttgaagtcttgta

SEQ ID NO: 5815437 - DNA, 16 bp, Homo sapiens
tttgaagtgcagctca

SEQ ID NO: 5815438 - DNA, 17 bp, Homo sapiens
tttgaagtgcctctgat

SEQ ID NO: 5815439 - DNA, 20 bp, Homo sapiens
tttgaagtgctgtttattaa

SEQ ID NO: 5815440 - DNA, 17 bp, Homo sapiens
tttgaagtgggaaagca

SEQ ID NO: 5815441 - DNA, 20 bp, Homo sapiens
tttgaagtgtacctgtgtac

SEQ ID NO: 5815442 - DNA, 19 bp, Homo sapiens
tttgaagtttacattttta

SEQ ID NO: 5815443 - DNA, 23 bp, Homo sapiens
tttgaataaaaaacatttgtaca

SEQ ID NO: 5815444 - DNA, 14 bp, Homo sapiens
tttgaataaaaagt

SEQ ID NO: 5815445 - DNA, 19 bp, Homo sapiens
tttgaataaaaagtgaact

SEQ ID NO: 5815446 - DNA, 20 bp, Homo sapiens
tttgaataaagaatacttga

SEQ ID NO: 5815447 - DNA, 19 bp, Homo sapiens
tttgaataaagtctgagtg

SEQ ID NO: 5815448 - DNA, 15 bp, Homo sapiens
tttgaataaatgtgt

SEQ ID NO: 5815449 - DNA, 23 bp, Homo sapiens
tttgaataacaaggaaaacagta

SEQ ID NO: 5815450 - DNA, 22 bp, Homo sapiens
tttgaataagcagaacatactg

SEQ ID NO: 5815451 - DNA, 13 bp, Homo sapiens
tttgaatacattt

SEQ ID NO: 5815452 - DNA, 16 bp, Homo sapiens
tttgaataccattaaa

SEQ ID NO: 5815453 - DNA, 16 bp, Homo sapiens
tttgaatacccccaga

SEQ ID NO: 5815454 - DNA, 20 bp, Homo sapiens
tttgaatacccccagagacc

SEQ ID NO: 5815455 - DNA, 19 bp, Homo sapiens
tttgaatatattttatctt

SEQ ID NO: 5815456 - DNA, 14 bp, Homo sapiens
tttgaatatgtagt

SEQ ID NO: 5815457 - DNA, 15 bp, Homo sapiens
tttgaatattttttg

SEQ ID NO: 5815458 - DNA, 21 bp, Homo sapiens
tttgaatattttttgaaggtt

SEQ ID NO: 5815459 - DNA, 17 bp, Homo sapiens
tttgaatcaaagaatag

SEQ ID NO: 5815460 - DNA, 19 bp, Homo sapiens
tttgaatcaatctggcttc

SEQ ID NO: 5815461 - DNA, 18 bp, Homo sapiens
tttgaatcacatgaatta

SEQ ID NO: 5815462 - DNA, 18 bp, Homo sapiens
tttgaatcatcaagtctt

SEQ ID NO: 5815463 - DNA, 21 bp, Homo sapiens
tttgaatctcataatttatac

SEQ ID NO: 5815464 - DNA, 22 bp, Homo sapiens
tttgaatctcataatttataca

SEQ ID NO: 5815465 - DNA, 15 bp, Homo sapiens
tttgaatgaaaaatt

SEQ ID NO: 5815466 - DNA, 14 bp, Homo sapiens
tttgaatgacaaag

SEQ ID NO: 5815467 - DNA, 22 bp, Homo sapiens
tttgaatgatttttctttacaa

SEQ ID NO: 5815468 - DNA, 19 bp, Homo sapiens
tttgaatggattaaatggc

SEQ ID NO: 5815469 - DNA, 17 bp, Homo sapiens
tttgaatggtttaacaa

SEQ ID NO: 5815470 - DNA, 12 bp, Homo sapiens
tttgaatgtacc

SEQ ID NO: 5815471 - DNA, 22 bp, Homo sapiens
tttgaatgtatgcttcatacag

SEQ ID NO: 5815472 - DNA, 21 bp, Homo sapiens
tttgaatgtattgttctgttt

SEQ ID NO: 5815473 - DNA, 23 bp, Homo sapiens
tttgaatgtccaaaatttatatt

SEQ ID NO: 5815474 - DNA, 19 bp, Homo sapiens
tttgaatgtgatcatcttt

SEQ ID NO: 5815475 - DNA, 17 bp, Homo sapiens
tttgaatgtgtttcaca

SEQ ID NO: 5815476 - DNA, 18 bp, Homo sapiens
tttgaatgttaaataaat

SEQ ID NO: 5815477 - DNA, 22 bp, Homo sapiens
tttgaatgttaaataaattgta

SEQ ID NO: 5815478 - DNA, 18 bp, Homo sapiens
tttgaatgttaagaataa

SEQ ID NO: 5815479 - DNA, 19 bp, Homo sapiens
tttgaatgttaagaataac

SEQ ID NO: 5815480 - DNA, 20 bp, Homo sapiens
tttgaatgttatttgttatt

SEQ ID NO: 5815481 - DNA, 12 bp, Homo sapiens
tttgaatgtttt

SEQ ID NO: 5815482 - DNA, 15 bp, Homo sapiens
tttgaatgttttgtg

SEQ ID NO: 5815483 - DNA, 13 bp, Homo sapiens
tttgaattaaaac

SEQ ID NO: 5815484 - DNA, 15 bp, Homo sapiens
tttgaattaaaactt

SEQ ID NO: 5815485 - DNA, 18 bp, Homo sapiens
tttgaattacagagatat

SEQ ID NO: 5815486 - DNA, 22 bp, Homo sapiens
tttgaattatccacatgaaaat

SEQ ID NO: 5815487 - DNA, 14 bp, Homo sapiens
tttgaattcatttg

SEQ ID NO: 5815488 - DNA, 17 bp, Homo sapiens
tttgaattggcctgaac

SEQ ID NO: 5815489 - DNA, 22 bp, Homo sapiens
tttgaattggcctgaacagatg

SEQ ID NO: 5815490 - DNA, 21 bp, Homo sapiens
tttgaattgtgtggagaagtg

SEQ ID NO: 5815491 - DNA, 15 bp, Homo sapiens
tttgaattgttacat

SEQ ID NO: 5815492 - DNA, 15 bp, Homo sapiens
tttgaatttaaataa

SEQ ID NO: 5815493 - DNA, 17 bp, Homo sapiens
tttgaattttcatttta

SEQ ID NO: 5815494 - DNA, 20 bp, Homo sapiens
tttgaattttcattttacag

SEQ ID NO: 5815495 - DNA, 23 bp, Homo sapiens
tttgataacattttgtttatgtt

SEQ ID NO: 5815496 - DNA, 18 bp, Homo sapiens
tttgataagcacattaaa

SEQ ID NO: 5815497 - DNA, 18 bp, Homo sapiens
tttgataatcaactgggc

SEQ ID NO: 5815498 - DNA, 19 bp, Homo sapiens
tttgataatgttaaatttg

SEQ ID NO: 5815499 - DNA, 17 bp, Homo sapiens
tttgataattttgaaat

SEQ ID NO: 5815500 - DNA, 13 bp, Homo sapiens
tttgatacaaatg

SEQ ID NO: 5815501 - DNA, 21 bp, Homo sapiens
tttgatacagtattgaaaaat

SEQ ID NO: 5815502 - DNA, 20 bp, Homo sapiens
tttgatacataaacttttgc

SEQ ID NO: 5815503 - DNA, 21 bp, Homo sapiens
tttgatacataaacttttgca

SEQ ID NO: 5815504 - DNA, 15 bp, Homo sapiens
tttgatacataataa

SEQ ID NO: 5815505 - DNA, 17 bp, Homo sapiens
tttgatacataataaaa

SEQ ID NO: 5815506 - DNA, 23 bp, Homo sapiens
tttgatacataataaaaaattat

SEQ ID NO: 5815507 - DNA, 17 bp, Homo sapiens
tttgatacatttatctt

SEQ ID NO: 5815508 - DNA, 15 bp, Homo sapiens
tttgatacccctggg

SEQ ID NO: 5815509 - DNA, 17 bp, Homo sapiens
tttgataccttcaatga

SEQ ID NO: 5815510 - DNA, 14 bp, Homo sapiens
tttgatacttatat

SEQ ID NO: 5815511 - DNA, 17 bp, Homo sapiens
tttgatacttatatttt

SEQ ID NO: 5815512 - DNA, 17 bp, Homo sapiens
tttgatagatgataatt

SEQ ID NO: 5815513 - DNA, 18 bp, Homo sapiens
tttgataggaaggaaact

SEQ ID NO: 5815514 - DNA, 17 bp, Homo sapiens
tttgatagtaaatgtcc

SEQ ID NO: 5815515 - DNA, 21 bp, Homo sapiens
tttgatagtatttataatata

SEQ ID NO: 5815516 - DNA, 16 bp, Homo sapiens
tttgatatacagacct

SEQ ID NO: 5815517 - DNA, 21 bp, Homo sapiens
tttgatatacagacctccaga

SEQ ID NO: 5815518 - DNA, 13 bp, Homo sapiens
tttgatatacatt

SEQ ID NO: 5815519 - DNA, 22 bp, Homo sapiens
tttgatataccaaattaaaaaa

SEQ ID NO: 5815520 - DNA, 14 bp, Homo sapiens
tttgatatatgaaa

SEQ ID NO: 5815521 - DNA, 16 bp, Homo sapiens
tttgatatatgtatct

SEQ ID NO: 5815522 - DNA, 19 bp, Homo sapiens
tttgatatgagtatacaat

SEQ ID NO: 5815523 - DNA, 22 bp, Homo sapiens
tttgatatgattgtaacatatt

SEQ ID NO: 5815524 - DNA, 18 bp, Homo sapiens
tttgatatgggtagtatt

SEQ ID NO: 5815525 - DNA, 15 bp, Homo sapiens
tttgatatgtgaaca

SEQ ID NO: 5815526 - DNA, 19 bp, Homo sapiens
tttgatatgttgatgaaat

SEQ ID NO: 5815527 - DNA, 19 bp, Homo sapiens
tttgatattaaaggagtta

SEQ ID NO: 5815528 - DNA, 21 bp, Homo sapiens
tttgatattatacaggaaagc

SEQ ID NO: 5815529 - DNA, 14 bp, Homo sapiens
tttgatattatcta

SEQ ID NO: 5815530 - DNA, 15 bp, Homo sapiens
tttgatattatgtgg

SEQ ID NO: 5815531 - DNA, 21 bp, Homo sapiens
tttgatattgagacattaatt

SEQ ID NO: 5815532 - DNA, 19 bp, Homo sapiens
tttgatattgtgtaggaaa

SEQ ID NO: 5815533 - DNA, 14 bp, Homo sapiens
tttgatcaagaatg

SEQ ID NO: 5815534 - DNA, 14 bp, Homo sapiens
tttgatcagacagc

SEQ ID NO: 5815535 - DNA, 15 bp, Homo sapiens
tttgatcatcccttt

SEQ ID NO: 5815536 - DNA, 19 bp, Homo sapiens
tttgatcatgaataactga

SEQ ID NO: 5815537 - DNA, 16 bp, Homo sapiens
tttgatctcacatttt

SEQ ID NO: 5815538 - DNA, 18 bp, Homo sapiens
tttgatctcacattttta

SEQ ID NO: 5815539 - DNA, 12 bp, Homo sapiens
tttgatctctgc

SEQ ID NO: 5815540 - DNA, 12 bp, Homo sapiens
tttgatcttcag

SEQ ID NO: 5815541 - DNA, 16 bp, Homo sapiens
tttgatctttgtttaa

SEQ ID NO: 5815542 - DNA, 20 bp, Homo sapiens
tttgatctttgtttaaatgc

SEQ ID NO: 5815543 - DNA, 22 bp, Homo sapiens
tttgatctttgtttaaatgcca

SEQ ID NO: 5815544 - DNA, 23 bp, Homo sapiens
tttgatgactggcattttataga

SEQ ID NO: 5815545 - DNA, 21 bp, Homo sapiens
tttgatgagatattaaattct

SEQ ID NO: 5815546 - DNA, 20 bp, Homo sapiens
tttgatgatgtctacagaaa

SEQ ID NO: 5815547 - DNA, 16 bp, Homo sapiens
tttgatgcatgtcttt

SEQ ID NO: 5815548 - DNA, 20 bp, Homo sapiens
tttgatgcccagataatata

SEQ ID NO: 5815549 - DNA, 20 bp, Homo sapiens
tttgatgctatttatgcaag

SEQ ID NO: 5815550 - DNA, 12 bp, Homo sapiens
tttgatggctgg

SEQ ID NO: 5815551 - DNA, 20 bp, Homo sapiens
tttgatggtgccagagaggg

SEQ ID NO: 5815552 - DNA, 14 bp, Homo sapiens
tttgatgtacatgt

SEQ ID NO: 5815553 - DNA, 18 bp, Homo sapiens
tttgatgtacatgtgtag

SEQ ID NO: 5815554 - DNA, 22 bp, Homo sapiens
tttgatgtacattacagattaa

SEQ ID NO: 5815555 - DNA, 14 bp, Homo sapiens
tttgatgtatgtgt

SEQ ID NO: 5815556 - DNA, 19 bp, Homo sapiens
tttgatgtatgtgtgaaac

SEQ ID NO: 5815557 - DNA, 23 bp, Homo sapiens
tttgatgtatgtgtgaaacaatg

SEQ ID NO: 5815558 - DNA, 22 bp, Homo sapiens
tttgatgtattattatatatgt

SEQ ID NO: 5815559 - DNA, 16 bp, Homo sapiens
tttgatgtcagcagtt

SEQ ID NO: 5815560 - DNA, 20 bp, Homo sapiens
tttgatgtcagcagttgctg

SEQ ID NO: 5815561 - DNA, 15 bp, Homo sapiens
tttgatgtcatgtgt

SEQ ID NO: 5815562 - DNA, 16 bp, Homo sapiens
tttgatgtctccaagt

SEQ ID NO: 5815563 - DNA, 21 bp, Homo sapiens
tttgatgtgttgttcttggca

SEQ ID NO: 5815564 - DNA, 15 bp, Homo sapiens
tttgatgttaacaca

SEQ ID NO: 5815565 - DNA, 22 bp, Homo sapiens
tttgatgttctttcaccctttt

SEQ ID NO: 5815566 - DNA, 17 bp, Homo sapiens
tttgatgtttgtggcct

SEQ ID NO: 5815567 - DNA, 20 bp, Homo sapiens
tttgattaaattatgaatga

SEQ ID NO: 5815568 - DNA, 23 bp, Homo sapiens
tttgattaaattcttgcaaagta

SEQ ID NO: 5815569 - DNA, 13 bp, Homo sapiens
tttgattaacaat

SEQ ID NO: 5815570 - DNA, 16 bp, Homo sapiens
tttgattaacaatgta

SEQ ID NO: 5815571 - DNA, 18 bp, Homo sapiens
tttgattaaccttttcaa

SEQ ID NO: 5815572 - DNA, 21 bp, Homo sapiens
tttgattaaccttttcaaatt

SEQ ID NO: 5815573 - DNA, 18 bp, Homo sapiens
tttgattaatccagaata

SEQ ID NO: 5815574 - DNA, 15 bp, Homo sapiens
tttgattatgactgt

SEQ ID NO: 5815575 - DNA, 23 bp, Homo sapiens
tttgattattatgtttattacaa

SEQ ID NO: 5815576 - DNA, 16 bp, Homo sapiens
tttgattattgtattt

SEQ ID NO: 5815577 - DNA, 14 bp, Homo sapiens
tttgattatttgca

SEQ ID NO: 5815578 - DNA, 17 bp, Homo sapiens
tttgattatttgcatgt

SEQ ID NO: 5815579 - DNA, 15 bp, Homo sapiens
tttgattcaaaatat

SEQ ID NO: 5815580 - DNA, 14 bp, Homo sapiens
tttgattcacatgt

SEQ ID NO: 5815581 - DNA, 18 bp, Homo sapiens
tttgattcacatgttttc

SEQ ID NO: 5815582 - DNA, 15 bp, Homo sapiens
tttgattcagacagc

SEQ ID NO: 5815583 - DNA, 17 bp, Homo sapiens
tttgattcagctcatta

SEQ ID NO: 5815584 - DNA, 23 bp, Homo sapiens
tttgattcagctcattatgaaaa

SEQ ID NO: 5815585 - DNA, 17 bp, Homo sapiens
tttgattctaaatagcg

SEQ ID NO: 5815586 - DNA, 14 bp, Homo sapiens
tttgattctgaagt

SEQ ID NO: 5815587 - DNA, 12 bp, Homo sapiens
tttgattgcata

SEQ ID NO: 5815588 - DNA, 22 bp, Homo sapiens
tttgattgcatattttgttata

SEQ ID NO: 5815589 - DNA, 22 bp, Homo sapiens
tttgattggatattctcctcgg

SEQ ID NO: 5815590 - DNA, 11 bp, Homo sapiens
tttgattggct

SEQ ID NO: 5815591 - DNA, 19 bp, Homo sapiens
tttgattgttatgtaaaac

SEQ ID NO: 5815592 - DNA, 19 bp, Homo sapiens
tttgattgtttacaggata

SEQ ID NO: 5815593 - DNA, 17 bp, Homo sapiens
tttgatttagattgagt

SEQ ID NO: 5815594 - DNA, 15 bp, Homo sapiens
tttgatttatcaata

SEQ ID NO: 5815595 - DNA, 17 bp, Homo sapiens
tttgatttatcaatatt

SEQ ID NO: 5815596 - DNA, 12 bp, Homo sapiens
tttgatttcaac

SEQ ID NO: 5815597 - DNA, 16 bp, Homo sapiens
tttgatttcaacatga

SEQ ID NO: 5815598 - DNA, 13 bp, Homo sapiens
tttgatttcaggt

SEQ ID NO: 5815599 - DNA, 21 bp, Homo sapiens
tttgatttccatcttaatgtt

SEQ ID NO: 5815600 - DNA, 16 bp, Homo sapiens
tttgatttctaagtgt

SEQ ID NO: 5815601 - DNA, 20 bp, Homo sapiens
tttgatttgcaacactgcca

SEQ ID NO: 5815602 - DNA, 14 bp, Homo sapiens
tttgatttgtctca

SEQ ID NO: 5815603 - DNA, 13 bp, Homo sapiens
tttgattttgctg

SEQ ID NO: 5815604 - DNA, 23 bp, Homo sapiens
tttgattttggaaagatgttaag

SEQ ID NO: 5815605 - DNA, 17 bp, Homo sapiens
tttgatttttgaagttg

SEQ ID NO: 5815606 - DNA, 18 bp, Homo sapiens
tttgatttttgaagttgg

SEQ ID NO: 5815607 - DNA, 20 bp, Homo sapiens
tttgcaaaaaatgtttttgg

SEQ ID NO: 5815608 - DNA, 22 bp, Homo sapiens
tttgcaaaaatccaaatattgt

SEQ ID NO: 5815609 - DNA, 20 bp, Homo sapiens
tttgcaaaataagtaaataa

SEQ ID NO: 5815610 - DNA, 18 bp, Homo sapiens
tttgcaaacaaaatgatg

SEQ ID NO: 5815611 - DNA, 19 bp, Homo sapiens
tttgcaaactttattttca

SEQ ID NO: 5815612 - DNA, 15 bp, Homo sapiens
tttgcaaaggagctc

SEQ ID NO: 5815613 - DNA, 23 bp, Homo sapiens
tttgcaaagtactgtaagaataa

SEQ ID NO: 5815614 - DNA, 14 bp, Homo sapiens
tttgcaaagtgcaa

SEQ ID NO: 5815615 - DNA, 18 bp, Homo sapiens
tttgcaaagtgtattagg

SEQ ID NO: 5815616 - DNA, 23 bp, Homo sapiens
tttgcaaataaaggctctggaag

SEQ ID NO: 5815617 - DNA, 13 bp, Homo sapiens
tttgcaaataact

SEQ ID NO: 5815618 - DNA, 19 bp, Homo sapiens
tttgcaaatatactttact

SEQ ID NO: 5815619 - DNA, 21 bp, Homo sapiens
tttgcaaatctaaagttgctc

SEQ ID NO: 5815620 - DNA, 16 bp, Homo sapiens
tttgcaaattatttat

SEQ ID NO: 5815621 - DNA, 19 bp, Homo sapiens
tttgcaaattatttattac

SEQ ID NO: 5815622 - DNA, 22 bp, Homo sapiens
tttgcaacagcaaattaatgtg

SEQ ID NO: 5815623 - DNA, 22 bp, Homo sapiens
tttgcaacagtaatcagagtta

SEQ ID NO: 5815624 - DNA, 19 bp, Homo sapiens
tttgcaacctctttgctca

SEQ ID NO: 5815625 - DNA, 22 bp, Homo sapiens
tttgcaaccttgtactttacaa

SEQ ID NO: 5815626 - DNA, 20 bp, Homo sapiens
tttgcaactaggtatttcta

SEQ ID NO: 5815627 - DNA, 20 bp, Homo sapiens
tttgcaactcgaactgcttt

SEQ ID NO: 5815628 - DNA, 17 bp, Homo sapiens
tttgcaacttaatactc

SEQ ID NO: 5815629 - DNA, 13 bp, Homo sapiens
tttgcaagaatct

SEQ ID NO: 5815630 - DNA, 14 bp, Homo sapiens
tttgcaaggaagcc

SEQ ID NO: 5815631 - DNA, 21 bp, Homo sapiens
tttgcaagtcatggctgtgcc

SEQ ID NO: 5815632 - DNA, 22 bp, Homo sapiens
tttgcaagtgaaggtttacaat

SEQ ID NO: 5815633 - DNA, 18 bp, Homo sapiens
tttgcaataaaaatgata

SEQ ID NO: 5815634 - DNA, 15 bp, Homo sapiens
tttgcaataacagct

SEQ ID NO: 5815635 - DNA, 13 bp, Homo sapiens
tttgcaataagga

SEQ ID NO: 5815636 - DNA, 15 bp, Homo sapiens
tttgcaataatgcag

SEQ ID NO: 5815637 - DNA, 15 bp, Homo sapiens
tttgcaatagcagtt

SEQ ID NO: 5815638 - DNA, 18 bp, Homo sapiens
tttgcaatagcagttata

SEQ ID NO: 5815639 - DNA, 22 bp, Homo sapiens
tttgcaatgccctaattagggc

SEQ ID NO: 5815640 - DNA, 14 bp, Homo sapiens
tttgcaatgtcaca

SEQ ID NO: 5815641 - DNA, 17 bp, Homo sapiens
tttgcaattgctcttct

SEQ ID NO: 5815642 - DNA, 19 bp, Homo sapiens
tttgcaatttcaggaattt

SEQ ID NO: 5815643 - DNA, 17 bp, Homo sapiens
tttgcacaaaaagatac

SEQ ID NO: 5815644 - DNA, 21 bp, Homo sapiens
tttgcacaaacttgtgagcat

SEQ ID NO: 5815645 - DNA, 15 bp, Homo sapiens
tttgcacaaggaaat

SEQ ID NO: 5815646 - DNA, 16 bp, Homo sapiens
tttgcacaatatttct

SEQ ID NO: 5815647 - DNA, 12 bp, Homo sapiens
tttgcacacttc

SEQ ID NO: 5815648 - DNA, 16 bp, Homo sapiens
tttgcacagagggcgc

SEQ ID NO: 5815649 - DNA, 22 bp, Homo sapiens
tttgcacagagggcgctcctgt

SEQ ID NO: 5815650 - DNA, 12 bp, Homo sapiens
tttgcacatgtg

SEQ ID NO: 5815651 - DNA, 16 bp, Homo sapiens
tttgcacattaaatga

SEQ ID NO: 5815652 - DNA, 13 bp, Homo sapiens
tttgcacattttg

SEQ ID NO: 5815653 - DNA, 16 bp, Homo sapiens
tttgcaccaaagacat

SEQ ID NO: 5815654 - DNA, 15 bp, Homo sapiens
tttgcaccatcatgt

SEQ ID NO: 5815655 - DNA, 17 bp, Homo sapiens
tttgcaccatgtgaagt

SEQ ID NO: 5815656 - DNA, 14 bp, Homo sapiens
tttgcacccctttc

SEQ ID NO: 5815657 - DNA, 16 bp, Homo sapiens
tttgcacctgctctct

SEQ ID NO: 5815658 - DNA, 22 bp, Homo sapiens
tttgcacgaattttaaaacatg

SEQ ID NO: 5815659 - DNA, 15 bp, Homo sapiens
tttgcactcttgttt

SEQ ID NO: 5815660 - DNA, 12 bp, Homo sapiens
tttgcactgagg

SEQ ID NO: 5815661 - DNA, 16 bp, Homo sapiens
tttgcactgagggcca

SEQ ID NO: 5815662 - DNA, 22 bp, Homo sapiens
tttgcactgagggccacactat

SEQ ID NO: 5815663 - DNA, 18 bp, Homo sapiens
tttgcactgctcaattct

SEQ ID NO: 5815664 - DNA, 14 bp, Homo sapiens
tttgcactgcttta

SEQ ID NO: 5815665 - DNA, 12 bp, Homo sapiens
tttgcactgtaa

SEQ ID NO: 5815666 - DNA, 14 bp, Homo sapiens
tttgcactgtctgt

SEQ ID NO: 5815667 - DNA, 13 bp, Homo sapiens
tttgcactgtgtg

SEQ ID NO: 5815668 - DNA, 19 bp, Homo sapiens
tttgcacttatgtacttga

SEQ ID NO: 5815669 - DNA, 23 bp, Homo sapiens
tttgcacttatgtacttgatact

SEQ ID NO: 5815670 - DNA, 17 bp, Homo sapiens
tttgcacttctgtaaac

SEQ ID NO: 5815671 - DNA, 21 bp, Homo sapiens
tttgcacttttgaaataaagt

SEQ ID NO: 5815672 - DNA, 16 bp, Homo sapiens
tttggacgcacacagc

SEQ ID NO: 5815673 - DNA, 17 bp, Homo sapiens
tttggacgcacacagct

SEQ ID NO: 5815674 - DNA, 13 bp, Homo sapiens
tttggactcgaaa

SEQ ID NO: 5815675 - DNA, 18 bp, Homo sapiens
tttggactctctgtggtc

SEQ ID NO: 5815676 - DNA, 20 bp, Homo sapiens
tttggactgagatttcttaa

SEQ ID NO: 5815677 - DNA, 17 bp, Homo sapiens
tttggactgttttcaat

SEQ ID NO: 5815678 - DNA, 15 bp, Homo sapiens
tttggacttatctat

SEQ ID NO: 5815679 - DNA, 18 bp, Homo sapiens
tttggacttctgaagaga

SEQ ID NO: 5815680 - DNA, 17 bp, Homo sapiens
tttggagaaaaattaca

SEQ ID NO: 5815681 - DNA, 21 bp, Homo sapiens
tttggagaaatgtcataaatt

SEQ ID NO: 5815682 - DNA, 19 bp, Homo sapiens
tttggagaacgccagtctc

SEQ ID NO: 5815683 - DNA, 23 bp, Homo sapiens
tttggagaactcatttcaagtta

SEQ ID NO: 5815684 - DNA, 19 bp, Homo sapiens
tttggagaaggtctgtggt

SEQ ID NO: 5815685 - DNA, 19 bp, Homo sapiens
tttggagactctgtggggc

SEQ ID NO: 5815686 - DNA, 23 bp, Homo sapiens
tttggagactggggtggcctcaa

SEQ ID NO: 5815687 - DNA, 15 bp, Homo sapiens
tttggagactttctt

SEQ ID NO: 5815688 - DNA, 19 bp, Homo sapiens
tttggagactttgttcctt

SEQ ID NO: 5815689 - DNA, 22 bp, Homo sapiens
tttggagagtgggctgacatca

SEQ ID NO: 5815690 - DNA, 16 bp, Homo sapiens
tttggagagtttgcct

SEQ ID NO: 5815691 - DNA, 20 bp, Homo sapiens
tttggagcacaaaattcaaa

SEQ ID NO: 5815692 - DNA, 18 bp, Homo sapiens
tttggagcactctgagtt

SEQ ID NO: 5815693 - DNA, 21 bp, Homo sapiens
tttggagcctcccttctgcct

SEQ ID NO: 5815694 - DNA, 22 bp, Homo sapiens
tttggaggaacagctccctagt

SEQ ID NO: 5815695 - DNA, 19 bp, Homo sapiens
tttggaggaatcaccccat

SEQ ID NO: 5815696 - DNA, 17 bp, Homo sapiens
tttggaggtttattacg

SEQ ID NO: 5815697 - DNA, 21 bp, Homo sapiens
tttggagtcagtaggtccaag

SEQ ID NO: 5815698 - DNA, 12 bp, Homo sapiens
tttggagtgtgt

SEQ ID NO: 5815699 - DNA, 22 bp, Homo sapiens
tttggagtgttatgtatttcct

SEQ ID NO: 5815700 - DNA, 20 bp, Homo sapiens
tttggagttaggtcctcact

SEQ ID NO: 5815701 - DNA, 20 bp, Homo sapiens
tttggataataggaattcaa

SEQ ID NO: 5815702 - DNA, 15 bp, Homo sapiens
tttggatacatctgc

SEQ ID NO: 5815703 - DNA, 17 bp, Homo sapiens
tttggatacatctgctg

SEQ ID NO: 5815704 - DNA, 18 bp, Homo sapiens
tttggatacatctgctgt

SEQ ID NO: 5815705 - DNA, 15 bp, Homo sapiens
tttggatagcatgtc

SEQ ID NO: 5815706 - DNA, 21 bp, Homo sapiens
tttggatatctgttagatgct

SEQ ID NO: 5815707 - DNA, 12 bp, Homo sapiens
tttggatgaagg

SEQ ID NO: 5815708 - DNA, 18 bp, Homo sapiens
tttggatgaatgcagtat

SEQ ID NO: 5815709 - DNA, 14 bp, Homo sapiens
tttggatggtttgt

SEQ ID NO: 5815710 - DNA, 13 bp, Homo sapiens
tttggatgtaatt

SEQ ID NO: 5815711 - DNA, 17 bp, Homo sapiens
tttggatgtctgtagca

SEQ ID NO: 5815712 - DNA, 19 bp, Homo sapiens
tttggatgttgtaaataaa

SEQ ID NO: 5815713 - DNA, 19 bp, Homo sapiens
tttggattctaaatacatg

SEQ ID NO: 5815714 - DNA, 20 bp, Homo sapiens
tttggattcttatgtagcag

SEQ ID NO: 5815715 - DNA, 23 bp, Homo sapiens
tttggattctttaaatatatatt

SEQ ID NO: 5815716 - DNA, 20 bp, Homo sapiens
tttggatttaaaagcctgct

SEQ ID NO: 5815717 - DNA, 19 bp, Homo sapiens
tttggatttacgactgaag

SEQ ID NO: 5815718 - DNA, 22 bp, Homo sapiens
tttggatttcctttatactgtg

SEQ ID NO: 5815719 - DNA, 14 bp, Homo sapiens
tttggattttatgg

SEQ ID NO: 5815720 - DNA, 23 bp, Homo sapiens
tttggcaaactctccaccacacg

SEQ ID NO: 5815721 - DNA, 22 bp, Homo sapiens
tttggcaacacctccttgcttt

SEQ ID NO: 5815722 - DNA, 14 bp, Homo sapiens
tttggcaacatctt

SEQ ID NO: 5815723 - DNA, 17 bp, Homo sapiens
tttggcaacctttgtgt

SEQ ID NO: 5815724 - DNA, 23 bp, Homo sapiens
tttggcaagagcgttactgtaga

SEQ ID NO: 5815725 - DNA, 22 bp, Homo sapiens
tttggcaatatcatattctaaa

SEQ ID NO: 5815726 - DNA, 17 bp, Homo sapiens
tttggcaatgccatcat

SEQ ID NO: 5815727 - DNA, 14 bp, Homo sapiens
tttggcaattcaca

SEQ ID NO: 5815728 - DNA, 19 bp, Homo sapiens
tttggcaatttttttatac

SEQ ID NO: 5815729 - DNA, 15 bp, Homo sapiens
tttggcactctctgc

SEQ ID NO: 5815730 - DNA, 20 bp, Homo sapiens
tttggcagagcttcttccag

SEQ ID NO: 5815731 - DNA, 12 bp, Homo sapiens
tttggcagagtc

SEQ ID NO: 5815732 - DNA, 12 bp, Homo sapiens
tttggcagccag

SEQ ID NO: 5815733 - DNA, 17 bp, Homo sapiens
tttggcaggaagatgta

SEQ ID NO: 5815734 - DNA, 23 bp, Homo sapiens
tttggcatccctgggccttgggc

SEQ ID NO: 5815735 - DNA, 20 bp, Homo sapiens
tttggcatctgtttaaagta

SEQ ID NO: 5815736 - DNA, 17 bp, Homo sapiens
tttggcatgggacagac

SEQ ID NO: 5815737 - DNA, 16 bp, Homo sapiens
tttggcatgtttaatt

SEQ ID NO: 5815738 - DNA, 14 bp, Homo sapiens
tttggcattgatct

SEQ ID NO: 5815739 - DNA, 10 bp, Homo sapiens
tttggccaga

SEQ ID NO: 5815740 - DNA, 19 bp, Homo sapiens
tttggccagggaggcgcag

SEQ ID NO: 5815741 - DNA, 21 bp, Homo sapiens
tttggccagtgacatttcaat

SEQ ID NO: 5815742 - DNA, 20 bp, Homo sapiens
tttggcccaagactgggctg

SEQ ID NO: 5815743 - DNA, 12 bp, Homo sapiens
tttggcccagag

SEQ ID NO: 5815744 - DNA, 13 bp, Homo sapiens
tttggcccagaga

SEQ ID NO: 5815745 - DNA, 12 bp, Homo sapiens
tttggcccaggg

SEQ ID NO: 5815746 - DNA, 12 bp, Homo sapiens
tttggcccccga

SEQ ID NO: 5815747 - DNA, 21 bp, Homo sapiens
tttggcccccgagctgggggc

SEQ ID NO: 5815748 - DNA, 11 bp, Homo sapiens
tttggccctgg

SEQ ID NO: 5815749 - DNA, 16 bp, Homo sapiens
tttggccctggagcca

SEQ ID NO: 5815750 - DNA, 12 bp, Homo sapiens
tttggcctgttt

SEQ ID NO: 5815751 - DNA, 16 bp, Homo sapiens
tttggccttaagaact

SEQ ID NO: 5815752 - DNA, 19 bp, Homo sapiens
tttggcgccccatgggccc

SEQ ID NO: 5815753 - DNA, 17 bp, Homo sapiens
tttggcgctattacaaa

SEQ ID NO: 5815754 - DNA, 19 bp, Homo sapiens
tttggcgggccaaggactg

SEQ ID NO: 5815755 - DNA, 16 bp, Homo sapiens
tttggctagtccttgt

SEQ ID NO: 5815756 - DNA, 18 bp, Homo sapiens
tttggctcactgcagcct

SEQ ID NO: 5815757 - DNA, 19 bp, Homo sapiens
tttggctctattggatttg

SEQ ID NO: 5815758 - DNA, 19 bp, Homo sapiens
tttggctctgaagaagcaa

SEQ ID NO: 5815759 - DNA, 14 bp, Homo sapiens
tttggctctttcag

SEQ ID NO: 5815760 - DNA, 20 bp, Homo sapiens
tttggctgacttcatctggg

SEQ ID NO: 5815761 - DNA, 22 bp, Homo sapiens
tttggctgagacctgggatttg

SEQ ID NO: 5815762 - DNA, 21 bp, Homo sapiens
tttggctgtgatgtcacagtt

SEQ ID NO: 5815763 - DNA, 21 bp, Homo sapiens
tttggctgttttccctctgct

SEQ ID NO: 5815764 - DNA, 22 bp, Homo sapiens
tttggcttaaagcatcctcctc

SEQ ID NO: 5815765 - DNA, 17 bp, Homo sapiens
tttggcttcagaattgt

SEQ ID NO: 5815766 - DNA, 16 bp, Homo sapiens
tttggcttcctctgct

SEQ ID NO: 5815767 - DNA, 16 bp, Homo sapiens
tttggcttctcctgtg

SEQ ID NO: 5815768 - DNA, 13 bp, Homo sapiens
tttggctttctcc

SEQ ID NO: 5815769 - DNA, 17 bp, Homo sapiens
tttggctttctccctgt

SEQ ID NO: 5815770 - DNA, 22 bp, Homo sapiens
tttggcttttcttatttaaaat

SEQ ID NO: 5815771 - DNA, 22 bp, Homo sapiens
tttgggaaaaaaacatacacaa

SEQ ID NO: 5815772 - DNA, 16 bp, Homo sapiens
tttgggaaaaattatt

SEQ ID NO: 5815773 - DNA, 16 bp, Homo sapiens
tttgggaaacttgtca

SEQ ID NO: 5815774 - DNA, 19 bp, Homo sapiens
tttgggaaagatggataaa

SEQ ID NO: 5815775 - DNA, 23 bp, Homo sapiens
tttgggaaagatggataaactga

SEQ ID NO: 5815776 - DNA, 11 bp, Homo sapiens
tttgggaaagc

SEQ ID NO: 5815777 - DNA, 23 bp, Homo sapiens
tttgggaaagcccagactttagt

SEQ ID NO: 5815778 - DNA, 21 bp, Homo sapiens
tttgggaagaatccagtatta

SEQ ID NO: 5815779 - DNA, 20 bp, Homo sapiens
tttgggaagcaacaaagagc

SEQ ID NO: 5815780 - DNA, 20 bp, Homo sapiens
tttgggaagtgaagactgga

SEQ ID NO: 5815781 - DNA, 16 bp, Homo sapiens
tttgggaatatttgaa

SEQ ID NO: 5815782 - DNA, 17 bp, Homo sapiens
tttgggaatatttgaat

SEQ ID NO: 5815783 - DNA, 15 bp, Homo sapiens
tttgggaccctgctt

SEQ ID NO: 5815784 - DNA, 14 bp, Homo sapiens
tttgggacttctac

SEQ ID NO: 5815785 - DNA, 23 bp, Homo sapiens
tttgggagagacttgttttggat

SEQ ID NO: 5815786 - DNA, 18 bp, Homo sapiens
tttgggagagtggtgagt

SEQ ID NO: 5815787 - DNA, 14 bp, Homo sapiens
tttgggagccagga

SEQ ID NO: 5815788 - DNA, 14 bp, Homo sapiens
tttgggagctctgc

SEQ ID NO: 5815789 - DNA, 23 bp, Homo sapiens
tttgggagctgaaccaaagcctc

SEQ ID NO: 5815790 - DNA, 15 bp, Homo sapiens
tttgggaggagccat

SEQ ID NO: 5815791 - DNA, 16 bp, Homo sapiens
tttgggagggaaaagg

SEQ ID NO: 5815792 - DNA, 19 bp, Homo sapiens
tttgggatagagaatgttc

SEQ ID NO: 5815793 - DNA, 12 bp, Homo sapiens
tttgggatgtct

SEQ ID NO: 5815794 - DNA, 18 bp, Homo sapiens
tttgggatttaatttcca

SEQ ID NO: 5815795 - DNA, 20 bp, Homo sapiens
tttgggcagaagggagaagg

SEQ ID NO: 5815796 - DNA, 12 bp, Homo sapiens
tttgggcagagc

SEQ ID NO: 5815797 - DNA, 15 bp, Homo sapiens
tttgggcagatttgc

SEQ ID NO: 5815798 - DNA, 16 bp, Homo sapiens
tttgggcagatttgca

SEQ ID NO: 5815799 - DNA, 18 bp, Homo sapiens
tttgggcagatttgcaac

SEQ ID NO: 5815800 - DNA, 21 bp, Homo sapiens
tttgggcagcaatttaaatgt

SEQ ID NO: 5815801 - DNA, 23 bp, Homo sapiens
tttgggccaatttactggccact

SEQ ID NO: 5815802 - DNA, 17 bp, Homo sapiens
tttgggccactgccagc

SEQ ID NO: 5815803 - DNA, 20 bp, Homo sapiens
tttgggccagttatagctta

SEQ ID NO: 5815804 - DNA, 15 bp, Homo sapiens
tttgggcccagggac

SEQ ID NO: 5815805 - DNA, 17 bp, Homo sapiens
tttgggcccctcagagc

SEQ ID NO: 5815806 - DNA, 12 bp, Homo sapiens
tttgggccctgc

SEQ ID NO: 5815807 - DNA, 23 bp, Homo sapiens
tttgggccgaatcccccagggaa

SEQ ID NO: 5815808 - DNA, 21 bp, Homo sapiens
tttgggcctccatgccccagc

SEQ ID NO: 5815809 - DNA, 22 bp, Homo sapiens
tttgggcctccatgccccagct

SEQ ID NO: 5815810 - DNA, 14 bp, Homo sapiens
tttgggcctctgct

SEQ ID NO: 5815811 - DNA, 16 bp, Homo sapiens
tttgggctaacattta

SEQ ID NO: 5815812 - DNA, 16 bp, Homo sapiens
tttgggcttcagctgc

SEQ ID NO: 5815813 - DNA, 20 bp, Homo sapiens
tttgggcttcagctgccagt

SEQ ID NO: 5815814 - DNA, 23 bp, Homo sapiens
tttgggcttgttgtttgtaacaa

SEQ ID NO: 5815815 - DNA, 16 bp, Homo sapiens
tttggggaaaaaagca

SEQ ID NO: 5815816 - DNA, 17 bp, Homo sapiens
tttggggaaacctagag

SEQ ID NO: 5815817 - DNA, 18 bp, Homo sapiens
tttggggaagttcaagtg

SEQ ID NO: 5815818 - DNA, 23 bp, Homo sapiens
tttggggacagattcagtcttgc

SEQ ID NO: 5815819 - DNA, 20 bp, Homo sapiens
tttggggagcagagacacta

SEQ ID NO: 5815820 - DNA, 23 bp, Homo sapiens
tttggggaggagttgtctgtcct

SEQ ID NO: 5815821 - DNA, 16 bp, Homo sapiens
tttggggatatgctta

SEQ ID NO: 5815822 - DNA, 14 bp, Homo sapiens
tttggggatatttt

SEQ ID NO: 5815823 - DNA, 22 bp, Homo sapiens
tttggggccgattgggagaaag

SEQ ID NO: 5815824 - DNA, 14 bp, Homo sapiens
tttggggcgaggca

SEQ ID NO: 5815825 - DNA, 18 bp, Homo sapiens
tttggggcttatcagaac

SEQ ID NO: 5815826 - DNA, 15 bp, Homo sapiens
tttggggcttgatga

SEQ ID NO: 5815827 - DNA, 19 bp, Homo sapiens
tttgggggacgcccagccc

SEQ ID NO: 5815828 - DNA, 20 bp, Homo sapiens
tttggggggcagagaataaa

SEQ ID NO: 5815829 - DNA, 20 bp, Homo sapiens
tttggggggttttcttgcct

SEQ ID NO: 5815830 - DNA, 18 bp, Homo sapiens
tttgggggtaaagtttgc

SEQ ID NO: 5815831 - DNA, 22 bp, Homo sapiens
tttgggggttggatgggaagat

SEQ ID NO: 5815832 - DNA, 21 bp, Homo sapiens
tttggggtacccactgctctg

SEQ ID NO: 5815833 - DNA, 18 bp, Homo sapiens
tttggggtagaccttgag

SEQ ID NO: 5815834 - DNA, 23 bp, Homo sapiens
tttggggtgcctaggttggtttc

SEQ ID NO: 5815835 - DNA, 17 bp, Homo sapiens
tttggggttgggacagg

SEQ ID NO: 5815836 - DNA, 20 bp, Homo sapiens
tttgggtaacctgaagtttt

SEQ ID NO: 5815837 - DNA, 13 bp, Homo sapiens
tttgggtatgtta

SEQ ID NO: 5815838 - DNA, 18 bp, Homo sapiens
tttgggtcatttttaact

SEQ ID NO: 5815839 - DNA, 18 bp, Homo sapiens
tttgggtcttttatacat

SEQ ID NO: 5815840 - DNA, 17 bp, Homo sapiens
tttgggtgaccagccac

SEQ ID NO: 5815841 - DNA, 18 bp, Homo sapiens
tttgggtgccattaaata

SEQ ID NO: 5815842 - DNA, 20 bp, Homo sapiens
tttgggtggctcactactga

SEQ ID NO: 5815843 - DNA, 15 bp, Homo sapiens
tttgggttctgcctg

SEQ ID NO: 5815844 - DNA, 16 bp, Homo sapiens
tttgggttctgcctgc

SEQ ID NO: 5815845 - DNA, 17 bp, Homo sapiens
tttgggtttggccaggg

SEQ ID NO: 5815846 - DNA, 17 bp, Homo sapiens
tttgggtttttaactca

SEQ ID NO: 5815847 - DNA, 23 bp, Homo sapiens
tttgggtttttaactcatcttta

SEQ ID NO: 5815848 - DNA, 16 bp, Homo sapiens
tttgggtttttttcct

SEQ ID NO: 5815849 - DNA, 18 bp, Homo sapiens
tttgggtttttttccttt

SEQ ID NO: 5815850 - DNA, 14 bp, Homo sapiens
tttggtaaaaatgc

SEQ ID NO: 5815851 - DNA, 15 bp, Homo sapiens
tttggtaaaacagtt

SEQ ID NO: 5815852 - DNA, 19 bp, Homo sapiens
tttggtaaacggtttttat

SEQ ID NO: 5815853 - DNA, 13 bp, Homo sapiens
tttggtaaatgtt

SEQ ID NO: 5815854 - DNA, 15 bp, Homo sapiens
tttggtaaatttttg

SEQ ID NO: 5815855 - DNA, 15 bp, Homo sapiens
tttggtaagggaagt

SEQ ID NO: 5815856 - DNA, 23 bp, Homo sapiens
tttggtaataacaaacgtgtttt

SEQ ID NO: 5815857 - DNA, 15 bp, Homo sapiens
tttggtaatgtgtca

SEQ ID NO: 5815858 - DNA, 14 bp, Homo sapiens
tttggtacaagttt

SEQ ID NO: 5815859 - DNA, 19 bp, Homo sapiens
tttggtacagttcataatt

SEQ ID NO: 5815860 - DNA, 14 bp, Homo sapiens
tttggtacccccaa

SEQ ID NO: 5815861 - DNA, 18 bp, Homo sapiens
tttggtagatcttcaatt

SEQ ID NO: 5815862 - DNA, 14 bp, Homo sapiens
tttggtagatgaca

SEQ ID NO: 5815863 - DNA, 21 bp, Homo sapiens
tttggtagctgggaaagcata

SEQ ID NO: 5815864 - DNA, 17 bp, Homo sapiens
tttggtaggtaaatcta

SEQ ID NO: 5815865 - DNA, 13 bp, Homo sapiens
tttggtatattac

SEQ ID NO: 5815866 - DNA, 19 bp, Homo sapiens
tttggtatctgttctttaa

SEQ ID NO: 5815867 - DNA, 15 bp, Homo sapiens
tttggtattctgctt

SEQ ID NO: 5815868 - DNA, 15 bp, Homo sapiens
tttggtattgtaaaa

SEQ ID NO: 5815869 - DNA, 12 bp, Homo sapiens
tttggtatttgc

SEQ ID NO: 5815870 - DNA, 22 bp, Homo sapiens
tttggtcaccttcctctgcctt

SEQ ID NO: 5815871 - DNA, 13 bp, Homo sapiens
tttggtcatgccc

SEQ ID NO: 5815872 - DNA, 23 bp, Homo sapiens
tttggtcatttggcagcccctgt

SEQ ID NO: 5815873 - DNA, 13 bp, Homo sapiens
tttggtccaaaaa

SEQ ID NO: 5815874 - DNA, 14 bp, Homo sapiens
tttggtccaaaaaa

SEQ ID NO: 5815875 - DNA, 12 bp, Homo sapiens
tttggtcccctc

SEQ ID NO: 5815876 - DNA, 19 bp, Homo sapiens
tttggtcccctccctcgtg

SEQ ID NO: 5815877 - DNA, 13 bp, Homo sapiens
tttggtccctggg

SEQ ID NO: 5815878 - DNA, 21 bp, Homo sapiens
tttggtccttcaaaggcttgt

SEQ ID NO: 5815879 - DNA, 18 bp, Homo sapiens
tttggtcgaggagtaaca

SEQ ID NO: 5815880 - DNA, 18 bp, Homo sapiens
tttggtcgagtctttgtg

SEQ ID NO: 5815881 - DNA, 19 bp, Homo sapiens
tttggtcgagtctttgtgt

SEQ ID NO: 5815882 - DNA, 17 bp, Homo sapiens
tttggtctacactgtgc

SEQ ID NO: 5815883 - DNA, 15 bp, Homo sapiens
tttggtctccctggg

SEQ ID NO: 5815884 - DNA, 20 bp, Homo sapiens
tttggtctccttgggccctt

SEQ ID NO: 5815885 - DNA, 16 bp, Homo sapiens
tttggtctgccagaat

SEQ ID NO: 5815886 - DNA, 21 bp, Homo sapiens
tttggtctggactgacagcat

SEQ ID NO: 5815887 - DNA, 22 bp, Homo sapiens
tttggtctggactgacagcatg

SEQ ID NO: 5815888 - DNA, 13 bp, Homo sapiens
tttggtctgtgtt

SEQ ID NO: 5815889 - DNA, 19 bp, Homo sapiens
tttggtcttagctttacat

SEQ ID NO: 5815890 - DNA, 22 bp, Homo sapiens
tttggtcttcagcctccctcag

SEQ ID NO: 5815891 - DNA, 23 bp, Homo sapiens
tttggtgaacattgcaatagaaa

SEQ ID NO: 5815892 - DNA, 13 bp, Homo sapiens
tttggtgaataac

SEQ ID NO: 5815893 - DNA, 14 bp, Homo sapiens
tttggtgagaacct

SEQ ID NO: 5815894 - DNA, 21 bp, Homo sapiens
tttggtgagagtcaaagctga

SEQ ID NO: 5815895 - DNA, 14 bp, Homo sapiens
tttggtgataagta

SEQ ID NO: 5815896 - DNA, 14 bp, Homo sapiens
tttggtgattcaaa

SEQ ID NO: 5815897 - DNA, 16 bp, Homo sapiens
tttggtgcatagaact

SEQ ID NO: 5815898 - DNA, 15 bp, Homo sapiens
tttggtgcctgcctc

SEQ ID NO: 5815899 - DNA, 12 bp, Homo sapiens
tttggtgccttt

SEQ ID NO: 5815900 - DNA, 15 bp, Homo sapiens
tttggtggagataaa

SEQ ID NO: 5815901 - DNA, 16 bp, Homo sapiens
tttggtggatgtaaat

SEQ ID NO: 5815902 - DNA, 17 bp, Homo sapiens
tttggtggatgtaaata

SEQ ID NO: 5815903 - DNA, 13 bp, Homo sapiens
tttggtggctcta

SEQ ID NO: 5815904 - DNA, 20 bp, Homo sapiens
tttggtgggggtagagctga

SEQ ID NO: 5815905 - DNA, 19 bp, Homo sapiens
tttggtggggtggcacctg

SEQ ID NO: 5815906 - DNA, 12 bp, Homo sapiens
tttggtgtatgg

SEQ ID NO: 5815907 - DNA, 13 bp, Homo sapiens
tttggtgtatggt

SEQ ID NO: 5815908 - DNA, 16 bp, Homo sapiens
tttggtgtctgatgtg

SEQ ID NO: 5815909 - DNA, 13 bp, Homo sapiens
tttggtgtgttcc

SEQ ID NO: 5815910 - DNA, 16 bp, Homo sapiens
tttggtgttcctggaa

SEQ ID NO: 5815911 - DNA, 12 bp, Homo sapiens
tttggtgttttg

SEQ ID NO: 5815912 - DNA, 19 bp, Homo sapiens
tttggttaagttggcttct

SEQ ID NO: 5815913 - DNA, 22 bp, Homo sapiens
tttggttaagttggcttctgtt

SEQ ID NO: 5815914 - DNA, 12 bp, Homo sapiens
tttggttaatat

SEQ ID NO: 5815915 - DNA, 14 bp, Homo sapiens
tttggttaatctct

SEQ ID NO: 5815916 - DNA, 15 bp, Homo sapiens
tttggttaatctctt

SEQ ID NO: 5815917 - DNA, 13 bp, Homo sapiens
tttggttacatgg

SEQ ID NO: 5815918 - DNA, 14 bp, Homo sapiens
tttggttatgaaac

SEQ ID NO: 5815919 - DNA, 20 bp, Homo sapiens
tttggttatgaatactttgc

SEQ ID NO: 5815920 - DNA, 13 bp, Homo sapiens
tttggttatttta

SEQ ID NO: 5815921 - DNA, 13 bp, Homo sapiens
tttggttcaattt

SEQ ID NO: 5815922 - DNA, 23 bp, Homo sapiens
tttggttcctaaagaaaaagata

SEQ ID NO: 5815923 - DNA, 15 bp, Homo sapiens
tttggttcctcatgg

SEQ ID NO: 5815924 - DNA, 13 bp, Homo sapiens
tttggttcctctc

SEQ ID NO: 5815925 - DNA, 16 bp, Homo sapiens
tttggttcctctctgg

SEQ ID NO: 5815926 - DNA, 13 bp, Homo sapiens
tttggttctaagg

SEQ ID NO: 5815927 - DNA, 14 bp, Homo sapiens
tttggttgaataaa

SEQ ID NO: 5815928 - DNA, 12 bp, Homo sapiens
tttggtttacat

SEQ ID NO: 5815929 - DNA, 18 bp, Homo sapiens
tttggtttatattcttat

SEQ ID NO: 5815930 - DNA, 14 bp, Homo sapiens
tttggtttattttt

SEQ ID NO: 5815931 - DNA, 19 bp, Homo sapiens
tttggtttatttttgtaat

SEQ ID NO: 5815932 - DNA, 19 bp, Homo sapiens
tttggtttcccaagagcta

SEQ ID NO: 5815933 - DNA, 21 bp, Homo sapiens
tttggtttcccaagagctacg

SEQ ID NO: 5815934 - DNA, 14 bp, Homo sapiens
tttggtttcttcat

SEQ ID NO: 5815935 - DNA, 9 bp, Homo sapiens
tttggtttt

SEQ ID NO: 5815936 - DNA, 18 bp, Homo sapiens
tttggttttaaaatactg

SEQ ID NO: 5815937 - DNA, 22 bp, Homo sapiens
tttggttttaaaatactgtaga

SEQ ID NO: 5815938 - DNA, 23 bp, Homo sapiens
tttggttttaaaatactgtagat

SEQ ID NO: 5815939 - DNA, 18 bp, Homo sapiens
tttggttttaaaccttta

SEQ ID NO: 5815940 - DNA, 16 bp, Homo sapiens
tttggttttacacagg

SEQ ID NO: 5815941 - DNA, 21 bp, Homo sapiens
tttggttttccttaactaaat

SEQ ID NO: 5815942 - DNA, 15 bp, Homo sapiens
tttggttttggaaaa

SEQ ID NO: 5815943 - DNA, 16 bp, Homo sapiens
tttggttttgttcccc

SEQ ID NO: 5815944 - DNA, 19 bp, Homo sapiens
tttggttttgttcccctcc

SEQ ID NO: 5815945 - DNA, 12 bp, Homo sapiens
tttggtttttga

SEQ ID NO: 5815946 - DNA, 19 bp, Homo sapiens
tttggtttttgttgctttt

SEQ ID NO: 5815947 - DNA, 16 bp, Homo sapiens
tttgtaaaaactgaag

SEQ ID NO: 5815948 - DNA, 17 bp, Homo sapiens
tttgtaaaaactgaaga

SEQ ID NO: 5815949 - DNA, 23 bp, Homo sapiens
tttgtaaaaactgaagaattttg

SEQ ID NO: 5815950 - DNA, 22 bp, Homo sapiens
tttgtaaaaatcttttgaagca

SEQ ID NO: 5815951 - DNA, 14 bp, Homo sapiens
tttgtaaaaatgta

SEQ ID NO: 5815952 - DNA, 13 bp, Homo sapiens
tttgtaaaactgt

SEQ ID NO: 5815953 - DNA, 15 bp, Homo sapiens
tttgtaaaacttctg

SEQ ID NO: 5815954 - DNA, 23 bp, Homo sapiens
tttgtaaaagaacagtaaacatt

SEQ ID NO: 5815955 - DNA, 15 bp, Homo sapiens
tttgtaaaagacatt

SEQ ID NO: 5815956 - DNA, 14 bp, Homo sapiens
tttgtaaaagagct

SEQ ID NO: 5815957 - DNA, 21 bp, Homo sapiens
tttgtaaaagagctgttcttt

SEQ ID NO: 5815958 - DNA, 22 bp, Homo sapiens
tttgtaaaagagctgttctttt

SEQ ID NO: 5815959 - DNA, 17 bp, Homo sapiens
tttgtaaaataaaacca

SEQ ID NO: 5815960 - DNA, 20 bp, Homo sapiens
tttgtaaaatattatgtttg

SEQ ID NO: 5815961 - DNA, 19 bp, Homo sapiens
tttgtaaaatcttgcagtt

SEQ ID NO: 5815962 - DNA, 14 bp, Homo sapiens
tttgtaaaatgaca

SEQ ID NO: 5815963 - DNA, 13 bp, Homo sapiens
tttgtaaaatgta

SEQ ID NO: 5815964 - DNA, 15 bp, Homo sapiens
tttgtaaaatgtatt

SEQ ID NO: 5815965 - DNA, 18 bp, Homo sapiens
tttgtaaactacaaagta

SEQ ID NO: 5815966 - DNA, 16 bp, Homo sapiens
tttgtaaactggaatt

SEQ ID NO: 5815967 - DNA, 17 bp, Homo sapiens
tttgtaaactgtatcaa

SEQ ID NO: 5815968 - DNA, 15 bp, Homo sapiens
tttgtaaacttctga

SEQ ID NO: 5815969 - DNA, 15 bp, Homo sapiens
tttgtaaactttgaa

SEQ ID NO: 5815970 - DNA, 17 bp, Homo sapiens
tttgtaaactttgcttc

SEQ ID NO: 5815971 - DNA, 15 bp, Homo sapiens
tttgtaaagaaaaat

SEQ ID NO: 5815972 - DNA, 17 bp, Homo sapiens
tttgtaaagaaaaatat

SEQ ID NO: 5815973 - DNA, 21 bp, Homo sapiens
tttgtaaagaaatttactata

SEQ ID NO: 5815974 - DNA, 23 bp, Homo sapiens
tttgtaaagaaatttactatata

SEQ ID NO: 5815975 - DNA, 13 bp, Homo sapiens
tttgtaaaggtca

SEQ ID NO: 5815976 - DNA, 21 bp, Homo sapiens
tttgtaaaggtgaaaaaagct

SEQ ID NO: 5815977 - DNA, 15 bp, Homo sapiens
tttgtaaagtaaaat

SEQ ID NO: 5815978 - DNA, 17 bp, Homo sapiens
tttgtaaagtaaaatat

SEQ ID NO: 5815979 - DNA, 22 bp, Homo sapiens
tttgtaaagtgtggtcccaaca

SEQ ID NO: 5815980 - DNA, 19 bp, Homo sapiens
tttgtaaagttgcctttat

SEQ ID NO: 5815981 - DNA, 22 bp, Homo sapiens
tttgtaaataagagatttggag

SEQ ID NO: 5815982 - DNA, 21 bp, Homo sapiens
tttgtaaatagtttaacactt

SEQ ID NO: 5815983 - DNA, 22 bp, Homo sapiens
tttgtaaatatcttttcttctc

SEQ ID NO: 5815984 - DNA, 14 bp, Homo sapiens
tttgtaaatattct

SEQ ID NO: 5815985 - DNA, 15 bp, Homo sapiens
tttgtaaatctgcca

SEQ ID NO: 5815986 - DNA, 17 bp, Homo sapiens
tttgtaaatctgccaca

SEQ ID NO: 5815987 - DNA, 13 bp, Homo sapiens
tttgtaaatctgt

SEQ ID NO: 5815988 - DNA, 14 bp, Homo sapiens
tttgtaaatctgta

SEQ ID NO: 5815989 - DNA, 19 bp, Homo sapiens
tttgtaaatctgtactttt

SEQ ID NO: 5815990 - DNA, 20 bp, Homo sapiens
tttgtaaatctgtacttttt

SEQ ID NO: 5815991 - DNA, 23 bp, Homo sapiens
tttgtaaatctgtacttttttca

SEQ ID NO: 5815992 - DNA, 21 bp, Homo sapiens
tttgtaaatgaaacttaagaa

SEQ ID NO: 5815993 - DNA, 13 bp, Homo sapiens
tttgtaaatgact

SEQ ID NO: 5815994 - DNA, 23 bp, Homo sapiens
tttgtaaatgactttcataataa

SEQ ID NO: 5815995 - DNA, 13 bp, Homo sapiens
tttgtaaatgatt

SEQ ID NO: 5815996 - DNA, 13 bp, Homo sapiens
tttgtaaatgcat

SEQ ID NO: 5815997 - DNA, 19 bp, Homo sapiens
tttgtaaatgcctcttaaa

SEQ ID NO: 5815998 - DNA, 21 bp, Homo sapiens
tttgtaaatgcctcttaaatt

SEQ ID NO: 5815999 - DNA, 16 bp, Homo sapiens
tttgtaaatgtactgg

SEQ ID NO: 5816000 - DNA, 20 bp, Homo sapiens
tttgtaaatgtactggtaat

SEQ ID NO: 5816001 - DNA, 22 bp, Homo sapiens
tttgtaaattaaacataaaaca

SEQ ID NO: 5816002 - DNA, 15 bp, Homo sapiens
tttgtaaattaactt

SEQ ID NO: 5816003 - DNA, 17 bp, Homo sapiens
tttgtaaattaactttt

SEQ ID NO: 5816004 - DNA, 18 bp, Homo sapiens
tttgtaaattatttgcta

SEQ ID NO: 5816005 - DNA, 19 bp, Homo sapiens
tttgtaaattctgatttct

SEQ ID NO: 5816006 - DNA, 20 bp, Homo sapiens
tttgtaacccagattttgct

SEQ ID NO: 5816007 - DNA, 10 bp, Homo sapiens
tttgtaactc

SEQ ID NO: 5816008 - DNA, 12 bp, Homo sapiens
tttgtaactctt

SEQ ID NO: 5816009 - DNA, 13 bp, Homo sapiens
tttgtaactcttt

SEQ ID NO: 5816010 - DNA, 19 bp, Homo sapiens
tttgtaactgcctaccagt

SEQ ID NO: 5816011 - DNA, 14 bp, Homo sapiens
tttgtaactgtaaa

SEQ ID NO: 5816012 - DNA, 23 bp, Homo sapiens
tttgtaactgtttagatgaatgt

SEQ ID NO: 5816013 - DNA, 10 bp, Homo sapiens
tttgtaactt

SEQ ID NO: 5816014 - DNA, 20 bp, Homo sapiens
tttgtaacttgggctgtaaa

SEQ ID NO: 5816015 - DNA, 16 bp, Homo sapiens
tttgtaactttgcatg

SEQ ID NO: 5816016 - DNA, 19 bp, Homo sapiens
tttgtaagaactaaagaag

SEQ ID NO: 5816017 - DNA, 20 bp, Homo sapiens
tttgtaagaaggcaatatta

SEQ ID NO: 5816018 - DNA, 16 bp, Homo sapiens
tttgtaagagtgtaga

SEQ ID NO: 5816019 - DNA, 21 bp, Homo sapiens
tttgtaagagtgtagaagcat

SEQ ID NO: 5816020 - DNA, 19 bp, Homo sapiens
tttgtaagatatttgcagt

SEQ ID NO: 5816021 - DNA, 14 bp, Homo sapiens
tttgtaagatgctg

SEQ ID NO: 5816022 - DNA, 21 bp, Homo sapiens
tttgtaagcaacttgcttcta

SEQ ID NO: 5816023 - DNA, 19 bp, Homo sapiens
tttgtaagcaattctaagt

SEQ ID NO: 5816024 - DNA, 14 bp, Homo sapiens
tttgtaaggcagcc

SEQ ID NO: 5816025 - DNA, 18 bp, Homo sapiens
tttgtaaggtactgaata

SEQ ID NO: 5816026 - DNA, 22 bp, Homo sapiens
tttgtaaggtcatgctggtggg

SEQ ID NO: 5816027 - DNA, 18 bp, Homo sapiens
tttgtaagtataagaaat

SEQ ID NO: 5816028 - DNA, 14 bp, Homo sapiens
tttgtggactttat

SEQ ID NO: 5816029 - DNA, 16 bp, Homo sapiens
tttgtggaggtgagaa

SEQ ID NO: 5816030 - DNA, 11 bp, Homo sapiens
tttgtggccaa

SEQ ID NO: 5816031 - DNA, 20 bp, Homo sapiens
tttgtggccaaggagctgct

SEQ ID NO: 5816032 - DNA, 12 bp, Homo sapiens
tttgtggcctca

SEQ ID NO: 5816033 - DNA, 14 bp, Homo sapiens
tttgtggcctcaga

SEQ ID NO: 5816034 - DNA, 14 bp, Homo sapiens
tttgtggccttccc

SEQ ID NO: 5816035 - DNA, 22 bp, Homo sapiens
tttgtggctgttgagatgtgct

SEQ ID NO: 5816036 - DNA, 12 bp, Homo sapiens
tttgtgggactg

SEQ ID NO: 5816037 - DNA, 21 bp, Homo sapiens
tttgtgggctggttgctgtag

SEQ ID NO: 5816038 - DNA, 11 bp, Homo sapiens
tttgtggggag

SEQ ID NO: 5816039 - DNA, 20 bp, Homo sapiens
tttgtgggtttctctgtgct

SEQ ID NO: 5816040 - DNA, 19 bp, Homo sapiens
tttgtggtaaaaagattat

SEQ ID NO: 5816041 - DNA, 17 bp, Homo sapiens
tttgtggtaatctacac

SEQ ID NO: 5816042 - DNA, 19 bp, Homo sapiens
tttgtggtaatctacacca

SEQ ID NO: 5816043 - DNA, 16 bp, Homo sapiens
tttgtggtataaaaag

SEQ ID NO: 5816044 - DNA, 14 bp, Homo sapiens
tttgtggtctaaag

SEQ ID NO: 5816045 - DNA, 19 bp, Homo sapiens
tttgtggttgtagaaggag

SEQ ID NO: 5816046 - DNA, 15 bp, Homo sapiens
tttgtggtttggaat

SEQ ID NO: 5816047 - DNA, 16 bp, Homo sapiens
tttgtggttttgggaa

SEQ ID NO: 5816048 - DNA, 11 bp, Homo sapiens
tttgtgtaaag

SEQ ID NO: 5816049 - DNA, 18 bp, Homo sapiens
tttgtgtaaatttctcaa

SEQ ID NO: 5816050 - DNA, 14 bp, Homo sapiens
tttgtgtaacatat

SEQ ID NO: 5816051 - DNA, 16 bp, Homo sapiens
tttgtgtaataaagtg

SEQ ID NO: 5816052 - DNA, 22 bp, Homo sapiens
tttgtgtaataaagtgttttca

SEQ ID NO: 5816053 - DNA, 19 bp, Homo sapiens
tttgtgtaatagaaaactg

SEQ ID NO: 5816054 - DNA, 16 bp, Homo sapiens
tttgtgtaatgaaaat

SEQ ID NO: 5816055 - DNA, 18 bp, Homo sapiens
tttgtgtacagtatgtgt

SEQ ID NO: 5816056 - DNA, 21 bp, Homo sapiens
tttgtgtacagtatgtgtcta

SEQ ID NO: 5816057 - DNA, 13 bp, Homo sapiens
tttgtgtactttt

SEQ ID NO: 5816058 - DNA, 20 bp, Homo sapiens
tttgtgtagaagtccacaga

SEQ ID NO: 5816059 - DNA, 12 bp, Homo sapiens
tttgtgtagtat

SEQ ID NO: 5816060 - DNA, 14 bp, Homo sapiens
tttgtgtatgtact

SEQ ID NO: 5816061 - DNA, 14 bp, Homo sapiens
tttgtgtattaaat

SEQ ID NO: 5816062 - DNA, 15 bp, Homo sapiens
tttgtgtattctgtg

SEQ ID NO: 5816063 - DNA, 20 bp, Homo sapiens
tttgtgtatttaacagggag

SEQ ID NO: 5816064 - DNA, 19 bp, Homo sapiens
tttgtgtcactgtacagtt

SEQ ID NO: 5816065 - DNA, 20 bp, Homo sapiens
tttgtgtccatttcaagtgt

SEQ ID NO: 5816066 - DNA, 12 bp, Homo sapiens
tttgtgtcccat

SEQ ID NO: 5816067 - DNA, 17 bp, Homo sapiens
tttgtgtcctgctctgt

SEQ ID NO: 5816068 - DNA, 12 bp, Homo sapiens
tttgtgtctgac

SEQ ID NO: 5816069 - DNA, 20 bp, Homo sapiens
tttgtgtctgcctgcctcat

SEQ ID NO: 5816070 - DNA, 14 bp, Homo sapiens
tttgtgtctgtgtt

SEQ ID NO: 5816071 - DNA, 15 bp, Homo sapiens
tttgtgtctttgtct

SEQ ID NO: 5816072 - DNA, 12 bp, Homo sapiens
tttgtgtctttt

SEQ ID NO: 5816073 - DNA, 15 bp, Homo sapiens
tttgtgtgaaataat

SEQ ID NO: 5816074 - DNA, 20 bp, Homo sapiens
tttgtgtgaccaactgtgtt

SEQ ID NO: 5816075 - DNA, 13 bp, Homo sapiens
tttgtgtgattga

SEQ ID NO: 5816076 - DNA, 14 bp, Homo sapiens
tttgtgtgattgaa

SEQ ID NO: 5816077 - DNA, 13 bp, Homo sapiens
tttgtgtgatttc

SEQ ID NO: 5816078 - DNA, 20 bp, Homo sapiens
tttgtgtgtatttgtattaa

SEQ ID NO: 5816079 - DNA, 13 bp, Homo sapiens
tttgtgtgtctta

SEQ ID NO: 5816080 - DNA, 17 bp, Homo sapiens
tttgtgtgttgtctctt

SEQ ID NO: 5816081 - DNA, 15 bp, Homo sapiens
tttgtgtgttgtctt

SEQ ID NO: 5816082 - DNA, 15 bp, Homo sapiens
tttgtgtgtttcaag

SEQ ID NO: 5816083 - DNA, 15 bp, Homo sapiens
tttgtgttcagtttt

SEQ ID NO: 5816084 - DNA, 21 bp, Homo sapiens
tttgtgttcctctttgcatga

SEQ ID NO: 5816085 - DNA, 19 bp, Homo sapiens
tttgtgttctgtttgttaa

SEQ ID NO: 5816086 - DNA, 13 bp, Homo sapiens
tttgtgttgtaat

SEQ ID NO: 5816087 - DNA, 22 bp, Homo sapiens
tttgtgttgtaattcttcagtt

SEQ ID NO: 5816088 - DNA, 14 bp, Homo sapiens
tttgtgttgtacaa

SEQ ID NO: 5816089 - DNA, 15 bp, Homo sapiens
tttgtgttgtacaat

SEQ ID NO: 5816090 - DNA, 23 bp, Homo sapiens
tttgtgttgtcttttttatgtta

SEQ ID NO: 5816091 - DNA, 17 bp, Homo sapiens
tttgtgtttggtttaca

SEQ ID NO: 5816092 - DNA, 18 bp, Homo sapiens
tttgtgtttggtttacat

SEQ ID NO: 5816093 - DNA, 21 bp, Homo sapiens
tttgtgttttaaaaaaactga

SEQ ID NO: 5816094 - DNA, 14 bp, Homo sapiens
tttgttaaaaataa

SEQ ID NO: 5816095 - DNA, 18 bp, Homo sapiens
tttgttaaaaccaaactg

SEQ ID NO: 5816096 - DNA, 13 bp, Homo sapiens
tttgttaaaatat

SEQ ID NO: 5816097 - DNA, 13 bp, Homo sapiens
tttgttaaaatct

SEQ ID NO: 5816098 - DNA, 14 bp, Homo sapiens
tttgttaaagcctg

SEQ ID NO: 5816099 - DNA, 13 bp, Homo sapiens
tttgttaaataat

SEQ ID NO: 5816100 - DNA, 19 bp, Homo sapiens
tttgttaaattcagtaatg

SEQ ID NO: 5816101 - DNA, 20 bp, Homo sapiens
tttgttaacagacactgtaa

SEQ ID NO: 5816102 - DNA, 21 bp, Homo sapiens
tttgttaaccttaaatacact

SEQ ID NO: 5816103 - DNA, 14 bp, Homo sapiens
tttgttaacttttg

SEQ ID NO: 5816104 - DNA, 19 bp, Homo sapiens
tttgttaagaatttcaata

SEQ ID NO: 5816105 - DNA, 22 bp, Homo sapiens
tttgttaatatatataatactt

SEQ ID NO: 5816106 - DNA, 15 bp, Homo sapiens
tttgttaatcatctt

SEQ ID NO: 5816107 - DNA, 14 bp, Homo sapiens
tttgttaattaaat

SEQ ID NO: 5816108 - DNA, 16 bp, Homo sapiens
tttgttaattgattaa

SEQ ID NO: 5816109 - DNA, 21 bp, Homo sapiens
tttgttaatttatctgttgtc

SEQ ID NO: 5816110 - DNA, 13 bp, Homo sapiens
tttgttaatttct

SEQ ID NO: 5816111 - DNA, 14 bp, Homo sapiens
tttgttacaataaa

SEQ ID NO: 5816112 - DNA, 22 bp, Homo sapiens
tttgttacataaggatgacttt

SEQ ID NO: 5816113 - DNA, 14 bp, Homo sapiens
tttgttaccacaga

SEQ ID NO: 5816114 - DNA, 23 bp, Homo sapiens
tttgttaccatactgtctctgga

SEQ ID NO: 5816115 - DNA, 24 bp, Homo sapiens
tttgttacctccaacagaactaaa

SEQ ID NO: 5816116 - DNA, 17 bp, Homo sapiens
tttgttaccttaaaact

SEQ ID NO: 5816117 - DNA, 19 bp, Homo sapiens
tttgttaccttttacagaa

SEQ ID NO: 5816118 - DNA, 21 bp, Homo sapiens
tttgttactctcttccacatg

SEQ ID NO: 5816119 - DNA, 18 bp, Homo sapiens
tttgttactgttcttgct

SEQ ID NO: 5816120 - DNA, 21 bp, Homo sapiens
tttgttactgttcttgctgct

SEQ ID NO: 5816121 - DNA, 23 bp, Homo sapiens
tttgttactgttcttgctgctag

SEQ ID NO: 5816122 - DNA, 12 bp, Homo sapiens
tttgttacttta

SEQ ID NO: 5816123 - DNA, 13 bp, Homo sapiens
tttgttactttga

SEQ ID NO: 5816124 - DNA, 16 bp, Homo sapiens
tttgttactttgaata

SEQ ID NO: 5816125 - DNA, 19 bp, Homo sapiens
tttgttactttgaatagtc

SEQ ID NO: 5816126 - DNA, 19 bp, Homo sapiens
tttgttagactagtttctt

SEQ ID NO: 5816127 - DNA, 14 bp, Homo sapiens
tttgttagcaaaga

SEQ ID NO: 5816128 - DNA, 22 bp, Homo sapiens
tttgttagtatgaggcatttgt

SEQ ID NO: 5816129 - DNA, 15 bp, Homo sapiens
tttgttagttcctgt

SEQ ID NO: 5816130 - DNA, 13 bp, Homo sapiens
tttgttataaatg

SEQ ID NO: 5816131 - DNA, 17 bp, Homo sapiens
tttgttataccatttcc

SEQ ID NO: 5816132 - DNA, 16 bp, Homo sapiens
tttgttatacttcaaa

SEQ ID NO: 5816133 - DNA, 19 bp, Homo sapiens
tttgttatagaatactttt

SEQ ID NO: 5816134 - DNA, 21 bp, Homo sapiens
tttgttatatataataaatac

SEQ ID NO: 5816135 - DNA, 14 bp, Homo sapiens
tttgttatgcaaat

SEQ ID NO: 5816136 - DNA, 14 bp, Homo sapiens
tttgttattaaaaa

SEQ ID NO: 5816137 - DNA, 14 bp, Homo sapiens
tttgttattccatc

SEQ ID NO: 5816138 - DNA, 15 bp, Homo sapiens
tttgttattccatca

SEQ ID NO: 5816139 - DNA, 14 bp, Homo sapiens
tttgttattcctag

SEQ ID NO: 5816140 - DNA, 15 bp, Homo sapiens
tttgttatttacact

SEQ ID NO: 5816141 - DNA, 17 bp, Homo sapiens
tttgttatttacactgg

SEQ ID NO: 5816142 - DNA, 20 bp, Homo sapiens
tttgttatttacactggtct

SEQ ID NO: 5816143 - DNA, 17 bp, Homo sapiens
tttgttatttgtacagt

SEQ ID NO: 5816144 - DNA, 16 bp, Homo sapiens
tttgttcaatgttcca

SEQ ID NO: 5816145 - DNA, 13 bp, Homo sapiens
tttgttcatcatt

SEQ ID NO: 5816146 - DNA, 12 bp, Homo sapiens
tttgttcatgtt

SEQ ID NO: 5816147 - DNA, 14 bp, Homo sapiens
tttgttcatgtttg

SEQ ID NO: 5816148 - DNA, 23 bp, Homo sapiens
tttgttcatttcatcctttcact

SEQ ID NO: 5816149 - DNA, 12 bp, Homo sapiens
tttgttccactt

SEQ ID NO: 5816150 - DNA, 19 bp, Homo sapiens
tttgttccccactggagca

SEQ ID NO: 5816151 - DNA, 12 bp, Homo sapiens
tttgttccctgt

SEQ ID NO: 5816152 - DNA, 11 bp, Homo sapiens
tttgttcctgg

SEQ ID NO: 5816153 - DNA, 12 bp, Homo sapiens
tttgttcctgga

SEQ ID NO: 5816154 - DNA, 16 bp, Homo sapiens
tttgttcctttgaaga

SEQ ID NO: 5816155 - DNA, 18 bp, Homo sapiens
tttgttcctttgaagaat

SEQ ID NO: 5816156 - DNA, 17 bp, Homo sapiens
tttgttctactccttcc

SEQ ID NO: 5816157 - DNA, 19 bp, Homo sapiens
tttgttctcagctccccct

SEQ ID NO: 5816158 - DNA, 21 bp, Homo sapiens
tttgttctccgggtgtggcct

SEQ ID NO: 5816159 - DNA, 13 bp, Homo sapiens
tttgttctcttct

SEQ ID NO: 5816160 - DNA, 21 bp, Homo sapiens
tttgttctgcagagacttcta

SEQ ID NO: 5816161 - DNA, 21 bp, Homo sapiens
tttgttctggctcttccaggc

SEQ ID NO: 5816162 - DNA, 16 bp, Homo sapiens
tttgttctgttctggg

SEQ ID NO: 5816163 - DNA, 19 bp, Homo sapiens
tttgttcttaaaaatgcat

SEQ ID NO: 5816164 - DNA, 22 bp, Homo sapiens
tttgttcttaaaaatgcattta

SEQ ID NO: 5816165 - DNA, 14 bp, Homo sapiens
tttgttcttacaca

SEQ ID NO: 5816166 - DNA, 19 bp, Homo sapiens
tttgttcttacacatacag

SEQ ID NO: 5816167 - DNA, 15 bp, Homo sapiens
tttgttcttcagatt

SEQ ID NO: 5816168 - DNA, 15 bp, Homo sapiens
tttgttcttcttaaa

SEQ ID NO: 5816169 - DNA, 14 bp, Homo sapiens
tttgttctttatgt

SEQ ID NO: 5816170 - DNA, 13 bp, Homo sapiens
tttgttgaaaaat

SEQ ID NO: 5816171 - DNA, 19 bp, Homo sapiens
tttgttgaaaaatgttgct

SEQ ID NO: 5816172 - DNA, 19 bp, Homo sapiens
tttgttgaaagtaaaagtt

SEQ ID NO: 5816173 - DNA, 15 bp, Homo sapiens
tttgttgaactgtta

SEQ ID NO: 5816174 - DNA, 15 bp, Homo sapiens
tttgttgaagtttga

SEQ ID NO: 5816175 - DNA, 22 bp, Homo sapiens
tttgttgacagcttggaaaggg

SEQ ID NO: 5816176 - DNA, 14 bp, Homo sapiens
tttgttgacattag

SEQ ID NO: 5816177 - DNA, 17 bp, Homo sapiens
tttgttgacattctgaa

SEQ ID NO: 5816178 - DNA, 18 bp, Homo sapiens
tttgttgacattctgaat

SEQ ID NO: 5816179 - DNA, 19 bp, Homo sapiens
tttgttgacattctgaatg

SEQ ID NO: 5816180 - DNA, 17 bp, Homo sapiens
tttgttgaccattttgt

SEQ ID NO: 5816181 - DNA, 17 bp, Homo sapiens
tttgttgagtctctgaa

SEQ ID NO: 5816182 - DNA, 18 bp, Homo sapiens
tttgttgcaagatgtgaa

SEQ ID NO: 5816183 - DNA, 19 bp, Homo sapiens
tttgttgcaagatgtgaat

SEQ ID NO: 5816184 - DNA, 22 bp, Homo sapiens
tttgttgcacagtccctcctgt

SEQ ID NO: 5816185 - DNA, 16 bp, Homo sapiens
tttgttgcactaaaat

SEQ ID NO: 5816186 - DNA, 22 bp, Homo sapiens
tttgttgcactgaagtttgata

SEQ ID NO: 5816187 - DNA, 23 bp, Homo sapiens
tttgttgcactgaagtttgataa

SEQ ID NO: 5816188 - DNA, 20 bp, Homo sapiens
tttgttgccagatttcagaa

SEQ ID NO: 5816189 - DNA, 14 bp, Homo sapiens
tttgttgctgctgc

SEQ ID NO: 5816190 - DNA, 19 bp, Homo sapiens
tttgttgctgctgctgctc

SEQ ID NO: 5816191 - DNA, 14 bp, Homo sapiens
tttgttgctgtcaa

SEQ ID NO: 5816192 - DNA, 15 bp, Homo sapiens
tttgttgctttctta

SEQ ID NO: 5816193 - DNA, 19 bp, Homo sapiens
tttgttggagtattattga

SEQ ID NO: 5816194 - DNA, 16 bp, Homo sapiens
tttgttggcccttcca

SEQ ID NO: 5816195 - DNA, 18 bp, Homo sapiens
tttgttggctcagaaaat

SEQ ID NO: 5816196 - DNA, 20 bp, Homo sapiens
tttgttggttgattgtttaa

SEQ ID NO: 5816197 - DNA, 13 bp, Homo sapiens
tttgttggttggt

SEQ ID NO: 5816198 - DNA, 12 bp, Homo sapiens
tttgttgtactt

SEQ ID NO: 5816199 - DNA, 18 bp, Homo sapiens
tttgttgtacttaaatgg

SEQ ID NO: 5816200 - DNA, 13 bp, Homo sapiens
tttgttgtatggg

SEQ ID NO: 5816201 - DNA, 15 bp, Homo sapiens
tttgttgtcagctga

SEQ ID NO: 5816202 - DNA, 16 bp, Homo sapiens
tttgttgtcatgtgta

SEQ ID NO: 5816203 - DNA, 22 bp, Homo sapiens
tttgttgtccttgccccactcc

SEQ ID NO: 5816204 - DNA, 20 bp, Homo sapiens
tttgttgtgattttgtacag

SEQ ID NO: 5816205 - DNA, 15 bp, Homo sapiens
tttgttgtgtgtgca

SEQ ID NO: 5816206 - DNA, 12 bp, Homo sapiens
tttgttgttccc

SEQ ID NO: 5816207 - DNA, 14 bp, Homo sapiens
tttgttgtttgttt

SEQ ID NO: 5816208 - DNA, 19 bp, Homo sapiens
tttgttgtttgtttagtct

SEQ ID NO: 5816209 - DNA, 12 bp, Homo sapiens
ttttaagttaat

SEQ ID NO: 5816210 - DNA, 14 bp, Homo sapiens
ttttaagttcccag

SEQ ID NO: 5816211 - DNA, 12 bp, Homo sapiens
ttttaagttctt

SEQ ID NO: 5816212 - DNA, 15 bp, Homo sapiens
ttttaagttcttatg

SEQ ID NO: 5816213 - DNA, 21 bp, Homo sapiens
ttttaagtttaaaatgtgtat

SEQ ID NO: 5816214 - DNA, 16 bp, Homo sapiens
ttttaagtttgaaact

SEQ ID NO: 5816215 - DNA, 19 bp, Homo sapiens
ttttaagtttgactacata

SEQ ID NO: 5816216 - DNA, 15 bp, Homo sapiens
ttttaagtttgcact

SEQ ID NO: 5816217 - DNA, 21 bp, Homo sapiens
ttttaataaaaaggaaatatt

SEQ ID NO: 5816218 - DNA, 12 bp, Homo sapiens
ttttaataaact

SEQ ID NO: 5816219 - DNA, 13 bp, Homo sapiens
ttttaataaacta

SEQ ID NO: 5816220 - DNA, 21 bp, Homo sapiens
ttttaataaactactctttga

SEQ ID NO: 5816221 - DNA, 19 bp, Homo sapiens
ttttaataaagattctatt

SEQ ID NO: 5816222 - DNA, 21 bp, Homo sapiens
ttttaataaagtatgaatatt

SEQ ID NO: 5816223 - DNA, 12 bp, Homo sapiens
ttttaataaatt

SEQ ID NO: 5816224 - DNA, 15 bp, Homo sapiens
ttttaataagaacag

SEQ ID NO: 5816225 - DNA, 12 bp, Homo sapiens
ttttaataatgt

SEQ ID NO: 5816226 - DNA, 16 bp, Homo sapiens
ttttaataatgtttca

SEQ ID NO: 5816227 - DNA, 23 bp, Homo sapiens
ttttaataattatttttaattta

SEQ ID NO: 5816228 - DNA, 23 bp, Homo sapiens
ttttaatagaaataaattcctaa

SEQ ID NO: 5816229 - DNA, 18 bp, Homo sapiens
ttttaatagaataaaata

SEQ ID NO: 5816230 - DNA, 21 bp, Homo sapiens
ttttaatagaatataattatc

SEQ ID NO: 5816231 - DNA, 15 bp, Homo sapiens
ttttaatatataatt

SEQ ID NO: 5816232 - DNA, 18 bp, Homo sapiens
ttttaatatataatttaa

SEQ ID NO: 5816233 - DNA, 22 bp, Homo sapiens
ttttaatatgcttaaaataagc

SEQ ID NO: 5816234 - DNA, 19 bp, Homo sapiens
ttttaatatggatctgtat

SEQ ID NO: 5816235 - DNA, 18 bp, Homo sapiens
ttttaatattactgtctt

SEQ ID NO: 5816236 - DNA, 22 bp, Homo sapiens
ttttaatattattactgttgat

SEQ ID NO: 5816237 - DNA, 21 bp, Homo sapiens
ttttaatattcttttgtttcc

SEQ ID NO: 5816238 - DNA, 22 bp, Homo sapiens
ttttaatcagacaaagtaattc

SEQ ID NO: 5816239 - DNA, 12 bp, Homo sapiens
ttttaatcagag

SEQ ID NO: 5816240 - DNA, 12 bp, Homo sapiens
ttttaatcatga

SEQ ID NO: 5816241 - DNA, 14 bp, Homo sapiens
ttttaatcatgaaa

SEQ ID NO: 5816242 - DNA, 19 bp, Homo sapiens
ttttaatcatgagcctgtt

SEQ ID NO: 5816243 - DNA, 21 bp, Homo sapiens
ttttaatcatgagcctgttta

SEQ ID NO: 5816244 - DNA, 23 bp, Homo sapiens
ttttaatcatgagcctgtttatt

SEQ ID NO: 5816245 - DNA, 18 bp, Homo sapiens
ttttaatcattatttgag

SEQ ID NO: 5816246 - DNA, 15 bp, Homo sapiens
ttttaatcatttaaa

SEQ ID NO: 5816247 - DNA, 22 bp, Homo sapiens
ttttaatcccattgcaaacatt

SEQ ID NO: 5816248 - DNA, 20 bp, Homo sapiens
ttttaatccgccaatattag

SEQ ID NO: 5816249 - DNA, 17 bp, Homo sapiens
ttttaatctgaaattct

SEQ ID NO: 5816250 - DNA, 15 bp, Homo sapiens
ttttaatgaaaagga

SEQ ID NO: 5816251 - DNA, 16 bp, Homo sapiens
ttttaatgaacaaatg

SEQ ID NO: 5816252 - DNA, 15 bp, Homo sapiens
ttttaatgatgacaa

SEQ ID NO: 5816253 - DNA, 16 bp, Homo sapiens
ttttaatgattgttta

SEQ ID NO: 5816254 - DNA, 13 bp, Homo sapiens
ttttaatgcttaa

SEQ ID NO: 5816255 - DNA, 16 bp, Homo sapiens
ttttaatggaaagttt

SEQ ID NO: 5816256 - DNA, 17 bp, Homo sapiens
ttttaatggattgttaa

SEQ ID NO: 5816257 - DNA, 18 bp, Homo sapiens
ttttaatggattgttaat

SEQ ID NO: 5816258 - DNA, 13 bp, Homo sapiens
ttttaatggcatt

SEQ ID NO: 5816259 - DNA, 23 bp, Homo sapiens
ttttaatgggggtagcagctgga

SEQ ID NO: 5816260 - DNA, 14 bp, Homo sapiens
ttttaatgtacaag

SEQ ID NO: 5816261 - DNA, 20 bp, Homo sapiens
ttttaatgtacaagttttgt

SEQ ID NO: 5816262 - DNA, 18 bp, Homo sapiens
ttttaatgtatatttgct

SEQ ID NO: 5816263 - DNA, 20 bp, Homo sapiens
ttttaatgtatatttgctgc

SEQ ID NO: 5816264 - DNA, 13 bp, Homo sapiens
ttttaatgtatct

SEQ ID NO: 5816265 - DNA, 20 bp, Homo sapiens
ttttaatgtcatttgttaaa

SEQ ID NO: 5816266 - DNA, 14 bp, Homo sapiens
ttttaatgtgaaga

SEQ ID NO: 5816267 - DNA, 19 bp, Homo sapiens
ttttaatgtgaagacattt

SEQ ID NO: 5816268 - DNA, 22 bp, Homo sapiens
ttttaatgtgagacagcaagtt

SEQ ID NO: 5816269 - DNA, 11 bp, Homo sapiens
ttttaatgtgc

SEQ ID NO: 5816270 - DNA, 12 bp, Homo sapiens
ttttaatgtgct

SEQ ID NO: 5816271 - DNA, 15 bp, Homo sapiens
ttttaatgtgctctg

SEQ ID NO: 5816272 - DNA, 17 bp, Homo sapiens
ttttaatgtgctgtgta

SEQ ID NO: 5816273 - DNA, 18 bp, Homo sapiens
ttttaatgttagaattta

SEQ ID NO: 5816274 - DNA, 13 bp, Homo sapiens
ttttaatgttatt

SEQ ID NO: 5816275 - DNA, 17 bp, Homo sapiens
ttttaatgtttaaaaag

SEQ ID NO: 5816276 - DNA, 22 bp, Homo sapiens
ttttaatgtttattatttacat

SEQ ID NO: 5816277 - DNA, 17 bp, Homo sapiens
ttttaattaaaaacttt

SEQ ID NO: 5816278 - DNA, 13 bp, Homo sapiens
ttttaattaaata

SEQ ID NO: 5816279 - DNA, 19 bp, Homo sapiens
ttttaattaactttggatt

SEQ ID NO: 5816280 - DNA, 22 bp, Homo sapiens
ttttaattaatgaaatatctgt

SEQ ID NO: 5816281 - DNA, 11 bp, Homo sapiens
ttttaattatt

SEQ ID NO: 5816282 - DNA, 17 bp, Homo sapiens
ttttaattattattctt

SEQ ID NO: 5816283 - DNA, 20 bp, Homo sapiens
ttttaattattatttatata

SEQ ID NO: 5816284 - DNA, 22 bp, Homo sapiens
ttttaattcaacatcaaaactt

SEQ ID NO: 5816285 - DNA, 23 bp, Homo sapiens
ttttaattgaaagggacaagtat

SEQ ID NO: 5816286 - DNA, 15 bp, Homo sapiens
ttttaattgattatt

SEQ ID NO: 5816287 - DNA, 10 bp, Homo sapiens
ttttaattta

SEQ ID NO: 5816288 - DNA, 12 bp, Homo sapiens
ttttaatttaac

SEQ ID NO: 5816289 - DNA, 14 bp, Homo sapiens
ttttaatttaacaa

SEQ ID NO: 5816290 - DNA, 21 bp, Homo sapiens
ttttaatttatatttgaaatt

SEQ ID NO: 5816291 - DNA, 15 bp, Homo sapiens
ttttaatttatttgt

SEQ ID NO: 5816292 - DNA, 15 bp, Homo sapiens
ttttaatttcaggaa

SEQ ID NO: 5816293 - DNA, 21 bp, Homo sapiens
ttttaatttcaggaaaatgta

SEQ ID NO: 5816294 - DNA, 15 bp, Homo sapiens
ttttaatttcctgtg

SEQ ID NO: 5816295 - DNA, 20 bp, Homo sapiens
ttttaatttctgcaaatgta

SEQ ID NO: 5816296 - DNA, 19 bp, Homo sapiens
ttttaatttgatgaaagct

SEQ ID NO: 5816297 - DNA, 22 bp, Homo sapiens
ttttaatttggtagatgacaaa

SEQ ID NO: 5816298 - DNA, 22 bp, Homo sapiens
ttttaattttggaacaaatgct

SEQ ID NO: 5816299 - DNA, 22 bp, Homo sapiens
ttttaattttgtcagattcaca

SEQ ID NO: 5816300 - DNA, 12 bp, Homo sapiens
ttttaattttta

SEQ ID NO: 5816301 - DNA, 19 bp, Homo sapiens
ttttacaaaacatacccag

SEQ ID NO: 5816302 - DNA, 21 bp, Homo sapiens
ttttacaaagaaacaaaatat

SEQ ID NO: 5816303 - DNA, 23 bp, Homo sapiens
ttttacaaaggctgtattcagca

SEQ ID NO: 5816304 - DNA, 23 bp, Homo sapiens
ttttacaaattggagcagggaca

SEQ ID NO: 5816305 - DNA, 18 bp, Homo sapiens
ttttacaaattgttttta

SEQ ID NO: 5816306 - DNA, 21 bp, Homo sapiens
ttttacaagaagtacgaatct

SEQ ID NO: 5816307 - DNA, 12 bp, Homo sapiens
ttttacaataaa

SEQ ID NO: 5816308 - DNA, 17 bp, Homo sapiens
ttttacaataaaatctt

SEQ ID NO: 5816309 - DNA, 18 bp, Homo sapiens
ttttacaataaaattttg

SEQ ID NO: 5816310 - DNA, 12 bp, Homo sapiens
ttttacaataat

SEQ ID NO: 5816311 - DNA, 19 bp, Homo sapiens
ttttacaatgatttgtaaa

SEQ ID NO: 5816312 - DNA, 23 bp, Homo sapiens
ttttacaatgtaattatttatgt

SEQ ID NO: 5816313 - DNA, 18 bp, Homo sapiens
ttttacacagaaacactg

SEQ ID NO: 5816314 - DNA, 22 bp, Homo sapiens
ttttacacagaaacactgcctt

SEQ ID NO: 5816315 - DNA, 15 bp, Homo sapiens
ttttacacagagaaa

SEQ ID NO: 5816316 - DNA, 17 bp, Homo sapiens
ttttacacagcaatttt

SEQ ID NO: 5816317 - DNA, 19 bp, Homo sapiens
ttttacacattgacaatga

SEQ ID NO: 5816318 - DNA, 19 bp, Homo sapiens
ttttacacgtctatgcaat

SEQ ID NO: 5816319 - DNA, 23 bp, Homo sapiens
ttttacactgataaaagttttga

SEQ ID NO: 5816320 - DNA, 12 bp, Homo sapiens
ttttacactgga

SEQ ID NO: 5816321 - DNA, 12 bp, Homo sapiens
ttttacacttta

SEQ ID NO: 5816322 - DNA, 23 bp, Homo sapiens
ttttacagaataaaagaattaca

SEQ ID NO: 5816323 - DNA, 12 bp, Homo sapiens
ttttacagagaa

SEQ ID NO: 5816324 - DNA, 17 bp, Homo sapiens
ttttacagcagcaatat

SEQ ID NO: 5816325 - DNA, 21 bp, Homo sapiens
ttttacagcattgtctttgct

SEQ ID NO: 5816326 - DNA, 12 bp, Homo sapiens
ttttacaggaaa

SEQ ID NO: 5816327 - DNA, 17 bp, Homo sapiens
ttttacagtatcttcaa

SEQ ID NO: 5816328 - DNA, 20 bp, Homo sapiens
ttttacagtatcttcaaaaa

SEQ ID NO: 5816329 - DNA, 22 bp, Homo sapiens
ttttacagtgaccttttcttca

SEQ ID NO: 5816330 - DNA, 19 bp, Homo sapiens
ttttacagtgtatctcgaa

SEQ ID NO: 5816331 - DNA, 21 bp, Homo sapiens
ttttacagttacttccttcct

SEQ ID NO: 5816332 - DNA, 22 bp, Homo sapiens
ttttacagttagggttttgcaa

SEQ ID NO: 5816333 - DNA, 13 bp, Homo sapiens
ttttacataactg

SEQ ID NO: 5816334 - DNA, 21 bp, Homo sapiens
ttttacataattgccaataat

SEQ ID NO: 5816335 - DNA, 14 bp, Homo sapiens
ttttacatacagtg

SEQ ID NO: 5816336 - DNA, 16 bp, Homo sapiens
ttttacatacttttgc

SEQ ID NO: 5816337 - DNA, 14 bp, Homo sapiens
ttttacatatagct

SEQ ID NO: 5816338 - DNA, 21 bp, Homo sapiens
ttttacatccttgattacttc

SEQ ID NO: 5816339 - DNA, 12 bp, Homo sapiens
ttttacatgaag

SEQ ID NO: 5816340 - DNA, 20 bp, Homo sapiens
ttttacatgccccgtttttg

SEQ ID NO: 5816341 - DNA, 18 bp, Homo sapiens
ttttacatgtttataaat

SEQ ID NO: 5816342 - DNA, 17 bp, Homo sapiens
ttttacatgtttccatc

SEQ ID NO: 5816343 - DNA, 20 bp, Homo sapiens
ttttacattacaaatttctg

SEQ ID NO: 5816344 - DNA, 15 bp, Homo sapiens
ttttacattctgtgt

SEQ ID NO: 5816345 - DNA, 17 bp, Homo sapiens
ttttacattctgtgtgt

SEQ ID NO: 5816346 - DNA, 12 bp, Homo sapiens
ttttacattgtg

SEQ ID NO: 5816347 - DNA, 11 bp, Homo sapiens
ttttacattta

SEQ ID NO: 5816348 - DNA, 17 bp, Homo sapiens
ttttacatttagagtat

SEQ ID NO: 5816349 - DNA, 21 bp, Homo sapiens
ttttacatttggattagaaat

SEQ ID NO: 5816350 - DNA, 14 bp, Homo sapiens
ttttacattttagt

SEQ ID NO: 5816351 - DNA, 18 bp, Homo sapiens
ttttacattttcctgtgt

SEQ ID NO: 5816352 - DNA, 12 bp, Homo sapiens
ttttaccaaagc

SEQ ID NO: 5816353 - DNA, 17 bp, Homo sapiens
ttttaccaaagcatcaa

SEQ ID NO: 5816354 - DNA, 16 bp, Homo sapiens
ttttaccaagtacaaa

SEQ ID NO: 5816355 - DNA, 13 bp, Homo sapiens
ttttaccaataaa

SEQ ID NO: 5816356 - DNA, 20 bp, Homo sapiens
ttttaccacacactgttttt

SEQ ID NO: 5816357 - DNA, 18 bp, Homo sapiens
ttttaccaccgtctgtct

SEQ ID NO: 5816358 - DNA, 22 bp, Homo sapiens
ttttaccactaattttgtttta

SEQ ID NO: 5816359 - DNA, 16 bp, Homo sapiens
ttttaccagcttttaa

SEQ ID NO: 5816360 - DNA, 14 bp, Homo sapiens
ttttaccattagca

SEQ ID NO: 5816361 - DNA, 19 bp, Homo sapiens
ttttaccattagcataatt

SEQ ID NO: 5816362 - DNA, 21 bp, Homo sapiens
ttttaccattttgcgatgtgt

SEQ ID NO: 5816363 - DNA, 22 bp, Homo sapiens
ttttacccagacaactctagaa

SEQ ID NO: 5816364 - DNA, 21 bp, Homo sapiens
ttttacccataagtaatattt

SEQ ID NO: 5816365 - DNA, 14 bp, Homo sapiens
ttttacccatatcc

SEQ ID NO: 5816366 - DNA, 20 bp, Homo sapiens
ttttacccatttgttcatat

SEQ ID NO: 5816367 - DNA, 17 bp, Homo sapiens
ttttacccctgcacagt

SEQ ID NO: 5816368 - DNA, 19 bp, Homo sapiens
ttttaccctatatctataa

SEQ ID NO: 5816369 - DNA, 17 bp, Homo sapiens
ttttaccctgtgtcaga

SEQ ID NO: 5816370 - DNA, 21 bp, Homo sapiens
ttttaccctgtgtcagagcct

SEQ ID NO: 5816371 - DNA, 23 bp, Homo sapiens
ttttaccctgttcccaagcaaag

SEQ ID NO: 5816372 - DNA, 17 bp, Homo sapiens
ttttaccgtttcttccc

SEQ ID NO: 5816373 - DNA, 19 bp, Homo sapiens
ttttacctagctaattatt

SEQ ID NO: 5816374 - DNA, 14 bp, Homo sapiens
ttttacctattctg

SEQ ID NO: 5816375 - DNA, 23 bp, Homo sapiens
ttttacctattctgaaaaagaca

SEQ ID NO: 5816376 - DNA, 16 bp, Homo sapiens
ttttacctgagacttt

SEQ ID NO: 5816377 - DNA, 14 bp, Homo sapiens
ttttacctgctgct

SEQ ID NO: 5816378 - DNA, 20 bp, Homo sapiens
ttttacctgggatatgacaa

SEQ ID NO: 5816379 - DNA, 21 bp, Homo sapiens
ttttactaaaatcgtattcta

SEQ ID NO: 5816380 - DNA, 20 bp, Homo sapiens
ttttactaaagcagtgtttt

SEQ ID NO: 5816381 - DNA, 21 bp, Homo sapiens
ttttactaagatcacacaaat

SEQ ID NO: 5816382 - DNA, 14 bp, Homo sapiens
ttttactaatgata

SEQ ID NO: 5816383 - DNA, 22 bp, Homo sapiens
ttttactacataggttaatttt

SEQ ID NO: 5816384 - DNA, 15 bp, Homo sapiens
ttttactactgtgga

SEQ ID NO: 5816385 - DNA, 18 bp, Homo sapiens
ttttactacttgttacct

SEQ ID NO: 5816386 - DNA, 13 bp, Homo sapiens
ttttatagtgtgt

SEQ ID NO: 5816387 - DNA, 18 bp, Homo sapiens
ttttatagttattaaatg

SEQ ID NO: 5816388 - DNA, 23 bp, Homo sapiens
ttttatagttgtattttgtacat

SEQ ID NO: 5816389 - DNA, 20 bp, Homo sapiens
ttttatataaagaaaatcaa

SEQ ID NO: 5816390 - DNA, 11 bp, Homo sapiens
ttttatatata

SEQ ID NO: 5816391 - DNA, 16 bp, Homo sapiens
ttttatatatatgcat

SEQ ID NO: 5816392 - DNA, 20 bp, Homo sapiens
ttttatatatgaatattaca

SEQ ID NO: 5816393 - DNA, 22 bp, Homo sapiens
ttttatatatgaatattacatg

SEQ ID NO: 5816394 - DNA, 21 bp, Homo sapiens
ttttatatattatgtgaagaa

SEQ ID NO: 5816395 - DNA, 23 bp, Homo sapiens
ttttatatcattttaaaatgtct

SEQ ID NO: 5816396 - DNA, 13 bp, Homo sapiens
ttttatatcccat

SEQ ID NO: 5816397 - DNA, 13 bp, Homo sapiens
ttttatatctgta

SEQ ID NO: 5816398 - DNA, 16 bp, Homo sapiens
ttttatatctgtatgt

SEQ ID NO: 5816399 - DNA, 13 bp, Homo sapiens
ttttatatctttt

SEQ ID NO: 5816400 - DNA, 20 bp, Homo sapiens
ttttatatgatgggggaaaa

SEQ ID NO: 5816401 - DNA, 13 bp, Homo sapiens
ttttatatgcttt

SEQ ID NO: 5816402 - DNA, 16 bp, Homo sapiens
ttttatatgtaaatgt

SEQ ID NO: 5816403 - DNA, 16 bp, Homo sapiens
ttttatatgttgctat

SEQ ID NO: 5816404 - DNA, 9 bp, Homo sapiens
ttttatatt

SEQ ID NO: 5816405 - DNA, 13 bp, Homo sapiens
ttttatattaaaa

SEQ ID NO: 5816406 - DNA, 23 bp, Homo sapiens
ttttatattaaaataagcactgt

SEQ ID NO: 5816407 - DNA, 14 bp, Homo sapiens
ttttatattaaagt

SEQ ID NO: 5816408 - DNA, 20 bp, Homo sapiens
ttttatattaaccagatata

SEQ ID NO: 5816409 - DNA, 21 bp, Homo sapiens
ttttatattaaccagatatat

SEQ ID NO: 5816410 - DNA, 17 bp, Homo sapiens
ttttatattacttttgt

SEQ ID NO: 5816411 - DNA, 22 bp, Homo sapiens
ttttatattacttttgtaaata

SEQ ID NO: 5816412 - DNA, 13 bp, Homo sapiens
ttttatattgaaa

SEQ ID NO: 5816413 - DNA, 12 bp, Homo sapiens
ttttatatttaa

SEQ ID NO: 5816414 - DNA, 14 bp, Homo sapiens
ttttatatttaaaa

SEQ ID NO: 5816415 - DNA, 21 bp, Homo sapiens
ttttatatttaaaaaattaaa

SEQ ID NO: 5816416 - DNA, 20 bp, Homo sapiens
ttttatatttattgttagaa

SEQ ID NO: 5816417 - DNA, 18 bp, Homo sapiens
ttttatatttcaagtaca

SEQ ID NO: 5816418 - DNA, 14 bp, Homo sapiens
ttttatatttgaaa

SEQ ID NO: 5816419 - DNA, 18 bp, Homo sapiens
ttttatatttgaaaaaat

SEQ ID NO: 5816420 - DNA, 19 bp, Homo sapiens
ttttatatttgaaaaaatt

SEQ ID NO: 5816421 - DNA, 13 bp, Homo sapiens
ttttatatttgag

SEQ ID NO: 5816422 - DNA, 17 bp, Homo sapiens
ttttatatttgtatcga

SEQ ID NO: 5816423 - DNA, 18 bp, Homo sapiens
ttttatattttatactgc

SEQ ID NO: 5816424 - DNA, 15 bp, Homo sapiens
ttttatcacatgtat

SEQ ID NO: 5816425 - DNA, 22 bp, Homo sapiens
ttttatcagaactatgtttttg

SEQ ID NO: 5816426 - DNA, 12 bp, Homo sapiens
ttttatcagaat

SEQ ID NO: 5816427 - DNA, 16 bp, Homo sapiens
ttttatcagccatgtt

SEQ ID NO: 5816428 - DNA, 14 bp, Homo sapiens
ttttatcaggcagg

SEQ ID NO: 5816429 - DNA, 15 bp, Homo sapiens
ttttatcaggcagga

SEQ ID NO: 5816430 - DNA, 13 bp, Homo sapiens
ttttatcatgaat

SEQ ID NO: 5816431 - DNA, 15 bp, Homo sapiens
ttttatcatgacatg

SEQ ID NO: 5816432 - DNA, 19 bp, Homo sapiens
ttttatcatgacatgttat

SEQ ID NO: 5816433 - DNA, 16 bp, Homo sapiens
ttttatcatgcatgtc

SEQ ID NO: 5816434 - DNA, 17 bp, Homo sapiens
ttttatcattgaaacat

SEQ ID NO: 5816435 - DNA, 21 bp, Homo sapiens
ttttatcattgaaacatttat

SEQ ID NO: 5816436 - DNA, 19 bp, Homo sapiens
ttttatcccatttagtgtg

SEQ ID NO: 5816437 - DNA, 16 bp, Homo sapiens
ttttatcccttcctgt

SEQ ID NO: 5816438 - DNA, 19 bp, Homo sapiens
ttttatcccttcctgtctg

SEQ ID NO: 5816439 - DNA, 20 bp, Homo sapiens
ttttatcctggccttgtact

SEQ ID NO: 5816440 - DNA, 20 bp, Homo sapiens
ttttatccttacaatgtgaa

SEQ ID NO: 5816441 - DNA, 18 bp, Homo sapiens
ttttatcgtcactgctta

SEQ ID NO: 5816442 - DNA, 13 bp, Homo sapiens
ttttatctcagtg

SEQ ID NO: 5816443 - DNA, 13 bp, Homo sapiens
ttttatctgcaga

SEQ ID NO: 5816444 - DNA, 19 bp, Homo sapiens
ttttatctgcggctttaaa

SEQ ID NO: 5816445 - DNA, 20 bp, Homo sapiens
ttttatctggttctatatga

SEQ ID NO: 5816446 - DNA, 22 bp, Homo sapiens
ttttatcttggtagtacatttt

SEQ ID NO: 5816447 - DNA, 12 bp, Homo sapiens
ttttatctttga

SEQ ID NO: 5816448 - DNA, 23 bp, Homo sapiens
ttttatcttttagctagaatcca

SEQ ID NO: 5816449 - DNA, 16 bp, Homo sapiens
ttttatcttttctaca

SEQ ID NO: 5816450 - DNA, 18 bp, Homo sapiens
ttttatgaacattgtact

SEQ ID NO: 5816451 - DNA, 20 bp, Homo sapiens
ttttatgaagaaaaagtaca

SEQ ID NO: 5816452 - DNA, 14 bp, Homo sapiens
ttttatgacagtat

SEQ ID NO: 5816453 - DNA, 12 bp, Homo sapiens
ttttatgagatg

SEQ ID NO: 5816454 - DNA, 18 bp, Homo sapiens
ttttatgagctcatgtag

SEQ ID NO: 5816455 - DNA, 16 bp, Homo sapiens
ttttatgagcttccaa

SEQ ID NO: 5816456 - DNA, 15 bp, Homo sapiens
ttttatgcacagcct

SEQ ID NO: 5816457 - DNA, 24 bp, Homo sapiens
ttttatgcagaagcatattttgct

SEQ ID NO: 5816458 - DNA, 13 bp, Homo sapiens
ttttatgcatgtt

SEQ ID NO: 5816459 - DNA, 22 bp, Homo sapiens
ttttatgccaaattgattgtca

SEQ ID NO: 5816460 - DNA, 13 bp, Homo sapiens
ttttatgccccat

SEQ ID NO: 5816461 - DNA, 13 bp, Homo sapiens
ttttatgcgcaaa

SEQ ID NO: 5816462 - DNA, 15 bp, Homo sapiens
ttttatgctcttgaa

SEQ ID NO: 5816463 - DNA, 19 bp, Homo sapiens
ttttatgctcttttttact

SEQ ID NO: 5816464 - DNA, 18 bp, Homo sapiens
ttttatgctttaaacatt

SEQ ID NO: 5816465 - DNA, 23 bp, Homo sapiens
ttttatggaggctttgcatagat

SEQ ID NO: 5816466 - DNA, 16 bp, Homo sapiens
ttttatggatgattaa

SEQ ID NO: 5816467 - DNA, 18 bp, Homo sapiens
ttttatggttccaatgaa

SEQ ID NO: 5816468 - DNA, 18 bp, Homo sapiens
ttttatgtacaaccctga

SEQ ID NO: 5816469 - DNA, 19 bp, Homo sapiens
ttttatgtacaaccctgac

SEQ ID NO: 5816470 - DNA, 20 bp, Homo sapiens
ttttatgtacaaccctgacc

SEQ ID NO: 5816471 - DNA, 13 bp, Homo sapiens
ttttatgtctttc

SEQ ID NO: 5816472 - DNA, 16 bp, Homo sapiens
ttttatgtctttcttg

SEQ ID NO: 5816473 - DNA, 18 bp, Homo sapiens
ttttatgtctttcttgta

SEQ ID NO: 5816474 - DNA, 18 bp, Homo sapiens
ttttatgtgaaacatgtt

SEQ ID NO: 5816475 - DNA, 20 bp, Homo sapiens
ttttatgtgaaggtgtttca

SEQ ID NO: 5816476 - DNA, 15 bp, Homo sapiens
ttttatgtgatgcca

SEQ ID NO: 5816477 - DNA, 20 bp, Homo sapiens
ttttatgtggtggtttctat

SEQ ID NO: 5816478 - DNA, 12 bp, Homo sapiens
ttttatgtgtat

SEQ ID NO: 5816479 - DNA, 16 bp, Homo sapiens
ttttatgttatttata

SEQ ID NO: 5816480 - DNA, 12 bp, Homo sapiens
ttttatgttgac

SEQ ID NO: 5816481 - DNA, 12 bp, Homo sapiens
ttttatgttgat

SEQ ID NO: 5816482 - DNA, 12 bp, Homo sapiens
ttttatgtttaa

SEQ ID NO: 5816483 - DNA, 16 bp, Homo sapiens
ttttattaaacagata

SEQ ID NO: 5816484 - DNA, 17 bp, Homo sapiens
ttttattaaacattttc

SEQ ID NO: 5816485 - DNA, 14 bp, Homo sapiens
ttttattaaagcaa

SEQ ID NO: 5816486 - DNA, 16 bp, Homo sapiens
ttttattaaagcaaca

SEQ ID NO: 5816487 - DNA, 20 bp, Homo sapiens
ttttattaaagcatttccta

SEQ ID NO: 5816488 - DNA, 23 bp, Homo sapiens
ttttattaaatttatttgaaaat

SEQ ID NO: 5816489 - DNA, 19 bp, Homo sapiens
ttttattaataaacattct

SEQ ID NO: 5816490 - DNA, 13 bp, Homo sapiens
ttttattaatata

SEQ ID NO: 5816491 - DNA, 20 bp, Homo sapiens
ttttattaatcactgtgtat

SEQ ID NO: 5816492 - DNA, 22 bp, Homo sapiens
ttttattaatcactgtgtatat

SEQ ID NO: 5816493 - DNA, 23 bp, Homo sapiens
ttttattaatcactgtgtatatt

SEQ ID NO: 5816494 - DNA, 14 bp, Homo sapiens
ttttattaatgcac

SEQ ID NO: 5816495 - DNA, 19 bp, Homo sapiens
ttttattaatgcactttct

SEQ ID NO: 5816496 - DNA, 19 bp, Homo sapiens
ttttattaattataaaatg

SEQ ID NO: 5816497 - DNA, 19 bp, Homo sapiens
ttttattaattttagtttt

SEQ ID NO: 5816498 - DNA, 20 bp, Homo sapiens
ttttattagtattgttgtcc

SEQ ID NO: 5816499 - DNA, 16 bp, Homo sapiens
ttttattataaattct

SEQ ID NO: 5816500 - DNA, 16 bp, Homo sapiens
ttttattatcttctat

SEQ ID NO: 5816501 - DNA, 14 bp, Homo sapiens
ttttattatgcatt

SEQ ID NO: 5816502 - DNA, 21 bp, Homo sapiens
ttttattatgctgtattttct

SEQ ID NO: 5816503 - DNA, 12 bp, Homo sapiens
ttttattatgta

SEQ ID NO: 5816504 - DNA, 15 bp, Homo sapiens
ttttattattaacaa

SEQ ID NO: 5816505 - DNA, 12 bp, Homo sapiens
ttttattattgt

SEQ ID NO: 5816506 - DNA, 13 bp, Homo sapiens
ttttattattgtg

SEQ ID NO: 5816507 - DNA, 13 bp, Homo sapiens
ttttattatttgt

SEQ ID NO: 5816508 - DNA, 21 bp, Homo sapiens
ttttattcaaactacctatat

SEQ ID NO: 5816509 - DNA, 14 bp, Homo sapiens
ttttattcaagtta

SEQ ID NO: 5816510 - DNA, 11 bp, Homo sapiens
ttttattcagc

SEQ ID NO: 5816511 - DNA, 18 bp, Homo sapiens
ttttattcagtagtttga

SEQ ID NO: 5816512 - DNA, 16 bp, Homo sapiens
ttttattcatgtgaag

SEQ ID NO: 5816513 - DNA, 13 bp, Homo sapiens
ttttattccacat

SEQ ID NO: 5816514 - DNA, 13 bp, Homo sapiens
ttttattccctgc

SEQ ID NO: 5816515 - DNA, 23 bp, Homo sapiens
ttttattcctgccctgctgttta

SEQ ID NO: 5816516 - DNA, 15 bp, Homo sapiens
ttttattcctttcct

SEQ ID NO: 5816517 - DNA, 14 bp, Homo sapiens
ttttattctgactt

SEQ ID NO: 5816518 - DNA, 14 bp, Homo sapiens
ttttattctgtttt

SEQ ID NO: 5816519 - DNA, 13 bp, Homo sapiens
ttttattcttgat

SEQ ID NO: 5816520 - DNA, 18 bp, Homo sapiens
ttttattcttgtgaatat

SEQ ID NO: 5816521 - DNA, 13 bp, Homo sapiens
ttttattcttttt

SEQ ID NO: 5816522 - DNA, 14 bp, Homo sapiens
ttttattgaaagct

SEQ ID NO: 5816523 - DNA, 14 bp, Homo sapiens
ttttattgaataac

SEQ ID NO: 5816524 - DNA, 14 bp, Homo sapiens
ttttattgaatact

SEQ ID NO: 5816525 - DNA, 19 bp, Homo sapiens
ttttattgaatctatttaa

SEQ ID NO: 5816526 - DNA, 21 bp, Homo sapiens
ttttattgatgtgaaattaaa

SEQ ID NO: 5816527 - DNA, 22 bp, Homo sapiens
ttttattgcatggtgtgaacta

SEQ ID NO: 5816528 - DNA, 12 bp, Homo sapiens
ttttattgcctt

SEQ ID NO: 5816529 - DNA, 14 bp, Homo sapiens
ttttattgccttct

SEQ ID NO: 5816530 - DNA, 22 bp, Homo sapiens
ttttattgccttctcaccagct

SEQ ID NO: 5816531 - DNA, 23 bp, Homo sapiens
ttttattgccttctcaccagctg

SEQ ID NO: 5816532 - DNA, 24 bp, Homo sapiens
ttttattgccttctcaccagctgc

SEQ ID NO: 5816533 - DNA, 18 bp, Homo sapiens
ttttattgcctttagaaa

SEQ ID NO: 5816534 - DNA, 12 bp, Homo sapiens
ttttattgctag

SEQ ID NO: 5816535 - DNA, 21 bp, Homo sapiens
ttttattgtaacagacattgt

SEQ ID NO: 5816536 - DNA, 20 bp, Homo sapiens
ttttattgtattttgatgag

SEQ ID NO: 5816537 - DNA, 17 bp, Homo sapiens
ttttattgtttaaagca

SEQ ID NO: 5816538 - DNA, 15 bp, Homo sapiens
ttttatttaaatgct

SEQ ID NO: 5816539 - DNA, 11 bp, Homo sapiens
ttttatttaca

SEQ ID NO: 5816540 - DNA, 13 bp, Homo sapiens
ttttatttacatt

SEQ ID NO: 5816541 - DNA, 16 bp, Homo sapiens
ttttatttataaacta

SEQ ID NO: 5816542 - DNA, 22 bp, Homo sapiens
ttttatttatagttaataatct

SEQ ID NO: 5816543 - DNA, 14 bp, Homo sapiens
ttttatttatatgt

SEQ ID NO: 5816544 - DNA, 13 bp, Homo sapiens
ttttatttatcaa

SEQ ID NO: 5816545 - DNA, 16 bp, Homo sapiens
ttttatttattttaat

SEQ ID NO: 5816546 - DNA, 15 bp, Homo sapiens
ttttatttcaattgt

SEQ ID NO: 5816547 - DNA, 21 bp, Homo sapiens
ttttatttcattcacattaat

SEQ ID NO: 5816548 - DNA, 14 bp, Homo sapiens
ttttatttcattgg

SEQ ID NO: 5816549 - DNA, 23 bp, Homo sapiens
ttttatttccaggtaatatgtct

SEQ ID NO: 5816550 - DNA, 13 bp, Homo sapiens
ttttatttctaag

SEQ ID NO: 5816551 - DNA, 12 bp, Homo sapiens
ttttatttctat

SEQ ID NO: 5816552 - DNA, 18 bp, Homo sapiens
ttttatttctccttttgt

SEQ ID NO: 5816553 - DNA, 13 bp, Homo sapiens
ttttatttctcgg

SEQ ID NO: 5816554 - DNA, 22 bp, Homo sapiens
ttttatttctttttgattttta

SEQ ID NO: 5816555 - DNA, 14 bp, Homo sapiens
ttttatttgaaaaa

SEQ ID NO: 5816556 - DNA, 22 bp, Homo sapiens
ttttatttggaataataatttt

SEQ ID NO: 5816557 - DNA, 13 bp, Homo sapiens
ttttatttgtatt

SEQ ID NO: 5816558 - DNA, 16 bp, Homo sapiens
ttttattttatgttta

SEQ ID NO: 5816559 - DNA, 17 bp, Homo sapiens
ttttattttattgaata

SEQ ID NO: 5816560 - DNA, 17 bp, Homo sapiens
ttttattttcaaaacca

SEQ ID NO: 5816561 - DNA, 15 bp, Homo sapiens
ttttattttcaagca

SEQ ID NO: 5816562 - DNA, 15 bp, Homo sapiens
ttttattttcattgt

SEQ ID NO: 5816563 - DNA, 15 bp, Homo sapiens
ttttattttcccttc

SEQ ID NO: 5816564 - DNA, 20 bp, Homo sapiens
ttttattttgaaaagcttct

SEQ ID NO: 5816565 - DNA, 13 bp, Homo sapiens
ttttattttgtaa

SEQ ID NO: 5816566 - DNA, 20 bp, Homo sapiens
ttttcatgacataataaagt

SEQ ID NO: 5816567 - DNA, 23 bp, Homo sapiens
ttttcatgacataataaagtatt

SEQ ID NO: 5816568 - DNA, 17 bp, Homo sapiens
ttttcatgcaaactctt

SEQ ID NO: 5816569 - DNA, 21 bp, Homo sapiens
ttttcatgcgatgacacttgt

SEQ ID NO: 5816570 - DNA, 22 bp, Homo sapiens
ttttcatggacactttgaaatg

SEQ ID NO: 5816571 - DNA, 10 bp, Homo sapiens
ttttcatgtt

SEQ ID NO: 5816572 - DNA, 15 bp, Homo sapiens
ttttcatgttgatga

SEQ ID NO: 5816573 - DNA, 11 bp, Homo sapiens
ttttcatgttt

SEQ ID NO: 5816574 - DNA, 13 bp, Homo sapiens
ttttcattaaact

SEQ ID NO: 5816575 - DNA, 14 bp, Homo sapiens
ttttcattaaactt

SEQ ID NO: 5816576 - DNA, 16 bp, Homo sapiens
ttttcattaaacttga

SEQ ID NO: 5816577 - DNA, 18 bp, Homo sapiens
ttttcattaaataaattt

SEQ ID NO: 5816578 - DNA, 22 bp, Homo sapiens
ttttcattaaataaatttgact

SEQ ID NO: 5816579 - DNA, 16 bp, Homo sapiens
ttttcattacaatgga

SEQ ID NO: 5816580 - DNA, 12 bp, Homo sapiens
ttttcattacct

SEQ ID NO: 5816581 - DNA, 22 bp, Homo sapiens
ttttcattagcaaaaaaagttg

SEQ ID NO: 5816582 - DNA, 14 bp, Homo sapiens
ttttcattatttca

SEQ ID NO: 5816583 - DNA, 21 bp, Homo sapiens
ttttcattcaggtatttgtaa

SEQ ID NO: 5816584 - DNA, 13 bp, Homo sapiens
ttttcattcatga

SEQ ID NO: 5816585 - DNA, 17 bp, Homo sapiens
ttttcattcatgaatat

SEQ ID NO: 5816586 - DNA, 21 bp, Homo sapiens
ttttcattccatgtgcccagt

SEQ ID NO: 5816587 - DNA, 18 bp, Homo sapiens
ttttcattccctgtagtt

SEQ ID NO: 5816588 - DNA, 22 bp, Homo sapiens
ttttcattctcctatcacctgt

SEQ ID NO: 5816589 - DNA, 17 bp, Homo sapiens
ttttcattctcctcctc

SEQ ID NO: 5816590 - DNA, 13 bp, Homo sapiens
ttttcattctgaa

SEQ ID NO: 5816591 - DNA, 12 bp, Homo sapiens
ttttcattctgg

SEQ ID NO: 5816592 - DNA, 13 bp, Homo sapiens
ttttcattctgtt

SEQ ID NO: 5816593 - DNA, 17 bp, Homo sapiens
ttttcattgatatgaaa

SEQ ID NO: 5816594 - DNA, 20 bp, Homo sapiens
ttttcattgattatatgggt

SEQ ID NO: 5816595 - DNA, 16 bp, Homo sapiens
ttttcatttcagattt

SEQ ID NO: 5816596 - DNA, 16 bp, Homo sapiens
ttttcatttcatatat

SEQ ID NO: 5816597 - DNA, 14 bp, Homo sapiens
ttttcatttcatga

SEQ ID NO: 5816598 - DNA, 18 bp, Homo sapiens
ttttcatttcatgaaaat

SEQ ID NO: 5816599 - DNA, 13 bp, Homo sapiens
ttttcatttgcct

SEQ ID NO: 5816600 - DNA, 15 bp, Homo sapiens
ttttcatttgcctat

SEQ ID NO: 5816601 - DNA, 16 bp, Homo sapiens
ttttcatttgcctatt

SEQ ID NO: 5816602 - DNA, 16 bp, Homo sapiens
ttttcatttgtacaag

SEQ ID NO: 5816603 - DNA, 22 bp, Homo sapiens
ttttcatttgttttgcttttgt

SEQ ID NO: 5816604 - DNA, 15 bp, Homo sapiens
ttttcattttaactg

SEQ ID NO: 5816605 - DNA, 14 bp, Homo sapiens
ttttcattttaata

SEQ ID NO: 5816606 - DNA, 14 bp, Homo sapiens
ttttcattttccaa

SEQ ID NO: 5816607 - DNA, 15 bp, Homo sapiens
ttttcattttctctc

SEQ ID NO: 5816608 - DNA, 11 bp, Homo sapiens
ttttcattttg

SEQ ID NO: 5816609 - DNA, 17 bp, Homo sapiens
ttttcatttttccatga

SEQ ID NO: 5816610 - DNA, 14 bp, Homo sapiens
ttttccaaaatcta

SEQ ID NO: 5816611 - DNA, 23 bp, Homo sapiens
ttttccaaagagccatgtgtcat

SEQ ID NO: 5816612 - DNA, 14 bp, Homo sapiens
ttttccaaatgctt

SEQ ID NO: 5816613 - DNA, 17 bp, Homo sapiens
ttttccaagtaaagtga

SEQ ID NO: 5816614 - DNA, 19 bp, Homo sapiens
ttttccaagtgtataatgt

SEQ ID NO: 5816615 - DNA, 12 bp, Homo sapiens
ttttccaatatt

SEQ ID NO: 5816616 - DNA, 22 bp, Homo sapiens
ttttccaatattttaataaagt

SEQ ID NO: 5816617 - DNA, 19 bp, Homo sapiens
ttttccacactatgtgtgt

SEQ ID NO: 5816618 - DNA, 22 bp, Homo sapiens
ttttccacatggcagatgattt

SEQ ID NO: 5816619 - DNA, 13 bp, Homo sapiens
ttttccactactg

SEQ ID NO: 5816620 - DNA, 15 bp, Homo sapiens
ttttccactactgct

SEQ ID NO: 5816621 - DNA, 15 bp, Homo sapiens
ttttccacttagtat

SEQ ID NO: 5816622 - DNA, 15 bp, Homo sapiens
ttttccacttttgtt

SEQ ID NO: 5816623 - DNA, 17 bp, Homo sapiens
ttttccagaaagaaaat

SEQ ID NO: 5816624 - DNA, 13 bp, Homo sapiens
ttttccaggctgg

SEQ ID NO: 5816625 - DNA, 15 bp, Homo sapiens
ttttccagtctcttg

SEQ ID NO: 5816626 - DNA, 13 bp, Homo sapiens
ttttccagtctgt

SEQ ID NO: 5816627 - DNA, 18 bp, Homo sapiens
ttttccagtgacttgcaa

SEQ ID NO: 5816628 - DNA, 22 bp, Homo sapiens
ttttccatatagtttgttttct

SEQ ID NO: 5816629 - DNA, 16 bp, Homo sapiens
ttttccatatcctggt

SEQ ID NO: 5816630 - DNA, 12 bp, Homo sapiens
ttttccatcatt

SEQ ID NO: 5816631 - DNA, 19 bp, Homo sapiens
ttttccatcattttacagt

SEQ ID NO: 5816632 - DNA, 11 bp, Homo sapiens
ttttccatgac

SEQ ID NO: 5816633 - DNA, 15 bp, Homo sapiens
ttttccatgacattt

SEQ ID NO: 5816634 - DNA, 22 bp, Homo sapiens
ttttccatggcaggaaggcttg

SEQ ID NO: 5816635 - DNA, 14 bp, Homo sapiens
ttttccatgtgttt

SEQ ID NO: 5816636 - DNA, 22 bp, Homo sapiens
ttttccatgtgttttgctttta

SEQ ID NO: 5816637 - DNA, 20 bp, Homo sapiens
ttttccattatgaggaaact

SEQ ID NO: 5816638 - DNA, 17 bp, Homo sapiens
ttttccattatgttcat

SEQ ID NO: 5816639 - DNA, 19 bp, Homo sapiens
ttttccattgaccagctct

SEQ ID NO: 5816640 - DNA, 16 bp, Homo sapiens
ttttccattggtttac

SEQ ID NO: 5816641 - DNA, 17 bp, Homo sapiens
ttttccattgtttgaaa

SEQ ID NO: 5816642 - DNA, 18 bp, Homo sapiens
ttttccatttcttcagag

SEQ ID NO: 5816643 - DNA, 13 bp, Homo sapiens
ttttccattttat

SEQ ID NO: 5816644 - DNA, 18 bp, Homo sapiens
ttttccatttttgtcagt

SEQ ID NO: 5816645 - DNA, 18 bp, Homo sapiens
ttttcccaaaatgttgaa

SEQ ID NO: 5816646 - DNA, 14 bp, Homo sapiens
ttttcccaataaat

SEQ ID NO: 5816647 - DNA, 21 bp, Homo sapiens
ttttcccaatagcactttcat

SEQ ID NO: 5816648 - DNA, 17 bp, Homo sapiens
ttttcccacctctttgg

SEQ ID NO: 5816649 - DNA, 21 bp, Homo sapiens
ttttcccacgtctaactggaa

SEQ ID NO: 5816650 - DNA, 17 bp, Homo sapiens
ttttcccactccaagcc

SEQ ID NO: 5816651 - DNA, 13 bp, Homo sapiens
ttttcccactgca

SEQ ID NO: 5816652 - DNA, 23 bp, Homo sapiens
ttttcccagactactattttctt

SEQ ID NO: 5816653 - DNA, 18 bp, Homo sapiens
ttttcccagctacacctt

SEQ ID NO: 5816654 - DNA, 18 bp, Homo sapiens
ttttcccaggacaggaaa

SEQ ID NO: 5816655 - DNA, 16 bp, Homo sapiens
ttttcccagtaatttg

SEQ ID NO: 5816656 - DNA, 14 bp, Homo sapiens
ttttcccagtattt

SEQ ID NO: 5816657 - DNA, 18 bp, Homo sapiens
ttttcccagtgaataaat

SEQ ID NO: 5816658 - DNA, 21 bp, Homo sapiens
ttttcccagtgaataaatatt

SEQ ID NO: 5816659 - DNA, 15 bp, Homo sapiens
ttttcccataagaca

SEQ ID NO: 5816660 - DNA, 21 bp, Homo sapiens
ttttcccatgactcttggagc

SEQ ID NO: 5816661 - DNA, 20 bp, Homo sapiens
ttttcccatttatctaaata

SEQ ID NO: 5816662 - DNA, 20 bp, Homo sapiens
ttttccccaaaccataaaac

SEQ ID NO: 5816663 - DNA, 22 bp, Homo sapiens
ttttccccaaaggcatgcagtc

SEQ ID NO: 5816664 - DNA, 14 bp, Homo sapiens
ttttccccagactt

SEQ ID NO: 5816665 - DNA, 18 bp, Homo sapiens
ttttccccccactctccc

SEQ ID NO: 5816666 - DNA, 19 bp, Homo sapiens
ttttccccccactctcccc

SEQ ID NO: 5816667 - DNA, 16 bp, Homo sapiens
ttttcccccctagaaa

SEQ ID NO: 5816668 - DNA, 14 bp, Homo sapiens
ttttccccctaatt

SEQ ID NO: 5816669 - DNA, 15 bp, Homo sapiens
ttttccccctggaat

SEQ ID NO: 5816670 - DNA, 17 bp, Homo sapiens
ttttccccctgttttta

SEQ ID NO: 5816671 - DNA, 15 bp, Homo sapiens
ttttcccccttccca

SEQ ID NO: 5816672 - DNA, 16 bp, Homo sapiens
ttttcccccttcccat

SEQ ID NO: 5816673 - DNA, 21 bp, Homo sapiens
ttttcccccttgaggattgtg

SEQ ID NO: 5816674 - DNA, 19 bp, Homo sapiens
ttttcccccttttctgcat

SEQ ID NO: 5816675 - DNA, 19 bp, Homo sapiens
ttttccccggtcccttgag

SEQ ID NO: 5816676 - DNA, 22 bp, Homo sapiens
ttttcccctatcctgttcttcc

SEQ ID NO: 5816677 - DNA, 12 bp, Homo sapiens
ttttcccctccc

SEQ ID NO: 5816678 - DNA, 19 bp, Homo sapiens
ttttcccctcttttgttaa

SEQ ID NO: 5816679 - DNA, 13 bp, Homo sapiens
ttttcccctgcaa

SEQ ID NO: 5816680 - DNA, 15 bp, Homo sapiens
ttttcccctgttaaa

SEQ ID NO: 5816681 - DNA, 19 bp, Homo sapiens
ttttcccctgttaaacagt

SEQ ID NO: 5816682 - DNA, 17 bp, Homo sapiens
ttttcccctttgattca

SEQ ID NO: 5816683 - DNA, 22 bp, Homo sapiens
ttttcccgtataataaaaccaa

SEQ ID NO: 5816684 - DNA, 23 bp, Homo sapiens
ttttccctacctaagaatttcac

SEQ ID NO: 5816685 - DNA, 22 bp, Homo sapiens
ttttccctattagagaagagat

SEQ ID NO: 5816686 - DNA, 21 bp, Homo sapiens
ttttccctccataagtttaac

SEQ ID NO: 5816687 - DNA, 15 bp, Homo sapiens
ttttccctcctgaca

SEQ ID NO: 5816688 - DNA, 17 bp, Homo sapiens
ttttccctctcttgcct

SEQ ID NO: 5816689 - DNA, 14 bp, Homo sapiens
ttttccctctggca

SEQ ID NO: 5816690 - DNA, 14 bp, Homo sapiens
ttttccctggaact

SEQ ID NO: 5816691 - DNA, 19 bp, Homo sapiens
ttttccctggaactcctgg

SEQ ID NO: 5816692 - DNA, 15 bp, Homo sapiens
ttttccctgggtgga

SEQ ID NO: 5816693 - DNA, 13 bp, Homo sapiens
ttttcccttaaat

SEQ ID NO: 5816694 - DNA, 15 bp, Homo sapiens
ttttcccttgcctta

SEQ ID NO: 5816695 - DNA, 14 bp, Homo sapiens
ttttcccttgctgt

SEQ ID NO: 5816696 - DNA, 15 bp, Homo sapiens
ttttcccttgctgta

SEQ ID NO: 5816697 - DNA, 17 bp, Homo sapiens
ttttcccttttctttcc

SEQ ID NO: 5816698 - DNA, 14 bp, Homo sapiens
ttttccctttttaa

SEQ ID NO: 5816699 - DNA, 19 bp, Homo sapiens
ttttccctttttaaaaaat

SEQ ID NO: 5816700 - DNA, 17 bp, Homo sapiens
ttttccctttttatgtg

SEQ ID NO: 5816701 - DNA, 19 bp, Homo sapiens
ttttccgctcttaattaaa

SEQ ID NO: 5816702 - DNA, 14 bp, Homo sapiens
ttttccgtaaatgt

SEQ ID NO: 5816703 - DNA, 21 bp, Homo sapiens
ttttccgtaaatgtctgcact

SEQ ID NO: 5816704 - DNA, 16 bp, Homo sapiens
ttttccgtcacttaaa

SEQ ID NO: 5816705 - DNA, 19 bp, Homo sapiens
ttttccgtcacttaaattt

SEQ ID NO: 5816706 - DNA, 14 bp, Homo sapiens
ttttcctaaatgca

SEQ ID NO: 5816707 - DNA, 15 bp, Homo sapiens
ttttcctaagacatt

SEQ ID NO: 5816708 - DNA, 17 bp, Homo sapiens
ttttcctaagacatttt

SEQ ID NO: 5816709 - DNA, 23 bp, Homo sapiens
ttttcctaagacatttttcattc

SEQ ID NO: 5816710 - DNA, 17 bp, Homo sapiens
ttttcctaagcacaaat

SEQ ID NO: 5816711 - DNA, 18 bp, Homo sapiens
ttttcctaagtgtttact

SEQ ID NO: 5816712 - DNA, 21 bp, Homo sapiens
ttttcctacaggcctatttaa

SEQ ID NO: 5816713 - DNA, 17 bp, Homo sapiens
ttttcctagccctctca

SEQ ID NO: 5816714 - DNA, 18 bp, Homo sapiens
ttttcctattttcagccc

SEQ ID NO: 5816715 - DNA, 22 bp, Homo sapiens
ttttcctcaagcaataattgtt

SEQ ID NO: 5816716 - DNA, 21 bp, Homo sapiens
ttttcctcatcctttccctct

SEQ ID NO: 5816717 - DNA, 17 bp, Homo sapiens
ttttcctcatgtaacat

SEQ ID NO: 5816718 - DNA, 18 bp, Homo sapiens
ttttcctcatgtaacatt

SEQ ID NO: 5816719 - DNA, 17 bp, Homo sapiens
ttttcctccctgcttaa

SEQ ID NO: 5816720 - DNA, 14 bp, Homo sapiens
ttttcctcccttct

SEQ ID NO: 5816721 - DNA, 21 bp, Homo sapiens
ttttcctcccttctgctactg

SEQ ID NO: 5816722 - DNA, 18 bp, Homo sapiens
ttttcctcctttctctgt

SEQ ID NO: 5816723 - DNA, 23 bp, Homo sapiens
ttttcctcctttgcagtgtctta

SEQ ID NO: 5816724 - DNA, 21 bp, Homo sapiens
ttttcctcgcttctttcaagg

SEQ ID NO: 5816725 - DNA, 13 bp, Homo sapiens
ttttcctctgagc

SEQ ID NO: 5816726 - DNA, 13 bp, Homo sapiens
ttttcctctggcc

SEQ ID NO: 5816727 - DNA, 16 bp, Homo sapiens
ttttcctcttgtgatt

SEQ ID NO: 5816728 - DNA, 13 bp, Homo sapiens
ttttcctgaaaac

SEQ ID NO: 5816729 - DNA, 14 bp, Homo sapiens
ttttcctgcatgtt

SEQ ID NO: 5816730 - DNA, 18 bp, Homo sapiens
ttttcctgcatgttctgt

SEQ ID NO: 5816731 - DNA, 12 bp, Homo sapiens
ttttcctgcttc

SEQ ID NO: 5816732 - DNA, 19 bp, Homo sapiens
ttttcctggacttaaagaa

SEQ ID NO: 5816733 - DNA, 16 bp, Homo sapiens
ttttcctggcagctgc

SEQ ID NO: 5816734 - DNA, 20 bp, Homo sapiens
ttttcctgggacatcttctg

SEQ ID NO: 5816735 - DNA, 21 bp, Homo sapiens
ttttcctgggccttctcagct

SEQ ID NO: 5816736 - DNA, 13 bp, Homo sapiens
ttttcctgtcaat

SEQ ID NO: 5816737 - DNA, 13 bp, Homo sapiens
ttttcctgtcagt

SEQ ID NO: 5816738 - DNA, 22 bp, Homo sapiens
ttttcctgtcctctttcagctc

SEQ ID NO: 5816739 - DNA, 13 bp, Homo sapiens
ttttcctgtcctg

SEQ ID NO: 5816740 - DNA, 14 bp, Homo sapiens
ttttcctgtcctgc

SEQ ID NO: 5816741 - DNA, 14 bp, Homo sapiens
ttttcctgtggaat

SEQ ID NO: 5816742 - DNA, 12 bp, Homo sapiens
ttttccttagct

SEQ ID NO: 5816743 - DNA, 18 bp, Homo sapiens
ttttccttatttcaaggg

SEQ ID NO: 5816744 - DNA, 16 bp, Homo sapiens
ttttccttatttgcct

SEQ ID NO: 5816745 - DNA, 21 bp, Homo sapiens
ttttccttcaagaatgcagta

SEQ ID NO: 5816746 - DNA, 18 bp, Homo sapiens
ttttgagaacgtaaagaa

SEQ ID NO: 5816747 - DNA, 19 bp, Homo sapiens
ttttgagaacgtaaagaac

SEQ ID NO: 5816748 - DNA, 22 bp, Homo sapiens
ttttgagaactccagctggtgc

SEQ ID NO: 5816749 - DNA, 9 bp, Homo sapiens
ttttgagac

SEQ ID NO: 5816750 - DNA, 17 bp, Homo sapiens
ttttgagacatgggatc

SEQ ID NO: 5816751 - DNA, 20 bp, Homo sapiens
ttttgagagaaccttatatt

SEQ ID NO: 5816752 - DNA, 13 bp, Homo sapiens
ttttgagatatta

SEQ ID NO: 5816753 - DNA, 16 bp, Homo sapiens
ttttgaggacaagtta

SEQ ID NO: 5816754 - DNA, 13 bp, Homo sapiens
ttttgaggcaaaa

SEQ ID NO: 5816755 - DNA, 18 bp, Homo sapiens
ttttgaggcaaaagaagg

SEQ ID NO: 5816756 - DNA, 16 bp, Homo sapiens
ttttgaggcttctgtt

SEQ ID NO: 5816757 - DNA, 23 bp, Homo sapiens
ttttgaggtaaagatatggagaa

SEQ ID NO: 5816758 - DNA, 21 bp, Homo sapiens
ttttgagtaaaaagacatttt

SEQ ID NO: 5816759 - DNA, 22 bp, Homo sapiens
ttttgagtagatattactttat

SEQ ID NO: 5816760 - DNA, 19 bp, Homo sapiens
ttttgagtatttttaaaaa

SEQ ID NO: 5816761 - DNA, 19 bp, Homo sapiens
ttttgagtcattgacttca

SEQ ID NO: 5816762 - DNA, 17 bp, Homo sapiens
ttttgagtgccttacac

SEQ ID NO: 5816763 - DNA, 22 bp, Homo sapiens
ttttgagtggatggaggagaaa

SEQ ID NO: 5816764 - DNA, 16 bp, Homo sapiens
ttttgagtgggccctg

SEQ ID NO: 5816765 - DNA, 21 bp, Homo sapiens
ttttgagtgtatacatgtgtg

SEQ ID NO: 5816766 - DNA, 13 bp, Homo sapiens
ttttgagtgtgca

SEQ ID NO: 5816767 - DNA, 14 bp, Homo sapiens
ttttgagtgtgcaa

SEQ ID NO: 5816768 - DNA, 14 bp, Homo sapiens
ttttgagtgtgtgt

SEQ ID NO: 5816769 - DNA, 16 bp, Homo sapiens
ttttgagttacaattt

SEQ ID NO: 5816770 - DNA, 13 bp, Homo sapiens
ttttgataaaaga

SEQ ID NO: 5816771 - DNA, 19 bp, Homo sapiens
ttttgataaaatgttcctt

SEQ ID NO: 5816772 - DNA, 20 bp, Homo sapiens
ttttgataaagtaataatgt

SEQ ID NO: 5816773 - DNA, 20 bp, Homo sapiens
ttttgataaagtttctcaga

SEQ ID NO: 5816774 - DNA, 18 bp, Homo sapiens
ttttgataataatattgt

SEQ ID NO: 5816775 - DNA, 20 bp, Homo sapiens
ttttgataataatattgttt

SEQ ID NO: 5816776 - DNA, 20 bp, Homo sapiens
ttttgatacatttatcttct

SEQ ID NO: 5816777 - DNA, 19 bp, Homo sapiens
ttttgatacttgtaacttt

SEQ ID NO: 5816778 - DNA, 17 bp, Homo sapiens
ttttgatagatgataat

SEQ ID NO: 5816779 - DNA, 15 bp, Homo sapiens
ttttgatagcaaagc

SEQ ID NO: 5816780 - DNA, 17 bp, Homo sapiens
ttttgatatgattgtaa

SEQ ID NO: 5816781 - DNA, 20 bp, Homo sapiens
ttttgatatttatttcctgc

SEQ ID NO: 5816782 - DNA, 16 bp, Homo sapiens
ttttgatatttctagc

SEQ ID NO: 5816783 - DNA, 22 bp, Homo sapiens
ttttgatcatccctttctccca

SEQ ID NO: 5816784 - DNA, 13 bp, Homo sapiens
ttttgatcttcaa

SEQ ID NO: 5816785 - DNA, 22 bp, Homo sapiens
ttttgatgagatattaaattct

SEQ ID NO: 5816786 - DNA, 16 bp, Homo sapiens
ttttgatgagttgtga

SEQ ID NO: 5816787 - DNA, 22 bp, Homo sapiens
ttttgatgatgtctacagaaaa

SEQ ID NO: 5816788 - DNA, 13 bp, Homo sapiens
ttttgatgcacaa

SEQ ID NO: 5816789 - DNA, 17 bp, Homo sapiens
ttttgatgcagcatttg

SEQ ID NO: 5816790 - DNA, 21 bp, Homo sapiens
ttttgatgcagcatttgataa

SEQ ID NO: 5816791 - DNA, 18 bp, Homo sapiens
ttttgatgtaaagatgtt

SEQ ID NO: 5816792 - DNA, 21 bp, Homo sapiens
ttttgatgtatatatctatta

SEQ ID NO: 5816793 - DNA, 13 bp, Homo sapiens
ttttgatgtatta

SEQ ID NO: 5816794 - DNA, 14 bp, Homo sapiens
ttttgatgtctcca

SEQ ID NO: 5816795 - DNA, 15 bp, Homo sapiens
ttttgatgtttgtgg

SEQ ID NO: 5816796 - DNA, 20 bp, Homo sapiens
ttttgattaaccttttcaaa

SEQ ID NO: 5816797 - DNA, 22 bp, Homo sapiens
ttttgattaatgaagaaagtaa

SEQ ID NO: 5816798 - DNA, 19 bp, Homo sapiens
ttttgattaatgtttctta

SEQ ID NO: 5816799 - DNA, 20 bp, Homo sapiens
ttttgatttaatgttttcag

SEQ ID NO: 5816800 - DNA, 14 bp, Homo sapiens
ttttgatttcaggt

SEQ ID NO: 5816801 - DNA, 13 bp, Homo sapiens
ttttgatttggtg

SEQ ID NO: 5816802 - DNA, 20 bp, Homo sapiens
ttttgatttgtactgaaaaa

SEQ ID NO: 5816803 - DNA, 13 bp, Homo sapiens
ttttgattttgct

SEQ ID NO: 5816804 - DNA, 16 bp, Homo sapiens
ttttgcaaaagaagtt

SEQ ID NO: 5816805 - DNA, 21 bp, Homo sapiens
ttttgcaaaataagtaaataa

SEQ ID NO: 5816806 - DNA, 17 bp, Homo sapiens
ttttgcaaaataagttt

SEQ ID NO: 5816807 - DNA, 17 bp, Homo sapiens
ttttgcaaagatttaat

SEQ ID NO: 5816808 - DNA, 10 bp, Homo sapiens
ttttgcaaat

SEQ ID NO: 5816809 - DNA, 18 bp, Homo sapiens
ttttgcaaataagtgtat

SEQ ID NO: 5816810 - DNA, 18 bp, Homo sapiens
ttttgcaaatataaacat

SEQ ID NO: 5816811 - DNA, 19 bp, Homo sapiens
ttttgcaaattatattttg

SEQ ID NO: 5816812 - DNA, 21 bp, Homo sapiens
ttttgcaaccaggaacagcaa

SEQ ID NO: 5816813 - DNA, 19 bp, Homo sapiens
ttttgcaataacttctata

SEQ ID NO: 5816814 - DNA, 17 bp, Homo sapiens
ttttgcaataatgcagt

SEQ ID NO: 5816815 - DNA, 23 bp, Homo sapiens
ttttgcaatcttaagcagagata

SEQ ID NO: 5816816 - DNA, 15 bp, Homo sapiens
ttttgcacatatatt

SEQ ID NO: 5816817 - DNA, 17 bp, Homo sapiens
ttttgcacattccaaaa

SEQ ID NO: 5816818 - DNA, 19 bp, Homo sapiens
ttttgcaccccatgctgtt

SEQ ID NO: 5816819 - DNA, 19 bp, Homo sapiens
ttttgcacgaattttaaaa

SEQ ID NO: 5816820 - DNA, 14 bp, Homo sapiens
ttttgcactgtctg

SEQ ID NO: 5816821 - DNA, 12 bp, Homo sapiens
ttttgcactttt

SEQ ID NO: 5816822 - DNA, 13 bp, Homo sapiens
ttttgcagaagag

SEQ ID NO: 5816823 - DNA, 17 bp, Homo sapiens
ttttgcagaaggaaatg

SEQ ID NO: 5816824 - DNA, 14 bp, Homo sapiens
ttttgcagcagtga

SEQ ID NO: 5816825 - DNA, 13 bp, Homo sapiens
ttttgcaggagca

SEQ ID NO: 5816826 - DNA, 17 bp, Homo sapiens
ttttgcaggctggcttt

SEQ ID NO: 5816827 - DNA, 13 bp, Homo sapiens
ttttgcagtaact

SEQ ID NO: 5816828 - DNA, 22 bp, Homo sapiens
ttttgcagtagagtcatctcca

SEQ ID NO: 5816829 - DNA, 17 bp, Homo sapiens
ttttgcataagattaaa

SEQ ID NO: 5816830 - DNA, 22 bp, Homo sapiens
ttttgcataagattaaaggaag

SEQ ID NO: 5816831 - DNA, 13 bp, Homo sapiens
ttttgcatattct

SEQ ID NO: 5816832 - DNA, 23 bp, Homo sapiens
ttttgcatattctctattttact

SEQ ID NO: 5816833 - DNA, 18 bp, Homo sapiens
ttttgcatattgcatact

SEQ ID NO: 5816834 - DNA, 18 bp, Homo sapiens
ttttgcatcattgtttta

SEQ ID NO: 5816835 - DNA, 15 bp, Homo sapiens
ttttgcattcaaatt

SEQ ID NO: 5816836 - DNA, 20 bp, Homo sapiens
ttttgcattccagaatcttg

SEQ ID NO: 5816837 - DNA, 15 bp, Homo sapiens
ttttgcattgtctgt

SEQ ID NO: 5816838 - DNA, 15 bp, Homo sapiens
ttttgcatttagttt

SEQ ID NO: 5816839 - DNA, 19 bp, Homo sapiens
ttttgcatttgaataaagc

SEQ ID NO: 5816840 - DNA, 18 bp, Homo sapiens
ttttgccaagaatatagt

SEQ ID NO: 5816841 - DNA, 16 bp, Homo sapiens
ttttgccaatttgcac

SEQ ID NO: 5816842 - DNA, 19 bp, Homo sapiens
ttttgccaatttgcacatt

SEQ ID NO: 5816843 - DNA, 16 bp, Homo sapiens
ttttgccacagctttt

SEQ ID NO: 5816844 - DNA, 16 bp, Homo sapiens
ttttgccactgcaaac

SEQ ID NO: 5816845 - DNA, 20 bp, Homo sapiens
ttttgccagtgataagagca

SEQ ID NO: 5816846 - DNA, 20 bp, Homo sapiens
ttttgccatacatcagttat

SEQ ID NO: 5816847 - DNA, 23 bp, Homo sapiens
ttttgccatgttggccaggctgg

SEQ ID NO: 5816848 - DNA, 13 bp, Homo sapiens
ttttgcccatcct

SEQ ID NO: 5816849 - DNA, 19 bp, Homo sapiens
ttttgccgtggcttgggga

SEQ ID NO: 5816850 - DNA, 15 bp, Homo sapiens
ttttgcctcttttct

SEQ ID NO: 5816851 - DNA, 14 bp, Homo sapiens
ttttgcctgtaaga

SEQ ID NO: 5816852 - DNA, 23 bp, Homo sapiens
ttttgcctgtgactgtaaagagt

SEQ ID NO: 5816853 - DNA, 17 bp, Homo sapiens
ttttgcgatttcacagt

SEQ ID NO: 5816854 - DNA, 13 bp, Homo sapiens
ttttgctaactgg

SEQ ID NO: 5816855 - DNA, 19 bp, Homo sapiens
ttttgctaactgggttaaa

SEQ ID NO: 5816856 - DNA, 14 bp, Homo sapiens
ttttgctaactggt

SEQ ID NO: 5816857 - DNA, 15 bp, Homo sapiens
ttttgctaactggtt

SEQ ID NO: 5816858 - DNA, 17 bp, Homo sapiens
ttttgctaactggttaa

SEQ ID NO: 5816859 - DNA, 18 bp, Homo sapiens
ttttgctaactggttaaa

SEQ ID NO: 5816860 - DNA, 22 bp, Homo sapiens
ttttgctaagtaaatctcttct

SEQ ID NO: 5816861 - DNA, 20 bp, Homo sapiens
ttttgctaccaaagaatgca

SEQ ID NO: 5816862 - DNA, 16 bp, Homo sapiens
ttttgctataatcatt

SEQ ID NO: 5816863 - DNA, 21 bp, Homo sapiens
ttttgctattagactgtagga

SEQ ID NO: 5816864 - DNA, 15 bp, Homo sapiens
ttttgctcagttcca

SEQ ID NO: 5816865 - DNA, 22 bp, Homo sapiens
ttttgctcccccattttaactt

SEQ ID NO: 5816866 - DNA, 17 bp, Homo sapiens
ttttgctctagggccct

SEQ ID NO: 5816867 - DNA, 11 bp, Homo sapiens
ttttgctctat

SEQ ID NO: 5816868 - DNA, 11 bp, Homo sapiens
ttttgctctcc

SEQ ID NO: 5816869 - DNA, 13 bp, Homo sapiens
ttttgctgaattc

SEQ ID NO: 5816870 - DNA, 17 bp, Homo sapiens
ttttgctgaattcatct

SEQ ID NO: 5816871 - DNA, 16 bp, Homo sapiens
ttttgctgaattcctt

SEQ ID NO: 5816872 - DNA, 15 bp, Homo sapiens
ttttgctgattgcta

SEQ ID NO: 5816873 - DNA, 11 bp, Homo sapiens
ttttgctgctg

SEQ ID NO: 5816874 - DNA, 16 bp, Homo sapiens
ttttgctgctgaattt

SEQ ID NO: 5816875 - DNA, 16 bp, Homo sapiens
ttttgctgctgctgct

SEQ ID NO: 5816876 - DNA, 16 bp, Homo sapiens
ttttgctggagggaag

SEQ ID NO: 5816877 - DNA, 19 bp, Homo sapiens
ttttgctggtgtctgagct

SEQ ID NO: 5816878 - DNA, 12 bp, Homo sapiens
ttttgctgtata

SEQ ID NO: 5816879 - DNA, 10 bp, Homo sapiens
ttttgctgtt

SEQ ID NO: 5816880 - DNA, 21 bp, Homo sapiens
ttttgctgttgtttctaaaca

SEQ ID NO: 5816881 - DNA, 22 bp, Homo sapiens
ttttgcttgaagcaaacagttg

SEQ ID NO: 5816882 - DNA, 16 bp, Homo sapiens
ttttgcttgcaatgta

SEQ ID NO: 5816883 - DNA, 23 bp, Homo sapiens
ttttgcttgttatattaagcaga

SEQ ID NO: 5816884 - DNA, 18 bp, Homo sapiens
ttttgctttaaaacaaag

SEQ ID NO: 5816885 - DNA, 17 bp, Homo sapiens
ttttgctttaattttag

SEQ ID NO: 5816886 - DNA, 18 bp, Homo sapiens
ttttgctttaattttagc

SEQ ID NO: 5816887 - DNA, 13 bp, Homo sapiens
ttttgctttggtt

SEQ ID NO: 5816888 - DNA, 19 bp, Homo sapiens
ttttgcttttaattaaata

SEQ ID NO: 5816889 - DNA, 14 bp, Homo sapiens
ttttgcttttatga

SEQ ID NO: 5816890 - DNA, 17 bp, Homo sapiens
ttttgcttttgtaactt

SEQ ID NO: 5816891 - DNA, 15 bp, Homo sapiens
ttttggaaaaacctt

SEQ ID NO: 5816892 - DNA, 14 bp, Homo sapiens
ttttggaaaagaat

SEQ ID NO: 5816893 - DNA, 13 bp, Homo sapiens
ttttggaaactgc

SEQ ID NO: 5816894 - DNA, 17 bp, Homo sapiens
ttttggaaactgttggt

SEQ ID NO: 5816895 - DNA, 15 bp, Homo sapiens
ttttggaaagaaatt

SEQ ID NO: 5816896 - DNA, 14 bp, Homo sapiens
ttttggaaagtcag

SEQ ID NO: 5816897 - DNA, 18 bp, Homo sapiens
ttttggaaattgttgtat

SEQ ID NO: 5816898 - DNA, 14 bp, Homo sapiens
ttttggaagacata

SEQ ID NO: 5816899 - DNA, 17 bp, Homo sapiens
ttttggactagccagaa

SEQ ID NO: 5816900 - DNA, 21 bp, Homo sapiens
ttttggactcagcccacctgc

SEQ ID NO: 5816901 - DNA, 18 bp, Homo sapiens
ttttggactctctgtggt

SEQ ID NO: 5816902 - DNA, 13 bp, Homo sapiens
ttttggactggca

SEQ ID NO: 5816903 - DNA, 14 bp, Homo sapiens
ttttggactttgtt

SEQ ID NO: 5816904 - DNA, 13 bp, Homo sapiens
ttttggagaaaaa

SEQ ID NO: 5816905 - DNA, 21 bp, Homo sapiens
ttttggagaaatgtcataaat

SEQ ID NO: 5816906 - DNA, 22 bp, Homo sapiens
ttttggagaaatgtcataaatt

SEQ ID NO: 5816907 - DNA, 13 bp, Homo sapiens
ttttggaggtgct

SEQ ID NO: 5816908 - DNA, 18 bp, Homo sapiens
ttttggatatattattgt

SEQ ID NO: 5816909 - DNA, 11 bp, Homo sapiens
ttttggatgag

SEQ ID NO: 5816910 - DNA, 24 bp, Homo sapiens
ttttggatgttgctatagtgacat

SEQ ID NO: 5816911 - DNA, 19 bp, Homo sapiens
ttttggattgacagtaact

SEQ ID NO: 5816912 - DNA, 20 bp, Homo sapiens
ttttggattgacagtaactt

SEQ ID NO: 5816913 - DNA, 16 bp, Homo sapiens
ttttggattggacaaa

SEQ ID NO: 5816914 - DNA, 16 bp, Homo sapiens
ttttggatttctttat

SEQ ID NO: 5816915 - DNA, 17 bp, Homo sapiens
ttttggatttctttata

SEQ ID NO: 5816916 - DNA, 17 bp, Homo sapiens
ttttggcaaagccagaa

SEQ ID NO: 5816917 - DNA, 17 bp, Homo sapiens
ttttggcagccatgata

SEQ ID NO: 5816918 - DNA, 15 bp, Homo sapiens
ttttggcattcctct

SEQ ID NO: 5816919 - DNA, 15 bp, Homo sapiens
ttttggccaaagtgt

SEQ ID NO: 5816920 - DNA, 17 bp, Homo sapiens
ttttggccaaagtgtta

SEQ ID NO: 5816921 - DNA, 22 bp, Homo sapiens
ttttggccaccccttgctctct

SEQ ID NO: 5816922 - DNA, 16 bp, Homo sapiens
ttttggccatgaaagc

SEQ ID NO: 5816923 - DNA, 19 bp, Homo sapiens
ttttggcctgtgatgtttt

SEQ ID NO: 5816924 - DNA, 16 bp, Homo sapiens
ttttggcctgtttgat

SEQ ID NO: 5816925 - DNA, 20 bp, Homo sapiens
tttttaaattcttactctgg

SEQ ID NO: 5816926 - DNA, 20 bp, Homo sapiens
tttttaaattttatttcctg

SEQ ID NO: 5816927 - DNA, 19 bp, Homo sapiens
tttttaaattttctccagt

SEQ ID NO: 5816928 - DNA, 20 bp, Homo sapiens
tttttaaattttcttcagtt

SEQ ID NO: 5816929 - DNA, 19 bp, Homo sapiens
tttttaaattttgtaatga

SEQ ID NO: 5816930 - DNA, 18 bp, Homo sapiens
tttttaacaatctaacaa

SEQ ID NO: 5816931 - DNA, 20 bp, Homo sapiens
tttttaacactgtcatctgt

SEQ ID NO: 5816932 - DNA, 14 bp, Homo sapiens
tttttaacagcatg

SEQ ID NO: 5816933 - DNA, 16 bp, Homo sapiens
tttttaacatctttgt

SEQ ID NO: 5816934 - DNA, 12 bp, Homo sapiens
tttttaaccaaa

SEQ ID NO: 5816935 - DNA, 23 bp, Homo sapiens
tttttaaccaacagaacccacag

SEQ ID NO: 5816936 - DNA, 22 bp, Homo sapiens
tttttaaccaaggaggggccag

SEQ ID NO: 5816937 - DNA, 12 bp, Homo sapiens
tttttaactgat

SEQ ID NO: 5816938 - DNA, 17 bp, Homo sapiens
tttttaactgcattcta

SEQ ID NO: 5816939 - DNA, 11 bp, Homo sapiens
tttttaactgt

SEQ ID NO: 5816940 - DNA, 14 bp, Homo sapiens
tttttaacttgaaa

SEQ ID NO: 5816941 - DNA, 22 bp, Homo sapiens
tttttaactttaccaaatgaaa

SEQ ID NO: 5816942 - DNA, 17 bp, Homo sapiens
tttttaactttaccatg

SEQ ID NO: 5816943 - DNA, 11 bp, Homo sapiens
tttttaagaaa

SEQ ID NO: 5816944 - DNA, 12 bp, Homo sapiens
tttttaagaaaa

SEQ ID NO: 5816945 - DNA, 16 bp, Homo sapiens
tttttaagaaaacatt

SEQ ID NO: 5816946 - DNA, 20 bp, Homo sapiens
tttttaagaaagtaatttaa

SEQ ID NO: 5816947 - DNA, 16 bp, Homo sapiens
tttttaagaatatctg

SEQ ID NO: 5816948 - DNA, 17 bp, Homo sapiens
tttttaagaatatctgt

SEQ ID NO: 5816949 - DNA, 14 bp, Homo sapiens
tttttaagaatatt

SEQ ID NO: 5816950 - DNA, 16 bp, Homo sapiens
tttttaagaatttatt

SEQ ID NO: 5816951 - DNA, 20 bp, Homo sapiens
tttttaagatagtgtaactt

SEQ ID NO: 5816952 - DNA, 16 bp, Homo sapiens
tttttaagatttttct

SEQ ID NO: 5816953 - DNA, 20 bp, Homo sapiens
tttttaagcctttgaagtgc

SEQ ID NO: 5816954 - DNA, 18 bp, Homo sapiens
tttttaagctatcagcaa

SEQ ID NO: 5816955 - DNA, 14 bp, Homo sapiens
tttttaagctctga

SEQ ID NO: 5816956 - DNA, 20 bp, Homo sapiens
tttttaagctctgagctgtc

SEQ ID NO: 5816957 - DNA, 17 bp, Homo sapiens
tttttaaggctgtgtga

SEQ ID NO: 5816958 - DNA, 20 bp, Homo sapiens
tttttaagggatgttgcaaa

SEQ ID NO: 5816959 - DNA, 20 bp, Homo sapiens
tttttaagggccctttttca

SEQ ID NO: 5816960 - DNA, 21 bp, Homo sapiens
tttttaaggtctaatcagtga

SEQ ID NO: 5816961 - DNA, 18 bp, Homo sapiens
tttttaagtaagactttt

SEQ ID NO: 5816962 - DNA, 19 bp, Homo sapiens
tttttaagtaatttcatgc

SEQ ID NO: 5816963 - DNA, 16 bp, Homo sapiens
tttttaagtgaaattt

SEQ ID NO: 5816964 - DNA, 16 bp, Homo sapiens
tttttaagtgcaacat

SEQ ID NO: 5816965 - DNA, 16 bp, Homo sapiens
tttttaagtgctatgc

SEQ ID NO: 5816966 - DNA, 16 bp, Homo sapiens
tttttaagtgctgcat

SEQ ID NO: 5816967 - DNA, 23 bp, Homo sapiens
tttttaagtgctgcatttaaaag

SEQ ID NO: 5816968 - DNA, 18 bp, Homo sapiens
tttttaagtgtatcttaa

SEQ ID NO: 5816969 - DNA, 16 bp, Homo sapiens
tttttaagttgtcaaa

SEQ ID NO: 5816970 - DNA, 20 bp, Homo sapiens
tttttaataaaaatacacat

SEQ ID NO: 5816971 - DNA, 22 bp, Homo sapiens
tttttaataaaaatacacatga

SEQ ID NO: 5816972 - DNA, 17 bp, Homo sapiens
tttttaataaagacagg

SEQ ID NO: 5816973 - DNA, 16 bp, Homo sapiens
tttttaataaatttca

SEQ ID NO: 5816974 - DNA, 20 bp, Homo sapiens
tttttaatatactaaccatt

SEQ ID NO: 5816975 - DNA, 13 bp, Homo sapiens
tttttaatatgtt

SEQ ID NO: 5816976 - DNA, 17 bp, Homo sapiens
tttttaatcatgaaatt

SEQ ID NO: 5816977 - DNA, 14 bp, Homo sapiens
tttttaatcattta

SEQ ID NO: 5816978 - DNA, 22 bp, Homo sapiens
tttttaatctcttgtcattctc

SEQ ID NO: 5816979 - DNA, 15 bp, Homo sapiens
tttttaatgaccaat

SEQ ID NO: 5816980 - DNA, 10 bp, Homo sapiens
tttttaatgg

SEQ ID NO: 5816981 - DNA, 19 bp, Homo sapiens
tttttaatggttaagaact

SEQ ID NO: 5816982 - DNA, 12 bp, Homo sapiens
tttttaatgtat

SEQ ID NO: 5816983 - DNA, 18 bp, Homo sapiens
tttttaatgtttaaaaag

SEQ ID NO: 5816984 - DNA, 16 bp, Homo sapiens
tttttaattaaaaact

SEQ ID NO: 5816985 - DNA, 12 bp, Homo sapiens
tttttaattatt

SEQ ID NO: 5816986 - DNA, 15 bp, Homo sapiens
tttttaattgcaaca

SEQ ID NO: 5816987 - DNA, 14 bp, Homo sapiens
tttttaatttaaac

SEQ ID NO: 5816988 - DNA, 13 bp, Homo sapiens
tttttaatttaat

SEQ ID NO: 5816989 - DNA, 11 bp, Homo sapiens
tttttaatttc

SEQ ID NO: 5816990 - DNA, 12 bp, Homo sapiens
tttttaatttct

SEQ ID NO: 5816991 - DNA, 21 bp, Homo sapiens
tttttaattttcacaaaatgt

SEQ ID NO: 5816992 - DNA, 17 bp, Homo sapiens
tttttacaaaactgctt

SEQ ID NO: 5816993 - DNA, 21 bp, Homo sapiens
tttttacaaattatgttttaa

SEQ ID NO: 5816994 - DNA, 21 bp, Homo sapiens
tttttacaactatgtaattta

SEQ ID NO: 5816995 - DNA, 13 bp, Homo sapiens
tttttacaagaag

SEQ ID NO: 5816996 - DNA, 20 bp, Homo sapiens
tttttacaagttatagtact

SEQ ID NO: 5816997 - DNA, 13 bp, Homo sapiens
tttttacagctgt

SEQ ID NO: 5816998 - DNA, 19 bp, Homo sapiens
tttttacagctgtgttatt

SEQ ID NO: 5816999 - DNA, 17 bp, Homo sapiens
tttttacattatgcaaa

SEQ ID NO: 5817000 - DNA, 11 bp, Homo sapiens
tttttacattt

SEQ ID NO: 5817001 - DNA, 12 bp, Homo sapiens
tttttacatttt

SEQ ID NO: 5817002 - DNA, 15 bp, Homo sapiens
tttttacattttcct

SEQ ID NO: 5817003 - DNA, 18 bp, Homo sapiens
tttttaccacttctgttt

SEQ ID NO: 5817004 - DNA, 22 bp, Homo sapiens
tttttacccatatcccctctcc

SEQ ID NO: 5817005 - DNA, 13 bp, Homo sapiens
tttttacctaatc

SEQ ID NO: 5817006 - DNA, 15 bp, Homo sapiens
tttttacctgtcaca

SEQ ID NO: 5817007 - DNA, 21 bp, Homo sapiens
tttttacctgtcacattgcat

SEQ ID NO: 5817008 - DNA, 17 bp, Homo sapiens
tttttacggaattccaa

SEQ ID NO: 5817009 - DNA, 18 bp, Homo sapiens
tttttacggaattccaat

SEQ ID NO: 5817010 - DNA, 22 bp, Homo sapiens
tttttacgtagctatttttata

SEQ ID NO: 5817011 - DNA, 15 bp, Homo sapiens
tttttactaaagcag

SEQ ID NO: 5817012 - DNA, 15 bp, Homo sapiens
tttttactagaaatt

SEQ ID NO: 5817013 - DNA, 16 bp, Homo sapiens
tttttactcaaccaaa

SEQ ID NO: 5817014 - DNA, 16 bp, Homo sapiens
tttttactcaggcttt

SEQ ID NO: 5817015 - DNA, 21 bp, Homo sapiens
tttttactcaggctttctatt

SEQ ID NO: 5817016 - DNA, 22 bp, Homo sapiens
tttttactcaggctttctattg

SEQ ID NO: 5817017 - DNA, 21 bp, Homo sapiens
tttttactcattgaaatgtca

SEQ ID NO: 5817018 - DNA, 15 bp, Homo sapiens
tttttactgaaacat

SEQ ID NO: 5817019 - DNA, 14 bp, Homo sapiens
tttttactgaacaa

SEQ ID NO: 5817020 - DNA, 13 bp, Homo sapiens
tttttactgccac

SEQ ID NO: 5817021 - DNA, 13 bp, Homo sapiens
tttttactgccct

SEQ ID NO: 5817022 - DNA, 13 bp, Homo sapiens
tttttactgtatg

SEQ ID NO: 5817023 - DNA, 14 bp, Homo sapiens
tttttactgtatgt

SEQ ID NO: 5817024 - DNA, 18 bp, Homo sapiens
tttttactgtgttttata

SEQ ID NO: 5817025 - DNA, 23 bp, Homo sapiens
tttttactgtttgaaaagaaata

SEQ ID NO: 5817026 - DNA, 13 bp, Homo sapiens
tttttacttgaat

SEQ ID NO: 5817027 - DNA, 17 bp, Homo sapiens
tttttagaacagaaaac

SEQ ID NO: 5817028 - DNA, 12 bp, Homo sapiens
tttttagaattt

SEQ ID NO: 5817029 - DNA, 14 bp, Homo sapiens
tttttagacacctt

SEQ ID NO: 5817030 - DNA, 12 bp, Homo sapiens
tttttagagcat

SEQ ID NO: 5817031 - DNA, 14 bp, Homo sapiens
tttttagagcatta

SEQ ID NO: 5817032 - DNA, 15 bp, Homo sapiens
tttttagagcattaa

SEQ ID NO: 5817033 - DNA, 17 bp, Homo sapiens
tttttagaggtgagttt

SEQ ID NO: 5817034 - DNA, 14 bp, Homo sapiens
tttttagatcaaat

SEQ ID NO: 5817035 - DNA, 15 bp, Homo sapiens
tttttagatcaaata

SEQ ID NO: 5817036 - DNA, 17 bp, Homo sapiens
tttttagatggttacac

SEQ ID NO: 5817037 - DNA, 14 bp, Homo sapiens
tttttagatgtatt

SEQ ID NO: 5817038 - DNA, 20 bp, Homo sapiens
tttttagatgtgctgctttg

SEQ ID NO: 5817039 - DNA, 19 bp, Homo sapiens
tttttagattgagaaatgt

SEQ ID NO: 5817040 - DNA, 14 bp, Homo sapiens
tttttagccattgt

SEQ ID NO: 5817041 - DNA, 15 bp, Homo sapiens
tttttagcttcatat

SEQ ID NO: 5817042 - DNA, 12 bp, Homo sapiens
tttttaggaaaa

SEQ ID NO: 5817043 - DNA, 20 bp, Homo sapiens
tttttaggaagcaagcttaa

SEQ ID NO: 5817044 - DNA, 17 bp, Homo sapiens
tttttaggccacattga

SEQ ID NO: 5817045 - DNA, 22 bp, Homo sapiens
tttttagtaagttaatgtatat

SEQ ID NO: 5817046 - DNA, 13 bp, Homo sapiens
tttttagttcaat

SEQ ID NO: 5817047 - DNA, 18 bp, Homo sapiens
tttttagtttaaaatctt

SEQ ID NO: 5817048 - DNA, 12 bp, Homo sapiens
tttttagttttt

SEQ ID NO: 5817049 - DNA, 12 bp, Homo sapiens
tttttataaaaa

SEQ ID NO: 5817050 - DNA, 20 bp, Homo sapiens
tttttataaaaataaataga

SEQ ID NO: 5817051 - DNA, 12 bp, Homo sapiens
tttttataaaca

SEQ ID NO: 5817052 - DNA, 18 bp, Homo sapiens
tttttataaactaccaaa

SEQ ID NO: 5817053 - DNA, 23 bp, Homo sapiens
tttttataacatctttattgaaa

SEQ ID NO: 5817054 - DNA, 13 bp, Homo sapiens
tttttataataga

SEQ ID NO: 5817055 - DNA, 15 bp, Homo sapiens
tttttataatatcca

SEQ ID NO: 5817056 - DNA, 12 bp, Homo sapiens
tttttatacact

SEQ ID NO: 5817057 - DNA, 17 bp, Homo sapiens
tttttatacatatcaga

SEQ ID NO: 5817058 - DNA, 19 bp, Homo sapiens
tttttatacatatcagaaa

SEQ ID NO: 5817059 - DNA, 15 bp, Homo sapiens
tttttataccattca

SEQ ID NO: 5817060 - DNA, 17 bp, Homo sapiens
tttttataccattcaga

SEQ ID NO: 5817061 - DNA, 12 bp, Homo sapiens
tttttatactcc

SEQ ID NO: 5817062 - DNA, 13 bp, Homo sapiens
tttttatacttca

SEQ ID NO: 5817063 - DNA, 22 bp, Homo sapiens
tttttatacttcaaatgtcatt

SEQ ID NO: 5817064 - DNA, 12 bp, Homo sapiens
tttttatacttt

SEQ ID NO: 5817065 - DNA, 18 bp, Homo sapiens
tttttatagcaacaacaa

SEQ ID NO: 5817066 - DNA, 12 bp, Homo sapiens
tttttataggtt

SEQ ID NO: 5817067 - DNA, 19 bp, Homo sapiens
tttttatagttattaaatg

SEQ ID NO: 5817068 - DNA, 21 bp, Homo sapiens
tttttatatacgtttatataa

SEQ ID NO: 5817069 - DNA, 17 bp, Homo sapiens
tttttatatatgaatat

SEQ ID NO: 5817070 - DNA, 22 bp, Homo sapiens
tttttatatatgaatattacat

SEQ ID NO: 5817071 - DNA, 13 bp, Homo sapiens
tttttatatatta

SEQ ID NO: 5817072 - DNA, 14 bp, Homo sapiens
tttttatatgtgga

SEQ ID NO: 5817073 - DNA, 13 bp, Homo sapiens
tttttatattact

SEQ ID NO: 5817074 - DNA, 22 bp, Homo sapiens
tttttatattacttttgtaaat

SEQ ID NO: 5817075 - DNA, 18 bp, Homo sapiens
tttttatattagttgctt

SEQ ID NO: 5817076 - DNA, 22 bp, Homo sapiens
tttttatattctcagcagagtg

SEQ ID NO: 5817077 - DNA, 20 bp, Homo sapiens
tttttatatttactaaaatg

SEQ ID NO: 5817078 - DNA, 15 bp, Homo sapiens
tttttatatttcctt

SEQ ID NO: 5817079 - DNA, 19 bp, Homo sapiens
tttttatccatttctttta

SEQ ID NO: 5817080 - DNA, 20 bp, Homo sapiens
tttttatcgtcactgcttaa

SEQ ID NO: 5817081 - DNA, 19 bp, Homo sapiens
tttttatctagaacattca

SEQ ID NO: 5817082 - DNA, 17 bp, Homo sapiens
tttttatctttaaatag

SEQ ID NO: 5817083 - DNA, 17 bp, Homo sapiens
tttttatgcagacagtc

SEQ ID NO: 5817084 - DNA, 17 bp, Homo sapiens
tttttatgtaattatat

SEQ ID NO: 5817085 - DNA, 16 bp, Homo sapiens
tttttatgtgatcaat

SEQ ID NO: 5817086 - DNA, 14 bp, Homo sapiens
tttttatgtgcagc

SEQ ID NO: 5817087 - DNA, 13 bp, Homo sapiens
tttttatgttata

SEQ ID NO: 5817088 - DNA, 22 bp, Homo sapiens
tttttattaaacagatatcttc

SEQ ID NO: 5817089 - DNA, 12 bp, Homo sapiens
tttttattaaat

SEQ ID NO: 5817090 - DNA, 13 bp, Homo sapiens
tttttattaaatg

SEQ ID NO: 5817091 - DNA, 15 bp, Homo sapiens
tttttattaatcact

SEQ ID NO: 5817092 - DNA, 21 bp, Homo sapiens
tttttattaggttaagtctca

SEQ ID NO: 5817093 - DNA, 13 bp, Homo sapiens
tttttattatttg

SEQ ID NO: 5817094 - DNA, 23 bp, Homo sapiens
tttttattatttttacctaaaga

SEQ ID NO: 5817095 - DNA, 13 bp, Homo sapiens
tttttattctgtt

SEQ ID NO: 5817096 - DNA, 11 bp, Homo sapiens
tttttattctt

SEQ ID NO: 5817097 - DNA, 14 bp, Homo sapiens
tttttattcttgtg

SEQ ID NO: 5817098 - DNA, 13 bp, Homo sapiens
tttttatttaaat

SEQ ID NO: 5817099 - DNA, 21 bp, Homo sapiens
tttttatttatatgtatgtgt

SEQ ID NO: 5817100 - DNA, 19 bp, Homo sapiens
tttttatttcctatgatgt

SEQ ID NO: 5817101 - DNA, 13 bp, Homo sapiens
tttttatttctaa

SEQ ID NO: 5817102 - DNA, 16 bp, Homo sapiens
tttttatttctactgt

SEQ ID NO: 5817103 - DNA, 19 bp, Homo sapiens
tttttatttctgatagttt

SEQ ID NO: 5817104 - DNA, 20 bp, Homo sapiens
tttttatttcttttgtgcag

SEQ ID NO: 5817105 - DNA, 19 bp, Homo sapiens
tttttatttgtttgtgcat

SEQ ID NO: 5817106 - DNA, 21 bp, Homo sapiens
ttttttacattttcctgtgta

SEQ ID NO: 5817107 - DNA, 20 bp, Homo sapiens
ttttttacggaattccaata

SEQ ID NO: 5817108 - DNA, 12 bp, Homo sapiens
ttttttacttga

SEQ ID NO: 5817109 - DNA, 16 bp, Homo sapiens
ttttttagatcaaata

SEQ ID NO: 5817110 - DNA, 21 bp, Homo sapiens
ttttttagtatttatttatgt

SEQ ID NO: 5817111 - DNA, 22 bp, Homo sapiens
ttttttataaccatgagaattt

SEQ ID NO: 5817112 - DNA, 20 bp, Homo sapiens
ttttttatacactgtaatga

SEQ ID NO: 5817113 - DNA, 12 bp, Homo sapiens
ttttttatcttt

SEQ ID NO: 5817114 - DNA, 13 bp, Homo sapiens
ttttttatgctaa

SEQ ID NO: 5817115 - DNA, 11 bp, Homo sapiens
ttttttatgtt

SEQ ID NO: 5817116 - DNA, 13 bp, Homo sapiens
ttttttattaata

SEQ ID NO: 5817117 - DNA, 21 bp, Homo sapiens
ttttttattagcattctgaaa

SEQ ID NO: 5817118 - DNA, 11 bp, Homo sapiens
ttttttattct

SEQ ID NO: 5817119 - DNA, 13 bp, Homo sapiens
ttttttcaatgta

SEQ ID NO: 5817120 - DNA, 22 bp, Homo sapiens
ttttttcacaatgtgaaactga

SEQ ID NO: 5817121 - DNA, 12 bp, Homo sapiens
ttttttcagacc

SEQ ID NO: 5817122 - DNA, 12 bp, Homo sapiens
ttttttcagttc

SEQ ID NO: 5817123 - DNA, 20 bp, Homo sapiens
ttttttcatgttttaacaaa

SEQ ID NO: 5817124 - DNA, 13 bp, Homo sapiens
ttttttcatttat

SEQ ID NO: 5817125 - DNA, 12 bp, Homo sapiens
ttttttccaaat

SEQ ID NO: 5817126 - DNA, 13 bp, Homo sapiens
ttttttccactta

SEQ ID NO: 5817127 - DNA, 13 bp, Homo sapiens
ttttttccatctt

SEQ ID NO: 5817128 - DNA, 15 bp, Homo sapiens
ttttttcccataaga

SEQ ID NO: 5817129 - DNA, 19 bp, Homo sapiens
ttttttcccttttagttaa

SEQ ID NO: 5817130 - DNA, 20 bp, Homo sapiens
ttttttccgtaaatgtctgc

SEQ ID NO: 5817131 - DNA, 18 bp, Homo sapiens
ttttttcctcctttctct

SEQ ID NO: 5817132 - DNA, 20 bp, Homo sapiens
ttttttccttacataaacat

SEQ ID NO: 5817133 - DNA, 11 bp, Homo sapiens
ttttttccttt

SEQ ID NO: 5817134 - DNA, 19 bp, Homo sapiens
ttttttctaataaagccat

SEQ ID NO: 5817135 - DNA, 23 bp, Homo sapiens
ttttttctcttttaaaatatcct

SEQ ID NO: 5817136 - DNA, 11 bp, Homo sapiens
ttttttctgat

SEQ ID NO: 5817137 - DNA, 13 bp, Homo sapiens
ttttttcttactg

SEQ ID NO: 5817138 - DNA, 12 bp, Homo sapiens
ttttttctttct

SEQ ID NO: 5817139 - DNA, 14 bp, Homo sapiens
ttttttcttttgta

SEQ ID NO: 5817140 - DNA, 16 bp, Homo sapiens
ttttttgaatccaaat

SEQ ID NO: 5817141 - DNA, 13 bp, Homo sapiens
ttttttgactaaa

SEQ ID NO: 5817142 - DNA, 13 bp, Homo sapiens
ttttttgagattt

SEQ ID NO: 5817143 - DNA, 12 bp, Homo sapiens
ttttttgataaa

SEQ ID NO: 5817144 - DNA, 13 bp, Homo sapiens
ttttttgatcctg

SEQ ID NO: 5817145 - DNA, 15 bp, Homo sapiens
ttttttgatggctaa

SEQ ID NO: 5817146 - DNA, 12 bp, Homo sapiens
ttttttggccta

SEQ ID NO: 5817147 - DNA, 16 bp, Homo sapiens
ttttttgggcagcaat

SEQ ID NO: 5817148 - DNA, 14 bp, Homo sapiens
ttttttggtaatta

SEQ ID NO: 5817149 - DNA, 13 bp, Homo sapiens
ttttttggtacaa

SEQ ID NO: 5817150 - DNA, 16 bp, Homo sapiens
ttttttggtacaaaaa

SEQ ID NO: 5817151 - DNA, 13 bp, Homo sapiens
ttttttggtataa

SEQ ID NO: 5817152 - DNA, 13 bp, Homo sapiens
ttttttgtaaact

SEQ ID NO: 5817153 - DNA, 13 bp, Homo sapiens
ttttttgtaccaa

SEQ ID NO: 5817154 - DNA, 13 bp, Homo sapiens
ttttttgtatatt

SEQ ID NO: 5817155 - DNA, 13 bp, Homo sapiens
ttttttgtatgtg

SEQ ID NO: 5817156 - DNA, 13 bp, Homo sapiens
ttttttgtattat

SEQ ID NO: 5817157 - DNA, 13 bp, Homo sapiens
ttttttgtatttc

SEQ ID NO: 5817158 - DNA, 12 bp, Homo sapiens
ttttttgtcaac

SEQ ID NO: 5817159 - DNA, 14 bp, Homo sapiens
ttttttgtctgtga

SEQ ID NO: 5817160 - DNA, 16 bp, Homo sapiens
ttttttgtttgtttct

SEQ ID NO: 5817161 - DNA, 14 bp, Homo sapiens
tttttttaactggt

SEQ ID NO: 5817162 - DNA, 14 bp, Homo sapiens
tttttttaactgtg

SEQ ID NO: 5817163 - DNA, 13 bp, Homo sapiens
tttttttaagaca

SEQ ID NO: 5817164 - DNA, 12 bp, Homo sapiens
tttttttaagtg

SEQ ID NO: 5817165 - DNA, 19 bp, Homo sapiens
tttttttacggaattccaa

SEQ ID NO: 5817166 - DNA, 12 bp, Homo sapiens
tttttttcagtg

SEQ ID NO: 5817167 - DNA, 12 bp, Homo sapiens
tttttttccctt

SEQ ID NO: 5817168 - DNA, 10 bp, Homo sapiens
tttttttccg

SEQ ID NO: 5817169 - DNA, 12 bp, Homo sapiens
tttttttcctga

SEQ ID NO: 5817170 - DNA, 14 bp, Homo sapiens
tttttttctaagag

SEQ ID NO: 5817171 - DNA, 13 bp, Homo sapiens
tttttttctagct

SEQ ID NO: 5817172 - DNA, 13 bp, Homo sapiens
tttttttctgatt

SEQ ID NO: 5817173 - DNA, 13 bp, Homo sapiens
tttttttctgttt

SEQ ID NO: 5817174 - DNA, 12 bp, Homo sapiens
tttttttcttta

SEQ ID NO: 5817175 - DNA, 10 bp, Homo sapiens
tttttttgtc

SEQ ID NO: 5817176 - DNA, 12 bp, Homo sapiens
tttttttgtgtg

SEQ ID NO: 5817177 - DNA, 14 bp, Homo sapiens
ttttttttaaacaa

SEQ ID NO: 5817178 - DNA, 13 bp, Homo sapiens
ttttttttaacat

SEQ ID NO: 5817179 - DNA, 11 bp, Homo sapiens
ttttttttcag

SEQ ID NO: 5817180 - DNA, 13 bp, Homo sapiens
ttttttttccaaa

SEQ ID NO: 5817181 - DNA, 14 bp, Homo sapiens
ttttttttctgaat

SEQ ID NO: 5817182 - DNA, 12 bp, Homo sapiens
ttttttttgcag

SEQ ID NO: 5817183 - DNA, 11 bp, Homo sapiens
ttttttttggt

SEQ ID NO: 5817184 - DNA, 13 bp, Homo sapiens
ttttttttgtaaa

SEQ ID NO: 5817185 - DNA, 14 bp, Homo sapiens
ttttttttgtttgt

SEQ ID NO: 5817186 - DNA, 13 bp, Homo sapiens
tttttttttaaac

SEQ ID NO: 5817187 - DNA, 14 bp, Homo sapiens
tttttttttaaata

SEQ ID NO: 5817188 - DNA, 13 bp, Homo sapiens
tttttttttaagt

SEQ ID NO: 5817189 - DNA, 13 bp, Homo sapiens
tttttttttgagg

SEQ ID NO: 5817190 - DNA, 13 bp, Homo sapiens
ttttttttttcca

SEQ ID NO: 5817191 - DNA, 11 bp, Homo sapiens
aaaaattaaaa

SEQ ID NO: 5817192 - DNA, 18 bp, Homo sapiens
aaaaattaaaacgaaaat

SEQ ID NO: 5817193 - DNA, 19 bp, Homo sapiens
aaaaattaaaagaaggaat

SEQ ID NO: 5817194 - DNA, 13 bp, Homo sapiens
aaaaattaaaatg

SEQ ID NO: 5817195 - DNA, 19 bp, Homo sapiens
aaaaattaaaccaagcagc

SEQ ID NO: 5817196 - DNA, 20 bp, Homo sapiens
aaaaattaaaccaagcagct

SEQ ID NO: 5817197 - DNA, 15 bp, Homo sapiens
aaaaattaaattgta

SEQ ID NO: 5817198 - DNA, 12 bp, Homo sapiens
aaaaattaactg

SEQ ID NO: 5817199 - DNA, 15 bp, Homo sapiens
aaaaattaacttttt

SEQ ID NO: 5817200 - DNA, 18 bp, Homo sapiens
aaaaattaagagatacat

SEQ ID NO: 5817201 - DNA, 19 bp, Homo sapiens
aaaaattaagagatacatt

SEQ ID NO: 5817202 - DNA, 15 bp, Homo sapiens
aaaaattaagtcttc

SEQ ID NO: 5817203 - DNA, 14 bp, Homo sapiens
aaaaattaattctt

SEQ ID NO: 5817204 - DNA, 21 bp, Homo sapiens
aaaaattacaaagaaaataat

SEQ ID NO: 5817205 - DNA, 20 bp, Homo sapiens
aaaaattacctttaatttta

SEQ ID NO: 5817206 - DNA, 23 bp, Homo sapiens
aaaaattacctttaattttaatg

SEQ ID NO: 5817207 - DNA, 14 bp, Homo sapiens
aaaaattactaatt

SEQ ID NO: 5817208 - DNA, 11 bp, Homo sapiens
aaaaattactg

SEQ ID NO: 5817209 - DNA, 13 bp, Homo sapiens
aaaaattagctga

SEQ ID NO: 5817210 - DNA, 19 bp, Homo sapiens
aaaaattagtgaagttctt

SEQ ID NO: 5817211 - DNA, 14 bp, Homo sapiens
aaaaattatcagtt

SEQ ID NO: 5817212 - DNA, 19 bp, Homo sapiens
aaaaattatctatagctaa

SEQ ID NO: 5817213 - DNA, 16 bp, Homo sapiens
aaaaattatgaaatat

SEQ ID NO: 5817214 - DNA, 14 bp, Homo sapiens
aaaaattattcatg

SEQ ID NO: 5817215 - DNA, 16 bp, Homo sapiens
aaaaattattcccatg

SEQ ID NO: 5817216 - DNA, 21 bp, Homo sapiens
aaaaattatttgccttttaaa

SEQ ID NO: 5817217 - DNA, 15 bp, Homo sapiens
aaaaattcaatagta

SEQ ID NO: 5817218 - DNA, 14 bp, Homo sapiens
aaaaattcacataa

SEQ ID NO: 5817219 - DNA, 22 bp, Homo sapiens
aaaaattcagcaaaccattttt

SEQ ID NO: 5817220 - DNA, 13 bp, Homo sapiens
aaaaattccagaa

SEQ ID NO: 5817221 - DNA, 18 bp, Homo sapiens
aaaaattcctaagaatca

SEQ ID NO: 5817222 - DNA, 16 bp, Homo sapiens
aaaaattctgatacat

SEQ ID NO: 5817223 - DNA, 18 bp, Homo sapiens
aaaaattctgatacatta

SEQ ID NO: 5817224 - DNA, 22 bp, Homo sapiens
aaaaattctgcccccacctaga

SEQ ID NO: 5817225 - DNA, 20 bp, Homo sapiens
aaaaattctgttgttccatt

SEQ ID NO: 5817226 - DNA, 20 bp, Homo sapiens
aaaaattgaaaaataaaaac

SEQ ID NO: 5817227 - DNA, 14 bp, Homo sapiens
aaaaattgaaagaa

SEQ ID NO: 5817228 - DNA, 17 bp, Homo sapiens
aaaaattgaaataaata

SEQ ID NO: 5817229 - DNA, 10 bp, Homo sapiens
aaaaattgca

SEQ ID NO: 5817230 - DNA, 15 bp, Homo sapiens
aaaaattgcacaatt

SEQ ID NO: 5817231 - DNA, 16 bp, Homo sapiens
aaaaattgctctgtgt

SEQ ID NO: 5817232 - DNA, 15 bp, Homo sapiens
aaaaattgctgactg

SEQ ID NO: 5817233 - DNA, 17 bp, Homo sapiens
aaaaattggggattctt

SEQ ID NO: 5817234 - DNA, 21 bp, Homo sapiens
aaaaattgtattgaaaacact

SEQ ID NO: 5817235 - DNA, 14 bp, Homo sapiens
aaaaattgtcttca

SEQ ID NO: 5817236 - DNA, 11 bp, Homo sapiens
aaaaattgttt

SEQ ID NO: 5817237 - DNA, 12 bp, Homo sapiens
aaaaattgtttt

SEQ ID NO: 5817238 - DNA, 23 bp, Homo sapiens
aaaaatttaactccatatgtgtt

SEQ ID NO: 5817239 - DNA, 18 bp, Homo sapiens
aaaaatttaagcattgtt

SEQ ID NO: 5817240 - DNA, 22 bp, Homo sapiens
aaaaatttaagcattgtttgct

SEQ ID NO: 5817241 - DNA, 17 bp, Homo sapiens
aaaaatttacaagagaa

SEQ ID NO: 5817242 - DNA, 19 bp, Homo sapiens
aaaaatttactttaaacta

SEQ ID NO: 5817243 - DNA, 14 bp, Homo sapiens
aaaaatttataaca

SEQ ID NO: 5817244 - DNA, 12 bp, Homo sapiens
aaaaatttatta

SEQ ID NO: 5817245 - DNA, 13 bp, Homo sapiens
aaaaatttattat

SEQ ID NO: 5817246 - DNA, 11 bp, Homo sapiens
aaaaatttcac

SEQ ID NO: 5817247 - DNA, 21 bp, Homo sapiens
aaaaatttgacgcttgcttag

SEQ ID NO: 5817248 - DNA, 23 bp, Homo sapiens
aaaaatttgtctgaaacatttca

SEQ ID NO: 5817249 - DNA, 14 bp, Homo sapiens
aaaaatttgtttaa

SEQ ID NO: 5817250 - DNA, 14 bp, Homo sapiens
aaaaattttgtaat

SEQ ID NO: 5817251 - DNA, 17 bp, Homo sapiens
aaaaatttttataaatt

SEQ ID NO: 5817252 - DNA, 18 bp, Homo sapiens
aaaaatttttataaatta

SEQ ID NO: 5817253 - DNA, 15 bp, Homo sapiens
aaaaatttttgcaaa

SEQ ID NO: 5817254 - DNA, 21 bp, Homo sapiens
aaaaatttttggattgacagt

SEQ ID NO: 5817255 - DNA, 14 bp, Homo sapiens
aaaaatttttgttt

SEQ ID NO: 5817256 - DNA, 23 bp, Homo sapiens
aaaaattttttgattaatgaaga

SEQ ID NO: 5817257 - DNA, 18 bp, Homo sapiens
aaaacaaaaaaacccagg

SEQ ID NO: 5817258 - DNA, 17 bp, Homo sapiens
aaaacaaaaaaagacaa

SEQ ID NO: 5817259 - DNA, 18 bp, Homo sapiens
aaaacaaaaaaatttaaa

SEQ ID NO: 5817260 - DNA, 14 bp, Homo sapiens
aaaacaaaaaacaa

SEQ ID NO: 5817261 - DNA, 14 bp, Homo sapiens
aaaacaaaaagaca

SEQ ID NO: 5817262 - DNA, 23 bp, Homo sapiens
aaaacaaaaattcacaagctgcc

SEQ ID NO: 5817263 - DNA, 10 bp, Homo sapiens
aaaacaaaac

SEQ ID NO: 5817264 - DNA, 11 bp, Homo sapiens
aaaacaaaaca

SEQ ID NO: 5817265 - DNA, 13 bp, Homo sapiens
aaaacaaaacaaa

SEQ ID NO: 5817266 - DNA, 14 bp, Homo sapiens
aaaacaaaacaaaa

SEQ ID NO: 5817267 - DNA, 17 bp, Homo sapiens
aaaacaaaaccaagcct

SEQ ID NO: 5817268 - DNA, 20 bp, Homo sapiens
aaaacaaaaccaagccttgg

SEQ ID NO: 5817269 - DNA, 11 bp, Homo sapiens
aaaacaaaaga

SEQ ID NO: 5817270 - DNA, 16 bp, Homo sapiens
aaaacaaaagagagaa

SEQ ID NO: 5817271 - DNA, 15 bp, Homo sapiens
aaaacaaaatctaaa

SEQ ID NO: 5817272 - DNA, 12 bp, Homo sapiens
aaaacaaaattt

SEQ ID NO: 5817273 - DNA, 19 bp, Homo sapiens
aaaacaaacaaatcaaaca

SEQ ID NO: 5817274 - DNA, 16 bp, Homo sapiens
aaaacaaacacacaca

SEQ ID NO: 5817275 - DNA, 12 bp, Homo sapiens
aaaacaaacatg

SEQ ID NO: 5817276 - DNA, 20 bp, Homo sapiens
aaaacaaagcaattctttca

SEQ ID NO: 5817277 - DNA, 23 bp, Homo sapiens
aaaacaaaggagcattaagccca

SEQ ID NO: 5817278 - DNA, 19 bp, Homo sapiens
aaaacaaagggaaaaaaga

SEQ ID NO: 5817279 - DNA, 17 bp, Homo sapiens
aaaacaaagtgcaaagc

SEQ ID NO: 5817280 - DNA, 16 bp, Homo sapiens
aaaacaaataaatatg

SEQ ID NO: 5817281 - DNA, 18 bp, Homo sapiens
aaaacaaattcaaataat

SEQ ID NO: 5817282 - DNA, 15 bp, Homo sapiens
aaaacaacagcaaca

SEQ ID NO: 5817283 - DNA, 22 bp, Homo sapiens
aaaacaaccgtcctgctgtccc

SEQ ID NO: 5817284 - DNA, 22 bp, Homo sapiens
aaaacaacttaataaaaactta

SEQ ID NO: 5817285 - DNA, 19 bp, Homo sapiens
aaaacaacttggcatttct

SEQ ID NO: 5817286 - DNA, 20 bp, Homo sapiens
aaaacaacttggcatttcta

SEQ ID NO: 5817287 - DNA, 12 bp, Homo sapiens
aaaacaacttta

SEQ ID NO: 5817288 - DNA, 12 bp, Homo sapiens
aaaacaagaaac

SEQ ID NO: 5817289 - DNA, 13 bp, Homo sapiens
aaaacaagaaaga

SEQ ID NO: 5817290 - DNA, 18 bp, Homo sapiens
aaaacaagacagactcga

SEQ ID NO: 5817291 - DNA, 20 bp, Homo sapiens
aaaacaagagaccacttcct

SEQ ID NO: 5817292 - DNA, 19 bp, Homo sapiens
aaaacccctaggtcatttg

SEQ ID NO: 5817293 - DNA, 20 bp, Homo sapiens
aaaaccctaagtgtggatgt

SEQ ID NO: 5817294 - DNA, 19 bp, Homo sapiens
aaaaccctatatgcttact

SEQ ID NO: 5817295 - DNA, 19 bp, Homo sapiens
aaaaccctcgatgttcatg

SEQ ID NO: 5817296 - DNA, 23 bp, Homo sapiens
aaaaccctcgatgttcatggaat

SEQ ID NO: 5817297 - DNA, 15 bp, Homo sapiens
aaaaccctgccccca

SEQ ID NO: 5817298 - DNA, 16 bp, Homo sapiens
aaaacccttgggccag

SEQ ID NO: 5817299 - DNA, 15 bp, Homo sapiens
aaaaccgaataaatg

SEQ ID NO: 5817300 - DNA, 23 bp, Homo sapiens
aaaaccgagataggggagggggg

SEQ ID NO: 5817301 - DNA, 20 bp, Homo sapiens
aaaaccggcaacctgtaact

SEQ ID NO: 5817302 - DNA, 19 bp, Homo sapiens
aaaaccgtgtttgtctctt

SEQ ID NO: 5817303 - DNA, 20 bp, Homo sapiens
aaaaccgttcaaattctctt

SEQ ID NO: 5817304 - DNA, 20 bp, Homo sapiens
aaaacctacacacatacctt

SEQ ID NO: 5817305 - DNA, 12 bp, Homo sapiens
aaaacctaccag

SEQ ID NO: 5817306 - DNA, 22 bp, Homo sapiens
aaaacctagaacttcaaaatgt

SEQ ID NO: 5817307 - DNA, 14 bp, Homo sapiens
aaaacctattttga

SEQ ID NO: 5817308 - DNA, 11 bp, Homo sapiens
aaaacctcagt

SEQ ID NO: 5817309 - DNA, 20 bp, Homo sapiens
aaaacctcagttggcctctg

SEQ ID NO: 5817310 - DNA, 21 bp, Homo sapiens
aaaacctcagttggcctctgc

SEQ ID NO: 5817311 - DNA, 18 bp, Homo sapiens
aaaacctgaactttcatt

SEQ ID NO: 5817312 - DNA, 15 bp, Homo sapiens
aaaacctgagattta

SEQ ID NO: 5817313 - DNA, 21 bp, Homo sapiens
aaaacctgattggccactgga

SEQ ID NO: 5817314 - DNA, 13 bp, Homo sapiens
aaaacctgcctaa

SEQ ID NO: 5817315 - DNA, 22 bp, Homo sapiens
aaaacctgcctaaattaaattg

SEQ ID NO: 5817316 - DNA, 14 bp, Homo sapiens
aaaacctggagtgc

SEQ ID NO: 5817317 - DNA, 17 bp, Homo sapiens
aaaacctgtcaatgata

SEQ ID NO: 5817318 - DNA, 22 bp, Homo sapiens
aaaacctgtttttaacatgtga

SEQ ID NO: 5817319 - DNA, 15 bp, Homo sapiens
aaaaccttaaaagta

SEQ ID NO: 5817320 - DNA, 12 bp, Homo sapiens
aaaaccttcctt

SEQ ID NO: 5817321 - DNA, 15 bp, Homo sapiens
aaaaccttccttccc

SEQ ID NO: 5817322 - DNA, 18 bp, Homo sapiens
aaaaccttgatttaaaat

SEQ ID NO: 5817323 - DNA, 13 bp, Homo sapiens
aaaaccttgtaaa

SEQ ID NO: 5817324 - DNA, 22 bp, Homo sapiens
aaaaccttgtaaaaaaagcaaa

SEQ ID NO: 5817325 - DNA, 14 bp, Homo sapiens
aaaacctttattct

SEQ ID NO: 5817326 - DNA, 14 bp, Homo sapiens
aaaaccttttgaaa

SEQ ID NO: 5817327 - DNA, 14 bp, Homo sapiens
aaaacgaaaacagt

SEQ ID NO: 5817328 - DNA, 13 bp, Homo sapiens
aaaacgagataag

SEQ ID NO: 5817329 - DNA, 16 bp, Homo sapiens
aaaacgcgcagatgtg

SEQ ID NO: 5817330 - DNA, 17 bp, Homo sapiens
aaaacgcgcagatgtgc

SEQ ID NO: 5817331 - DNA, 19 bp, Homo sapiens
aaaacggatgagttattat

SEQ ID NO: 5817332 - DNA, 16 bp, Homo sapiens
aaaacggccctcttga

SEQ ID NO: 5817333 - DNA, 20 bp, Homo sapiens
aaaacgggttactaagatga

SEQ ID NO: 5817334 - DNA, 14 bp, Homo sapiens
aaaacggtgctttc

SEQ ID NO: 5817335 - DNA, 22 bp, Homo sapiens
aaaacgtgatgttttgaatgtg

SEQ ID NO: 5817336 - DNA, 14 bp, Homo sapiens
aaaacgtggctgct

SEQ ID NO: 5817337 - DNA, 23 bp, Homo sapiens
aaaacgttttatgtgaatgtggc

SEQ ID NO: 5817338 - DNA, 16 bp, Homo sapiens
aaaacgttttattgtg

SEQ ID NO: 5817339 - DNA, 19 bp, Homo sapiens
aaaacgttttattgtgttt

SEQ ID NO: 5817340 - DNA, 17 bp, Homo sapiens
aaaactaaaatcattgt

SEQ ID NO: 5817341 - DNA, 22 bp, Homo sapiens
aaaactaaatagcatgtattgt

SEQ ID NO: 5817342 - DNA, 13 bp, Homo sapiens
aaaactaaatgtg

SEQ ID NO: 5817343 - DNA, 19 bp, Homo sapiens
aaaactaaatgtgtacaca

SEQ ID NO: 5817344 - DNA, 13 bp, Homo sapiens
aaaactaaattta

SEQ ID NO: 5817345 - DNA, 14 bp, Homo sapiens
aaaactaaatttat

SEQ ID NO: 5817346 - DNA, 15 bp, Homo sapiens
aaaactaagcacaaa

SEQ ID NO: 5817347 - DNA, 12 bp, Homo sapiens
aaaactactttt

SEQ ID NO: 5817348 - DNA, 23 bp, Homo sapiens
aaaactagagctctaagcccatt

SEQ ID NO: 5817349 - DNA, 20 bp, Homo sapiens
aaaactagataacttaaata

SEQ ID NO: 5817350 - DNA, 22 bp, Homo sapiens
aaaactagataacttaaataat

SEQ ID NO: 5817351 - DNA, 15 bp, Homo sapiens
aaaactagcaactct

SEQ ID NO: 5817352 - DNA, 17 bp, Homo sapiens
aaaactaggctcaaaat

SEQ ID NO: 5817353 - DNA, 22 bp, Homo sapiens
aaaactagggctcattttcctg

SEQ ID NO: 5817354 - DNA, 15 bp, Homo sapiens
aaaactagtaaaact

SEQ ID NO: 5817355 - DNA, 13 bp, Homo sapiens
aaaactatacaac

SEQ ID NO: 5817356 - DNA, 14 bp, Homo sapiens
aaaactatcctgat

SEQ ID NO: 5817357 - DNA, 19 bp, Homo sapiens
aaaactatgacaatttttg

SEQ ID NO: 5817358 - DNA, 21 bp, Homo sapiens
aaaactatgacaatttttgct

SEQ ID NO: 5817359 - DNA, 22 bp, Homo sapiens
aaaactatgacaatttttgctg

SEQ ID NO: 5817360 - DNA, 12 bp, Homo sapiens
aaaactatggtt

SEQ ID NO: 5817361 - DNA, 20 bp, Homo sapiens
aaaactatgtattaatttag

SEQ ID NO: 5817362 - DNA, 16 bp, Homo sapiens
aaaactatgttcagaa

SEQ ID NO: 5817363 - DNA, 16 bp, Homo sapiens
aaaactattcatgcta

SEQ ID NO: 5817364 - DNA, 18 bp, Homo sapiens
aaaactattgagccttgc

SEQ ID NO: 5817365 - DNA, 20 bp, Homo sapiens
aaaactatttaaaattggca

SEQ ID NO: 5817366 - DNA, 14 bp, Homo sapiens
aaaactatttaaca

SEQ ID NO: 5817367 - DNA, 15 bp, Homo sapiens
aaaactatttgtata

SEQ ID NO: 5817368 - DNA, 23 bp, Homo sapiens
aaaactcaaccaaatggtacaaa

SEQ ID NO: 5817369 - DNA, 16 bp, Homo sapiens
aaaactcaccatttca

SEQ ID NO: 5817370 - DNA, 19 bp, Homo sapiens
aaaactcactcactgttta

SEQ ID NO: 5817371 - DNA, 14 bp, Homo sapiens
aaaactcactgtga

SEQ ID NO: 5817372 - DNA, 13 bp, Homo sapiens
aaaactcataatt

SEQ ID NO: 5817373 - DNA, 19 bp, Homo sapiens
aaaactcatcacataaaga

SEQ ID NO: 5817374 - DNA, 15 bp, Homo sapiens
aaaactcatgatcaa

SEQ ID NO: 5817375 - DNA, 16 bp, Homo sapiens
aaaactccactcagca

SEQ ID NO: 5817376 - DNA, 21 bp, Homo sapiens
aaaactccagggtcccctgcc

SEQ ID NO: 5817377 - DNA, 17 bp, Homo sapiens
aaaactcccaatggata

SEQ ID NO: 5817378 - DNA, 19 bp, Homo sapiens
aaaactccgcccccagcct

SEQ ID NO: 5817379 - DNA, 20 bp, Homo sapiens
aaaactccgcccccagccta

SEQ ID NO: 5817380 - DNA, 13 bp, Homo sapiens
aaaactcctgtgt

SEQ ID NO: 5817381 - DNA, 21 bp, Homo sapiens
aaaactcctgttttcacacct

SEQ ID NO: 5817382 - DNA, 14 bp, Homo sapiens
aaaactcgaaaata

SEQ ID NO: 5817383 - DNA, 14 bp, Homo sapiens
aaaactcgctttta

SEQ ID NO: 5817384 - DNA, 21 bp, Homo sapiens
aaaactctacttaatccaatg

SEQ ID NO: 5817385 - DNA, 19 bp, Homo sapiens
aaaactctatttttgtaaa

SEQ ID NO: 5817386 - DNA, 17 bp, Homo sapiens
aaaactctctcccagga

SEQ ID NO: 5817387 - DNA, 21 bp, Homo sapiens
aaaactcttatggccaaattc

SEQ ID NO: 5817388 - DNA, 14 bp, Homo sapiens
aaaactcttggcct

SEQ ID NO: 5817389 - DNA, 19 bp, Homo sapiens
aaaactcttggcctctgct

SEQ ID NO: 5817390 - DNA, 13 bp, Homo sapiens
aaaactctttaac

SEQ ID NO: 5817391 - DNA, 12 bp, Homo sapiens
aaaactctttta

SEQ ID NO: 5817392 - DNA, 19 bp, Homo sapiens
aaaactcttttgacctgta

SEQ ID NO: 5817393 - DNA, 12 bp, Homo sapiens
aaaactgaaata

SEQ ID NO: 5817394 - DNA, 14 bp, Homo sapiens
aaaactgaaggttt

SEQ ID NO: 5817395 - DNA, 15 bp, Homo sapiens
aaaactgaagtctga

SEQ ID NO: 5817396 - DNA, 13 bp, Homo sapiens
aaaactgaatctc

SEQ ID NO: 5817397 - DNA, 23 bp, Homo sapiens
aaaactgacatcagatttcttaa

SEQ ID NO: 5817398 - DNA, 16 bp, Homo sapiens
aaaactgacttaatgc

SEQ ID NO: 5817399 - DNA, 19 bp, Homo sapiens
aaaactgagtccatgaaaa

SEQ ID NO: 5817400 - DNA, 20 bp, Homo sapiens
aaaactgagtccatgaaaat

SEQ ID NO: 5817401 - DNA, 21 bp, Homo sapiens
aaaactgagtccatgaaaata

SEQ ID NO: 5817402 - DNA, 15 bp, Homo sapiens
aaaactgatgtgaaa

SEQ ID NO: 5817403 - DNA, 18 bp, Homo sapiens
aaaactgattgaatgata

SEQ ID NO: 5817404 - DNA, 16 bp, Homo sapiens
aaaactgcacagtgct

SEQ ID NO: 5817405 - DNA, 18 bp, Homo sapiens
aaaactgcacagtgctgt

SEQ ID NO: 5817406 - DNA, 11 bp, Homo sapiens
aaaactgccac

SEQ ID NO: 5817407 - DNA, 12 bp, Homo sapiens
aaaactgccaca

SEQ ID NO: 5817408 - DNA, 18 bp, Homo sapiens
aaaactgccacaagcaca

SEQ ID NO: 5817409 - DNA, 22 bp, Homo sapiens
aaaactgcctgacaattatgaa

SEQ ID NO: 5817410 - DNA, 22 bp, Homo sapiens
aaaactgctcatttcatgaagc

SEQ ID NO: 5817411 - DNA, 23 bp, Homo sapiens
aaaactgctgactgttttctctt

SEQ ID NO: 5817412 - DNA, 13 bp, Homo sapiens
aaaactgctgtaa

SEQ ID NO: 5817413 - DNA, 14 bp, Homo sapiens
aaaactgctgtaaa

SEQ ID NO: 5817414 - DNA, 19 bp, Homo sapiens
aaaactggacctgtatatt

SEQ ID NO: 5817415 - DNA, 13 bp, Homo sapiens
aaaactggctttt

SEQ ID NO: 5817416 - DNA, 14 bp, Homo sapiens
aaaactggcttttt

SEQ ID NO: 5817417 - DNA, 19 bp, Homo sapiens
aaaactgggataactgatt

SEQ ID NO: 5817418 - DNA, 21 bp, Homo sapiens
aaaactgggataactgatttc

SEQ ID NO: 5817419 - DNA, 22 bp, Homo sapiens
aaaactgggataactgatttct

SEQ ID NO: 5817420 - DNA, 19 bp, Homo sapiens
aaaactgggcctgtagctc

SEQ ID NO: 5817421 - DNA, 20 bp, Homo sapiens
aaaactggtgggtctttaat

SEQ ID NO: 5817422 - DNA, 11 bp, Homo sapiens
aaaactgtaaa

SEQ ID NO: 5817423 - DNA, 17 bp, Homo sapiens
aaaactgtacatttaaa

SEQ ID NO: 5817424 - DNA, 20 bp, Homo sapiens
aaaactgtacatttaaaatt

SEQ ID NO: 5817425 - DNA, 15 bp, Homo sapiens
aaaactgtataagga

SEQ ID NO: 5817426 - DNA, 23 bp, Homo sapiens
aaaactgtattgaaaaaatattg

SEQ ID NO: 5817427 - DNA, 10 bp, Homo sapiens
aaaactgtga

SEQ ID NO: 5817428 - DNA, 11 bp, Homo sapiens
aaaactgtgac

SEQ ID NO: 5817429 - DNA, 21 bp, Homo sapiens
aaaactgtgacattccacaga

SEQ ID NO: 5817430 - DNA, 15 bp, Homo sapiens
aaaactgtgtaaacc

SEQ ID NO: 5817431 - DNA, 22 bp, Homo sapiens
aaaactgtgtatcattaaaata

SEQ ID NO: 5817432 - DNA, 23 bp, Homo sapiens
aaaactgtgtatcattaaaatat

SEQ ID NO: 5817433 - DNA, 20 bp, Homo sapiens
aaaactgttcttttgcattt

SEQ ID NO: 5817434 - DNA, 12 bp, Homo sapiens
aaaactgtttat

SEQ ID NO: 5817435 - DNA, 18 bp, Homo sapiens
aaaacttaaaaattaata

SEQ ID NO: 5817436 - DNA, 21 bp, Homo sapiens
aaaacttatgctgatttattt

SEQ ID NO: 5817437 - DNA, 11 bp, Homo sapiens
aaaacttcaaa

SEQ ID NO: 5817438 - DNA, 17 bp, Homo sapiens
aaaacttcactccaaag

SEQ ID NO: 5817439 - DNA, 18 bp, Homo sapiens
aaaacttcactccaaaga

SEQ ID NO: 5817440 - DNA, 20 bp, Homo sapiens
aaaacttcactccaaagaga

SEQ ID NO: 5817441 - DNA, 21 bp, Homo sapiens
aaaacttcactccaaagagaa

SEQ ID NO: 5817442 - DNA, 13 bp, Homo sapiens
aaaacttcagaga

SEQ ID NO: 5817443 - DNA, 17 bp, Homo sapiens
aaaacttcatgtaattt

SEQ ID NO: 5817444 - DNA, 21 bp, Homo sapiens
aaaacttcattctaaaccaaa

SEQ ID NO: 5817445 - DNA, 23 bp, Homo sapiens
aaaacttccattctttcttcctc

SEQ ID NO: 5817446 - DNA, 20 bp, Homo sapiens
aaaacttcgtaagaacatgt

SEQ ID NO: 5817447 - DNA, 23 bp, Homo sapiens
aaaacttcgtgcatttgttacag

SEQ ID NO: 5817448 - DNA, 20 bp, Homo sapiens
aaaacttcgtttaatgaatg

SEQ ID NO: 5817449 - DNA, 17 bp, Homo sapiens
aaaacttctcttctgag

SEQ ID NO: 5817450 - DNA, 12 bp, Homo sapiens
aaaacttctgct

SEQ ID NO: 5817451 - DNA, 20 bp, Homo sapiens
aaaacttcttagaaaattaa

SEQ ID NO: 5817452 - DNA, 18 bp, Homo sapiens
aaaacttgacatgtagct

SEQ ID NO: 5817453 - DNA, 21 bp, Homo sapiens
aaaacttgctgaaaaacacaa

SEQ ID NO: 5817454 - DNA, 14 bp, Homo sapiens
aaaacttggcactt

SEQ ID NO: 5817455 - DNA, 19 bp, Homo sapiens
aaaacttggttttatggtt

SEQ ID NO: 5817456 - DNA, 22 bp, Homo sapiens
aaaacttgtgtgaaattttctt

SEQ ID NO: 5817457 - DNA, 17 bp, Homo sapiens
aaaactttaaaaggcaa

SEQ ID NO: 5817458 - DNA, 15 bp, Homo sapiens
aaaactttaaacctg

SEQ ID NO: 5817459 - DNA, 14 bp, Homo sapiens
aaaactttaaagat

SEQ ID NO: 5817460 - DNA, 13 bp, Homo sapiens
aaaactttaaagc

SEQ ID NO: 5817461 - DNA, 18 bp, Homo sapiens
aaaactttattaaaagaa

SEQ ID NO: 5817462 - DNA, 12 bp, Homo sapiens
aaaactttattg

SEQ ID NO: 5817463 - DNA, 16 bp, Homo sapiens
aaaactttatttaaaa

SEQ ID NO: 5817464 - DNA, 17 bp, Homo sapiens
aaaactttattttatat

SEQ ID NO: 5817465 - DNA, 19 bp, Homo sapiens
aaaactttattttatataa

SEQ ID NO: 5817466 - DNA, 23 bp, Homo sapiens
aaaactttattttatataataaa

SEQ ID NO: 5817467 - DNA, 14 bp, Homo sapiens
aaaactttcagaga

SEQ ID NO: 5817468 - DNA, 16 bp, Homo sapiens
aaaactttcctcgcct

SEQ ID NO: 5817469 - DNA, 24 bp, Homo sapiens
aaaactttgacgagtcaccttcca

SEQ ID NO: 5817470 - DNA, 17 bp, Homo sapiens
aaaagatttgttttgtc

SEQ ID NO: 5817471 - DNA, 12 bp, Homo sapiens
aaaagattttat

SEQ ID NO: 5817472 - DNA, 13 bp, Homo sapiens
aaaagattttatg

SEQ ID NO: 5817473 - DNA, 15 bp, Homo sapiens
aaaagattttattta

SEQ ID NO: 5817474 - DNA, 21 bp, Homo sapiens
aaaagattttcagaaaatatt

SEQ ID NO: 5817475 - DNA, 13 bp, Homo sapiens
aaaagattttcct

SEQ ID NO: 5817476 - DNA, 20 bp, Homo sapiens
aaaagattttgtgaaatttc

SEQ ID NO: 5817477 - DNA, 23 bp, Homo sapiens
aaaagattttgtgaaatttcatg

SEQ ID NO: 5817478 - DNA, 21 bp, Homo sapiens
aaaagatttttaaaatgaatc

SEQ ID NO: 5817479 - DNA, 16 bp, Homo sapiens
aaaagcaaaaaagaaa

SEQ ID NO: 5817480 - DNA, 18 bp, Homo sapiens
aaaagcaaaaagatgtat

SEQ ID NO: 5817481 - DNA, 14 bp, Homo sapiens
aaaagcaaaagaga

SEQ ID NO: 5817482 - DNA, 13 bp, Homo sapiens
aaaagcaaaattt

SEQ ID NO: 5817483 - DNA, 10 bp, Homo sapiens
aaaagcaaat

SEQ ID NO: 5817484 - DNA, 13 bp, Homo sapiens
aaaagcaaatact

SEQ ID NO: 5817485 - DNA, 13 bp, Homo sapiens
aaaagcaaatcag

SEQ ID NO: 5817486 - DNA, 14 bp, Homo sapiens
aaaagcaaatcatt

SEQ ID NO: 5817487 - DNA, 13 bp, Homo sapiens
aaaagcaacttca

SEQ ID NO: 5817488 - DNA, 14 bp, Homo sapiens
aaaagcaacttcat

SEQ ID NO: 5817489 - DNA, 18 bp, Homo sapiens
aaaagcaatcatagagaa

SEQ ID NO: 5817490 - DNA, 21 bp, Homo sapiens
aaaagcaattactacaaatgg

SEQ ID NO: 5817491 - DNA, 12 bp, Homo sapiens
aaaagcaattct

SEQ ID NO: 5817492 - DNA, 18 bp, Homo sapiens
aaaagcaattctgactgt

SEQ ID NO: 5817493 - DNA, 22 bp, Homo sapiens
aaaagcacaaagttctcagagc

SEQ ID NO: 5817494 - DNA, 20 bp, Homo sapiens
aaaagcacaatcactaaact

SEQ ID NO: 5817495 - DNA, 21 bp, Homo sapiens
aaaagcacactcatcccctca

SEQ ID NO: 5817496 - DNA, 20 bp, Homo sapiens
aaaagcacatacattaaaac

SEQ ID NO: 5817497 - DNA, 17 bp, Homo sapiens
aaaagcacttaaagttt

SEQ ID NO: 5817498 - DNA, 21 bp, Homo sapiens
aaaagcacttaaagtttttta

SEQ ID NO: 5817499 - DNA, 13 bp, Homo sapiens
aaaagcactttga

SEQ ID NO: 5817500 - DNA, 17 bp, Homo sapiens
aaaagcacttttgttat

SEQ ID NO: 5817501 - DNA, 23 bp, Homo sapiens
aaaagcagctaaatgtaacttat

SEQ ID NO: 5817502 - DNA, 17 bp, Homo sapiens
aaaagcagctctcccct

SEQ ID NO: 5817503 - DNA, 12 bp, Homo sapiens
aaaagcagcttt

SEQ ID NO: 5817504 - DNA, 14 bp, Homo sapiens
aaaagcaggaaata

SEQ ID NO: 5817505 - DNA, 22 bp, Homo sapiens
aaaagcaggcttctatgaaaga

SEQ ID NO: 5817506 - DNA, 22 bp, Homo sapiens
aaaagcaggttgataaatcatt

SEQ ID NO: 5817507 - DNA, 19 bp, Homo sapiens
aaaagcatctgccacaaaa

SEQ ID NO: 5817508 - DNA, 18 bp, Homo sapiens
aaaagcatgaatatttct

SEQ ID NO: 5817509 - DNA, 22 bp, Homo sapiens
aaaagcatgactatttccacca

SEQ ID NO: 5817510 - DNA, 20 bp, Homo sapiens
aaaagcatgatgggaaaata

SEQ ID NO: 5817511 - DNA, 12 bp, Homo sapiens
aaaagcatgtac

SEQ ID NO: 5817512 - DNA, 15 bp, Homo sapiens
aaaagcattttgtaa

SEQ ID NO: 5817513 - DNA, 16 bp, Homo sapiens
aaaagcattttgtaat

SEQ ID NO: 5817514 - DNA, 12 bp, Homo sapiens
aaaagcattttt

SEQ ID NO: 5817515 - DNA, 11 bp, Homo sapiens
aaaagccaaaa

SEQ ID NO: 5817516 - DNA, 13 bp, Homo sapiens
aaaagccaaaggt

SEQ ID NO: 5817517 - DNA, 14 bp, Homo sapiens
aaaagccaaaggtc

SEQ ID NO: 5817518 - DNA, 11 bp, Homo sapiens
aaaagccacag

SEQ ID NO: 5817519 - DNA, 18 bp, Homo sapiens
aaaagccacagcagagca

SEQ ID NO: 5817520 - DNA, 10 bp, Homo sapiens
aaaagccata

SEQ ID NO: 5817521 - DNA, 15 bp, Homo sapiens
aaaagccatatcatg

SEQ ID NO: 5817522 - DNA, 14 bp, Homo sapiens
aaaagccatcatgt

SEQ ID NO: 5817523 - DNA, 17 bp, Homo sapiens
aaaagccatgtataacc

SEQ ID NO: 5817524 - DNA, 24 bp, Homo sapiens
aaaagccatgtatttcagggacct

SEQ ID NO: 5817525 - DNA, 13 bp, Homo sapiens
aaaagccatgttt

SEQ ID NO: 5817526 - DNA, 14 bp, Homo sapiens
aaaagccatgttta

SEQ ID NO: 5817527 - DNA, 17 bp, Homo sapiens
aaaagccatgtttaaga

SEQ ID NO: 5817528 - DNA, 20 bp, Homo sapiens
aaaagccatgtttaagattt

SEQ ID NO: 5817529 - DNA, 17 bp, Homo sapiens
aaaagccattattatga

SEQ ID NO: 5817530 - DNA, 19 bp, Homo sapiens
aaaagcccaccatttggca

SEQ ID NO: 5817531 - DNA, 16 bp, Homo sapiens
aaaagcccagtgacct

SEQ ID NO: 5817532 - DNA, 21 bp, Homo sapiens
aaaagccctcatcttctcttt

SEQ ID NO: 5817533 - DNA, 16 bp, Homo sapiens
aaaagcctaagaaaaa

SEQ ID NO: 5817534 - DNA, 18 bp, Homo sapiens
aaaagcctccttgtgcaa

SEQ ID NO: 5817535 - DNA, 19 bp, Homo sapiens
aaaagcctccttgtgcaat

SEQ ID NO: 5817536 - DNA, 18 bp, Homo sapiens
aaaagcctgcatcgggga

SEQ ID NO: 5817537 - DNA, 11 bp, Homo sapiens
aaaagcctgct

SEQ ID NO: 5817538 - DNA, 16 bp, Homo sapiens
aaaagcctgtttaaga

SEQ ID NO: 5817539 - DNA, 14 bp, Homo sapiens
aaaagccttggcct

SEQ ID NO: 5817540 - DNA, 17 bp, Homo sapiens
aaaagccttgtgtatat

SEQ ID NO: 5817541 - DNA, 18 bp, Homo sapiens
aaaagccttgtgtatatt

SEQ ID NO: 5817542 - DNA, 20 bp, Homo sapiens
aaaagccttgtgtatatttg

SEQ ID NO: 5817543 - DNA, 14 bp, Homo sapiens
aaaagcctttgaaa

SEQ ID NO: 5817544 - DNA, 17 bp, Homo sapiens
aaaagcctttgaaaata

SEQ ID NO: 5817545 - DNA, 20 bp, Homo sapiens
aaaagcgacccattcagaga

SEQ ID NO: 5817546 - DNA, 16 bp, Homo sapiens
aaaagcgcttttcctt

SEQ ID NO: 5817547 - DNA, 19 bp, Homo sapiens
aaaagcggggttcaatgct

SEQ ID NO: 5817548 - DNA, 18 bp, Homo sapiens
aaaagcgtctttaagaga

SEQ ID NO: 5817549 - DNA, 19 bp, Homo sapiens
aaaagcgtctttaagagac

SEQ ID NO: 5817550 - DNA, 22 bp, Homo sapiens
aaaagctaacatctttacgtac

SEQ ID NO: 5817551 - DNA, 14 bp, Homo sapiens
aaaagctaagagaa

SEQ ID NO: 5817552 - DNA, 11 bp, Homo sapiens
aaaagctaatt

SEQ ID NO: 5817553 - DNA, 21 bp, Homo sapiens
aaaagctacaaaaaactgcag

SEQ ID NO: 5817554 - DNA, 14 bp, Homo sapiens
aaaagctagaattg

SEQ ID NO: 5817555 - DNA, 22 bp, Homo sapiens
aaaagctataaagtatatatta

SEQ ID NO: 5817556 - DNA, 16 bp, Homo sapiens
aaaagctatcttcatg

SEQ ID NO: 5817557 - DNA, 19 bp, Homo sapiens
aaaagctatcttcatgtaa

SEQ ID NO: 5817558 - DNA, 21 bp, Homo sapiens
aaaagctattagccaggatca

SEQ ID NO: 5817559 - DNA, 15 bp, Homo sapiens
aaaagctcctggggc

SEQ ID NO: 5817560 - DNA, 13 bp, Homo sapiens
aaaagctcctgtc

SEQ ID NO: 5817561 - DNA, 20 bp, Homo sapiens
aaaagctctagataaaactt

SEQ ID NO: 5817562 - DNA, 23 bp, Homo sapiens
aaaagctctctttggaatgaaca

SEQ ID NO: 5817563 - DNA, 11 bp, Homo sapiens
aaaagctcttt

SEQ ID NO: 5817564 - DNA, 15 bp, Homo sapiens
aaaagctcttttaat

SEQ ID NO: 5817565 - DNA, 19 bp, Homo sapiens
aaaagctgaagcctattta

SEQ ID NO: 5817566 - DNA, 17 bp, Homo sapiens
aaaagctggaccttttc

SEQ ID NO: 5817567 - DNA, 14 bp, Homo sapiens
aaaagctgggcagg

SEQ ID NO: 5817568 - DNA, 18 bp, Homo sapiens
aaaagctgtggaatgaag

SEQ ID NO: 5817569 - DNA, 12 bp, Homo sapiens
aaaagctgttcc

SEQ ID NO: 5817570 - DNA, 15 bp, Homo sapiens
aaaagcttacaaata

SEQ ID NO: 5817571 - DNA, 14 bp, Homo sapiens
aaaagcttcaaatt

SEQ ID NO: 5817572 - DNA, 17 bp, Homo sapiens
aaaagcttccctccctg

SEQ ID NO: 5817573 - DNA, 15 bp, Homo sapiens
aaaagcttcttaatt

SEQ ID NO: 5817574 - DNA, 15 bp, Homo sapiens
aaaagcttgtgtatc

SEQ ID NO: 5817575 - DNA, 16 bp, Homo sapiens
aaaagctttaaaaaat

SEQ ID NO: 5817576 - DNA, 12 bp, Homo sapiens
aaaagctttact

SEQ ID NO: 5817577 - DNA, 18 bp, Homo sapiens
aaaagctttagattgaaa

SEQ ID NO: 5817578 - DNA, 20 bp, Homo sapiens
aaaagctttatgattttcat

SEQ ID NO: 5817579 - DNA, 22 bp, Homo sapiens
aaaagctttatgattttcataa

SEQ ID NO: 5817580 - DNA, 15 bp, Homo sapiens
aaaagcttttatgag

SEQ ID NO: 5817581 - DNA, 18 bp, Homo sapiens
aaaagctttttaaaattt

SEQ ID NO: 5817582 - DNA, 14 bp, Homo sapiens
aaaagctttttatt

SEQ ID NO: 5817583 - DNA, 15 bp, Homo sapiens
aaaaggaaaaatatt

SEQ ID NO: 5817584 - DNA, 14 bp, Homo sapiens
aaaaggaaaagcaa

SEQ ID NO: 5817585 - DNA, 16 bp, Homo sapiens
aaaaggaaaagttaaa

SEQ ID NO: 5817586 - DNA, 21 bp, Homo sapiens
aaaaggaaacttcagttgatc

SEQ ID NO: 5817587 - DNA, 22 bp, Homo sapiens
aaaaggaaagtttgccaggagg

SEQ ID NO: 5817588 - DNA, 15 bp, Homo sapiens
aaaaggaaattagtc

SEQ ID NO: 5817589 - DNA, 17 bp, Homo sapiens
aaaaggaaattagtctt

SEQ ID NO: 5817590 - DNA, 23 bp, Homo sapiens
aaaaggaacagttgcatttagct

SEQ ID NO: 5817591 - DNA, 12 bp, Homo sapiens
aaaaggaagact

SEQ ID NO: 5817592 - DNA, 14 bp, Homo sapiens
aaaaggaagactag

SEQ ID NO: 5817593 - DNA, 15 bp, Homo sapiens
aaaaggaagactaga

SEQ ID NO: 5817594 - DNA, 13 bp, Homo sapiens
aaaaggaagactg

SEQ ID NO: 5817595 - DNA, 21 bp, Homo sapiens
aaaaggaagcttacatgccta

SEQ ID NO: 5817596 - DNA, 21 bp, Homo sapiens
aaaaggaagtggggacagatt

SEQ ID NO: 5817597 - DNA, 16 bp, Homo sapiens
aaaaggacaatttcaa

SEQ ID NO: 5817598 - DNA, 16 bp, Homo sapiens
aaaaggacacctttta

SEQ ID NO: 5817599 - DNA, 13 bp, Homo sapiens
aaaaggacattgg

SEQ ID NO: 5817600 - DNA, 18 bp, Homo sapiens
aaaaggacgtaaaattta

SEQ ID NO: 5817601 - DNA, 18 bp, Homo sapiens
aaaaggacttcaggaaca

SEQ ID NO: 5817602 - DNA, 21 bp, Homo sapiens
aaaaggagaaaggagctctga

SEQ ID NO: 5817603 - DNA, 11 bp, Homo sapiens
aaaaggagaga

SEQ ID NO: 5817604 - DNA, 13 bp, Homo sapiens
aaaaggagagaag

SEQ ID NO: 5817605 - DNA, 18 bp, Homo sapiens
aaaaggagagaagaaagt

SEQ ID NO: 5817606 - DNA, 14 bp, Homo sapiens
aaaaggagagatta

SEQ ID NO: 5817607 - DNA, 21 bp, Homo sapiens
aaaaggagagattattaaatc

SEQ ID NO: 5817608 - DNA, 16 bp, Homo sapiens
aaaaggagcgggcagg

SEQ ID NO: 5817609 - DNA, 14 bp, Homo sapiens
aaaaggagtataca

SEQ ID NO: 5817610 - DNA, 15 bp, Homo sapiens
aaaaggagtatacaa

SEQ ID NO: 5817611 - DNA, 16 bp, Homo sapiens
aaaaggataggaaaag

SEQ ID NO: 5817612 - DNA, 15 bp, Homo sapiens
aaaaggatagtattt

SEQ ID NO: 5817613 - DNA, 16 bp, Homo sapiens
aaaaggatagtatttt

SEQ ID NO: 5817614 - DNA, 17 bp, Homo sapiens
aaaaggatagtattttt

SEQ ID NO: 5817615 - DNA, 14 bp, Homo sapiens
aaaaggatctcctt

SEQ ID NO: 5817616 - DNA, 23 bp, Homo sapiens
aaaaggatctttgtggccaagga

SEQ ID NO: 5817617 - DNA, 13 bp, Homo sapiens
aaaaggatgcaca

SEQ ID NO: 5817618 - DNA, 19 bp, Homo sapiens
aaaaggatggaagaaagaa

SEQ ID NO: 5817619 - DNA, 22 bp, Homo sapiens
aaaaggatgttacaagtttgct

SEQ ID NO: 5817620 - DNA, 13 bp, Homo sapiens
aaaaggatttaag

SEQ ID NO: 5817621 - DNA, 18 bp, Homo sapiens
aaaaggatttttatcttt

SEQ ID NO: 5817622 - DNA, 15 bp, Homo sapiens
aaaaggccaaacctc

SEQ ID NO: 5817623 - DNA, 16 bp, Homo sapiens
aaaaggccaaagataa

SEQ ID NO: 5817624 - DNA, 18 bp, Homo sapiens
aaaaggccaaagataaaa

SEQ ID NO: 5817625 - DNA, 18 bp, Homo sapiens
aaaaggccagtggaaatt

SEQ ID NO: 5817626 - DNA, 18 bp, Homo sapiens
aaaaggcctaatgcatta

SEQ ID NO: 5817627 - DNA, 15 bp, Homo sapiens
aaaaggcctcttgta

SEQ ID NO: 5817628 - DNA, 14 bp, Homo sapiens
aaaaggcctggggt

SEQ ID NO: 5817629 - DNA, 20 bp, Homo sapiens
aaaaggcctgtgatccagga

SEQ ID NO: 5817630 - DNA, 12 bp, Homo sapiens
aaaaggcctttg

SEQ ID NO: 5817631 - DNA, 13 bp, Homo sapiens
aaaaggcctttgg

SEQ ID NO: 5817632 - DNA, 16 bp, Homo sapiens
aaaaggcctttgggat

SEQ ID NO: 5817633 - DNA, 15 bp, Homo sapiens
aaaaggcgcatctaa

SEQ ID NO: 5817634 - DNA, 20 bp, Homo sapiens
aaaaggcgcatctaacgcgt

SEQ ID NO: 5817635 - DNA, 20 bp, Homo sapiens
aaaaggcggtactagttcag

SEQ ID NO: 5817636 - DNA, 20 bp, Homo sapiens
aaaaggctaggtacacagct

SEQ ID NO: 5817637 - DNA, 19 bp, Homo sapiens
aaaaggctcgtttggatct

SEQ ID NO: 5817638 - DNA, 14 bp, Homo sapiens
aaaaggctgagaag

SEQ ID NO: 5817639 - DNA, 17 bp, Homo sapiens
aaaaggctgagaaggaa

SEQ ID NO: 5817640 - DNA, 11 bp, Homo sapiens
aaaaggctgga

SEQ ID NO: 5817641 - DNA, 19 bp, Homo sapiens
aaaaggctgtgctgccctg

SEQ ID NO: 5817642 - DNA, 17 bp, Homo sapiens
aaaaggcttataaaaca

SEQ ID NO: 5817643 - DNA, 11 bp, Homo sapiens
aaaagggaaaa

SEQ ID NO: 5817644 - DNA, 14 bp, Homo sapiens
aaaagggaaaaaag

SEQ ID NO: 5817645 - DNA, 15 bp, Homo sapiens
aaaagggaacaggaa

SEQ ID NO: 5817646 - DNA, 16 bp, Homo sapiens
aaaagggaagaaactg

SEQ ID NO: 5817647 - DNA, 12 bp, Homo sapiens
aaaagggaagga

SEQ ID NO: 5817648 - DNA, 18 bp, Homo sapiens
aaaagggaagtagtcctt

SEQ ID NO: 5817649 - DNA, 19 bp, Homo sapiens
aaaagggaagttgtgcctt

SEQ ID NO: 5817650 - DNA, 13 bp, Homo sapiens
aaaagggagaata

SEQ ID NO: 5817651 - DNA, 19 bp, Homo sapiens
aaaagtttcacaacagatt

SEQ ID NO: 5817652 - DNA, 17 bp, Homo sapiens
aaaagtttgaggaatat

SEQ ID NO: 5817653 - DNA, 12 bp, Homo sapiens
aaaagtttgcat

SEQ ID NO: 5817654 - DNA, 18 bp, Homo sapiens
aaaagtttgttactttga

SEQ ID NO: 5817655 - DNA, 12 bp, Homo sapiens
aaaagtttgttt

SEQ ID NO: 5817656 - DNA, 16 bp, Homo sapiens
aaaagtttgttttact

SEQ ID NO: 5817657 - DNA, 17 bp, Homo sapiens
aaaagttttatgtactt

SEQ ID NO: 5817658 - DNA, 18 bp, Homo sapiens
aaaagttttatgtacttt

SEQ ID NO: 5817659 - DNA, 17 bp, Homo sapiens
aaaagttttatttttct

SEQ ID NO: 5817660 - DNA, 12 bp, Homo sapiens
aaaagttttcta

SEQ ID NO: 5817661 - DNA, 13 bp, Homo sapiens
aaaagttttctaa

SEQ ID NO: 5817662 - DNA, 21 bp, Homo sapiens
aaaagtttttgtcactatctt

SEQ ID NO: 5817663 - DNA, 18 bp, Homo sapiens
aaaataaaaaaaagaaaa

SEQ ID NO: 5817664 - DNA, 16 bp, Homo sapiens
aaaataaaaaaataca

SEQ ID NO: 5817665 - DNA, 21 bp, Homo sapiens
aaaataaaaaagatcccaaat

SEQ ID NO: 5817666 - DNA, 15 bp, Homo sapiens
aaaataaaaaatgtg

SEQ ID NO: 5817667 - DNA, 11 bp, Homo sapiens
aaaataaaaac

SEQ ID NO: 5817668 - DNA, 18 bp, Homo sapiens
aaaataaaaacataaaat

SEQ ID NO: 5817669 - DNA, 15 bp, Homo sapiens
aaaataaaaaccaga

SEQ ID NO: 5817670 - DNA, 21 bp, Homo sapiens
aaaataaaaacccacaaaaat

SEQ ID NO: 5817671 - DNA, 17 bp, Homo sapiens
aaaataaaaaccttcca

SEQ ID NO: 5817672 - DNA, 16 bp, Homo sapiens
aaaataaaaactattc

SEQ ID NO: 5817673 - DNA, 18 bp, Homo sapiens
aaaataaaaactattcga

SEQ ID NO: 5817674 - DNA, 12 bp, Homo sapiens
aaaataaaaaga

SEQ ID NO: 5817675 - DNA, 20 bp, Homo sapiens
aaaataaaaagatcactttc

SEQ ID NO: 5817676 - DNA, 20 bp, Homo sapiens
aaaataaaaagcctcagtga

SEQ ID NO: 5817677 - DNA, 17 bp, Homo sapiens
aaaataaaaagtaactg

SEQ ID NO: 5817678 - DNA, 22 bp, Homo sapiens
aaaataaaaagtgacacagcag

SEQ ID NO: 5817679 - DNA, 14 bp, Homo sapiens
aaaataaaacaaag

SEQ ID NO: 5817680 - DNA, 14 bp, Homo sapiens
aaaataaaacaagc

SEQ ID NO: 5817681 - DNA, 15 bp, Homo sapiens
aaaataaaacaagcc

SEQ ID NO: 5817682 - DNA, 12 bp, Homo sapiens
aaaataaaacag

SEQ ID NO: 5817683 - DNA, 13 bp, Homo sapiens
aaaataaaacagt

SEQ ID NO: 5817684 - DNA, 13 bp, Homo sapiens
aaaataaaacatg

SEQ ID NO: 5817685 - DNA, 13 bp, Homo sapiens
aaaataaaacatt

SEQ ID NO: 5817686 - DNA, 15 bp, Homo sapiens
aaaataaaacatttt

SEQ ID NO: 5817687 - DNA, 16 bp, Homo sapiens
aaaataaaacatttta

SEQ ID NO: 5817688 - DNA, 13 bp, Homo sapiens
aaaataaaactaa

SEQ ID NO: 5817689 - DNA, 12 bp, Homo sapiens
aaaataaaactg

SEQ ID NO: 5817690 - DNA, 16 bp, Homo sapiens
aaaataaaacttttta

SEQ ID NO: 5817691 - DNA, 15 bp, Homo sapiens
aaaataaaagaaaat

SEQ ID NO: 5817692 - DNA, 20 bp, Homo sapiens
aaaataaaaggactctggaa

SEQ ID NO: 5817693 - DNA, 16 bp, Homo sapiens
aaaataaaagtaccta

SEQ ID NO: 5817694 - DNA, 22 bp, Homo sapiens
aaaataaaagtacctattgaac

SEQ ID NO: 5817695 - DNA, 11 bp, Homo sapiens
aaaataaaata

SEQ ID NO: 5817696 - DNA, 12 bp, Homo sapiens
aaaataaaataa

SEQ ID NO: 5817697 - DNA, 13 bp, Homo sapiens
aaaataaaatgaa

SEQ ID NO: 5817698 - DNA, 21 bp, Homo sapiens
aaaataaaatgaaaattgtat

SEQ ID NO: 5817699 - DNA, 19 bp, Homo sapiens
aaaataaaatgcatttaaa

SEQ ID NO: 5817700 - DNA, 14 bp, Homo sapiens
aaaataaaatgcct

SEQ ID NO: 5817701 - DNA, 16 bp, Homo sapiens
aaaataaaatgtttca

SEQ ID NO: 5817702 - DNA, 19 bp, Homo sapiens
aaaataaaattaaagctga

SEQ ID NO: 5817703 - DNA, 21 bp, Homo sapiens
aaaataaaatttccttcaggt

SEQ ID NO: 5817704 - DNA, 20 bp, Homo sapiens
aaaataaacaggtcaatgaa

SEQ ID NO: 5817705 - DNA, 13 bp, Homo sapiens
aaaataaaccaaa

SEQ ID NO: 5817706 - DNA, 22 bp, Homo sapiens
aaaataaacgtggattttaaaa

SEQ ID NO: 5817707 - DNA, 18 bp, Homo sapiens
aaaataaactagtttcca

SEQ ID NO: 5817708 - DNA, 21 bp, Homo sapiens
aaaataaactagtttccagtg

SEQ ID NO: 5817709 - DNA, 11 bp, Homo sapiens
aaaataaactg

SEQ ID NO: 5817710 - DNA, 12 bp, Homo sapiens
aaaataaactgt

SEQ ID NO: 5817711 - DNA, 11 bp, Homo sapiens
aaaataaactt

SEQ ID NO: 5817712 - DNA, 14 bp, Homo sapiens
aaaataaactttct

SEQ ID NO: 5817713 - DNA, 22 bp, Homo sapiens
aaaataaactttcttaatattt

SEQ ID NO: 5817714 - DNA, 17 bp, Homo sapiens
aaaataaagaatatgcc

SEQ ID NO: 5817715 - DNA, 18 bp, Homo sapiens
aaaataaagatcacacat

SEQ ID NO: 5817716 - DNA, 11 bp, Homo sapiens
aaaataaagca

SEQ ID NO: 5817717 - DNA, 16 bp, Homo sapiens
aaaataaagcagaagc

SEQ ID NO: 5817718 - DNA, 12 bp, Homo sapiens
aaaataaagcct

SEQ ID NO: 5817719 - DNA, 14 bp, Homo sapiens
aaaataaagctact

SEQ ID NO: 5817720 - DNA, 12 bp, Homo sapiens
aaaataaagctt

SEQ ID NO: 5817721 - DNA, 22 bp, Homo sapiens
aaaataaaggaaaatgacttgt

SEQ ID NO: 5817722 - DNA, 14 bp, Homo sapiens
aaaataaaggaaat

SEQ ID NO: 5817723 - DNA, 20 bp, Homo sapiens
aaaataaaggataactctgt

SEQ ID NO: 5817724 - DNA, 13 bp, Homo sapiens
aaaataaagtctg

SEQ ID NO: 5817725 - DNA, 16 bp, Homo sapiens
aaaataaagttacatt

SEQ ID NO: 5817726 - DNA, 15 bp, Homo sapiens
aaaataaataaaagc

SEQ ID NO: 5817727 - DNA, 16 bp, Homo sapiens
aaaataaataaaagcc

SEQ ID NO: 5817728 - DNA, 17 bp, Homo sapiens
aaaataaataattttaa

SEQ ID NO: 5817729 - DNA, 17 bp, Homo sapiens
aaaataaataccaaaga

SEQ ID NO: 5817730 - DNA, 20 bp, Homo sapiens
aaaataaatagcttaaaatt

SEQ ID NO: 5817731 - DNA, 11 bp, Homo sapiens
aaaataaatat

SEQ ID NO: 5817732 - DNA, 16 bp, Homo sapiens
aaaataaatataattg

SEQ ID NO: 5817733 - DNA, 20 bp, Homo sapiens
aaaataaatatactaataaa

SEQ ID NO: 5817734 - DNA, 21 bp, Homo sapiens
aaaataaatatactaataaaa

SEQ ID NO: 5817735 - DNA, 22 bp, Homo sapiens
aaaataaatatactaataaaaa

SEQ ID NO: 5817736 - DNA, 14 bp, Homo sapiens
aaaataaatcaagg

SEQ ID NO: 5817737 - DNA, 20 bp, Homo sapiens
aaaataaatcttagtgttca

SEQ ID NO: 5817738 - DNA, 18 bp, Homo sapiens
aaaataaatgaaaaacag

SEQ ID NO: 5817739 - DNA, 13 bp, Homo sapiens
aaaataaatggaa

SEQ ID NO: 5817740 - DNA, 23 bp, Homo sapiens
aaaataaatgtcaccaggtactt

SEQ ID NO: 5817741 - DNA, 19 bp, Homo sapiens
aaaataaatgttttggaat

SEQ ID NO: 5817742 - DNA, 13 bp, Homo sapiens
aaaataaattgga

SEQ ID NO: 5817743 - DNA, 12 bp, Homo sapiens
aaaataaattta

SEQ ID NO: 5817744 - DNA, 20 bp, Homo sapiens
aaaataaatttatatgaaaa

SEQ ID NO: 5817745 - DNA, 18 bp, Homo sapiens
aaaataaattttgaatgt

SEQ ID NO: 5817746 - DNA, 22 bp, Homo sapiens
aaaataacaactaacttgtttg

SEQ ID NO: 5817747 - DNA, 16 bp, Homo sapiens
aaaataacactgttgg

SEQ ID NO: 5817748 - DNA, 20 bp, Homo sapiens
aaaataacatattcttgctt

SEQ ID NO: 5817749 - DNA, 19 bp, Homo sapiens
aaaataacatctgaaaaga

SEQ ID NO: 5817750 - DNA, 20 bp, Homo sapiens
aaaataactatcaggcagaa

SEQ ID NO: 5817751 - DNA, 22 bp, Homo sapiens
aaaataactgaaccaaattgca

SEQ ID NO: 5817752 - DNA, 15 bp, Homo sapiens
aaaataactgaattt

SEQ ID NO: 5817753 - DNA, 14 bp, Homo sapiens
aaaataactgtaat

SEQ ID NO: 5817754 - DNA, 16 bp, Homo sapiens
aaaataactgtgcact

SEQ ID NO: 5817755 - DNA, 22 bp, Homo sapiens
aaaataacttcattgtttggac

SEQ ID NO: 5817756 - DNA, 12 bp, Homo sapiens
aaaataagacaa

SEQ ID NO: 5817757 - DNA, 20 bp, Homo sapiens
aaaataagacaatagtattt

SEQ ID NO: 5817758 - DNA, 18 bp, Homo sapiens
aaaataagagatagcaga

SEQ ID NO: 5817759 - DNA, 13 bp, Homo sapiens
aaaataagcaggt

SEQ ID NO: 5817760 - DNA, 14 bp, Homo sapiens
aaaataagcaggtg

SEQ ID NO: 5817761 - DNA, 22 bp, Homo sapiens
aaaataagccaaaataagacta

SEQ ID NO: 5817762 - DNA, 14 bp, Homo sapiens
aaaataagctttct

SEQ ID NO: 5817763 - DNA, 22 bp, Homo sapiens
aaaataagctttctcagaatgt

SEQ ID NO: 5817764 - DNA, 14 bp, Homo sapiens
aaaataaggttatg

SEQ ID NO: 5817765 - DNA, 14 bp, Homo sapiens
aaaataagtatttc

SEQ ID NO: 5817766 - DNA, 18 bp, Homo sapiens
aaaataagtcaacagtaa

SEQ ID NO: 5817767 - DNA, 16 bp, Homo sapiens
aaaataagtcatttta

SEQ ID NO: 5817768 - DNA, 22 bp, Homo sapiens
aaaataagtggattttgtattt

SEQ ID NO: 5817769 - DNA, 18 bp, Homo sapiens
aaaataagttttatacat

SEQ ID NO: 5817770 - DNA, 12 bp, Homo sapiens
aaaataataaaa

SEQ ID NO: 5817771 - DNA, 16 bp, Homo sapiens
aaaataataaaaaaag

SEQ ID NO: 5817772 - DNA, 22 bp, Homo sapiens
aaaataataaaagaatcatttg

SEQ ID NO: 5817773 - DNA, 12 bp, Homo sapiens
aaaataataaat

SEQ ID NO: 5817774 - DNA, 13 bp, Homo sapiens
aaaataataaatt

SEQ ID NO: 5817775 - DNA, 16 bp, Homo sapiens
aaaataataaattgca

SEQ ID NO: 5817776 - DNA, 16 bp, Homo sapiens
aaaataatactgctga

SEQ ID NO: 5817777 - DNA, 18 bp, Homo sapiens
aaaataatagccatcctt

SEQ ID NO: 5817778 - DNA, 23 bp, Homo sapiens
aaaataataggatataaaacaca

SEQ ID NO: 5817779 - DNA, 16 bp, Homo sapiens
aaaataatcaagattt

SEQ ID NO: 5817780 - DNA, 21 bp, Homo sapiens
aaaataatctatattaaatga

SEQ ID NO: 5817781 - DNA, 22 bp, Homo sapiens
aaaataatctatattaaatgag

SEQ ID NO: 5817782 - DNA, 23 bp, Homo sapiens
aaaataatctggtgttcttgcta

SEQ ID NO: 5817783 - DNA, 12 bp, Homo sapiens
aaaataatgtaa

SEQ ID NO: 5817784 - DNA, 15 bp, Homo sapiens
aaaataatgtaaggg

SEQ ID NO: 5817785 - DNA, 16 bp, Homo sapiens
aaaataatgtaatgat

SEQ ID NO: 5817786 - DNA, 23 bp, Homo sapiens
aaaataatgtactgaattcttta

SEQ ID NO: 5817787 - DNA, 20 bp, Homo sapiens
aaaataatgtcttgttaata

SEQ ID NO: 5817788 - DNA, 17 bp, Homo sapiens
aaaataatgtttgatag

SEQ ID NO: 5817789 - DNA, 16 bp, Homo sapiens
aaaataattagctata

SEQ ID NO: 5817790 - DNA, 14 bp, Homo sapiens
aaaataattagtta

SEQ ID NO: 5817791 - DNA, 19 bp, Homo sapiens
aaaataattatttattaca

SEQ ID NO: 5817792 - DNA, 16 bp, Homo sapiens
aaaataattcatatct

SEQ ID NO: 5817793 - DNA, 19 bp, Homo sapiens
aaaataattgagactgaaa

SEQ ID NO: 5817794 - DNA, 19 bp, Homo sapiens
aaaataattgagatcacat

SEQ ID NO: 5817795 - DNA, 16 bp, Homo sapiens
aaaataattgatttca

SEQ ID NO: 5817796 - DNA, 15 bp, Homo sapiens
aaaataattgggtga

SEQ ID NO: 5817797 - DNA, 13 bp, Homo sapiens
aaaataatttaac

SEQ ID NO: 5817798 - DNA, 15 bp, Homo sapiens
aaaataatttaacta

SEQ ID NO: 5817799 - DNA, 20 bp, Homo sapiens
aaaataatttaactaattta

SEQ ID NO: 5817800 - DNA, 19 bp, Homo sapiens
aaaataattttaaacaaag

SEQ ID NO: 5817801 - DNA, 15 bp, Homo sapiens
aaaataattttccaa

SEQ ID NO: 5817802 - DNA, 20 bp, Homo sapiens
aaaataatttttatatttga

SEQ ID NO: 5817803 - DNA, 16 bp, Homo sapiens
aaaatacaaaaatttg

SEQ ID NO: 5817804 - DNA, 17 bp, Homo sapiens
aaaatacaaaaatttgc

SEQ ID NO: 5817805 - DNA, 14 bp, Homo sapiens
aaaatacaaaatta

SEQ ID NO: 5817806 - DNA, 14 bp, Homo sapiens
aaaatacaagactg

SEQ ID NO: 5817807 - DNA, 14 bp, Homo sapiens
aaaatacaataaac

SEQ ID NO: 5817808 - DNA, 15 bp, Homo sapiens
aaaatacaatcctgt

SEQ ID NO: 5817809 - DNA, 20 bp, Homo sapiens
aaaatacaattattgtatat

SEQ ID NO: 5817810 - DNA, 16 bp, Homo sapiens
aaaatacaatttttat

SEQ ID NO: 5817811 - DNA, 19 bp, Homo sapiens
aaaatacacgtttatctta

SEQ ID NO: 5817812 - DNA, 14 bp, Homo sapiens
aaaatacagtaaag

SEQ ID NO: 5817813 - DNA, 22 bp, Homo sapiens
aaaatacagtaaagtttaaaaa

SEQ ID NO: 5817814 - DNA, 16 bp, Homo sapiens
aaaatacagtattatt

SEQ ID NO: 5817815 - DNA, 21 bp, Homo sapiens
aaaatacagtttgtcacatga

SEQ ID NO: 5817816 - DNA, 18 bp, Homo sapiens
aaaatacataaaagaatg

SEQ ID NO: 5817817 - DNA, 16 bp, Homo sapiens
aaaatacataacttca

SEQ ID NO: 5817818 - DNA, 19 bp, Homo sapiens
aaaatacataacttcagtg

SEQ ID NO: 5817819 - DNA, 17 bp, Homo sapiens
aaaatacataagaccat

SEQ ID NO: 5817820 - DNA, 16 bp, Homo sapiens
aaaatacatataaaga

SEQ ID NO: 5817821 - DNA, 19 bp, Homo sapiens
aaaatacatataaagatta

SEQ ID NO: 5817822 - DNA, 12 bp, Homo sapiens
aaaatacatgta

SEQ ID NO: 5817823 - DNA, 13 bp, Homo sapiens
aaaatacattctt

SEQ ID NO: 5817824 - DNA, 12 bp, Homo sapiens
aaaatacatttt

SEQ ID NO: 5817825 - DNA, 16 bp, Homo sapiens
aaaataccactgtaat

SEQ ID NO: 5817826 - DNA, 14 bp, Homo sapiens
aaaataccagccag

SEQ ID NO: 5817827 - DNA, 23 bp, Homo sapiens
aaaataccataggaagacataaa

SEQ ID NO: 5817828 - DNA, 14 bp, Homo sapiens
aaaataccattgaa

SEQ ID NO: 5817829 - DNA, 19 bp, Homo sapiens
aaaatacctaattgtggat

SEQ ID NO: 5817830 - DNA, 20 bp, Homo sapiens
aaaatacctattttatatga

SEQ ID NO: 5817831 - DNA, 22 bp, Homo sapiens
aaaatacctctaataaacactg

SEQ ID NO: 5817832 - DNA, 23 bp, Homo sapiens
aaaatatttattaaataaaatca

SEQ ID NO: 5817833 - DNA, 20 bp, Homo sapiens
aaaatatttctaagcttatt

SEQ ID NO: 5817834 - DNA, 23 bp, Homo sapiens
aaaatatttctaagcttatttct

SEQ ID NO: 5817835 - DNA, 20 bp, Homo sapiens
aaaatatttctatgtaaatt

SEQ ID NO: 5817836 - DNA, 21 bp, Homo sapiens
aaaatatttgactattctgta

SEQ ID NO: 5817837 - DNA, 14 bp, Homo sapiens
aaaatatttggaat

SEQ ID NO: 5817838 - DNA, 15 bp, Homo sapiens
aaaatatttgtacat

SEQ ID NO: 5817839 - DNA, 14 bp, Homo sapiens
aaaatattttaaga

SEQ ID NO: 5817840 - DNA, 19 bp, Homo sapiens
aaaatattttaagaaagag

SEQ ID NO: 5817841 - DNA, 23 bp, Homo sapiens
aaaatattttaagaaagagaatg

SEQ ID NO: 5817842 - DNA, 17 bp, Homo sapiens
aaaatattttataattt

SEQ ID NO: 5817843 - DNA, 18 bp, Homo sapiens
aaaatattttatgatcca

SEQ ID NO: 5817844 - DNA, 12 bp, Homo sapiens
aaaatattttca

SEQ ID NO: 5817845 - DNA, 16 bp, Homo sapiens
aaaatattttcctgcc

SEQ ID NO: 5817846 - DNA, 13 bp, Homo sapiens
aaaatattttctg

SEQ ID NO: 5817847 - DNA, 20 bp, Homo sapiens
aaaatattttctgtgtgttc

SEQ ID NO: 5817848 - DNA, 17 bp, Homo sapiens
aaaatattttgatcttc

SEQ ID NO: 5817849 - DNA, 21 bp, Homo sapiens
aaaatattttgatcttcaaca

SEQ ID NO: 5817850 - DNA, 18 bp, Homo sapiens
aaaatattttgtctaaaa

SEQ ID NO: 5817851 - DNA, 20 bp, Homo sapiens
aaaatattttgtctaaaatg

SEQ ID NO: 5817852 - DNA, 22 bp, Homo sapiens
aaaatattttgttaacttttgt

SEQ ID NO: 5817853 - DNA, 13 bp, Homo sapiens
aaaatatttttgt

SEQ ID NO: 5817854 - DNA, 15 bp, Homo sapiens
aaaatattttttgca

SEQ ID NO: 5817855 - DNA, 16 bp, Homo sapiens
aaaatattttttgcaa

SEQ ID NO: 5817856 - DNA, 20 bp, Homo sapiens
aaaatatttttttaagaaaa

SEQ ID NO: 5817857 - DNA, 16 bp, Homo sapiens
aaaatcaaaaactttt

SEQ ID NO: 5817858 - DNA, 23 bp, Homo sapiens
aaaatcaaaaggcactgtgaact

SEQ ID NO: 5817859 - DNA, 17 bp, Homo sapiens
aaaatcaaaaggtaatg

SEQ ID NO: 5817860 - DNA, 18 bp, Homo sapiens
aaaatcaaagaaaacata

SEQ ID NO: 5817861 - DNA, 16 bp, Homo sapiens
aaaatcaaagctgagg

SEQ ID NO: 5817862 - DNA, 18 bp, Homo sapiens
aaaatcaaatttttctgg

SEQ ID NO: 5817863 - DNA, 14 bp, Homo sapiens
aaaatcaacatgac

SEQ ID NO: 5817864 - DNA, 18 bp, Homo sapiens
aaaatcaactcatcattt

SEQ ID NO: 5817865 - DNA, 11 bp, Homo sapiens
aaaatcaactt

SEQ ID NO: 5817866 - DNA, 13 bp, Homo sapiens
aaaatcaactttt

SEQ ID NO: 5817867 - DNA, 21 bp, Homo sapiens
aaaatcaactttttattgcct

SEQ ID NO: 5817868 - DNA, 23 bp, Homo sapiens
aaaatcaactttttattgccttc

SEQ ID NO: 5817869 - DNA, 10 bp, Homo sapiens
aaaatcaaga

SEQ ID NO: 5817870 - DNA, 16 bp, Homo sapiens
aaaatcaagtattata

SEQ ID NO: 5817871 - DNA, 21 bp, Homo sapiens
aaaatcaagttatttcctttt

SEQ ID NO: 5817872 - DNA, 12 bp, Homo sapiens
aaaatcaatcaa

SEQ ID NO: 5817873 - DNA, 13 bp, Homo sapiens
aaaatcaatcaat

SEQ ID NO: 5817874 - DNA, 15 bp, Homo sapiens
aaaatcaatcaatgg

SEQ ID NO: 5817875 - DNA, 13 bp, Homo sapiens
aaaatcaatcatt

SEQ ID NO: 5817876 - DNA, 15 bp, Homo sapiens
aaaatcaatgcttta

SEQ ID NO: 5817877 - DNA, 15 bp, Homo sapiens
aaaatcaattaacca

SEQ ID NO: 5817878 - DNA, 13 bp, Homo sapiens
aaaatcacaaaaa

SEQ ID NO: 5817879 - DNA, 14 bp, Homo sapiens
aaaatcacaaaaat

SEQ ID NO: 5817880 - DNA, 15 bp, Homo sapiens
aaaatcacaaactca

SEQ ID NO: 5817881 - DNA, 20 bp, Homo sapiens
aaaatcacaagcaataatta

SEQ ID NO: 5817882 - DNA, 14 bp, Homo sapiens
aaaatcacacctga

SEQ ID NO: 5817883 - DNA, 17 bp, Homo sapiens
aaaatcaccatctttgt

SEQ ID NO: 5817884 - DNA, 21 bp, Homo sapiens
aaaatcaccatctttgtcaaa

SEQ ID NO: 5817885 - DNA, 16 bp, Homo sapiens
aaaatcaccctgactg

SEQ ID NO: 5817886 - DNA, 14 bp, Homo sapiens
aaaatcacgttaaa

SEQ ID NO: 5817887 - DNA, 19 bp, Homo sapiens
aaaatcactatctttctga

SEQ ID NO: 5817888 - DNA, 16 bp, Homo sapiens
aaaatcactcatataa

SEQ ID NO: 5817889 - DNA, 17 bp, Homo sapiens
aaaatcacttcagatct

SEQ ID NO: 5817890 - DNA, 15 bp, Homo sapiens
aaaatcactttcata

SEQ ID NO: 5817891 - DNA, 20 bp, Homo sapiens
aaaatcagaaagacattctt

SEQ ID NO: 5817892 - DNA, 15 bp, Homo sapiens
aaaatcagcaacttc

SEQ ID NO: 5817893 - DNA, 14 bp, Homo sapiens
aaaatcagccaatt

SEQ ID NO: 5817894 - DNA, 18 bp, Homo sapiens
aaaatcagccaattatgt

SEQ ID NO: 5817895 - DNA, 24 bp, Homo sapiens
aaaatcagccaattatgttaaact

SEQ ID NO: 5817896 - DNA, 13 bp, Homo sapiens
aaaatcagcctgc

SEQ ID NO: 5817897 - DNA, 18 bp, Homo sapiens
aaaatcaggcatttttcc

SEQ ID NO: 5817898 - DNA, 19 bp, Homo sapiens
aaaatcaggtattaatctt

SEQ ID NO: 5817899 - DNA, 17 bp, Homo sapiens
aaaatcagttgattaag

SEQ ID NO: 5817900 - DNA, 17 bp, Homo sapiens
aaaatcagttgtacagt

SEQ ID NO: 5817901 - DNA, 16 bp, Homo sapiens
aaaatcagtttcttac

SEQ ID NO: 5817902 - DNA, 12 bp, Homo sapiens
aaaatcagtttt

SEQ ID NO: 5817903 - DNA, 16 bp, Homo sapiens
aaaatcagtttttcat

SEQ ID NO: 5817904 - DNA, 12 bp, Homo sapiens
aaaatcatatag

SEQ ID NO: 5817905 - DNA, 15 bp, Homo sapiens
aaaatcatatagacc

SEQ ID NO: 5817906 - DNA, 14 bp, Homo sapiens
aaaatcatattcta

SEQ ID NO: 5817907 - DNA, 20 bp, Homo sapiens
aaaatcatattctaacttat

SEQ ID NO: 5817908 - DNA, 15 bp, Homo sapiens
aaaatcatattgaga

SEQ ID NO: 5817909 - DNA, 12 bp, Homo sapiens
aaaatcatcaag

SEQ ID NO: 5817910 - DNA, 20 bp, Homo sapiens
aaaatcatcaagaagggctg

SEQ ID NO: 5817911 - DNA, 23 bp, Homo sapiens
aaaatcatcaagaagggctgcat

SEQ ID NO: 5817912 - DNA, 18 bp, Homo sapiens
aaaatcatcacaattagg

SEQ ID NO: 5817913 - DNA, 14 bp, Homo sapiens
aaaatcatctattt

SEQ ID NO: 5817914 - DNA, 19 bp, Homo sapiens
aaaatcatctattttgatg

SEQ ID NO: 5817915 - DNA, 12 bp, Homo sapiens
aaaatcatgaga

SEQ ID NO: 5817916 - DNA, 22 bp, Homo sapiens
aaaatcatgatccttgtgttca

SEQ ID NO: 5817917 - DNA, 18 bp, Homo sapiens
aaaatcatgccagtattt

SEQ ID NO: 5817918 - DNA, 19 bp, Homo sapiens
aaaatcatgccagtatttt

SEQ ID NO: 5817919 - DNA, 13 bp, Homo sapiens
aaaatcatggaat

SEQ ID NO: 5817920 - DNA, 17 bp, Homo sapiens
aaaatcatggaatggtt

SEQ ID NO: 5817921 - DNA, 22 bp, Homo sapiens
aaaatcatggaatggttataaa

SEQ ID NO: 5817922 - DNA, 16 bp, Homo sapiens
aaaatcatgtacattt

SEQ ID NO: 5817923 - DNA, 22 bp, Homo sapiens
aaaatcatgtgctcagaagagg

SEQ ID NO: 5817924 - DNA, 15 bp, Homo sapiens
aaaatcatgtttgct

SEQ ID NO: 5817925 - DNA, 12 bp, Homo sapiens
aaaatcattgat

SEQ ID NO: 5817926 - DNA, 22 bp, Homo sapiens
aaaatcattgattgtcagctac

SEQ ID NO: 5817927 - DNA, 21 bp, Homo sapiens
aaaatcatttctgcatcagct

SEQ ID NO: 5817928 - DNA, 19 bp, Homo sapiens
aaaatcattttatatgtca

SEQ ID NO: 5817929 - DNA, 20 bp, Homo sapiens
aaaatcattttatatgtcaa

SEQ ID NO: 5817930 - DNA, 14 bp, Homo sapiens
aaaatccaaactgc

SEQ ID NO: 5817931 - DNA, 16 bp, Homo sapiens
aaaatccaaactgctg

SEQ ID NO: 5817932 - DNA, 22 bp, Homo sapiens
aaaatccagaaacttgttcttc

SEQ ID NO: 5817933 - DNA, 16 bp, Homo sapiens
aaaatccagcatccca

SEQ ID NO: 5817934 - DNA, 18 bp, Homo sapiens
aaaatccagtattatatt

SEQ ID NO: 5817935 - DNA, 18 bp, Homo sapiens
aaaatccatagatttatt

SEQ ID NO: 5817936 - DNA, 14 bp, Homo sapiens
aaaatccatgaaca

SEQ ID NO: 5817937 - DNA, 16 bp, Homo sapiens
aaaatccatttaatca

SEQ ID NO: 5817938 - DNA, 18 bp, Homo sapiens
aaaatcccaaagtgcctt

SEQ ID NO: 5817939 - DNA, 18 bp, Homo sapiens
aaaatcccaccttcccac

SEQ ID NO: 5817940 - DNA, 23 bp, Homo sapiens
aaaatcccctcagcctcttctct

SEQ ID NO: 5817941 - DNA, 21 bp, Homo sapiens
aaaatccccttcgctgaaatt

SEQ ID NO: 5817942 - DNA, 22 bp, Homo sapiens
aaaatcccttaatctatgtgca

SEQ ID NO: 5817943 - DNA, 22 bp, Homo sapiens
aaaatcccttacctcggtgcct

SEQ ID NO: 5817944 - DNA, 16 bp, Homo sapiens
aaaatcctaagacaca

SEQ ID NO: 5817945 - DNA, 21 bp, Homo sapiens
aaaatcctaagacacaaatgc

SEQ ID NO: 5817946 - DNA, 14 bp, Homo sapiens
aaaatcctatatct

SEQ ID NO: 5817947 - DNA, 18 bp, Homo sapiens
aaaatcctcaacactatt

SEQ ID NO: 5817948 - DNA, 16 bp, Homo sapiens
aaaatcctcttcctct

SEQ ID NO: 5817949 - DNA, 19 bp, Homo sapiens
aaaatcctgcccaaaatgt

SEQ ID NO: 5817950 - DNA, 21 bp, Homo sapiens
aaaatcctgcccaaaatgtga

SEQ ID NO: 5817951 - DNA, 15 bp, Homo sapiens
aaaatcctgtgcaat

SEQ ID NO: 5817952 - DNA, 15 bp, Homo sapiens
aaaatccttctaatc

SEQ ID NO: 5817953 - DNA, 18 bp, Homo sapiens
aaaatcgccataggccaa

SEQ ID NO: 5817954 - DNA, 13 bp, Homo sapiens
aaaatctaaaatg

SEQ ID NO: 5817955 - DNA, 15 bp, Homo sapiens
aaaatctaatattaa

SEQ ID NO: 5817956 - DNA, 17 bp, Homo sapiens
aaaatctaccttctgta

SEQ ID NO: 5817957 - DNA, 18 bp, Homo sapiens
aaaatctaccttctgtag

SEQ ID NO: 5817958 - DNA, 18 bp, Homo sapiens
aaaatctacgtctttatt

SEQ ID NO: 5817959 - DNA, 22 bp, Homo sapiens
aaaatctagtgggttgaccttt

SEQ ID NO: 5817960 - DNA, 14 bp, Homo sapiens
aaaatctagttttt

SEQ ID NO: 5817961 - DNA, 19 bp, Homo sapiens
aaaatctagttttttttgt

SEQ ID NO: 5817962 - DNA, 13 bp, Homo sapiens
aaaatctattctg

SEQ ID NO: 5817963 - DNA, 20 bp, Homo sapiens
aaaatctattttgtaacttt

SEQ ID NO: 5817964 - DNA, 23 bp, Homo sapiens
aaaatctcattatttcaaaatga

SEQ ID NO: 5817965 - DNA, 13 bp, Homo sapiens
aaaatctctcaga

SEQ ID NO: 5817966 - DNA, 15 bp, Homo sapiens
aaaatctcttgatta

SEQ ID NO: 5817967 - DNA, 21 bp, Homo sapiens
aaaatctcttgattataaatg

SEQ ID NO: 5817968 - DNA, 12 bp, Homo sapiens
aaaatctgaaga

SEQ ID NO: 5817969 - DNA, 13 bp, Homo sapiens
aaaatctgaattt

SEQ ID NO: 5817970 - DNA, 12 bp, Homo sapiens
aaaatctgattt

SEQ ID NO: 5817971 - DNA, 15 bp, Homo sapiens
aaaatctgatttaat

SEQ ID NO: 5817972 - DNA, 23 bp, Homo sapiens
aaaatctgatttaatgttttctg

SEQ ID NO: 5817973 - DNA, 13 bp, Homo sapiens
aaaatctgcctgg

SEQ ID NO: 5817974 - DNA, 15 bp, Homo sapiens
aaaatctgctaggga

SEQ ID NO: 5817975 - DNA, 17 bp, Homo sapiens
aaaatctgctgttaact

SEQ ID NO: 5817976 - DNA, 16 bp, Homo sapiens
aaaatctggaaatctg

SEQ ID NO: 5817977 - DNA, 17 bp, Homo sapiens
aaaatctggaaatctgt

SEQ ID NO: 5817978 - DNA, 20 bp, Homo sapiens
aaaatctgttgataaatcca

SEQ ID NO: 5817979 - DNA, 13 bp, Homo sapiens
aaaatctgttggt

SEQ ID NO: 5817980 - DNA, 19 bp, Homo sapiens
aaaatctgtttgatccctg

SEQ ID NO: 5817981 - DNA, 16 bp, Homo sapiens
aaaatcttaatactgt

SEQ ID NO: 5817982 - DNA, 18 bp, Homo sapiens
aaaatcttatagttctag

SEQ ID NO: 5817983 - DNA, 19 bp, Homo sapiens
aaaatcttatagttctagg

SEQ ID NO: 5817984 - DNA, 12 bp, Homo sapiens
aaaatcttatta

SEQ ID NO: 5817985 - DNA, 16 bp, Homo sapiens
aaaatcttattaaagt

SEQ ID NO: 5817986 - DNA, 18 bp, Homo sapiens
aaaatcttattaaagttt

SEQ ID NO: 5817987 - DNA, 23 bp, Homo sapiens
aaaatcttattaaagtttcaaaa

SEQ ID NO: 5817988 - DNA, 19 bp, Homo sapiens
aaaatcttcactgaatatc

SEQ ID NO: 5817989 - DNA, 21 bp, Homo sapiens
aaaatcttcactgaatatcat

SEQ ID NO: 5817990 - DNA, 22 bp, Homo sapiens
aaaatcttcactttcttaagca

SEQ ID NO: 5817991 - DNA, 13 bp, Homo sapiens
aaaatcttcagct

SEQ ID NO: 5817992 - DNA, 14 bp, Homo sapiens
aaaatcttgaaagc

SEQ ID NO: 5817993 - DNA, 18 bp, Homo sapiens
aaaatcttgaaagcgaaa

SEQ ID NO: 5817994 - DNA, 18 bp, Homo sapiens
aaaatcttgatcagttaa

SEQ ID NO: 5817995 - DNA, 14 bp, Homo sapiens
aaaatcttgcataa

SEQ ID NO: 5817996 - DNA, 13 bp, Homo sapiens
aaaatcttggttt

SEQ ID NO: 5817997 - DNA, 11 bp, Homo sapiens
aaaatcttgtc

SEQ ID NO: 5817998 - DNA, 19 bp, Homo sapiens
aaaatcttgttaatgtcat

SEQ ID NO: 5817999 - DNA, 12 bp, Homo sapiens
aaaatctttcag

SEQ ID NO: 5818000 - DNA, 22 bp, Homo sapiens
aaaatctttcagaatacaattc

SEQ ID NO: 5818001 - DNA, 23 bp, Homo sapiens
aaaatctttcagaatacaattca

SEQ ID NO: 5818002 - DNA, 13 bp, Homo sapiens
aaaatctttcttt

SEQ ID NO: 5818003 - DNA, 20 bp, Homo sapiens
aaaatctttctttcttagaa

SEQ ID NO: 5818004 - DNA, 15 bp, Homo sapiens
aaaatctttctttgg

SEQ ID NO: 5818005 - DNA, 16 bp, Homo sapiens
aaaatgaaaaaaaaag

SEQ ID NO: 5818006 - DNA, 18 bp, Homo sapiens
aaaatgaaaagagaaact

SEQ ID NO: 5818007 - DNA, 19 bp, Homo sapiens
aaaatgaaaagagaaactt

SEQ ID NO: 5818008 - DNA, 16 bp, Homo sapiens
aaaatgaaaagcaata

SEQ ID NO: 5818009 - DNA, 15 bp, Homo sapiens
aaaatgaaaagccaa

SEQ ID NO: 5818010 - DNA, 17 bp, Homo sapiens
aaaatgaaaataagtga

SEQ ID NO: 5818011 - DNA, 15 bp, Homo sapiens
aaaattctgaatgta

SEQ ID NO: 5818012 - DNA, 14 bp, Homo sapiens
aaaattctgatgtt

SEQ ID NO: 5818013 - DNA, 20 bp, Homo sapiens
aaaattctgatgtttctgtg

SEQ ID NO: 5818014 - DNA, 21 bp, Homo sapiens
aaaattctgatgtttctgtga

SEQ ID NO: 5818015 - DNA, 14 bp, Homo sapiens
aaaattctgtgcct

SEQ ID NO: 5818016 - DNA, 18 bp, Homo sapiens
aaaattctgttggtgcca

SEQ ID NO: 5818017 - DNA, 14 bp, Homo sapiens
aaaattctgttgtt

SEQ ID NO: 5818018 - DNA, 23 bp, Homo sapiens
aaaattctgttgttccattttat

SEQ ID NO: 5818019 - DNA, 17 bp, Homo sapiens
aaaattcttgagaagta

SEQ ID NO: 5818020 - DNA, 20 bp, Homo sapiens
aaaattctttcacttgatgt

SEQ ID NO: 5818021 - DNA, 13 bp, Homo sapiens
aaaattgaaaaaa

SEQ ID NO: 5818022 - DNA, 14 bp, Homo sapiens
aaaattgaaaaaag

SEQ ID NO: 5818023 - DNA, 20 bp, Homo sapiens
aaaattgaaaaataaaaacc

SEQ ID NO: 5818024 - DNA, 13 bp, Homo sapiens
aaaattgaaaaca

SEQ ID NO: 5818025 - DNA, 12 bp, Homo sapiens
aaaattgaactg

SEQ ID NO: 5818026 - DNA, 12 bp, Homo sapiens
aaaattgaatgc

SEQ ID NO: 5818027 - DNA, 22 bp, Homo sapiens
aaaattgaattcgtttctgaca

SEQ ID NO: 5818028 - DNA, 14 bp, Homo sapiens
aaaattgacaaaaa

SEQ ID NO: 5818029 - DNA, 19 bp, Homo sapiens
aaaattgacctcaaaagaa

SEQ ID NO: 5818030 - DNA, 23 bp, Homo sapiens
aaaattgacttagatattaaaat

SEQ ID NO: 5818031 - DNA, 23 bp, Homo sapiens
aaaattgagttcttcctgtaatc

SEQ ID NO: 5818032 - DNA, 19 bp, Homo sapiens
aaaattgagtttcagaata

SEQ ID NO: 5818033 - DNA, 14 bp, Homo sapiens
aaaattgataatta

SEQ ID NO: 5818034 - DNA, 13 bp, Homo sapiens
aaaattgatattt

SEQ ID NO: 5818035 - DNA, 12 bp, Homo sapiens
aaaattgatgtg

SEQ ID NO: 5818036 - DNA, 14 bp, Homo sapiens
aaaattgatgtgtt

SEQ ID NO: 5818037 - DNA, 20 bp, Homo sapiens
aaaattgatttccatatttt

SEQ ID NO: 5818038 - DNA, 21 bp, Homo sapiens
aaaattgatttttctcttcat

SEQ ID NO: 5818039 - DNA, 9 bp, Homo sapiens
aaaattgca

SEQ ID NO: 5818040 - DNA, 15 bp, Homo sapiens
aaaattgcaaatctt

SEQ ID NO: 5818041 - DNA, 18 bp, Homo sapiens
aaaattgcagcagttgct

SEQ ID NO: 5818042 - DNA, 20 bp, Homo sapiens
aaaattgcatgaaactaggc

SEQ ID NO: 5818043 - DNA, 17 bp, Homo sapiens
aaaattgccatattgca

SEQ ID NO: 5818044 - DNA, 18 bp, Homo sapiens
aaaattgccatattgcac

SEQ ID NO: 5818045 - DNA, 17 bp, Homo sapiens
aaaattgccattttatt

SEQ ID NO: 5818046 - DNA, 15 bp, Homo sapiens
aaaattgcctttaaa

SEQ ID NO: 5818047 - DNA, 19 bp, Homo sapiens
aaaattgctagtgatttca

SEQ ID NO: 5818048 - DNA, 14 bp, Homo sapiens
aaaattgctataaa

SEQ ID NO: 5818049 - DNA, 18 bp, Homo sapiens
aaaattgctataaatcga

SEQ ID NO: 5818050 - DNA, 12 bp, Homo sapiens
aaaattgcttct

SEQ ID NO: 5818051 - DNA, 22 bp, Homo sapiens
aaaattgcttttgagagaacat

SEQ ID NO: 5818052 - DNA, 22 bp, Homo sapiens
aaaattggacattaagcatcac

SEQ ID NO: 5818053 - DNA, 16 bp, Homo sapiens
aaaattggcaaaacta

SEQ ID NO: 5818054 - DNA, 18 bp, Homo sapiens
aaaattggcattttaagt

SEQ ID NO: 5818055 - DNA, 20 bp, Homo sapiens
aaaattggtaattgaatgga

SEQ ID NO: 5818056 - DNA, 22 bp, Homo sapiens
aaaattggtatatttgaaataa

SEQ ID NO: 5818057 - DNA, 16 bp, Homo sapiens
aaaattggttggagaa

SEQ ID NO: 5818058 - DNA, 17 bp, Homo sapiens
aaaattggttggagaat

SEQ ID NO: 5818059 - DNA, 18 bp, Homo sapiens
aaaattgtataccaatgt

SEQ ID NO: 5818060 - DNA, 13 bp, Homo sapiens
aaaattgtataga

SEQ ID NO: 5818061 - DNA, 13 bp, Homo sapiens
aaaattgtattga

SEQ ID NO: 5818062 - DNA, 22 bp, Homo sapiens
aaaattgtattgaaaacactta

SEQ ID NO: 5818063 - DNA, 22 bp, Homo sapiens
aaaattgtgatgttttgttcaa

SEQ ID NO: 5818064 - DNA, 19 bp, Homo sapiens
aaaattgtgtccacataat

SEQ ID NO: 5818065 - DNA, 19 bp, Homo sapiens
aaaattgtgtttagatttt

SEQ ID NO: 5818066 - DNA, 21 bp, Homo sapiens
aaaattgtgtttagattttat

SEQ ID NO: 5818067 - DNA, 20 bp, Homo sapiens
aaaattgttaatttttccta

SEQ ID NO: 5818068 - DNA, 21 bp, Homo sapiens
aaaattgttacccatttgaaa

SEQ ID NO: 5818069 - DNA, 16 bp, Homo sapiens
aaaattgttataatta

SEQ ID NO: 5818070 - DNA, 22 bp, Homo sapiens
aaaattgttataattagagttg

SEQ ID NO: 5818071 - DNA, 21 bp, Homo sapiens
aaaattgtttcttgacaagct

SEQ ID NO: 5818072 - DNA, 15 bp, Homo sapiens
aaaattgttttcact

SEQ ID NO: 5818073 - DNA, 20 bp, Homo sapiens
aaaattgtttttaatttgaa

SEQ ID NO: 5818074 - DNA, 19 bp, Homo sapiens
aaaatttaaaaagcccaac

SEQ ID NO: 5818075 - DNA, 19 bp, Homo sapiens
aaaatttaaaagtaaaatg

SEQ ID NO: 5818076 - DNA, 16 bp, Homo sapiens
aaaatttaaaattacg

SEQ ID NO: 5818077 - DNA, 15 bp, Homo sapiens
aaaatttaacatctg

SEQ ID NO: 5818078 - DNA, 23 bp, Homo sapiens
aaaatttaacatctgcagtgttc

SEQ ID NO: 5818079 - DNA, 14 bp, Homo sapiens
aaaatttaagcatt

SEQ ID NO: 5818080 - DNA, 15 bp, Homo sapiens
aaaatttaagcattg

SEQ ID NO: 5818081 - DNA, 23 bp, Homo sapiens
aaaatttaagcattgtttgctta

SEQ ID NO: 5818082 - DNA, 15 bp, Homo sapiens
aaaatttaagtgcgt

SEQ ID NO: 5818083 - DNA, 23 bp, Homo sapiens
aaaatttaagtgcgtgtgtagag

SEQ ID NO: 5818084 - DNA, 11 bp, Homo sapiens
aaaatttaatt

SEQ ID NO: 5818085 - DNA, 14 bp, Homo sapiens
aaaatttaattatt

SEQ ID NO: 5818086 - DNA, 21 bp, Homo sapiens
aaaatttaattgtgtaactgt

SEQ ID NO: 5818087 - DNA, 23 bp, Homo sapiens
aaaatttaattgtgtaactgttc

SEQ ID NO: 5818088 - DNA, 18 bp, Homo sapiens
aaaatttaatttctgaaa

SEQ ID NO: 5818089 - DNA, 19 bp, Homo sapiens
aaaatttacacatcttaaa

SEQ ID NO: 5818090 - DNA, 20 bp, Homo sapiens
aaaatttacacatcttaaaa

SEQ ID NO: 5818091 - DNA, 22 bp, Homo sapiens
aaaatttacatttaatacagat

SEQ ID NO: 5818092 - DNA, 20 bp, Homo sapiens
aaaatttacctttaaaataa

SEQ ID NO: 5818093 - DNA, 21 bp, Homo sapiens
aaaatttactacaatatgtac

SEQ ID NO: 5818094 - DNA, 17 bp, Homo sapiens
aaaatttagatttaatt

SEQ ID NO: 5818095 - DNA, 15 bp, Homo sapiens
aaaatttagtttttg

SEQ ID NO: 5818096 - DNA, 12 bp, Homo sapiens
aaaatttataca

SEQ ID NO: 5818097 - DNA, 14 bp, Homo sapiens
aaaatttatacacc

SEQ ID NO: 5818098 - DNA, 21 bp, Homo sapiens
aaaatttatacaccagcaatt

SEQ ID NO: 5818099 - DNA, 15 bp, Homo sapiens
aaaatttatataact

SEQ ID NO: 5818100 - DNA, 13 bp, Homo sapiens
aaaatttatatgt

SEQ ID NO: 5818101 - DNA, 15 bp, Homo sapiens
aaaatttatgtcatt

SEQ ID NO: 5818102 - DNA, 20 bp, Homo sapiens
aaaatttatgtcattttcag

SEQ ID NO: 5818103 - DNA, 20 bp, Homo sapiens
aaaatttattatatatttac

SEQ ID NO: 5818104 - DNA, 22 bp, Homo sapiens
aaaatttattatatatttacag

SEQ ID NO: 5818105 - DNA, 14 bp, Homo sapiens
aaaatttatttcat

SEQ ID NO: 5818106 - DNA, 18 bp, Homo sapiens
aaaatttattttataaga

SEQ ID NO: 5818107 - DNA, 20 bp, Homo sapiens
aaaatttattttataagaaa

SEQ ID NO: 5818108 - DNA, 23 bp, Homo sapiens
aaaatttccagtacctttgtcac

SEQ ID NO: 5818109 - DNA, 22 bp, Homo sapiens
aaaatttcctccacattcatgt

SEQ ID NO: 5818110 - DNA, 19 bp, Homo sapiens
aaaatttccttcaggtttt

SEQ ID NO: 5818111 - DNA, 23 bp, Homo sapiens
aaaatttcgttgtccaatttgta

SEQ ID NO: 5818112 - DNA, 19 bp, Homo sapiens
aaaatttgaaacattgctt

SEQ ID NO: 5818113 - DNA, 20 bp, Homo sapiens
aaaatttgaaacattgcttt

SEQ ID NO: 5818114 - DNA, 12 bp, Homo sapiens
aaaatttgaagt

SEQ ID NO: 5818115 - DNA, 23 bp, Homo sapiens
aaaatttgacattgtcagaatgt

SEQ ID NO: 5818116 - DNA, 23 bp, Homo sapiens
aaaatttgatggtgaatattaca

SEQ ID NO: 5818117 - DNA, 16 bp, Homo sapiens
aaaatttgccctccca

SEQ ID NO: 5818118 - DNA, 20 bp, Homo sapiens
aaaatttggtgcttataaga

SEQ ID NO: 5818119 - DNA, 13 bp, Homo sapiens
aaaatttgtaata

SEQ ID NO: 5818120 - DNA, 15 bp, Homo sapiens
aaaatttgtgtgctt

SEQ ID NO: 5818121 - DNA, 13 bp, Homo sapiens
aaaatttgtttaa

SEQ ID NO: 5818122 - DNA, 15 bp, Homo sapiens
aaaatttgtttgaca

SEQ ID NO: 5818123 - DNA, 14 bp, Homo sapiens
aaaatttgttttca

SEQ ID NO: 5818124 - DNA, 20 bp, Homo sapiens
aaaatttgttttcaacaatt

SEQ ID NO: 5818125 - DNA, 21 bp, Homo sapiens
aaaatttgttttcaacaattg

SEQ ID NO: 5818126 - DNA, 10 bp, Homo sapiens
aaaattttaa

SEQ ID NO: 5818127 - DNA, 15 bp, Homo sapiens
aaaattttaacacta

SEQ ID NO: 5818128 - DNA, 12 bp, Homo sapiens
aaaattttaaga

SEQ ID NO: 5818129 - DNA, 19 bp, Homo sapiens
aaaattttaagaagaaaga

SEQ ID NO: 5818130 - DNA, 22 bp, Homo sapiens
aaaattttaagaagaaagattt

SEQ ID NO: 5818131 - DNA, 16 bp, Homo sapiens
aaaattttaagtatct

SEQ ID NO: 5818132 - DNA, 22 bp, Homo sapiens
aaaattttaccagcagaaggat

SEQ ID NO: 5818133 - DNA, 15 bp, Homo sapiens
aaaattttagatgta

SEQ ID NO: 5818134 - DNA, 19 bp, Homo sapiens
aaaattttaggcaagtttt

SEQ ID NO: 5818135 - DNA, 21 bp, Homo sapiens
aaaattttataaaattaagca

SEQ ID NO: 5818136 - DNA, 13 bp, Homo sapiens
aaaattttataag

SEQ ID NO: 5818137 - DNA, 14 bp, Homo sapiens
aaaattttatagct

SEQ ID NO: 5818138 - DNA, 19 bp, Homo sapiens
aaaattttattgaatataa

SEQ ID NO: 5818139 - DNA, 12 bp, Homo sapiens
aaaattttattt

SEQ ID NO: 5818140 - DNA, 12 bp, Homo sapiens
aaaattttcatt

SEQ ID NO: 5818141 - DNA, 14 bp, Homo sapiens
aaaattttctaaga

SEQ ID NO: 5818142 - DNA, 15 bp, Homo sapiens
aaaattttctcattt

SEQ ID NO: 5818143 - DNA, 15 bp, Homo sapiens
aaaattttcttcttt

SEQ ID NO: 5818144 - DNA, 16 bp, Homo sapiens
aaaattttcttcttta

SEQ ID NO: 5818145 - DNA, 22 bp, Homo sapiens
aaaattttctttcaacatttct

SEQ ID NO: 5818146 - DNA, 14 bp, Homo sapiens
aaaattttgaatgt

SEQ ID NO: 5818147 - DNA, 11 bp, Homo sapiens
aaaattttgca

SEQ ID NO: 5818148 - DNA, 16 bp, Homo sapiens
aaaattttgcatttca

SEQ ID NO: 5818149 - DNA, 16 bp, Homo sapiens
aaaattttgcctaata

SEQ ID NO: 5818150 - DNA, 22 bp, Homo sapiens
aaaattttgctccccagtgaag

SEQ ID NO: 5818151 - DNA, 21 bp, Homo sapiens
aaaattttggaatatttgctt

SEQ ID NO: 5818152 - DNA, 12 bp, Homo sapiens
aaaattttgtaa

SEQ ID NO: 5818153 - DNA, 18 bp, Homo sapiens
aaaattttgtaaaacaat

SEQ ID NO: 5818154 - DNA, 23 bp, Homo sapiens
aaaattttgtaaaacaatgccat

SEQ ID NO: 5818155 - DNA, 19 bp, Homo sapiens
aaaattttgtaattttctt

SEQ ID NO: 5818156 - DNA, 22 bp, Homo sapiens
aaaattttgtatgttaaagaga

SEQ ID NO: 5818157 - DNA, 16 bp, Homo sapiens
aaaattttgtgacatt

SEQ ID NO: 5818158 - DNA, 22 bp, Homo sapiens
aaaattttgtgagtgactcggt

SEQ ID NO: 5818159 - DNA, 10 bp, Homo sapiens
aaaattttta

SEQ ID NO: 5818160 - DNA, 17 bp, Homo sapiens
aaaatttttaaaactgc

SEQ ID NO: 5818161 - DNA, 20 bp, Homo sapiens
aaaatttttaaaatacttgt

SEQ ID NO: 5818162 - DNA, 15 bp, Homo sapiens
aaaatttttaatctt

SEQ ID NO: 5818163 - DNA, 17 bp, Homo sapiens
aaaatttttacattcat

SEQ ID NO: 5818164 - DNA, 18 bp, Homo sapiens
aaaatttttatgtaatta

SEQ ID NO: 5818165 - DNA, 15 bp, Homo sapiens
aaaatttttcttttc

SEQ ID NO: 5818166 - DNA, 19 bp, Homo sapiens
aaaatttttgacacttttt

SEQ ID NO: 5818167 - DNA, 23 bp, Homo sapiens
aaaatttttggattgacagtaac

SEQ ID NO: 5818168 - DNA, 16 bp, Homo sapiens
aaaattttttttcatg

SEQ ID NO: 5818169 - DNA, 17 bp, Homo sapiens
aaaattttttttcatgt

SEQ ID NO: 5818170 - DNA, 9 bp, Homo sapiens
aaacaaaaa

SEQ ID NO: 5818171 - DNA, 14 bp, Homo sapiens
aaacaaaaaaaaca

SEQ ID NO: 5818172 - DNA, 14 bp, Homo sapiens
aaacaaaaaaagac

SEQ ID NO: 5818173 - DNA, 15 bp, Homo sapiens
aaacaaaaaaagaca

SEQ ID NO: 5818174 - DNA, 12 bp, Homo sapiens
aaacaaaaaact

SEQ ID NO: 5818175 - DNA, 13 bp, Homo sapiens
aaacaaaaaactt

SEQ ID NO: 5818176 - DNA, 19 bp, Homo sapiens
aaacaaaaacagaatttga

SEQ ID NO: 5818177 - DNA, 18 bp, Homo sapiens
aaacaaaaactttccatg

SEQ ID NO: 5818178 - DNA, 12 bp, Homo sapiens
aaacaaaaagac

SEQ ID NO: 5818179 - DNA, 13 bp, Homo sapiens
aaacaaaaagccc

SEQ ID NO: 5818180 - DNA, 16 bp, Homo sapiens
aaacaaaaatagaata

SEQ ID NO: 5818181 - DNA, 17 bp, Homo sapiens
aaacaaaaatagaatat

SEQ ID NO: 5818182 - DNA, 14 bp, Homo sapiens
aaacaaaaatatct

SEQ ID NO: 5818183 - DNA, 16 bp, Homo sapiens
aaacaaaaatatcttg

SEQ ID NO: 5818184 - DNA, 17 bp, Homo sapiens
aaacaaaaatgactcta

SEQ ID NO: 5818185 - DNA, 12 bp, Homo sapiens
aaacaaaacaaa

SEQ ID NO: 5818186 - DNA, 17 bp, Homo sapiens
aaacaaaacaaaacaaa

SEQ ID NO: 5818187 - DNA, 16 bp, Homo sapiens
aaacaaaacaaacaca

SEQ ID NO: 5818188 - DNA, 14 bp, Homo sapiens
aaacaaaacaaact

SEQ ID NO: 5818189 - DNA, 18 bp, Homo sapiens
aaacaaaacaaacttcca

SEQ ID NO: 5818190 - DNA, 23 bp, Homo sapiens
aaacacctgacagcccctccctc

SEQ ID NO: 5818191 - DNA, 12 bp, Homo sapiens
aaacacctgctg

SEQ ID NO: 5818192 - DNA, 22 bp, Homo sapiens
aaacaccttccagctcctgtaa

SEQ ID NO: 5818193 - DNA, 15 bp, Homo sapiens
aaacaccttctctgg

SEQ ID NO: 5818194 - DNA, 22 bp, Homo sapiens
aaacacctttattttatttttt

SEQ ID NO: 5818195 - DNA, 21 bp, Homo sapiens
aaacacgcacttagtctctaa

SEQ ID NO: 5818196 - DNA, 22 bp, Homo sapiens
aaacacgccttgttcctgctct

SEQ ID NO: 5818197 - DNA, 18 bp, Homo sapiens
aaacacggccctcctggg

SEQ ID NO: 5818198 - DNA, 15 bp, Homo sapiens
aaacacgtggtcatg

SEQ ID NO: 5818199 - DNA, 22 bp, Homo sapiens
aaacacgtggtcatgaatagaa

SEQ ID NO: 5818200 - DNA, 21 bp, Homo sapiens
aaacacgtgtctataatggaa

SEQ ID NO: 5818201 - DNA, 17 bp, Homo sapiens
aaacacgttttaaggac

SEQ ID NO: 5818202 - DNA, 14 bp, Homo sapiens
aaacactaaaagca

SEQ ID NO: 5818203 - DNA, 13 bp, Homo sapiens
aaacactaaatgt

SEQ ID NO: 5818204 - DNA, 19 bp, Homo sapiens
aaacactaaggctgcttca

SEQ ID NO: 5818205 - DNA, 21 bp, Homo sapiens
aaacactacacatttgaaaca

SEQ ID NO: 5818206 - DNA, 23 bp, Homo sapiens
aaacactagtaccttcagatcct

SEQ ID NO: 5818207 - DNA, 13 bp, Homo sapiens
aaacactattctc

SEQ ID NO: 5818208 - DNA, 19 bp, Homo sapiens
aaacactatttgtgacttt

SEQ ID NO: 5818209 - DNA, 23 bp, Homo sapiens
aaacactatttttttttcttttg

SEQ ID NO: 5818210 - DNA, 22 bp, Homo sapiens
aaacactcaagttgattagaaa

SEQ ID NO: 5818211 - DNA, 14 bp, Homo sapiens
aaacactcagctgt

SEQ ID NO: 5818212 - DNA, 15 bp, Homo sapiens
aaacactcagctgtt

SEQ ID NO: 5818213 - DNA, 13 bp, Homo sapiens
aaacactcatccc

SEQ ID NO: 5818214 - DNA, 16 bp, Homo sapiens
aaacactccacagtgt

SEQ ID NO: 5818215 - DNA, 21 bp, Homo sapiens
aaacactccacagtgtttata

SEQ ID NO: 5818216 - DNA, 18 bp, Homo sapiens
aaacactccacattcttc

SEQ ID NO: 5818217 - DNA, 20 bp, Homo sapiens
aaacactccaccctccacct

SEQ ID NO: 5818218 - DNA, 13 bp, Homo sapiens
aaacactccttgc

SEQ ID NO: 5818219 - DNA, 15 bp, Homo sapiens
aaacactccttgcat

SEQ ID NO: 5818220 - DNA, 20 bp, Homo sapiens
aaacactcgtgtgcatgaga

SEQ ID NO: 5818221 - DNA, 22 bp, Homo sapiens
aaacactcgtgtgcatgagaat

SEQ ID NO: 5818222 - DNA, 18 bp, Homo sapiens
aaacactctaaataaatt

SEQ ID NO: 5818223 - DNA, 21 bp, Homo sapiens
aaacactctcactatgctgct

SEQ ID NO: 5818224 - DNA, 13 bp, Homo sapiens
aaacactgaaaaa

SEQ ID NO: 5818225 - DNA, 13 bp, Homo sapiens
aaacactgcaaat

SEQ ID NO: 5818226 - DNA, 19 bp, Homo sapiens
aaacactgcagtttcctgg

SEQ ID NO: 5818227 - DNA, 23 bp, Homo sapiens
aaacactgccatattgtgtaatt

SEQ ID NO: 5818228 - DNA, 14 bp, Homo sapiens
aaacactgcctgcc

SEQ ID NO: 5818229 - DNA, 19 bp, Homo sapiens
aaacactgcttaaggaaaa

SEQ ID NO: 5818230 - DNA, 22 bp, Homo sapiens
aaacactgcttaaggaaaagag

SEQ ID NO: 5818231 - DNA, 12 bp, Homo sapiens
aaacactgcttc

SEQ ID NO: 5818232 - DNA, 13 bp, Homo sapiens
aaacactggacct

SEQ ID NO: 5818233 - DNA, 14 bp, Homo sapiens
aaacactggacctg

SEQ ID NO: 5818234 - DNA, 16 bp, Homo sapiens
aaacactggtgccaac

SEQ ID NO: 5818235 - DNA, 15 bp, Homo sapiens
aaacactgtaatctt

SEQ ID NO: 5818236 - DNA, 13 bp, Homo sapiens
aaacactgtgcac

SEQ ID NO: 5818237 - DNA, 12 bp, Homo sapiens
aaacactgtgta

SEQ ID NO: 5818238 - DNA, 13 bp, Homo sapiens
aaacactgtgtat

SEQ ID NO: 5818239 - DNA, 20 bp, Homo sapiens
aaacactgttttatagaaaa

SEQ ID NO: 5818240 - DNA, 15 bp, Homo sapiens
aaacacttaggaaga

SEQ ID NO: 5818241 - DNA, 20 bp, Homo sapiens
aaacacttaggaagaaatca

SEQ ID NO: 5818242 - DNA, 18 bp, Homo sapiens
aaacacttctcatcatat

SEQ ID NO: 5818243 - DNA, 15 bp, Homo sapiens
aaacacttctcctta

SEQ ID NO: 5818244 - DNA, 18 bp, Homo sapiens
aaacacttctccttaacc

SEQ ID NO: 5818245 - DNA, 24 bp, Homo sapiens
aaacacttgcggatattctggact

SEQ ID NO: 5818246 - DNA, 21 bp, Homo sapiens
aaacacttggcatacaaaata

SEQ ID NO: 5818247 - DNA, 20 bp, Homo sapiens
aaacacttgtgacttttgct

SEQ ID NO: 5818248 - DNA, 21 bp, Homo sapiens
aaacactttctcttcttgttt

SEQ ID NO: 5818249 - DNA, 21 bp, Homo sapiens
aaacactttgaggacatttat

SEQ ID NO: 5818250 - DNA, 17 bp, Homo sapiens
aaacactttgcctcctg

SEQ ID NO: 5818251 - DNA, 14 bp, Homo sapiens
aaacactttttctg

SEQ ID NO: 5818252 - DNA, 12 bp, Homo sapiens
aaacagaaaaaa

SEQ ID NO: 5818253 - DNA, 17 bp, Homo sapiens
aaacagaaaaaaaacac

SEQ ID NO: 5818254 - DNA, 15 bp, Homo sapiens
aaacagaaaaacaaa

SEQ ID NO: 5818255 - DNA, 18 bp, Homo sapiens
aaacagaaaaacagacaa

SEQ ID NO: 5818256 - DNA, 11 bp, Homo sapiens
aaacagaaaac

SEQ ID NO: 5818257 - DNA, 14 bp, Homo sapiens
aaacagaaaagaga

SEQ ID NO: 5818258 - DNA, 18 bp, Homo sapiens
aaacagaaaagagaagaa

SEQ ID NO: 5818259 - DNA, 13 bp, Homo sapiens
aaacagaaaaggt

SEQ ID NO: 5818260 - DNA, 15 bp, Homo sapiens
aaacagaaaaggttc

SEQ ID NO: 5818261 - DNA, 13 bp, Homo sapiens
aaacagaaacaaa

SEQ ID NO: 5818262 - DNA, 19 bp, Homo sapiens
aaacagaaacaaaaacact

SEQ ID NO: 5818263 - DNA, 11 bp, Homo sapiens
aaacagaaata

SEQ ID NO: 5818264 - DNA, 14 bp, Homo sapiens
aaacagaaattgca

SEQ ID NO: 5818265 - DNA, 15 bp, Homo sapiens
aaacagaaattgcaa

SEQ ID NO: 5818266 - DNA, 12 bp, Homo sapiens
aaacagaacagg

SEQ ID NO: 5818267 - DNA, 15 bp, Homo sapiens
aaacagaacagggtc

SEQ ID NO: 5818268 - DNA, 15 bp, Homo sapiens
aaacagaacatttct

SEQ ID NO: 5818269 - DNA, 18 bp, Homo sapiens
aaacagaacatttctcat

SEQ ID NO: 5818270 - DNA, 23 bp, Homo sapiens
aaacagaagacaaaattgtaagc

SEQ ID NO: 5818271 - DNA, 22 bp, Homo sapiens
aaacagaagattacaaaagcaa

SEQ ID NO: 5818272 - DNA, 12 bp, Homo sapiens
aaacagaaggag

SEQ ID NO: 5818273 - DNA, 13 bp, Homo sapiens
aaacagaataaaa

SEQ ID NO: 5818274 - DNA, 16 bp, Homo sapiens
aaacagacaaaaacaa

SEQ ID NO: 5818275 - DNA, 22 bp, Homo sapiens
aaacagacaaaaacagcctcac

SEQ ID NO: 5818276 - DNA, 16 bp, Homo sapiens
aaacagacaagcaggc

SEQ ID NO: 5818277 - DNA, 20 bp, Homo sapiens
aaacagactcgattcatatt

SEQ ID NO: 5818278 - DNA, 21 bp, Homo sapiens
aaacagagaaagaaaaggcaa

SEQ ID NO: 5818279 - DNA, 23 bp, Homo sapiens
aaacagagaaagaaaaggcaaaa

SEQ ID NO: 5818280 - DNA, 16 bp, Homo sapiens
aaacagagatgtgata

SEQ ID NO: 5818281 - DNA, 17 bp, Homo sapiens
aaacagagcctgcctaa

SEQ ID NO: 5818282 - DNA, 23 bp, Homo sapiens
aaacagagcctgcctaaccaggc

SEQ ID NO: 5818283 - DNA, 16 bp, Homo sapiens
aaacagagctactgag

SEQ ID NO: 5818284 - DNA, 20 bp, Homo sapiens
aaacagagtccaatttaagg

SEQ ID NO: 5818285 - DNA, 19 bp, Homo sapiens
aaacagataccatactcat

SEQ ID NO: 5818286 - DNA, 12 bp, Homo sapiens
aaacagatattg

SEQ ID NO: 5818287 - DNA, 14 bp, Homo sapiens
aaacagatgaaaag

SEQ ID NO: 5818288 - DNA, 18 bp, Homo sapiens
aaacagatgagaagacta

SEQ ID NO: 5818289 - DNA, 18 bp, Homo sapiens
aaacagatgataaatatt

SEQ ID NO: 5818290 - DNA, 21 bp, Homo sapiens
aaacagatgatgagaatttct

SEQ ID NO: 5818291 - DNA, 17 bp, Homo sapiens
aaacagatggtagagag

SEQ ID NO: 5818292 - DNA, 18 bp, Homo sapiens
aaacagatgtgaatattc

SEQ ID NO: 5818293 - DNA, 20 bp, Homo sapiens
aaacagattcaggccagccc

SEQ ID NO: 5818294 - DNA, 15 bp, Homo sapiens
aaacagatttaagca

SEQ ID NO: 5818295 - DNA, 19 bp, Homo sapiens
aaacagatttttacaaatg

SEQ ID NO: 5818296 - DNA, 23 bp, Homo sapiens
aaacagcaaaccaagagattgct

SEQ ID NO: 5818297 - DNA, 15 bp, Homo sapiens
aaacagcaaagccat

SEQ ID NO: 5818298 - DNA, 15 bp, Homo sapiens
aaacagcacacctgt

SEQ ID NO: 5818299 - DNA, 16 bp, Homo sapiens
aaacagcacacctgtg

SEQ ID NO: 5818300 - DNA, 22 bp, Homo sapiens
aaacagcacacctgtgtccaag

SEQ ID NO: 5818301 - DNA, 20 bp, Homo sapiens
aaacagcaccaccatttaat

SEQ ID NO: 5818302 - DNA, 16 bp, Homo sapiens
aaacagcagggtttga

SEQ ID NO: 5818303 - DNA, 18 bp, Homo sapiens
aaacagcagggtttgagc

SEQ ID NO: 5818304 - DNA, 11 bp, Homo sapiens
aaacagcatga

SEQ ID NO: 5818305 - DNA, 23 bp, Homo sapiens
aaacagcatgaataaaacactca

SEQ ID NO: 5818306 - DNA, 21 bp, Homo sapiens
aaacagcattgctttctgaaa

SEQ ID NO: 5818307 - DNA, 21 bp, Homo sapiens
aaacagcccttccttggggaa

SEQ ID NO: 5818308 - DNA, 15 bp, Homo sapiens
aaacagcctcacaga

SEQ ID NO: 5818309 - DNA, 11 bp, Homo sapiens
aaacagcctgg

SEQ ID NO: 5818310 - DNA, 21 bp, Homo sapiens
aaacagcctgggtaggaaaat

SEQ ID NO: 5818311 - DNA, 16 bp, Homo sapiens
aaacagcgtcttcctt

SEQ ID NO: 5818312 - DNA, 15 bp, Homo sapiens
aaacagctaaatttg

SEQ ID NO: 5818313 - DNA, 14 bp, Homo sapiens
aaacagctattata

SEQ ID NO: 5818314 - DNA, 14 bp, Homo sapiens
aaacagctatttaa

SEQ ID NO: 5818315 - DNA, 18 bp, Homo sapiens
aaacagctatttaagggg

SEQ ID NO: 5818316 - DNA, 20 bp, Homo sapiens
aaacagctgaaagaggagga

SEQ ID NO: 5818317 - DNA, 14 bp, Homo sapiens
aaacagctgcctct

SEQ ID NO: 5818318 - DNA, 15 bp, Homo sapiens
aaacagctgccttag

SEQ ID NO: 5818319 - DNA, 18 bp, Homo sapiens
aaacagctgccttagctt

SEQ ID NO: 5818320 - DNA, 19 bp, Homo sapiens
aaacagctgccttagcttc

SEQ ID NO: 5818321 - DNA, 22 bp, Homo sapiens
aaacagctgccttagcttcagg

SEQ ID NO: 5818322 - DNA, 13 bp, Homo sapiens
aaacagctgcttt

SEQ ID NO: 5818323 - DNA, 17 bp, Homo sapiens
aaacagcttaaattctt

SEQ ID NO: 5818324 - DNA, 20 bp, Homo sapiens
aaacagcttcatgcctttgt

SEQ ID NO: 5818325 - DNA, 15 bp, Homo sapiens
aaacagcttgttcta

SEQ ID NO: 5818326 - DNA, 18 bp, Homo sapiens
aaacagctttcaagtgcc

SEQ ID NO: 5818327 - DNA, 19 bp, Homo sapiens
aaacagctttcaagtgcct

SEQ ID NO: 5818328 - DNA, 20 bp, Homo sapiens
aaacaggaaaaaaactttta

SEQ ID NO: 5818329 - DNA, 23 bp, Homo sapiens
aaacaggaaaggagcaatgaaga

SEQ ID NO: 5818330 - DNA, 15 bp, Homo sapiens
aaacaggaatgtctg

SEQ ID NO: 5818331 - DNA, 16 bp, Homo sapiens
aaacaggaattttatt

SEQ ID NO: 5818332 - DNA, 21 bp, Homo sapiens
aaacaggacttaaaatgacat

SEQ ID NO: 5818333 - DNA, 16 bp, Homo sapiens
aaacaggagacaggaa

SEQ ID NO: 5818334 - DNA, 23 bp, Homo sapiens
aaacaggcaaagttttacagaga

SEQ ID NO: 5818335 - DNA, 11 bp, Homo sapiens
aaacaggcagt

SEQ ID NO: 5818336 - DNA, 10 bp, Homo sapiens
aaacagggca

SEQ ID NO: 5818337 - DNA, 13 bp, Homo sapiens
aaacagggcagca

SEQ ID NO: 5818338 - DNA, 17 bp, Homo sapiens
aaacagggcatctccag

SEQ ID NO: 5818339 - DNA, 19 bp, Homo sapiens
aaacagggcatctccagga

SEQ ID NO: 5818340 - DNA, 15 bp, Homo sapiens
aaacagggctttact

SEQ ID NO: 5818341 - DNA, 19 bp, Homo sapiens
aaacagggggaaaatgttt

SEQ ID NO: 5818342 - DNA, 15 bp, Homo sapiens
aaacaggggggccct

SEQ ID NO: 5818343 - DNA, 15 bp, Homo sapiens
aaacagggtctggga

SEQ ID NO: 5818344 - DNA, 18 bp, Homo sapiens
aaacaggtatatactttg

SEQ ID NO: 5818345 - DNA, 21 bp, Homo sapiens
aaacaggtatatactttgaaa

SEQ ID NO: 5818346 - DNA, 21 bp, Homo sapiens
aaacaggtatttttttaaatc

SEQ ID NO: 5818347 - DNA, 22 bp, Homo sapiens
aaacaggtatttttttaaatca

SEQ ID NO: 5818348 - DNA, 23 bp, Homo sapiens
aaacaggtatttttttaaatcaa

SEQ ID NO: 5818349 - DNA, 20 bp, Homo sapiens
aaacaggtcgagctgtgctc

SEQ ID NO: 5818350 - DNA, 18 bp, Homo sapiens
aaacaggtgctaacactg

SEQ ID NO: 5818351 - DNA, 17 bp, Homo sapiens
aaacaggtgctggccca

SEQ ID NO: 5818352 - DNA, 18 bp, Homo sapiens
aaacaggtgctggcccag

SEQ ID NO: 5818353 - DNA, 18 bp, Homo sapiens
aaacaggtggtgagaaat

SEQ ID NO: 5818354 - DNA, 19 bp, Homo sapiens
aaacaggtggttcttttta

SEQ ID NO: 5818355 - DNA, 18 bp, Homo sapiens
aaacaggtgtgtgtgaac

SEQ ID NO: 5818356 - DNA, 21 bp, Homo sapiens
aaacaggtgtgtgtgaactgg

SEQ ID NO: 5818357 - DNA, 19 bp, Homo sapiens
aaacaggttaagtagcagg

SEQ ID NO: 5818358 - DNA, 14 bp, Homo sapiens
aaacagtaatgact

SEQ ID NO: 5818359 - DNA, 22 bp, Homo sapiens
aaacagtacttaggtaattgta

SEQ ID NO: 5818360 - DNA, 12 bp, Homo sapiens
aaacagtatctc

SEQ ID NO: 5818361 - DNA, 12 bp, Homo sapiens
aaacagtattta

SEQ ID NO: 5818362 - DNA, 14 bp, Homo sapiens
aaacagtatttatt

SEQ ID NO: 5818363 - DNA, 13 bp, Homo sapiens
aaacagtatttct

SEQ ID NO: 5818364 - DNA, 19 bp, Homo sapiens
aaacagtcttactctgtct

SEQ ID NO: 5818365 - DNA, 18 bp, Homo sapiens
aaacagtgagaaaagaaa

SEQ ID NO: 5818366 - DNA, 17 bp, Homo sapiens
aaacagtgagcatatct

SEQ ID NO: 5818367 - DNA, 14 bp, Homo sapiens
aaacagtgagcctg

SEQ ID NO: 5818368 - DNA, 21 bp, Homo sapiens
aaacccagcggcttagccaag

SEQ ID NO: 5818369 - DNA, 17 bp, Homo sapiens
aaacccagttgccatct

SEQ ID NO: 5818370 - DNA, 13 bp, Homo sapiens
aaacccatacaat

SEQ ID NO: 5818371 - DNA, 22 bp, Homo sapiens
aaacccataggcccacacacag

SEQ ID NO: 5818372 - DNA, 23 bp, Homo sapiens
aaacccataggcccacacacagg

SEQ ID NO: 5818373 - DNA, 12 bp, Homo sapiens
aaacccatcttc

SEQ ID NO: 5818374 - DNA, 18 bp, Homo sapiens
aaacccatggctctattt

SEQ ID NO: 5818375 - DNA, 19 bp, Homo sapiens
aaacccattaggcatgcct

SEQ ID NO: 5818376 - DNA, 14 bp, Homo sapiens
aaacccatttactt

SEQ ID NO: 5818377 - DNA, 21 bp, Homo sapiens
aaacccattttggtgcaatat

SEQ ID NO: 5818378 - DNA, 15 bp, Homo sapiens
aaaccccaagcagca

SEQ ID NO: 5818379 - DNA, 16 bp, Homo sapiens
aaaccccaagcttccc

SEQ ID NO: 5818380 - DNA, 21 bp, Homo sapiens
aaacccccaaaatccaaaact

SEQ ID NO: 5818381 - DNA, 15 bp, Homo sapiens
aaacccccacacaca

SEQ ID NO: 5818382 - DNA, 18 bp, Homo sapiens
aaacccccaggaggagag

SEQ ID NO: 5818383 - DNA, 17 bp, Homo sapiens
aaacccccgctccagat

SEQ ID NO: 5818384 - DNA, 14 bp, Homo sapiens
aaaccccctgcagc

SEQ ID NO: 5818385 - DNA, 15 bp, Homo sapiens
aaaccccctgcagcc

SEQ ID NO: 5818386 - DNA, 21 bp, Homo sapiens
aaacccccttttcccttcagc

SEQ ID NO: 5818387 - DNA, 22 bp, Homo sapiens
aaacccccttttcccttcagct

SEQ ID NO: 5818388 - DNA, 18 bp, Homo sapiens
aaacccctaaaaacaaaa

SEQ ID NO: 5818389 - DNA, 12 bp, Homo sapiens
aaacccctggct

SEQ ID NO: 5818390 - DNA, 13 bp, Homo sapiens
aaaccccttccca

SEQ ID NO: 5818391 - DNA, 20 bp, Homo sapiens
aaacccgacaacatttctgc

SEQ ID NO: 5818392 - DNA, 16 bp, Homo sapiens
aaacccgacagaggga

SEQ ID NO: 5818393 - DNA, 15 bp, Homo sapiens
aaacccgagggttga

SEQ ID NO: 5818394 - DNA, 21 bp, Homo sapiens
aaacccgtctctactaaaaat

SEQ ID NO: 5818395 - DNA, 20 bp, Homo sapiens
aaaccctaattttgtacata

SEQ ID NO: 5818396 - DNA, 14 bp, Homo sapiens
aaaccctagccttg

SEQ ID NO: 5818397 - DNA, 15 bp, Homo sapiens
aaaccctagccttgc

SEQ ID NO: 5818398 - DNA, 17 bp, Homo sapiens
aaaccctagccttgctt

SEQ ID NO: 5818399 - DNA, 11 bp, Homo sapiens
aaaccctaggt

SEQ ID NO: 5818400 - DNA, 12 bp, Homo sapiens
aaaccctatatg

SEQ ID NO: 5818401 - DNA, 21 bp, Homo sapiens
aaaccctatgccttttgtagc

SEQ ID NO: 5818402 - DNA, 16 bp, Homo sapiens
aaaccctccacttctc

SEQ ID NO: 5818403 - DNA, 14 bp, Homo sapiens
aaaccctctgtgaa

SEQ ID NO: 5818404 - DNA, 15 bp, Homo sapiens
aaaccctctgtgaaa

SEQ ID NO: 5818405 - DNA, 17 bp, Homo sapiens
aaaccctcttcttccct

SEQ ID NO: 5818406 - DNA, 13 bp, Homo sapiens
aaaccctgctaaa

SEQ ID NO: 5818407 - DNA, 19 bp, Homo sapiens
aaaccctgctaaatgactt

SEQ ID NO: 5818408 - DNA, 20 bp, Homo sapiens
aaaccctgctccaatctgtc

SEQ ID NO: 5818409 - DNA, 14 bp, Homo sapiens
aaaccctgcttctg

SEQ ID NO: 5818410 - DNA, 17 bp, Homo sapiens
aaaccctggcttgcttg

SEQ ID NO: 5818411 - DNA, 22 bp, Homo sapiens
aaaccctggtggtattttattt

SEQ ID NO: 5818412 - DNA, 16 bp, Homo sapiens
aaaccctgtcaaacat

SEQ ID NO: 5818413 - DNA, 21 bp, Homo sapiens
aaaccctgtctctactaaaaa

SEQ ID NO: 5818414 - DNA, 19 bp, Homo sapiens
aaacccttcaactcctggc

SEQ ID NO: 5818415 - DNA, 14 bp, Homo sapiens
aaacccttcagtgc

SEQ ID NO: 5818416 - DNA, 22 bp, Homo sapiens
aaacccttcagtgctacatttt

SEQ ID NO: 5818417 - DNA, 23 bp, Homo sapiens
aaacccttcagtgctacattttg

SEQ ID NO: 5818418 - DNA, 13 bp, Homo sapiens
aaacccttctctt

SEQ ID NO: 5818419 - DNA, 21 bp, Homo sapiens
aaacccttgactgttatctcg

SEQ ID NO: 5818420 - DNA, 17 bp, Homo sapiens
aaaccctttagtgcttt

SEQ ID NO: 5818421 - DNA, 15 bp, Homo sapiens
aaaccctttgtatta

SEQ ID NO: 5818422 - DNA, 16 bp, Homo sapiens
aaaccgaataaatgtt

SEQ ID NO: 5818423 - DNA, 17 bp, Homo sapiens
aaaccgaggacccatga

SEQ ID NO: 5818424 - DNA, 20 bp, Homo sapiens
aaaccgaggacccatgaaac

SEQ ID NO: 5818425 - DNA, 13 bp, Homo sapiens
aaaccgccagctc

SEQ ID NO: 5818426 - DNA, 14 bp, Homo sapiens
aaaccgccagctct

SEQ ID NO: 5818427 - DNA, 19 bp, Homo sapiens
aaaccgccagctctgttct

SEQ ID NO: 5818428 - DNA, 21 bp, Homo sapiens
aaaccgctaaaagaaactttc

SEQ ID NO: 5818429 - DNA, 14 bp, Homo sapiens
aaaccgcttttggt

SEQ ID NO: 5818430 - DNA, 16 bp, Homo sapiens
aaaccgcttttggttt

SEQ ID NO: 5818431 - DNA, 19 bp, Homo sapiens
aaaccgtcctgtgtacaca

SEQ ID NO: 5818432 - DNA, 17 bp, Homo sapiens
aaacctaaaaaagatat

SEQ ID NO: 5818433 - DNA, 15 bp, Homo sapiens
aaacctaaaaatttt

SEQ ID NO: 5818434 - DNA, 16 bp, Homo sapiens
aaacctaaagaggaaa

SEQ ID NO: 5818435 - DNA, 23 bp, Homo sapiens
aaacctaaagaggaaaagtgcaa

SEQ ID NO: 5818436 - DNA, 20 bp, Homo sapiens
aaacctaaggcaacatttcc

SEQ ID NO: 5818437 - DNA, 14 bp, Homo sapiens
aaacctacaggaat

SEQ ID NO: 5818438 - DNA, 15 bp, Homo sapiens
aaacctacatattcc

SEQ ID NO: 5818439 - DNA, 16 bp, Homo sapiens
aaacctacatattcca

SEQ ID NO: 5818440 - DNA, 22 bp, Homo sapiens
aaacctactttttatgtgctat

SEQ ID NO: 5818441 - DNA, 16 bp, Homo sapiens
aaacctagaattttct

SEQ ID NO: 5818442 - DNA, 15 bp, Homo sapiens
aaacctagcttttaa

SEQ ID NO: 5818443 - DNA, 18 bp, Homo sapiens
aaacctagcttttaaaaa

SEQ ID NO: 5818444 - DNA, 22 bp, Homo sapiens
aaacctatctgtattggcagca

SEQ ID NO: 5818445 - DNA, 23 bp, Homo sapiens
aaacctattctctttttaacaaa

SEQ ID NO: 5818446 - DNA, 17 bp, Homo sapiens
aaacctatttttccttt

SEQ ID NO: 5818447 - DNA, 19 bp, Homo sapiens
aaacctatttttcctttaa

SEQ ID NO: 5818448 - DNA, 17 bp, Homo sapiens
aaacctcaaatatagta

SEQ ID NO: 5818449 - DNA, 15 bp, Homo sapiens
aaacctcacatttgt

SEQ ID NO: 5818450 - DNA, 17 bp, Homo sapiens
aaacctcacatttgtga

SEQ ID NO: 5818451 - DNA, 22 bp, Homo sapiens
aaacctcacccgaggctgccca

SEQ ID NO: 5818452 - DNA, 12 bp, Homo sapiens
aaacctcactgg

SEQ ID NO: 5818453 - DNA, 19 bp, Homo sapiens
aaacctcagctagctctgc

SEQ ID NO: 5818454 - DNA, 21 bp, Homo sapiens
aaacctcagctagctctgcca

SEQ ID NO: 5818455 - DNA, 19 bp, Homo sapiens
aaacctcagggacaacatt

SEQ ID NO: 5818456 - DNA, 18 bp, Homo sapiens
aaacctcagttggcctct

SEQ ID NO: 5818457 - DNA, 21 bp, Homo sapiens
aaacctcagttggcctctgcc

SEQ ID NO: 5818458 - DNA, 22 bp, Homo sapiens
aaacctcatagcaaccagagga

SEQ ID NO: 5818459 - DNA, 22 bp, Homo sapiens
aaacctcatgacagccagagcc

SEQ ID NO: 5818460 - DNA, 16 bp, Homo sapiens
aaacctcattggccag

SEQ ID NO: 5818461 - DNA, 17 bp, Homo sapiens
aaacctcattgttctgt

SEQ ID NO: 5818462 - DNA, 12 bp, Homo sapiens
aaacctccagcc

SEQ ID NO: 5818463 - DNA, 20 bp, Homo sapiens
aaacctccatcctgccagga

SEQ ID NO: 5818464 - DNA, 14 bp, Homo sapiens
aaacctcctgtcag

SEQ ID NO: 5818465 - DNA, 18 bp, Homo sapiens
aaacctctaatttatttt

SEQ ID NO: 5818466 - DNA, 20 bp, Homo sapiens
aaacctctaatttattttgt

SEQ ID NO: 5818467 - DNA, 24 bp, Homo sapiens
aaacctctaatttattttgtcgaa

SEQ ID NO: 5818468 - DNA, 16 bp, Homo sapiens
aaacctctactaaaaa

SEQ ID NO: 5818469 - DNA, 22 bp, Homo sapiens
aaacctctcctcatgttctgct

SEQ ID NO: 5818470 - DNA, 11 bp, Homo sapiens
aaacctctgtt

SEQ ID NO: 5818471 - DNA, 17 bp, Homo sapiens
aaacctctgttcagtgt

SEQ ID NO: 5818472 - DNA, 20 bp, Homo sapiens
aaacctgaaatatattttaa

SEQ ID NO: 5818473 - DNA, 15 bp, Homo sapiens
aaacctgaagactga

SEQ ID NO: 5818474 - DNA, 16 bp, Homo sapiens
aaacctgagatttatt

SEQ ID NO: 5818475 - DNA, 21 bp, Homo sapiens
aaacctgagatttattaaaga

SEQ ID NO: 5818476 - DNA, 23 bp, Homo sapiens
aaacctgagatttattaaagaaa

SEQ ID NO: 5818477 - DNA, 15 bp, Homo sapiens
aaacctgaggccaaa

SEQ ID NO: 5818478 - DNA, 21 bp, Homo sapiens
aaacctgaggccaaatattga

SEQ ID NO: 5818479 - DNA, 22 bp, Homo sapiens
aaacctgatgctggggacacag

SEQ ID NO: 5818480 - DNA, 19 bp, Homo sapiens
aaacctgatgttgagctga

SEQ ID NO: 5818481 - DNA, 16 bp, Homo sapiens
aaacctgcactgaaac

SEQ ID NO: 5818482 - DNA, 20 bp, Homo sapiens
aaacctgcatgaaagcattc

SEQ ID NO: 5818483 - DNA, 12 bp, Homo sapiens
aaacctgcattt

SEQ ID NO: 5818484 - DNA, 16 bp, Homo sapiens
aaacctgccctgcctg

SEQ ID NO: 5818485 - DNA, 17 bp, Homo sapiens
aaacctgccctgcctga

SEQ ID NO: 5818486 - DNA, 22 bp, Homo sapiens
aaacctgcctttgtatgtggaa

SEQ ID NO: 5818487 - DNA, 13 bp, Homo sapiens
aaacctgctggtg

SEQ ID NO: 5818488 - DNA, 14 bp, Homo sapiens
aaacctgctggtgg

SEQ ID NO: 5818489 - DNA, 16 bp, Homo sapiens
aaacctgctggtgggg

SEQ ID NO: 5818490 - DNA, 15 bp, Homo sapiens
aaacctgcttccttc

SEQ ID NO: 5818491 - DNA, 20 bp, Homo sapiens
aaacctgcttttcaatgtgt

SEQ ID NO: 5818492 - DNA, 11 bp, Homo sapiens
aaacctggaga

SEQ ID NO: 5818493 - DNA, 16 bp, Homo sapiens
aaacctggagatgatg

SEQ ID NO: 5818494 - DNA, 16 bp, Homo sapiens
aaacctggagctgagg

SEQ ID NO: 5818495 - DNA, 15 bp, Homo sapiens
aaacctggatgtcac

SEQ ID NO: 5818496 - DNA, 17 bp, Homo sapiens
aaacctgggaaggccag

SEQ ID NO: 5818497 - DNA, 18 bp, Homo sapiens
aaacctgggattatatat

SEQ ID NO: 5818498 - DNA, 21 bp, Homo sapiens
aaacctgggattcaggaatgt

SEQ ID NO: 5818499 - DNA, 22 bp, Homo sapiens
aaacctgggtatagtgcagaaa

SEQ ID NO: 5818500 - DNA, 22 bp, Homo sapiens
aaacctggttcatatttatact

SEQ ID NO: 5818501 - DNA, 22 bp, Homo sapiens
aaacctgtagatgcagaaaaag

SEQ ID NO: 5818502 - DNA, 18 bp, Homo sapiens
aaacctgtcaatgataca

SEQ ID NO: 5818503 - DNA, 12 bp, Homo sapiens
aaacctgtgaag

SEQ ID NO: 5818504 - DNA, 18 bp, Homo sapiens
aaacctgtgaagctgaaa

SEQ ID NO: 5818505 - DNA, 14 bp, Homo sapiens
aaacctgtgccagg

SEQ ID NO: 5818506 - DNA, 13 bp, Homo sapiens
aaacctgtgcttt

SEQ ID NO: 5818507 - DNA, 17 bp, Homo sapiens
aaacctgttatgccaaa

SEQ ID NO: 5818508 - DNA, 13 bp, Homo sapiens
aaacctgttcctg

SEQ ID NO: 5818509 - DNA, 19 bp, Homo sapiens
aaacctgttgaagattatt

SEQ ID NO: 5818510 - DNA, 21 bp, Homo sapiens
aaacctgttgaagattatttc

SEQ ID NO: 5818511 - DNA, 20 bp, Homo sapiens
aaaccttaaaagtaataaag

SEQ ID NO: 5818512 - DNA, 22 bp, Homo sapiens
aaaccttaaaagtaataaagag

SEQ ID NO: 5818513 - DNA, 13 bp, Homo sapiens
aaaccttaagtgc

SEQ ID NO: 5818514 - DNA, 13 bp, Homo sapiens
aaaccttaatatt

SEQ ID NO: 5818515 - DNA, 23 bp, Homo sapiens
aaaccttaatatttcttcaaata

SEQ ID NO: 5818516 - DNA, 18 bp, Homo sapiens
aaaccttactctgagctc

SEQ ID NO: 5818517 - DNA, 11 bp, Homo sapiens
aaaccttcaca

SEQ ID NO: 5818518 - DNA, 16 bp, Homo sapiens
aaaccttcacccagca

SEQ ID NO: 5818519 - DNA, 20 bp, Homo sapiens
aaaccttcagattaatgact

SEQ ID NO: 5818520 - DNA, 21 bp, Homo sapiens
aaaccttcctgggaggacagg

SEQ ID NO: 5818521 - DNA, 11 bp, Homo sapiens
aaaccttcctt

SEQ ID NO: 5818522 - DNA, 14 bp, Homo sapiens
aaaccttccttccc

SEQ ID NO: 5818523 - DNA, 17 bp, Homo sapiens
aaaccttctcaggaggt

SEQ ID NO: 5818524 - DNA, 19 bp, Homo sapiens
aaaccttcttttcaatgca

SEQ ID NO: 5818525 - DNA, 20 bp, Homo sapiens
aaaccttcttttcaatgcaa

SEQ ID NO: 5818526 - DNA, 22 bp, Homo sapiens
aaaccttcttttcaatgcaatg

SEQ ID NO: 5818527 - DNA, 12 bp, Homo sapiens
aaaccttgaaca

SEQ ID NO: 5818528 - DNA, 19 bp, Homo sapiens
aaaccttgaagttctgaaa

SEQ ID NO: 5818529 - DNA, 13 bp, Homo sapiens
aaaccttgattta

SEQ ID NO: 5818530 - DNA, 13 bp, Homo sapiens
aaaccttgcagca

SEQ ID NO: 5818531 - DNA, 15 bp, Homo sapiens
aaaccttgcagcatt

SEQ ID NO: 5818532 - DNA, 16 bp, Homo sapiens
aaaccttgcagcattt

SEQ ID NO: 5818533 - DNA, 19 bp, Homo sapiens
aaaccttgctgctatgctg

SEQ ID NO: 5818534 - DNA, 22 bp, Homo sapiens
aaaccttggtgtagttgaactg

SEQ ID NO: 5818535 - DNA, 15 bp, Homo sapiens
aaaccttgtaaaaaa

SEQ ID NO: 5818536 - DNA, 19 bp, Homo sapiens
aaaccttgtaaaaaaagca

SEQ ID NO: 5818537 - DNA, 15 bp, Homo sapiens
aaaccttgtgactca

SEQ ID NO: 5818538 - DNA, 21 bp, Homo sapiens
aaaccttgtggataagtggct

SEQ ID NO: 5818539 - DNA, 20 bp, Homo sapiens
aaaccttgttctatttttca

SEQ ID NO: 5818540 - DNA, 18 bp, Homo sapiens
aaaccttgtttctttctg

SEQ ID NO: 5818541 - DNA, 15 bp, Homo sapiens
aaacctttaaaaaaa

SEQ ID NO: 5818542 - DNA, 22 bp, Homo sapiens
aaacctttaaaaaaaaaatgct

SEQ ID NO: 5818543 - DNA, 15 bp, Homo sapiens
aaacctttaagaaaa

SEQ ID NO: 5818544 - DNA, 17 bp, Homo sapiens
aaacctttagggcagct

SEQ ID NO: 5818545 - DNA, 14 bp, Homo sapiens
aaacctttccattt

SEQ ID NO: 5818546 - DNA, 20 bp, Homo sapiens
aaacctttccccagacacat

SEQ ID NO: 5818547 - DNA, 17 bp, Homo sapiens
aaacctttctacttttt

SEQ ID NO: 5818548 - DNA, 13 bp, Homo sapiens
aaacctttgcccc

SEQ ID NO: 5818549 - DNA, 22 bp, Homo sapiens
aaaccttttcatgcctttagat

SEQ ID NO: 5818550 - DNA, 13 bp, Homo sapiens
aaaccttttgaaa

SEQ ID NO: 5818551 - DNA, 18 bp, Homo sapiens
aaaccttttttaagattt

SEQ ID NO: 5818552 - DNA, 20 bp, Homo sapiens
aaaccttttttaagattttt

SEQ ID NO: 5818553 - DNA, 21 bp, Homo sapiens
aaaccttttttaagatttttc

SEQ ID NO: 5818554 - DNA, 23 bp, Homo sapiens
aaaccttttttaagatttttctc

SEQ ID NO: 5818555 - DNA, 19 bp, Homo sapiens
aaacgaagccatctttctt

SEQ ID NO: 5818556 - DNA, 14 bp, Homo sapiens
aaacgaaggcctct

SEQ ID NO: 5818557 - DNA, 21 bp, Homo sapiens
aaacgaagtctttttcatttt

SEQ ID NO: 5818558 - DNA, 15 bp, Homo sapiens
aaacgaataaagata

SEQ ID NO: 5818559 - DNA, 19 bp, Homo sapiens
aaacgacaaatctgtctgc

SEQ ID NO: 5818560 - DNA, 21 bp, Homo sapiens
aaacgacactctctggaagcc

SEQ ID NO: 5818561 - DNA, 18 bp, Homo sapiens
aaacgactaacctatcta

SEQ ID NO: 5818562 - DNA, 22 bp, Homo sapiens
aaacgactaacctatctatgaa

SEQ ID NO: 5818563 - DNA, 18 bp, Homo sapiens
aaacgactcaaaatgaca

SEQ ID NO: 5818564 - DNA, 19 bp, Homo sapiens
aaacgactccgagaacaac

SEQ ID NO: 5818565 - DNA, 13 bp, Homo sapiens
aaacgagactttc

SEQ ID NO: 5818566 - DNA, 19 bp, Homo sapiens
aaacgagtcaatcccctca

SEQ ID NO: 5818567 - DNA, 14 bp, Homo sapiens
aaacgatatatgta

SEQ ID NO: 5818568 - DNA, 16 bp, Homo sapiens
aaacgattagtgatgt

SEQ ID NO: 5818569 - DNA, 16 bp, Homo sapiens
aaacgatttaattctc

SEQ ID NO: 5818570 - DNA, 19 bp, Homo sapiens
aaacgatttaattctcttg

SEQ ID NO: 5818571 - DNA, 23 bp, Homo sapiens
aaacgcagattgggctggctctg

SEQ ID NO: 5818572 - DNA, 21 bp, Homo sapiens
aaacgcagttgtgtggcccag

SEQ ID NO: 5818573 - DNA, 22 bp, Homo sapiens
aaacgccccgggcaaagggtct

SEQ ID NO: 5818574 - DNA, 12 bp, Homo sapiens
aaacgccttgca

SEQ ID NO: 5818575 - DNA, 18 bp, Homo sapiens
aaacgcgcagatgtgcag

SEQ ID NO: 5818576 - DNA, 20 bp, Homo sapiens
aaacgcgtgatgaagacaga

SEQ ID NO: 5818577 - DNA, 22 bp, Homo sapiens
aaacgctaaagagcccttgcct

SEQ ID NO: 5818578 - DNA, 14 bp, Homo sapiens
aaacgctgcctgcc

SEQ ID NO: 5818579 - DNA, 16 bp, Homo sapiens
aaacgctgcctgccca

SEQ ID NO: 5818580 - DNA, 21 bp, Homo sapiens
aaacggaataataaaaagcat

SEQ ID NO: 5818581 - DNA, 16 bp, Homo sapiens
aaacggatgatttcta

SEQ ID NO: 5818582 - DNA, 12 bp, Homo sapiens
aaacggattatt

SEQ ID NO: 5818583 - DNA, 14 bp, Homo sapiens
aaacggattatttt

SEQ ID NO: 5818584 - DNA, 13 bp, Homo sapiens
aaacgggaaagaa

SEQ ID NO: 5818585 - DNA, 17 bp, Homo sapiens
aaacggtatcctccctg

SEQ ID NO: 5818586 - DNA, 13 bp, Homo sapiens
aaacggtctttat

SEQ ID NO: 5818587 - DNA, 15 bp, Homo sapiens
aaacggtgcaacaga

SEQ ID NO: 5818588 - DNA, 17 bp, Homo sapiens
aaacggttaaaactgtc

SEQ ID NO: 5818589 - DNA, 14 bp, Homo sapiens
aaacggttcagttt

SEQ ID NO: 5818590 - DNA, 19 bp, Homo sapiens
aaacggttcagtttcttct

SEQ ID NO: 5818591 - DNA, 17 bp, Homo sapiens
aaacggttcctggtgac

SEQ ID NO: 5818592 - DNA, 22 bp, Homo sapiens
aaacggttcctggtgactcctg

SEQ ID NO: 5818593 - DNA, 23 bp, Homo sapiens
aaacggtttttttctttggctgc

SEQ ID NO: 5818594 - DNA, 16 bp, Homo sapiens
aaacgtatgcatgtga

SEQ ID NO: 5818595 - DNA, 23 bp, Homo sapiens
aaacgtcctctttagtttttggt

SEQ ID NO: 5818596 - DNA, 17 bp, Homo sapiens
aaacgtctaacttcatg

SEQ ID NO: 5818597 - DNA, 16 bp, Homo sapiens
aaacgtctattttgta

SEQ ID NO: 5818598 - DNA, 13 bp, Homo sapiens
aaacgtcttaaat

SEQ ID NO: 5818599 - DNA, 13 bp, Homo sapiens
aaacgtcttttta

SEQ ID NO: 5818600 - DNA, 15 bp, Homo sapiens
aaacgtctttttaag

SEQ ID NO: 5818601 - DNA, 19 bp, Homo sapiens
aaacgtgaaacgccacaaa

SEQ ID NO: 5818602 - DNA, 22 bp, Homo sapiens
aaacgtgatgttttgaatgtgg

SEQ ID NO: 5818603 - DNA, 16 bp, Homo sapiens
aaacgtgccccccagt

SEQ ID NO: 5818604 - DNA, 18 bp, Homo sapiens
aaacgtggatctccccct

SEQ ID NO: 5818605 - DNA, 23 bp, Homo sapiens
aaacgtggattttaaaaaatcaa

SEQ ID NO: 5818606 - DNA, 16 bp, Homo sapiens
aaacgtggctgcttca

SEQ ID NO: 5818607 - DNA, 17 bp, Homo sapiens
aaacgtgtaaattgcac

SEQ ID NO: 5818608 - DNA, 18 bp, Homo sapiens
aaacgtgtatgtttttca

SEQ ID NO: 5818609 - DNA, 17 bp, Homo sapiens
aaacgtgttgccttgaa

SEQ ID NO: 5818610 - DNA, 23 bp, Homo sapiens
aaacgtgttgtatctacagtaat

SEQ ID NO: 5818611 - DNA, 13 bp, Homo sapiens
aaacgttgacccc

SEQ ID NO: 5818612 - DNA, 19 bp, Homo sapiens
aaacgttgacccctttccc

SEQ ID NO: 5818613 - DNA, 21 bp, Homo sapiens
aaacgtttcagtaataaaaca

SEQ ID NO: 5818614 - DNA, 21 bp, Homo sapiens
aaacgtttctcaaatctgctt

SEQ ID NO: 5818615 - DNA, 16 bp, Homo sapiens
aaacgttttattgtgt

SEQ ID NO: 5818616 - DNA, 17 bp, Homo sapiens
aaactaaaaaaaaaaag

SEQ ID NO: 5818617 - DNA, 17 bp, Homo sapiens
aaactaaaaaattaaac

SEQ ID NO: 5818618 - DNA, 15 bp, Homo sapiens
aaactaaaagacatt

SEQ ID NO: 5818619 - DNA, 14 bp, Homo sapiens
aaactaaaatacaa

SEQ ID NO: 5818620 - DNA, 22 bp, Homo sapiens
aaactaaaatagattaaaggaa

SEQ ID NO: 5818621 - DNA, 21 bp, Homo sapiens
aaactaaagtgtgctttataa

SEQ ID NO: 5818622 - DNA, 24 bp, Homo sapiens
aaactaaagttgaaaatacattct

SEQ ID NO: 5818623 - DNA, 14 bp, Homo sapiens
aaactaaataatga

SEQ ID NO: 5818624 - DNA, 13 bp, Homo sapiens
aaactaaatatat

SEQ ID NO: 5818625 - DNA, 18 bp, Homo sapiens
aaactaaatctctaatat

SEQ ID NO: 5818626 - DNA, 14 bp, Homo sapiens
aaactaaatgtgta

SEQ ID NO: 5818627 - DNA, 15 bp, Homo sapiens
aaactaaattactgt

SEQ ID NO: 5818628 - DNA, 14 bp, Homo sapiens
aaactaacaaccaa

SEQ ID NO: 5818629 - DNA, 16 bp, Homo sapiens
aaactaacaatatgat

SEQ ID NO: 5818630 - DNA, 15 bp, Homo sapiens
aaactaacagataag

SEQ ID NO: 5818631 - DNA, 21 bp, Homo sapiens
aaactaacagctacaaacttt

SEQ ID NO: 5818632 - DNA, 21 bp, Homo sapiens
aaactaaccagcattccctac

SEQ ID NO: 5818633 - DNA, 15 bp, Homo sapiens
aaactaaccttgaat

SEQ ID NO: 5818634 - DNA, 19 bp, Homo sapiens
aaactaaccttttatcaat

SEQ ID NO: 5818635 - DNA, 15 bp, Homo sapiens
aaactaagagaaact

SEQ ID NO: 5818636 - DNA, 22 bp, Homo sapiens
aaactaagagacagttctctgt

SEQ ID NO: 5818637 - DNA, 18 bp, Homo sapiens
aaactaagatctgttaaa

SEQ ID NO: 5818638 - DNA, 16 bp, Homo sapiens
aaactaagatgtgcag

SEQ ID NO: 5818639 - DNA, 17 bp, Homo sapiens
aaactaagatttatctg

SEQ ID NO: 5818640 - DNA, 13 bp, Homo sapiens
aaactaagccagg

SEQ ID NO: 5818641 - DNA, 17 bp, Homo sapiens
aaactaaggatttttca

SEQ ID NO: 5818642 - DNA, 16 bp, Homo sapiens
aaactaaggtcagaag

SEQ ID NO: 5818643 - DNA, 13 bp, Homo sapiens
aaactaaggtgct

SEQ ID NO: 5818644 - DNA, 14 bp, Homo sapiens
aaactaataaaata

SEQ ID NO: 5818645 - DNA, 22 bp, Homo sapiens
aaactaataaaatattttctgt

SEQ ID NO: 5818646 - DNA, 12 bp, Homo sapiens
aaactaatacgt

SEQ ID NO: 5818647 - DNA, 16 bp, Homo sapiens
aaactaatattttatg

SEQ ID NO: 5818648 - DNA, 12 bp, Homo sapiens
aaactaatctaa

SEQ ID NO: 5818649 - DNA, 13 bp, Homo sapiens
aaactaatcttaa

SEQ ID NO: 5818650 - DNA, 16 bp, Homo sapiens
aaactaatgaacaaat

SEQ ID NO: 5818651 - DNA, 12 bp, Homo sapiens
aaactaatgagt

SEQ ID NO: 5818652 - DNA, 20 bp, Homo sapiens
aaactaatgagtatgaactt

SEQ ID NO: 5818653 - DNA, 20 bp, Homo sapiens
aaactaatgtactgtacata

SEQ ID NO: 5818654 - DNA, 13 bp, Homo sapiens
aaactaattgttt

SEQ ID NO: 5818655 - DNA, 14 bp, Homo sapiens
aaactacaaaaacc

SEQ ID NO: 5818656 - DNA, 19 bp, Homo sapiens
aaactacaaacgtttgaca

SEQ ID NO: 5818657 - DNA, 20 bp, Homo sapiens
aaactacaaagtaaaatgaa

SEQ ID NO: 5818658 - DNA, 15 bp, Homo sapiens
aaactacaccacact

SEQ ID NO: 5818659 - DNA, 21 bp, Homo sapiens
aaactacagaatattaaatat

SEQ ID NO: 5818660 - DNA, 18 bp, Homo sapiens
aaactacagacctgcttt

SEQ ID NO: 5818661 - DNA, 16 bp, Homo sapiens
aaactacatcttgaaa

SEQ ID NO: 5818662 - DNA, 22 bp, Homo sapiens
aaactacatgtaaaatcttgat

SEQ ID NO: 5818663 - DNA, 16 bp, Homo sapiens
aaactacattttaaca

SEQ ID NO: 5818664 - DNA, 17 bp, Homo sapiens
aaactacattttaacat

SEQ ID NO: 5818665 - DNA, 15 bp, Homo sapiens
aaactaccaaattag

SEQ ID NO: 5818666 - DNA, 17 bp, Homo sapiens
aaactaccaccctcgct

SEQ ID NO: 5818667 - DNA, 20 bp, Homo sapiens
aaactaccaccctcgctgcc

SEQ ID NO: 5818668 - DNA, 21 bp, Homo sapiens
aaactaccaccctcgctgcca

SEQ ID NO: 5818669 - DNA, 16 bp, Homo sapiens
aaactacccatgtctt

SEQ ID NO: 5818670 - DNA, 14 bp, Homo sapiens
aaactacctctgga

SEQ ID NO: 5818671 - DNA, 12 bp, Homo sapiens
aaactactcttt

SEQ ID NO: 5818672 - DNA, 17 bp, Homo sapiens
aaactactctttgattt

SEQ ID NO: 5818673 - DNA, 16 bp, Homo sapiens
aaactactgaatgaag

SEQ ID NO: 5818674 - DNA, 20 bp, Homo sapiens
aaactactgaatgaagcagt

SEQ ID NO: 5818675 - DNA, 13 bp, Homo sapiens
aaactactgcctt

SEQ ID NO: 5818676 - DNA, 21 bp, Homo sapiens
aaactactgcctttagaaaat

SEQ ID NO: 5818677 - DNA, 19 bp, Homo sapiens
aaactactgcctttcaaag

SEQ ID NO: 5818678 - DNA, 14 bp, Homo sapiens
aaactactgtaatt

SEQ ID NO: 5818679 - DNA, 15 bp, Homo sapiens
aaactactgtacatt

SEQ ID NO: 5818680 - DNA, 17 bp, Homo sapiens
aaactactgttaacact

SEQ ID NO: 5818681 - DNA, 19 bp, Homo sapiens
aaactactgttaacactgc

SEQ ID NO: 5818682 - DNA, 21 bp, Homo sapiens
aaactactgttaggaacagca

SEQ ID NO: 5818683 - DNA, 14 bp, Homo sapiens
aaactactttctta

SEQ ID NO: 5818684 - DNA, 22 bp, Homo sapiens
aaactagaaagcagagattttc

SEQ ID NO: 5818685 - DNA, 13 bp, Homo sapiens
aaactagaaatct

SEQ ID NO: 5818686 - DNA, 19 bp, Homo sapiens
aaactagaaggcttctctc

SEQ ID NO: 5818687 - DNA, 20 bp, Homo sapiens
aaactagaattgttgcatcc

SEQ ID NO: 5818688 - DNA, 21 bp, Homo sapiens
aaactagacaaaagtttcaca

SEQ ID NO: 5818689 - DNA, 24 bp, Homo sapiens
aaactagacaaaagtttcacaaca

SEQ ID NO: 5818690 - DNA, 22 bp, Homo sapiens
aaactagaggtgagaaatttaa

SEQ ID NO: 5818691 - DNA, 12 bp, Homo sapiens
aaactagatgac

SEQ ID NO: 5818692 - DNA, 14 bp, Homo sapiens
aaactagcaactct

SEQ ID NO: 5818693 - DNA, 14 bp, Homo sapiens
aaactagcatatct

SEQ ID NO: 5818694 - DNA, 20 bp, Homo sapiens
aaactagcatatctgccttt

SEQ ID NO: 5818695 - DNA, 23 bp, Homo sapiens
aaactagcttacatgagaacaga

SEQ ID NO: 5818696 - DNA, 17 bp, Homo sapiens
aaactaggaaatttttt

SEQ ID NO: 5818697 - DNA, 15 bp, Homo sapiens
aaactaggaggaaaa

SEQ ID NO: 5818698 - DNA, 17 bp, Homo sapiens
aaactaggcatttgtaa

SEQ ID NO: 5818699 - DNA, 16 bp, Homo sapiens
aaactaggcttctgta

SEQ ID NO: 5818700 - DNA, 22 bp, Homo sapiens
aaactaggtgcatatttataaa

SEQ ID NO: 5818701 - DNA, 15 bp, Homo sapiens
aaactagtaactagt

SEQ ID NO: 5818702 - DNA, 13 bp, Homo sapiens
aaactagtactat

SEQ ID NO: 5818703 - DNA, 14 bp, Homo sapiens
aaactagtagttct

SEQ ID NO: 5818704 - DNA, 17 bp, Homo sapiens
aaactagtagttctctt

SEQ ID NO: 5818705 - DNA, 19 bp, Homo sapiens
aaactagtctgttggcaat

SEQ ID NO: 5818706 - DNA, 14 bp, Homo sapiens
aaactagttatttt

SEQ ID NO: 5818707 - DNA, 14 bp, Homo sapiens
aaactagtttttcc

SEQ ID NO: 5818708 - DNA, 13 bp, Homo sapiens
aaactataaaaca

SEQ ID NO: 5818709 - DNA, 17 bp, Homo sapiens
aaactataaactactgt

SEQ ID NO: 5818710 - DNA, 18 bp, Homo sapiens
aaactataaactactgta

SEQ ID NO: 5818711 - DNA, 13 bp, Homo sapiens
aaactataaactt

SEQ ID NO: 5818712 - DNA, 16 bp, Homo sapiens
aaactataaatacaaa

SEQ ID NO: 5818713 - DNA, 19 bp, Homo sapiens
aaactatactacaaggcta

SEQ ID NO: 5818714 - DNA, 20 bp, Homo sapiens
aaactatacttgaacaaaag

SEQ ID NO: 5818715 - DNA, 14 bp, Homo sapiens
aaactataggtaat

SEQ ID NO: 5818716 - DNA, 15 bp, Homo sapiens
aaactatatataatg

SEQ ID NO: 5818717 - DNA, 18 bp, Homo sapiens
aaactatatataatgtat

SEQ ID NO: 5818718 - DNA, 17 bp, Homo sapiens
aaactatattttgtcat

SEQ ID NO: 5818719 - DNA, 20 bp, Homo sapiens
aaactatcaactacaaatta

SEQ ID NO: 5818720 - DNA, 11 bp, Homo sapiens
aaactatcagt

SEQ ID NO: 5818721 - DNA, 16 bp, Homo sapiens
aaactatcagtttgtc

SEQ ID NO: 5818722 - DNA, 20 bp, Homo sapiens
aaactatccaattaaaatta

SEQ ID NO: 5818723 - DNA, 19 bp, Homo sapiens
aaactatcctatgccttca

SEQ ID NO: 5818724 - DNA, 16 bp, Homo sapiens
aaacttggatggactt

SEQ ID NO: 5818725 - DNA, 17 bp, Homo sapiens
aaacttggatggacttg

SEQ ID NO: 5818726 - DNA, 14 bp, Homo sapiens
aaacttggcacttt

SEQ ID NO: 5818727 - DNA, 14 bp, Homo sapiens
aaacttggctggaa

SEQ ID NO: 5818728 - DNA, 23 bp, Homo sapiens
aaacttgggcaccagcttctttc

SEQ ID NO: 5818729 - DNA, 23 bp, Homo sapiens
aaacttggtgacttgatccacta

SEQ ID NO: 5818730 - DNA, 20 bp, Homo sapiens
aaacttggtgcttattgata

SEQ ID NO: 5818731 - DNA, 17 bp, Homo sapiens
aaacttggttccattgt

SEQ ID NO: 5818732 - DNA, 15 bp, Homo sapiens
aaacttggttcccag

SEQ ID NO: 5818733 - DNA, 12 bp, Homo sapiens
aaacttgtaaat

SEQ ID NO: 5818734 - DNA, 19 bp, Homo sapiens
aaacttgtaaataaaggaa

SEQ ID NO: 5818735 - DNA, 13 bp, Homo sapiens
aaacttgtacatg

SEQ ID NO: 5818736 - DNA, 18 bp, Homo sapiens
aaacttgtacatggaatt

SEQ ID NO: 5818737 - DNA, 20 bp, Homo sapiens
aaacttgtacttacactgaa

SEQ ID NO: 5818738 - DNA, 16 bp, Homo sapiens
aaacttgtattatgtg

SEQ ID NO: 5818739 - DNA, 17 bp, Homo sapiens
aaacttgtcacttgcat

SEQ ID NO: 5818740 - DNA, 13 bp, Homo sapiens
aaacttgtgaatg

SEQ ID NO: 5818741 - DNA, 15 bp, Homo sapiens
aaacttgtgaatgct

SEQ ID NO: 5818742 - DNA, 18 bp, Homo sapiens
aaacttgtgagcatcaga

SEQ ID NO: 5818743 - DNA, 12 bp, Homo sapiens
aaacttgtgcct

SEQ ID NO: 5818744 - DNA, 14 bp, Homo sapiens
aaacttgtgcctcc

SEQ ID NO: 5818745 - DNA, 15 bp, Homo sapiens
aaacttgtgtaaata

SEQ ID NO: 5818746 - DNA, 17 bp, Homo sapiens
aaacttgtgtaaataca

SEQ ID NO: 5818747 - DNA, 16 bp, Homo sapiens
aaacttgttattgtga

SEQ ID NO: 5818748 - DNA, 16 bp, Homo sapiens
aaactttaaaaaatat

SEQ ID NO: 5818749 - DNA, 19 bp, Homo sapiens
aaactttaaaaattattat

SEQ ID NO: 5818750 - DNA, 16 bp, Homo sapiens
aaactttaaaaggcaa

SEQ ID NO: 5818751 - DNA, 17 bp, Homo sapiens
aaactttaaaatgcgaa

SEQ ID NO: 5818752 - DNA, 14 bp, Homo sapiens
aaactttaatatgt

SEQ ID NO: 5818753 - DNA, 18 bp, Homo sapiens
aaactttaatatgtattt

SEQ ID NO: 5818754 - DNA, 20 bp, Homo sapiens
aaactttacccaaaaactaa

SEQ ID NO: 5818755 - DNA, 18 bp, Homo sapiens
aaactttactatggccct

SEQ ID NO: 5818756 - DNA, 15 bp, Homo sapiens
aaactttatcactta

SEQ ID NO: 5818757 - DNA, 11 bp, Homo sapiens
aaactttattg

SEQ ID NO: 5818758 - DNA, 21 bp, Homo sapiens
aaactttattgggtttttatt

SEQ ID NO: 5818759 - DNA, 19 bp, Homo sapiens
aaactttatttaaatgcat

SEQ ID NO: 5818760 - DNA, 21 bp, Homo sapiens
aaactttatttaaatgcatgt

SEQ ID NO: 5818761 - DNA, 22 bp, Homo sapiens
aaactttatttaaatgcatgtc

SEQ ID NO: 5818762 - DNA, 14 bp, Homo sapiens
aaactttattttat

SEQ ID NO: 5818763 - DNA, 23 bp, Homo sapiens
aaactttattttatataataaag

SEQ ID NO: 5818764 - DNA, 22 bp, Homo sapiens
aaactttattttttaaaaatga

SEQ ID NO: 5818765 - DNA, 19 bp, Homo sapiens
aaactttcaagtattatat

SEQ ID NO: 5818766 - DNA, 19 bp, Homo sapiens
aaactttcaatattttaac

SEQ ID NO: 5818767 - DNA, 14 bp, Homo sapiens
aaactttcagagaa

SEQ ID NO: 5818768 - DNA, 11 bp, Homo sapiens
aaactttcagc

SEQ ID NO: 5818769 - DNA, 15 bp, Homo sapiens
aaactttccatgaca

SEQ ID NO: 5818770 - DNA, 20 bp, Homo sapiens
aaactttcctcttcctgcct

SEQ ID NO: 5818771 - DNA, 17 bp, Homo sapiens
aaactttcctgtactca

SEQ ID NO: 5818772 - DNA, 21 bp, Homo sapiens
aaactttctactcattttaat

SEQ ID NO: 5818773 - DNA, 12 bp, Homo sapiens
aaactttctcat

SEQ ID NO: 5818774 - DNA, 17 bp, Homo sapiens
aaactttctcataagca

SEQ ID NO: 5818775 - DNA, 12 bp, Homo sapiens
aaactttctctt

SEQ ID NO: 5818776 - DNA, 15 bp, Homo sapiens
aaactttctttctaa

SEQ ID NO: 5818777 - DNA, 15 bp, Homo sapiens
aaactttgaaatata

SEQ ID NO: 5818778 - DNA, 14 bp, Homo sapiens
aaactttgaataaa

SEQ ID NO: 5818779 - DNA, 19 bp, Homo sapiens
aaactttgatctctgctta

SEQ ID NO: 5818780 - DNA, 15 bp, Homo sapiens
aaactttgcttctcc

SEQ ID NO: 5818781 - DNA, 23 bp, Homo sapiens
aaactttggaagcactttttctg

SEQ ID NO: 5818782 - DNA, 16 bp, Homo sapiens
aaactttggaagtttt

SEQ ID NO: 5818783 - DNA, 20 bp, Homo sapiens
aaactttggaagttttactt

SEQ ID NO: 5818784 - DNA, 20 bp, Homo sapiens
aaactttggagaactcattt

SEQ ID NO: 5818785 - DNA, 13 bp, Homo sapiens
aaactttgggaaa

SEQ ID NO: 5818786 - DNA, 17 bp, Homo sapiens
aaactttgggaaaacat

SEQ ID NO: 5818787 - DNA, 20 bp, Homo sapiens
aaactttgggaaaacatgtt

SEQ ID NO: 5818788 - DNA, 16 bp, Homo sapiens
aaactttggtgcattg

SEQ ID NO: 5818789 - DNA, 18 bp, Homo sapiens
aaactttgtagaaagcaa

SEQ ID NO: 5818790 - DNA, 19 bp, Homo sapiens
aaactttgtagaaagcaaa

SEQ ID NO: 5818791 - DNA, 23 bp, Homo sapiens
aaactttgtagacattttgaaat

SEQ ID NO: 5818792 - DNA, 16 bp, Homo sapiens
aaactttgtgcctttg

SEQ ID NO: 5818793 - DNA, 22 bp, Homo sapiens
aaactttgtttttggtttttta

SEQ ID NO: 5818794 - DNA, 13 bp, Homo sapiens
aaacttttaactg

SEQ ID NO: 5818795 - DNA, 15 bp, Homo sapiens
aaacttttaatgcct

SEQ ID NO: 5818796 - DNA, 14 bp, Homo sapiens
aaacttttaggacc

SEQ ID NO: 5818797 - DNA, 16 bp, Homo sapiens
aaacttttaggttgtt

SEQ ID NO: 5818798 - DNA, 13 bp, Homo sapiens
aaacttttcaagg

SEQ ID NO: 5818799 - DNA, 22 bp, Homo sapiens
aaacttttcaaggcttatattc

SEQ ID NO: 5818800 - DNA, 18 bp, Homo sapiens
aaacttttcatttcagat

SEQ ID NO: 5818801 - DNA, 22 bp, Homo sapiens
aaacttttcatttcagatttta

SEQ ID NO: 5818802 - DNA, 13 bp, Homo sapiens
aaacttttctaga

SEQ ID NO: 5818803 - DNA, 12 bp, Homo sapiens
aaacttttctca

SEQ ID NO: 5818804 - DNA, 17 bp, Homo sapiens
aaacttttctgatagag

SEQ ID NO: 5818805 - DNA, 13 bp, Homo sapiens
aaacttttctgct

SEQ ID NO: 5818806 - DNA, 16 bp, Homo sapiens
aaacttttctgctgat

SEQ ID NO: 5818807 - DNA, 20 bp, Homo sapiens
aaacttttcttaaaaagtta

SEQ ID NO: 5818808 - DNA, 13 bp, Homo sapiens
aaacttttgaaaa

SEQ ID NO: 5818809 - DNA, 15 bp, Homo sapiens
aaacttttgaaagat

SEQ ID NO: 5818810 - DNA, 22 bp, Homo sapiens
aaacttttgagaatgtttgaaa

SEQ ID NO: 5818811 - DNA, 24 bp, Homo sapiens
aaacttttgtaaagaaatttacta

SEQ ID NO: 5818812 - DNA, 14 bp, Homo sapiens
aaacttttgtaaat

SEQ ID NO: 5818813 - DNA, 16 bp, Homo sapiens
aaacttttgtaaatta

SEQ ID NO: 5818814 - DNA, 13 bp, Homo sapiens
aaacttttgttta

SEQ ID NO: 5818815 - DNA, 20 bp, Homo sapiens
aaacttttgtttaaagcatt

SEQ ID NO: 5818816 - DNA, 20 bp, Homo sapiens
aaacttttgtttagagccct

SEQ ID NO: 5818817 - DNA, 18 bp, Homo sapiens
aaactttttaaaatactt

SEQ ID NO: 5818818 - DNA, 20 bp, Homo sapiens
aaactttttaataaagtata

SEQ ID NO: 5818819 - DNA, 22 bp, Homo sapiens
aaactttttccagcaaaatgga

SEQ ID NO: 5818820 - DNA, 12 bp, Homo sapiens
aaacttttttat

SEQ ID NO: 5818821 - DNA, 18 bp, Homo sapiens
aaacttttttctttgaaa

SEQ ID NO: 5818822 - DNA, 14 bp, Homo sapiens
aaactttttttcaa

SEQ ID NO: 5818823 - DNA, 17 bp, Homo sapiens
aaactttttttcaatgt

SEQ ID NO: 5818824 - DNA, 17 bp, Homo sapiens
aaacttttttttgagaa

SEQ ID NO: 5818825 - DNA, 21 bp, Homo sapiens
aaagaaaaaaaaaaaagccag

SEQ ID NO: 5818826 - DNA, 22 bp, Homo sapiens
aaagaaaaaaaaaaagaaagaa

SEQ ID NO: 5818827 - DNA, 22 bp, Homo sapiens
aaagaaaaaaaaaagaaaaagg

SEQ ID NO: 5818828 - DNA, 21 bp, Homo sapiens
aaagaaaaaaaaaagaagaag

SEQ ID NO: 5818829 - DNA, 22 bp, Homo sapiens
aaagaaaaaaaaaagaagaaga

SEQ ID NO: 5818830 - DNA, 17 bp, Homo sapiens
aaagaaaaaaaaatact

SEQ ID NO: 5818831 - DNA, 22 bp, Homo sapiens
aaagaaaaaaaattttgtatgt

SEQ ID NO: 5818832 - DNA, 13 bp, Homo sapiens
aaagaaaaaaacc

SEQ ID NO: 5818833 - DNA, 15 bp, Homo sapiens
aaagaaaaaaagaaa

SEQ ID NO: 5818834 - DNA, 15 bp, Homo sapiens
aaagaaaaaaatagt

SEQ ID NO: 5818835 - DNA, 14 bp, Homo sapiens
aaagaaaaaaatat

SEQ ID NO: 5818836 - DNA, 16 bp, Homo sapiens
aaagaaaaaaatatat

SEQ ID NO: 5818837 - DNA, 15 bp, Homo sapiens
aaagaaaaaaatgat

SEQ ID NO: 5818838 - DNA, 16 bp, Homo sapiens
aaagaaaaaaatgtca

SEQ ID NO: 5818839 - DNA, 19 bp, Homo sapiens
aaagaaaaaaatgtcaaaa

SEQ ID NO: 5818840 - DNA, 16 bp, Homo sapiens
aaagaaaaaaattgaa

SEQ ID NO: 5818841 - DNA, 22 bp, Homo sapiens
aaagaaaaaaattgaaatgtaa

SEQ ID NO: 5818842 - DNA, 15 bp, Homo sapiens
aaagaaaaaacaact

SEQ ID NO: 5818843 - DNA, 14 bp, Homo sapiens
aaagaaaaaagaag

SEQ ID NO: 5818844 - DNA, 18 bp, Homo sapiens
aaagaaaaaagagaaaag

SEQ ID NO: 5818845 - DNA, 10 bp, Homo sapiens
aaagaaaaac

SEQ ID NO: 5818846 - DNA, 13 bp, Homo sapiens
aaagaaaaacaaa

SEQ ID NO: 5818847 - DNA, 15 bp, Homo sapiens
aaagaaaaaggaaaa

SEQ ID NO: 5818848 - DNA, 13 bp, Homo sapiens
aaagaaaaagtat

SEQ ID NO: 5818849 - DNA, 12 bp, Homo sapiens
aaagaaaaatgc

SEQ ID NO: 5818850 - DNA, 21 bp, Homo sapiens
aaagaaaaatgcctgtctcta

SEQ ID NO: 5818851 - DNA, 19 bp, Homo sapiens
aaagaaaaattaattagga

SEQ ID NO: 5818852 - DNA, 22 bp, Homo sapiens
aaagaaaaattaattaggaatt

SEQ ID NO: 5818853 - DNA, 21 bp, Homo sapiens
aaagaaaaattattaaaggaa

SEQ ID NO: 5818854 - DNA, 19 bp, Homo sapiens
aaagaaaacaaaaaacgaa

SEQ ID NO: 5818855 - DNA, 13 bp, Homo sapiens
aaagaaaacagac

SEQ ID NO: 5818856 - DNA, 14 bp, Homo sapiens
aaagaaaaccattt

SEQ ID NO: 5818857 - DNA, 16 bp, Homo sapiens
aaagaaaacccacccc

SEQ ID NO: 5818858 - DNA, 20 bp, Homo sapiens
aaagaaaacttgtattatgt

SEQ ID NO: 5818859 - DNA, 16 bp, Homo sapiens
aaagaaaagaaaattt

SEQ ID NO: 5818860 - DNA, 17 bp, Homo sapiens
aaagaaaagacatttta

SEQ ID NO: 5818861 - DNA, 14 bp, Homo sapiens
aaagaaaagagaaa

SEQ ID NO: 5818862 - DNA, 15 bp, Homo sapiens
aaagaaaagagaaaa

SEQ ID NO: 5818863 - DNA, 17 bp, Homo sapiens
aaagaaaaggaatgcaa

SEQ ID NO: 5818864 - DNA, 13 bp, Homo sapiens
aaagaaaaggcaa

SEQ ID NO: 5818865 - DNA, 14 bp, Homo sapiens
aaagaaaataaaat

SEQ ID NO: 5818866 - DNA, 23 bp, Homo sapiens
aaagaaaataaagacaaccatat

SEQ ID NO: 5818867 - DNA, 22 bp, Homo sapiens
aaagaaaataggggatggtcca

SEQ ID NO: 5818868 - DNA, 12 bp, Homo sapiens
aaagaaaatatt

SEQ ID NO: 5818869 - DNA, 17 bp, Homo sapiens
aaagaaaatatttttgt

SEQ ID NO: 5818870 - DNA, 13 bp, Homo sapiens
aaagaaaatctat

SEQ ID NO: 5818871 - DNA, 13 bp, Homo sapiens
aaagaaaatgcct

SEQ ID NO: 5818872 - DNA, 19 bp, Homo sapiens
aaagaaaatgtctgttttc

SEQ ID NO: 5818873 - DNA, 14 bp, Homo sapiens
aaagaaaattatat

SEQ ID NO: 5818874 - DNA, 13 bp, Homo sapiens
aaagaaaattcct

SEQ ID NO: 5818875 - DNA, 13 bp, Homo sapiens
aaagaaaattgag

SEQ ID NO: 5818876 - DNA, 14 bp, Homo sapiens
aaagaaaattgcat

SEQ ID NO: 5818877 - DNA, 22 bp, Homo sapiens
aaagaaaattgcatgaaactag

SEQ ID NO: 5818878 - DNA, 15 bp, Homo sapiens
aaagaaaattgccaa

SEQ ID NO: 5818879 - DNA, 17 bp, Homo sapiens
aaagaaaattgccaaaa

SEQ ID NO: 5818880 - DNA, 18 bp, Homo sapiens
aaagaaaattgccaaaat

SEQ ID NO: 5818881 - DNA, 19 bp, Homo sapiens
aaagaaaatttttgtagta

SEQ ID NO: 5818882 - DNA, 17 bp, Homo sapiens
aaagaaacaccagtgtt

SEQ ID NO: 5818883 - DNA, 15 bp, Homo sapiens
aaagaaacactaaat

SEQ ID NO: 5818884 - DNA, 15 bp, Homo sapiens
aaagaaacactttct

SEQ ID NO: 5818885 - DNA, 13 bp, Homo sapiens
aaagaaacatttg

SEQ ID NO: 5818886 - DNA, 17 bp, Homo sapiens
aaagaaaccatgacaaa

SEQ ID NO: 5818887 - DNA, 21 bp, Homo sapiens
aaagaaaccatgcaaagcaac

SEQ ID NO: 5818888 - DNA, 20 bp, Homo sapiens
aaagaaaccccaaactcagg

SEQ ID NO: 5818889 - DNA, 20 bp, Homo sapiens
aaagaaacccgacagaggga

SEQ ID NO: 5818890 - DNA, 23 bp, Homo sapiens
aaagaaacccgacagagggaaga

SEQ ID NO: 5818891 - DNA, 19 bp, Homo sapiens
aaagaaaccgtaattttat

SEQ ID NO: 5818892 - DNA, 20 bp, Homo sapiens
aaagaaacctggggtgaata

SEQ ID NO: 5818893 - DNA, 17 bp, Homo sapiens
aaagaaactgaggccca

SEQ ID NO: 5818894 - DNA, 21 bp, Homo sapiens
aaagaaacttaccaattgatg

SEQ ID NO: 5818895 - DNA, 21 bp, Homo sapiens
aaagaaacttgaagctttgta

SEQ ID NO: 5818896 - DNA, 19 bp, Homo sapiens
aaagaaacttggctggaat

SEQ ID NO: 5818897 - DNA, 20 bp, Homo sapiens
aaagaaacttggctggaatt

SEQ ID NO: 5818898 - DNA, 12 bp, Homo sapiens
aaagaaactttc

SEQ ID NO: 5818899 - DNA, 21 bp, Homo sapiens
aaagaaactttttaataaagt

SEQ ID NO: 5818900 - DNA, 10 bp, Homo sapiens
aaagaaagaa

SEQ ID NO: 5818901 - DNA, 16 bp, Homo sapiens
aaagaaagaaaaaagt

SEQ ID NO: 5818902 - DNA, 14 bp, Homo sapiens
aaagaaagaaggaa

SEQ ID NO: 5818903 - DNA, 18 bp, Homo sapiens
aaagaggttctgcactcc

SEQ ID NO: 5818904 - DNA, 16 bp, Homo sapiens
aaagaggtttttctta

SEQ ID NO: 5818905 - DNA, 18 bp, Homo sapiens
aaagagtaaaaccaaagg

SEQ ID NO: 5818906 - DNA, 19 bp, Homo sapiens
aaagagtaaaggaaatgat

SEQ ID NO: 5818907 - DNA, 16 bp, Homo sapiens
aaagagtaatttcatt

SEQ ID NO: 5818908 - DNA, 18 bp, Homo sapiens
aaagagtaatttcattta

SEQ ID NO: 5818909 - DNA, 23 bp, Homo sapiens
aaagagtaatttcatttaaatat

SEQ ID NO: 5818910 - DNA, 18 bp, Homo sapiens
aaagagtacactcagcca

SEQ ID NO: 5818911 - DNA, 17 bp, Homo sapiens
aaagagtactcttgttt

SEQ ID NO: 5818912 - DNA, 23 bp, Homo sapiens
aaagagtagaactttaaaagaag

SEQ ID NO: 5818913 - DNA, 23 bp, Homo sapiens
aaagagtagacatttctcttact

SEQ ID NO: 5818914 - DNA, 13 bp, Homo sapiens
aaagagtcagaca

SEQ ID NO: 5818915 - DNA, 22 bp, Homo sapiens
aaagagtctctggctcagctgt

SEQ ID NO: 5818916 - DNA, 14 bp, Homo sapiens
aaagagtcttccaa

SEQ ID NO: 5818917 - DNA, 15 bp, Homo sapiens
aaagagtgaaatatt

SEQ ID NO: 5818918 - DNA, 16 bp, Homo sapiens
aaagagtggagcaaat

SEQ ID NO: 5818919 - DNA, 19 bp, Homo sapiens
aaagagtgtgttataaaat

SEQ ID NO: 5818920 - DNA, 19 bp, Homo sapiens
aaagagttattcaaatgaa

SEQ ID NO: 5818921 - DNA, 14 bp, Homo sapiens
aaagagttcaagaa

SEQ ID NO: 5818922 - DNA, 16 bp, Homo sapiens
aaagagttcaagaaat

SEQ ID NO: 5818923 - DNA, 20 bp, Homo sapiens
aaagagttcaagaaataagt

SEQ ID NO: 5818924 - DNA, 14 bp, Homo sapiens
aaagagttgagcac

SEQ ID NO: 5818925 - DNA, 14 bp, Homo sapiens
aaagagtttgaaac

SEQ ID NO: 5818926 - DNA, 16 bp, Homo sapiens
aaagataaacacaaga

SEQ ID NO: 5818927 - DNA, 21 bp, Homo sapiens
aaagataaacctggagatatt

SEQ ID NO: 5818928 - DNA, 15 bp, Homo sapiens
aaagataaagaccag

SEQ ID NO: 5818929 - DNA, 13 bp, Homo sapiens
aaagataaatatt

SEQ ID NO: 5818930 - DNA, 22 bp, Homo sapiens
aaagataacaagatctttcagg

SEQ ID NO: 5818931 - DNA, 19 bp, Homo sapiens
aaagataacgcaggagaga

SEQ ID NO: 5818932 - DNA, 21 bp, Homo sapiens
aaagataacgcaggagagaga

SEQ ID NO: 5818933 - DNA, 18 bp, Homo sapiens
aaagataataaattgatt

SEQ ID NO: 5818934 - DNA, 17 bp, Homo sapiens
aaagataatattactgt

SEQ ID NO: 5818935 - DNA, 24 bp, Homo sapiens
aaagataatcgaagcaaaagtaat

SEQ ID NO: 5818936 - DNA, 23 bp, Homo sapiens
aaagataatctcagtgctttcct

SEQ ID NO: 5818937 - DNA, 20 bp, Homo sapiens
aaagataatgcatatttttg

SEQ ID NO: 5818938 - DNA, 21 bp, Homo sapiens
aaagatacagaactctttcaa

SEQ ID NO: 5818939 - DNA, 15 bp, Homo sapiens
aaagatacagttact

SEQ ID NO: 5818940 - DNA, 14 bp, Homo sapiens
aaagatacatgatt

SEQ ID NO: 5818941 - DNA, 15 bp, Homo sapiens
aaagatacatttgta

SEQ ID NO: 5818942 - DNA, 20 bp, Homo sapiens
aaagataccaaatagaaaca

SEQ ID NO: 5818943 - DNA, 19 bp, Homo sapiens
aaagatacccaaattttaa

SEQ ID NO: 5818944 - DNA, 20 bp, Homo sapiens
aaagataccttaaaatttga

SEQ ID NO: 5818945 - DNA, 22 bp, Homo sapiens
aaagataccttaaaatttgaaa

SEQ ID NO: 5818946 - DNA, 19 bp, Homo sapiens
aaagatagagtcattgctg

SEQ ID NO: 5818947 - DNA, 15 bp, Homo sapiens
aaagatagatatcca

SEQ ID NO: 5818948 - DNA, 20 bp, Homo sapiens
aaagatagcaatatgagaca

SEQ ID NO: 5818949 - DNA, 20 bp, Homo sapiens
aaagatagggagggaagggg

SEQ ID NO: 5818950 - DNA, 17 bp, Homo sapiens
aaagatataagtgctgt

SEQ ID NO: 5818951 - DNA, 18 bp, Homo sapiens
aaagatataagtgctgta

SEQ ID NO: 5818952 - DNA, 20 bp, Homo sapiens
aaagatataagtgctgtata

SEQ ID NO: 5818953 - DNA, 22 bp, Homo sapiens
aaagatataagtgctgtataaa

SEQ ID NO: 5818954 - DNA, 17 bp, Homo sapiens
aaagatatatacacagg

SEQ ID NO: 5818955 - DNA, 14 bp, Homo sapiens
aaagatatatattc

SEQ ID NO: 5818956 - DNA, 20 bp, Homo sapiens
aaagatatatgaatatgaca

SEQ ID NO: 5818957 - DNA, 12 bp, Homo sapiens
aaagatatatta

SEQ ID NO: 5818958 - DNA, 21 bp, Homo sapiens
aaagatatattaaaaatataa

SEQ ID NO: 5818959 - DNA, 18 bp, Homo sapiens
aaagatatctatgactgt

SEQ ID NO: 5818960 - DNA, 18 bp, Homo sapiens
aaagatatgaagaactat

SEQ ID NO: 5818961 - DNA, 15 bp, Homo sapiens
aaagatatggagaat

SEQ ID NO: 5818962 - DNA, 19 bp, Homo sapiens
aaagatatgtatatttttg

SEQ ID NO: 5818963 - DNA, 18 bp, Homo sapiens
aaagatattgtatctcct

SEQ ID NO: 5818964 - DNA, 19 bp, Homo sapiens
aaagatattgtattatcat

SEQ ID NO: 5818965 - DNA, 13 bp, Homo sapiens
aaagatattgttg

SEQ ID NO: 5818966 - DNA, 14 bp, Homo sapiens
aaagatatttccaa

SEQ ID NO: 5818967 - DNA, 12 bp, Homo sapiens
aaagatattttg

SEQ ID NO: 5818968 - DNA, 16 bp, Homo sapiens
aaagatatttttatct

SEQ ID NO: 5818969 - DNA, 16 bp, Homo sapiens
aaagatatttttattc

SEQ ID NO: 5818970 - DNA, 14 bp, Homo sapiens
aaagatcaaaataa

SEQ ID NO: 5818971 - DNA, 17 bp, Homo sapiens
aaagatcaaaataaaaa

SEQ ID NO: 5818972 - DNA, 13 bp, Homo sapiens
aaagatcacacat

SEQ ID NO: 5818973 - DNA, 15 bp, Homo sapiens
aaagatcaccttgta

SEQ ID NO: 5818974 - DNA, 22 bp, Homo sapiens
aaagatcacttgttgttttact

SEQ ID NO: 5818975 - DNA, 15 bp, Homo sapiens
aaagatcatgtaaaa

SEQ ID NO: 5818976 - DNA, 23 bp, Homo sapiens
aaagatccaccctcaaatgtcag

SEQ ID NO: 5818977 - DNA, 17 bp, Homo sapiens
aaagatcccaagatgga

SEQ ID NO: 5818978 - DNA, 16 bp, Homo sapiens
aaagatccttcatttt

SEQ ID NO: 5818979 - DNA, 17 bp, Homo sapiens
aaagatccttcatttta

SEQ ID NO: 5818980 - DNA, 16 bp, Homo sapiens
aaagatctacatgaat

SEQ ID NO: 5818981 - DNA, 21 bp, Homo sapiens
aaagatctccagttgtatcct

SEQ ID NO: 5818982 - DNA, 18 bp, Homo sapiens
aaagatctgtcctcagcc

SEQ ID NO: 5818983 - DNA, 15 bp, Homo sapiens
aaagatcttcaaaag

SEQ ID NO: 5818984 - DNA, 20 bp, Homo sapiens
aaagatctttttttaagtgt

SEQ ID NO: 5818985 - DNA, 16 bp, Homo sapiens
aaagatgaaaaagaat

SEQ ID NO: 5818986 - DNA, 19 bp, Homo sapiens
aaagatgaaactgaaagca

SEQ ID NO: 5818987 - DNA, 20 bp, Homo sapiens
aaagatgacttcccctgcct

SEQ ID NO: 5818988 - DNA, 20 bp, Homo sapiens
aaagatgagctttgtctact

SEQ ID NO: 5818989 - DNA, 15 bp, Homo sapiens
aaagatgagtaattt

SEQ ID NO: 5818990 - DNA, 15 bp, Homo sapiens
aaagatgagtgagca

SEQ ID NO: 5818991 - DNA, 12 bp, Homo sapiens
aaagatgagttg

SEQ ID NO: 5818992 - DNA, 17 bp, Homo sapiens
aaagatgatcgctgtat

SEQ ID NO: 5818993 - DNA, 22 bp, Homo sapiens
aaagatgatcgctgtattttga

SEQ ID NO: 5818994 - DNA, 13 bp, Homo sapiens
aaagatgatggaa

SEQ ID NO: 5818995 - DNA, 20 bp, Homo sapiens
aaagatgatggaaacgcact

SEQ ID NO: 5818996 - DNA, 23 bp, Homo sapiens
aaagatgattttgcttttcccta

SEQ ID NO: 5818997 - DNA, 19 bp, Homo sapiens
aaagatgcactttgcttta

SEQ ID NO: 5818998 - DNA, 21 bp, Homo sapiens
aaagatgcatcatctcttcct

SEQ ID NO: 5818999 - DNA, 12 bp, Homo sapiens
aaagatgcattt

SEQ ID NO: 5819000 - DNA, 21 bp, Homo sapiens
aaagatgccatagcataatat

SEQ ID NO: 5819001 - DNA, 20 bp, Homo sapiens
aaagatgccccattccttgc

SEQ ID NO: 5819002 - DNA, 22 bp, Homo sapiens
aaagatgccgggttttatattt

SEQ ID NO: 5819003 - DNA, 22 bp, Homo sapiens
aaagatgctcaggtacagagaa

SEQ ID NO: 5819004 - DNA, 15 bp, Homo sapiens
aaagatgcttaaaaa

SEQ ID NO: 5819005 - DNA, 13 bp, Homo sapiens
aaagatggaagtg

SEQ ID NO: 5819006 - DNA, 15 bp, Homo sapiens
aaagatggagaggca

SEQ ID NO: 5819007 - DNA, 14 bp, Homo sapiens
aaagatggagttgt

SEQ ID NO: 5819008 - DNA, 16 bp, Homo sapiens
aaagatggagtttcta

SEQ ID NO: 5819009 - DNA, 18 bp, Homo sapiens
aaagatggagtttctaag

SEQ ID NO: 5819010 - DNA, 21 bp, Homo sapiens
aaagatggagtttctaaggtc

SEQ ID NO: 5819011 - DNA, 16 bp, Homo sapiens
aaagatggatgtgctt

SEQ ID NO: 5819012 - DNA, 18 bp, Homo sapiens
aaagatggcttatgtcat

SEQ ID NO: 5819013 - DNA, 23 bp, Homo sapiens
aaagatggcttttgtttcttccc

SEQ ID NO: 5819014 - DNA, 13 bp, Homo sapiens
aaagatgggagga

SEQ ID NO: 5819015 - DNA, 23 bp, Homo sapiens
aaagatgggaggagaccagcggt

SEQ ID NO: 5819016 - DNA, 22 bp, Homo sapiens
aaagatggggaaactgagggca

SEQ ID NO: 5819017 - DNA, 16 bp, Homo sapiens
aaagatggtaatcttt

SEQ ID NO: 5819018 - DNA, 20 bp, Homo sapiens
aaagatggttaaacattttc

SEQ ID NO: 5819019 - DNA, 20 bp, Homo sapiens
aaagatggttgtagcattta

SEQ ID NO: 5819020 - DNA, 13 bp, Homo sapiens
aaagatgtactga

SEQ ID NO: 5819021 - DNA, 17 bp, Homo sapiens
aaagatgtactgagagg

SEQ ID NO: 5819022 - DNA, 14 bp, Homo sapiens
aaagatgtagcaaa

SEQ ID NO: 5819023 - DNA, 16 bp, Homo sapiens
aaagatgtcccacagg

SEQ ID NO: 5819024 - DNA, 18 bp, Homo sapiens
aaagatgtcccacaggga

SEQ ID NO: 5819025 - DNA, 23 bp, Homo sapiens
aaagatgtctctgcaaaccaaca

SEQ ID NO: 5819026 - DNA, 20 bp, Homo sapiens
aaagatgtcttaacctcagg

SEQ ID NO: 5819027 - DNA, 13 bp, Homo sapiens
aaagatgtgggga

SEQ ID NO: 5819028 - DNA, 10 bp, Homo sapiens
aaagatgtgt

SEQ ID NO: 5819029 - DNA, 11 bp, Homo sapiens
aaagatgtgtt

SEQ ID NO: 5819030 - DNA, 20 bp, Homo sapiens
aaagatgtgttgttggtttc

SEQ ID NO: 5819031 - DNA, 13 bp, Homo sapiens
aaagatgttaaat

SEQ ID NO: 5819032 - DNA, 18 bp, Homo sapiens
aaagatgttaaatggaat

SEQ ID NO: 5819033 - DNA, 21 bp, Homo sapiens
aaagatgttaacagtatttta

SEQ ID NO: 5819034 - DNA, 21 bp, Homo sapiens
aaagatgttccagtgaggaac

SEQ ID NO: 5819035 - DNA, 14 bp, Homo sapiens
aaagatgtttgaaa

SEQ ID NO: 5819036 - DNA, 21 bp, Homo sapiens
aaagatgtttgaaaatgctct

SEQ ID NO: 5819037 - DNA, 20 bp, Homo sapiens
aaagatgtttgtcagatatg

SEQ ID NO: 5819038 - DNA, 19 bp, Homo sapiens
aaagattaaatgtgtcatt

SEQ ID NO: 5819039 - DNA, 22 bp, Homo sapiens
aaagattactttttctttatgt

SEQ ID NO: 5819040 - DNA, 21 bp, Homo sapiens
aaagattaggtcgttttccaa

SEQ ID NO: 5819041 - DNA, 21 bp, Homo sapiens
aaagattatatatcataaagt

SEQ ID NO: 5819042 - DNA, 12 bp, Homo sapiens
aaagattatgta

SEQ ID NO: 5819043 - DNA, 22 bp, Homo sapiens
aaagattattgtgacttcactg

SEQ ID NO: 5819044 - DNA, 23 bp, Homo sapiens
aaagattattgtgacttcactgt

SEQ ID NO: 5819045 - DNA, 23 bp, Homo sapiens
aaagattatttgtgcattttatt

SEQ ID NO: 5819046 - DNA, 15 bp, Homo sapiens
aaagattcattttta

SEQ ID NO: 5819047 - DNA, 20 bp, Homo sapiens
aaagattcatttttaatcat

SEQ ID NO: 5819048 - DNA, 17 bp, Homo sapiens
aaagattccattttata

SEQ ID NO: 5819049 - DNA, 22 bp, Homo sapiens
aaagattccattttatacaaga

SEQ ID NO: 5819050 - DNA, 20 bp, Homo sapiens
aaagattctagctattattt

SEQ ID NO: 5819051 - DNA, 19 bp, Homo sapiens
aaagattctatagttctag

SEQ ID NO: 5819052 - DNA, 21 bp, Homo sapiens
aaagattctatagttctagac

SEQ ID NO: 5819053 - DNA, 22 bp, Homo sapiens
aaagattctctttaaaaaagac

SEQ ID NO: 5819054 - DNA, 19 bp, Homo sapiens
aaagattctggggctgtgt

SEQ ID NO: 5819055 - DNA, 12 bp, Homo sapiens
aaagattcttct

SEQ ID NO: 5819056 - DNA, 18 bp, Homo sapiens
aaagattctttaaactac

SEQ ID NO: 5819057 - DNA, 21 bp, Homo sapiens
aaagattctttaaactactga

SEQ ID NO: 5819058 - DNA, 17 bp, Homo sapiens
aaagattctttttctga

SEQ ID NO: 5819059 - DNA, 20 bp, Homo sapiens
aaagattgcaacccagggca

SEQ ID NO: 5819060 - DNA, 17 bp, Homo sapiens
aaagattgctgaaaaag

SEQ ID NO: 5819061 - DNA, 21 bp, Homo sapiens
aaagattgctgaaattttata

SEQ ID NO: 5819062 - DNA, 13 bp, Homo sapiens
aaagattgtactt

SEQ ID NO: 5819063 - DNA, 16 bp, Homo sapiens
aaagattgtattactt

SEQ ID NO: 5819064 - DNA, 16 bp, Homo sapiens
aaagattgtgtggtgt

SEQ ID NO: 5819065 - DNA, 14 bp, Homo sapiens
aaagattgttaaat

SEQ ID NO: 5819066 - DNA, 13 bp, Homo sapiens
aaagattgttggc

SEQ ID NO: 5819067 - DNA, 16 bp, Homo sapiens
aaagatttaacaaata

SEQ ID NO: 5819068 - DNA, 20 bp, Homo sapiens
aaagatttaagcacaaactt

SEQ ID NO: 5819069 - DNA, 21 bp, Homo sapiens
aaagatttaagcacaaacttt

SEQ ID NO: 5819070 - DNA, 17 bp, Homo sapiens
aaagatttaatgttaca

SEQ ID NO: 5819071 - DNA, 16 bp, Homo sapiens
aaagatttactttgta

SEQ ID NO: 5819072 - DNA, 12 bp, Homo sapiens
aaagatttatca

SEQ ID NO: 5819073 - DNA, 14 bp, Homo sapiens
aaagatttattgta

SEQ ID NO: 5819074 - DNA, 17 bp, Homo sapiens
aaagatttattgtaagc

SEQ ID NO: 5819075 - DNA, 22 bp, Homo sapiens
aaagatttcagtagaattttag

SEQ ID NO: 5819076 - DNA, 23 bp, Homo sapiens
aaagatttcagtagaattttagt

SEQ ID NO: 5819077 - DNA, 13 bp, Homo sapiens
aaagatttctgct

SEQ ID NO: 5819078 - DNA, 14 bp, Homo sapiens
aaagatttctgttc

SEQ ID NO: 5819079 - DNA, 23 bp, Homo sapiens
aaatacctttgtagttactcaag

SEQ ID NO: 5819080 - DNA, 21 bp, Homo sapiens
aaatacgccagaactgcttta

SEQ ID NO: 5819081 - DNA, 20 bp, Homo sapiens
aaatacgtgggcattcaaat

SEQ ID NO: 5819082 - DNA, 16 bp, Homo sapiens
aaatacgtgttcaaaa

SEQ ID NO: 5819083 - DNA, 14 bp, Homo sapiens
aaatactaaaagca

SEQ ID NO: 5819084 - DNA, 22 bp, Homo sapiens
aaatactaaaagcaaatctaca

SEQ ID NO: 5819085 - DNA, 13 bp, Homo sapiens
aaatactacctat

SEQ ID NO: 5819086 - DNA, 23 bp, Homo sapiens
aaatactacctgtcccctatgcc

SEQ ID NO: 5819087 - DNA, 12 bp, Homo sapiens
aaatactagtgg

SEQ ID NO: 5819088 - DNA, 14 bp, Homo sapiens
aaatactatccaaa

SEQ ID NO: 5819089 - DNA, 23 bp, Homo sapiens
aaatactatgaaatgaaagaact

SEQ ID NO: 5819090 - DNA, 16 bp, Homo sapiens
aaatactattgcctca

SEQ ID NO: 5819091 - DNA, 20 bp, Homo sapiens
aaatactatttaaagcctcc

SEQ ID NO: 5819092 - DNA, 16 bp, Homo sapiens
aaatactatttaagat

SEQ ID NO: 5819093 - DNA, 21 bp, Homo sapiens
aaatactatttaagatgtgaa

SEQ ID NO: 5819094 - DNA, 16 bp, Homo sapiens
aaatactatttttact

SEQ ID NO: 5819095 - DNA, 15 bp, Homo sapiens
aaatactcatgtgta

SEQ ID NO: 5819096 - DNA, 15 bp, Homo sapiens
aaatactccaagctt

SEQ ID NO: 5819097 - DNA, 17 bp, Homo sapiens
aaatactccagcacctg

SEQ ID NO: 5819098 - DNA, 16 bp, Homo sapiens
aaatactcgtttttat

SEQ ID NO: 5819099 - DNA, 14 bp, Homo sapiens
aaatactctaattc

SEQ ID NO: 5819100 - DNA, 16 bp, Homo sapiens
aaatactctaattcta

SEQ ID NO: 5819101 - DNA, 22 bp, Homo sapiens
aaatactctaattctaaccaga

SEQ ID NO: 5819102 - DNA, 20 bp, Homo sapiens
aaatactctgctatttctct

SEQ ID NO: 5819103 - DNA, 16 bp, Homo sapiens
aaatactctttcaata

SEQ ID NO: 5819104 - DNA, 14 bp, Homo sapiens
aaatactgacaatg

SEQ ID NO: 5819105 - DNA, 14 bp, Homo sapiens
aaatactgattttc

SEQ ID NO: 5819106 - DNA, 18 bp, Homo sapiens
aaatactgccagatgctg

SEQ ID NO: 5819107 - DNA, 20 bp, Homo sapiens
aaatactgccagatgctgat

SEQ ID NO: 5819108 - DNA, 18 bp, Homo sapiens
aaatactgcctagaaaat

SEQ ID NO: 5819109 - DNA, 22 bp, Homo sapiens
aaatactgcctagaaaatgcaa

SEQ ID NO: 5819110 - DNA, 23 bp, Homo sapiens
aaatactgctctgaatattttgt

SEQ ID NO: 5819111 - DNA, 23 bp, Homo sapiens
aaatactgcttttgcaaacagaa

SEQ ID NO: 5819112 - DNA, 15 bp, Homo sapiens
aaatactggactcag

SEQ ID NO: 5819113 - DNA, 16 bp, Homo sapiens
aaatactggtggcgtc

SEQ ID NO: 5819114 - DNA, 14 bp, Homo sapiens
aaatactgtacaat

SEQ ID NO: 5819115 - DNA, 13 bp, Homo sapiens
aaatactgtacat

SEQ ID NO: 5819116 - DNA, 14 bp, Homo sapiens
aaatactgtacata

SEQ ID NO: 5819117 - DNA, 16 bp, Homo sapiens
aaatactgtacataga

SEQ ID NO: 5819118 - DNA, 17 bp, Homo sapiens
aaatactgtagataatt

SEQ ID NO: 5819119 - DNA, 16 bp, Homo sapiens
aaatactgtgcagaat

SEQ ID NO: 5819120 - DNA, 14 bp, Homo sapiens
aaatactgttggtg

SEQ ID NO: 5819121 - DNA, 18 bp, Homo sapiens
aaatactgttttggaatg

SEQ ID NO: 5819122 - DNA, 18 bp, Homo sapiens
aaatacttaaatgttatg

SEQ ID NO: 5819123 - DNA, 19 bp, Homo sapiens
aaatacttaaatttggttt

SEQ ID NO: 5819124 - DNA, 14 bp, Homo sapiens
aaatacttattcat

SEQ ID NO: 5819125 - DNA, 18 bp, Homo sapiens
aaatacttcaaatcatat

SEQ ID NO: 5819126 - DNA, 17 bp, Homo sapiens
aaatacttcgatgatga

SEQ ID NO: 5819127 - DNA, 19 bp, Homo sapiens
aaatacttctttttcatta

SEQ ID NO: 5819128 - DNA, 17 bp, Homo sapiens
aaatacttgagaaattt

SEQ ID NO: 5819129 - DNA, 13 bp, Homo sapiens
aaatacttgcagt

SEQ ID NO: 5819130 - DNA, 18 bp, Homo sapiens
aaatacttgcagttgtga

SEQ ID NO: 5819131 - DNA, 22 bp, Homo sapiens
aaatacttgtcaatatttaaac

SEQ ID NO: 5819132 - DNA, 14 bp, Homo sapiens
aaatacttgtctgt

SEQ ID NO: 5819133 - DNA, 16 bp, Homo sapiens
aaatacttgtctgttt

SEQ ID NO: 5819134 - DNA, 19 bp, Homo sapiens
aaatacttgtctgttttaa

SEQ ID NO: 5819135 - DNA, 16 bp, Homo sapiens
aaatacttgtgatttt

SEQ ID NO: 5819136 - DNA, 18 bp, Homo sapiens
aaatacttgtttcagctt

SEQ ID NO: 5819137 - DNA, 15 bp, Homo sapiens
aaatactttaaagga

SEQ ID NO: 5819138 - DNA, 15 bp, Homo sapiens
aaatactttgatttt

SEQ ID NO: 5819139 - DNA, 17 bp, Homo sapiens
aaatactttgattttta

SEQ ID NO: 5819140 - DNA, 19 bp, Homo sapiens
aaatactttgcataaatta

SEQ ID NO: 5819141 - DNA, 20 bp, Homo sapiens
aaatactttgcataaattaa

SEQ ID NO: 5819142 - DNA, 12 bp, Homo sapiens
aaatactttgtc

SEQ ID NO: 5819143 - DNA, 17 bp, Homo sapiens
aaatacttttactctgc

SEQ ID NO: 5819144 - DNA, 14 bp, Homo sapiens
aaatacttttcctt

SEQ ID NO: 5819145 - DNA, 19 bp, Homo sapiens
aaatacttttccttacctt

SEQ ID NO: 5819146 - DNA, 22 bp, Homo sapiens
aaatacttttgcatttttcctt

SEQ ID NO: 5819147 - DNA, 14 bp, Homo sapiens
aaatactttttcag

SEQ ID NO: 5819148 - DNA, 16 bp, Homo sapiens
aaatactttttctaat

SEQ ID NO: 5819149 - DNA, 18 bp, Homo sapiens
aaatactttttctaatga

SEQ ID NO: 5819150 - DNA, 15 bp, Homo sapiens
aaatagaaaaaaaga

SEQ ID NO: 5819151 - DNA, 23 bp, Homo sapiens
aaatagaaacaccttccagcttt

SEQ ID NO: 5819152 - DNA, 15 bp, Homo sapiens
aaatagaaagagttc

SEQ ID NO: 5819153 - DNA, 14 bp, Homo sapiens
aaatagaaataagt

SEQ ID NO: 5819154 - DNA, 14 bp, Homo sapiens
aaatagaaatatag

SEQ ID NO: 5819155 - DNA, 12 bp, Homo sapiens
aaatagaaattt

SEQ ID NO: 5819156 - DNA, 24 bp, Homo sapiens
aaatagaactatctgcattatcta

SEQ ID NO: 5819157 - DNA, 15 bp, Homo sapiens
aaatagaagaagagg

SEQ ID NO: 5819158 - DNA, 17 bp, Homo sapiens
aaatagaagaagaggaa

SEQ ID NO: 5819159 - DNA, 16 bp, Homo sapiens
aaatagaataattctt

SEQ ID NO: 5819160 - DNA, 17 bp, Homo sapiens
aaatagaatacattttg

SEQ ID NO: 5819161 - DNA, 18 bp, Homo sapiens
aaatagaataggcaaact

SEQ ID NO: 5819162 - DNA, 19 bp, Homo sapiens
aaatagaataggcaaactt

SEQ ID NO: 5819163 - DNA, 17 bp, Homo sapiens
aaatagaatatataaac

SEQ ID NO: 5819164 - DNA, 16 bp, Homo sapiens
aaatagaatgaaaagt

SEQ ID NO: 5819165 - DNA, 17 bp, Homo sapiens
aaatagaatgaaaagtt

SEQ ID NO: 5819166 - DNA, 14 bp, Homo sapiens
aaatagacttttgt

SEQ ID NO: 5819167 - DNA, 13 bp, Homo sapiens
aaatagagcaaga

SEQ ID NO: 5819168 - DNA, 19 bp, Homo sapiens
aaatagagccaactgattt

SEQ ID NO: 5819169 - DNA, 21 bp, Homo sapiens
aaatagataagagtagaaact

SEQ ID NO: 5819170 - DNA, 17 bp, Homo sapiens
aaatagatacttttgat

SEQ ID NO: 5819171 - DNA, 14 bp, Homo sapiens
aaatagatataaat

SEQ ID NO: 5819172 - DNA, 15 bp, Homo sapiens
aaatagatgctgtgt

SEQ ID NO: 5819173 - DNA, 18 bp, Homo sapiens
aaatagatgtcttttata

SEQ ID NO: 5819174 - DNA, 18 bp, Homo sapiens
aaatagattcagagaaat

SEQ ID NO: 5819175 - DNA, 13 bp, Homo sapiens
aaatagatttaaa

SEQ ID NO: 5819176 - DNA, 18 bp, Homo sapiens
aaatagatttgattattt

SEQ ID NO: 5819177 - DNA, 16 bp, Homo sapiens
aaatagatttgcaaaa

SEQ ID NO: 5819178 - DNA, 16 bp, Homo sapiens
aaatagattttaagct

SEQ ID NO: 5819179 - DNA, 21 bp, Homo sapiens
aaatagattttataagatgac

SEQ ID NO: 5819180 - DNA, 16 bp, Homo sapiens
aaatagatttttagat

SEQ ID NO: 5819181 - DNA, 13 bp, Homo sapiens
aaatagatttttg

SEQ ID NO: 5819182 - DNA, 17 bp, Homo sapiens
aaatagcaaaagaagaa

SEQ ID NO: 5819183 - DNA, 19 bp, Homo sapiens
aaatagcaattagcagaag

SEQ ID NO: 5819184 - DNA, 13 bp, Homo sapiens
aaatagcagagcc

SEQ ID NO: 5819185 - DNA, 19 bp, Homo sapiens
aaatagcatactgtgtatg

SEQ ID NO: 5819186 - DNA, 21 bp, Homo sapiens
aaatagcatactgtgtatgtt

SEQ ID NO: 5819187 - DNA, 14 bp, Homo sapiens
aaatagcatgtatt

SEQ ID NO: 5819188 - DNA, 18 bp, Homo sapiens
aaatagcatgtattgtgt

SEQ ID NO: 5819189 - DNA, 21 bp, Homo sapiens
aaatagcatgtattgtgtctt

SEQ ID NO: 5819190 - DNA, 18 bp, Homo sapiens
aaatagccaaaaaggcaa

SEQ ID NO: 5819191 - DNA, 21 bp, Homo sapiens
aaatagccaaaaaggcaaata

SEQ ID NO: 5819192 - DNA, 23 bp, Homo sapiens
aaatagccaacacccatctgttt

SEQ ID NO: 5819193 - DNA, 15 bp, Homo sapiens
aaatagccaccttga

SEQ ID NO: 5819194 - DNA, 21 bp, Homo sapiens
aaatagccacttaccttcaat

SEQ ID NO: 5819195 - DNA, 17 bp, Homo sapiens
aaatagccagtgctagt

SEQ ID NO: 5819196 - DNA, 15 bp, Homo sapiens
aaatagcctaaatga

SEQ ID NO: 5819197 - DNA, 15 bp, Homo sapiens
aaatagcggccctgg

SEQ ID NO: 5819198 - DNA, 21 bp, Homo sapiens
aaatagcgtgggatagatttg

SEQ ID NO: 5819199 - DNA, 19 bp, Homo sapiens
aaatagcgttcttgtaatt

SEQ ID NO: 5819200 - DNA, 20 bp, Homo sapiens
aaatagcgttcttgtaattt

SEQ ID NO: 5819201 - DNA, 15 bp, Homo sapiens
aaatagctaaatggc

SEQ ID NO: 5819202 - DNA, 16 bp, Homo sapiens
aaatagctaaatggca

SEQ ID NO: 5819203 - DNA, 13 bp, Homo sapiens
aaatagctataaa

SEQ ID NO: 5819204 - DNA, 18 bp, Homo sapiens
aaatagctataaatagtg

SEQ ID NO: 5819205 - DNA, 21 bp, Homo sapiens
aaatagctataaatagtgaaa

SEQ ID NO: 5819206 - DNA, 12 bp, Homo sapiens
aaatagctatat

SEQ ID NO: 5819207 - DNA, 16 bp, Homo sapiens
aaatagctatatccat

SEQ ID NO: 5819208 - DNA, 13 bp, Homo sapiens
aaatagctctttc

SEQ ID NO: 5819209 - DNA, 16 bp, Homo sapiens
aaatagcttatgaaaa

SEQ ID NO: 5819210 - DNA, 15 bp, Homo sapiens
aaatagcttgtatag

SEQ ID NO: 5819211 - DNA, 15 bp, Homo sapiens
aaatagcttttcact

SEQ ID NO: 5819212 - DNA, 15 bp, Homo sapiens
aaataggatcctgga

SEQ ID NO: 5819213 - DNA, 19 bp, Homo sapiens
aaataggatctccactgga

SEQ ID NO: 5819214 - DNA, 20 bp, Homo sapiens
aaataggattttgaacccaa

SEQ ID NO: 5819215 - DNA, 16 bp, Homo sapiens
aaataggatttttaga

SEQ ID NO: 5819216 - DNA, 15 bp, Homo sapiens
aaataggcaattaga

SEQ ID NO: 5819217 - DNA, 16 bp, Homo sapiens
aaatagggaaaaaaca

SEQ ID NO: 5819218 - DNA, 19 bp, Homo sapiens
aaatagggaagatggagac

SEQ ID NO: 5819219 - DNA, 20 bp, Homo sapiens
aaataggggatggtccagga

SEQ ID NO: 5819220 - DNA, 19 bp, Homo sapiens
aaatagggtggacagaagc

SEQ ID NO: 5819221 - DNA, 17 bp, Homo sapiens
aaatagtagacatttgt

SEQ ID NO: 5819222 - DNA, 22 bp, Homo sapiens
aaatagtatacattgtcttgat

SEQ ID NO: 5819223 - DNA, 14 bp, Homo sapiens
aaatagtatagaaa

SEQ ID NO: 5819224 - DNA, 16 bp, Homo sapiens
aaatagtatagaaaat

SEQ ID NO: 5819225 - DNA, 18 bp, Homo sapiens
aaatagtcaaatacgaaa

SEQ ID NO: 5819226 - DNA, 14 bp, Homo sapiens
aaatagtcatgatt

SEQ ID NO: 5819227 - DNA, 17 bp, Homo sapiens
aaatagtcatgattcta

SEQ ID NO: 5819228 - DNA, 23 bp, Homo sapiens
aaatagtcctgaagttcttggat

SEQ ID NO: 5819229 - DNA, 20 bp, Homo sapiens
aaatagtctagactaaaaga

SEQ ID NO: 5819230 - DNA, 13 bp, Homo sapiens
aaatagtctcatt

SEQ ID NO: 5819231 - DNA, 13 bp, Homo sapiens
aaatagtgaaaat

SEQ ID NO: 5819232 - DNA, 23 bp, Homo sapiens
aaatagtgattgtaacaaattga

SEQ ID NO: 5819233 - DNA, 19 bp, Homo sapiens
aaatagtggtgtgatttgg

SEQ ID NO: 5819234 - DNA, 19 bp, Homo sapiens
aaatagtggttcttggaaa

SEQ ID NO: 5819235 - DNA, 12 bp, Homo sapiens
aaatagtgtaag

SEQ ID NO: 5819236 - DNA, 18 bp, Homo sapiens
aaatagtgtaagaactgt

SEQ ID NO: 5819237 - DNA, 20 bp, Homo sapiens
aaatagtgtaagaactgtac

SEQ ID NO: 5819238 - DNA, 13 bp, Homo sapiens
aaatagtgtgaaa

SEQ ID NO: 5819239 - DNA, 18 bp, Homo sapiens
aaatagtgtgaaatatat

SEQ ID NO: 5819240 - DNA, 17 bp, Homo sapiens
aaatagtgttcttttta

SEQ ID NO: 5819241 - DNA, 17 bp, Homo sapiens
aaatagtgttgatcaga

SEQ ID NO: 5819242 - DNA, 17 bp, Homo sapiens
aaatagttaatatagtc

SEQ ID NO: 5819243 - DNA, 20 bp, Homo sapiens
aaatagttagatctttgtaa

SEQ ID NO: 5819244 - DNA, 17 bp, Homo sapiens
aaatagttcaaactgca

SEQ ID NO: 5819245 - DNA, 13 bp, Homo sapiens
aaatagttctatt

SEQ ID NO: 5819246 - DNA, 15 bp, Homo sapiens
aaatagttctatttc

SEQ ID NO: 5819247 - DNA, 23 bp, Homo sapiens
aaatagttctgtgactaggaaaa

SEQ ID NO: 5819248 - DNA, 23 bp, Homo sapiens
aaatagttgagccagcagacatt

SEQ ID NO: 5819249 - DNA, 18 bp, Homo sapiens
aaatagttgtaggggaaa

SEQ ID NO: 5819250 - DNA, 13 bp, Homo sapiens
aaatagtttaaaa

SEQ ID NO: 5819251 - DNA, 20 bp, Homo sapiens
aaatagtttaaaaatattcc

SEQ ID NO: 5819252 - DNA, 19 bp, Homo sapiens
aaatagtttaggaaaatga

SEQ ID NO: 5819253 - DNA, 21 bp, Homo sapiens
aaatagtttaggaaaatgaga

SEQ ID NO: 5819254 - DNA, 19 bp, Homo sapiens
aaatagtttatttttcaca

SEQ ID NO: 5819255 - DNA, 21 bp, Homo sapiens
aaatagtttggatatgtaaaa

SEQ ID NO: 5819256 - DNA, 18 bp, Homo sapiens
aaatagttttaaatatga

SEQ ID NO: 5819257 - DNA, 18 bp, Homo sapiens
aaatcaaaaacttttgca

SEQ ID NO: 5819258 - DNA, 16 bp, Homo sapiens
aaatcaaaacaagtga

SEQ ID NO: 5819259 - DNA, 20 bp, Homo sapiens
aaatcaaaagaatgtccaat

SEQ ID NO: 5819260 - DNA, 14 bp, Homo sapiens
aaatcaaaagctgc

SEQ ID NO: 5819261 - DNA, 21 bp, Homo sapiens
aaatcaaaaggtaatgcacat

SEQ ID NO: 5819262 - DNA, 13 bp, Homo sapiens
aaatcaaaatctc

SEQ ID NO: 5819263 - DNA, 14 bp, Homo sapiens
aaatcaaaatctct

SEQ ID NO: 5819264 - DNA, 15 bp, Homo sapiens
aaatcaaaatctctc

SEQ ID NO: 5819265 - DNA, 16 bp, Homo sapiens
aaatcaaaatctctcc

SEQ ID NO: 5819266 - DNA, 17 bp, Homo sapiens
aaatcaaaatctctcca

SEQ ID NO: 5819267 - DNA, 20 bp, Homo sapiens
aaatcaaactgtagttgttt

SEQ ID NO: 5819268 - DNA, 16 bp, Homo sapiens
aaatcaaagaacagat

SEQ ID NO: 5819269 - DNA, 17 bp, Homo sapiens
aaatcaaagaacagatg

SEQ ID NO: 5819270 - DNA, 14 bp, Homo sapiens
aaatcaaagtgcta

SEQ ID NO: 5819271 - DNA, 23 bp, Homo sapiens
aaatcaaagttatggtttcctca

SEQ ID NO: 5819272 - DNA, 18 bp, Homo sapiens
aaatcaaatatgcaaagc

SEQ ID NO: 5819273 - DNA, 13 bp, Homo sapiens
aaatcaaatgaat

SEQ ID NO: 5819274 - DNA, 15 bp, Homo sapiens
aaatcaaatgtatgt

SEQ ID NO: 5819275 - DNA, 18 bp, Homo sapiens
aaatcaacagaagcattt

SEQ ID NO: 5819276 - DNA, 23 bp, Homo sapiens
aaatcaacaggagggcagcccgt

SEQ ID NO: 5819277 - DNA, 17 bp, Homo sapiens
aaatcaaccctctcctg

SEQ ID NO: 5819278 - DNA, 23 bp, Homo sapiens
aaatcaaccctgcaatcactttt

SEQ ID NO: 5819279 - DNA, 12 bp, Homo sapiens
aaatcaactttt

SEQ ID NO: 5819280 - DNA, 15 bp, Homo sapiens
aaatcaagatgagat

SEQ ID NO: 5819281 - DNA, 17 bp, Homo sapiens
aaatcaagcaagcctct

SEQ ID NO: 5819282 - DNA, 16 bp, Homo sapiens
aaatcaaggaaaggct

SEQ ID NO: 5819283 - DNA, 22 bp, Homo sapiens
aaatcaaggagtcttctaatgt

SEQ ID NO: 5819284 - DNA, 11 bp, Homo sapiens
aaatcaaggat

SEQ ID NO: 5819285 - DNA, 12 bp, Homo sapiens
aaatcaaggatc

SEQ ID NO: 5819286 - DNA, 14 bp, Homo sapiens
aaatcaaggatctt

SEQ ID NO: 5819287 - DNA, 21 bp, Homo sapiens
aaatcaagtttgaccagtgca

SEQ ID NO: 5819288 - DNA, 21 bp, Homo sapiens
aaatcaataaaagttgatcat

SEQ ID NO: 5819289 - DNA, 13 bp, Homo sapiens
aaatcaataagaa

SEQ ID NO: 5819290 - DNA, 15 bp, Homo sapiens
aaatcaatacactag

SEQ ID NO: 5819291 - DNA, 17 bp, Homo sapiens
aaatcaatacactagtt

SEQ ID NO: 5819292 - DNA, 17 bp, Homo sapiens
aaatcaatatgcagaat

SEQ ID NO: 5819293 - DNA, 12 bp, Homo sapiens
aaatcaattttt

SEQ ID NO: 5819294 - DNA, 17 bp, Homo sapiens
aaatcaatttttaggaa

SEQ ID NO: 5819295 - DNA, 14 bp, Homo sapiens
aaatcacaaaaaca

SEQ ID NO: 5819296 - DNA, 15 bp, Homo sapiens
aaatcacaaactcat

SEQ ID NO: 5819297 - DNA, 18 bp, Homo sapiens
aaatcacaaactcatcca

SEQ ID NO: 5819298 - DNA, 15 bp, Homo sapiens
aaatcacaatgagaa

SEQ ID NO: 5819299 - DNA, 18 bp, Homo sapiens
aaatcacagaaaatttaa

SEQ ID NO: 5819300 - DNA, 17 bp, Homo sapiens
aaatcacagatttccaa

SEQ ID NO: 5819301 - DNA, 12 bp, Homo sapiens
aaatcacatcct

SEQ ID NO: 5819302 - DNA, 18 bp, Homo sapiens
aaatcacatccttatcct

SEQ ID NO: 5819303 - DNA, 16 bp, Homo sapiens
aaatcacattctgcat

SEQ ID NO: 5819304 - DNA, 21 bp, Homo sapiens
aaatcacattctgcatactaa

SEQ ID NO: 5819305 - DNA, 20 bp, Homo sapiens
aaatcacattttaagtgctt

SEQ ID NO: 5819306 - DNA, 20 bp, Homo sapiens
aaatcaccacaaactgtaat

SEQ ID NO: 5819307 - DNA, 19 bp, Homo sapiens
aaatcaccatctttgtcaa

SEQ ID NO: 5819308 - DNA, 20 bp, Homo sapiens
aaatcaccatgtaacaacca

SEQ ID NO: 5819309 - DNA, 23 bp, Homo sapiens
aaatcaccatgtaacaaccagag

SEQ ID NO: 5819310 - DNA, 20 bp, Homo sapiens
aaatcaccctgactgtgggg

SEQ ID NO: 5819311 - DNA, 22 bp, Homo sapiens
aaatcaccttttctaaaaagtc

SEQ ID NO: 5819312 - DNA, 18 bp, Homo sapiens
aaatcactaacattatat

SEQ ID NO: 5819313 - DNA, 18 bp, Homo sapiens
aaatcactatctttctga

SEQ ID NO: 5819314 - DNA, 15 bp, Homo sapiens
aaatcactctgcaat

SEQ ID NO: 5819315 - DNA, 11 bp, Homo sapiens
aaatcactgtg

SEQ ID NO: 5819316 - DNA, 22 bp, Homo sapiens
aaatcactgtgaaatttcatga

SEQ ID NO: 5819317 - DNA, 19 bp, Homo sapiens
aaatcactgtggggaaaca

SEQ ID NO: 5819318 - DNA, 23 bp, Homo sapiens
aaatcactgtggggaaacaattt

SEQ ID NO: 5819319 - DNA, 13 bp, Homo sapiens
aaatcacttcaga

SEQ ID NO: 5819320 - DNA, 14 bp, Homo sapiens
aaatcacttcagat

SEQ ID NO: 5819321 - DNA, 15 bp, Homo sapiens
aaatcacttccatag

SEQ ID NO: 5819322 - DNA, 12 bp, Homo sapiens
aaatcacttgta

SEQ ID NO: 5819323 - DNA, 17 bp, Homo sapiens
aaatcacttgtaaataa

SEQ ID NO: 5819324 - DNA, 18 bp, Homo sapiens
aaatcacttgtaaataaa

SEQ ID NO: 5819325 - DNA, 20 bp, Homo sapiens
aaatcacttgtaaataaata

SEQ ID NO: 5819326 - DNA, 21 bp, Homo sapiens
aaatcagaaagtttagatctg

SEQ ID NO: 5819327 - DNA, 15 bp, Homo sapiens
aaatcagaagtgcaa

SEQ ID NO: 5819328 - DNA, 20 bp, Homo sapiens
aaatcagaagtgcaaaggtg

SEQ ID NO: 5819329 - DNA, 13 bp, Homo sapiens
aaatcagaataaa

SEQ ID NO: 5819330 - DNA, 12 bp, Homo sapiens
aaatcagaatct

SEQ ID NO: 5819331 - DNA, 17 bp, Homo sapiens
aaatcagaatctttaaa

SEQ ID NO: 5819332 - DNA, 14 bp, Homo sapiens
aaatcagaatttct

SEQ ID NO: 5819333 - DNA, 18 bp, Homo sapiens
aaatcagactagagaata

SEQ ID NO: 5819334 - DNA, 13 bp, Homo sapiens
aaatcagagcagt

SEQ ID NO: 5819335 - DNA, 20 bp, Homo sapiens
aaatcagagcatacaaaata

SEQ ID NO: 5819336 - DNA, 18 bp, Homo sapiens
aaatcagattagaccagt

SEQ ID NO: 5819337 - DNA, 15 bp, Homo sapiens
aaatcagcatgacaa

SEQ ID NO: 5819338 - DNA, 18 bp, Homo sapiens
aaatcagccaattatgtt

SEQ ID NO: 5819339 - DNA, 19 bp, Homo sapiens
aaatcagccgtgtaaccat

SEQ ID NO: 5819340 - DNA, 19 bp, Homo sapiens
aaatcagcctgctccagct

SEQ ID NO: 5819341 - DNA, 21 bp, Homo sapiens
aaatcagcctgctccagctgt

SEQ ID NO: 5819342 - DNA, 19 bp, Homo sapiens
aaatcaggcagaaatattt

SEQ ID NO: 5819343 - DNA, 21 bp, Homo sapiens
aaatcaggtagaccatattct

SEQ ID NO: 5819344 - DNA, 16 bp, Homo sapiens
aaatcaggtgttttaa

SEQ ID NO: 5819345 - DNA, 14 bp, Homo sapiens
aaatcaggttttct

SEQ ID NO: 5819346 - DNA, 15 bp, Homo sapiens
aaatcagtaaacact

SEQ ID NO: 5819347 - DNA, 13 bp, Homo sapiens
aaatcagtaagag

SEQ ID NO: 5819348 - DNA, 13 bp, Homo sapiens
aaatcagtaattg

SEQ ID NO: 5819349 - DNA, 15 bp, Homo sapiens
aaatcagtagaaagc

SEQ ID NO: 5819350 - DNA, 18 bp, Homo sapiens
aaatcagtagaaagctaa

SEQ ID NO: 5819351 - DNA, 17 bp, Homo sapiens
aaatcagtatattttct

SEQ ID NO: 5819352 - DNA, 15 bp, Homo sapiens
aaatcagtatcagaa

SEQ ID NO: 5819353 - DNA, 12 bp, Homo sapiens
aaatcagtattt

SEQ ID NO: 5819354 - DNA, 14 bp, Homo sapiens
aaatcagtcttcct

SEQ ID NO: 5819355 - DNA, 13 bp, Homo sapiens
aaatcagtgatct

SEQ ID NO: 5819356 - DNA, 15 bp, Homo sapiens
aaatcagttctcaat

SEQ ID NO: 5819357 - DNA, 19 bp, Homo sapiens
aaatcagttgattaagtta

SEQ ID NO: 5819358 - DNA, 22 bp, Homo sapiens
aaatcagttgtgaatacattct

SEQ ID NO: 5819359 - DNA, 14 bp, Homo sapiens
aaatcataaactgt

SEQ ID NO: 5819360 - DNA, 16 bp, Homo sapiens
aaatcataaactgtgt

SEQ ID NO: 5819361 - DNA, 13 bp, Homo sapiens
aaatcataaagtc

SEQ ID NO: 5819362 - DNA, 22 bp, Homo sapiens
aaatcataagatatttttcatg

SEQ ID NO: 5819363 - DNA, 19 bp, Homo sapiens
aaatcataccagttgttca

SEQ ID NO: 5819364 - DNA, 23 bp, Homo sapiens
aaatcataggcaccttttactgt

SEQ ID NO: 5819365 - DNA, 20 bp, Homo sapiens
aaatcatatagaaaggctgg

SEQ ID NO: 5819366 - DNA, 22 bp, Homo sapiens
aaatcatattaattattttcca

SEQ ID NO: 5819367 - DNA, 12 bp, Homo sapiens
aaatcatatttc

SEQ ID NO: 5819368 - DNA, 21 bp, Homo sapiens
aaatcatatttcccttacaat

SEQ ID NO: 5819369 - DNA, 16 bp, Homo sapiens
aaatcatcaaaaagaa

SEQ ID NO: 5819370 - DNA, 14 bp, Homo sapiens
aaatcatcaaagtg

SEQ ID NO: 5819371 - DNA, 17 bp, Homo sapiens
aaatcatcaaagtgttt

SEQ ID NO: 5819372 - DNA, 19 bp, Homo sapiens
aaatcatcaagaagggctg

SEQ ID NO: 5819373 - DNA, 15 bp, Homo sapiens
aaatcatcctcatgt

SEQ ID NO: 5819374 - DNA, 18 bp, Homo sapiens
aaatcatcctcatgtcct

SEQ ID NO: 5819375 - DNA, 19 bp, Homo sapiens
aaatcatcctgttttctct

SEQ ID NO: 5819376 - DNA, 23 bp, Homo sapiens
aaatcatcctgttttctctgtga

SEQ ID NO: 5819377 - DNA, 17 bp, Homo sapiens
aaatcatctattttgat

SEQ ID NO: 5819378 - DNA, 15 bp, Homo sapiens
aaatcatgggccaga

SEQ ID NO: 5819379 - DNA, 14 bp, Homo sapiens
aaatcatgtatgtt

SEQ ID NO: 5819380 - DNA, 20 bp, Homo sapiens
aaatcatgtgcatatatctt

SEQ ID NO: 5819381 - DNA, 22 bp, Homo sapiens
aaatcatgtggcctaatattga

SEQ ID NO: 5819382 - DNA, 16 bp, Homo sapiens
aaatcatgttatgata

SEQ ID NO: 5819383 - DNA, 14 bp, Homo sapiens
aaatcatgtttatt

SEQ ID NO: 5819384 - DNA, 17 bp, Homo sapiens
aaatcatgttttgatga

SEQ ID NO: 5819385 - DNA, 17 bp, Homo sapiens
aaatcatgttttttctg

SEQ ID NO: 5819386 - DNA, 16 bp, Homo sapiens
aaatcattcattttct

SEQ ID NO: 5819387 - DNA, 14 bp, Homo sapiens
aaatcattccttag

SEQ ID NO: 5819388 - DNA, 21 bp, Homo sapiens
aaatcattcttactaaaaagt

SEQ ID NO: 5819389 - DNA, 12 bp, Homo sapiens
aaatcatttcag

SEQ ID NO: 5819390 - DNA, 14 bp, Homo sapiens
aaatcatttcatgt

SEQ ID NO: 5819391 - DNA, 11 bp, Homo sapiens
aaatcatttct

SEQ ID NO: 5819392 - DNA, 12 bp, Homo sapiens
aaatcatttctg

SEQ ID NO: 5819393 - DNA, 19 bp, Homo sapiens
aaatcatttctgcatcagc

SEQ ID NO: 5819394 - DNA, 21 bp, Homo sapiens
aaatcatttctgcatcagctg

SEQ ID NO: 5819395 - DNA, 19 bp, Homo sapiens
aaatcatttggttaaatca

SEQ ID NO: 5819396 - DNA, 20 bp, Homo sapiens
aaatcattttatatgtcaaa

SEQ ID NO: 5819397 - DNA, 17 bp, Homo sapiens
aaatcattttatgtcaa

SEQ ID NO: 5819398 - DNA, 16 bp, Homo sapiens
aaatcattttgatgta

SEQ ID NO: 5819399 - DNA, 14 bp, Homo sapiens
aaatcattttgcaa

SEQ ID NO: 5819400 - DNA, 22 bp, Homo sapiens
aaatccaaaaagctctgaaaac

SEQ ID NO: 5819401 - DNA, 14 bp, Homo sapiens
aaatccaaatattg

SEQ ID NO: 5819402 - DNA, 15 bp, Homo sapiens
aaatccaaatttctc

SEQ ID NO: 5819403 - DNA, 18 bp, Homo sapiens
aaatccaagatgctggca

SEQ ID NO: 5819404 - DNA, 13 bp, Homo sapiens
aaatccaataaaa

SEQ ID NO: 5819405 - DNA, 16 bp, Homo sapiens
aaatccacccagccca

SEQ ID NO: 5819406 - DNA, 17 bp, Homo sapiens
aaatccacccatatgtt

SEQ ID NO: 5819407 - DNA, 20 bp, Homo sapiens
aaatccacccatatgttaaa

SEQ ID NO: 5819408 - DNA, 19 bp, Homo sapiens
aaatccagactttcttttt

SEQ ID NO: 5819409 - DNA, 18 bp, Homo sapiens
aaatccagccccttgctt

SEQ ID NO: 5819410 - DNA, 22 bp, Homo sapiens
aaatccagcgtgcaccccgccg

SEQ ID NO: 5819411 - DNA, 11 bp, Homo sapiens
aaatccaggac

SEQ ID NO: 5819412 - DNA, 12 bp, Homo sapiens
aaatccaggacc

SEQ ID NO: 5819413 - DNA, 20 bp, Homo sapiens
aaatccaggctttatgtaca

SEQ ID NO: 5819414 - DNA, 17 bp, Homo sapiens
aaatccagtattatatt

SEQ ID NO: 5819415 - DNA, 22 bp, Homo sapiens
aaatccagtattatattatcat

SEQ ID NO: 5819416 - DNA, 19 bp, Homo sapiens
aaatccagtggtgggtaat

SEQ ID NO: 5819417 - DNA, 20 bp, Homo sapiens
aaatccagtggtgggtaatt

SEQ ID NO: 5819418 - DNA, 19 bp, Homo sapiens
aaatccagtgtgcacccct

SEQ ID NO: 5819419 - DNA, 16 bp, Homo sapiens
aaatccagtttcccac

SEQ ID NO: 5819420 - DNA, 17 bp, Homo sapiens
aaatccagtttcccacc

SEQ ID NO: 5819421 - DNA, 20 bp, Homo sapiens
aaatccataaactaagagaa

SEQ ID NO: 5819422 - DNA, 23 bp, Homo sapiens
aaatccataaactaagagaaact

SEQ ID NO: 5819423 - DNA, 18 bp, Homo sapiens
aaatccatacatttgtgt

SEQ ID NO: 5819424 - DNA, 20 bp, Homo sapiens
aaatccatgtgaccattctg

SEQ ID NO: 5819425 - DNA, 18 bp, Homo sapiens
aaatccattccaggtagc

SEQ ID NO: 5819426 - DNA, 13 bp, Homo sapiens
aaatcccaaatcc

SEQ ID NO: 5819427 - DNA, 15 bp, Homo sapiens
aaatcccaagaaatg

SEQ ID NO: 5819428 - DNA, 13 bp, Homo sapiens
aaatcccaagtgt

SEQ ID NO: 5819429 - DNA, 22 bp, Homo sapiens
aaatcccaagtgtctcttgact

SEQ ID NO: 5819430 - DNA, 12 bp, Homo sapiens
aaatcccacatc

SEQ ID NO: 5819431 - DNA, 18 bp, Homo sapiens
aaatcccagggcaaatgt

SEQ ID NO: 5819432 - DNA, 15 bp, Homo sapiens
aaatcccattattca

SEQ ID NO: 5819433 - DNA, 17 bp, Homo sapiens
aaatcccattattcaaa

SEQ ID NO: 5819434 - DNA, 20 bp, Homo sapiens
aaatcccattgtatttaaaa

SEQ ID NO: 5819435 - DNA, 13 bp, Homo sapiens
aaatcccatttct

SEQ ID NO: 5819436 - DNA, 21 bp, Homo sapiens
aaatgaggaatagcaaaattc

SEQ ID NO: 5819437 - DNA, 18 bp, Homo sapiens
aaatgaggaatgtatatg

SEQ ID NO: 5819438 - DNA, 19 bp, Homo sapiens
aaatgaggaatgtatatgt

SEQ ID NO: 5819439 - DNA, 16 bp, Homo sapiens
aaatgaggacatgttt

SEQ ID NO: 5819440 - DNA, 14 bp, Homo sapiens
aaatgaggatccag

SEQ ID NO: 5819441 - DNA, 19 bp, Homo sapiens
aaatgaggccatggactct

SEQ ID NO: 5819442 - DNA, 21 bp, Homo sapiens
aaatgagggaagaacattatt

SEQ ID NO: 5819443 - DNA, 18 bp, Homo sapiens
aaatgagggctgcacatt

SEQ ID NO: 5819444 - DNA, 22 bp, Homo sapiens
aaatgagggctgcacattgcct

SEQ ID NO: 5819445 - DNA, 16 bp, Homo sapiens
aaatgaggtactctcc

SEQ ID NO: 5819446 - DNA, 16 bp, Homo sapiens
aaatgaggtctgttta

SEQ ID NO: 5819447 - DNA, 21 bp, Homo sapiens
aaatgaggtctgtttaaagtg

SEQ ID NO: 5819448 - DNA, 13 bp, Homo sapiens
aaatgagtaacat

SEQ ID NO: 5819449 - DNA, 15 bp, Homo sapiens
aaatgagtaacattt

SEQ ID NO: 5819450 - DNA, 18 bp, Homo sapiens
aaatgagtaacatttgct

SEQ ID NO: 5819451 - DNA, 14 bp, Homo sapiens
aaatgagtcatttg

SEQ ID NO: 5819452 - DNA, 16 bp, Homo sapiens
aaatgagtcatttgtt

SEQ ID NO: 5819453 - DNA, 16 bp, Homo sapiens
aaatgagttacctcat

SEQ ID NO: 5819454 - DNA, 13 bp, Homo sapiens
aaatgagttactt

SEQ ID NO: 5819455 - DNA, 19 bp, Homo sapiens
aaatgagttgtgaaagttt

SEQ ID NO: 5819456 - DNA, 16 bp, Homo sapiens
aaatgagtttaaaaaa

SEQ ID NO: 5819457 - DNA, 21 bp, Homo sapiens
aaatgagtttgtattattaca

SEQ ID NO: 5819458 - DNA, 13 bp, Homo sapiens
aaatgataaagac

SEQ ID NO: 5819459 - DNA, 15 bp, Homo sapiens
aaatgataaagatgt

SEQ ID NO: 5819460 - DNA, 18 bp, Homo sapiens
aaatgataaagatgtcaa

SEQ ID NO: 5819461 - DNA, 12 bp, Homo sapiens
aaatgataaggt

SEQ ID NO: 5819462 - DNA, 13 bp, Homo sapiens
aaatgataaggtt

SEQ ID NO: 5819463 - DNA, 18 bp, Homo sapiens
aaatgatagaactgtact

SEQ ID NO: 5819464 - DNA, 19 bp, Homo sapiens
aaatgatagatttgacctc

SEQ ID NO: 5819465 - DNA, 20 bp, Homo sapiens
aaatgatagatttgacctcc

SEQ ID NO: 5819466 - DNA, 21 bp, Homo sapiens
aaatgatagatttgacctcct

SEQ ID NO: 5819467 - DNA, 21 bp, Homo sapiens
aaatgatcaaggagggagaaa

SEQ ID NO: 5819468 - DNA, 14 bp, Homo sapiens
aaatgatcaaggca

SEQ ID NO: 5819469 - DNA, 13 bp, Homo sapiens
aaatgatcatgaa

SEQ ID NO: 5819470 - DNA, 18 bp, Homo sapiens
aaatgatcctcccacctc

SEQ ID NO: 5819471 - DNA, 19 bp, Homo sapiens
aaatgatctgagtcccagg

SEQ ID NO: 5819472 - DNA, 21 bp, Homo sapiens
aaatgatctggtggttattta

SEQ ID NO: 5819473 - DNA, 22 bp, Homo sapiens
aaatgatgcagctgttgagaaa

SEQ ID NO: 5819474 - DNA, 18 bp, Homo sapiens
aaatgatggaatttttct

SEQ ID NO: 5819475 - DNA, 21 bp, Homo sapiens
aaatgatggcgacttgtataa

SEQ ID NO: 5819476 - DNA, 17 bp, Homo sapiens
aaatgatggggagtgag

SEQ ID NO: 5819477 - DNA, 14 bp, Homo sapiens
aaatgatgtagaca

SEQ ID NO: 5819478 - DNA, 17 bp, Homo sapiens
aaatgatgtatgatttg

SEQ ID NO: 5819479 - DNA, 16 bp, Homo sapiens
aaatgatgtgaaagat

SEQ ID NO: 5819480 - DNA, 18 bp, Homo sapiens
aaatgatgtgtacccaaa

SEQ ID NO: 5819481 - DNA, 13 bp, Homo sapiens
aaatgatgttggt

SEQ ID NO: 5819482 - DNA, 16 bp, Homo sapiens
aaatgatgttttcagg

SEQ ID NO: 5819483 - DNA, 13 bp, Homo sapiens
aaatgattcactt

SEQ ID NO: 5819484 - DNA, 21 bp, Homo sapiens
aaatgattcatctttcagaaa

SEQ ID NO: 5819485 - DNA, 20 bp, Homo sapiens
aaatgattcatttttctgtt

SEQ ID NO: 5819486 - DNA, 21 bp, Homo sapiens
aaatgattcatttttctgtta

SEQ ID NO: 5819487 - DNA, 11 bp, Homo sapiens
aaatgattcca

SEQ ID NO: 5819488 - DNA, 13 bp, Homo sapiens
aaatgattccaaa

SEQ ID NO: 5819489 - DNA, 16 bp, Homo sapiens
aaatgattgcttttaa

SEQ ID NO: 5819490 - DNA, 18 bp, Homo sapiens
aaatgattggtaggaaat

SEQ ID NO: 5819491 - DNA, 16 bp, Homo sapiens
aaatgattgtcttttt

SEQ ID NO: 5819492 - DNA, 23 bp, Homo sapiens
aaatgattgtttcttcttcatgc

SEQ ID NO: 5819493 - DNA, 21 bp, Homo sapiens
aaatgatttaaatttaagtaa

SEQ ID NO: 5819494 - DNA, 13 bp, Homo sapiens
aaatgatttcata

SEQ ID NO: 5819495 - DNA, 14 bp, Homo sapiens
aaatgatttgcttt

SEQ ID NO: 5819496 - DNA, 17 bp, Homo sapiens
aaatgatttgcttttga

SEQ ID NO: 5819497 - DNA, 16 bp, Homo sapiens
aaatgatttgtggaaa

SEQ ID NO: 5819498 - DNA, 12 bp, Homo sapiens
aaatgattttaa

SEQ ID NO: 5819499 - DNA, 13 bp, Homo sapiens
aaatgattttaat

SEQ ID NO: 5819500 - DNA, 18 bp, Homo sapiens
aaatgattttaattttat

SEQ ID NO: 5819501 - DNA, 21 bp, Homo sapiens
aaatgattttatctgtgaatt

SEQ ID NO: 5819502 - DNA, 19 bp, Homo sapiens
aaatgattttattaccttg

SEQ ID NO: 5819503 - DNA, 13 bp, Homo sapiens
aaatgattttcat

SEQ ID NO: 5819504 - DNA, 17 bp, Homo sapiens
aaatgcaaaaaaaatta

SEQ ID NO: 5819505 - DNA, 20 bp, Homo sapiens
aaatgcaaaaaatcttaata

SEQ ID NO: 5819506 - DNA, 15 bp, Homo sapiens
aaatgcaaaaatctc

SEQ ID NO: 5819507 - DNA, 21 bp, Homo sapiens
aaatgcaaacacacaaaggta

SEQ ID NO: 5819508 - DNA, 16 bp, Homo sapiens
aaatgcaaacactgtg

SEQ ID NO: 5819509 - DNA, 15 bp, Homo sapiens
aaatgcaaagctgaa

SEQ ID NO: 5819510 - DNA, 15 bp, Homo sapiens
aaatgcaaagttctg

SEQ ID NO: 5819511 - DNA, 17 bp, Homo sapiens
aaatgcaaagttctgtg

SEQ ID NO: 5819512 - DNA, 14 bp, Homo sapiens
aaatgcaaatccta

SEQ ID NO: 5819513 - DNA, 17 bp, Homo sapiens
aaatgcaaatgaatcat

SEQ ID NO: 5819514 - DNA, 20 bp, Homo sapiens
aaatgcaacagtttttaaaa

SEQ ID NO: 5819515 - DNA, 14 bp, Homo sapiens
aaatgcaagatttt

SEQ ID NO: 5819516 - DNA, 19 bp, Homo sapiens
aaatgcaagtgtttgaagt

SEQ ID NO: 5819517 - DNA, 14 bp, Homo sapiens
aaatgcaataactc

SEQ ID NO: 5819518 - DNA, 14 bp, Homo sapiens
aaatgcaataagat

SEQ ID NO: 5819519 - DNA, 17 bp, Homo sapiens
aaatgcaataattttac

SEQ ID NO: 5819520 - DNA, 15 bp, Homo sapiens
aaatgcaatatttgt

SEQ ID NO: 5819521 - DNA, 22 bp, Homo sapiens
aaatgcaatcaggattttaaac

SEQ ID NO: 5819522 - DNA, 18 bp, Homo sapiens
aaatgcaatctcttttct

SEQ ID NO: 5819523 - DNA, 14 bp, Homo sapiens
aaatgcaatgtgaa

SEQ ID NO: 5819524 - DNA, 14 bp, Homo sapiens
aaatgcacaaacaa

SEQ ID NO: 5819525 - DNA, 12 bp, Homo sapiens
aaatgcacaatg

SEQ ID NO: 5819526 - DNA, 16 bp, Homo sapiens
aaatgcacaatgtctt

SEQ ID NO: 5819527 - DNA, 16 bp, Homo sapiens
aaatgcacacacctca

SEQ ID NO: 5819528 - DNA, 20 bp, Homo sapiens
aaatgcacacacctcatgct

SEQ ID NO: 5819529 - DNA, 21 bp, Homo sapiens
aaatgcacagttctatttgct

SEQ ID NO: 5819530 - DNA, 23 bp, Homo sapiens
aaatgcacctaaaatctaattag

SEQ ID NO: 5819531 - DNA, 19 bp, Homo sapiens
aaatgcactgtaatatgta

SEQ ID NO: 5819532 - DNA, 14 bp, Homo sapiens
aaatgcacttctat

SEQ ID NO: 5819533 - DNA, 24 bp, Homo sapiens
aaatgcacttgcctatgatactgt

SEQ ID NO: 5819534 - DNA, 15 bp, Homo sapiens
aaatgcagaaccaca

SEQ ID NO: 5819535 - DNA, 14 bp, Homo sapiens
aaatgcagaactta

SEQ ID NO: 5819536 - DNA, 14 bp, Homo sapiens
aaatgcagacacac

SEQ ID NO: 5819537 - DNA, 12 bp, Homo sapiens
aaatgcagccca

SEQ ID NO: 5819538 - DNA, 23 bp, Homo sapiens
aaatgcagcgaaccaatatttgt

SEQ ID NO: 5819539 - DNA, 17 bp, Homo sapiens
aaatgcagtatataggt

SEQ ID NO: 5819540 - DNA, 18 bp, Homo sapiens
aaatgcagtatatttctt

SEQ ID NO: 5819541 - DNA, 20 bp, Homo sapiens
aaatgcagtccagtgagaaa

SEQ ID NO: 5819542 - DNA, 12 bp, Homo sapiens
aaatgcagtgaa

SEQ ID NO: 5819543 - DNA, 13 bp, Homo sapiens
aaatgcagtgtat

SEQ ID NO: 5819544 - DNA, 22 bp, Homo sapiens
aaatgcagtgtatttaatgttt

SEQ ID NO: 5819545 - DNA, 16 bp, Homo sapiens
aaatgcagttttaaga

SEQ ID NO: 5819546 - DNA, 17 bp, Homo sapiens
aaatgcagttttaagaa

SEQ ID NO: 5819547 - DNA, 14 bp, Homo sapiens
aaatgcataaaata

SEQ ID NO: 5819548 - DNA, 15 bp, Homo sapiens
aaatgcatagagcaa

SEQ ID NO: 5819549 - DNA, 16 bp, Homo sapiens
aaatgcatatttctat

SEQ ID NO: 5819550 - DNA, 17 bp, Homo sapiens
aaatgcatatttctatg

SEQ ID NO: 5819551 - DNA, 21 bp, Homo sapiens
aaatgcatcaatcctgtgtgg

SEQ ID NO: 5819552 - DNA, 22 bp, Homo sapiens
aaatgcatccattcctcaggga

SEQ ID NO: 5819553 - DNA, 14 bp, Homo sapiens
aaatgcatctttga

SEQ ID NO: 5819554 - DNA, 21 bp, Homo sapiens
aaatgcatctttgatgtgttg

SEQ ID NO: 5819555 - DNA, 16 bp, Homo sapiens
aaatgcatgatattgt

SEQ ID NO: 5819556 - DNA, 18 bp, Homo sapiens
aaatgcatgattttgtaa

SEQ ID NO: 5819557 - DNA, 20 bp, Homo sapiens
aaatgcatgattttgtaacc

SEQ ID NO: 5819558 - DNA, 21 bp, Homo sapiens
aaatgcatgtcttaaatgctc

SEQ ID NO: 5819559 - DNA, 13 bp, Homo sapiens
aaatgcatgttgc

SEQ ID NO: 5819560 - DNA, 20 bp, Homo sapiens
aaatgcattataggatcatt

SEQ ID NO: 5819561 - DNA, 11 bp, Homo sapiens
aaatgcattca

SEQ ID NO: 5819562 - DNA, 22 bp, Homo sapiens
aaatgcattctatcgttattat

SEQ ID NO: 5819563 - DNA, 23 bp, Homo sapiens
aaatgcattctatcgttattata

SEQ ID NO: 5819564 - DNA, 20 bp, Homo sapiens
aaatgcattgtatcgatgtt

SEQ ID NO: 5819565 - DNA, 16 bp, Homo sapiens
aaatgcatttaagttg

SEQ ID NO: 5819566 - DNA, 20 bp, Homo sapiens
aaatgcatttaagttgtaaa

SEQ ID NO: 5819567 - DNA, 24 bp, Homo sapiens
aaatgcatttatagatcatttcta

SEQ ID NO: 5819568 - DNA, 11 bp, Homo sapiens
aaatgcatttt

SEQ ID NO: 5819569 - DNA, 12 bp, Homo sapiens
aaatgcattttc

SEQ ID NO: 5819570 - DNA, 13 bp, Homo sapiens
aaatgcattttct

SEQ ID NO: 5819571 - DNA, 18 bp, Homo sapiens
aaatgcatttttatcatg

SEQ ID NO: 5819572 - DNA, 17 bp, Homo sapiens
aaatgccaaattaaaaa

SEQ ID NO: 5819573 - DNA, 22 bp, Homo sapiens
aaatgccaaattaaaaaagata

SEQ ID NO: 5819574 - DNA, 21 bp, Homo sapiens
aaatgccaactggtcactgtg

SEQ ID NO: 5819575 - DNA, 18 bp, Homo sapiens
aaatgccaagactctatg

SEQ ID NO: 5819576 - DNA, 14 bp, Homo sapiens
aaatgccaatctct

SEQ ID NO: 5819577 - DNA, 21 bp, Homo sapiens
aaatgccacaagacataattt

SEQ ID NO: 5819578 - DNA, 17 bp, Homo sapiens
aaatgccacattttgct

SEQ ID NO: 5819579 - DNA, 23 bp, Homo sapiens
aaatgccacgtgccattgtcttt

SEQ ID NO: 5819580 - DNA, 15 bp, Homo sapiens
aaatgccagaaacag

SEQ ID NO: 5819581 - DNA, 23 bp, Homo sapiens
aaatgccagacttctaaaataaa

SEQ ID NO: 5819582 - DNA, 13 bp, Homo sapiens
aaatgccagagcc

SEQ ID NO: 5819583 - DNA, 19 bp, Homo sapiens
aaatgccagagccaacctg

SEQ ID NO: 5819584 - DNA, 17 bp, Homo sapiens
aaatgccataatacaaa

SEQ ID NO: 5819585 - DNA, 15 bp, Homo sapiens
aaatgccatgtttat

SEQ ID NO: 5819586 - DNA, 21 bp, Homo sapiens
aaatgccatttatttattgat

SEQ ID NO: 5819587 - DNA, 22 bp, Homo sapiens
aaatgccatttatttattgatt

SEQ ID NO: 5819588 - DNA, 14 bp, Homo sapiens
aaatgcccaaggat

SEQ ID NO: 5819589 - DNA, 19 bp, Homo sapiens
aaatgcccaaggatgcctt

SEQ ID NO: 5819590 - DNA, 13 bp, Homo sapiens
aaatgcccagccc

SEQ ID NO: 5819591 - DNA, 15 bp, Homo sapiens
aaatgcccagcccct

SEQ ID NO: 5819592 - DNA, 20 bp, Homo sapiens
aaatgcccatttttgctaat

SEQ ID NO: 5819593 - DNA, 21 bp, Homo sapiens
aaatgccctacatcttatttc

SEQ ID NO: 5819594 - DNA, 19 bp, Homo sapiens
aaatgccctcctaaatgtc

SEQ ID NO: 5819595 - DNA, 13 bp, Homo sapiens
aaatgccctcttc

SEQ ID NO: 5819596 - DNA, 22 bp, Homo sapiens
aaatgcccttacacttactgtt

SEQ ID NO: 5819597 - DNA, 19 bp, Homo sapiens
aaatgcccttcactttctc

SEQ ID NO: 5819598 - DNA, 24 bp, Homo sapiens
aaatgcccttcactttctcctggt

SEQ ID NO: 5819599 - DNA, 16 bp, Homo sapiens
aaatgccgctgtgtcc

SEQ ID NO: 5819600 - DNA, 16 bp, Homo sapiens
aaatgcctaagaagat

SEQ ID NO: 5819601 - DNA, 22 bp, Homo sapiens
aaatgcctagagatatttcaag

SEQ ID NO: 5819602 - DNA, 14 bp, Homo sapiens
aaatgcctcagcta

SEQ ID NO: 5819603 - DNA, 21 bp, Homo sapiens
aaatgcctcagtgtatttgta

SEQ ID NO: 5819604 - DNA, 14 bp, Homo sapiens
aaatgcctcttaaa

SEQ ID NO: 5819605 - DNA, 17 bp, Homo sapiens
aaatgcctcttaaatta

SEQ ID NO: 5819606 - DNA, 17 bp, Homo sapiens
aaatgcctgctgctgcc

SEQ ID NO: 5819607 - DNA, 15 bp, Homo sapiens
aaatgccttaaaatg

SEQ ID NO: 5819608 - DNA, 20 bp, Homo sapiens
aaatgccttactttgtatga

SEQ ID NO: 5819609 - DNA, 20 bp, Homo sapiens
aaatgccttcatgaatcttt

SEQ ID NO: 5819610 - DNA, 20 bp, Homo sapiens
aaatgccttgcttgtatgat

SEQ ID NO: 5819611 - DNA, 14 bp, Homo sapiens
aaatgccttgtata

SEQ ID NO: 5819612 - DNA, 15 bp, Homo sapiens
aaatgccttgtataa

SEQ ID NO: 5819613 - DNA, 13 bp, Homo sapiens
aaatgcctttgag

SEQ ID NO: 5819614 - DNA, 14 bp, Homo sapiens
aaatggtgccttca

SEQ ID NO: 5819615 - DNA, 20 bp, Homo sapiens
aaatggtggaggattgctgc

SEQ ID NO: 5819616 - DNA, 20 bp, Homo sapiens
aaatggtggcttcagctcca

SEQ ID NO: 5819617 - DNA, 13 bp, Homo sapiens
aaatggtgggaac

SEQ ID NO: 5819618 - DNA, 19 bp, Homo sapiens
aaatggtggtttgtcatat

SEQ ID NO: 5819619 - DNA, 17 bp, Homo sapiens
aaatggtgttacattaa

SEQ ID NO: 5819620 - DNA, 13 bp, Homo sapiens
aaatggtgttgag

SEQ ID NO: 5819621 - DNA, 18 bp, Homo sapiens
aaatggtgttttcatgta

SEQ ID NO: 5819622 - DNA, 13 bp, Homo sapiens
aaatggttaaaag

SEQ ID NO: 5819623 - DNA, 16 bp, Homo sapiens
aaatggttaaatttta

SEQ ID NO: 5819624 - DNA, 17 bp, Homo sapiens
aaatggttaaattttac

SEQ ID NO: 5819625 - DNA, 14 bp, Homo sapiens
aaatggttaagaca

SEQ ID NO: 5819626 - DNA, 21 bp, Homo sapiens
aaatggttaatccaactgtca

SEQ ID NO: 5819627 - DNA, 19 bp, Homo sapiens
aaatggttaatttttcctg

SEQ ID NO: 5819628 - DNA, 23 bp, Homo sapiens
aaatggttatccaattgctcttt

SEQ ID NO: 5819629 - DNA, 14 bp, Homo sapiens
aaatggttgatgga

SEQ ID NO: 5819630 - DNA, 18 bp, Homo sapiens
aaatggtttacttaacag

SEQ ID NO: 5819631 - DNA, 17 bp, Homo sapiens
aaatggtttcctctgga

SEQ ID NO: 5819632 - DNA, 23 bp, Homo sapiens
aaatggttttcaacaagcctgaa

SEQ ID NO: 5819633 - DNA, 14 bp, Homo sapiens
aaatgtaaaaaaca

SEQ ID NO: 5819634 - DNA, 15 bp, Homo sapiens
aaatgtaaaaatgaa

SEQ ID NO: 5819635 - DNA, 12 bp, Homo sapiens
aaatgtaaaata

SEQ ID NO: 5819636 - DNA, 16 bp, Homo sapiens
aaatgtaaaattgaaa

SEQ ID NO: 5819637 - DNA, 22 bp, Homo sapiens
aaatgtaaactcagcatcaaaa

SEQ ID NO: 5819638 - DNA, 18 bp, Homo sapiens
aaatgtaaactcttcacc

SEQ ID NO: 5819639 - DNA, 20 bp, Homo sapiens
aaatgtaaagtctagaaaat

SEQ ID NO: 5819640 - DNA, 16 bp, Homo sapiens
aaatgtaaagttgtct

SEQ ID NO: 5819641 - DNA, 21 bp, Homo sapiens
aaatgtaaagttgtcttttaa

SEQ ID NO: 5819642 - DNA, 11 bp, Homo sapiens
aaatgtaaatc

SEQ ID NO: 5819643 - DNA, 18 bp, Homo sapiens
aaatgtaaattagtttga

SEQ ID NO: 5819644 - DNA, 20 bp, Homo sapiens
aaatgtaaattagtttgaca

SEQ ID NO: 5819645 - DNA, 18 bp, Homo sapiens
aaatgtaaatttataaat

SEQ ID NO: 5819646 - DNA, 13 bp, Homo sapiens
aaatgtaacagtc

SEQ ID NO: 5819647 - DNA, 16 bp, Homo sapiens
aaatgtaacagtctga

SEQ ID NO: 5819648 - DNA, 17 bp, Homo sapiens
aaatgtaacagtctgat

SEQ ID NO: 5819649 - DNA, 11 bp, Homo sapiens
aaatgtaacat

SEQ ID NO: 5819650 - DNA, 22 bp, Homo sapiens
aaatgtaacatcataattacat

SEQ ID NO: 5819651 - DNA, 18 bp, Homo sapiens
aaatgtaactatgtttta

SEQ ID NO: 5819652 - DNA, 11 bp, Homo sapiens
aaatgtaactg

SEQ ID NO: 5819653 - DNA, 21 bp, Homo sapiens
aaatgtaactgtccgtagtat

SEQ ID NO: 5819654 - DNA, 23 bp, Homo sapiens
aaatgtaacttttcttacagcac

SEQ ID NO: 5819655 - DNA, 17 bp, Homo sapiens
aaatgtaacttttgtaa

SEQ ID NO: 5819656 - DNA, 13 bp, Homo sapiens
aaatgtaagaaag

SEQ ID NO: 5819657 - DNA, 20 bp, Homo sapiens
aaatgtaagattatagattc

SEQ ID NO: 5819658 - DNA, 13 bp, Homo sapiens
aaatgtaagcaaa

SEQ ID NO: 5819659 - DNA, 17 bp, Homo sapiens
aaatgtaaggattctgg

SEQ ID NO: 5819660 - DNA, 19 bp, Homo sapiens
aaatgtaaggattctggaa

SEQ ID NO: 5819661 - DNA, 22 bp, Homo sapiens
aaatgtaaggattctggaatac

SEQ ID NO: 5819662 - DNA, 13 bp, Homo sapiens
aaatgtaaggcaa

SEQ ID NO: 5819663 - DNA, 12 bp, Homo sapiens
aaatgtaataat

SEQ ID NO: 5819664 - DNA, 19 bp, Homo sapiens
aaatgtaataataatgaat

SEQ ID NO: 5819665 - DNA, 18 bp, Homo sapiens
aaatgtaatgcgatttta

SEQ ID NO: 5819666 - DNA, 18 bp, Homo sapiens
aaatgtaatgtcagactt

SEQ ID NO: 5819667 - DNA, 20 bp, Homo sapiens
aaatgtaatgtggcttctgg

SEQ ID NO: 5819668 - DNA, 17 bp, Homo sapiens
aaatgtaatttaaatga

SEQ ID NO: 5819669 - DNA, 19 bp, Homo sapiens
aaatgtaatttaaatgaaa

SEQ ID NO: 5819670 - DNA, 21 bp, Homo sapiens
aaatgtacaaaataaagttac

SEQ ID NO: 5819671 - DNA, 22 bp, Homo sapiens
aaatgtacactttttacagcag

SEQ ID NO: 5819672 - DNA, 16 bp, Homo sapiens
aaatgtacagacatat

SEQ ID NO: 5819673 - DNA, 13 bp, Homo sapiens
aaatgtacatgtt

SEQ ID NO: 5819674 - DNA, 22 bp, Homo sapiens
aaatgtacatgttcctttgtaa

SEQ ID NO: 5819675 - DNA, 12 bp, Homo sapiens
aaatgtacattt

SEQ ID NO: 5819676 - DNA, 21 bp, Homo sapiens
aaatgtaccatcaaatgttaa

SEQ ID NO: 5819677 - DNA, 20 bp, Homo sapiens
aaatgtacccctctcagtct

SEQ ID NO: 5819678 - DNA, 22 bp, Homo sapiens
aaatgtacccctctcagtctgc

SEQ ID NO: 5819679 - DNA, 20 bp, Homo sapiens
aaatgtacccgagcacatag

SEQ ID NO: 5819680 - DNA, 19 bp, Homo sapiens
aaatgtactacatttgcat

SEQ ID NO: 5819681 - DNA, 22 bp, Homo sapiens
aaatgtactacatttgcatgcc

SEQ ID NO: 5819682 - DNA, 15 bp, Homo sapiens
aaatgtactggtaat

SEQ ID NO: 5819683 - DNA, 21 bp, Homo sapiens
aaatgtactggtaattgtaca

SEQ ID NO: 5819684 - DNA, 18 bp, Homo sapiens
aaatgtagaatattcaga

SEQ ID NO: 5819685 - DNA, 15 bp, Homo sapiens
aaatgtagactctga

SEQ ID NO: 5819686 - DNA, 17 bp, Homo sapiens
aaatgtagactctgact

SEQ ID NO: 5819687 - DNA, 19 bp, Homo sapiens
aaatgtagagtttttaaac

SEQ ID NO: 5819688 - DNA, 15 bp, Homo sapiens
aaatgtagcttttat

SEQ ID NO: 5819689 - DNA, 17 bp, Homo sapiens
aaatgtagcttttatgt

SEQ ID NO: 5819690 - DNA, 18 bp, Homo sapiens
aaatgtagcttttatgtg

SEQ ID NO: 5819691 - DNA, 20 bp, Homo sapiens
aaatgtagcttttggggagg

SEQ ID NO: 5819692 - DNA, 13 bp, Homo sapiens
aaatgtaggtcct

SEQ ID NO: 5819693 - DNA, 17 bp, Homo sapiens
aaatgtaggtcctcaga

SEQ ID NO: 5819694 - DNA, 19 bp, Homo sapiens
aaatgtagttgatgtatcc

SEQ ID NO: 5819695 - DNA, 20 bp, Homo sapiens
aaatgtagttttgtatacag

SEQ ID NO: 5819696 - DNA, 13 bp, Homo sapiens
aaatgtataaaaa

SEQ ID NO: 5819697 - DNA, 14 bp, Homo sapiens
aaatgtataaactt

SEQ ID NO: 5819698 - DNA, 15 bp, Homo sapiens
aaatgtataaatata

SEQ ID NO: 5819699 - DNA, 16 bp, Homo sapiens
aaatgtataaatatac

SEQ ID NO: 5819700 - DNA, 18 bp, Homo sapiens
aaatgtataattaactta

SEQ ID NO: 5819701 - DNA, 21 bp, Homo sapiens
aaatgtataattaacttaact

SEQ ID NO: 5819702 - DNA, 18 bp, Homo sapiens
aaatgtatacaccaagtg

SEQ ID NO: 5819703 - DNA, 18 bp, Homo sapiens
aaatgtatacctgtaact

SEQ ID NO: 5819704 - DNA, 13 bp, Homo sapiens
aaatgtatataca

SEQ ID NO: 5819705 - DNA, 16 bp, Homo sapiens
aaatgtatatacacat

SEQ ID NO: 5819706 - DNA, 22 bp, Homo sapiens
aaatgtatatacacatatacct

SEQ ID NO: 5819707 - DNA, 14 bp, Homo sapiens
aaatgtatatgcac

SEQ ID NO: 5819708 - DNA, 17 bp, Homo sapiens
aaatgtatcatagaaat

SEQ ID NO: 5819709 - DNA, 20 bp, Homo sapiens
aaatgtatcatagaaatgta

SEQ ID NO: 5819710 - DNA, 23 bp, Homo sapiens
aaatgtatcatttttgtgcacag

SEQ ID NO: 5819711 - DNA, 23 bp, Homo sapiens
aaatgtatcctgataaacattaa

SEQ ID NO: 5819712 - DNA, 15 bp, Homo sapiens
aaatgtatctgaata

SEQ ID NO: 5819713 - DNA, 14 bp, Homo sapiens
aaatgtatgcatgt

SEQ ID NO: 5819714 - DNA, 20 bp, Homo sapiens
aaatgtatgcatgttgtcta

SEQ ID NO: 5819715 - DNA, 21 bp, Homo sapiens
aaatgtatgtgtgtctatttt

SEQ ID NO: 5819716 - DNA, 15 bp, Homo sapiens
aaatgtattagaaga

SEQ ID NO: 5819717 - DNA, 22 bp, Homo sapiens
aaatgtattagaagattttaga

SEQ ID NO: 5819718 - DNA, 13 bp, Homo sapiens
aaatgtattatgt

SEQ ID NO: 5819719 - DNA, 14 bp, Homo sapiens
aaatgtattatgtc

SEQ ID NO: 5819720 - DNA, 17 bp, Homo sapiens
aaatgtattcaagcaaa

SEQ ID NO: 5819721 - DNA, 17 bp, Homo sapiens
aaatgtattcctgaaaa

SEQ ID NO: 5819722 - DNA, 19 bp, Homo sapiens
aaatgtattcctgaaaagc

SEQ ID NO: 5819723 - DNA, 21 bp, Homo sapiens
aaatgtattcctttaaaatat

SEQ ID NO: 5819724 - DNA, 14 bp, Homo sapiens
aaatgtattgattc

SEQ ID NO: 5819725 - DNA, 10 bp, Homo sapiens
aaatgtattt

SEQ ID NO: 5819726 - DNA, 23 bp, Homo sapiens
aaatgtatttaattaaatctcaa

SEQ ID NO: 5819727 - DNA, 14 bp, Homo sapiens
aaatgtattttaca

SEQ ID NO: 5819728 - DNA, 15 bp, Homo sapiens
aaatgtattttacat

SEQ ID NO: 5819729 - DNA, 15 bp, Homo sapiens
aaatgtattttatgt

SEQ ID NO: 5819730 - DNA, 16 bp, Homo sapiens
aaatgtattttgaaga

SEQ ID NO: 5819731 - DNA, 14 bp, Homo sapiens
aaatgtatttttct

SEQ ID NO: 5819732 - DNA, 23 bp, Homo sapiens
aaatgtcaaaagtagaactttgt

SEQ ID NO: 5819733 - DNA, 15 bp, Homo sapiens
aaatgtcaaatgtga

SEQ ID NO: 5819734 - DNA, 15 bp, Homo sapiens
aaatgtcaacctttg

SEQ ID NO: 5819735 - DNA, 21 bp, Homo sapiens
aaatgtcacaatcctgtccct

SEQ ID NO: 5819736 - DNA, 21 bp, Homo sapiens
aaatgtcactgaagtgattga

SEQ ID NO: 5819737 - DNA, 20 bp, Homo sapiens
aaatgtcacttcatatttta

SEQ ID NO: 5819738 - DNA, 13 bp, Homo sapiens
aaatgtcactttt

SEQ ID NO: 5819739 - DNA, 14 bp, Homo sapiens
aaatgtcacttttt

SEQ ID NO: 5819740 - DNA, 15 bp, Homo sapiens
aaatgtcactttttg

SEQ ID NO: 5819741 - DNA, 16 bp, Homo sapiens
aaatgtcactttttga

SEQ ID NO: 5819742 - DNA, 20 bp, Homo sapiens
aaatgtcactttttgaggca

SEQ ID NO: 5819743 - DNA, 22 bp, Homo sapiens
aaatgtcactttttgaggcaaa

SEQ ID NO: 5819744 - DNA, 20 bp, Homo sapiens
aaatgtcagatacaatgtat

SEQ ID NO: 5819745 - DNA, 22 bp, Homo sapiens
aaatgtcagtagtgctaatgca

SEQ ID NO: 5819746 - DNA, 22 bp, Homo sapiens
aaatgtcagtggaagaagcaga

SEQ ID NO: 5819747 - DNA, 20 bp, Homo sapiens
aaatgtcataaattactgtt

SEQ ID NO: 5819748 - DNA, 17 bp, Homo sapiens
aaatgtcatcaaatatt

SEQ ID NO: 5819749 - DNA, 20 bp, Homo sapiens
aaatgtccacttaaaataca

SEQ ID NO: 5819750 - DNA, 11 bp, Homo sapiens
aaatgtccctc

SEQ ID NO: 5819751 - DNA, 13 bp, Homo sapiens
aaatgtcctcaga

SEQ ID NO: 5819752 - DNA, 22 bp, Homo sapiens
aaatgtcctccagaagcctctg

SEQ ID NO: 5819753 - DNA, 22 bp, Homo sapiens
aaatgtccttgtgatgtgcacg

SEQ ID NO: 5819754 - DNA, 19 bp, Homo sapiens
aaatgtcgattttcaataa

SEQ ID NO: 5819755 - DNA, 17 bp, Homo sapiens
aaatgtctaattgtccc

SEQ ID NO: 5819756 - DNA, 18 bp, Homo sapiens
aaatgtctactgaagctt

SEQ ID NO: 5819757 - DNA, 12 bp, Homo sapiens
aaatgtctataa

SEQ ID NO: 5819758 - DNA, 17 bp, Homo sapiens
aaatgtctataaatggt

SEQ ID NO: 5819759 - DNA, 21 bp, Homo sapiens
aaatgtctcaatggtgctata

SEQ ID NO: 5819760 - DNA, 17 bp, Homo sapiens
aaatgtctcagttttca

SEQ ID NO: 5819761 - DNA, 15 bp, Homo sapiens
aaatgtctctgctcc

SEQ ID NO: 5819762 - DNA, 21 bp, Homo sapiens
aaatgtctctttaatgtcaca

SEQ ID NO: 5819763 - DNA, 16 bp, Homo sapiens
aaatgtctgtggcctt

SEQ ID NO: 5819764 - DNA, 21 bp, Homo sapiens
aaatgtctgttttagttggaa

SEQ ID NO: 5819765 - DNA, 15 bp, Homo sapiens
aaatgtcttcatgtt

SEQ ID NO: 5819766 - DNA, 21 bp, Homo sapiens
aaatgtcttggtcttctactg

SEQ ID NO: 5819767 - DNA, 23 bp, Homo sapiens
aaatgtcttgtgtatttctctgt

SEQ ID NO: 5819768 - DNA, 19 bp, Homo sapiens
aaatgtctttaatgcaata

SEQ ID NO: 5819769 - DNA, 18 bp, Homo sapiens
aaatgtctttcatgtaaa

SEQ ID NO: 5819770 - DNA, 17 bp, Homo sapiens
aaatgtctttgtaagtc

SEQ ID NO: 5819771 - DNA, 17 bp, Homo sapiens
aaatgtcttttagaaga

SEQ ID NO: 5819772 - DNA, 18 bp, Homo sapiens
aaatgtcttttagaagat

SEQ ID NO: 5819773 - DNA, 20 bp, Homo sapiens
aaatgtcttttttttaatgt

SEQ ID NO: 5819774 - DNA, 14 bp, Homo sapiens
aaatgtgaaaaact

SEQ ID NO: 5819775 - DNA, 15 bp, Homo sapiens
aaatgtgaaaaacta

SEQ ID NO: 5819776 - DNA, 13 bp, Homo sapiens
aaatgtgaaagat

SEQ ID NO: 5819777 - DNA, 16 bp, Homo sapiens
aaatgtgaaatgcttt

SEQ ID NO: 5819778 - DNA, 12 bp, Homo sapiens
aaatgtgaaatt

SEQ ID NO: 5819779 - DNA, 18 bp, Homo sapiens
aaatgtgaaatttttcca

SEQ ID NO: 5819780 - DNA, 22 bp, Homo sapiens
aaatgtgaaatttttccacact

SEQ ID NO: 5819781 - DNA, 22 bp, Homo sapiens
aaatgtgaagatgcattgtagt

SEQ ID NO: 5819782 - DNA, 19 bp, Homo sapiens
aaatgtgaatgggaaaaga

SEQ ID NO: 5819783 - DNA, 13 bp, Homo sapiens
aaatgtgactcag

SEQ ID NO: 5819784 - DNA, 11 bp, Homo sapiens
aaatgtgactt

SEQ ID NO: 5819785 - DNA, 16 bp, Homo sapiens
aaatgtgagaaatgtc

SEQ ID NO: 5819786 - DNA, 17 bp, Homo sapiens
aaatgtgagctataatg

SEQ ID NO: 5819787 - DNA, 14 bp, Homo sapiens
aaatgtgaggaaga

SEQ ID NO: 5819788 - DNA, 17 bp, Homo sapiens
aaatgtgaggcaataag

SEQ ID NO: 5819789 - DNA, 15 bp, Homo sapiens
aaatgtgatcaactg

SEQ ID NO: 5819790 - DNA, 21 bp, Homo sapiens
aaatgtgatgaatactgtatt

SEQ ID NO: 5819791 - DNA, 19 bp, Homo sapiens
aaatgtgatttgtcttccc

SEQ ID NO: 5819792 - DNA, 12 bp, Homo sapiens
aaattaaatata

SEQ ID NO: 5819793 - DNA, 23 bp, Homo sapiens
aaattaaatatatgtatgtaaaa

SEQ ID NO: 5819794 - DNA, 12 bp, Homo sapiens
aaattaaatcta

SEQ ID NO: 5819795 - DNA, 13 bp, Homo sapiens
aaattaaatctag

SEQ ID NO: 5819796 - DNA, 19 bp, Homo sapiens
aaattaaatgccttgtata

SEQ ID NO: 5819797 - DNA, 12 bp, Homo sapiens
aaattaaatgga

SEQ ID NO: 5819798 - DNA, 15 bp, Homo sapiens
aaattaaatggattt

SEQ ID NO: 5819799 - DNA, 18 bp, Homo sapiens
aaattaacaaagtgtcac

SEQ ID NO: 5819800 - DNA, 20 bp, Homo sapiens
aaattaacaaagtgtcactc

SEQ ID NO: 5819801 - DNA, 23 bp, Homo sapiens
aaattaacaaattcagtggacat

SEQ ID NO: 5819802 - DNA, 12 bp, Homo sapiens
aaattaacatta

SEQ ID NO: 5819803 - DNA, 13 bp, Homo sapiens
aaattaacattat

SEQ ID NO: 5819804 - DNA, 22 bp, Homo sapiens
aaattaactgctaacttctatt

SEQ ID NO: 5819805 - DNA, 15 bp, Homo sapiens
aaattaactgtatgt

SEQ ID NO: 5819806 - DNA, 19 bp, Homo sapiens
aaattaactgtatgtgtgt

SEQ ID NO: 5819807 - DNA, 16 bp, Homo sapiens
aaattaacttagtttt

SEQ ID NO: 5819808 - DNA, 22 bp, Homo sapiens
aaattaacttttataaacttta

SEQ ID NO: 5819809 - DNA, 15 bp, Homo sapiens
aaattaagaactgaa

SEQ ID NO: 5819810 - DNA, 19 bp, Homo sapiens
aaattaagaactgaatcca

SEQ ID NO: 5819811 - DNA, 15 bp, Homo sapiens
aaattaagaaggcaa

SEQ ID NO: 5819812 - DNA, 17 bp, Homo sapiens
aaattaagaagtacaat

SEQ ID NO: 5819813 - DNA, 13 bp, Homo sapiens
aaattaagaatgt

SEQ ID NO: 5819814 - DNA, 12 bp, Homo sapiens
aaattaagacat

SEQ ID NO: 5819815 - DNA, 18 bp, Homo sapiens
aaattaagagcataaaca

SEQ ID NO: 5819816 - DNA, 20 bp, Homo sapiens
aaattaagagcataaacaat

SEQ ID NO: 5819817 - DNA, 20 bp, Homo sapiens
aaattaagatcctaaactct

SEQ ID NO: 5819818 - DNA, 16 bp, Homo sapiens
aaattaagcaaatgtt

SEQ ID NO: 5819819 - DNA, 12 bp, Homo sapiens
aaattaagcatt

SEQ ID NO: 5819820 - DNA, 14 bp, Homo sapiens
aaattaaggtctgg

SEQ ID NO: 5819821 - DNA, 21 bp, Homo sapiens
aaattaaggtgtttgaaaata

SEQ ID NO: 5819822 - DNA, 14 bp, Homo sapiens
aaattaagtagaac

SEQ ID NO: 5819823 - DNA, 15 bp, Homo sapiens
aaattaagtagaaca

SEQ ID NO: 5819824 - DNA, 16 bp, Homo sapiens
aaattaagtgtgtata

SEQ ID NO: 5819825 - DNA, 15 bp, Homo sapiens
aaattaagttgaaaa

SEQ ID NO: 5819826 - DNA, 13 bp, Homo sapiens
aaattaataatct

SEQ ID NO: 5819827 - DNA, 12 bp, Homo sapiens
aaattaatatct

SEQ ID NO: 5819828 - DNA, 16 bp, Homo sapiens
aaattaatatgattat

SEQ ID NO: 5819829 - DNA, 20 bp, Homo sapiens
aaattaatatggcttcacca

SEQ ID NO: 5819830 - DNA, 22 bp, Homo sapiens
aaattaatatggcttcaccaag

SEQ ID NO: 5819831 - DNA, 14 bp, Homo sapiens
aaattaatatttgt

SEQ ID NO: 5819832 - DNA, 13 bp, Homo sapiens
aaattaatcacaa

SEQ ID NO: 5819833 - DNA, 16 bp, Homo sapiens
aaattaatcatagtca

SEQ ID NO: 5819834 - DNA, 12 bp, Homo sapiens
aaattaatcttg

SEQ ID NO: 5819835 - DNA, 17 bp, Homo sapiens
aaattaatcttgcttca

SEQ ID NO: 5819836 - DNA, 12 bp, Homo sapiens
aaattaatcttt

SEQ ID NO: 5819837 - DNA, 21 bp, Homo sapiens
aaattaatcttttaaaaatga

SEQ ID NO: 5819838 - DNA, 13 bp, Homo sapiens
aaattaatgattc

SEQ ID NO: 5819839 - DNA, 12 bp, Homo sapiens
aaattaatgtaa

SEQ ID NO: 5819840 - DNA, 14 bp, Homo sapiens
aaattaatgtaata

SEQ ID NO: 5819841 - DNA, 20 bp, Homo sapiens
aaattaatgtaataaagtga

SEQ ID NO: 5819842 - DNA, 16 bp, Homo sapiens
aaattaattaggaatt

SEQ ID NO: 5819843 - DNA, 14 bp, Homo sapiens
aaattaattatatt

SEQ ID NO: 5819844 - DNA, 17 bp, Homo sapiens
aaattaattctaaactt

SEQ ID NO: 5819845 - DNA, 17 bp, Homo sapiens
aaattaattgaatctag

SEQ ID NO: 5819846 - DNA, 19 bp, Homo sapiens
aaattaattggcagcagat

SEQ ID NO: 5819847 - DNA, 21 bp, Homo sapiens
aaattaattggcagcagattt

SEQ ID NO: 5819848 - DNA, 13 bp, Homo sapiens
aaattaattgtgt

SEQ ID NO: 5819849 - DNA, 16 bp, Homo sapiens
aaattaattgtgtgaa

SEQ ID NO: 5819850 - DNA, 16 bp, Homo sapiens
aaattaatttgtgaat

SEQ ID NO: 5819851 - DNA, 15 bp, Homo sapiens
aaattaatttgtgca

SEQ ID NO: 5819852 - DNA, 17 bp, Homo sapiens
aaattaatttgttaatt

SEQ ID NO: 5819853 - DNA, 14 bp, Homo sapiens
aaattaattttact

SEQ ID NO: 5819854 - DNA, 14 bp, Homo sapiens
aaattaatttttca

SEQ ID NO: 5819855 - DNA, 16 bp, Homo sapiens
aaattacaaaagagca

SEQ ID NO: 5819856 - DNA, 11 bp, Homo sapiens
aaattacaagt

SEQ ID NO: 5819857 - DNA, 12 bp, Homo sapiens
aaattacaagta

SEQ ID NO: 5819858 - DNA, 18 bp, Homo sapiens
aaattacacaataaagca

SEQ ID NO: 5819859 - DNA, 16 bp, Homo sapiens
aaattacactttattc

SEQ ID NO: 5819860 - DNA, 13 bp, Homo sapiens
aaattacagaaga

SEQ ID NO: 5819861 - DNA, 20 bp, Homo sapiens
aaattacagaagaagctcct

SEQ ID NO: 5819862 - DNA, 11 bp, Homo sapiens
aaattacagat

SEQ ID NO: 5819863 - DNA, 17 bp, Homo sapiens
aaattacagatgtgaaa

SEQ ID NO: 5819864 - DNA, 13 bp, Homo sapiens
aaattacagcttt

SEQ ID NO: 5819865 - DNA, 14 bp, Homo sapiens
aaattacagctttt

SEQ ID NO: 5819866 - DNA, 14 bp, Homo sapiens
aaattacatgaaga

SEQ ID NO: 5819867 - DNA, 17 bp, Homo sapiens
aaattacatgaagattt

SEQ ID NO: 5819868 - DNA, 13 bp, Homo sapiens
aaattacatgcat

SEQ ID NO: 5819869 - DNA, 18 bp, Homo sapiens
aaattacatgcatgagca

SEQ ID NO: 5819870 - DNA, 14 bp, Homo sapiens
aaattacatgtttt

SEQ ID NO: 5819871 - DNA, 15 bp, Homo sapiens
aaattacatttgtaa

SEQ ID NO: 5819872 - DNA, 23 bp, Homo sapiens
aaattacatttgtaatttaaggt

SEQ ID NO: 5819873 - DNA, 16 bp, Homo sapiens
aaattaccagtaaagt

SEQ ID NO: 5819874 - DNA, 22 bp, Homo sapiens
aaattaccccctcctccagatc

SEQ ID NO: 5819875 - DNA, 23 bp, Homo sapiens
aaattaccccctcctccagatca

SEQ ID NO: 5819876 - DNA, 16 bp, Homo sapiens
aaattacctttaattt

SEQ ID NO: 5819877 - DNA, 21 bp, Homo sapiens
aaattacctttaattttaatg

SEQ ID NO: 5819878 - DNA, 20 bp, Homo sapiens
aaattacgtactaaggatac

SEQ ID NO: 5819879 - DNA, 16 bp, Homo sapiens
aaattacgtatgcaag

SEQ ID NO: 5819880 - DNA, 18 bp, Homo sapiens
aaattactaataaattga

SEQ ID NO: 5819881 - DNA, 15 bp, Homo sapiens
aaattactatagcaa

SEQ ID NO: 5819882 - DNA, 18 bp, Homo sapiens
aaattactccaaggttta

SEQ ID NO: 5819883 - DNA, 22 bp, Homo sapiens
aaattactgtgtaaatatatgt

SEQ ID NO: 5819884 - DNA, 17 bp, Homo sapiens
aaattactttaacattt

SEQ ID NO: 5819885 - DNA, 22 bp, Homo sapiens
aaattactttgattccatttta

SEQ ID NO: 5819886 - DNA, 14 bp, Homo sapiens
aaattacttttctg

SEQ ID NO: 5819887 - DNA, 20 bp, Homo sapiens
aaattagaaaaaaacaaact

SEQ ID NO: 5819888 - DNA, 20 bp, Homo sapiens
aaattagaaagcaacttatc

SEQ ID NO: 5819889 - DNA, 13 bp, Homo sapiens
aaattagaacttg

SEQ ID NO: 5819890 - DNA, 14 bp, Homo sapiens
aaattagaacttga

SEQ ID NO: 5819891 - DNA, 16 bp, Homo sapiens
aaattagaatagaact

SEQ ID NO: 5819892 - DNA, 18 bp, Homo sapiens
aaattagaatgaatttat

SEQ ID NO: 5819893 - DNA, 20 bp, Homo sapiens
aaattagaatgaatttatct

SEQ ID NO: 5819894 - DNA, 13 bp, Homo sapiens
aaattagagaaat

SEQ ID NO: 5819895 - DNA, 17 bp, Homo sapiens
aaattagcaatcatttt

SEQ ID NO: 5819896 - DNA, 14 bp, Homo sapiens
aaattagcatctgg

SEQ ID NO: 5819897 - DNA, 12 bp, Homo sapiens
aaattagcatgc

SEQ ID NO: 5819898 - DNA, 16 bp, Homo sapiens
aaattagcatgcaagc

SEQ ID NO: 5819899 - DNA, 16 bp, Homo sapiens
aaattagccaggcttg

SEQ ID NO: 5819900 - DNA, 18 bp, Homo sapiens
aaattagccagtaatcct

SEQ ID NO: 5819901 - DNA, 21 bp, Homo sapiens
aaattagccagtaatcctgta

SEQ ID NO: 5819902 - DNA, 15 bp, Homo sapiens
aaattagctatttct

SEQ ID NO: 5819903 - DNA, 13 bp, Homo sapiens
aaattagctgggc

SEQ ID NO: 5819904 - DNA, 19 bp, Homo sapiens
aaattagctgtgtgaaata

SEQ ID NO: 5819905 - DNA, 21 bp, Homo sapiens
aaattaggatgtaaatctgct

SEQ ID NO: 5819906 - DNA, 18 bp, Homo sapiens
aaattaggatttcatgat

SEQ ID NO: 5819907 - DNA, 17 bp, Homo sapiens
aaattaggccttatgta

SEQ ID NO: 5819908 - DNA, 20 bp, Homo sapiens
aaattagggctctaatttcc

SEQ ID NO: 5819909 - DNA, 21 bp, Homo sapiens
aaattagggctctaatttcct

SEQ ID NO: 5819910 - DNA, 23 bp, Homo sapiens
aaattagggctctaatttcctta

SEQ ID NO: 5819911 - DNA, 18 bp, Homo sapiens
aaattaggggttaaagca

SEQ ID NO: 5819912 - DNA, 18 bp, Homo sapiens
aaattaggtattttgtcc

SEQ ID NO: 5819913 - DNA, 13 bp, Homo sapiens
aaattaggttaaa

SEQ ID NO: 5819914 - DNA, 14 bp, Homo sapiens
aaattaggttgaaa

SEQ ID NO: 5819915 - DNA, 19 bp, Homo sapiens
aaattaggttttgtacaat

SEQ ID NO: 5819916 - DNA, 23 bp, Homo sapiens
aaattaggttttgtacaattgaa

SEQ ID NO: 5819917 - DNA, 17 bp, Homo sapiens
aaattagtaatgtacta

SEQ ID NO: 5819918 - DNA, 14 bp, Homo sapiens
aaattagtaattgt

SEQ ID NO: 5819919 - DNA, 15 bp, Homo sapiens
aaattagtaattgta

SEQ ID NO: 5819920 - DNA, 22 bp, Homo sapiens
aaattagtaggctcatttactg

SEQ ID NO: 5819921 - DNA, 15 bp, Homo sapiens
aaattagtagtgtgt

SEQ ID NO: 5819922 - DNA, 16 bp, Homo sapiens
aaattagtattttgag

SEQ ID NO: 5819923 - DNA, 20 bp, Homo sapiens
aaattagtattttgagcctt

SEQ ID NO: 5819924 - DNA, 15 bp, Homo sapiens
aaattagtcttttgt

SEQ ID NO: 5819925 - DNA, 17 bp, Homo sapiens
aaattagtgaagttctt

SEQ ID NO: 5819926 - DNA, 20 bp, Homo sapiens
aaattagtgaccattattca

SEQ ID NO: 5819927 - DNA, 19 bp, Homo sapiens
aaattagtgagatttgtat

SEQ ID NO: 5819928 - DNA, 21 bp, Homo sapiens
aaattagtgttttcattctgg

SEQ ID NO: 5819929 - DNA, 21 bp, Homo sapiens
aaattagttagccaatatttt

SEQ ID NO: 5819930 - DNA, 17 bp, Homo sapiens
aaattagtttgacactg

SEQ ID NO: 5819931 - DNA, 12 bp, Homo sapiens
aaattataaaat

SEQ ID NO: 5819932 - DNA, 14 bp, Homo sapiens
aaattataaacttt

SEQ ID NO: 5819933 - DNA, 15 bp, Homo sapiens
aaattataaagataa

SEQ ID NO: 5819934 - DNA, 22 bp, Homo sapiens
aaattataactattacagtgtt

SEQ ID NO: 5819935 - DNA, 16 bp, Homo sapiens
aaattataacttaaaa

SEQ ID NO: 5819936 - DNA, 17 bp, Homo sapiens
aaattataacttaaaat

SEQ ID NO: 5819937 - DNA, 16 bp, Homo sapiens
aaattataaggactgc

SEQ ID NO: 5819938 - DNA, 18 bp, Homo sapiens
aaattataaggactgcat

SEQ ID NO: 5819939 - DNA, 20 bp, Homo sapiens
aaattataaggactgcatgg

SEQ ID NO: 5819940 - DNA, 20 bp, Homo sapiens
aaattataagggccctgccc

SEQ ID NO: 5819941 - DNA, 22 bp, Homo sapiens
aaattataagtaacttgtcaag

SEQ ID NO: 5819942 - DNA, 17 bp, Homo sapiens
aaattataatgtattca

SEQ ID NO: 5819943 - DNA, 20 bp, Homo sapiens
aaattatacaatgatatcca

SEQ ID NO: 5819944 - DNA, 16 bp, Homo sapiens
aaattatactgtagct

SEQ ID NO: 5819945 - DNA, 14 bp, Homo sapiens
aaattatagaaaca

SEQ ID NO: 5819946 - DNA, 22 bp, Homo sapiens
aaattatagaaacaatactgtt

SEQ ID NO: 5819947 - DNA, 17 bp, Homo sapiens
aaattatagatgggaat

SEQ ID NO: 5819948 - DNA, 20 bp, Homo sapiens
aaattatagatgggaatgaa

SEQ ID NO: 5819949 - DNA, 15 bp, Homo sapiens
aaattatagctctaa

SEQ ID NO: 5819950 - DNA, 17 bp, Homo sapiens
aaattatagtagcttat

SEQ ID NO: 5819951 - DNA, 18 bp, Homo sapiens
aaattatataagtattct

SEQ ID NO: 5819952 - DNA, 22 bp, Homo sapiens
aaattatataagtattctaaat

SEQ ID NO: 5819953 - DNA, 12 bp, Homo sapiens
aaattatatagc

SEQ ID NO: 5819954 - DNA, 15 bp, Homo sapiens
aaattatatagcaaa

SEQ ID NO: 5819955 - DNA, 15 bp, Homo sapiens
aaattatatatttat

SEQ ID NO: 5819956 - DNA, 22 bp, Homo sapiens
aaattatatatttattttattc

SEQ ID NO: 5819957 - DNA, 13 bp, Homo sapiens
aaattatatccgt

SEQ ID NO: 5819958 - DNA, 14 bp, Homo sapiens
aaattatatgatat

SEQ ID NO: 5819959 - DNA, 20 bp, Homo sapiens
aaattatatgatatgcatgt

SEQ ID NO: 5819960 - DNA, 14 bp, Homo sapiens
aaattatattctgt

SEQ ID NO: 5819961 - DNA, 22 bp, Homo sapiens
aaattatatttgtgctatagta

SEQ ID NO: 5819962 - DNA, 13 bp, Homo sapiens
aaattatcaaaaa

SEQ ID NO: 5819963 - DNA, 16 bp, Homo sapiens
aaattatcaagctaat

SEQ ID NO: 5819964 - DNA, 16 bp, Homo sapiens
aaattatcaatatcta

SEQ ID NO: 5819965 - DNA, 22 bp, Homo sapiens
aaattatcaggcaaatttgcat

SEQ ID NO: 5819966 - DNA, 15 bp, Homo sapiens
aaattatcattgttt

SEQ ID NO: 5819967 - DNA, 20 bp, Homo sapiens
aaattatcattgtttgtcct

SEQ ID NO: 5819968 - DNA, 14 bp, Homo sapiens
aaattatcctcttt

SEQ ID NO: 5819969 - DNA, 18 bp, Homo sapiens
aaattatcctctttgtaa

SEQ ID NO: 5819970 - DNA, 16 bp, Homo sapiens
aaattatctatagcta

SEQ ID NO: 5819971 - DNA, 16 bp, Homo sapiens
aaattatctatttgta

SEQ ID NO: 5819972 - DNA, 12 bp, Homo sapiens
aaattgtgcata

SEQ ID NO: 5819973 - DNA, 13 bp, Homo sapiens
aaattgtgccaaa

SEQ ID NO: 5819974 - DNA, 14 bp, Homo sapiens
aaattgtgccaaag

SEQ ID NO: 5819975 - DNA, 18 bp, Homo sapiens
aaattgtgccaaagatag

SEQ ID NO: 5819976 - DNA, 21 bp, Homo sapiens
aaattgtgcttctccccagaa

SEQ ID NO: 5819977 - DNA, 11 bp, Homo sapiens
aaattgtggat

SEQ ID NO: 5819978 - DNA, 14 bp, Homo sapiens
aaattgtggatgaa

SEQ ID NO: 5819979 - DNA, 20 bp, Homo sapiens
aaattgtgtatatatcttat

SEQ ID NO: 5819980 - DNA, 13 bp, Homo sapiens
aaattgtgtgtgc

SEQ ID NO: 5819981 - DNA, 17 bp, Homo sapiens
aaattgtgttcttaaaa

SEQ ID NO: 5819982 - DNA, 18 bp, Homo sapiens
aaattgtgttcttaaaat

SEQ ID NO: 5819983 - DNA, 19 bp, Homo sapiens
aaattgtgttgtcttcagc

SEQ ID NO: 5819984 - DNA, 22 bp, Homo sapiens
aaattgtgtttagattttatga

SEQ ID NO: 5819985 - DNA, 23 bp, Homo sapiens
aaattgttacccatttgaaagaa

SEQ ID NO: 5819986 - DNA, 19 bp, Homo sapiens
aaattgttactccatatat

SEQ ID NO: 5819987 - DNA, 16 bp, Homo sapiens
aaattgttatcaaaat

SEQ ID NO: 5819988 - DNA, 15 bp, Homo sapiens
aaattgttatttcaa

SEQ ID NO: 5819989 - DNA, 16 bp, Homo sapiens
aaattgttatttcaat

SEQ ID NO: 5819990 - DNA, 13 bp, Homo sapiens
aaattgttcatgt

SEQ ID NO: 5819991 - DNA, 21 bp, Homo sapiens
aaattgttcctctttgtttat

SEQ ID NO: 5819992 - DNA, 14 bp, Homo sapiens
aaattgttcctgat

SEQ ID NO: 5819993 - DNA, 20 bp, Homo sapiens
aaattgttctctaatatgta

SEQ ID NO: 5819994 - DNA, 17 bp, Homo sapiens
aaattgttctcttaaat

SEQ ID NO: 5819995 - DNA, 16 bp, Homo sapiens
aaattgttgcaaacta

SEQ ID NO: 5819996 - DNA, 23 bp, Homo sapiens
aaattgttgtccggtttacttta

SEQ ID NO: 5819997 - DNA, 14 bp, Homo sapiens
aaattgttgtgctt

SEQ ID NO: 5819998 - DNA, 22 bp, Homo sapiens
aaattgtttaagtgttgtaaat

SEQ ID NO: 5819999 - DNA, 13 bp, Homo sapiens
aaattgtttagtg

SEQ ID NO: 5820000 - DNA, 15 bp, Homo sapiens
aaattgtttagtgat

SEQ ID NO: 5820001 - DNA, 23 bp, Homo sapiens
aaattgtttagtgatattacatt

SEQ ID NO: 5820002 - DNA, 23 bp, Homo sapiens
aaattgtttatgtgttatgaaca

SEQ ID NO: 5820003 - DNA, 21 bp, Homo sapiens
aaattgtttcaaaataaaaac

SEQ ID NO: 5820004 - DNA, 23 bp, Homo sapiens
aaattgtttcatatctggtcaag

SEQ ID NO: 5820005 - DNA, 22 bp, Homo sapiens
aaattgtttccaagatagagag

SEQ ID NO: 5820006 - DNA, 16 bp, Homo sapiens
aaattgtttctataaa

SEQ ID NO: 5820007 - DNA, 21 bp, Homo sapiens
aaattgtttctataaattgta

SEQ ID NO: 5820008 - DNA, 21 bp, Homo sapiens
aaattgtttggcttcctcctg

SEQ ID NO: 5820009 - DNA, 14 bp, Homo sapiens
aaattgtttgtaca

SEQ ID NO: 5820010 - DNA, 18 bp, Homo sapiens
aaattgttttcacttgta

SEQ ID NO: 5820011 - DNA, 21 bp, Homo sapiens
aaattgttttcacttgtattg

SEQ ID NO: 5820012 - DNA, 15 bp, Homo sapiens
aaatttaaaaaactc

SEQ ID NO: 5820013 - DNA, 19 bp, Homo sapiens
aaatttaaaaaactcctgt

SEQ ID NO: 5820014 - DNA, 13 bp, Homo sapiens
aaatttaaaaaat

SEQ ID NO: 5820015 - DNA, 18 bp, Homo sapiens
aaatttaaaaacttaaat

SEQ ID NO: 5820016 - DNA, 20 bp, Homo sapiens
aaatttaaaaataaagctac

SEQ ID NO: 5820017 - DNA, 16 bp, Homo sapiens
aaatttaaaaatcttt

SEQ ID NO: 5820018 - DNA, 18 bp, Homo sapiens
aaatttaaaacaaacaac

SEQ ID NO: 5820019 - DNA, 17 bp, Homo sapiens
aaatttaaaagtaaaat

SEQ ID NO: 5820020 - DNA, 19 bp, Homo sapiens
aaatttaaaagtaaaatgt

SEQ ID NO: 5820021 - DNA, 16 bp, Homo sapiens
aaatttaaaatgtgtg

SEQ ID NO: 5820022 - DNA, 21 bp, Homo sapiens
aaatttaaaatgttacttatt

SEQ ID NO: 5820023 - DNA, 13 bp, Homo sapiens
aaatttaaaatta

SEQ ID NO: 5820024 - DNA, 16 bp, Homo sapiens
aaatttaaaattacgt

SEQ ID NO: 5820025 - DNA, 15 bp, Homo sapiens
aaatttaaagatatt

SEQ ID NO: 5820026 - DNA, 21 bp, Homo sapiens
aaatttaaagcaggttcttgt

SEQ ID NO: 5820027 - DNA, 17 bp, Homo sapiens
aaatttaaataatagac

SEQ ID NO: 5820028 - DNA, 21 bp, Homo sapiens
aaatttaacatctgcagtgtt

SEQ ID NO: 5820029 - DNA, 22 bp, Homo sapiens
aaatttaacatctgcagtgttc

SEQ ID NO: 5820030 - DNA, 17 bp, Homo sapiens
aaatttaactgcatata

SEQ ID NO: 5820031 - DNA, 18 bp, Homo sapiens
aaatttaagaaaacaagt

SEQ ID NO: 5820032 - DNA, 12 bp, Homo sapiens
aaatttaagcac

SEQ ID NO: 5820033 - DNA, 15 bp, Homo sapiens
aaatttaagcacaaa

SEQ ID NO: 5820034 - DNA, 16 bp, Homo sapiens
aaatttaagcattgtt

SEQ ID NO: 5820035 - DNA, 22 bp, Homo sapiens
aaatttaagtcgggaaattctg

SEQ ID NO: 5820036 - DNA, 14 bp, Homo sapiens
aaatttaatatact

SEQ ID NO: 5820037 - DNA, 16 bp, Homo sapiens
aaatttaatatactgc

SEQ ID NO: 5820038 - DNA, 20 bp, Homo sapiens
aaatttaatatactgcatat

SEQ ID NO: 5820039 - DNA, 13 bp, Homo sapiens
aaatttaatgctg

SEQ ID NO: 5820040 - DNA, 17 bp, Homo sapiens
aaatttaatgctgcctt

SEQ ID NO: 5820041 - DNA, 16 bp, Homo sapiens
aaatttaatgtagaca

SEQ ID NO: 5820042 - DNA, 13 bp, Homo sapiens
aaatttaattaca

SEQ ID NO: 5820043 - DNA, 13 bp, Homo sapiens
aaatttaattatt

SEQ ID NO: 5820044 - DNA, 15 bp, Homo sapiens
aaatttaattatttg

SEQ ID NO: 5820045 - DNA, 12 bp, Homo sapiens
aaatttaattct

SEQ ID NO: 5820046 - DNA, 15 bp, Homo sapiens
aaatttaattttgca

SEQ ID NO: 5820047 - DNA, 15 bp, Homo sapiens
aaatttacacagtga

SEQ ID NO: 5820048 - DNA, 18 bp, Homo sapiens
aaatttacacagtgagac

SEQ ID NO: 5820049 - DNA, 13 bp, Homo sapiens
aaatttacagtga

SEQ ID NO: 5820050 - DNA, 13 bp, Homo sapiens
aaatttacattta

SEQ ID NO: 5820051 - DNA, 17 bp, Homo sapiens
aaatttacatttaatac

SEQ ID NO: 5820052 - DNA, 14 bp, Homo sapiens
aaatttacatttat

SEQ ID NO: 5820053 - DNA, 15 bp, Homo sapiens
aaatttacgtatatt

SEQ ID NO: 5820054 - DNA, 13 bp, Homo sapiens
aaatttactatat

SEQ ID NO: 5820055 - DNA, 18 bp, Homo sapiens
aaatttactctgttgaat

SEQ ID NO: 5820056 - DNA, 19 bp, Homo sapiens
aaatttactgtgagactgt

SEQ ID NO: 5820057 - DNA, 12 bp, Homo sapiens
aaatttacttta

SEQ ID NO: 5820058 - DNA, 14 bp, Homo sapiens
aaatttactttaaa

SEQ ID NO: 5820059 - DNA, 17 bp, Homo sapiens
aaatttactttaaaaag

SEQ ID NO: 5820060 - DNA, 17 bp, Homo sapiens
aaatttactttaaacta

SEQ ID NO: 5820061 - DNA, 16 bp, Homo sapiens
aaatttactttacaca

SEQ ID NO: 5820062 - DNA, 12 bp, Homo sapiens
aaatttagaaca

SEQ ID NO: 5820063 - DNA, 21 bp, Homo sapiens
aaatttagaagaaaagttatt

SEQ ID NO: 5820064 - DNA, 23 bp, Homo sapiens
aaatttagagtcaatttgctgaa

SEQ ID NO: 5820065 - DNA, 15 bp, Homo sapiens
aaatttagatttaat

SEQ ID NO: 5820066 - DNA, 13 bp, Homo sapiens
aaatttagcattg

SEQ ID NO: 5820067 - DNA, 21 bp, Homo sapiens
aaatttagcattgtagtgctt

SEQ ID NO: 5820068 - DNA, 20 bp, Homo sapiens
aaatttagccctttaaaacg

SEQ ID NO: 5820069 - DNA, 20 bp, Homo sapiens
aaatttaggtaaataaagct

SEQ ID NO: 5820070 - DNA, 20 bp, Homo sapiens
aaatttagtattttgtttca

SEQ ID NO: 5820071 - DNA, 15 bp, Homo sapiens
aaatttagtttgtta

SEQ ID NO: 5820072 - DNA, 17 bp, Homo sapiens
aaatttagtttgttaaa

SEQ ID NO: 5820073 - DNA, 20 bp, Homo sapiens
aaatttagtttgttaaagcc

SEQ ID NO: 5820074 - DNA, 21 bp, Homo sapiens
aaatttagtttgttaaagcct

SEQ ID NO: 5820075 - DNA, 10 bp, Homo sapiens
aaatttataa

SEQ ID NO: 5820076 - DNA, 22 bp, Homo sapiens
aaatttataaactaattttgta

SEQ ID NO: 5820077 - DNA, 16 bp, Homo sapiens
aaatttataacagtta

SEQ ID NO: 5820078 - DNA, 21 bp, Homo sapiens
aaatttataacagttataaag

SEQ ID NO: 5820079 - DNA, 19 bp, Homo sapiens
aaatttataattttaagat

SEQ ID NO: 5820080 - DNA, 21 bp, Homo sapiens
aaatttataattttaagattc

SEQ ID NO: 5820081 - DNA, 20 bp, Homo sapiens
aaatttatacaccaattgat

SEQ ID NO: 5820082 - DNA, 11 bp, Homo sapiens
aaatttatata

SEQ ID NO: 5820083 - DNA, 15 bp, Homo sapiens
aaatttatataactg

SEQ ID NO: 5820084 - DNA, 19 bp, Homo sapiens
aaatttatataactgttgt

SEQ ID NO: 5820085 - DNA, 20 bp, Homo sapiens
aaatttatatgtatccagta

SEQ ID NO: 5820086 - DNA, 14 bp, Homo sapiens
aaatttatattcat

SEQ ID NO: 5820087 - DNA, 21 bp, Homo sapiens
aaatttatgattattcaagaa

SEQ ID NO: 5820088 - DNA, 14 bp, Homo sapiens
aaatttatgcattt

SEQ ID NO: 5820089 - DNA, 15 bp, Homo sapiens
aaatttatgcatttc

SEQ ID NO: 5820090 - DNA, 16 bp, Homo sapiens
aaatttatgcatttca

SEQ ID NO: 5820091 - DNA, 21 bp, Homo sapiens
aaatttatgcatttcattcaa

SEQ ID NO: 5820092 - DNA, 23 bp, Homo sapiens
aaatttatgcatttcattcaaat

SEQ ID NO: 5820093 - DNA, 20 bp, Homo sapiens
aaatttatggccgtatcaaa

SEQ ID NO: 5820094 - DNA, 23 bp, Homo sapiens
aaatttatggttttggtattttt

SEQ ID NO: 5820095 - DNA, 18 bp, Homo sapiens
aaatttatgtcattttca

SEQ ID NO: 5820096 - DNA, 12 bp, Homo sapiens
aaatttatgtga

SEQ ID NO: 5820097 - DNA, 15 bp, Homo sapiens
aaatttatgtgatgg

SEQ ID NO: 5820098 - DNA, 14 bp, Homo sapiens
aaatttattatgtc

SEQ ID NO: 5820099 - DNA, 20 bp, Homo sapiens
aaatttatttaatgtgagtt

SEQ ID NO: 5820100 - DNA, 18 bp, Homo sapiens
aaatttatttatattccg

SEQ ID NO: 5820101 - DNA, 22 bp, Homo sapiens
aaatttatttcaatattagcaa

SEQ ID NO: 5820102 - DNA, 13 bp, Homo sapiens
aaatttatttcct

SEQ ID NO: 5820103 - DNA, 20 bp, Homo sapiens
aaatttatttcctagttctg

SEQ ID NO: 5820104 - DNA, 13 bp, Homo sapiens
aaatttatttgca

SEQ ID NO: 5820105 - DNA, 22 bp, Homo sapiens
aaatttattttataagaaaaac

SEQ ID NO: 5820106 - DNA, 14 bp, Homo sapiens
aaatttcaaatgca

SEQ ID NO: 5820107 - DNA, 16 bp, Homo sapiens
aaatttcaacagttat

SEQ ID NO: 5820108 - DNA, 20 bp, Homo sapiens
aaatttcaattagatttaaa

SEQ ID NO: 5820109 - DNA, 18 bp, Homo sapiens
aaatttcacagttctgta

SEQ ID NO: 5820110 - DNA, 17 bp, Homo sapiens
aaatttcacgattcatt

SEQ ID NO: 5820111 - DNA, 15 bp, Homo sapiens
aaatttcacttgaaa

SEQ ID NO: 5820112 - DNA, 12 bp, Homo sapiens
aaatttcagatt

SEQ ID NO: 5820113 - DNA, 17 bp, Homo sapiens
aaatttcagctttggct

SEQ ID NO: 5820114 - DNA, 14 bp, Homo sapiens
aaatttcaggatta

SEQ ID NO: 5820115 - DNA, 23 bp, Homo sapiens
aaatttcagggaaaacagaagca

SEQ ID NO: 5820116 - DNA, 18 bp, Homo sapiens
aaatttcataattctgaa

SEQ ID NO: 5820117 - DNA, 19 bp, Homo sapiens
aaatttcataattctgaaa

SEQ ID NO: 5820118 - DNA, 18 bp, Homo sapiens
aaatttcatctttccaaa

SEQ ID NO: 5820119 - DNA, 13 bp, Homo sapiens
aaatttcatgaaa

SEQ ID NO: 5820120 - DNA, 23 bp, Homo sapiens
aaatttcatgaaaactttttaat

SEQ ID NO: 5820121 - DNA, 15 bp, Homo sapiens
aaatttcatgattgg

SEQ ID NO: 5820122 - DNA, 18 bp, Homo sapiens
aaatttcatgattggctt

SEQ ID NO: 5820123 - DNA, 18 bp, Homo sapiens
aaatttcattgcactttc

SEQ ID NO: 5820124 - DNA, 21 bp, Homo sapiens
aaatttcatttcacatttttg

SEQ ID NO: 5820125 - DNA, 14 bp, Homo sapiens
aaatttccatatcc

SEQ ID NO: 5820126 - DNA, 23 bp, Homo sapiens
aaatttccattcccaaaataact

SEQ ID NO: 5820127 - DNA, 17 bp, Homo sapiens
aaatttcccaattttct

SEQ ID NO: 5820128 - DNA, 19 bp, Homo sapiens
aaatttccccaacagtgtg

SEQ ID NO: 5820129 - DNA, 14 bp, Homo sapiens
aaatttccctgggg

SEQ ID NO: 5820130 - DNA, 22 bp, Homo sapiens
aaatttcctgggagcttttgta

SEQ ID NO: 5820131 - DNA, 22 bp, Homo sapiens
aaatttcctgtttgaaatatca

SEQ ID NO: 5820132 - DNA, 18 bp, Homo sapiens
aaatttccttcaggtttt

SEQ ID NO: 5820133 - DNA, 12 bp, Homo sapiens
aaatttcgttgt

SEQ ID NO: 5820134 - DNA, 12 bp, Homo sapiens
aaatttctaaat

SEQ ID NO: 5820135 - DNA, 13 bp, Homo sapiens
aaatttctaaatc

SEQ ID NO: 5820136 - DNA, 16 bp, Homo sapiens
aaatttctaagagagc

SEQ ID NO: 5820137 - DNA, 20 bp, Homo sapiens
aaatttctagatatgagaaa

SEQ ID NO: 5820138 - DNA, 21 bp, Homo sapiens
aaatttctataaatttaagaa

SEQ ID NO: 5820139 - DNA, 23 bp, Homo sapiens
aaatttctcatcacagggattta

SEQ ID NO: 5820140 - DNA, 16 bp, Homo sapiens
aaatttctgccctgag

SEQ ID NO: 5820141 - DNA, 12 bp, Homo sapiens
aaatttctgtat

SEQ ID NO: 5820142 - DNA, 17 bp, Homo sapiens
aaatttcttatgtgaca

SEQ ID NO: 5820143 - DNA, 17 bp, Homo sapiens
aaatttcttttattaat

SEQ ID NO: 5820144 - DNA, 15 bp, Homo sapiens
aaatttgaaacattg

SEQ ID NO: 5820145 - DNA, 16 bp, Homo sapiens
aaatttgaaacattgc

SEQ ID NO: 5820146 - DNA, 16 bp, Homo sapiens
aaatttgaataagcag

SEQ ID NO: 5820147 - DNA, 20 bp, Homo sapiens
aaatttgaataagcagaaca

SEQ ID NO: 5820148 - DNA, 12 bp, Homo sapiens
aaatttgaattt

SEQ ID NO: 5820149 - DNA, 23 bp, Homo sapiens
aaatttgacattgtcagaatgtt

SEQ ID NO: 5820150 - DNA, 12 bp, Homo sapiens
aacaagagttcc

SEQ ID NO: 5820151 - DNA, 20 bp, Homo sapiens
aacaagagtttgttctgttc

SEQ ID NO: 5820152 - DNA, 14 bp, Homo sapiens
aacaagatatttat

SEQ ID NO: 5820153 - DNA, 20 bp, Homo sapiens
aacaagatatttatatgtta

SEQ ID NO: 5820154 - DNA, 17 bp, Homo sapiens
aacaagatctttcagga

SEQ ID NO: 5820155 - DNA, 19 bp, Homo sapiens
aacaagatggttctagcat

SEQ ID NO: 5820156 - DNA, 19 bp, Homo sapiens
aacaagatgtttcatttta

SEQ ID NO: 5820157 - DNA, 20 bp, Homo sapiens
aacaagatttccctaaaaat

SEQ ID NO: 5820158 - DNA, 20 bp, Homo sapiens
aacaagattttaaagacatg

SEQ ID NO: 5820159 - DNA, 19 bp, Homo sapiens
aacaagcaagctcccaagg

SEQ ID NO: 5820160 - DNA, 15 bp, Homo sapiens
aacaagcatttcaaa

SEQ ID NO: 5820161 - DNA, 22 bp, Homo sapiens
aacaagccaaacattcttattt

SEQ ID NO: 5820162 - DNA, 13 bp, Homo sapiens
aacaagccagagc

SEQ ID NO: 5820163 - DNA, 16 bp, Homo sapiens
aacaagcccaaattta

SEQ ID NO: 5820164 - DNA, 20 bp, Homo sapiens
aacaagccctgcttttgcat

SEQ ID NO: 5820165 - DNA, 22 bp, Homo sapiens
aacaagcctgaaagtaatttca

SEQ ID NO: 5820166 - DNA, 23 bp, Homo sapiens
aacaagctaattgggagtccagg

SEQ ID NO: 5820167 - DNA, 14 bp, Homo sapiens
aacaagctcatccc

SEQ ID NO: 5820168 - DNA, 18 bp, Homo sapiens
aacaagctcatccctgga

SEQ ID NO: 5820169 - DNA, 16 bp, Homo sapiens
aacaagctggcttctg

SEQ ID NO: 5820170 - DNA, 12 bp, Homo sapiens
aacaagctgtgc

SEQ ID NO: 5820171 - DNA, 22 bp, Homo sapiens
aacaagcttcaaagccatatgg

SEQ ID NO: 5820172 - DNA, 12 bp, Homo sapiens
aacaagcttcag

SEQ ID NO: 5820173 - DNA, 14 bp, Homo sapiens
aacaagcttcagta

SEQ ID NO: 5820174 - DNA, 16 bp, Homo sapiens
aacaaggaaaacagta

SEQ ID NO: 5820175 - DNA, 18 bp, Homo sapiens
aacaaggaaggacatttc

SEQ ID NO: 5820176 - DNA, 12 bp, Homo sapiens
aacaaggaatgc

SEQ ID NO: 5820177 - DNA, 20 bp, Homo sapiens
aacaaggaatgcctgtgcca

SEQ ID NO: 5820178 - DNA, 22 bp, Homo sapiens
aacaaggaccctgttttccaca

SEQ ID NO: 5820179 - DNA, 17 bp, Homo sapiens
aacaaggagctcaccct

SEQ ID NO: 5820180 - DNA, 22 bp, Homo sapiens
aacaaggagctcaccctgcccg

SEQ ID NO: 5820181 - DNA, 24 bp, Homo sapiens
aacaaggagctcaccctgcccgct

SEQ ID NO: 5820182 - DNA, 15 bp, Homo sapiens
aacaaggatgaatta

SEQ ID NO: 5820183 - DNA, 21 bp, Homo sapiens
aacaaggcaaggctgtcaatt

SEQ ID NO: 5820184 - DNA, 14 bp, Homo sapiens
aacaaggcattcag

SEQ ID NO: 5820185 - DNA, 23 bp, Homo sapiens
aacaaggcctgtcagctaaagaa

SEQ ID NO: 5820186 - DNA, 22 bp, Homo sapiens
aacaagggaaaaatttttatgt

SEQ ID NO: 5820187 - DNA, 20 bp, Homo sapiens
aacaagggagagacctcatc

SEQ ID NO: 5820188 - DNA, 21 bp, Homo sapiens
aacaagggagagacctcatca

SEQ ID NO: 5820189 - DNA, 20 bp, Homo sapiens
aacaagggctacctctgagt

SEQ ID NO: 5820190 - DNA, 17 bp, Homo sapiens
aacaagggctgcaatgc

SEQ ID NO: 5820191 - DNA, 18 bp, Homo sapiens
aacaaggggttactttac

SEQ ID NO: 5820192 - DNA, 19 bp, Homo sapiens
aacaagggtggcatcccag

SEQ ID NO: 5820193 - DNA, 23 bp, Homo sapiens
aacaaggtaatttttttttgtaa

SEQ ID NO: 5820194 - DNA, 18 bp, Homo sapiens
aacaaggtatacctcagt

SEQ ID NO: 5820195 - DNA, 22 bp, Homo sapiens
aacaaggtatacctcagttcca

SEQ ID NO: 5820196 - DNA, 19 bp, Homo sapiens
aacaaggttatatgaatat

SEQ ID NO: 5820197 - DNA, 22 bp, Homo sapiens
aacaaggttcttctaaaattga

SEQ ID NO: 5820198 - DNA, 15 bp, Homo sapiens
aacaagtaaatatat

SEQ ID NO: 5820199 - DNA, 16 bp, Homo sapiens
aacaagtaagaaaaat

SEQ ID NO: 5820200 - DNA, 15 bp, Homo sapiens
aacaagtaatgtatt

SEQ ID NO: 5820201 - DNA, 14 bp, Homo sapiens
aacaagtacatctg

SEQ ID NO: 5820202 - DNA, 13 bp, Homo sapiens
aacaagtaccaaa

SEQ ID NO: 5820203 - DNA, 13 bp, Homo sapiens
aacaagtatgaat

SEQ ID NO: 5820204 - DNA, 16 bp, Homo sapiens
aacaagtatttattcc

SEQ ID NO: 5820205 - DNA, 20 bp, Homo sapiens
aacaagtatttattcccata

SEQ ID NO: 5820206 - DNA, 12 bp, Homo sapiens
aacaagtatttg

SEQ ID NO: 5820207 - DNA, 20 bp, Homo sapiens
aacaagtatttgttaattta

SEQ ID NO: 5820208 - DNA, 23 bp, Homo sapiens
aacaagtcaattctgtgtggtat

SEQ ID NO: 5820209 - DNA, 15 bp, Homo sapiens
aacaagtcagtcatt

SEQ ID NO: 5820210 - DNA, 14 bp, Homo sapiens
aacaagtcattttt

SEQ ID NO: 5820211 - DNA, 17 bp, Homo sapiens
aacaagtcatttttgta

SEQ ID NO: 5820212 - DNA, 18 bp, Homo sapiens
aacaagtcatttttgtat

SEQ ID NO: 5820213 - DNA, 19 bp, Homo sapiens
aacaagtcgatgaactatt

SEQ ID NO: 5820214 - DNA, 23 bp, Homo sapiens
aacaagtctttagtgttcaaata

SEQ ID NO: 5820215 - DNA, 23 bp, Homo sapiens
aacaagtgaaataacaaaatgga

SEQ ID NO: 5820216 - DNA, 23 bp, Homo sapiens
aacaagtgaccccagggcctgtc

SEQ ID NO: 5820217 - DNA, 14 bp, Homo sapiens
aacaagtgctggca

SEQ ID NO: 5820218 - DNA, 16 bp, Homo sapiens
aacaagtggatgtttt

SEQ ID NO: 5820219 - DNA, 11 bp, Homo sapiens
aacaagtgtac

SEQ ID NO: 5820220 - DNA, 20 bp, Homo sapiens
aacaagtgtacagaagaatt

SEQ ID NO: 5820221 - DNA, 21 bp, Homo sapiens
aacaagttgagctatgactta

SEQ ID NO: 5820222 - DNA, 12 bp, Homo sapiens
aacaagttgcct

SEQ ID NO: 5820223 - DNA, 14 bp, Homo sapiens
aacaagttgtgcct

SEQ ID NO: 5820224 - DNA, 16 bp, Homo sapiens
aacaagttgtgccttt

SEQ ID NO: 5820225 - DNA, 14 bp, Homo sapiens
aacaagttgttaaa

SEQ ID NO: 5820226 - DNA, 23 bp, Homo sapiens
aacaagttgttaaaacatttaat

SEQ ID NO: 5820227 - DNA, 17 bp, Homo sapiens
aacaagtttagaaagct

SEQ ID NO: 5820228 - DNA, 15 bp, Homo sapiens
aacaagttttagaaa

SEQ ID NO: 5820229 - DNA, 21 bp, Homo sapiens
aacaagttttggcagccatga

SEQ ID NO: 5820230 - DNA, 22 bp, Homo sapiens
aacaataaaaacaactttcact

SEQ ID NO: 5820231 - DNA, 19 bp, Homo sapiens
aacaataaaaaccaaactc

SEQ ID NO: 5820232 - DNA, 15 bp, Homo sapiens
aacaataaaacatta

SEQ ID NO: 5820233 - DNA, 17 bp, Homo sapiens
aacaataaaacattatg

SEQ ID NO: 5820234 - DNA, 15 bp, Homo sapiens
aacaataaagagctc

SEQ ID NO: 5820235 - DNA, 15 bp, Homo sapiens
aacaataaagcattt

SEQ ID NO: 5820236 - DNA, 15 bp, Homo sapiens
aacaataaatgtgca

SEQ ID NO: 5820237 - DNA, 18 bp, Homo sapiens
aacaataactactgtgtt

SEQ ID NO: 5820238 - DNA, 11 bp, Homo sapiens
aacaataataa

SEQ ID NO: 5820239 - DNA, 13 bp, Homo sapiens
aacaataataaaa

SEQ ID NO: 5820240 - DNA, 15 bp, Homo sapiens
aacaataataaagat

SEQ ID NO: 5820241 - DNA, 17 bp, Homo sapiens
aacaataataaagatgt

SEQ ID NO: 5820242 - DNA, 14 bp, Homo sapiens
aacaataataaatg

SEQ ID NO: 5820243 - DNA, 16 bp, Homo sapiens
aacaataatgagagca

SEQ ID NO: 5820244 - DNA, 12 bp, Homo sapiens
aacaataattca

SEQ ID NO: 5820245 - DNA, 13 bp, Homo sapiens
aacaataattcat

SEQ ID NO: 5820246 - DNA, 13 bp, Homo sapiens
aacaatacaaatg

SEQ ID NO: 5820247 - DNA, 15 bp, Homo sapiens
aacaatacaaatgga

SEQ ID NO: 5820248 - DNA, 14 bp, Homo sapiens
aacaatacaacaag

SEQ ID NO: 5820249 - DNA, 20 bp, Homo sapiens
aacaatacctgaatgctctg

SEQ ID NO: 5820250 - DNA, 13 bp, Homo sapiens
aacaatactaaat

SEQ ID NO: 5820251 - DNA, 16 bp, Homo sapiens
aacaatactaaataaa

SEQ ID NO: 5820252 - DNA, 22 bp, Homo sapiens
aacaatactgttctatacgagt

SEQ ID NO: 5820253 - DNA, 17 bp, Homo sapiens
aacaatagctattgcat

SEQ ID NO: 5820254 - DNA, 21 bp, Homo sapiens
aacaatagctattgcatgtaa

SEQ ID NO: 5820255 - DNA, 23 bp, Homo sapiens
aacaatagctattgcatgtaaaa

SEQ ID NO: 5820256 - DNA, 18 bp, Homo sapiens
aacaataggctgttccca

SEQ ID NO: 5820257 - DNA, 16 bp, Homo sapiens
aacaataggtatttct

SEQ ID NO: 5820258 - DNA, 18 bp, Homo sapiens
aacaatagtaattctcag

SEQ ID NO: 5820259 - DNA, 22 bp, Homo sapiens
aacaatagttcttagctttgaa

SEQ ID NO: 5820260 - DNA, 16 bp, Homo sapiens
aacaatatatgatata

SEQ ID NO: 5820261 - DNA, 14 bp, Homo sapiens
aacaatatatgtaa

SEQ ID NO: 5820262 - DNA, 19 bp, Homo sapiens
aacaatatgaggagacatt

SEQ ID NO: 5820263 - DNA, 14 bp, Homo sapiens
aacaatatgcttta

SEQ ID NO: 5820264 - DNA, 15 bp, Homo sapiens
aacaatattactttg

SEQ ID NO: 5820265 - DNA, 16 bp, Homo sapiens
aacaatattactttgt

SEQ ID NO: 5820266 - DNA, 18 bp, Homo sapiens
aacaatattgtatactac

SEQ ID NO: 5820267 - DNA, 12 bp, Homo sapiens
aacaatatttat

SEQ ID NO: 5820268 - DNA, 13 bp, Homo sapiens
aacaatcacactc

SEQ ID NO: 5820269 - DNA, 18 bp, Homo sapiens
aacaatcactattcttaa

SEQ ID NO: 5820270 - DNA, 23 bp, Homo sapiens
aacaatccaaatgcattcatgtt

SEQ ID NO: 5820271 - DNA, 23 bp, Homo sapiens
aacaatccatgtgattaatgttt

SEQ ID NO: 5820272 - DNA, 20 bp, Homo sapiens
aacaatcccaatctttctat

SEQ ID NO: 5820273 - DNA, 17 bp, Homo sapiens
aacaatcctagtgcttt

SEQ ID NO: 5820274 - DNA, 12 bp, Homo sapiens
aacaatcctgtt

SEQ ID NO: 5820275 - DNA, 20 bp, Homo sapiens
aacaatctatttaaaaaact

SEQ ID NO: 5820276 - DNA, 17 bp, Homo sapiens
aacaatctggaagaaaa

SEQ ID NO: 5820277 - DNA, 14 bp, Homo sapiens
aacaatcttccaaa

SEQ ID NO: 5820278 - DNA, 12 bp, Homo sapiens
aacaatgaaaac

SEQ ID NO: 5820279 - DNA, 18 bp, Homo sapiens
aacaatgaaaactctttg

SEQ ID NO: 5820280 - DNA, 15 bp, Homo sapiens
aacaatgaaattgac

SEQ ID NO: 5820281 - DNA, 17 bp, Homo sapiens
aacaatgaagtgtttta

SEQ ID NO: 5820282 - DNA, 22 bp, Homo sapiens
aacaatgaataaaaactcaagg

SEQ ID NO: 5820283 - DNA, 11 bp, Homo sapiens
aacaatgaatg

SEQ ID NO: 5820284 - DNA, 17 bp, Homo sapiens
aacaatgacaagatgtt

SEQ ID NO: 5820285 - DNA, 21 bp, Homo sapiens
aacaatgactaattcttgcat

SEQ ID NO: 5820286 - DNA, 14 bp, Homo sapiens
aacaatgactttta

SEQ ID NO: 5820287 - DNA, 19 bp, Homo sapiens
aacaatgacttttaaagat

SEQ ID NO: 5820288 - DNA, 22 bp, Homo sapiens
aacaatgattttcttgaatggg

SEQ ID NO: 5820289 - DNA, 15 bp, Homo sapiens
aacaatgccatgaac

SEQ ID NO: 5820290 - DNA, 18 bp, Homo sapiens
aacaatgccatgaacaaa

SEQ ID NO: 5820291 - DNA, 21 bp, Homo sapiens
aacaatgccatgaacaaattc

SEQ ID NO: 5820292 - DNA, 18 bp, Homo sapiens
aacaatgccgcctgtcaa

SEQ ID NO: 5820293 - DNA, 20 bp, Homo sapiens
aacaatgccgcctgtcaata

SEQ ID NO: 5820294 - DNA, 19 bp, Homo sapiens
aacaatgccttgttgtatt

SEQ ID NO: 5820295 - DNA, 14 bp, Homo sapiens
aacaatgctgtatt

SEQ ID NO: 5820296 - DNA, 16 bp, Homo sapiens
aacaatggaaactgaa

SEQ ID NO: 5820297 - DNA, 22 bp, Homo sapiens
aacaatggaagaagaaaggact

SEQ ID NO: 5820298 - DNA, 17 bp, Homo sapiens
aacaatggaagatttgc

SEQ ID NO: 5820299 - DNA, 17 bp, Homo sapiens
aacaatggggactttgt

SEQ ID NO: 5820300 - DNA, 20 bp, Homo sapiens
aacaatggtaacatttttca

SEQ ID NO: 5820301 - DNA, 22 bp, Homo sapiens
aacaatggtgtctcttttatgt

SEQ ID NO: 5820302 - DNA, 13 bp, Homo sapiens
aacaatgtataaa

SEQ ID NO: 5820303 - DNA, 22 bp, Homo sapiens
aacaatgtataaagattgtact

SEQ ID NO: 5820304 - DNA, 12 bp, Homo sapiens
aacaatgtatgt

SEQ ID NO: 5820305 - DNA, 23 bp, Homo sapiens
aacaatgtatgtgaaagtgtaaa

SEQ ID NO: 5820306 - DNA, 14 bp, Homo sapiens
aacaatgtatttta

SEQ ID NO: 5820307 - DNA, 22 bp, Homo sapiens
aacaatgtcaaggtgctgttgt

SEQ ID NO: 5820308 - DNA, 22 bp, Homo sapiens
aacaatgtggagtctccctctg

SEQ ID NO: 5820309 - DNA, 23 bp, Homo sapiens
aacaatgtgggcgtttgtaaatt

SEQ ID NO: 5820310 - DNA, 18 bp, Homo sapiens
aacaatgttaaggaaact

SEQ ID NO: 5820311 - DNA, 17 bp, Homo sapiens
aacaatgttgtccaaca

SEQ ID NO: 5820312 - DNA, 15 bp, Homo sapiens
aacaatgtttgtcat

SEQ ID NO: 5820313 - DNA, 23 bp, Homo sapiens
aacaatgtttttcatactgaata

SEQ ID NO: 5820314 - DNA, 18 bp, Homo sapiens
aacaatgttttttatact

SEQ ID NO: 5820315 - DNA, 22 bp, Homo sapiens
aacaatgttttttatacttcaa

SEQ ID NO: 5820316 - DNA, 17 bp, Homo sapiens
aacaattaaacagccaa

SEQ ID NO: 5820317 - DNA, 20 bp, Homo sapiens
aacaattacatgtaaacaaa

SEQ ID NO: 5820318 - DNA, 15 bp, Homo sapiens
aacaattactaatga

SEQ ID NO: 5820319 - DNA, 22 bp, Homo sapiens
aacaattaggtctgcattttct

SEQ ID NO: 5820320 - DNA, 13 bp, Homo sapiens
aacaattatgttt

SEQ ID NO: 5820321 - DNA, 15 bp, Homo sapiens
aacaattatgtttct

SEQ ID NO: 5820322 - DNA, 14 bp, Homo sapiens
aacaattattgtac

SEQ ID NO: 5820323 - DNA, 17 bp, Homo sapiens
aacaattcaatcaaagc

SEQ ID NO: 5820324 - DNA, 18 bp, Homo sapiens
aacaattcaatcaaagct

SEQ ID NO: 5820325 - DNA, 11 bp, Homo sapiens
aacaattcagt

SEQ ID NO: 5820326 - DNA, 12 bp, Homo sapiens
aacaattcagtg

SEQ ID NO: 5820327 - DNA, 12 bp, Homo sapiens
aacaattcatgc

SEQ ID NO: 5820328 - DNA, 16 bp, Homo sapiens
aacaccctatattttg

SEQ ID NO: 5820329 - DNA, 17 bp, Homo sapiens
aacaccctcacactggg

SEQ ID NO: 5820330 - DNA, 23 bp, Homo sapiens
aacaccctgcttctcccggggac

SEQ ID NO: 5820331 - DNA, 13 bp, Homo sapiens
aacacccttagaa

SEQ ID NO: 5820332 - DNA, 22 bp, Homo sapiens
aacaccctttcatctcagagtc

SEQ ID NO: 5820333 - DNA, 15 bp, Homo sapiens
aacacctaagtgact

SEQ ID NO: 5820334 - DNA, 16 bp, Homo sapiens
aacacctagatcagaa

SEQ ID NO: 5820335 - DNA, 23 bp, Homo sapiens
aacacctaggtcgccagtgaaat

SEQ ID NO: 5820336 - DNA, 13 bp, Homo sapiens
aacacctcctcct

SEQ ID NO: 5820337 - DNA, 15 bp, Homo sapiens
aacacctcctcctgc

SEQ ID NO: 5820338 - DNA, 18 bp, Homo sapiens
aacacctccttgctttgc

SEQ ID NO: 5820339 - DNA, 19 bp, Homo sapiens
aacacctctgcacaagctg

SEQ ID NO: 5820340 - DNA, 13 bp, Homo sapiens
aacacctgacaca

SEQ ID NO: 5820341 - DNA, 15 bp, Homo sapiens
aacacctgacagccc

SEQ ID NO: 5820342 - DNA, 18 bp, Homo sapiens
aacacctgacagcccctc

SEQ ID NO: 5820343 - DNA, 13 bp, Homo sapiens
aacacctgatgtg

SEQ ID NO: 5820344 - DNA, 22 bp, Homo sapiens
aacaccttcagaggctgaggtg

SEQ ID NO: 5820345 - DNA, 19 bp, Homo sapiens
aacaccttcctcctgcaga

SEQ ID NO: 5820346 - DNA, 19 bp, Homo sapiens
aacaccttcttattatata

SEQ ID NO: 5820347 - DNA, 21 bp, Homo sapiens
aacaccttcttattatatata

SEQ ID NO: 5820348 - DNA, 24 bp, Homo sapiens
aacaccttcttggcttctgggacc

SEQ ID NO: 5820349 - DNA, 19 bp, Homo sapiens
aacaccttttatgaaaatg

SEQ ID NO: 5820350 - DNA, 15 bp, Homo sapiens
aacacgaaacttgtt

SEQ ID NO: 5820351 - DNA, 19 bp, Homo sapiens
aacacgaaacttgttattg

SEQ ID NO: 5820352 - DNA, 15 bp, Homo sapiens
aacacgaaagaaatg

SEQ ID NO: 5820353 - DNA, 15 bp, Homo sapiens
aacacgagcaggcta

SEQ ID NO: 5820354 - DNA, 15 bp, Homo sapiens
aacacgataaaccat

SEQ ID NO: 5820355 - DNA, 18 bp, Homo sapiens
aacacgcatgcctcagcc

SEQ ID NO: 5820356 - DNA, 15 bp, Homo sapiens
aacacgcctgcaaac

SEQ ID NO: 5820357 - DNA, 20 bp, Homo sapiens
aacacgcctgcaaacgctgc

SEQ ID NO: 5820358 - DNA, 16 bp, Homo sapiens
aacacgcgtatttaca

SEQ ID NO: 5820359 - DNA, 14 bp, Homo sapiens
aacacgctgcctgg

SEQ ID NO: 5820360 - DNA, 15 bp, Homo sapiens
aacacgctgcctggt

SEQ ID NO: 5820361 - DNA, 18 bp, Homo sapiens
aacacgctgcctggtctg

SEQ ID NO: 5820362 - DNA, 17 bp, Homo sapiens
aacacggagcagggaga

SEQ ID NO: 5820363 - DNA, 14 bp, Homo sapiens
aacacggcagctgt

SEQ ID NO: 5820364 - DNA, 17 bp, Homo sapiens
aacacggccctcctggg

SEQ ID NO: 5820365 - DNA, 15 bp, Homo sapiens
aacacgtgatgtgat

SEQ ID NO: 5820366 - DNA, 22 bp, Homo sapiens
aacacgttccctaatcaggaaa

SEQ ID NO: 5820367 - DNA, 18 bp, Homo sapiens
aacacgtttagaaatgat

SEQ ID NO: 5820368 - DNA, 14 bp, Homo sapiens
aacactaaaaccat

SEQ ID NO: 5820369 - DNA, 19 bp, Homo sapiens
aacactaaacagactattt

SEQ ID NO: 5820370 - DNA, 13 bp, Homo sapiens
aacactaaatgtt

SEQ ID NO: 5820371 - DNA, 16 bp, Homo sapiens
aacactaaatgttaaa

SEQ ID NO: 5820372 - DNA, 16 bp, Homo sapiens
aacactaaattgcagt

SEQ ID NO: 5820373 - DNA, 20 bp, Homo sapiens
aacactaaattgcagtttac

SEQ ID NO: 5820374 - DNA, 23 bp, Homo sapiens
aacactaacaaaatttgaataat

SEQ ID NO: 5820375 - DNA, 11 bp, Homo sapiens
aacactaacct

SEQ ID NO: 5820376 - DNA, 18 bp, Homo sapiens
aacactaactcaccagcc

SEQ ID NO: 5820377 - DNA, 15 bp, Homo sapiens
aacactaagctctct

SEQ ID NO: 5820378 - DNA, 16 bp, Homo sapiens
aacactaaggctgctt

SEQ ID NO: 5820379 - DNA, 17 bp, Homo sapiens
aacactaaggctgcttc

SEQ ID NO: 5820380 - DNA, 20 bp, Homo sapiens
aacactaatatatttaaaaa

SEQ ID NO: 5820381 - DNA, 23 bp, Homo sapiens
aacactaatatatttaaaaataa

SEQ ID NO: 5820382 - DNA, 16 bp, Homo sapiens
aacactaatggccaag

SEQ ID NO: 5820383 - DNA, 15 bp, Homo sapiens
aacactaattcataa

SEQ ID NO: 5820384 - DNA, 17 bp, Homo sapiens
aacactaattcataatc

SEQ ID NO: 5820385 - DNA, 15 bp, Homo sapiens
aacactacagagtac

SEQ ID NO: 5820386 - DNA, 20 bp, Homo sapiens
aacactacagagtacgtgaa

SEQ ID NO: 5820387 - DNA, 22 bp, Homo sapiens
aacactactcttacatgtataa

SEQ ID NO: 5820388 - DNA, 23 bp, Homo sapiens
aacactactgctaaatcctcatg

SEQ ID NO: 5820389 - DNA, 15 bp, Homo sapiens
aacactataaaggtt

SEQ ID NO: 5820390 - DNA, 17 bp, Homo sapiens
aacactatataaataag

SEQ ID NO: 5820391 - DNA, 18 bp, Homo sapiens
aacactatataaataagc

SEQ ID NO: 5820392 - DNA, 17 bp, Homo sapiens
aacactatatattttat

SEQ ID NO: 5820393 - DNA, 18 bp, Homo sapiens
aacactatatggcagtgt

SEQ ID NO: 5820394 - DNA, 15 bp, Homo sapiens
aacactatatttatt

SEQ ID NO: 5820395 - DNA, 22 bp, Homo sapiens
aacactatatttatttttgggt

SEQ ID NO: 5820396 - DNA, 21 bp, Homo sapiens
aacactatctgtactaaaaac

SEQ ID NO: 5820397 - DNA, 19 bp, Homo sapiens
aacactatgtaaatgtgaa

SEQ ID NO: 5820398 - DNA, 16 bp, Homo sapiens
aacactatgtttattt

SEQ ID NO: 5820399 - DNA, 14 bp, Homo sapiens
aacactattacagt

SEQ ID NO: 5820400 - DNA, 14 bp, Homo sapiens
aacactatttgtga

SEQ ID NO: 5820401 - DNA, 15 bp, Homo sapiens
aacactatttgtgac

SEQ ID NO: 5820402 - DNA, 16 bp, Homo sapiens
aacactattttcagaa

SEQ ID NO: 5820403 - DNA, 16 bp, Homo sapiens
aacactcaacaataaa

SEQ ID NO: 5820404 - DNA, 15 bp, Homo sapiens
aacactcactgcctg

SEQ ID NO: 5820405 - DNA, 21 bp, Homo sapiens
aacactcacttaattctcatt

SEQ ID NO: 5820406 - DNA, 20 bp, Homo sapiens
aacactcagcagacatttat

SEQ ID NO: 5820407 - DNA, 23 bp, Homo sapiens
aacactcagcagacatttatctt

SEQ ID NO: 5820408 - DNA, 12 bp, Homo sapiens
aacactcagtcc

SEQ ID NO: 5820409 - DNA, 14 bp, Homo sapiens
aacactcagtccac

SEQ ID NO: 5820410 - DNA, 17 bp, Homo sapiens
aacactcagtccactgt

SEQ ID NO: 5820411 - DNA, 17 bp, Homo sapiens
aacactcagtggcccat

SEQ ID NO: 5820412 - DNA, 16 bp, Homo sapiens
aacactcatgctgaaa

SEQ ID NO: 5820413 - DNA, 19 bp, Homo sapiens
aacactcatgggaatgcat

SEQ ID NO: 5820414 - DNA, 20 bp, Homo sapiens
aacactccaccccctccagc

SEQ ID NO: 5820415 - DNA, 12 bp, Homo sapiens
aacactccaggc

SEQ ID NO: 5820416 - DNA, 21 bp, Homo sapiens
aacactccggtcagcccctgg

SEQ ID NO: 5820417 - DNA, 15 bp, Homo sapiens
aacactcgtgtgcat

SEQ ID NO: 5820418 - DNA, 19 bp, Homo sapiens
aacactcgtgtgcccacca

SEQ ID NO: 5820419 - DNA, 23 bp, Homo sapiens
aacactctacttgaagcaacttg

SEQ ID NO: 5820420 - DNA, 20 bp, Homo sapiens
aacactctcactatgctgct

SEQ ID NO: 5820421 - DNA, 12 bp, Homo sapiens
aacactctgaga

SEQ ID NO: 5820422 - DNA, 16 bp, Homo sapiens
aacactcttacacctg

SEQ ID NO: 5820423 - DNA, 12 bp, Homo sapiens
aacactcttttg

SEQ ID NO: 5820424 - DNA, 16 bp, Homo sapiens
aacactgaaatgaaat

SEQ ID NO: 5820425 - DNA, 16 bp, Homo sapiens
aacactgaacctctgg

SEQ ID NO: 5820426 - DNA, 20 bp, Homo sapiens
aacactgaagtgcttgcaga

SEQ ID NO: 5820427 - DNA, 19 bp, Homo sapiens
aacactgaatcatgttaat

SEQ ID NO: 5820428 - DNA, 15 bp, Homo sapiens
aacactgagctgtca

SEQ ID NO: 5820429 - DNA, 15 bp, Homo sapiens
aacactgagtgaaat

SEQ ID NO: 5820430 - DNA, 20 bp, Homo sapiens
aacactgataatcacactgc

SEQ ID NO: 5820431 - DNA, 16 bp, Homo sapiens
aacactgcaggacagt

SEQ ID NO: 5820432 - DNA, 21 bp, Homo sapiens
aacactgcagtgttattttct

SEQ ID NO: 5820433 - DNA, 18 bp, Homo sapiens
aacactgcagtttcctgg

SEQ ID NO: 5820434 - DNA, 19 bp, Homo sapiens
aacactgcagtttcctgga

SEQ ID NO: 5820435 - DNA, 12 bp, Homo sapiens
aacactgccaaa

SEQ ID NO: 5820436 - DNA, 12 bp, Homo sapiens
aacactgccagc

SEQ ID NO: 5820437 - DNA, 23 bp, Homo sapiens
aacactgcctgccctctgtctgt

SEQ ID NO: 5820438 - DNA, 16 bp, Homo sapiens
aacactgcttaaggaa

SEQ ID NO: 5820439 - DNA, 23 bp, Homo sapiens
aacactgcttctcggccagcccg

SEQ ID NO: 5820440 - DNA, 14 bp, Homo sapiens
aacactgcttgtgt

SEQ ID NO: 5820441 - DNA, 12 bp, Homo sapiens
aacactggacct

SEQ ID NO: 5820442 - DNA, 20 bp, Homo sapiens
aacactggcacactgctctt

SEQ ID NO: 5820443 - DNA, 14 bp, Homo sapiens
aacactggctctgg

SEQ ID NO: 5820444 - DNA, 18 bp, Homo sapiens
aacactgggctctgagga

SEQ ID NO: 5820445 - DNA, 14 bp, Homo sapiens
aacactggggctgg

SEQ ID NO: 5820446 - DNA, 17 bp, Homo sapiens
aacactgggggagggga

SEQ ID NO: 5820447 - DNA, 14 bp, Homo sapiens
aacactggtgccaa

SEQ ID NO: 5820448 - DNA, 15 bp, Homo sapiens
aacactggtgccaac

SEQ ID NO: 5820449 - DNA, 20 bp, Homo sapiens
aacactggtgtgacctgagg

SEQ ID NO: 5820450 - DNA, 22 bp, Homo sapiens
aacactgtattttaatgtactt

SEQ ID NO: 5820451 - DNA, 15 bp, Homo sapiens
aacactgtccttccc

SEQ ID NO: 5820452 - DNA, 22 bp, Homo sapiens
aacactgtccttccctgccact

SEQ ID NO: 5820453 - DNA, 14 bp, Homo sapiens
aacactgtgaccag

SEQ ID NO: 5820454 - DNA, 22 bp, Homo sapiens
aacactgtgcacatctgtgtct

SEQ ID NO: 5820455 - DNA, 14 bp, Homo sapiens
aacactgtgtattt

SEQ ID NO: 5820456 - DNA, 12 bp, Homo sapiens
aacactgttatc

SEQ ID NO: 5820457 - DNA, 18 bp, Homo sapiens
aacactgttatcattttt

SEQ ID NO: 5820458 - DNA, 15 bp, Homo sapiens
aacactgttttatag

SEQ ID NO: 5820459 - DNA, 14 bp, Homo sapiens
aacacttaaatttc

SEQ ID NO: 5820460 - DNA, 16 bp, Homo sapiens
aacacttaaatttctt

SEQ ID NO: 5820461 - DNA, 18 bp, Homo sapiens
aacacttaatagcaacag

SEQ ID NO: 5820462 - DNA, 16 bp, Homo sapiens
aacacttaatcatttt

SEQ ID NO: 5820463 - DNA, 22 bp, Homo sapiens
aacacttaggactagaagatta

SEQ ID NO: 5820464 - DNA, 16 bp, Homo sapiens
aacacttatcttctgg

SEQ ID NO: 5820465 - DNA, 18 bp, Homo sapiens
aacacttatcttctggat

SEQ ID NO: 5820466 - DNA, 23 bp, Homo sapiens
aacacttattgtttgaaagactt

SEQ ID NO: 5820467 - DNA, 17 bp, Homo sapiens
aacacttattttctgaa

SEQ ID NO: 5820468 - DNA, 18 bp, Homo sapiens
aacacttattttctgaat

SEQ ID NO: 5820469 - DNA, 23 bp, Homo sapiens
aacacttattttctgaattcata

SEQ ID NO: 5820470 - DNA, 11 bp, Homo sapiens
aacacttccat

SEQ ID NO: 5820471 - DNA, 17 bp, Homo sapiens
aacacttctgtcctgtg

SEQ ID NO: 5820472 - DNA, 13 bp, Homo sapiens
aacacttgaacct

SEQ ID NO: 5820473 - DNA, 15 bp, Homo sapiens
aacacttgagggcct

SEQ ID NO: 5820474 - DNA, 22 bp, Homo sapiens
aacacttgcccatgctatttgt

SEQ ID NO: 5820475 - DNA, 22 bp, Homo sapiens
aacacttggcatacaaaatatt

SEQ ID NO: 5820476 - DNA, 23 bp, Homo sapiens
aacacttggcatacaaaatattt

SEQ ID NO: 5820477 - DNA, 21 bp, Homo sapiens
aacacttgtgttgctttctga

SEQ ID NO: 5820478 - DNA, 15 bp, Homo sapiens
aacactttaggtaga

SEQ ID NO: 5820479 - DNA, 20 bp, Homo sapiens
aacactttagttatattcac

SEQ ID NO: 5820480 - DNA, 21 bp, Homo sapiens
aacactttagttatattcact

SEQ ID NO: 5820481 - DNA, 20 bp, Homo sapiens
aacactttctcacttacagg

SEQ ID NO: 5820482 - DNA, 11 bp, Homo sapiens
aacactttggt

SEQ ID NO: 5820483 - DNA, 11 bp, Homo sapiens
aacactttgta

SEQ ID NO: 5820484 - DNA, 15 bp, Homo sapiens
aacactttgtattac

SEQ ID NO: 5820485 - DNA, 18 bp, Homo sapiens
aacactttgtattactta

SEQ ID NO: 5820486 - DNA, 18 bp, Homo sapiens
aacacttttgctctgcag

SEQ ID NO: 5820487 - DNA, 18 bp, Homo sapiens
aacagaaaaacagacaaa

SEQ ID NO: 5820488 - DNA, 11 bp, Homo sapiens
aacagaaaaca

SEQ ID NO: 5820489 - DNA, 16 bp, Homo sapiens
aacagaaaacaacaaa

SEQ ID NO: 5820490 - DNA, 18 bp, Homo sapiens
aacagaaaacaacaaaaa

SEQ ID NO: 5820491 - DNA, 19 bp, Homo sapiens
aacagaaaacattctgatt

SEQ ID NO: 5820492 - DNA, 13 bp, Homo sapiens
aacagaaacaaaa

SEQ ID NO: 5820493 - DNA, 20 bp, Homo sapiens
aacagaaactacatttctac

SEQ ID NO: 5820494 - DNA, 15 bp, Homo sapiens
aacagaaacttctca

SEQ ID NO: 5820495 - DNA, 23 bp, Homo sapiens
aacagaaagttggaaaggaaaaa

SEQ ID NO: 5820496 - DNA, 23 bp, Homo sapiens
aacagaaataaaatacacaacac

SEQ ID NO: 5820497 - DNA, 16 bp, Homo sapiens
aacagaaatatataaa

SEQ ID NO: 5820498 - DNA, 15 bp, Homo sapiens
aacagaaatgctctg

SEQ ID NO: 5820499 - DNA, 18 bp, Homo sapiens
aacagaaatgctctgatt

SEQ ID NO: 5820500 - DNA, 14 bp, Homo sapiens
aacagaaattggta

SEQ ID NO: 5820501 - DNA, 15 bp, Homo sapiens
aacagaaattgtata

SEQ ID NO: 5820502 - DNA, 19 bp, Homo sapiens
aacagaaattgtatattgt

SEQ ID NO: 5820503 - DNA, 14 bp, Homo sapiens
aacagaacagcaag

SEQ ID NO: 5820504 - DNA, 13 bp, Homo sapiens
aacagaacagctt

SEQ ID NO: 5820505 - DNA, 14 bp, Homo sapiens
aacagaacagcttc

SEQ ID NO: 5820506 - DNA, 16 bp, Homo sapiens
aacagaacagcttcag

SEQ ID NO: 5820507 - DNA, 15 bp, Homo sapiens
aacagcctttgaatg

SEQ ID NO: 5820508 - DNA, 22 bp, Homo sapiens
aacagcctttgaatgtaaccaa

SEQ ID NO: 5820509 - DNA, 13 bp, Homo sapiens
aacagcgctgggt

SEQ ID NO: 5820510 - DNA, 22 bp, Homo sapiens
aacagcgtgtcaactttcattt

SEQ ID NO: 5820511 - DNA, 23 bp, Homo sapiens
aacagcgttcctagagaagacag

SEQ ID NO: 5820512 - DNA, 21 bp, Homo sapiens
aacagctacaaacttttaaga

SEQ ID NO: 5820513 - DNA, 14 bp, Homo sapiens
aacagctacaacag

SEQ ID NO: 5820514 - DNA, 16 bp, Homo sapiens
aacagctagcttgaaa

SEQ ID NO: 5820515 - DNA, 21 bp, Homo sapiens
aacagctagcttgaaaacttg

SEQ ID NO: 5820516 - DNA, 23 bp, Homo sapiens
aacagctaggttaataggaggac

SEQ ID NO: 5820517 - DNA, 19 bp, Homo sapiens
aacagctatgggagcccca

SEQ ID NO: 5820518 - DNA, 22 bp, Homo sapiens
aacagctatgggagccccaggg

SEQ ID NO: 5820519 - DNA, 17 bp, Homo sapiens
aacagctatttaagggg

SEQ ID NO: 5820520 - DNA, 10 bp, Homo sapiens
aacagctcag

SEQ ID NO: 5820521 - DNA, 14 bp, Homo sapiens
aacagctcagccag

SEQ ID NO: 5820522 - DNA, 18 bp, Homo sapiens
aacagctcagccagtggg

SEQ ID NO: 5820523 - DNA, 14 bp, Homo sapiens
aacagctcaggctg

SEQ ID NO: 5820524 - DNA, 23 bp, Homo sapiens
aacagctcccctagacatggcct

SEQ ID NO: 5820525 - DNA, 22 bp, Homo sapiens
aacagctccctagtggcttcct

SEQ ID NO: 5820526 - DNA, 18 bp, Homo sapiens
aacagctccttgggagga

SEQ ID NO: 5820527 - DNA, 21 bp, Homo sapiens
aacagctctcgttctccttcc

SEQ ID NO: 5820528 - DNA, 22 bp, Homo sapiens
aacagctctcttcaatgacata

SEQ ID NO: 5820529 - DNA, 19 bp, Homo sapiens
aacagctctgagatcctgg

SEQ ID NO: 5820530 - DNA, 20 bp, Homo sapiens
aacagctctgcaggcttaat

SEQ ID NO: 5820531 - DNA, 20 bp, Homo sapiens
aacagctcttcactcagcca

SEQ ID NO: 5820532 - DNA, 10 bp, Homo sapiens
aacagctgcc

SEQ ID NO: 5820533 - DNA, 11 bp, Homo sapiens
aacagctgcct

SEQ ID NO: 5820534 - DNA, 14 bp, Homo sapiens
aacagctgcttctc

SEQ ID NO: 5820535 - DNA, 14 bp, Homo sapiens
aacagctggacacc

SEQ ID NO: 5820536 - DNA, 18 bp, Homo sapiens
aacagctggacttattta

SEQ ID NO: 5820537 - DNA, 24 bp, Homo sapiens
aacagctggtactgatgttcacct

SEQ ID NO: 5820538 - DNA, 20 bp, Homo sapiens
aacagctggtgccctgcttt

SEQ ID NO: 5820539 - DNA, 21 bp, Homo sapiens
aacagctggtgccctgctttc

SEQ ID NO: 5820540 - DNA, 17 bp, Homo sapiens
aacagctggtgtagcta

SEQ ID NO: 5820541 - DNA, 21 bp, Homo sapiens
aacagctggtgtagctacaga

SEQ ID NO: 5820542 - DNA, 14 bp, Homo sapiens
aacagctgtattta

SEQ ID NO: 5820543 - DNA, 15 bp, Homo sapiens
aacagctgtatttat

SEQ ID NO: 5820544 - DNA, 20 bp, Homo sapiens
aacagctgtatttatataag

SEQ ID NO: 5820545 - DNA, 20 bp, Homo sapiens
aacagctgtgagccatgcct

SEQ ID NO: 5820546 - DNA, 22 bp, Homo sapiens
aacagctgtgagccatgcctcc

SEQ ID NO: 5820547 - DNA, 11 bp, Homo sapiens
aacagctgtgt

SEQ ID NO: 5820548 - DNA, 13 bp, Homo sapiens
aacagctgtgtct

SEQ ID NO: 5820549 - DNA, 16 bp, Homo sapiens
aacagcttcaggttat

SEQ ID NO: 5820550 - DNA, 21 bp, Homo sapiens
aacagcttcctgttactgaga

SEQ ID NO: 5820551 - DNA, 19 bp, Homo sapiens
aacagcttcttgcttgtaa

SEQ ID NO: 5820552 - DNA, 23 bp, Homo sapiens
aacagcttcttgcttgtaaaaat

SEQ ID NO: 5820553 - DNA, 14 bp, Homo sapiens
aacagcttgctgtc

SEQ ID NO: 5820554 - DNA, 20 bp, Homo sapiens
aacagctttctccagaacca

SEQ ID NO: 5820555 - DNA, 18 bp, Homo sapiens
aacagctttcttattcag

SEQ ID NO: 5820556 - DNA, 15 bp, Homo sapiens
aacagctttgtatgt

SEQ ID NO: 5820557 - DNA, 14 bp, Homo sapiens
aacagctttgtctc

SEQ ID NO: 5820558 - DNA, 15 bp, Homo sapiens
aacagctttgtctcc

SEQ ID NO: 5820559 - DNA, 20 bp, Homo sapiens
aacagctttgtctccaaaga

SEQ ID NO: 5820560 - DNA, 18 bp, Homo sapiens
aacagcttttcccaggag

SEQ ID NO: 5820561 - DNA, 19 bp, Homo sapiens
aacagcttttcccaggaga

SEQ ID NO: 5820562 - DNA, 22 bp, Homo sapiens
aacaggaaaaaaaataatgtaa

SEQ ID NO: 5820563 - DNA, 15 bp, Homo sapiens
aacaggaaaaaaact

SEQ ID NO: 5820564 - DNA, 19 bp, Homo sapiens
aacaggaaagagctaggaa

SEQ ID NO: 5820565 - DNA, 22 bp, Homo sapiens
aacaggaaaggctcgaaataca

SEQ ID NO: 5820566 - DNA, 22 bp, Homo sapiens
aacaggaagatcttaaattttg

SEQ ID NO: 5820567 - DNA, 10 bp, Homo sapiens
aacaggaagc

SEQ ID NO: 5820568 - DNA, 20 bp, Homo sapiens
aacaggaatccttactgata

SEQ ID NO: 5820569 - DNA, 15 bp, Homo sapiens
aacaggaatctcaga

SEQ ID NO: 5820570 - DNA, 20 bp, Homo sapiens
aacaggaattttattttgct

SEQ ID NO: 5820571 - DNA, 22 bp, Homo sapiens
aacaggacagagttcacaggag

SEQ ID NO: 5820572 - DNA, 17 bp, Homo sapiens
aacaggaccgggtggaa

SEQ ID NO: 5820573 - DNA, 16 bp, Homo sapiens
aacaggacctctgctt

SEQ ID NO: 5820574 - DNA, 12 bp, Homo sapiens
aacaggagaatt

SEQ ID NO: 5820575 - DNA, 17 bp, Homo sapiens
aacaggagacaggaagg

SEQ ID NO: 5820576 - DNA, 13 bp, Homo sapiens
aacaggagagaga

SEQ ID NO: 5820577 - DNA, 21 bp, Homo sapiens
aacaggagctgggatcctaag

SEQ ID NO: 5820578 - DNA, 14 bp, Homo sapiens
aacaggaggaactg

SEQ ID NO: 5820579 - DNA, 14 bp, Homo sapiens
aacaggaggacaat

SEQ ID NO: 5820580 - DNA, 16 bp, Homo sapiens
aacaggaggacaattc

SEQ ID NO: 5820581 - DNA, 17 bp, Homo sapiens
aacaggaggacaattca

SEQ ID NO: 5820582 - DNA, 18 bp, Homo sapiens
aacaggaggacaattcat

SEQ ID NO: 5820583 - DNA, 19 bp, Homo sapiens
aacaggaggacaattcatg

SEQ ID NO: 5820584 - DNA, 22 bp, Homo sapiens
aacaggaggacaattcatgaac

SEQ ID NO: 5820585 - DNA, 17 bp, Homo sapiens
aacaggagggcagcccg

SEQ ID NO: 5820586 - DNA, 19 bp, Homo sapiens
aacaggaggtgtgaatgca

SEQ ID NO: 5820587 - DNA, 18 bp, Homo sapiens
aacaggagttcagcggag

SEQ ID NO: 5820588 - DNA, 23 bp, Homo sapiens
aacaggatggtggcaggaaaatg

SEQ ID NO: 5820589 - DNA, 23 bp, Homo sapiens
aacaggcccagcattgctggttc

SEQ ID NO: 5820590 - DNA, 12 bp, Homo sapiens
aacaggcccagg

SEQ ID NO: 5820591 - DNA, 14 bp, Homo sapiens
aacaggcccaggga

SEQ ID NO: 5820592 - DNA, 19 bp, Homo sapiens
aacaggccccacgccctct

SEQ ID NO: 5820593 - DNA, 15 bp, Homo sapiens
aacaggcctcagggc

SEQ ID NO: 5820594 - DNA, 15 bp, Homo sapiens
aacaggcctctccat

SEQ ID NO: 5820595 - DNA, 18 bp, Homo sapiens
aacaggctactctcctcg

SEQ ID NO: 5820596 - DNA, 21 bp, Homo sapiens
aacaggctcaatattcctgaa

SEQ ID NO: 5820597 - DNA, 22 bp, Homo sapiens
aacaggctccaagaggctgagg

SEQ ID NO: 5820598 - DNA, 13 bp, Homo sapiens
aacaggctctgag

SEQ ID NO: 5820599 - DNA, 13 bp, Homo sapiens
aacaggctgattt

SEQ ID NO: 5820600 - DNA, 23 bp, Homo sapiens
aacaggctgttctgcactgaaaa

SEQ ID NO: 5820601 - DNA, 17 bp, Homo sapiens
aacagggaaaaaaagaa

SEQ ID NO: 5820602 - DNA, 14 bp, Homo sapiens
aacagggaaaatga

SEQ ID NO: 5820603 - DNA, 17 bp, Homo sapiens
aacagggaccagctccc

SEQ ID NO: 5820604 - DNA, 20 bp, Homo sapiens
aacagggactacgtattttt

SEQ ID NO: 5820605 - DNA, 24 bp, Homo sapiens
aacagggacttgtttagagagcct

SEQ ID NO: 5820606 - DNA, 21 bp, Homo sapiens
aacagggagaagtagctagta

SEQ ID NO: 5820607 - DNA, 14 bp, Homo sapiens
aacagggagactgc

SEQ ID NO: 5820608 - DNA, 21 bp, Homo sapiens
aacagggagcccctaggaaag

SEQ ID NO: 5820609 - DNA, 19 bp, Homo sapiens
aacagggcaaccaataaaa

SEQ ID NO: 5820610 - DNA, 21 bp, Homo sapiens
aacagggcaaccaataaaagt

SEQ ID NO: 5820611 - DNA, 17 bp, Homo sapiens
aacagggcatctccagg

SEQ ID NO: 5820612 - DNA, 18 bp, Homo sapiens
aacagggcatctccagga

SEQ ID NO: 5820613 - DNA, 20 bp, Homo sapiens
aacagggccacatagatgct

SEQ ID NO: 5820614 - DNA, 15 bp, Homo sapiens
aacagggccttgcta

SEQ ID NO: 5820615 - DNA, 20 bp, Homo sapiens
aacagggcgggggggggggc

SEQ ID NO: 5820616 - DNA, 21 bp, Homo sapiens
aacaggggaggaaaaaagaac

SEQ ID NO: 5820617 - DNA, 22 bp, Homo sapiens
aacaggggaggaaaaaagaacc

SEQ ID NO: 5820618 - DNA, 18 bp, Homo sapiens
aacaggggatcaaagttc

SEQ ID NO: 5820619 - DNA, 16 bp, Homo sapiens
aacagggtaaattatt

SEQ ID NO: 5820620 - DNA, 20 bp, Homo sapiens
aacagggtagatttctcttg

SEQ ID NO: 5820621 - DNA, 18 bp, Homo sapiens
aacagggtctctagtgct

SEQ ID NO: 5820622 - DNA, 18 bp, Homo sapiens
aacagggtttctcagcct

SEQ ID NO: 5820623 - DNA, 16 bp, Homo sapiens
aacaggtaaacacata

SEQ ID NO: 5820624 - DNA, 15 bp, Homo sapiens
aacaggtaatataaa

SEQ ID NO: 5820625 - DNA, 18 bp, Homo sapiens
aacaggtaatataaaaag

SEQ ID NO: 5820626 - DNA, 14 bp, Homo sapiens
aacaggtattttgt

SEQ ID NO: 5820627 - DNA, 18 bp, Homo sapiens
aacaggtattttgtttct

SEQ ID NO: 5820628 - DNA, 16 bp, Homo sapiens
aacaggtcaaagatgt

SEQ ID NO: 5820629 - DNA, 13 bp, Homo sapiens
aacaggtctcctc

SEQ ID NO: 5820630 - DNA, 19 bp, Homo sapiens
aacaggtctttgaaatatg

SEQ ID NO: 5820631 - DNA, 13 bp, Homo sapiens
aacaggtgctggc

SEQ ID NO: 5820632 - DNA, 19 bp, Homo sapiens
aacaggtgctggcccagca

SEQ ID NO: 5820633 - DNA, 23 bp, Homo sapiens
aacaggtgctggcccagcatgga

SEQ ID NO: 5820634 - DNA, 14 bp, Homo sapiens
aacaggtggagaaa

SEQ ID NO: 5820635 - DNA, 22 bp, Homo sapiens
aacaggtggcaggaccaggact

SEQ ID NO: 5820636 - DNA, 17 bp, Homo sapiens
aacaggtggttcttttt

SEQ ID NO: 5820637 - DNA, 22 bp, Homo sapiens
aacaggtgtggggacacagcag

SEQ ID NO: 5820638 - DNA, 14 bp, Homo sapiens
aacaggtgttcctc

SEQ ID NO: 5820639 - DNA, 21 bp, Homo sapiens
aacaggttattttagtttctg

SEQ ID NO: 5820640 - DNA, 15 bp, Homo sapiens
aacaggtttatctga

SEQ ID NO: 5820641 - DNA, 21 bp, Homo sapiens
aacaggttttcttctaatcat

SEQ ID NO: 5820642 - DNA, 19 bp, Homo sapiens
aacagtaaaccactgaaaa

SEQ ID NO: 5820643 - DNA, 14 bp, Homo sapiens
aacagtaaaggcca

SEQ ID NO: 5820644 - DNA, 15 bp, Homo sapiens
aacagtaacatagct

SEQ ID NO: 5820645 - DNA, 14 bp, Homo sapiens
aacagtaatcagtt

SEQ ID NO: 5820646 - DNA, 22 bp, Homo sapiens
aacagtaatctatgtgtttctg

SEQ ID NO: 5820647 - DNA, 17 bp, Homo sapiens
aacagtaattactttca

SEQ ID NO: 5820648 - DNA, 19 bp, Homo sapiens
aacagtaattactttcaga

SEQ ID NO: 5820649 - DNA, 22 bp, Homo sapiens
aacagtaattattatttaactc

SEQ ID NO: 5820650 - DNA, 20 bp, Homo sapiens
aacagtactggttactttca

SEQ ID NO: 5820651 - DNA, 21 bp, Homo sapiens
aacagtactggttactttcaa

SEQ ID NO: 5820652 - DNA, 18 bp, Homo sapiens
aacagtagagaacagcaa

SEQ ID NO: 5820653 - DNA, 22 bp, Homo sapiens
aacagtagttttgaaactagaa

SEQ ID NO: 5820654 - DNA, 23 bp, Homo sapiens
aacagtataacaactatttacat

SEQ ID NO: 5820655 - DNA, 12 bp, Homo sapiens
aacagtatctct

SEQ ID NO: 5820656 - DNA, 21 bp, Homo sapiens
aacagtatgtgggatattgaa

SEQ ID NO: 5820657 - DNA, 17 bp, Homo sapiens
aacagtattaaatgact

SEQ ID NO: 5820658 - DNA, 17 bp, Homo sapiens
aacagtattgggcagga

SEQ ID NO: 5820659 - DNA, 19 bp, Homo sapiens
aacagtattgggcaggagg

SEQ ID NO: 5820660 - DNA, 17 bp, Homo sapiens
aacagtatttattttgt

SEQ ID NO: 5820661 - DNA, 18 bp, Homo sapiens
aacagtatttattttgta

SEQ ID NO: 5820662 - DNA, 15 bp, Homo sapiens
aacagtatttccaca

SEQ ID NO: 5820663 - DNA, 22 bp, Homo sapiens
aacagtatttctggtgtatatt

SEQ ID NO: 5820664 - DNA, 15 bp, Homo sapiens
aacagtattttaaga

SEQ ID NO: 5820665 - DNA, 21 bp, Homo sapiens
aacagtcacgcctgaaacttt

SEQ ID NO: 5820666 - DNA, 16 bp, Homo sapiens
aacagtcatcatttat

SEQ ID NO: 5820667 - DNA, 12 bp, Homo sapiens
aacagtcatgtt

SEQ ID NO: 5820668 - DNA, 16 bp, Homo sapiens
aacagtccaatcagtg

SEQ ID NO: 5820669 - DNA, 22 bp, Homo sapiens
aacagtcgtaaccgtggctggt

SEQ ID NO: 5820670 - DNA, 12 bp, Homo sapiens
aacagtctgatc

SEQ ID NO: 5820671 - DNA, 17 bp, Homo sapiens
aacagtcttcaggcaaa

SEQ ID NO: 5820672 - DNA, 16 bp, Homo sapiens
aacagtgaagacagaa

SEQ ID NO: 5820673 - DNA, 20 bp, Homo sapiens
aacagtgaagttttactgtc

SEQ ID NO: 5820674 - DNA, 17 bp, Homo sapiens
aacagtgacaataaatg

SEQ ID NO: 5820675 - DNA, 12 bp, Homo sapiens
aacagtgagaaa

SEQ ID NO: 5820676 - DNA, 20 bp, Homo sapiens
aacagtgcacaagattattt

SEQ ID NO: 5820677 - DNA, 11 bp, Homo sapiens
aacagtgcatg

SEQ ID NO: 5820678 - DNA, 14 bp, Homo sapiens
aacagtgccaaatg

SEQ ID NO: 5820679 - DNA, 15 bp, Homo sapiens
aacagtgccaaatgc

SEQ ID NO: 5820680 - DNA, 12 bp, Homo sapiens
aacagtgccagc

SEQ ID NO: 5820681 - DNA, 18 bp, Homo sapiens
aacagtgccattgtcttt

SEQ ID NO: 5820682 - DNA, 17 bp, Homo sapiens
aacagtgctttgtaaat

SEQ ID NO: 5820683 - DNA, 14 bp, Homo sapiens
aacatgtgaaagat

SEQ ID NO: 5820684 - DNA, 15 bp, Homo sapiens
aacatgtgaaagata

SEQ ID NO: 5820685 - DNA, 14 bp, Homo sapiens
aacatgtgaatgaa

SEQ ID NO: 5820686 - DNA, 21 bp, Homo sapiens
aacatgtgaatgaatacacag

SEQ ID NO: 5820687 - DNA, 22 bp, Homo sapiens
aacatgtgcaactcttgtattg

SEQ ID NO: 5820688 - DNA, 14 bp, Homo sapiens
aacatgtgcccctg

SEQ ID NO: 5820689 - DNA, 11 bp, Homo sapiens
aacatgtgtga

SEQ ID NO: 5820690 - DNA, 16 bp, Homo sapiens
aacatgtgtttctgac

SEQ ID NO: 5820691 - DNA, 23 bp, Homo sapiens
aacatgttaaaccatgggataaa

SEQ ID NO: 5820692 - DNA, 16 bp, Homo sapiens
aacatgttactgacca

SEQ ID NO: 5820693 - DNA, 20 bp, Homo sapiens
aacatgttatttgtaataga

SEQ ID NO: 5820694 - DNA, 23 bp, Homo sapiens
aacatgttcccaaggccccactt

SEQ ID NO: 5820695 - DNA, 23 bp, Homo sapiens
aacatgttgatttagtcttcttt

SEQ ID NO: 5820696 - DNA, 12 bp, Homo sapiens
aacatgttggta

SEQ ID NO: 5820697 - DNA, 18 bp, Homo sapiens
aacatgttggtatttatc

SEQ ID NO: 5820698 - DNA, 19 bp, Homo sapiens
aacatgttggtatttatct

SEQ ID NO: 5820699 - DNA, 22 bp, Homo sapiens
aacatgttgtacatttcaccat

SEQ ID NO: 5820700 - DNA, 20 bp, Homo sapiens
aacatgtttaaatagcctaa

SEQ ID NO: 5820701 - DNA, 21 bp, Homo sapiens
aacatgtttaaatagcctaaa

SEQ ID NO: 5820702 - DNA, 16 bp, Homo sapiens
aacatgtttacaggtt

SEQ ID NO: 5820703 - DNA, 21 bp, Homo sapiens
aacatgtttacaggtttgaat

SEQ ID NO: 5820704 - DNA, 22 bp, Homo sapiens
aacatgtttacaggtttgaatt

SEQ ID NO: 5820705 - DNA, 22 bp, Homo sapiens
aacatgtttctgccttctttat

SEQ ID NO: 5820706 - DNA, 18 bp, Homo sapiens
aacatgtttctgttttgt

SEQ ID NO: 5820707 - DNA, 16 bp, Homo sapiens
aacattaaaaatggaa

SEQ ID NO: 5820708 - DNA, 21 bp, Homo sapiens
aacattaaaacaatattgttt

SEQ ID NO: 5820709 - DNA, 16 bp, Homo sapiens
aacattaaaactcata

SEQ ID NO: 5820710 - DNA, 14 bp, Homo sapiens
aacattaaaagaag

SEQ ID NO: 5820711 - DNA, 21 bp, Homo sapiens
aacattaaaagaagactggaa

SEQ ID NO: 5820712 - DNA, 16 bp, Homo sapiens
aacattaaacactgta

SEQ ID NO: 5820713 - DNA, 15 bp, Homo sapiens
aacattaaatcacag

SEQ ID NO: 5820714 - DNA, 23 bp, Homo sapiens
aacattaaatgtcttatatagca

SEQ ID NO: 5820715 - DNA, 17 bp, Homo sapiens
aacattaactctaactg

SEQ ID NO: 5820716 - DNA, 17 bp, Homo sapiens
aacattaagaaaatatt

SEQ ID NO: 5820717 - DNA, 16 bp, Homo sapiens
aacattaagaaaatca

SEQ ID NO: 5820718 - DNA, 19 bp, Homo sapiens
aacattaagaaaatcatat

SEQ ID NO: 5820719 - DNA, 19 bp, Homo sapiens
aacattaatccacatgttt

SEQ ID NO: 5820720 - DNA, 12 bp, Homo sapiens
aacattaatgtt

SEQ ID NO: 5820721 - DNA, 14 bp, Homo sapiens
aacattaatgttga

SEQ ID NO: 5820722 - DNA, 18 bp, Homo sapiens
aacattaatgttgaaaaa

SEQ ID NO: 5820723 - DNA, 19 bp, Homo sapiens
aacattaatgttgaaaaag

SEQ ID NO: 5820724 - DNA, 22 bp, Homo sapiens
aacattaatgttgaaaaagaaa

SEQ ID NO: 5820725 - DNA, 20 bp, Homo sapiens
aacattaattttgtgcattc

SEQ ID NO: 5820726 - DNA, 22 bp, Homo sapiens
aacattacaaaaaaattttatg

SEQ ID NO: 5820727 - DNA, 17 bp, Homo sapiens
aacattacagttcataa

SEQ ID NO: 5820728 - DNA, 17 bp, Homo sapiens
aacattaccttactgtg

SEQ ID NO: 5820729 - DNA, 21 bp, Homo sapiens
aacattactctgaaattgtaa

SEQ ID NO: 5820730 - DNA, 15 bp, Homo sapiens
aacattactgccttc

SEQ ID NO: 5820731 - DNA, 17 bp, Homo sapiens
aacattactgccttcag

SEQ ID NO: 5820732 - DNA, 18 bp, Homo sapiens
aacattagaagaaaacat

SEQ ID NO: 5820733 - DNA, 13 bp, Homo sapiens
aacattaggaatt

SEQ ID NO: 5820734 - DNA, 17 bp, Homo sapiens
aacattaggaattgttt

SEQ ID NO: 5820735 - DNA, 21 bp, Homo sapiens
aacattaggaattgtttatac

SEQ ID NO: 5820736 - DNA, 19 bp, Homo sapiens
aacattaggaccttagaat

SEQ ID NO: 5820737 - DNA, 20 bp, Homo sapiens
aacattaggaccttagaatt

SEQ ID NO: 5820738 - DNA, 17 bp, Homo sapiens
aacattagtactttata

SEQ ID NO: 5820739 - DNA, 12 bp, Homo sapiens
aacattagtata

SEQ ID NO: 5820740 - DNA, 13 bp, Homo sapiens
aacattagtgaaa

SEQ ID NO: 5820741 - DNA, 14 bp, Homo sapiens
aacattagttttaa

SEQ ID NO: 5820742 - DNA, 21 bp, Homo sapiens
aacattatagattttcatgtt

SEQ ID NO: 5820743 - DNA, 22 bp, Homo sapiens
aacattatgatctaataaactt

SEQ ID NO: 5820744 - DNA, 23 bp, Homo sapiens
aacattattaagtaacttattta

SEQ ID NO: 5820745 - DNA, 17 bp, Homo sapiens
aacattattacttttcc

SEQ ID NO: 5820746 - DNA, 20 bp, Homo sapiens
aacattattacttttcctct

SEQ ID NO: 5820747 - DNA, 17 bp, Homo sapiens
aacattattcatctctc

SEQ ID NO: 5820748 - DNA, 17 bp, Homo sapiens
aacattatttttagatt

SEQ ID NO: 5820749 - DNA, 18 bp, Homo sapiens
aacattattttttaatgt

SEQ ID NO: 5820750 - DNA, 21 bp, Homo sapiens
aacattattttttatttctga

SEQ ID NO: 5820751 - DNA, 15 bp, Homo sapiens
aacattcaaaagcac

SEQ ID NO: 5820752 - DNA, 17 bp, Homo sapiens
aacattcaaaagcacaa

SEQ ID NO: 5820753 - DNA, 17 bp, Homo sapiens
aacattcaatcttgccg

SEQ ID NO: 5820754 - DNA, 15 bp, Homo sapiens
aacattcaatttgct

SEQ ID NO: 5820755 - DNA, 22 bp, Homo sapiens
aacattcacacagggctctttg

SEQ ID NO: 5820756 - DNA, 22 bp, Homo sapiens
aacattcacttttgttaacagt

SEQ ID NO: 5820757 - DNA, 19 bp, Homo sapiens
aacattcagctctggagaa

SEQ ID NO: 5820758 - DNA, 22 bp, Homo sapiens
aacattcagctctggagaacag

SEQ ID NO: 5820759 - DNA, 13 bp, Homo sapiens
aacattcaggagc

SEQ ID NO: 5820760 - DNA, 16 bp, Homo sapiens
aacattcatagtcttt

SEQ ID NO: 5820761 - DNA, 22 bp, Homo sapiens
aacattcatatttgcaataaaa

SEQ ID NO: 5820762 - DNA, 18 bp, Homo sapiens
aacattcatcaagctgta

SEQ ID NO: 5820763 - DNA, 23 bp, Homo sapiens
aacattcatccagttgcaataaa

SEQ ID NO: 5820764 - DNA, 20 bp, Homo sapiens
aacattcatgtgtaggaaga

SEQ ID NO: 5820765 - DNA, 14 bp, Homo sapiens
aacattccagggat

SEQ ID NO: 5820766 - DNA, 16 bp, Homo sapiens
aacattccagggatga

SEQ ID NO: 5820767 - DNA, 21 bp, Homo sapiens
aacattcccctccccactcct

SEQ ID NO: 5820768 - DNA, 22 bp, Homo sapiens
aacattcccgaggtcagccagg

SEQ ID NO: 5820769 - DNA, 16 bp, Homo sapiens
aacattccctggaatt

SEQ ID NO: 5820770 - DNA, 19 bp, Homo sapiens
aacattccgtttacatttt

SEQ ID NO: 5820771 - DNA, 18 bp, Homo sapiens
aacattcctaaaatgctt

SEQ ID NO: 5820772 - DNA, 14 bp, Homo sapiens
aacattcctatcaa

SEQ ID NO: 5820773 - DNA, 15 bp, Homo sapiens
aacattcctatcaat

SEQ ID NO: 5820774 - DNA, 16 bp, Homo sapiens
aacattcctcaaaatg

SEQ ID NO: 5820775 - DNA, 22 bp, Homo sapiens
aacattcctccagcctcccctc

SEQ ID NO: 5820776 - DNA, 18 bp, Homo sapiens
aacattcgaatctctgcc

SEQ ID NO: 5820777 - DNA, 19 bp, Homo sapiens
aacattctatctactgatt

SEQ ID NO: 5820778 - DNA, 11 bp, Homo sapiens
aacattctgca

SEQ ID NO: 5820779 - DNA, 23 bp, Homo sapiens
aacattctggatctgaccctccc

SEQ ID NO: 5820780 - DNA, 20 bp, Homo sapiens
aacattctgtgggatatatt

SEQ ID NO: 5820781 - DNA, 20 bp, Homo sapiens
aacattctttcctaaatata

SEQ ID NO: 5820782 - DNA, 16 bp, Homo sapiens
aacattgaaagtgagc

SEQ ID NO: 5820783 - DNA, 16 bp, Homo sapiens
aacattgaagtaatga

SEQ ID NO: 5820784 - DNA, 17 bp, Homo sapiens
aacattgaccaagaact

SEQ ID NO: 5820785 - DNA, 20 bp, Homo sapiens
aacattgaccaagaactgca

SEQ ID NO: 5820786 - DNA, 22 bp, Homo sapiens
aacattgaccaagaactgcatg

SEQ ID NO: 5820787 - DNA, 14 bp, Homo sapiens
aacattgagactgc

SEQ ID NO: 5820788 - DNA, 20 bp, Homo sapiens
aacattgagattatgatgaa

SEQ ID NO: 5820789 - DNA, 15 bp, Homo sapiens
aacattgatgaatga

SEQ ID NO: 5820790 - DNA, 14 bp, Homo sapiens
aacattgcaataga

SEQ ID NO: 5820791 - DNA, 16 bp, Homo sapiens
aacattgcaatagaaa

SEQ ID NO: 5820792 - DNA, 23 bp, Homo sapiens
aacattgcactttataaacactg

SEQ ID NO: 5820793 - DNA, 20 bp, Homo sapiens
aacattgcatataacttata

SEQ ID NO: 5820794 - DNA, 21 bp, Homo sapiens
aacattgcatataacttatat

SEQ ID NO: 5820795 - DNA, 16 bp, Homo sapiens
aacattgcatgtattt

SEQ ID NO: 5820796 - DNA, 14 bp, Homo sapiens
aacattgcctattt

SEQ ID NO: 5820797 - DNA, 18 bp, Homo sapiens
aacattgccttatattgg

SEQ ID NO: 5820798 - DNA, 19 bp, Homo sapiens
aacattgccttgcatttgt

SEQ ID NO: 5820799 - DNA, 14 bp, Homo sapiens
aacattgcttttaa

SEQ ID NO: 5820800 - DNA, 15 bp, Homo sapiens
aacattgcttttaaa

SEQ ID NO: 5820801 - DNA, 12 bp, Homo sapiens
aacattggaagc

SEQ ID NO: 5820802 - DNA, 16 bp, Homo sapiens
aacattggaagcaggt

SEQ ID NO: 5820803 - DNA, 22 bp, Homo sapiens
aacattggaagcaggttaaatg

SEQ ID NO: 5820804 - DNA, 20 bp, Homo sapiens
aacattggacagaaaatgca

SEQ ID NO: 5820805 - DNA, 18 bp, Homo sapiens
aacattggcataattttt

SEQ ID NO: 5820806 - DNA, 22 bp, Homo sapiens
aacattggttcttgtattaaga

SEQ ID NO: 5820807 - DNA, 13 bp, Homo sapiens
aacattgtaaagt

SEQ ID NO: 5820808 - DNA, 16 bp, Homo sapiens
aacattgtagcctcaa

SEQ ID NO: 5820809 - DNA, 13 bp, Homo sapiens
aacattgtatgtt

SEQ ID NO: 5820810 - DNA, 22 bp, Homo sapiens
aacattgtccccaatgaatata

SEQ ID NO: 5820811 - DNA, 21 bp, Homo sapiens
aacattgtgactttgctttga

SEQ ID NO: 5820812 - DNA, 23 bp, Homo sapiens
aacattgtgttcccatttcagct

SEQ ID NO: 5820813 - DNA, 23 bp, Homo sapiens
aacattgttaatataatttaaca

SEQ ID NO: 5820814 - DNA, 13 bp, Homo sapiens
aacattgttatcc

SEQ ID NO: 5820815 - DNA, 22 bp, Homo sapiens
aacatttaaaattaaataaatt

SEQ ID NO: 5820816 - DNA, 14 bp, Homo sapiens
aacatttaaattcc

SEQ ID NO: 5820817 - DNA, 14 bp, Homo sapiens
aacatttaacataa

SEQ ID NO: 5820818 - DNA, 22 bp, Homo sapiens
aacatttaagggaatgtgagca

SEQ ID NO: 5820819 - DNA, 14 bp, Homo sapiens
aacatttaatttag

SEQ ID NO: 5820820 - DNA, 19 bp, Homo sapiens
aacatttacaataaatatt

SEQ ID NO: 5820821 - DNA, 20 bp, Homo sapiens
aacatttacaataaatattc

SEQ ID NO: 5820822 - DNA, 21 bp, Homo sapiens
aacatttacaataaatattct

SEQ ID NO: 5820823 - DNA, 15 bp, Homo sapiens
aacatttacagtcct

SEQ ID NO: 5820824 - DNA, 14 bp, Homo sapiens
aacatttacatgta

SEQ ID NO: 5820825 - DNA, 14 bp, Homo sapiens
aacatttagacaat

SEQ ID NO: 5820826 - DNA, 20 bp, Homo sapiens
aacatttaggagaagttggt

SEQ ID NO: 5820827 - DNA, 23 bp, Homo sapiens
aacatttatatattgtctgtaaa

SEQ ID NO: 5820828 - DNA, 22 bp, Homo sapiens
aacatttatttgagtggagtta

SEQ ID NO: 5820829 - DNA, 17 bp, Homo sapiens
aacatttattttatgag

SEQ ID NO: 5820830 - DNA, 20 bp, Homo sapiens
aacatttattttatgagaaa

SEQ ID NO: 5820831 - DNA, 17 bp, Homo sapiens
aacatttattttgacat

SEQ ID NO: 5820832 - DNA, 19 bp, Homo sapiens
aacatttattttgacataa

SEQ ID NO: 5820833 - DNA, 16 bp, Homo sapiens
aacatttcaagtttac

SEQ ID NO: 5820834 - DNA, 21 bp, Homo sapiens
aacatttcaatgtcagccttt

SEQ ID NO: 5820835 - DNA, 12 bp, Homo sapiens
aacatttcatgt

SEQ ID NO: 5820836 - DNA, 19 bp, Homo sapiens
aacatttcatgtagtaaga

SEQ ID NO: 5820837 - DNA, 19 bp, Homo sapiens
aacatttccgaataaagta

SEQ ID NO: 5820838 - DNA, 20 bp, Homo sapiens
aacatttccgaataaagtat

SEQ ID NO: 5820839 - DNA, 14 bp, Homo sapiens
aacatttccttttt

SEQ ID NO: 5820840 - DNA, 22 bp, Homo sapiens
aacatttctaactctgatgtaa

SEQ ID NO: 5820841 - DNA, 21 bp, Homo sapiens
aacatttctcatgtgctttgt

SEQ ID NO: 5820842 - DNA, 17 bp, Homo sapiens
aacatttctcatgttga

SEQ ID NO: 5820843 - DNA, 18 bp, Homo sapiens
aacatttctcatgttgaa

SEQ ID NO: 5820844 - DNA, 12 bp, Homo sapiens
aacatttctctc

SEQ ID NO: 5820845 - DNA, 15 bp, Homo sapiens
aacatttctctccac

SEQ ID NO: 5820846 - DNA, 23 bp, Homo sapiens
aacatttctctccaccttagtac

SEQ ID NO: 5820847 - DNA, 12 bp, Homo sapiens
aacatttctgta

SEQ ID NO: 5820848 - DNA, 13 bp, Homo sapiens
aacatttctgtat

SEQ ID NO: 5820849 - DNA, 16 bp, Homo sapiens
aacatttctgtatact

SEQ ID NO: 5820850 - DNA, 10 bp, Homo sapiens
aacatttctt

SEQ ID NO: 5820851 - DNA, 13 bp, Homo sapiens
aacatttcttgaa

SEQ ID NO: 5820852 - DNA, 12 bp, Homo sapiens
aacatttgatat

SEQ ID NO: 5820853 - DNA, 19 bp, Homo sapiens
aacatttgatatttttcca

SEQ ID NO: 5820854 - DNA, 16 bp, Homo sapiens
aacatttgatgtctag

SEQ ID NO: 5820855 - DNA, 20 bp, Homo sapiens
aacatttgattaataaaata

SEQ ID NO: 5820856 - DNA, 13 bp, Homo sapiens
aacatttgccaag

SEQ ID NO: 5820857 - DNA, 13 bp, Homo sapiens
aacatttgccttg

SEQ ID NO: 5820858 - DNA, 19 bp, Homo sapiens
aacatttgctgaatatgca

SEQ ID NO: 5820859 - DNA, 20 bp, Homo sapiens
aaccacagggccagagggag

SEQ ID NO: 5820860 - DNA, 20 bp, Homo sapiens
aaccacagtcagtggagaga

SEQ ID NO: 5820861 - DNA, 16 bp, Homo sapiens
aaccacagtcctcacc

SEQ ID NO: 5820862 - DNA, 13 bp, Homo sapiens
aaccacagtgcca

SEQ ID NO: 5820863 - DNA, 17 bp, Homo sapiens
aaccacagtgtaccatt

SEQ ID NO: 5820864 - DNA, 18 bp, Homo sapiens
aaccacagtgtaccatta

SEQ ID NO: 5820865 - DNA, 22 bp, Homo sapiens
aaccacagtgtaccattaaaat

SEQ ID NO: 5820866 - DNA, 18 bp, Homo sapiens
aaccacatcttgctctgc

SEQ ID NO: 5820867 - DNA, 20 bp, Homo sapiens
aaccacatcttgctctgctg

SEQ ID NO: 5820868 - DNA, 14 bp, Homo sapiens
aaccacatgggctg

SEQ ID NO: 5820869 - DNA, 18 bp, Homo sapiens
aaccacatttagaaatgt

SEQ ID NO: 5820870 - DNA, 20 bp, Homo sapiens
aaccacatttagaaatgttt

SEQ ID NO: 5820871 - DNA, 21 bp, Homo sapiens
aaccacatttcctctgttctt

SEQ ID NO: 5820872 - DNA, 17 bp, Homo sapiens
aaccacattttaggatc

SEQ ID NO: 5820873 - DNA, 16 bp, Homo sapiens
aaccaccaaaaacaaa

SEQ ID NO: 5820874 - DNA, 13 bp, Homo sapiens
aaccaccaaagtc

SEQ ID NO: 5820875 - DNA, 17 bp, Homo sapiens
aaccaccagaagcccag

SEQ ID NO: 5820876 - DNA, 21 bp, Homo sapiens
aaccaccagcgttcccttctc

SEQ ID NO: 5820877 - DNA, 21 bp, Homo sapiens
aaccaccccggccccctgccc

SEQ ID NO: 5820878 - DNA, 22 bp, Homo sapiens
aaccaccccggccccctgcccg

SEQ ID NO: 5820879 - DNA, 15 bp, Homo sapiens
aaccacccgccccgc

SEQ ID NO: 5820880 - DNA, 18 bp, Homo sapiens
aaccaccgctccccagcc

SEQ ID NO: 5820881 - DNA, 19 bp, Homo sapiens
aaccaccgctccccagccc

SEQ ID NO: 5820882 - DNA, 19 bp, Homo sapiens
aaccacctaatcaggctga

SEQ ID NO: 5820883 - DNA, 22 bp, Homo sapiens
aaccacctaggcaatgaagaat

SEQ ID NO: 5820884 - DNA, 23 bp, Homo sapiens
aaccacctctggccctgttgtgg

SEQ ID NO: 5820885 - DNA, 13 bp, Homo sapiens
aaccacctgggtt

SEQ ID NO: 5820886 - DNA, 20 bp, Homo sapiens
aaccacctggttgaatataa

SEQ ID NO: 5820887 - DNA, 13 bp, Homo sapiens
aaccaccttaaaa

SEQ ID NO: 5820888 - DNA, 16 bp, Homo sapiens
aaccaccttaaaacat

SEQ ID NO: 5820889 - DNA, 15 bp, Homo sapiens
aaccacgaggctgcc

SEQ ID NO: 5820890 - DNA, 18 bp, Homo sapiens
aaccacgaggctgccccc

SEQ ID NO: 5820891 - DNA, 14 bp, Homo sapiens
aaccacgcaggaag

SEQ ID NO: 5820892 - DNA, 17 bp, Homo sapiens
aaccacggttatttaag

SEQ ID NO: 5820893 - DNA, 20 bp, Homo sapiens
aaccacgtaccaagccaccg

SEQ ID NO: 5820894 - DNA, 22 bp, Homo sapiens
aaccacgtaccaagccaccgca

SEQ ID NO: 5820895 - DNA, 22 bp, Homo sapiens
aaccacgtggagaaaatcaaac

SEQ ID NO: 5820896 - DNA, 21 bp, Homo sapiens
aaccacgtgttttgacatcat

SEQ ID NO: 5820897 - DNA, 18 bp, Homo sapiens
aaccactaatttgtcact

SEQ ID NO: 5820898 - DNA, 12 bp, Homo sapiens
aaccactagaaa

SEQ ID NO: 5820899 - DNA, 23 bp, Homo sapiens
aaccactatcttttgttctacct

SEQ ID NO: 5820900 - DNA, 21 bp, Homo sapiens
aaccactcagtaaaagcaaaa

SEQ ID NO: 5820901 - DNA, 21 bp, Homo sapiens
aaccactcccaccacaggcat

SEQ ID NO: 5820902 - DNA, 13 bp, Homo sapiens
aaccactctgtgg

SEQ ID NO: 5820903 - DNA, 17 bp, Homo sapiens
aaccactctgtggccag

SEQ ID NO: 5820904 - DNA, 22 bp, Homo sapiens
aaccactctgtggccagcctgg

SEQ ID NO: 5820905 - DNA, 22 bp, Homo sapiens
aaccactctttctttctccttt

SEQ ID NO: 5820906 - DNA, 11 bp, Homo sapiens
aaccactgaat

SEQ ID NO: 5820907 - DNA, 23 bp, Homo sapiens
aaccactgcaagtccttttgtaa

SEQ ID NO: 5820908 - DNA, 19 bp, Homo sapiens
aaccactgcaatatcttcg

SEQ ID NO: 5820909 - DNA, 17 bp, Homo sapiens
aaccactgcttctcttt

SEQ ID NO: 5820910 - DNA, 18 bp, Homo sapiens
aaccactggtcccagagc

SEQ ID NO: 5820911 - DNA, 12 bp, Homo sapiens
aaccactgtaca

SEQ ID NO: 5820912 - DNA, 15 bp, Homo sapiens
aaccactgtacatat

SEQ ID NO: 5820913 - DNA, 14 bp, Homo sapiens
aaccactgtgccac

SEQ ID NO: 5820914 - DNA, 20 bp, Homo sapiens
aaccactgtgtactggagcc

SEQ ID NO: 5820915 - DNA, 13 bp, Homo sapiens
aaccacttaaaaa

SEQ ID NO: 5820916 - DNA, 19 bp, Homo sapiens
aaccacttaaaaaatgtcc

SEQ ID NO: 5820917 - DNA, 14 bp, Homo sapiens
aaccacttcattct

SEQ ID NO: 5820918 - DNA, 19 bp, Homo sapiens
aaccacttctccatgctgc

SEQ ID NO: 5820919 - DNA, 15 bp, Homo sapiens
aaccacttctctgct

SEQ ID NO: 5820920 - DNA, 15 bp, Homo sapiens
aaccacttgcctggg

SEQ ID NO: 5820921 - DNA, 17 bp, Homo sapiens
aaccacttgtagatttg

SEQ ID NO: 5820922 - DNA, 18 bp, Homo sapiens
aaccacttgtagatttga

SEQ ID NO: 5820923 - DNA, 22 bp, Homo sapiens
aaccacttgtagatttgatttt

SEQ ID NO: 5820924 - DNA, 18 bp, Homo sapiens
aaccactttcacctggga

SEQ ID NO: 5820925 - DNA, 21 bp, Homo sapiens
aaccactttcttatttttttc

SEQ ID NO: 5820926 - DNA, 22 bp, Homo sapiens
aaccactttcttatttttttct

SEQ ID NO: 5820927 - DNA, 17 bp, Homo sapiens
aaccactttttgcagct

SEQ ID NO: 5820928 - DNA, 15 bp, Homo sapiens
aaccagaaaagcaat

SEQ ID NO: 5820929 - DNA, 19 bp, Homo sapiens
aaccagaaacacccctctg

SEQ ID NO: 5820930 - DNA, 22 bp, Homo sapiens
aaccagaaacacccctctgtct

SEQ ID NO: 5820931 - DNA, 13 bp, Homo sapiens
aaccagaaagagg

SEQ ID NO: 5820932 - DNA, 18 bp, Homo sapiens
aaccagaacgtggtttgc

SEQ ID NO: 5820933 - DNA, 13 bp, Homo sapiens
aaccagaaggaag

SEQ ID NO: 5820934 - DNA, 14 bp, Homo sapiens
aaccagaaggccct

SEQ ID NO: 5820935 - DNA, 15 bp, Homo sapiens
aaccagaaggccctt

SEQ ID NO: 5820936 - DNA, 16 bp, Homo sapiens
aaccagaagtgcagcc

SEQ ID NO: 5820937 - DNA, 14 bp, Homo sapiens
aaccagaatcataa

SEQ ID NO: 5820938 - DNA, 18 bp, Homo sapiens
aaccagaatgattttgac

SEQ ID NO: 5820939 - DNA, 17 bp, Homo sapiens
aaccagacagcacaggg

SEQ ID NO: 5820940 - DNA, 14 bp, Homo sapiens
aaccagactcttgc

SEQ ID NO: 5820941 - DNA, 10 bp, Homo sapiens
aaccagagcc

SEQ ID NO: 5820942 - DNA, 18 bp, Homo sapiens
aaccagagccatggactc

SEQ ID NO: 5820943 - DNA, 11 bp, Homo sapiens
aaccagagccc

SEQ ID NO: 5820944 - DNA, 18 bp, Homo sapiens
aaccagagccccccacaa

SEQ ID NO: 5820945 - DNA, 13 bp, Homo sapiens
aaccagagggttg

SEQ ID NO: 5820946 - DNA, 18 bp, Homo sapiens
aaccagagtcagcacagg

SEQ ID NO: 5820947 - DNA, 15 bp, Homo sapiens
aaccagagtgctgaa

SEQ ID NO: 5820948 - DNA, 16 bp, Homo sapiens
aaccagatatatattc

SEQ ID NO: 5820949 - DNA, 23 bp, Homo sapiens
aaccagcacagcttagatttcat

SEQ ID NO: 5820950 - DNA, 17 bp, Homo sapiens
aaccagcactcccaggg

SEQ ID NO: 5820951 - DNA, 18 bp, Homo sapiens
aaccagcactcccagggc

SEQ ID NO: 5820952 - DNA, 20 bp, Homo sapiens
aaccagcactcccagggccc

SEQ ID NO: 5820953 - DNA, 20 bp, Homo sapiens
aaccagcagcaggggaaaga

SEQ ID NO: 5820954 - DNA, 15 bp, Homo sapiens
aaccagcagggagtt

SEQ ID NO: 5820955 - DNA, 15 bp, Homo sapiens
aaccagccacacaga

SEQ ID NO: 5820956 - DNA, 17 bp, Homo sapiens
aaccagccacacagagc

SEQ ID NO: 5820957 - DNA, 12 bp, Homo sapiens
aaccagccacag

SEQ ID NO: 5820958 - DNA, 19 bp, Homo sapiens
aaccagccacagtacatat

SEQ ID NO: 5820959 - DNA, 11 bp, Homo sapiens
aaccagcccag

SEQ ID NO: 5820960 - DNA, 12 bp, Homo sapiens
aaccagcccagc

SEQ ID NO: 5820961 - DNA, 13 bp, Homo sapiens
aaccagcccagcc

SEQ ID NO: 5820962 - DNA, 17 bp, Homo sapiens
aaccagcccagcctgcc

SEQ ID NO: 5820963 - DNA, 19 bp, Homo sapiens
aaccagcccagcctgcccc

SEQ ID NO: 5820964 - DNA, 19 bp, Homo sapiens
aaccagcccgacagtgcca

SEQ ID NO: 5820965 - DNA, 14 bp, Homo sapiens
aaccagccggggcc

SEQ ID NO: 5820966 - DNA, 20 bp, Homo sapiens
aaccagccgtattttacatg

SEQ ID NO: 5820967 - DNA, 12 bp, Homo sapiens
aaccagcctcag

SEQ ID NO: 5820968 - DNA, 14 bp, Homo sapiens
aaccagctcagcac

SEQ ID NO: 5820969 - DNA, 17 bp, Homo sapiens
aaccagctcagcactgc

SEQ ID NO: 5820970 - DNA, 15 bp, Homo sapiens
aaccagctcagtgtt

SEQ ID NO: 5820971 - DNA, 11 bp, Homo sapiens
aaccagctgct

SEQ ID NO: 5820972 - DNA, 16 bp, Homo sapiens
aaccagctggaaggta

SEQ ID NO: 5820973 - DNA, 13 bp, Homo sapiens
aaccagcttcctt

SEQ ID NO: 5820974 - DNA, 21 bp, Homo sapiens
aaccagcttccttcagagagc

SEQ ID NO: 5820975 - DNA, 22 bp, Homo sapiens
aaccagcttccttcagagagca

SEQ ID NO: 5820976 - DNA, 12 bp, Homo sapiens
aaccaggaaaaa

SEQ ID NO: 5820977 - DNA, 15 bp, Homo sapiens
aaccaggaaatggaa

SEQ ID NO: 5820978 - DNA, 16 bp, Homo sapiens
aaccaggacccagggt

SEQ ID NO: 5820979 - DNA, 15 bp, Homo sapiens
aaccaggactctgcc

SEQ ID NO: 5820980 - DNA, 15 bp, Homo sapiens
aaccaggagctgctc

SEQ ID NO: 5820981 - DNA, 18 bp, Homo sapiens
aaccaggagctgctcact

SEQ ID NO: 5820982 - DNA, 22 bp, Homo sapiens
aaccaggagctgctcactacct

SEQ ID NO: 5820983 - DNA, 12 bp, Homo sapiens
aaccaggcagct

SEQ ID NO: 5820984 - DNA, 13 bp, Homo sapiens
aaccaggcccagc

SEQ ID NO: 5820985 - DNA, 22 bp, Homo sapiens
aaccaggccccagcctccaggc

SEQ ID NO: 5820986 - DNA, 14 bp, Homo sapiens
aaccaggccttcat

SEQ ID NO: 5820987 - DNA, 18 bp, Homo sapiens
aaccaggccttcatcctc

SEQ ID NO: 5820988 - DNA, 20 bp, Homo sapiens
aaccaggccttcatcctcct

SEQ ID NO: 5820989 - DNA, 16 bp, Homo sapiens
aaccagggagactgca

SEQ ID NO: 5820990 - DNA, 15 bp, Homo sapiens
aaccagggagctgca

SEQ ID NO: 5820991 - DNA, 13 bp, Homo sapiens
aaccagggaggag

SEQ ID NO: 5820992 - DNA, 12 bp, Homo sapiens
aaccagggatag

SEQ ID NO: 5820993 - DNA, 20 bp, Homo sapiens
aaccagggatgtctgttgaa

SEQ ID NO: 5820994 - DNA, 15 bp, Homo sapiens
aaccagggattgttt

SEQ ID NO: 5820995 - DNA, 16 bp, Homo sapiens
aaccagggattgtttc

SEQ ID NO: 5820996 - DNA, 17 bp, Homo sapiens
aaccagggcaccaagcc

SEQ ID NO: 5820997 - DNA, 23 bp, Homo sapiens
aaccagggggaagcaccagcctc

SEQ ID NO: 5820998 - DNA, 15 bp, Homo sapiens
aaccagggtgcatgg

SEQ ID NO: 5820999 - DNA, 16 bp, Homo sapiens
aaccaggtccaatgag

SEQ ID NO: 5821000 - DNA, 17 bp, Homo sapiens
aaccaggtccaatgagc

SEQ ID NO: 5821001 - DNA, 22 bp, Homo sapiens
aaccaggtccaatgagctttct

SEQ ID NO: 5821002 - DNA, 18 bp, Homo sapiens
aaccaggtccagatgtgc

SEQ ID NO: 5821003 - DNA, 16 bp, Homo sapiens
aaccaggtttgcacct

SEQ ID NO: 5821004 - DNA, 20 bp, Homo sapiens
aaccagtaacgtgctgctca

SEQ ID NO: 5821005 - DNA, 17 bp, Homo sapiens
aaccagtacttctaaga

SEQ ID NO: 5821006 - DNA, 19 bp, Homo sapiens
aaccagtaggatatttcta

SEQ ID NO: 5821007 - DNA, 20 bp, Homo sapiens
aaccagtatggaagggaggg

SEQ ID NO: 5821008 - DNA, 16 bp, Homo sapiens
aaccagtcaagttgtg

SEQ ID NO: 5821009 - DNA, 18 bp, Homo sapiens
aaccagtccccccaccct

SEQ ID NO: 5821010 - DNA, 17 bp, Homo sapiens
aaccagtcctgctgcct

SEQ ID NO: 5821011 - DNA, 18 bp, Homo sapiens
aaccagtcctgctgcctg

SEQ ID NO: 5821012 - DNA, 20 bp, Homo sapiens
aaccagtcctgctgcctgga

SEQ ID NO: 5821013 - DNA, 21 bp, Homo sapiens
aaccagtctgaagtttcattt

SEQ ID NO: 5821014 - DNA, 13 bp, Homo sapiens
aaccagtgcagaa

SEQ ID NO: 5821015 - DNA, 14 bp, Homo sapiens
aaccagtgcagaaa

SEQ ID NO: 5821016 - DNA, 18 bp, Homo sapiens
aaccagtgcagaaatgaa

SEQ ID NO: 5821017 - DNA, 13 bp, Homo sapiens
aaccagtgtacag

SEQ ID NO: 5821018 - DNA, 22 bp, Homo sapiens
aaccagtgtacaggtcacccat

SEQ ID NO: 5821019 - DNA, 12 bp, Homo sapiens
aaccagtgtgaa

SEQ ID NO: 5821020 - DNA, 14 bp, Homo sapiens
aaccagtgtgaacc

SEQ ID NO: 5821021 - DNA, 19 bp, Homo sapiens
aaccagtgttgtggattta

SEQ ID NO: 5821022 - DNA, 17 bp, Homo sapiens
aaccagttataaataca

SEQ ID NO: 5821023 - DNA, 12 bp, Homo sapiens
aaccagttattt

SEQ ID NO: 5821024 - DNA, 20 bp, Homo sapiens
aaccagttgtggtgtgagta

SEQ ID NO: 5821025 - DNA, 16 bp, Homo sapiens
aaccagttgttttgtc

SEQ ID NO: 5821026 - DNA, 18 bp, Homo sapiens
aaccagtttattctgtgg

SEQ ID NO: 5821027 - DNA, 20 bp, Homo sapiens
aaccagtttattctgtggtt

SEQ ID NO: 5821028 - DNA, 16 bp, Homo sapiens
aaccagttttgctgct

SEQ ID NO: 5821029 - DNA, 15 bp, Homo sapiens
aaccataaaaagctg

SEQ ID NO: 5821030 - DNA, 17 bp, Homo sapiens
aaccataaaataaataa

SEQ ID NO: 5821031 - DNA, 18 bp, Homo sapiens
aaccataaacttcatggt

SEQ ID NO: 5821032 - DNA, 21 bp, Homo sapiens
aaccataaatcaattcatgtt

SEQ ID NO: 5821033 - DNA, 22 bp, Homo sapiens
aaccatacaaaaattccttttc

SEQ ID NO: 5821034 - DNA, 21 bp, Homo sapiens
aaccataccttccttccctgg

SEQ ID NO: 5821035 - DNA, 13 bp, Homo sapiens
aaccatactgaaa

SEQ ID NO: 5821036 - DNA, 23 bp, Homo sapiens
aaccatactttatatatgtacat

SEQ ID NO: 5821037 - DNA, 22 bp, Homo sapiens
aaccataggctgctctgcctgt

SEQ ID NO: 5821038 - DNA, 17 bp, Homo sapiens
aaccctttgtattataa

SEQ ID NO: 5821039 - DNA, 23 bp, Homo sapiens
aaccctttgtattataattgttg

SEQ ID NO: 5821040 - DNA, 22 bp, Homo sapiens
aacccttttggcccccgagctg

SEQ ID NO: 5821041 - DNA, 23 bp, Homo sapiens
aaccgaacatatcatttgtgaag

SEQ ID NO: 5821042 - DNA, 18 bp, Homo sapiens
aaccgaacatgaccaaaa

SEQ ID NO: 5821043 - DNA, 17 bp, Homo sapiens
aaccgagataggggagg

SEQ ID NO: 5821044 - DNA, 19 bp, Homo sapiens
aaccgagggggctgctccc

SEQ ID NO: 5821045 - DNA, 23 bp, Homo sapiens
aaccgagtagaaaatgtgaccct

SEQ ID NO: 5821046 - DNA, 20 bp, Homo sapiens
aaccgataatgcatgaagca

SEQ ID NO: 5821047 - DNA, 21 bp, Homo sapiens
aaccgatgctccagccaaccc

SEQ ID NO: 5821048 - DNA, 17 bp, Homo sapiens
aaccgatgctttaccaa

SEQ ID NO: 5821049 - DNA, 14 bp, Homo sapiens
aaccgcaaacgtga

SEQ ID NO: 5821050 - DNA, 15 bp, Homo sapiens
aaccgcacagctcag

SEQ ID NO: 5821051 - DNA, 13 bp, Homo sapiens
aaccgcaggaagc

SEQ ID NO: 5821052 - DNA, 22 bp, Homo sapiens
aaccgcattcagtgcacctgcc

SEQ ID NO: 5821053 - DNA, 14 bp, Homo sapiens
aaccgccagctctg

SEQ ID NO: 5821054 - DNA, 22 bp, Homo sapiens
aaccgccagctctgttcttcct

SEQ ID NO: 5821055 - DNA, 13 bp, Homo sapiens
aaccgccctcctg

SEQ ID NO: 5821056 - DNA, 17 bp, Homo sapiens
aaccgctttggcctgag

SEQ ID NO: 5821057 - DNA, 16 bp, Homo sapiens
aaccggcaacctgtaa

SEQ ID NO: 5821058 - DNA, 18 bp, Homo sapiens
aaccggcaacctgtaact

SEQ ID NO: 5821059 - DNA, 15 bp, Homo sapiens
aaccgggaaaggcat

SEQ ID NO: 5821060 - DNA, 17 bp, Homo sapiens
aaccgggaagggtggcc

SEQ ID NO: 5821061 - DNA, 17 bp, Homo sapiens
aaccgggactacagaag

SEQ ID NO: 5821062 - DNA, 13 bp, Homo sapiens
aaccgggatggga

SEQ ID NO: 5821063 - DNA, 18 bp, Homo sapiens
aaccgtagactaggaagt

SEQ ID NO: 5821064 - DNA, 13 bp, Homo sapiens
aaccgtcaatgtg

SEQ ID NO: 5821065 - DNA, 16 bp, Homo sapiens
aaccgtcaatgtgaaa

SEQ ID NO: 5821066 - DNA, 22 bp, Homo sapiens
aaccgtccccggcccctgcccc

SEQ ID NO: 5821067 - DNA, 12 bp, Homo sapiens
aaccgtccctga

SEQ ID NO: 5821068 - DNA, 15 bp, Homo sapiens
aaccgtcctcttttt

SEQ ID NO: 5821069 - DNA, 23 bp, Homo sapiens
aaccgtcctgctgtccctgtcag

SEQ ID NO: 5821070 - DNA, 16 bp, Homo sapiens
aaccgtctgttatgct

SEQ ID NO: 5821071 - DNA, 22 bp, Homo sapiens
aaccgtctgttatgctgtgaca

SEQ ID NO: 5821072 - DNA, 19 bp, Homo sapiens
aaccgtgcaacgtgtaact

SEQ ID NO: 5821073 - DNA, 18 bp, Homo sapiens
aaccgtggactcttcctt

SEQ ID NO: 5821074 - DNA, 17 bp, Homo sapiens
aaccgtggcccttcctg

SEQ ID NO: 5821075 - DNA, 16 bp, Homo sapiens
aaccgtggtatgtctg

SEQ ID NO: 5821076 - DNA, 14 bp, Homo sapiens
aaccgtttacagtg

SEQ ID NO: 5821077 - DNA, 14 bp, Homo sapiens
aacctaaaaatcaa

SEQ ID NO: 5821078 - DNA, 17 bp, Homo sapiens
aacctaaaactctttcg

SEQ ID NO: 5821079 - DNA, 17 bp, Homo sapiens
aacctaaaagtattatt

SEQ ID NO: 5821080 - DNA, 18 bp, Homo sapiens
aacctaaaagtattattc

SEQ ID NO: 5821081 - DNA, 13 bp, Homo sapiens
aacctaaataatt

SEQ ID NO: 5821082 - DNA, 22 bp, Homo sapiens
aacctaaatttggttctaggcc

SEQ ID NO: 5821083 - DNA, 21 bp, Homo sapiens
aacctaacacattaaatgtgg

SEQ ID NO: 5821084 - DNA, 15 bp, Homo sapiens
aacctaacccctttc

SEQ ID NO: 5821085 - DNA, 17 bp, Homo sapiens
aacctaactgtatcttg

SEQ ID NO: 5821086 - DNA, 18 bp, Homo sapiens
aacctaacttgcgcagaa

SEQ ID NO: 5821087 - DNA, 18 bp, Homo sapiens
aacctaaggcaacatttc

SEQ ID NO: 5821088 - DNA, 22 bp, Homo sapiens
aacctaagtccttccacctgcc

SEQ ID NO: 5821089 - DNA, 21 bp, Homo sapiens
aacctaatcaccatgtaagca

SEQ ID NO: 5821090 - DNA, 20 bp, Homo sapiens
aacctaatgggaatcattcc

SEQ ID NO: 5821091 - DNA, 18 bp, Homo sapiens
aacctaattaatatatta

SEQ ID NO: 5821092 - DNA, 19 bp, Homo sapiens
aacctacaagaactaatga

SEQ ID NO: 5821093 - DNA, 21 bp, Homo sapiens
aacctacacacataccttcat

SEQ ID NO: 5821094 - DNA, 21 bp, Homo sapiens
aacctacacacgtaccttcat

SEQ ID NO: 5821095 - DNA, 23 bp, Homo sapiens
aacctacagactccatctcttct

SEQ ID NO: 5821096 - DNA, 12 bp, Homo sapiens
aacctacagcat

SEQ ID NO: 5821097 - DNA, 18 bp, Homo sapiens
aacctacagtggagggag

SEQ ID NO: 5821098 - DNA, 17 bp, Homo sapiens
aacctacattccaccct

SEQ ID NO: 5821099 - DNA, 19 bp, Homo sapiens
aacctaccaccccttcctg

SEQ ID NO: 5821100 - DNA, 18 bp, Homo sapiens
aacctacctcccacactc

SEQ ID NO: 5821101 - DNA, 15 bp, Homo sapiens
aacctaccttataga

SEQ ID NO: 5821102 - DNA, 20 bp, Homo sapiens
aacctaccttatagagcaca

SEQ ID NO: 5821103 - DNA, 23 bp, Homo sapiens
aacctaccttcatttcaggaggg

SEQ ID NO: 5821104 - DNA, 22 bp, Homo sapiens
aacctactagacaatgatgtga

SEQ ID NO: 5821105 - DNA, 15 bp, Homo sapiens
aacctactaggccat

SEQ ID NO: 5821106 - DNA, 20 bp, Homo sapiens
aacctactgcccacatttgg

SEQ ID NO: 5821107 - DNA, 20 bp, Homo sapiens
aacctactttcatactgaag

SEQ ID NO: 5821108 - DNA, 15 bp, Homo sapiens
aacctagaacttcaa

SEQ ID NO: 5821109 - DNA, 16 bp, Homo sapiens
aacctagaacttcaaa

SEQ ID NO: 5821110 - DNA, 14 bp, Homo sapiens
aacctagaagggct

SEQ ID NO: 5821111 - DNA, 15 bp, Homo sapiens
aacctagaatgtcag

SEQ ID NO: 5821112 - DNA, 19 bp, Homo sapiens
aacctagacttcagagaga

SEQ ID NO: 5821113 - DNA, 15 bp, Homo sapiens
aacctagagaagata

SEQ ID NO: 5821114 - DNA, 20 bp, Homo sapiens
aacctagatgtttaacaaat

SEQ ID NO: 5821115 - DNA, 14 bp, Homo sapiens
aacctagcacacct

SEQ ID NO: 5821116 - DNA, 15 bp, Homo sapiens
aacctagcttttaaa

SEQ ID NO: 5821117 - DNA, 20 bp, Homo sapiens
aacctagcttttaaaaaata

SEQ ID NO: 5821118 - DNA, 21 bp, Homo sapiens
aacctagcttttaaaaaatat

SEQ ID NO: 5821119 - DNA, 22 bp, Homo sapiens
aacctagcttttaaaaaatatt

SEQ ID NO: 5821120 - DNA, 16 bp, Homo sapiens
aacctaggagggctct

SEQ ID NO: 5821121 - DNA, 19 bp, Homo sapiens
aacctaggagtgccccatt

SEQ ID NO: 5821122 - DNA, 22 bp, Homo sapiens
aacctaggatggatagaaggaa

SEQ ID NO: 5821123 - DNA, 20 bp, Homo sapiens
aacctaggcagtgggaggca

SEQ ID NO: 5821124 - DNA, 17 bp, Homo sapiens
aacctagtaaaaccttg

SEQ ID NO: 5821125 - DNA, 18 bp, Homo sapiens
aacctagtactctctgct

SEQ ID NO: 5821126 - DNA, 20 bp, Homo sapiens
aacctagttaaagaaaggaa

SEQ ID NO: 5821127 - DNA, 16 bp, Homo sapiens
aacctatatgatttat

SEQ ID NO: 5821128 - DNA, 20 bp, Homo sapiens
aacctatcatttattctgct

SEQ ID NO: 5821129 - DNA, 14 bp, Homo sapiens
aacctatccttcca

SEQ ID NO: 5821130 - DNA, 20 bp, Homo sapiens
aacctatgtaatttttaaag

SEQ ID NO: 5821131 - DNA, 22 bp, Homo sapiens
aacctatgtaatttttaaagca

SEQ ID NO: 5821132 - DNA, 19 bp, Homo sapiens
aacctattttcatttgtac

SEQ ID NO: 5821133 - DNA, 15 bp, Homo sapiens
aacctatttttcctt

SEQ ID NO: 5821134 - DNA, 17 bp, Homo sapiens
aacctcaaaatgtctaa

SEQ ID NO: 5821135 - DNA, 12 bp, Homo sapiens
aacctcaaacca

SEQ ID NO: 5821136 - DNA, 16 bp, Homo sapiens
aacctcaaactctggg

SEQ ID NO: 5821137 - DNA, 18 bp, Homo sapiens
aacctcaaatatagtata

SEQ ID NO: 5821138 - DNA, 16 bp, Homo sapiens
aacctcaactgcctac

SEQ ID NO: 5821139 - DNA, 18 bp, Homo sapiens
aacctcaactgcctactc

SEQ ID NO: 5821140 - DNA, 16 bp, Homo sapiens
aacctcaatgccctgc

SEQ ID NO: 5821141 - DNA, 18 bp, Homo sapiens
aacctcaatgccctgcca

SEQ ID NO: 5821142 - DNA, 23 bp, Homo sapiens
aacctcacactactgtatttcat

SEQ ID NO: 5821143 - DNA, 15 bp, Homo sapiens
aacctcaccaaacta

SEQ ID NO: 5821144 - DNA, 23 bp, Homo sapiens
aacctcaccattgtgaagcacct

SEQ ID NO: 5821145 - DNA, 12 bp, Homo sapiens
aacctcaccccg

SEQ ID NO: 5821146 - DNA, 20 bp, Homo sapiens
aacctcaccccgaggccctg

SEQ ID NO: 5821147 - DNA, 13 bp, Homo sapiens
aacctcactcttg

SEQ ID NO: 5821148 - DNA, 22 bp, Homo sapiens
aacctcactgagaggcctggag

SEQ ID NO: 5821149 - DNA, 11 bp, Homo sapiens
aacctcactgg

SEQ ID NO: 5821150 - DNA, 19 bp, Homo sapiens
aacctcagacttaccagga

SEQ ID NO: 5821151 - DNA, 18 bp, Homo sapiens
aacctcagccaaacacag

SEQ ID NO: 5821152 - DNA, 13 bp, Homo sapiens
aacctcagctctg

SEQ ID NO: 5821153 - DNA, 11 bp, Homo sapiens
aacctcaggga

SEQ ID NO: 5821154 - DNA, 20 bp, Homo sapiens
aacctcagggacaacatttt

SEQ ID NO: 5821155 - DNA, 17 bp, Homo sapiens
aacctcagggctcccag

SEQ ID NO: 5821156 - DNA, 22 bp, Homo sapiens
aacctcaggtacggagaagaat

SEQ ID NO: 5821157 - DNA, 18 bp, Homo sapiens
aacctcagtaatttagaa

SEQ ID NO: 5821158 - DNA, 15 bp, Homo sapiens
aacctcagtatttat

SEQ ID NO: 5821159 - DNA, 22 bp, Homo sapiens
aacctcagtatttatgtaattt

SEQ ID NO: 5821160 - DNA, 16 bp, Homo sapiens
aacctcagttggcctc

SEQ ID NO: 5821161 - DNA, 17 bp, Homo sapiens
aacctcagttggcctct

SEQ ID NO: 5821162 - DNA, 19 bp, Homo sapiens
aacctcagttggcctctgc

SEQ ID NO: 5821163 - DNA, 20 bp, Homo sapiens
aacctcagttggcctctgcc

SEQ ID NO: 5821164 - DNA, 18 bp, Homo sapiens
aacctcatgacagccaga

SEQ ID NO: 5821165 - DNA, 19 bp, Homo sapiens
aacctcatgacagccagag

SEQ ID NO: 5821166 - DNA, 17 bp, Homo sapiens
aacctcatggtcatgga

SEQ ID NO: 5821167 - DNA, 13 bp, Homo sapiens
aacctccaaatgg

SEQ ID NO: 5821168 - DNA, 15 bp, Homo sapiens
aacctccaaatggaa

SEQ ID NO: 5821169 - DNA, 11 bp, Homo sapiens
aacctccacct

SEQ ID NO: 5821170 - DNA, 16 bp, Homo sapiens
aacctccacctcctgg

SEQ ID NO: 5821171 - DNA, 17 bp, Homo sapiens
aacctccacctcctggg

SEQ ID NO: 5821172 - DNA, 18 bp, Homo sapiens
aacctccagactcagcag

SEQ ID NO: 5821173 - DNA, 20 bp, Homo sapiens
aacctccagcagactcctgc

SEQ ID NO: 5821174 - DNA, 14 bp, Homo sapiens
aacctccagcctcc

SEQ ID NO: 5821175 - DNA, 18 bp, Homo sapiens
aacctccagcctccctgt

SEQ ID NO: 5821176 - DNA, 18 bp, Homo sapiens
aacctccatactcaagct

SEQ ID NO: 5821177 - DNA, 18 bp, Homo sapiens
aacctccatcctgccagg

SEQ ID NO: 5821178 - DNA, 17 bp, Homo sapiens
aacctcccaaatttgag

SEQ ID NO: 5821179 - DNA, 23 bp, Homo sapiens
aacctcccagaggtccagcccat

SEQ ID NO: 5821180 - DNA, 15 bp, Homo sapiens
aacctccccagcctg

SEQ ID NO: 5821181 - DNA, 19 bp, Homo sapiens
aacctccccgcagagctcc

SEQ ID NO: 5821182 - DNA, 16 bp, Homo sapiens
aacctccccggctcaa

SEQ ID NO: 5821183 - DNA, 10 bp, Homo sapiens
aacctcccct

SEQ ID NO: 5821184 - DNA, 17 bp, Homo sapiens
aacctcccctctccccg

SEQ ID NO: 5821185 - DNA, 14 bp, Homo sapiens
aacctcccctggtc

SEQ ID NO: 5821186 - DNA, 19 bp, Homo sapiens
aacctcccctggtcctgca

SEQ ID NO: 5821187 - DNA, 19 bp, Homo sapiens
aacctccctcttgttttgt

SEQ ID NO: 5821188 - DNA, 19 bp, Homo sapiens
aacctccgcatcccgggtt

SEQ ID NO: 5821189 - DNA, 17 bp, Homo sapiens
aacctcctgctctggga

SEQ ID NO: 5821190 - DNA, 14 bp, Homo sapiens
aacctcctgggcta

SEQ ID NO: 5821191 - DNA, 22 bp, Homo sapiens
aacctcctgtggaacccagcag

SEQ ID NO: 5821192 - DNA, 15 bp, Homo sapiens
aacctccttacctgg

SEQ ID NO: 5821193 - DNA, 19 bp, Homo sapiens
aacctcctttctcttctct

SEQ ID NO: 5821194 - DNA, 22 bp, Homo sapiens
aacctcgaagctgttctctgct

SEQ ID NO: 5821195 - DNA, 23 bp, Homo sapiens
aacctcgaagctgttctctgctt

SEQ ID NO: 5821196 - DNA, 22 bp, Homo sapiens
aacctcgaggtttctcaaagaa

SEQ ID NO: 5821197 - DNA, 15 bp, Homo sapiens
aacctcgagtactgt

SEQ ID NO: 5821198 - DNA, 20 bp, Homo sapiens
aacctcgccctctcctttgt

SEQ ID NO: 5821199 - DNA, 19 bp, Homo sapiens
aacctcgctggactctcag

SEQ ID NO: 5821200 - DNA, 17 bp, Homo sapiens
aacctctaagtgctgct

SEQ ID NO: 5821201 - DNA, 20 bp, Homo sapiens
aacctctaagtgctgctgtg

SEQ ID NO: 5821202 - DNA, 16 bp, Homo sapiens
aacctctacaggcatt

SEQ ID NO: 5821203 - DNA, 16 bp, Homo sapiens
aacctctacatattta

SEQ ID NO: 5821204 - DNA, 23 bp, Homo sapiens
aacctctactaaaaagaaggaaa

SEQ ID NO: 5821205 - DNA, 18 bp, Homo sapiens
aacctctagaattttaag

SEQ ID NO: 5821206 - DNA, 13 bp, Homo sapiens
aacctctcactcc

SEQ ID NO: 5821207 - DNA, 15 bp, Homo sapiens
aacctctcagatccc

SEQ ID NO: 5821208 - DNA, 16 bp, Homo sapiens
aacctctctccttctg

SEQ ID NO: 5821209 - DNA, 13 bp, Homo sapiens
aacctctgcctcc

SEQ ID NO: 5821210 - DNA, 18 bp, Homo sapiens
aacctctgcttcccaggt

SEQ ID NO: 5821211 - DNA, 13 bp, Homo sapiens
aacctctggccct

SEQ ID NO: 5821212 - DNA, 14 bp, Homo sapiens
aacctctgtctcat

SEQ ID NO: 5821213 - DNA, 19 bp, Homo sapiens
aacctctgtctcccgggtt

SEQ ID NO: 5821214 - DNA, 18 bp, Homo sapiens
aacctctgttcagtgtaa

SEQ ID NO: 5821215 - DNA, 17 bp, Homo sapiens
aacctcttagcttttct

SEQ ID NO: 5821216 - DNA, 18 bp, Homo sapiens
aacctcttcagaggccct

SEQ ID NO: 5821217 - DNA, 22 bp, Homo sapiens
aacctctttgcgtttccttttt

SEQ ID NO: 5821218 - DNA, 16 bp, Homo sapiens
aacctcttttctgcat

SEQ ID NO: 5821219 - DNA, 18 bp, Homo sapiens
aacctcttttctgcatca

SEQ ID NO: 5821220 - DNA, 20 bp, Homo sapiens
aacctcttttgttgtccttg

SEQ ID NO: 5821221 - DNA, 16 bp, Homo sapiens
aacctctttttcctcc

SEQ ID NO: 5821222 - DNA, 21 bp, Homo sapiens
aacctgaaaaaaagtttacaa

SEQ ID NO: 5821223 - DNA, 21 bp, Homo sapiens
aacctgaaaagatgttgtgtc

SEQ ID NO: 5821224 - DNA, 14 bp, Homo sapiens
aacctgaaagacaa

SEQ ID NO: 5821225 - DNA, 15 bp, Homo sapiens
aacctgaaagttcct

SEQ ID NO: 5821226 - DNA, 21 bp, Homo sapiens
aacctgaaagttccttctgta

SEQ ID NO: 5821227 - DNA, 20 bp, Homo sapiens
aacctgaaatttattcacat

SEQ ID NO: 5821228 - DNA, 15 bp, Homo sapiens
aacctgaacctagga

SEQ ID NO: 5821229 - DNA, 18 bp, Homo sapiens
aacctgaagatgtctcct

SEQ ID NO: 5821230 - DNA, 15 bp, Homo sapiens
aacctgaagtttttt

SEQ ID NO: 5821231 - DNA, 19 bp, Homo sapiens
aacctgacaaaaaaaaagt

SEQ ID NO: 5821232 - DNA, 20 bp, Homo sapiens
aacctgacagatgtcagccg

SEQ ID NO: 5821233 - DNA, 23 bp, Homo sapiens
aacctgacagatgtcagccgagc

SEQ ID NO: 5821234 - DNA, 16 bp, Homo sapiens
aacctgacccctgctc

SEQ ID NO: 5821235 - DNA, 17 bp, Homo sapiens
aacctgacccctgctca

SEQ ID NO: 5821236 - DNA, 23 bp, Homo sapiens
aacctgacctaacctaggagggc

SEQ ID NO: 5821237 - DNA, 17 bp, Homo sapiens
aacctgacgtagctgca

SEQ ID NO: 5821238 - DNA, 22 bp, Homo sapiens
aacctgactcaattatttgcat

SEQ ID NO: 5821239 - DNA, 14 bp, Homo sapiens
aacctgagatttat

SEQ ID NO: 5821240 - DNA, 18 bp, Homo sapiens
aacctgagccccaaaagg

SEQ ID NO: 5821241 - DNA, 20 bp, Homo sapiens
aacctgagccccaaaaggta

SEQ ID NO: 5821242 - DNA, 19 bp, Homo sapiens
aacctgagccttttcttat

SEQ ID NO: 5821243 - DNA, 19 bp, Homo sapiens
aacctgagttcccgggagc

SEQ ID NO: 5821244 - DNA, 17 bp, Homo sapiens
aacctgatgaaaataaa

SEQ ID NO: 5821245 - DNA, 20 bp, Homo sapiens
aacctgatgaaaataaagaa

SEQ ID NO: 5821246 - DNA, 18 bp, Homo sapiens
aacctgatgccccttccc

SEQ ID NO: 5821247 - DNA, 21 bp, Homo sapiens
aacctgatgctggggacacag

SEQ ID NO: 5821248 - DNA, 18 bp, Homo sapiens
aacctgatgttaaaattc

SEQ ID NO: 5821249 - DNA, 15 bp, Homo sapiens
aacctgattggccac

SEQ ID NO: 5821250 - DNA, 16 bp, Homo sapiens
aacctgattgtaaact

SEQ ID NO: 5821251 - DNA, 21 bp, Homo sapiens
aacctgcaaaaaatacttttt

SEQ ID NO: 5821252 - DNA, 24 bp, Homo sapiens
aacctgcaagttgctctgacctcc

SEQ ID NO: 5821253 - DNA, 15 bp, Homo sapiens
aacctgcacacagga

SEQ ID NO: 5821254 - DNA, 20 bp, Homo sapiens
aacctgcacacaggacagcg

SEQ ID NO: 5821255 - DNA, 15 bp, Homo sapiens
aacctgcacaggctt

SEQ ID NO: 5821256 - DNA, 16 bp, Homo sapiens
aacctgcacaggcttg

SEQ ID NO: 5821257 - DNA, 14 bp, Homo sapiens
aacctgcactgaaa

SEQ ID NO: 5821258 - DNA, 20 bp, Homo sapiens
aacctgcagtttttaatttg

SEQ ID NO: 5821259 - DNA, 18 bp, Homo sapiens
aacctgcatgaaagcatt

SEQ ID NO: 5821260 - DNA, 14 bp, Homo sapiens
aacctgcatttaag

SEQ ID NO: 5821261 - DNA, 19 bp, Homo sapiens
aacctgccagggagacaga

SEQ ID NO: 5821262 - DNA, 22 bp, Homo sapiens
aacctgcccaaagattgatttg

SEQ ID NO: 5821263 - DNA, 13 bp, Homo sapiens
aacctgccctgcc

SEQ ID NO: 5821264 - DNA, 16 bp, Homo sapiens
aacctgccctgcctga

SEQ ID NO: 5821265 - DNA, 17 bp, Homo sapiens
aacctgccctgcctgag

SEQ ID NO: 5821266 - DNA, 22 bp, Homo sapiens
aacctgcctaaattaaattggg

SEQ ID NO: 5821267 - DNA, 22 bp, Homo sapiens
aacctgcctccaagatttcaga

SEQ ID NO: 5821268 - DNA, 14 bp, Homo sapiens
aacctgcgcagtca

SEQ ID NO: 5821269 - DNA, 14 bp, Homo sapiens
aacctgctctcctc

SEQ ID NO: 5821270 - DNA, 15 bp, Homo sapiens
aacctgctctcctct

SEQ ID NO: 5821271 - DNA, 18 bp, Homo sapiens
aacctgctggtggggcag

SEQ ID NO: 5821272 - DNA, 12 bp, Homo sapiens
aacctgcttcct

SEQ ID NO: 5821273 - DNA, 11 bp, Homo sapiens
aacctgcttgg

SEQ ID NO: 5821274 - DNA, 22 bp, Homo sapiens
aacctgcttgggtggagaagcc

SEQ ID NO: 5821275 - DNA, 17 bp, Homo sapiens
aacctggaaaataaatc

SEQ ID NO: 5821276 - DNA, 15 bp, Homo sapiens
aacctggaaatgatg

SEQ ID NO: 5821277 - DNA, 17 bp, Homo sapiens
aacctggaaatgatgtt

SEQ ID NO: 5821278 - DNA, 17 bp, Homo sapiens
aacctggaaccagaggg

SEQ ID NO: 5821279 - DNA, 23 bp, Homo sapiens
aacctggaagatcatggacctgg

SEQ ID NO: 5821280 - DNA, 17 bp, Homo sapiens
aacctggaccaaagctg

SEQ ID NO: 5821281 - DNA, 19 bp, Homo sapiens
aacctggaccccagccttg

SEQ ID NO: 5821282 - DNA, 20 bp, Homo sapiens
aacctggaccccagccttgg

SEQ ID NO: 5821283 - DNA, 21 bp, Homo sapiens
aacctggaccccagccttggt

SEQ ID NO: 5821284 - DNA, 10 bp, Homo sapiens
aacctggaga

SEQ ID NO: 5821285 - DNA, 19 bp, Homo sapiens
aacctggagagctagaacc

SEQ ID NO: 5821286 - DNA, 11 bp, Homo sapiens
aacctggagat

SEQ ID NO: 5821287 - DNA, 14 bp, Homo sapiens
aacctggagatatt

SEQ ID NO: 5821288 - DNA, 16 bp, Homo sapiens
aacctggagatgatga

SEQ ID NO: 5821289 - DNA, 18 bp, Homo sapiens
aacctggagatgatgatg

SEQ ID NO: 5821290 - DNA, 15 bp, Homo sapiens
aacctggagatggtg

SEQ ID NO: 5821291 - DNA, 15 bp, Homo sapiens
aacctggaggctgga

SEQ ID NO: 5821292 - DNA, 17 bp, Homo sapiens
aacctggaggctggacc

SEQ ID NO: 5821293 - DNA, 22 bp, Homo sapiens
aacctggagggctagaatctgg

SEQ ID NO: 5821294 - DNA, 11 bp, Homo sapiens
aacctggaggt

SEQ ID NO: 5821295 - DNA, 19 bp, Homo sapiens
aacctggcaagctagaacc

SEQ ID NO: 5821296 - DNA, 15 bp, Homo sapiens
aacctggcagatggg

SEQ ID NO: 5821297 - DNA, 21 bp, Homo sapiens
aacctggcaggccctgcccag

SEQ ID NO: 5821298 - DNA, 21 bp, Homo sapiens
aacctggcatggtgctttcag

SEQ ID NO: 5821299 - DNA, 21 bp, Homo sapiens
aacctggccactgtccctgtc

SEQ ID NO: 5821300 - DNA, 23 bp, Homo sapiens
aacctggccactgtccctgtcct

SEQ ID NO: 5821301 - DNA, 23 bp, Homo sapiens
aacctggccgcgtttagaccaag

SEQ ID NO: 5821302 - DNA, 16 bp, Homo sapiens
aacctggctccctccc

SEQ ID NO: 5821303 - DNA, 19 bp, Homo sapiens
aacctggctccctcccacc

SEQ ID NO: 5821304 - DNA, 16 bp, Homo sapiens
aacctgggaaagagat

SEQ ID NO: 5821305 - DNA, 21 bp, Homo sapiens
aacctgggaaagagatttaaa

SEQ ID NO: 5821306 - DNA, 10 bp, Homo sapiens
aacctgggac

SEQ ID NO: 5821307 - DNA, 20 bp, Homo sapiens
aacctgggattcaggaatgt

SEQ ID NO: 5821308 - DNA, 21 bp, Homo sapiens
aacctgggattcaggaatgtg

SEQ ID NO: 5821309 - DNA, 12 bp, Homo sapiens
aacctgggctgt

SEQ ID NO: 5821310 - DNA, 17 bp, Homo sapiens
aacctggggcaatgcct

SEQ ID NO: 5821311 - DNA, 12 bp, Homo sapiens
aacctggggggc

SEQ ID NO: 5821312 - DNA, 21 bp, Homo sapiens
aacctggggtgtggttccaga

SEQ ID NO: 5821313 - DNA, 17 bp, Homo sapiens
aacctgggtccaaataa

SEQ ID NO: 5821314 - DNA, 17 bp, Homo sapiens
aacctgggttgcagaca

SEQ ID NO: 5821315 - DNA, 21 bp, Homo sapiens
aacctggtattttaagagaaa

SEQ ID NO: 5821316 - DNA, 14 bp, Homo sapiens
aacctggtgctgga

SEQ ID NO: 5821317 - DNA, 11 bp, Homo sapiens
aacctggtggc

SEQ ID NO: 5821318 - DNA, 15 bp, Homo sapiens
aacctggtggctgga

SEQ ID NO: 5821319 - DNA, 17 bp, Homo sapiens
aacctggtgtgtttctt

SEQ ID NO: 5821320 - DNA, 15 bp, Homo sapiens
aacctgtaaattatt

SEQ ID NO: 5821321 - DNA, 20 bp, Homo sapiens
aacctgtaaattattttaaa

SEQ ID NO: 5821322 - DNA, 14 bp, Homo sapiens
aacctgtaactgcc

SEQ ID NO: 5821323 - DNA, 17 bp, Homo sapiens
aacctgtaagcccagca

SEQ ID NO: 5821324 - DNA, 16 bp, Homo sapiens
aacctgtaataaatat

SEQ ID NO: 5821325 - DNA, 17 bp, Homo sapiens
aacctgtactgggttat

SEQ ID NO: 5821326 - DNA, 14 bp, Homo sapiens
aacctgtagatgca

SEQ ID NO: 5821327 - DNA, 19 bp, Homo sapiens
aacctgtagatgcagaaaa

SEQ ID NO: 5821328 - DNA, 23 bp, Homo sapiens
aacctgtagatgcagaaaaagaa

SEQ ID NO: 5821329 - DNA, 19 bp, Homo sapiens
aacctgtaggatcttattt

SEQ ID NO: 5821330 - DNA, 22 bp, Homo sapiens
aacctgtataaccctgttacaa

SEQ ID NO: 5821331 - DNA, 18 bp, Homo sapiens
aacctgtatactcttgaa

SEQ ID NO: 5821332 - DNA, 13 bp, Homo sapiens
aacctgtatcttt

SEQ ID NO: 5821333 - DNA, 16 bp, Homo sapiens
aacctgtattactgaa

SEQ ID NO: 5821334 - DNA, 19 bp, Homo sapiens
aacctgtcatgtgcggatc

SEQ ID NO: 5821335 - DNA, 23 bp, Homo sapiens
aacctgtcctaaggaaccttcct

SEQ ID NO: 5821336 - DNA, 23 bp, Homo sapiens
aacctgtccttactcagagctgc

SEQ ID NO: 5821337 - DNA, 18 bp, Homo sapiens
aacctgtctccactgtgc

SEQ ID NO: 5821338 - DNA, 24 bp, Homo sapiens
aacctgtctccactgtgcctttgc

SEQ ID NO: 5821339 - DNA, 11 bp, Homo sapiens
aacctgtctga

SEQ ID NO: 5821340 - DNA, 19 bp, Homo sapiens
aacctgtcttggggccact

SEQ ID NO: 5821341 - DNA, 14 bp, Homo sapiens
aacctgtcttttgg

SEQ ID NO: 5821342 - DNA, 18 bp, Homo sapiens
aacctgtgagtaaatatt

SEQ ID NO: 5821343 - DNA, 22 bp, Homo sapiens
aacctgtgcagtcccgtggagg

SEQ ID NO: 5821344 - DNA, 17 bp, Homo sapiens
aacctgtgccaggctga

SEQ ID NO: 5821345 - DNA, 11 bp, Homo sapiens
aacctgtgcct

SEQ ID NO: 5821346 - DNA, 18 bp, Homo sapiens
aacctgtgctttcatgtt

SEQ ID NO: 5821347 - DNA, 22 bp, Homo sapiens
aacctgtgtctgcgaagtccta

SEQ ID NO: 5821348 - DNA, 24 bp, Homo sapiens
aacctgttacctactttgactttt

SEQ ID NO: 5821349 - DNA, 18 bp, Homo sapiens
aacctgttcaaaatgtta

SEQ ID NO: 5821350 - DNA, 13 bp, Homo sapiens
aacctgttctgct

SEQ ID NO: 5821351 - DNA, 19 bp, Homo sapiens
aacctgttcttagagtgta

SEQ ID NO: 5821352 - DNA, 21 bp, Homo sapiens
aacctgttgatagcaagtgaa

SEQ ID NO: 5821353 - DNA, 23 bp, Homo sapiens
aacctgttgctgtgtttaatttg

SEQ ID NO: 5821354 - DNA, 16 bp, Homo sapiens
aaccttaaaacagctg

SEQ ID NO: 5821355 - DNA, 17 bp, Homo sapiens
aaccttaaaacagctgt

SEQ ID NO: 5821356 - DNA, 17 bp, Homo sapiens
aaccttaaaaggtactg

SEQ ID NO: 5821357 - DNA, 15 bp, Homo sapiens
aaccttaaaagtaat

SEQ ID NO: 5821358 - DNA, 19 bp, Homo sapiens
aaccttaaagcaataagtt

SEQ ID NO: 5821359 - DNA, 23 bp, Homo sapiens
aaccttaaaggccgtcatttcat

SEQ ID NO: 5821360 - DNA, 13 bp, Homo sapiens
aaccttaagacct

SEQ ID NO: 5821361 - DNA, 15 bp, Homo sapiens
aaccttaaggactta

SEQ ID NO: 5821362 - DNA, 17 bp, Homo sapiens
aaccttaatttattatt

SEQ ID NO: 5821363 - DNA, 18 bp, Homo sapiens
aaccttaatttattatta

SEQ ID NO: 5821364 - DNA, 18 bp, Homo sapiens
aaccttaatttgaaataa

SEQ ID NO: 5821365 - DNA, 16 bp, Homo sapiens
aaccttacttacagca

SEQ ID NO: 5821366 - DNA, 23 bp, Homo sapiens
aaccttagatgttctaagtcttt

SEQ ID NO: 5821367 - DNA, 19 bp, Homo sapiens
aaccttagtacctttttaa

SEQ ID NO: 5821368 - DNA, 23 bp, Homo sapiens
aaccttagtcatcagatatgctt

SEQ ID NO: 5821369 - DNA, 15 bp, Homo sapiens
aaccttatatttaca

SEQ ID NO: 5821370 - DNA, 17 bp, Homo sapiens
aaccttatcaaggattt

SEQ ID NO: 5821371 - DNA, 17 bp, Homo sapiens
aaccttatcctgcattg

SEQ ID NO: 5821372 - DNA, 19 bp, Homo sapiens
aaccttattttgataaaat

SEQ ID NO: 5821373 - DNA, 13 bp, Homo sapiens
aaccttcaaagaa

SEQ ID NO: 5821374 - DNA, 16 bp, Homo sapiens
aaccttcaaagaaact

SEQ ID NO: 5821375 - DNA, 13 bp, Homo sapiens
aaccttcaaagct

SEQ ID NO: 5821376 - DNA, 19 bp, Homo sapiens
aaccttcacatctgtcacg

SEQ ID NO: 5821377 - DNA, 16 bp, Homo sapiens
aaccttcacccagcac

SEQ ID NO: 5821378 - DNA, 15 bp, Homo sapiens
aaccttcagaagcta

SEQ ID NO: 5821379 - DNA, 15 bp, Homo sapiens
aaccttccacccagt

SEQ ID NO: 5821380 - DNA, 22 bp, Homo sapiens
aaccttccatacatttttttct

SEQ ID NO: 5821381 - DNA, 17 bp, Homo sapiens
aaccttccatctcgcca

SEQ ID NO: 5821382 - DNA, 19 bp, Homo sapiens
aaccttccatctcgccacc

SEQ ID NO: 5821383 - DNA, 21 bp, Homo sapiens
aaccttcctgggaggacaggc

SEQ ID NO: 5821384 - DNA, 18 bp, Homo sapiens
aaccttcctgtctcccag

SEQ ID NO: 5821385 - DNA, 12 bp, Homo sapiens
aaccttccttcc

SEQ ID NO: 5821386 - DNA, 13 bp, Homo sapiens
aaccttccttccc

SEQ ID NO: 5821387 - DNA, 15 bp, Homo sapiens
aaccttccttccctg

SEQ ID NO: 5821388 - DNA, 17 bp, Homo sapiens
aaccttccttccctggc

SEQ ID NO: 5821389 - DNA, 15 bp, Homo sapiens
aaccttcgtcctttt

SEQ ID NO: 5821390 - DNA, 13 bp, Homo sapiens
aaccttctcagga

SEQ ID NO: 5821391 - DNA, 13 bp, Homo sapiens
aaccttctctatg

SEQ ID NO: 5821392 - DNA, 14 bp, Homo sapiens
aactacaacttctc

SEQ ID NO: 5821393 - DNA, 15 bp, Homo sapiens
aactacagaatatta

SEQ ID NO: 5821394 - DNA, 20 bp, Homo sapiens
aactacagaatattaaatat

SEQ ID NO: 5821395 - DNA, 23 bp, Homo sapiens
aactacagccaaattgcagaaga

SEQ ID NO: 5821396 - DNA, 14 bp, Homo sapiens
aactacagtctaaa

SEQ ID NO: 5821397 - DNA, 14 bp, Homo sapiens
aactacataaaaat

SEQ ID NO: 5821398 - DNA, 13 bp, Homo sapiens
aactacatgagaa

SEQ ID NO: 5821399 - DNA, 13 bp, Homo sapiens
aactacatgttct

SEQ ID NO: 5821400 - DNA, 20 bp, Homo sapiens
aactacattaggttgtgaat

SEQ ID NO: 5821401 - DNA, 15 bp, Homo sapiens
aactacatttatgag

SEQ ID NO: 5821402 - DNA, 17 bp, Homo sapiens
aactacatttctactat

SEQ ID NO: 5821403 - DNA, 13 bp, Homo sapiens
aactaccaccctc

SEQ ID NO: 5821404 - DNA, 15 bp, Homo sapiens
aactaccacctcagg

SEQ ID NO: 5821405 - DNA, 21 bp, Homo sapiens
aactacccaaaacaagcctgg

SEQ ID NO: 5821406 - DNA, 15 bp, Homo sapiens
aactacccctcctca

SEQ ID NO: 5821407 - DNA, 19 bp, Homo sapiens
aactaccctctcaaatgga

SEQ ID NO: 5821408 - DNA, 22 bp, Homo sapiens
aactaccgttcccaaattggtg

SEQ ID NO: 5821409 - DNA, 17 bp, Homo sapiens
aactacctatattcctt

SEQ ID NO: 5821410 - DNA, 19 bp, Homo sapiens
aactacctatccttacatt

SEQ ID NO: 5821411 - DNA, 16 bp, Homo sapiens
aactacctcaaaacac

SEQ ID NO: 5821412 - DNA, 17 bp, Homo sapiens
aactacctcaaaacact

SEQ ID NO: 5821413 - DNA, 18 bp, Homo sapiens
aactacctcaaaacactt

SEQ ID NO: 5821414 - DNA, 20 bp, Homo sapiens
aactacctcgcatcattgca

SEQ ID NO: 5821415 - DNA, 23 bp, Homo sapiens
aactacctcgcatcattgcagat

SEQ ID NO: 5821416 - DNA, 23 bp, Homo sapiens
aactaccttgctagctagccagc

SEQ ID NO: 5821417 - DNA, 21 bp, Homo sapiens
aactacgtgacctctgcaaga

SEQ ID NO: 5821418 - DNA, 14 bp, Homo sapiens
aactactaagaata

SEQ ID NO: 5821419 - DNA, 17 bp, Homo sapiens
aactactaatagaataa

SEQ ID NO: 5821420 - DNA, 14 bp, Homo sapiens
aactactaattttt

SEQ ID NO: 5821421 - DNA, 22 bp, Homo sapiens
aactactactggtgatgcctaa

SEQ ID NO: 5821422 - DNA, 18 bp, Homo sapiens
aactactatctcagagat

SEQ ID NO: 5821423 - DNA, 22 bp, Homo sapiens
aactactcagctctcctgctgc

SEQ ID NO: 5821424 - DNA, 17 bp, Homo sapiens
aactactgacagggagc

SEQ ID NO: 5821425 - DNA, 17 bp, Homo sapiens
aactactgacgaaagag

SEQ ID NO: 5821426 - DNA, 18 bp, Homo sapiens
aactactgattacttgta

SEQ ID NO: 5821427 - DNA, 16 bp, Homo sapiens
aactactgcaccattt

SEQ ID NO: 5821428 - DNA, 17 bp, Homo sapiens
aactactgcaccattta

SEQ ID NO: 5821429 - DNA, 20 bp, Homo sapiens
aactactgcaccatttaaaa

SEQ ID NO: 5821430 - DNA, 12 bp, Homo sapiens
aactactgcctt

SEQ ID NO: 5821431 - DNA, 20 bp, Homo sapiens
aactactgcctttagaaaat

SEQ ID NO: 5821432 - DNA, 18 bp, Homo sapiens
aactactgctaatgttga

SEQ ID NO: 5821433 - DNA, 12 bp, Homo sapiens
aactactgtaat

SEQ ID NO: 5821434 - DNA, 23 bp, Homo sapiens
aactactgtaattaagtgcaatt

SEQ ID NO: 5821435 - DNA, 14 bp, Homo sapiens
aactactgtacttt

SEQ ID NO: 5821436 - DNA, 16 bp, Homo sapiens
aactactgtactttgc

SEQ ID NO: 5821437 - DNA, 20 bp, Homo sapiens
aactactgtagaactgattt

SEQ ID NO: 5821438 - DNA, 13 bp, Homo sapiens
aactactgtgttc

SEQ ID NO: 5821439 - DNA, 16 bp, Homo sapiens
aactactgtgttcctg

SEQ ID NO: 5821440 - DNA, 14 bp, Homo sapiens
aactacttgatttt

SEQ ID NO: 5821441 - DNA, 13 bp, Homo sapiens
aactactttctta

SEQ ID NO: 5821442 - DNA, 22 bp, Homo sapiens
aactactttgaaaacaattcag

SEQ ID NO: 5821443 - DNA, 13 bp, Homo sapiens
aactactttgaat

SEQ ID NO: 5821444 - DNA, 16 bp, Homo sapiens
aactactttgctgcta

SEQ ID NO: 5821445 - DNA, 23 bp, Homo sapiens
aactacttttgtaccagtgtgaa

SEQ ID NO: 5821446 - DNA, 20 bp, Homo sapiens
aactagaaatctgtcctgtg

SEQ ID NO: 5821447 - DNA, 13 bp, Homo sapiens
aactagaacaaat

SEQ ID NO: 5821448 - DNA, 20 bp, Homo sapiens
aactagaattagtatgtctg

SEQ ID NO: 5821449 - DNA, 21 bp, Homo sapiens
aactagaattagtatgtctgt

SEQ ID NO: 5821450 - DNA, 17 bp, Homo sapiens
aactagaatttcattta

SEQ ID NO: 5821451 - DNA, 16 bp, Homo sapiens
aactagacaagtaaaa

SEQ ID NO: 5821452 - DNA, 17 bp, Homo sapiens
aactagacaccaaagtt

SEQ ID NO: 5821453 - DNA, 18 bp, Homo sapiens
aactagacattctgtcgc

SEQ ID NO: 5821454 - DNA, 23 bp, Homo sapiens
aactagactcccaagctggacta

SEQ ID NO: 5821455 - DNA, 12 bp, Homo sapiens
aactagagaagg

SEQ ID NO: 5821456 - DNA, 13 bp, Homo sapiens
aactagagactct

SEQ ID NO: 5821457 - DNA, 16 bp, Homo sapiens
aactagagatgtgcaa

SEQ ID NO: 5821458 - DNA, 22 bp, Homo sapiens
aactagaggtgagaaatttaaa

SEQ ID NO: 5821459 - DNA, 16 bp, Homo sapiens
aactagagtatgtgta

SEQ ID NO: 5821460 - DNA, 20 bp, Homo sapiens
aactagagtatgtgtatgta

SEQ ID NO: 5821461 - DNA, 21 bp, Homo sapiens
aactagagtttagctggaaaa

SEQ ID NO: 5821462 - DNA, 18 bp, Homo sapiens
aactagataacttaaata

SEQ ID NO: 5821463 - DNA, 13 bp, Homo sapiens
aactagatacaga

SEQ ID NO: 5821464 - DNA, 16 bp, Homo sapiens
aactagatacagaata

SEQ ID NO: 5821465 - DNA, 23 bp, Homo sapiens
aactagatcaaggagcccagaaa

SEQ ID NO: 5821466 - DNA, 15 bp, Homo sapiens
aactagatctcctgt

SEQ ID NO: 5821467 - DNA, 15 bp, Homo sapiens
aactagatgacctca

SEQ ID NO: 5821468 - DNA, 20 bp, Homo sapiens
aactagatggtgctgagaag

SEQ ID NO: 5821469 - DNA, 13 bp, Homo sapiens
aactagatttgtc

SEQ ID NO: 5821470 - DNA, 23 bp, Homo sapiens
aactagcacagtaaaagtaaaga

SEQ ID NO: 5821471 - DNA, 18 bp, Homo sapiens
aactagcatatctgcctt

SEQ ID NO: 5821472 - DNA, 17 bp, Homo sapiens
aactagcattacattat

SEQ ID NO: 5821473 - DNA, 15 bp, Homo sapiens
aactagccaccaact

SEQ ID NO: 5821474 - DNA, 14 bp, Homo sapiens
aactagctgggact

SEQ ID NO: 5821475 - DNA, 13 bp, Homo sapiens
aactaggacctca

SEQ ID NO: 5821476 - DNA, 19 bp, Homo sapiens
aactaggccatttgtattt

SEQ ID NO: 5821477 - DNA, 18 bp, Homo sapiens
aactaggctcatactcaa

SEQ ID NO: 5821478 - DNA, 15 bp, Homo sapiens
aactaggctgagcaa

SEQ ID NO: 5821479 - DNA, 22 bp, Homo sapiens
aactaggcttctgtaatcaata

SEQ ID NO: 5821480 - DNA, 14 bp, Homo sapiens
aactaggggaggag

SEQ ID NO: 5821481 - DNA, 15 bp, Homo sapiens
aactaggggaggaga

SEQ ID NO: 5821482 - DNA, 21 bp, Homo sapiens
aactagggtccatatgaggga

SEQ ID NO: 5821483 - DNA, 16 bp, Homo sapiens
aactaggtaatgtttt

SEQ ID NO: 5821484 - DNA, 18 bp, Homo sapiens
aactaggtaatgttttgt

SEQ ID NO: 5821485 - DNA, 22 bp, Homo sapiens
aactaggttgctactttatttg

SEQ ID NO: 5821486 - DNA, 22 bp, Homo sapiens
aactaggtttaaaacagcctgg

SEQ ID NO: 5821487 - DNA, 23 bp, Homo sapiens
aactaggtttaaaacagcctggg

SEQ ID NO: 5821488 - DNA, 14 bp, Homo sapiens
aactagtgatgtag

SEQ ID NO: 5821489 - DNA, 14 bp, Homo sapiens
aactagtgtacatt

SEQ ID NO: 5821490 - DNA, 18 bp, Homo sapiens
aactagttattttataat

SEQ ID NO: 5821491 - DNA, 14 bp, Homo sapiens
aactagtttccagt

SEQ ID NO: 5821492 - DNA, 18 bp, Homo sapiens
aactagtttccagtggat

SEQ ID NO: 5821493 - DNA, 12 bp, Homo sapiens
aactataaaact

SEQ ID NO: 5821494 - DNA, 15 bp, Homo sapiens
aactataaagtttta

SEQ ID NO: 5821495 - DNA, 16 bp, Homo sapiens
aactataacaatcact

SEQ ID NO: 5821496 - DNA, 15 bp, Homo sapiens
aactataacattcaa

SEQ ID NO: 5821497 - DNA, 15 bp, Homo sapiens
aactataaggtgcct

SEQ ID NO: 5821498 - DNA, 17 bp, Homo sapiens
aactataaggtgcctca

SEQ ID NO: 5821499 - DNA, 19 bp, Homo sapiens
aactataaggtgcctcagt

SEQ ID NO: 5821500 - DNA, 16 bp, Homo sapiens
aactatacttgaacaa

SEQ ID NO: 5821501 - DNA, 18 bp, Homo sapiens
aactatacttgaacaaaa

SEQ ID NO: 5821502 - DNA, 20 bp, Homo sapiens
aactatacttgaacaaaagg

SEQ ID NO: 5821503 - DNA, 22 bp, Homo sapiens
aactatacttgaacaaaagggt

SEQ ID NO: 5821504 - DNA, 20 bp, Homo sapiens
aactatacttgatagtttgg

SEQ ID NO: 5821505 - DNA, 16 bp, Homo sapiens
aactatatataatgta

SEQ ID NO: 5821506 - DNA, 20 bp, Homo sapiens
aactatattcatttccactc

SEQ ID NO: 5821507 - DNA, 16 bp, Homo sapiens
aactatcaatatttaa

SEQ ID NO: 5821508 - DNA, 15 bp, Homo sapiens
aactatcatttttac

SEQ ID NO: 5821509 - DNA, 18 bp, Homo sapiens
aactatcatttttacact

SEQ ID NO: 5821510 - DNA, 21 bp, Homo sapiens
aactatccaattaaaattaag

SEQ ID NO: 5821511 - DNA, 21 bp, Homo sapiens
aactatcctatgccttcaaat

SEQ ID NO: 5821512 - DNA, 18 bp, Homo sapiens
aactatcctgacttctaa

SEQ ID NO: 5821513 - DNA, 21 bp, Homo sapiens
aactatccttctctttcaatg

SEQ ID NO: 5821514 - DNA, 16 bp, Homo sapiens
aactatcggttcaagt

SEQ ID NO: 5821515 - DNA, 23 bp, Homo sapiens
aactatctcatgccagtgcctta

SEQ ID NO: 5821516 - DNA, 17 bp, Homo sapiens
aactatctgtatttatt

SEQ ID NO: 5821517 - DNA, 19 bp, Homo sapiens
aactatcttctttggactt

SEQ ID NO: 5821518 - DNA, 18 bp, Homo sapiens
aactatcttggtgaattt

SEQ ID NO: 5821519 - DNA, 14 bp, Homo sapiens
aactatgaaaagtg

SEQ ID NO: 5821520 - DNA, 15 bp, Homo sapiens
aactatgaacactgt

SEQ ID NO: 5821521 - DNA, 17 bp, Homo sapiens
aactatgaactacaaag

SEQ ID NO: 5821522 - DNA, 19 bp, Homo sapiens
aactatgacaatttttgct

SEQ ID NO: 5821523 - DNA, 23 bp, Homo sapiens
aactatgacaatttttgctgttt

SEQ ID NO: 5821524 - DNA, 13 bp, Homo sapiens
aactatgacagat

SEQ ID NO: 5821525 - DNA, 18 bp, Homo sapiens
aactatgatatggtaaaa

SEQ ID NO: 5821526 - DNA, 20 bp, Homo sapiens
aactatgatttattttggtg

SEQ ID NO: 5821527 - DNA, 16 bp, Homo sapiens
aactatgatttggaaa

SEQ ID NO: 5821528 - DNA, 16 bp, Homo sapiens
aactatgcatctgaga

SEQ ID NO: 5821529 - DNA, 17 bp, Homo sapiens
aactatggaatagatta

SEQ ID NO: 5821530 - DNA, 18 bp, Homo sapiens
aactatggcaaggaactt

SEQ ID NO: 5821531 - DNA, 16 bp, Homo sapiens
aactatgggttatttt

SEQ ID NO: 5821532 - DNA, 17 bp, Homo sapiens
aactatggttcccaata

SEQ ID NO: 5821533 - DNA, 22 bp, Homo sapiens
aactatggttcccaataaaagt

SEQ ID NO: 5821534 - DNA, 23 bp, Homo sapiens
aactatggttcccaataaaagtg

SEQ ID NO: 5821535 - DNA, 14 bp, Homo sapiens
aactatgtaaacaa

SEQ ID NO: 5821536 - DNA, 14 bp, Homo sapiens
aactatgtaataat

SEQ ID NO: 5821537 - DNA, 21 bp, Homo sapiens
aactatgtaatgcttatgtgt

SEQ ID NO: 5821538 - DNA, 16 bp, Homo sapiens
aactatgtacaatatt

SEQ ID NO: 5821539 - DNA, 20 bp, Homo sapiens
aactatgtacaatattttaa

SEQ ID NO: 5821540 - DNA, 23 bp, Homo sapiens
aactatgtgctatcacatgtgaa

SEQ ID NO: 5821541 - DNA, 20 bp, Homo sapiens
aactatgtgtttttctcata

SEQ ID NO: 5821542 - DNA, 22 bp, Homo sapiens
aactatgtgtttttctcatatt

SEQ ID NO: 5821543 - DNA, 21 bp, Homo sapiens
aactatgttcctaacaaaatg

SEQ ID NO: 5821544 - DNA, 15 bp, Homo sapiens
aactatgttgataaa

SEQ ID NO: 5821545 - DNA, 20 bp, Homo sapiens
aactattaaccttttttgtc

SEQ ID NO: 5821546 - DNA, 22 bp, Homo sapiens
aactattaagaggcagaaaatt

SEQ ID NO: 5821547 - DNA, 21 bp, Homo sapiens
aactattaattccatgtgata

SEQ ID NO: 5821548 - DNA, 13 bp, Homo sapiens
aactattcacaaa

SEQ ID NO: 5821549 - DNA, 15 bp, Homo sapiens
aactattcagaggaa

SEQ ID NO: 5821550 - DNA, 19 bp, Homo sapiens
aactattcattttgcttct

SEQ ID NO: 5821551 - DNA, 15 bp, Homo sapiens
aactattccatgttt

SEQ ID NO: 5821552 - DNA, 18 bp, Homo sapiens
aactattccatgttttaa

SEQ ID NO: 5821553 - DNA, 17 bp, Homo sapiens
aactattcgaatgaaaa

SEQ ID NO: 5821554 - DNA, 19 bp, Homo sapiens
aactattcttcatttacaa

SEQ ID NO: 5821555 - DNA, 12 bp, Homo sapiens
aactattgaatt

SEQ ID NO: 5821556 - DNA, 15 bp, Homo sapiens
aactattgagccttg

SEQ ID NO: 5821557 - DNA, 16 bp, Homo sapiens
aactattgagccttgc

SEQ ID NO: 5821558 - DNA, 15 bp, Homo sapiens
aactattgcatttat

SEQ ID NO: 5821559 - DNA, 15 bp, Homo sapiens
aactattgtgttttt

SEQ ID NO: 5821560 - DNA, 19 bp, Homo sapiens
aactatttaaaataaagag

SEQ ID NO: 5821561 - DNA, 17 bp, Homo sapiens
aactatttaaaattggc

SEQ ID NO: 5821562 - DNA, 19 bp, Homo sapiens
aactatttaaaattggcac

SEQ ID NO: 5821563 - DNA, 17 bp, Homo sapiens
aactatttaaagaaata

SEQ ID NO: 5821564 - DNA, 23 bp, Homo sapiens
aactatttaacttgagctttaaa

SEQ ID NO: 5821565 - DNA, 16 bp, Homo sapiens
aactatttattaaaaa

SEQ ID NO: 5821566 - DNA, 21 bp, Homo sapiens
aactatttattaaaaacatga

SEQ ID NO: 5821567 - DNA, 21 bp, Homo sapiens
aactatttattgactctgggt

SEQ ID NO: 5821568 - DNA, 17 bp, Homo sapiens
aactatttattgtgctg

SEQ ID NO: 5821569 - DNA, 15 bp, Homo sapiens
aactgaataaaaaat

SEQ ID NO: 5821570 - DNA, 14 bp, Homo sapiens
aactgaataccact

SEQ ID NO: 5821571 - DNA, 15 bp, Homo sapiens
aactgaataccactc

SEQ ID NO: 5821572 - DNA, 21 bp, Homo sapiens
aactgaataccactctgtaat

SEQ ID NO: 5821573 - DNA, 15 bp, Homo sapiens
aactgaatattttgg

SEQ ID NO: 5821574 - DNA, 17 bp, Homo sapiens
aactgaatattttggaa

SEQ ID NO: 5821575 - DNA, 18 bp, Homo sapiens
aactgaatccatatttca

SEQ ID NO: 5821576 - DNA, 12 bp, Homo sapiens
aactgaatgaat

SEQ ID NO: 5821577 - DNA, 22 bp, Homo sapiens
aactgaatggaaggtttgtata

SEQ ID NO: 5821578 - DNA, 22 bp, Homo sapiens
aactgaattctggacagattta

SEQ ID NO: 5821579 - DNA, 19 bp, Homo sapiens
aactgaattgctatcattt

SEQ ID NO: 5821580 - DNA, 21 bp, Homo sapiens
aactgaatttgttcttaaaaa

SEQ ID NO: 5821581 - DNA, 10 bp, Homo sapiens
aactgacaag

SEQ ID NO: 5821582 - DNA, 17 bp, Homo sapiens
aactgacaagccatctt

SEQ ID NO: 5821583 - DNA, 19 bp, Homo sapiens
aactgacaagctccattta

SEQ ID NO: 5821584 - DNA, 20 bp, Homo sapiens
aactgacaagctccatttaa

SEQ ID NO: 5821585 - DNA, 11 bp, Homo sapiens
aactgacacag

SEQ ID NO: 5821586 - DNA, 13 bp, Homo sapiens
aactgacacagga

SEQ ID NO: 5821587 - DNA, 22 bp, Homo sapiens
aactgacagggcccagttaaat

SEQ ID NO: 5821588 - DNA, 16 bp, Homo sapiens
aactgacatcagattt

SEQ ID NO: 5821589 - DNA, 18 bp, Homo sapiens
aactgacatcagatttct

SEQ ID NO: 5821590 - DNA, 19 bp, Homo sapiens
aactgacatcagatttctt

SEQ ID NO: 5821591 - DNA, 12 bp, Homo sapiens
aactgacatgat

SEQ ID NO: 5821592 - DNA, 21 bp, Homo sapiens
aactgaccctcaggcacacct

SEQ ID NO: 5821593 - DNA, 22 bp, Homo sapiens
aactgaccctcaggcacacctt

SEQ ID NO: 5821594 - DNA, 15 bp, Homo sapiens
aactgaccctccctt

SEQ ID NO: 5821595 - DNA, 23 bp, Homo sapiens
aactgacctgaccccattcctga

SEQ ID NO: 5821596 - DNA, 23 bp, Homo sapiens
aactgacctgagcggcaccctgg

SEQ ID NO: 5821597 - DNA, 15 bp, Homo sapiens
aactgacgctggaga

SEQ ID NO: 5821598 - DNA, 22 bp, Homo sapiens
aactgactatcataaaatcaaa

SEQ ID NO: 5821599 - DNA, 20 bp, Homo sapiens
aactgactattcttgatgta

SEQ ID NO: 5821600 - DNA, 20 bp, Homo sapiens
aactgactcccattttggtg

SEQ ID NO: 5821601 - DNA, 16 bp, Homo sapiens
aactgactctgttatt

SEQ ID NO: 5821602 - DNA, 19 bp, Homo sapiens
aactgacttcatttgtgcc

SEQ ID NO: 5821603 - DNA, 13 bp, Homo sapiens
aactgacttctgc

SEQ ID NO: 5821604 - DNA, 14 bp, Homo sapiens
aactgacttctgct

SEQ ID NO: 5821605 - DNA, 13 bp, Homo sapiens
aactgacttgctg

SEQ ID NO: 5821606 - DNA, 18 bp, Homo sapiens
aactgactttatcctcag

SEQ ID NO: 5821607 - DNA, 22 bp, Homo sapiens
aactgactttatttattgctta

SEQ ID NO: 5821608 - DNA, 23 bp, Homo sapiens
aactgagaaagagagagatacat

SEQ ID NO: 5821609 - DNA, 17 bp, Homo sapiens
aactgagaatttgtgtg

SEQ ID NO: 5821610 - DNA, 14 bp, Homo sapiens
aactgagagaaaga

SEQ ID NO: 5821611 - DNA, 14 bp, Homo sapiens
aactgagagaagta

SEQ ID NO: 5821612 - DNA, 23 bp, Homo sapiens
aactgagagcagatggtcctcca

SEQ ID NO: 5821613 - DNA, 16 bp, Homo sapiens
aactgagagtaattca

SEQ ID NO: 5821614 - DNA, 18 bp, Homo sapiens
aactgagagtcatataca

SEQ ID NO: 5821615 - DNA, 21 bp, Homo sapiens
aactgagccaaacacactgta

SEQ ID NO: 5821616 - DNA, 22 bp, Homo sapiens
aactgagccaaacacactgtaa

SEQ ID NO: 5821617 - DNA, 19 bp, Homo sapiens
aactgagccgtgcagctgg

SEQ ID NO: 5821618 - DNA, 21 bp, Homo sapiens
aactgagccgtgcagctggga

SEQ ID NO: 5821619 - DNA, 22 bp, Homo sapiens
aactgagccgtgcagctgggat

SEQ ID NO: 5821620 - DNA, 11 bp, Homo sapiens
aactgagccta

SEQ ID NO: 5821621 - DNA, 12 bp, Homo sapiens
aactgagcctag

SEQ ID NO: 5821622 - DNA, 16 bp, Homo sapiens
aactgagcctagctac

SEQ ID NO: 5821623 - DNA, 20 bp, Homo sapiens
aactgagctgggcaggaagg

SEQ ID NO: 5821624 - DNA, 21 bp, Homo sapiens
aactgagcttggaagcttctg

SEQ ID NO: 5821625 - DNA, 18 bp, Homo sapiens
aactgaggaatttcacct

SEQ ID NO: 5821626 - DNA, 20 bp, Homo sapiens
aactgaggagatgaccaggg

SEQ ID NO: 5821627 - DNA, 19 bp, Homo sapiens
aactgaggagtagctgaga

SEQ ID NO: 5821628 - DNA, 23 bp, Homo sapiens
aactgaggatgacccggggcagc

SEQ ID NO: 5821629 - DNA, 13 bp, Homo sapiens
aactgaggcccag

SEQ ID NO: 5821630 - DNA, 15 bp, Homo sapiens
aactgaggcccagag

SEQ ID NO: 5821631 - DNA, 21 bp, Homo sapiens
aactgaggcccagagagctga

SEQ ID NO: 5821632 - DNA, 21 bp, Homo sapiens
aactgaggcccagagagggaa

SEQ ID NO: 5821633 - DNA, 13 bp, Homo sapiens
aactgaggccctg

SEQ ID NO: 5821634 - DNA, 15 bp, Homo sapiens
aactgaggccctgtg

SEQ ID NO: 5821635 - DNA, 20 bp, Homo sapiens
aactgagggcagagaggtta

SEQ ID NO: 5821636 - DNA, 18 bp, Homo sapiens
aactgagggccagggacc

SEQ ID NO: 5821637 - DNA, 21 bp, Homo sapiens
aactgagggccagggacccag

SEQ ID NO: 5821638 - DNA, 17 bp, Homo sapiens
aactgagtcactcacat

SEQ ID NO: 5821639 - DNA, 18 bp, Homo sapiens
aactgagtcactcacatt

SEQ ID NO: 5821640 - DNA, 22 bp, Homo sapiens
aactgagtcactcacattgaga

SEQ ID NO: 5821641 - DNA, 18 bp, Homo sapiens
aactgagtccatgaaaat

SEQ ID NO: 5821642 - DNA, 23 bp, Homo sapiens
aactgagtccatgaaaataccat

SEQ ID NO: 5821643 - DNA, 16 bp, Homo sapiens
aactgagtgccttttg

SEQ ID NO: 5821644 - DNA, 14 bp, Homo sapiens
aactgataaagatg

SEQ ID NO: 5821645 - DNA, 23 bp, Homo sapiens
aactgatacatctgatgcatgct

SEQ ID NO: 5821646 - DNA, 19 bp, Homo sapiens
aactgatagttactgttgt

SEQ ID NO: 5821647 - DNA, 16 bp, Homo sapiens
aactgatcatgtttat

SEQ ID NO: 5821648 - DNA, 18 bp, Homo sapiens
aactgatcatgtttatga

SEQ ID NO: 5821649 - DNA, 21 bp, Homo sapiens
aactgatcatttgcagctgct

SEQ ID NO: 5821650 - DNA, 17 bp, Homo sapiens
aactgatccagcaatta

SEQ ID NO: 5821651 - DNA, 15 bp, Homo sapiens
aactgatcctgctcc

SEQ ID NO: 5821652 - DNA, 16 bp, Homo sapiens
aactgatcctgctcca

SEQ ID NO: 5821653 - DNA, 14 bp, Homo sapiens
aactgatctattta

SEQ ID NO: 5821654 - DNA, 18 bp, Homo sapiens
aactgatgagatacattt

SEQ ID NO: 5821655 - DNA, 23 bp, Homo sapiens
aactgatgatgacaggtcagcag

SEQ ID NO: 5821656 - DNA, 23 bp, Homo sapiens
aactgatgcgacttgttttgctg

SEQ ID NO: 5821657 - DNA, 14 bp, Homo sapiens
aactgatgctttca

SEQ ID NO: 5821658 - DNA, 16 bp, Homo sapiens
aactgatgctttcaga

SEQ ID NO: 5821659 - DNA, 15 bp, Homo sapiens
aactgatggcaatat

SEQ ID NO: 5821660 - DNA, 19 bp, Homo sapiens
aactgatggcaatattaag

SEQ ID NO: 5821661 - DNA, 13 bp, Homo sapiens
aactgatgtactg

SEQ ID NO: 5821662 - DNA, 19 bp, Homo sapiens
aactgatgtatagctttaa

SEQ ID NO: 5821663 - DNA, 14 bp, Homo sapiens
aactgatgtgaaac

SEQ ID NO: 5821664 - DNA, 15 bp, Homo sapiens
aactgattaaaaata

SEQ ID NO: 5821665 - DNA, 17 bp, Homo sapiens
aactgattacctgccaa

SEQ ID NO: 5821666 - DNA, 17 bp, Homo sapiens
aactgattcacatctca

SEQ ID NO: 5821667 - DNA, 13 bp, Homo sapiens
aactgattcataa

SEQ ID NO: 5821668 - DNA, 23 bp, Homo sapiens
aactgattctctatgacatgaaa

SEQ ID NO: 5821669 - DNA, 15 bp, Homo sapiens
aactgatttaacact

SEQ ID NO: 5821670 - DNA, 17 bp, Homo sapiens
aactgatttaacacttt

SEQ ID NO: 5821671 - DNA, 18 bp, Homo sapiens
aactgatttaacactttt

SEQ ID NO: 5821672 - DNA, 14 bp, Homo sapiens
aactgatttctatg

SEQ ID NO: 5821673 - DNA, 19 bp, Homo sapiens
aactgatttctatggcttt

SEQ ID NO: 5821674 - DNA, 22 bp, Homo sapiens
aactgatttctatggctttcaa

SEQ ID NO: 5821675 - DNA, 14 bp, Homo sapiens
aactgatttctcac

SEQ ID NO: 5821676 - DNA, 22 bp, Homo sapiens
aactgattttacaaattaatat

SEQ ID NO: 5821677 - DNA, 19 bp, Homo sapiens
aactgatttttttttcctt

SEQ ID NO: 5821678 - DNA, 22 bp, Homo sapiens
aactgatttttttttccttcag

SEQ ID NO: 5821679 - DNA, 23 bp, Homo sapiens
aactgatttttttttccttcagt

SEQ ID NO: 5821680 - DNA, 14 bp, Homo sapiens
aactgcaaagcttt

SEQ ID NO: 5821681 - DNA, 22 bp, Homo sapiens
aactgcaaagctttggctgaga

SEQ ID NO: 5821682 - DNA, 12 bp, Homo sapiens
aactgcaacact

SEQ ID NO: 5821683 - DNA, 17 bp, Homo sapiens
aactgcaaccttgttta

SEQ ID NO: 5821684 - DNA, 18 bp, Homo sapiens
aactgcaaccttgtttat

SEQ ID NO: 5821685 - DNA, 18 bp, Homo sapiens
aactgcaagtcacaaagg

SEQ ID NO: 5821686 - DNA, 21 bp, Homo sapiens
aactgcaataacttctgacct

SEQ ID NO: 5821687 - DNA, 20 bp, Homo sapiens
aactgcaatacaagtttcat

SEQ ID NO: 5821688 - DNA, 22 bp, Homo sapiens
aactgcaatgaaagtcaaattt

SEQ ID NO: 5821689 - DNA, 19 bp, Homo sapiens
aactgcacactatttccct

SEQ ID NO: 5821690 - DNA, 14 bp, Homo sapiens
aactgcacagtgct

SEQ ID NO: 5821691 - DNA, 15 bp, Homo sapiens
aactgcacagtgctg

SEQ ID NO: 5821692 - DNA, 11 bp, Homo sapiens
aactgcacatc

SEQ ID NO: 5821693 - DNA, 17 bp, Homo sapiens
aactgcacatgaagaaa

SEQ ID NO: 5821694 - DNA, 20 bp, Homo sapiens
aactgcacatgatttcacaa

SEQ ID NO: 5821695 - DNA, 21 bp, Homo sapiens
aactgcacatgatttcacaaa

SEQ ID NO: 5821696 - DNA, 23 bp, Homo sapiens
aactgcacatgatttcacaaata

SEQ ID NO: 5821697 - DNA, 20 bp, Homo sapiens
aactgcaccagttgctgctt

SEQ ID NO: 5821698 - DNA, 14 bp, Homo sapiens
aactgcacgttcta

SEQ ID NO: 5821699 - DNA, 21 bp, Homo sapiens
aactgcactcatagggtgctc

SEQ ID NO: 5821700 - DNA, 22 bp, Homo sapiens
aactgcactcatagggtgctct

SEQ ID NO: 5821701 - DNA, 19 bp, Homo sapiens
aactgcactgtcaagatga

SEQ ID NO: 5821702 - DNA, 13 bp, Homo sapiens
aactgcactttta

SEQ ID NO: 5821703 - DNA, 18 bp, Homo sapiens
aactgcagacctgtcctc

SEQ ID NO: 5821704 - DNA, 22 bp, Homo sapiens
aactgcagagtaaattgctctg

SEQ ID NO: 5821705 - DNA, 19 bp, Homo sapiens
aactgcagatagcccagga

SEQ ID NO: 5821706 - DNA, 21 bp, Homo sapiens
aactgcagatagcccaggagc

SEQ ID NO: 5821707 - DNA, 12 bp, Homo sapiens
aactgcagcaat

SEQ ID NO: 5821708 - DNA, 12 bp, Homo sapiens
aactgcagcctc

SEQ ID NO: 5821709 - DNA, 21 bp, Homo sapiens
aactgcagcctctctggctgg

SEQ ID NO: 5821710 - DNA, 14 bp, Homo sapiens
aactgcaggaagag

SEQ ID NO: 5821711 - DNA, 15 bp, Homo sapiens
aactgcaggaagaga

SEQ ID NO: 5821712 - DNA, 14 bp, Homo sapiens
aactgcaggaatgc

SEQ ID NO: 5821713 - DNA, 19 bp, Homo sapiens
aactgcaggaatgctgaca

SEQ ID NO: 5821714 - DNA, 19 bp, Homo sapiens
aactgcaggagcagtttgc

SEQ ID NO: 5821715 - DNA, 16 bp, Homo sapiens
aactgcaggccctggc

SEQ ID NO: 5821716 - DNA, 17 bp, Homo sapiens
aactgcaggccctggcc

SEQ ID NO: 5821717 - DNA, 18 bp, Homo sapiens
aactgcaggccctggcct

SEQ ID NO: 5821718 - DNA, 20 bp, Homo sapiens
aactgcagtcatcaacaatg

SEQ ID NO: 5821719 - DNA, 21 bp, Homo sapiens
aactgcagtcatcaacaatga

SEQ ID NO: 5821720 - DNA, 20 bp, Homo sapiens
aactgcagtgggttctccaa

SEQ ID NO: 5821721 - DNA, 13 bp, Homo sapiens
aactgcagtttga

SEQ ID NO: 5821722 - DNA, 18 bp, Homo sapiens
aactgcatacgttttggt

SEQ ID NO: 5821723 - DNA, 16 bp, Homo sapiens
aactgcatatagataa

SEQ ID NO: 5821724 - DNA, 15 bp, Homo sapiens
aactgcatcaagact

SEQ ID NO: 5821725 - DNA, 17 bp, Homo sapiens
aactgcatcaagacttc

SEQ ID NO: 5821726 - DNA, 20 bp, Homo sapiens
aactgcatccaggcctgagg

SEQ ID NO: 5821727 - DNA, 22 bp, Homo sapiens
aactgcatcccacgttctgtta

SEQ ID NO: 5821728 - DNA, 23 bp, Homo sapiens
aactgcatcgatccccagcctgg

SEQ ID NO: 5821729 - DNA, 15 bp, Homo sapiens
aactgcatggaccta

SEQ ID NO: 5821730 - DNA, 19 bp, Homo sapiens
aactgcatgtataaatgaa

SEQ ID NO: 5821731 - DNA, 21 bp, Homo sapiens
aactgcattaccgcgttgtaa

SEQ ID NO: 5821732 - DNA, 14 bp, Homo sapiens
aactgcattgagaa

SEQ ID NO: 5821733 - DNA, 21 bp, Homo sapiens
aactgcattggttttccatga

SEQ ID NO: 5821734 - DNA, 13 bp, Homo sapiens
aactgcattttac

SEQ ID NO: 5821735 - DNA, 18 bp, Homo sapiens
aactgcattttgtagcct

SEQ ID NO: 5821736 - DNA, 23 bp, Homo sapiens
aactgcattttgtagcctctctt

SEQ ID NO: 5821737 - DNA, 21 bp, Homo sapiens
aactgcatttttaatcagtgg

SEQ ID NO: 5821738 - DNA, 14 bp, Homo sapiens
aactgccaaaacaa

SEQ ID NO: 5821739 - DNA, 18 bp, Homo sapiens
aactgccaaaatgctcta

SEQ ID NO: 5821740 - DNA, 17 bp, Homo sapiens
aactgccaaacctcctg

SEQ ID NO: 5821741 - DNA, 21 bp, Homo sapiens
aactgccaaataaaatgttta

SEQ ID NO: 5821742 - DNA, 15 bp, Homo sapiens
aactgccaagaaatt

SEQ ID NO: 5821743 - DNA, 10 bp, Homo sapiens
aactgccaca

SEQ ID NO: 5821744 - DNA, 14 bp, Homo sapiens
aactgccacaagca

SEQ ID NO: 5821745 - DNA, 22 bp, Homo sapiens
aactgtttggtcgagtctttgt

SEQ ID NO: 5821746 - DNA, 18 bp, Homo sapiens
aactgttttagaaattgg

SEQ ID NO: 5821747 - DNA, 15 bp, Homo sapiens
aactgttttcttctt

SEQ ID NO: 5821748 - DNA, 22 bp, Homo sapiens
aactgttttgtatatgctgcat

SEQ ID NO: 5821749 - DNA, 15 bp, Homo sapiens
aactgttttttaagt

SEQ ID NO: 5821750 - DNA, 16 bp, Homo sapiens
aacttaaaaaactgca

SEQ ID NO: 5821751 - DNA, 13 bp, Homo sapiens
aacttaaaacata

SEQ ID NO: 5821752 - DNA, 14 bp, Homo sapiens
aacttaaaagaaca

SEQ ID NO: 5821753 - DNA, 15 bp, Homo sapiens
aacttaaaagattca

SEQ ID NO: 5821754 - DNA, 22 bp, Homo sapiens
aacttaaaagcaagatctacta

SEQ ID NO: 5821755 - DNA, 13 bp, Homo sapiens
aacttaaaatatt

SEQ ID NO: 5821756 - DNA, 14 bp, Homo sapiens
aacttaaaatattt

SEQ ID NO: 5821757 - DNA, 14 bp, Homo sapiens
aacttaaacaaaaa

SEQ ID NO: 5821758 - DNA, 14 bp, Homo sapiens
aacttaaataataa

SEQ ID NO: 5821759 - DNA, 17 bp, Homo sapiens
aacttaaataatgtgaa

SEQ ID NO: 5821760 - DNA, 19 bp, Homo sapiens
aacttaaataatgtgaaac

SEQ ID NO: 5821761 - DNA, 16 bp, Homo sapiens
aacttaaatagctttg

SEQ ID NO: 5821762 - DNA, 17 bp, Homo sapiens
aacttaaatattgtaat

SEQ ID NO: 5821763 - DNA, 13 bp, Homo sapiens
aacttaaatcact

SEQ ID NO: 5821764 - DNA, 14 bp, Homo sapiens
aacttaaatcactg

SEQ ID NO: 5821765 - DNA, 16 bp, Homo sapiens
aacttaaatcactgag

SEQ ID NO: 5821766 - DNA, 19 bp, Homo sapiens
aacttaaatgttattatct

SEQ ID NO: 5821767 - DNA, 16 bp, Homo sapiens
aacttaaattttaatt

SEQ ID NO: 5821768 - DNA, 16 bp, Homo sapiens
aacttaacatatttac

SEQ ID NO: 5821769 - DNA, 13 bp, Homo sapiens
aacttaacatgct

SEQ ID NO: 5821770 - DNA, 20 bp, Homo sapiens
aacttaacatggaagatatt

SEQ ID NO: 5821771 - DNA, 16 bp, Homo sapiens
aacttaacattctgta

SEQ ID NO: 5821772 - DNA, 18 bp, Homo sapiens
aacttaaccgcatcagaa

SEQ ID NO: 5821773 - DNA, 13 bp, Homo sapiens
aacttaactgaaa

SEQ ID NO: 5821774 - DNA, 14 bp, Homo sapiens
aacttaactgaaga

SEQ ID NO: 5821775 - DNA, 13 bp, Homo sapiens
aacttaacttaaa

SEQ ID NO: 5821776 - DNA, 13 bp, Homo sapiens
aacttaactttaa

SEQ ID NO: 5821777 - DNA, 18 bp, Homo sapiens
aacttaagatgaatacat

SEQ ID NO: 5821778 - DNA, 15 bp, Homo sapiens
aacttaagcataaaa

SEQ ID NO: 5821779 - DNA, 17 bp, Homo sapiens
aacttaagcataaaaat

SEQ ID NO: 5821780 - DNA, 22 bp, Homo sapiens
aacttaagccaatttcaatctt

SEQ ID NO: 5821781 - DNA, 15 bp, Homo sapiens
aacttaagtatattt

SEQ ID NO: 5821782 - DNA, 13 bp, Homo sapiens
aacttaagtattt

SEQ ID NO: 5821783 - DNA, 21 bp, Homo sapiens
aacttaagtttagaaattaca

SEQ ID NO: 5821784 - DNA, 22 bp, Homo sapiens
aacttaagtttagaaattacaa

SEQ ID NO: 5821785 - DNA, 12 bp, Homo sapiens
aacttaatgaag

SEQ ID NO: 5821786 - DNA, 13 bp, Homo sapiens
aacttaatgaaga

SEQ ID NO: 5821787 - DNA, 20 bp, Homo sapiens
aacttaatgttctgaataat

SEQ ID NO: 5821788 - DNA, 22 bp, Homo sapiens
aacttaatgttcttatgcaaaa

SEQ ID NO: 5821789 - DNA, 18 bp, Homo sapiens
aacttacaaactggtttg

SEQ ID NO: 5821790 - DNA, 21 bp, Homo sapiens
aacttacaaagattctctatg

SEQ ID NO: 5821791 - DNA, 21 bp, Homo sapiens
aacttacaagactgtaaattc

SEQ ID NO: 5821792 - DNA, 13 bp, Homo sapiens
aacttacacacaa

SEQ ID NO: 5821793 - DNA, 23 bp, Homo sapiens
aacttacattgtgaaacttctgt

SEQ ID NO: 5821794 - DNA, 17 bp, Homo sapiens
aacttaccaattgatgt

SEQ ID NO: 5821795 - DNA, 21 bp, Homo sapiens
aacttaccaattgatgtttta

SEQ ID NO: 5821796 - DNA, 23 bp, Homo sapiens
aacttaccctgtatatcagggta

SEQ ID NO: 5821797 - DNA, 19 bp, Homo sapiens
aacttacctgggcattctt

SEQ ID NO: 5821798 - DNA, 20 bp, Homo sapiens
aacttacggatttattatat

SEQ ID NO: 5821799 - DNA, 23 bp, Homo sapiens
aacttactattcattaaatgttt

SEQ ID NO: 5821800 - DNA, 12 bp, Homo sapiens
aacttagaaaag

SEQ ID NO: 5821801 - DNA, 14 bp, Homo sapiens
aacttagaaatatg

SEQ ID NO: 5821802 - DNA, 15 bp, Homo sapiens
aacttagaaatatgc

SEQ ID NO: 5821803 - DNA, 19 bp, Homo sapiens
aacttagatgttaaatgtt

SEQ ID NO: 5821804 - DNA, 19 bp, Homo sapiens
aacttagattttacatgaa

SEQ ID NO: 5821805 - DNA, 19 bp, Homo sapiens
aacttagcatgtgttgaaa

SEQ ID NO: 5821806 - DNA, 21 bp, Homo sapiens
aacttagcattttctgcatct

SEQ ID NO: 5821807 - DNA, 19 bp, Homo sapiens
aacttagccagagttaggt

SEQ ID NO: 5821808 - DNA, 13 bp, Homo sapiens
aacttagctcagg

SEQ ID NO: 5821809 - DNA, 21 bp, Homo sapiens
aacttagcttatgagtagctt

SEQ ID NO: 5821810 - DNA, 20 bp, Homo sapiens
aacttagcttgcacatgaat

SEQ ID NO: 5821811 - DNA, 13 bp, Homo sapiens
aacttagctttat

SEQ ID NO: 5821812 - DNA, 14 bp, Homo sapiens
aacttagctttatt

SEQ ID NO: 5821813 - DNA, 21 bp, Homo sapiens
aacttaggcatgcacagctgt

SEQ ID NO: 5821814 - DNA, 13 bp, Homo sapiens
aacttagtatttt

SEQ ID NO: 5821815 - DNA, 23 bp, Homo sapiens
aacttagtgcggacaagttttaa

SEQ ID NO: 5821816 - DNA, 19 bp, Homo sapiens
aacttagtgtctctattta

SEQ ID NO: 5821817 - DNA, 12 bp, Homo sapiens
aacttagttttg

SEQ ID NO: 5821818 - DNA, 16 bp, Homo sapiens
aacttagttttgcata

SEQ ID NO: 5821819 - DNA, 16 bp, Homo sapiens
aacttagtttttatct

SEQ ID NO: 5821820 - DNA, 13 bp, Homo sapiens
aacttataatgat

SEQ ID NO: 5821821 - DNA, 18 bp, Homo sapiens
aacttataatttccaaac

SEQ ID NO: 5821822 - DNA, 21 bp, Homo sapiens
aacttatagttaatattttgt

SEQ ID NO: 5821823 - DNA, 12 bp, Homo sapiens
aacttatattga

SEQ ID NO: 5821824 - DNA, 24 bp, Homo sapiens
aacttatgaagtaaagtttctgat

SEQ ID NO: 5821825 - DNA, 15 bp, Homo sapiens
aacttatgactaaaa

SEQ ID NO: 5821826 - DNA, 21 bp, Homo sapiens
aacttatggactgttttgata

SEQ ID NO: 5821827 - DNA, 18 bp, Homo sapiens
aacttatgtagatatttg

SEQ ID NO: 5821828 - DNA, 20 bp, Homo sapiens
aacttattaacaactgtgaa

SEQ ID NO: 5821829 - DNA, 22 bp, Homo sapiens
aacttattaacaactgtgaata

SEQ ID NO: 5821830 - DNA, 16 bp, Homo sapiens
aacttattacctcagg

SEQ ID NO: 5821831 - DNA, 22 bp, Homo sapiens
aacttattcaaagagaaaacat

SEQ ID NO: 5821832 - DNA, 21 bp, Homo sapiens
aacttattccaggtattaaag

SEQ ID NO: 5821833 - DNA, 14 bp, Homo sapiens
aacttattctgtag

SEQ ID NO: 5821834 - DNA, 22 bp, Homo sapiens
aacttattgcctgggcagtgcc

SEQ ID NO: 5821835 - DNA, 23 bp, Homo sapiens
aacttattgcctgggcagtgccc

SEQ ID NO: 5821836 - DNA, 21 bp, Homo sapiens
aacttattgctgattttaatg

SEQ ID NO: 5821837 - DNA, 19 bp, Homo sapiens
aacttattgtggcccagat

SEQ ID NO: 5821838 - DNA, 21 bp, Homo sapiens
aacttatttaaaaatatttca

SEQ ID NO: 5821839 - DNA, 17 bp, Homo sapiens
aacttatttatatgaag

SEQ ID NO: 5821840 - DNA, 21 bp, Homo sapiens
aacttatttatatgaagcaag

SEQ ID NO: 5821841 - DNA, 15 bp, Homo sapiens
aacttatttcataat

SEQ ID NO: 5821842 - DNA, 19 bp, Homo sapiens
aacttatttcataattgcc

SEQ ID NO: 5821843 - DNA, 21 bp, Homo sapiens
aacttatttcataattgccta

SEQ ID NO: 5821844 - DNA, 13 bp, Homo sapiens
aacttatttgagt

SEQ ID NO: 5821845 - DNA, 15 bp, Homo sapiens
aacttattttgattg

SEQ ID NO: 5821846 - DNA, 17 bp, Homo sapiens
aacttattttgattgtt

SEQ ID NO: 5821847 - DNA, 18 bp, Homo sapiens
aacttattttgattgttt

SEQ ID NO: 5821848 - DNA, 21 bp, Homo sapiens
aacttatttttttctgattgt

SEQ ID NO: 5821849 - DNA, 16 bp, Homo sapiens
aacttcaaatatagag

SEQ ID NO: 5821850 - DNA, 17 bp, Homo sapiens
aacttcaaatatagaga

SEQ ID NO: 5821851 - DNA, 22 bp, Homo sapiens
aacttcaagatgagcctgggct

SEQ ID NO: 5821852 - DNA, 21 bp, Homo sapiens
aacttcaaggaaaataagtga

SEQ ID NO: 5821853 - DNA, 22 bp, Homo sapiens
aacttcaaggaaaataagtgaa

SEQ ID NO: 5821854 - DNA, 17 bp, Homo sapiens
aacttcacattaaaaaa

SEQ ID NO: 5821855 - DNA, 17 bp, Homo sapiens
aacttcacatttatgtg

SEQ ID NO: 5821856 - DNA, 15 bp, Homo sapiens
aacttcaccaccccc

SEQ ID NO: 5821857 - DNA, 22 bp, Homo sapiens
aacttcaccaccccctgtccca

SEQ ID NO: 5821858 - DNA, 12 bp, Homo sapiens
aacttcacctta

SEQ ID NO: 5821859 - DNA, 14 bp, Homo sapiens
aacttcactccaaa

SEQ ID NO: 5821860 - DNA, 23 bp, Homo sapiens
aacttcactccaaagagaaacct

SEQ ID NO: 5821861 - DNA, 21 bp, Homo sapiens
aacttcagatacttgtgaaca

SEQ ID NO: 5821862 - DNA, 21 bp, Homo sapiens
aacttcagatgggaggaaaga

SEQ ID NO: 5821863 - DNA, 16 bp, Homo sapiens
aacttcagatgtttcc

SEQ ID NO: 5821864 - DNA, 20 bp, Homo sapiens
aacttcagcaagctagaact

SEQ ID NO: 5821865 - DNA, 11 bp, Homo sapiens
aacttcagcag

SEQ ID NO: 5821866 - DNA, 20 bp, Homo sapiens
aacttcagctagagcttcaa

SEQ ID NO: 5821867 - DNA, 22 bp, Homo sapiens
aacttcaggtgtgactctagca

SEQ ID NO: 5821868 - DNA, 17 bp, Homo sapiens
aacttcagtactcaaat

SEQ ID NO: 5821869 - DNA, 13 bp, Homo sapiens
aacttcagtcctg

SEQ ID NO: 5821870 - DNA, 21 bp, Homo sapiens
aacttcagtgcaagagacttt

SEQ ID NO: 5821871 - DNA, 19 bp, Homo sapiens
aacttcagtttcacagaaa

SEQ ID NO: 5821872 - DNA, 17 bp, Homo sapiens
aacttcagttttactgc

SEQ ID NO: 5821873 - DNA, 21 bp, Homo sapiens
aacttcagttttatttttgcc

SEQ ID NO: 5821874 - DNA, 22 bp, Homo sapiens
aacttcagttttatttttgcca

SEQ ID NO: 5821875 - DNA, 20 bp, Homo sapiens
aacttcatatatgaggactt

SEQ ID NO: 5821876 - DNA, 21 bp, Homo sapiens
aacttcatattaatataagtt

SEQ ID NO: 5821877 - DNA, 15 bp, Homo sapiens
aacttcatcccagct

SEQ ID NO: 5821878 - DNA, 14 bp, Homo sapiens
aacttcatgtaact

SEQ ID NO: 5821879 - DNA, 20 bp, Homo sapiens
aacttcatgtcaacttctgg

SEQ ID NO: 5821880 - DNA, 14 bp, Homo sapiens
aacttcattggtaa

SEQ ID NO: 5821881 - DNA, 16 bp, Homo sapiens
aacttcatttcagagt

SEQ ID NO: 5821882 - DNA, 14 bp, Homo sapiens
aacttcatttgatg

SEQ ID NO: 5821883 - DNA, 13 bp, Homo sapiens
aacttcattttta

SEQ ID NO: 5821884 - DNA, 14 bp, Homo sapiens
aacttccaaagaaa

SEQ ID NO: 5821885 - DNA, 16 bp, Homo sapiens
aacttccaaagaaagt

SEQ ID NO: 5821886 - DNA, 17 bp, Homo sapiens
aacttccaaagaaagtt

SEQ ID NO: 5821887 - DNA, 16 bp, Homo sapiens
aacttccaaataaata

SEQ ID NO: 5821888 - DNA, 10 bp, Homo sapiens
aacttccaag

SEQ ID NO: 5821889 - DNA, 21 bp, Homo sapiens
aacttccaaggccctgctttt

SEQ ID NO: 5821890 - DNA, 18 bp, Homo sapiens
aacttccactaatccatt

SEQ ID NO: 5821891 - DNA, 23 bp, Homo sapiens
aacttccactaatccattatcct

SEQ ID NO: 5821892 - DNA, 24 bp, Homo sapiens
aacttccactaatccattatcctt

SEQ ID NO: 5821893 - DNA, 14 bp, Homo sapiens
aacttccactgtta

SEQ ID NO: 5821894 - DNA, 22 bp, Homo sapiens
aacttccactttgtataaattt

SEQ ID NO: 5821895 - DNA, 20 bp, Homo sapiens
aacttccagaggacagctct

SEQ ID NO: 5821896 - DNA, 12 bp, Homo sapiens
aacttccaggaa

SEQ ID NO: 5821897 - DNA, 22 bp, Homo sapiens
aacttccaggtgttactgtaat

SEQ ID NO: 5821898 - DNA, 13 bp, Homo sapiens
aacttcccaggcc

SEQ ID NO: 5821899 - DNA, 16 bp, Homo sapiens
aacttccccatacaaa

SEQ ID NO: 5821900 - DNA, 14 bp, Homo sapiens
aacttccgctgagg

SEQ ID NO: 5821901 - DNA, 16 bp, Homo sapiens
aacttccgttcattgc

SEQ ID NO: 5821902 - DNA, 20 bp, Homo sapiens
aacttcctctgccatgtttt

SEQ ID NO: 5821903 - DNA, 14 bp, Homo sapiens
aacttcctgctgca

SEQ ID NO: 5821904 - DNA, 21 bp, Homo sapiens
aacttcctgctgcaccctgcg

SEQ ID NO: 5821905 - DNA, 17 bp, Homo sapiens
aacttcctgtgcctttc

SEQ ID NO: 5821906 - DNA, 14 bp, Homo sapiens
aacttcctgtggat

SEQ ID NO: 5821907 - DNA, 20 bp, Homo sapiens
aacttccttcacatctccca

SEQ ID NO: 5821908 - DNA, 17 bp, Homo sapiens
aacttccttgcccctgc

SEQ ID NO: 5821909 - DNA, 20 bp, Homo sapiens
aacttccttgcccctgctct

SEQ ID NO: 5821910 - DNA, 22 bp, Homo sapiens
aacttccttgcccctgctctgt

SEQ ID NO: 5821911 - DNA, 22 bp, Homo sapiens
aacttccttggactcattttaa

SEQ ID NO: 5821912 - DNA, 19 bp, Homo sapiens
aacttcgcatcaaaagaca

SEQ ID NO: 5821913 - DNA, 17 bp, Homo sapiens
aacttcgtgcatttgtt

SEQ ID NO: 5821914 - DNA, 15 bp, Homo sapiens
aacttctaaaactgt

SEQ ID NO: 5821915 - DNA, 14 bp, Homo sapiens
aacttctaatatat

SEQ ID NO: 5821916 - DNA, 16 bp, Homo sapiens
aacttctactcttcaa

SEQ ID NO: 5821917 - DNA, 15 bp, Homo sapiens
aacttctagcatata

SEQ ID NO: 5821918 - DNA, 16 bp, Homo sapiens
aacttctagcatatag

SEQ ID NO: 5821919 - DNA, 16 bp, Homo sapiens
aacttctatattttaa

SEQ ID NO: 5821920 - DNA, 20 bp, Homo sapiens
aacttctatgttggtttcag

SEQ ID NO: 5821921 - DNA, 19 bp, Homo sapiens
aacttctatgtttatcttt

SEQ ID NO: 5821922 - DNA, 16 bp, Homo sapiens
aacttctcagttttgg

SEQ ID NO: 5821923 - DNA, 19 bp, Homo sapiens
aacttctcctgaatgcatc

SEQ ID NO: 5821924 - DNA, 21 bp, Homo sapiens
aacttctccttagacactttg

SEQ ID NO: 5821925 - DNA, 19 bp, Homo sapiens
aacttctcttgctttctat

SEQ ID NO: 5821926 - DNA, 19 bp, Homo sapiens
aacttctgaactttggaag

SEQ ID NO: 5821927 - DNA, 17 bp, Homo sapiens
aacttctgtaaggggca

SEQ ID NO: 5821928 - DNA, 22 bp, Homo sapiens
aacttcttaaaccatttttgct

SEQ ID NO: 5821929 - DNA, 17 bp, Homo sapiens
aacttcttaaatatctt

SEQ ID NO: 5821930 - DNA, 20 bp, Homo sapiens
aacttcttaaatatctttta

SEQ ID NO: 5821931 - DNA, 16 bp, Homo sapiens
aacttcttaacgaaat

SEQ ID NO: 5821932 - DNA, 14 bp, Homo sapiens
aacttcttactagc

SEQ ID NO: 5821933 - DNA, 22 bp, Homo sapiens
aacttcttataggaaagcttga

SEQ ID NO: 5821934 - DNA, 17 bp, Homo sapiens
aacttcttatggaattg

SEQ ID NO: 5821935 - DNA, 22 bp, Homo sapiens
aacttcttccactttttccaga

SEQ ID NO: 5821936 - DNA, 12 bp, Homo sapiens
aacttcttcctg

SEQ ID NO: 5821937 - DNA, 15 bp, Homo sapiens
aacttcttcctgctg

SEQ ID NO: 5821938 - DNA, 18 bp, Homo sapiens
aacttcttcctgctggac

SEQ ID NO: 5821939 - DNA, 18 bp, Homo sapiens
aacttcttctatatccaa

SEQ ID NO: 5821940 - DNA, 12 bp, Homo sapiens
aacttcttgctt

SEQ ID NO: 5821941 - DNA, 18 bp, Homo sapiens
aacttcttgcttctttct

SEQ ID NO: 5821942 - DNA, 22 bp, Homo sapiens
aacttcttgcttctttctagaa

SEQ ID NO: 5821943 - DNA, 14 bp, Homo sapiens
aacttcttgtcaga

SEQ ID NO: 5821944 - DNA, 23 bp, Homo sapiens
aacttcttgtcagacataaagcc

SEQ ID NO: 5821945 - DNA, 16 bp, Homo sapiens
aacttcttgttcaaaa

SEQ ID NO: 5821946 - DNA, 19 bp, Homo sapiens
aacttctttgaagttattt

SEQ ID NO: 5821947 - DNA, 15 bp, Homo sapiens
aacttctttgaattt

SEQ ID NO: 5821948 - DNA, 11 bp, Homo sapiens
aacttgaaaaa

SEQ ID NO: 5821949 - DNA, 12 bp, Homo sapiens
aacttgaaaaat

SEQ ID NO: 5821950 - DNA, 18 bp, Homo sapiens
aacttgaaaagattgcaa

SEQ ID NO: 5821951 - DNA, 12 bp, Homo sapiens
aacttgaaaatt

SEQ ID NO: 5821952 - DNA, 21 bp, Homo sapiens
aacttgaaatatcctgcttga

SEQ ID NO: 5821953 - DNA, 14 bp, Homo sapiens
aacttgaacaaagt

SEQ ID NO: 5821954 - DNA, 22 bp, Homo sapiens
aacttgaaggattgcatcctgc

SEQ ID NO: 5821955 - DNA, 13 bp, Homo sapiens
aacttgaataata

SEQ ID NO: 5821956 - DNA, 13 bp, Homo sapiens
aacttgaattaca

SEQ ID NO: 5821957 - DNA, 16 bp, Homo sapiens
aacttgaatttctgga

SEQ ID NO: 5821958 - DNA, 21 bp, Homo sapiens
aacttgaatttggtctgtata

SEQ ID NO: 5821959 - DNA, 19 bp, Homo sapiens
aacttgaccctgagctgac

SEQ ID NO: 5821960 - DNA, 14 bp, Homo sapiens
aacttgactgggtg

SEQ ID NO: 5821961 - DNA, 22 bp, Homo sapiens
aacttgagatgtatgaaggctt

SEQ ID NO: 5821962 - DNA, 15 bp, Homo sapiens
aacttgagcatgtta

SEQ ID NO: 5821963 - DNA, 19 bp, Homo sapiens
aacttgagcgtgaatctgt

SEQ ID NO: 5821964 - DNA, 14 bp, Homo sapiens
aacttgaggacaca

SEQ ID NO: 5821965 - DNA, 20 bp, Homo sapiens
aacttgaggacacatgtcca

SEQ ID NO: 5821966 - DNA, 19 bp, Homo sapiens
aacttgagggcccagagca

SEQ ID NO: 5821967 - DNA, 16 bp, Homo sapiens
aacttgagggtaataa

SEQ ID NO: 5821968 - DNA, 22 bp, Homo sapiens
aacttgagggtaataaacttag

SEQ ID NO: 5821969 - DNA, 19 bp, Homo sapiens
aacttgaggtggcctcctt

SEQ ID NO: 5821970 - DNA, 21 bp, Homo sapiens
aacttgatagggtctaccaat

SEQ ID NO: 5821971 - DNA, 11 bp, Homo sapiens
aacttgatgca

SEQ ID NO: 5821972 - DNA, 14 bp, Homo sapiens
aacttgatgcatgt

SEQ ID NO: 5821973 - DNA, 13 bp, Homo sapiens
aacttgattatat

SEQ ID NO: 5821974 - DNA, 22 bp, Homo sapiens
aacttgattgttgagacgcctt

SEQ ID NO: 5821975 - DNA, 23 bp, Homo sapiens
aacttgatttgcatggattttgg

SEQ ID NO: 5821976 - DNA, 17 bp, Homo sapiens
aacttgcaaaatcagtt

SEQ ID NO: 5821977 - DNA, 18 bp, Homo sapiens
aacttgcaaaatcagttt

SEQ ID NO: 5821978 - DNA, 22 bp, Homo sapiens
aacttgcacttgttatattata

SEQ ID NO: 5821979 - DNA, 21 bp, Homo sapiens
aacttgcatccaactccagga

SEQ ID NO: 5821980 - DNA, 14 bp, Homo sapiens
aacttgccacatgt

SEQ ID NO: 5821981 - DNA, 17 bp, Homo sapiens
aacttgccatttcttta

SEQ ID NO: 5821982 - DNA, 16 bp, Homo sapiens
aacttgccctgagcac

SEQ ID NO: 5821983 - DNA, 12 bp, Homo sapiens
aacttgcctcca

SEQ ID NO: 5821984 - DNA, 22 bp, Homo sapiens
aacttgcctcttttacctgctg

SEQ ID NO: 5821985 - DNA, 13 bp, Homo sapiens
aacttgcctgcct

SEQ ID NO: 5821986 - DNA, 14 bp, Homo sapiens
aacttgcctttgaa

SEQ ID NO: 5821987 - DNA, 16 bp, Homo sapiens
aacttgctacttatca

SEQ ID NO: 5821988 - DNA, 12 bp, Homo sapiens
aacttgctgcct

SEQ ID NO: 5821989 - DNA, 15 bp, Homo sapiens
aacttgctgctgcct

SEQ ID NO: 5821990 - DNA, 14 bp, Homo sapiens
aacttgctgctgtc

SEQ ID NO: 5821991 - DNA, 16 bp, Homo sapiens
aacttgctgctgtctt

SEQ ID NO: 5821992 - DNA, 12 bp, Homo sapiens
aacttgctgtga

SEQ ID NO: 5821993 - DNA, 14 bp, Homo sapiens
aacttgctgtgaaa

SEQ ID NO: 5821994 - DNA, 16 bp, Homo sapiens
aacttgcttaaatgtg

SEQ ID NO: 5821995 - DNA, 18 bp, Homo sapiens
aacttgcttaaatttctt

SEQ ID NO: 5821996 - DNA, 22 bp, Homo sapiens
aacttgcttagtatggttctca

SEQ ID NO: 5821997 - DNA, 17 bp, Homo sapiens
aacttggaaaaagaaag

SEQ ID NO: 5821998 - DNA, 19 bp, Homo sapiens
aacttggaaaaagaaagaa

SEQ ID NO: 5821999 - DNA, 22 bp, Homo sapiens
aacttggaaaaagaaagaaaca

SEQ ID NO: 5822000 - DNA, 23 bp, Homo sapiens
aacttggaaaaatccagaaagaa

SEQ ID NO: 5822001 - DNA, 14 bp, Homo sapiens
aacttggaatcaag

SEQ ID NO: 5822002 - DNA, 19 bp, Homo sapiens
aacttggaatcaaggtaag

SEQ ID NO: 5822003 - DNA, 16 bp, Homo sapiens
aacttggacccttgga

SEQ ID NO: 5822004 - DNA, 15 bp, Homo sapiens
aacttggagccccag

SEQ ID NO: 5822005 - DNA, 14 bp, Homo sapiens
aacttggagtttca

SEQ ID NO: 5822006 - DNA, 21 bp, Homo sapiens
aacttggatattcaagccttt

SEQ ID NO: 5822007 - DNA, 12 bp, Homo sapiens
aacttggatcat

SEQ ID NO: 5822008 - DNA, 17 bp, Homo sapiens
aacttggatgagttttg

SEQ ID NO: 5822009 - DNA, 15 bp, Homo sapiens
aacttggatttttga

SEQ ID NO: 5822010 - DNA, 20 bp, Homo sapiens
aacttggcagctttttctgt

SEQ ID NO: 5822011 - DNA, 12 bp, Homo sapiens
aacttggcattt

SEQ ID NO: 5822012 - DNA, 14 bp, Homo sapiens
aacttggcgctgcc

SEQ ID NO: 5822013 - DNA, 19 bp, Homo sapiens
aacttggctgcaggaatct

SEQ ID NO: 5822014 - DNA, 23 bp, Homo sapiens
aacttgggagtgtggtttctttt

SEQ ID NO: 5822015 - DNA, 19 bp, Homo sapiens
aacttggggaacaagggtg

SEQ ID NO: 5822016 - DNA, 16 bp, Homo sapiens
aacttggggaaggggc

SEQ ID NO: 5822017 - DNA, 17 bp, Homo sapiens
aacttggggaaggggcc

SEQ ID NO: 5822018 - DNA, 21 bp, Homo sapiens
aacttggggagttaagacctg

SEQ ID NO: 5822019 - DNA, 22 bp, Homo sapiens
aacttggggagttaagacctgg

SEQ ID NO: 5822020 - DNA, 23 bp, Homo sapiens
aacttggggagttaagacctggc

SEQ ID NO: 5822021 - DNA, 14 bp, Homo sapiens
aacttggtcagagc

SEQ ID NO: 5822022 - DNA, 15 bp, Homo sapiens
aacttggttatacat

SEQ ID NO: 5822023 - DNA, 21 bp, Homo sapiens
aacttggttatacatgacact

SEQ ID NO: 5822024 - DNA, 15 bp, Homo sapiens
aacttggttcccaga

SEQ ID NO: 5822025 - DNA, 20 bp, Homo sapiens
aacttggttcccagaaaaca

SEQ ID NO: 5822026 - DNA, 19 bp, Homo sapiens
aacttggttctcagactct

SEQ ID NO: 5822027 - DNA, 17 bp, Homo sapiens
aacttggttctgcttca

SEQ ID NO: 5822028 - DNA, 22 bp, Homo sapiens
aacttgtaaaaagggggctgca

SEQ ID NO: 5822029 - DNA, 14 bp, Homo sapiens
aacttgtaaataca

SEQ ID NO: 5822030 - DNA, 15 bp, Homo sapiens
aacttgtaaatgctg

SEQ ID NO: 5822031 - DNA, 18 bp, Homo sapiens
aacttgtaataaaccctt

SEQ ID NO: 5822032 - DNA, 15 bp, Homo sapiens
aacttgtacatggaa

SEQ ID NO: 5822033 - DNA, 18 bp, Homo sapiens
aacttgtacttgtttcat

SEQ ID NO: 5822034 - DNA, 14 bp, Homo sapiens
aacttgtatctgaa

SEQ ID NO: 5822035 - DNA, 17 bp, Homo sapiens
aacttgtattaaagaca

SEQ ID NO: 5822036 - DNA, 15 bp, Homo sapiens
aacttgtatttccaa

SEQ ID NO: 5822037 - DNA, 19 bp, Homo sapiens
aacttgtattttcttaata

SEQ ID NO: 5822038 - DNA, 16 bp, Homo sapiens
aacttgtcacaaagtg

SEQ ID NO: 5822039 - DNA, 21 bp, Homo sapiens
aacttgtcctatgtcaatttg

SEQ ID NO: 5822040 - DNA, 14 bp, Homo sapiens
aacttgtctctgta

SEQ ID NO: 5822041 - DNA, 15 bp, Homo sapiens
aacttgtctctgtag

SEQ ID NO: 5822042 - DNA, 22 bp, Homo sapiens
aacttgtctggctttggcactc

SEQ ID NO: 5822043 - DNA, 13 bp, Homo sapiens
aacttgtcttaaa

SEQ ID NO: 5822044 - DNA, 20 bp, Homo sapiens
aacttgtctttttctggact

SEQ ID NO: 5822045 - DNA, 15 bp, Homo sapiens
aacttgtctttttgt

SEQ ID NO: 5822046 - DNA, 16 bp, Homo sapiens
aacttgtctttttgtt

SEQ ID NO: 5822047 - DNA, 20 bp, Homo sapiens
aacttgtgaactccatcatt

SEQ ID NO: 5822048 - DNA, 11 bp, Homo sapiens
aacttgtgaat

SEQ ID NO: 5822049 - DNA, 12 bp, Homo sapiens
aacttgtgaatg

SEQ ID NO: 5822050 - DNA, 12 bp, Homo sapiens
aacttgtggcct

SEQ ID NO: 5822051 - DNA, 15 bp, Homo sapiens
aacttgtgtaaatac

SEQ ID NO: 5822052 - DNA, 21 bp, Homo sapiens
aacttgtgtactgataaaata

SEQ ID NO: 5822053 - DNA, 19 bp, Homo sapiens
aacttgtgtccctaatgtg

SEQ ID NO: 5822054 - DNA, 23 bp, Homo sapiens
aacttgtgttactaatttgtata

SEQ ID NO: 5822055 - DNA, 15 bp, Homo sapiens
aacttgtgttctatt

SEQ ID NO: 5822056 - DNA, 17 bp, Homo sapiens
aacttgtgtttatggca

SEQ ID NO: 5822057 - DNA, 15 bp, Homo sapiens
aacttgttacttgca

SEQ ID NO: 5822058 - DNA, 17 bp, Homo sapiens
aacttgttattgtgaat

SEQ ID NO: 5822059 - DNA, 18 bp, Homo sapiens
aacttgttattgtgaatg

SEQ ID NO: 5822060 - DNA, 19 bp, Homo sapiens
aacttgttattgtgaatga

SEQ ID NO: 5822061 - DNA, 16 bp, Homo sapiens
aacttgttcatttaga

SEQ ID NO: 5822062 - DNA, 16 bp, Homo sapiens
aacttgttgaatttat

SEQ ID NO: 5822063 - DNA, 20 bp, Homo sapiens
aacttgttgctgattttgac

SEQ ID NO: 5822064 - DNA, 23 bp, Homo sapiens
aacttgtttacaacatttttgca

SEQ ID NO: 5822065 - DNA, 16 bp, Homo sapiens
aacttgtttgctgtga

SEQ ID NO: 5822066 - DNA, 16 bp, Homo sapiens
aacttgtttttattgc

SEQ ID NO: 5822067 - DNA, 18 bp, Homo sapiens
aacttgtttttattgcat

SEQ ID NO: 5822068 - DNA, 15 bp, Homo sapiens
aactttaaaaattat

SEQ ID NO: 5822069 - DNA, 21 bp, Homo sapiens
aactttaaaactgtatttaag

SEQ ID NO: 5822070 - DNA, 12 bp, Homo sapiens
aactttaaacat

SEQ ID NO: 5822071 - DNA, 14 bp, Homo sapiens
aactttaaatcttt

SEQ ID NO: 5822072 - DNA, 13 bp, Homo sapiens
aactttaaattat

SEQ ID NO: 5822073 - DNA, 21 bp, Homo sapiens
aactttaagaactaaaatgtt

SEQ ID NO: 5822074 - DNA, 13 bp, Homo sapiens
aactttaagagga

SEQ ID NO: 5822075 - DNA, 21 bp, Homo sapiens
aactttaagtttcaggataca

SEQ ID NO: 5822076 - DNA, 15 bp, Homo sapiens
aactttaatatgtat

SEQ ID NO: 5822077 - DNA, 19 bp, Homo sapiens
aactttaatatgtatttta

SEQ ID NO: 5822078 - DNA, 21 bp, Homo sapiens
aactttaccataaagccttta

SEQ ID NO: 5822079 - DNA, 22 bp, Homo sapiens
aactttaccataaagcctttaa

SEQ ID NO: 5822080 - DNA, 20 bp, Homo sapiens
aactttacccaaaaactaaa

SEQ ID NO: 5822081 - DNA, 21 bp, Homo sapiens
aactttaccttttttatacat

SEQ ID NO: 5822082 - DNA, 23 bp, Homo sapiens
aactttaccttttttatacataa

SEQ ID NO: 5822083 - DNA, 19 bp, Homo sapiens
aactttactaagatgacat

SEQ ID NO: 5822084 - DNA, 21 bp, Homo sapiens
aactttactctgtgtttaaaa

SEQ ID NO: 5822085 - DNA, 11 bp, Homo sapiens
aactttagaaa

SEQ ID NO: 5822086 - DNA, 19 bp, Homo sapiens
aactttataaatccagtga

SEQ ID NO: 5822087 - DNA, 18 bp, Homo sapiens
aactttatacacttggat

SEQ ID NO: 5822088 - DNA, 15 bp, Homo sapiens
aactttatacattag

SEQ ID NO: 5822089 - DNA, 16 bp, Homo sapiens
aactttatacattagt

SEQ ID NO: 5822090 - DNA, 21 bp, Homo sapiens
aactttatcacattatttgca

SEQ ID NO: 5822091 - DNA, 15 bp, Homo sapiens
aactttatgaagtgc

SEQ ID NO: 5822092 - DNA, 15 bp, Homo sapiens
aactttatgtactgc

SEQ ID NO: 5822093 - DNA, 17 bp, Homo sapiens
aactttatgtactgctg

SEQ ID NO: 5822094 - DNA, 18 bp, Homo sapiens
aactttatgtagagaaaa

SEQ ID NO: 5822095 - DNA, 13 bp, Homo sapiens
aactttatgtgta

SEQ ID NO: 5822096 - DNA, 17 bp, Homo sapiens
aactttatgtgtaaata

SEQ ID NO: 5822097 - DNA, 13 bp, Homo sapiens
aactttattaaaa

SEQ ID NO: 5822098 - DNA, 14 bp, Homo sapiens
aactttattaaaag

SEQ ID NO: 5822099 - DNA, 23 bp, Homo sapiens
aactttattaaaagaatgagtga

SEQ ID NO: 5822100 - DNA, 19 bp, Homo sapiens
aagaaaggatataaaagga

SEQ ID NO: 5822101 - DNA, 13 bp, Homo sapiens
aagaaaggcagag

SEQ ID NO: 5822102 - DNA, 20 bp, Homo sapiens
aagaaaggctgctgtactga

SEQ ID NO: 5822103 - DNA, 19 bp, Homo sapiens
aagaaagggaaagctgtgc

SEQ ID NO: 5822104 - DNA, 17 bp, Homo sapiens
aagaaagggagaaggat

SEQ ID NO: 5822105 - DNA, 15 bp, Homo sapiens
aagaaagtaaaaaga

SEQ ID NO: 5822106 - DNA, 12 bp, Homo sapiens
aagaaagtcaga

SEQ ID NO: 5822107 - DNA, 22 bp, Homo sapiens
aagaaagtcagacctgtttctt

SEQ ID NO: 5822108 - DNA, 19 bp, Homo sapiens
aagaaagtctatctaatga

SEQ ID NO: 5822109 - DNA, 16 bp, Homo sapiens
aagaaagtctatgctt

SEQ ID NO: 5822110 - DNA, 17 bp, Homo sapiens
aagaaagtgaaaaaaac

SEQ ID NO: 5822111 - DNA, 12 bp, Homo sapiens
aagaaagtgtat

SEQ ID NO: 5822112 - DNA, 15 bp, Homo sapiens
aagaaagtgtatttg

SEQ ID NO: 5822113 - DNA, 17 bp, Homo sapiens
aagaaagtgttaaaact

SEQ ID NO: 5822114 - DNA, 16 bp, Homo sapiens
aagaaagtgttttatt

SEQ ID NO: 5822115 - DNA, 14 bp, Homo sapiens
aagaaataaatgaa

SEQ ID NO: 5822116 - DNA, 23 bp, Homo sapiens
aagaaataaatgaaacttggcca

SEQ ID NO: 5822117 - DNA, 15 bp, Homo sapiens
aagaaataagttttt

SEQ ID NO: 5822118 - DNA, 18 bp, Homo sapiens
aagaaataataatatcca

SEQ ID NO: 5822119 - DNA, 19 bp, Homo sapiens
aagaaataatccctgtaat

SEQ ID NO: 5822120 - DNA, 21 bp, Homo sapiens
aagaaataattttattccaga

SEQ ID NO: 5822121 - DNA, 17 bp, Homo sapiens
aagaaatactcatgtgc

SEQ ID NO: 5822122 - DNA, 15 bp, Homo sapiens
aagaaatagaacaag

SEQ ID NO: 5822123 - DNA, 22 bp, Homo sapiens
aagaaatagagccaactgattt

SEQ ID NO: 5822124 - DNA, 16 bp, Homo sapiens
aagaaatatacagttt

SEQ ID NO: 5822125 - DNA, 11 bp, Homo sapiens
aagaaatatat

SEQ ID NO: 5822126 - DNA, 19 bp, Homo sapiens
aagaaatatgatcagagct

SEQ ID NO: 5822127 - DNA, 20 bp, Homo sapiens
aagaaatatgtattctgtaa

SEQ ID NO: 5822128 - DNA, 16 bp, Homo sapiens
aagaaatatgtgagat

SEQ ID NO: 5822129 - DNA, 14 bp, Homo sapiens
aagaaatatttacc

SEQ ID NO: 5822130 - DNA, 14 bp, Homo sapiens
aagaaatcaagtta

SEQ ID NO: 5822131 - DNA, 14 bp, Homo sapiens
aagaaatcaatttt

SEQ ID NO: 5822132 - DNA, 13 bp, Homo sapiens
aagaaatcatgtt

SEQ ID NO: 5822133 - DNA, 14 bp, Homo sapiens
aagaaatcatgtta

SEQ ID NO: 5822134 - DNA, 19 bp, Homo sapiens
aagaaatccggagaagctg

SEQ ID NO: 5822135 - DNA, 21 bp, Homo sapiens
aagaaatcgccttatgagaac

SEQ ID NO: 5822136 - DNA, 16 bp, Homo sapiens
aagaaatctatagaaa

SEQ ID NO: 5822137 - DNA, 20 bp, Homo sapiens
aagaaatctatagaaagtgt

SEQ ID NO: 5822138 - DNA, 15 bp, Homo sapiens
aagaaatctggccca

SEQ ID NO: 5822139 - DNA, 12 bp, Homo sapiens
aagaaatctgtt

SEQ ID NO: 5822140 - DNA, 16 bp, Homo sapiens
aagaaatgaacaaaag

SEQ ID NO: 5822141 - DNA, 14 bp, Homo sapiens
aagaaatgagaaat

SEQ ID NO: 5822142 - DNA, 21 bp, Homo sapiens
aagaaatgagaaattgtgcca

SEQ ID NO: 5822143 - DNA, 13 bp, Homo sapiens
aagaaatgatgga

SEQ ID NO: 5822144 - DNA, 15 bp, Homo sapiens
aagaaatgatgttgg

SEQ ID NO: 5822145 - DNA, 21 bp, Homo sapiens
aagaaatgattcaaattgctg

SEQ ID NO: 5822146 - DNA, 22 bp, Homo sapiens
aagaaatgattcaaattgctgc

SEQ ID NO: 5822147 - DNA, 16 bp, Homo sapiens
aagaaatgcaaaaatc

SEQ ID NO: 5822148 - DNA, 16 bp, Homo sapiens
aagaaatgcacaatgt

SEQ ID NO: 5822149 - DNA, 20 bp, Homo sapiens
aagaaatgctaatgtaatca

SEQ ID NO: 5822150 - DNA, 23 bp, Homo sapiens
aagaaatggaatgaatctccaag

SEQ ID NO: 5822151 - DNA, 17 bp, Homo sapiens
aagaaatggctatgaac

SEQ ID NO: 5822152 - DNA, 17 bp, Homo sapiens
aagaaatgggcctgcct

SEQ ID NO: 5822153 - DNA, 18 bp, Homo sapiens
aagaaatgggcctgcctg

SEQ ID NO: 5822154 - DNA, 19 bp, Homo sapiens
aagaaatgggtttcttgcc

SEQ ID NO: 5822155 - DNA, 13 bp, Homo sapiens
aagaaatggtatg

SEQ ID NO: 5822156 - DNA, 17 bp, Homo sapiens
aagaaatggtatgtaga

SEQ ID NO: 5822157 - DNA, 14 bp, Homo sapiens
aagaaatgtaaggg

SEQ ID NO: 5822158 - DNA, 21 bp, Homo sapiens
aagaaatgtagttgatgtatc

SEQ ID NO: 5822159 - DNA, 14 bp, Homo sapiens
aagaaatgtataaa

SEQ ID NO: 5822160 - DNA, 19 bp, Homo sapiens
aagaaatgtgaagttttct

SEQ ID NO: 5822161 - DNA, 16 bp, Homo sapiens
aagaaattaacaataa

SEQ ID NO: 5822162 - DNA, 14 bp, Homo sapiens
aagaaattaatatg

SEQ ID NO: 5822163 - DNA, 17 bp, Homo sapiens
aagaaattatctttagt

SEQ ID NO: 5822164 - DNA, 22 bp, Homo sapiens
aagaaattatctttagttgaat

SEQ ID NO: 5822165 - DNA, 23 bp, Homo sapiens
aagaaattatttaatatgcatct

SEQ ID NO: 5822166 - DNA, 20 bp, Homo sapiens
aagaaattcattaaagaaaa

SEQ ID NO: 5822167 - DNA, 21 bp, Homo sapiens
aagaaattccatacttctctc

SEQ ID NO: 5822168 - DNA, 17 bp, Homo sapiens
aagaaattgaatacttt

SEQ ID NO: 5822169 - DNA, 18 bp, Homo sapiens
aagaaattgaatactttg

SEQ ID NO: 5822170 - DNA, 19 bp, Homo sapiens
aagaaattgaatactttga

SEQ ID NO: 5822171 - DNA, 16 bp, Homo sapiens
aagaaattgcctcctt

SEQ ID NO: 5822172 - DNA, 15 bp, Homo sapiens
aagaaattgtccttg

SEQ ID NO: 5822173 - DNA, 16 bp, Homo sapiens
aagaaattgtccttga

SEQ ID NO: 5822174 - DNA, 16 bp, Homo sapiens
aagaaattgtttcttt

SEQ ID NO: 5822175 - DNA, 15 bp, Homo sapiens
aagaaattgtttttc

SEQ ID NO: 5822176 - DNA, 15 bp, Homo sapiens
aagaaatttattact

SEQ ID NO: 5822177 - DNA, 18 bp, Homo sapiens
aagaaatttcaacagtta

SEQ ID NO: 5822178 - DNA, 15 bp, Homo sapiens
aagaaatttgaaaaa

SEQ ID NO: 5822179 - DNA, 21 bp, Homo sapiens
aagaaatttgaaaaaactttc

SEQ ID NO: 5822180 - DNA, 16 bp, Homo sapiens
aagaaatttgatttct

SEQ ID NO: 5822181 - DNA, 15 bp, Homo sapiens
aagaaattttattag

SEQ ID NO: 5822182 - DNA, 15 bp, Homo sapiens
aagaaattttttaaa

SEQ ID NO: 5822183 - DNA, 14 bp, Homo sapiens
aagaacaaaactgt

SEQ ID NO: 5822184 - DNA, 14 bp, Homo sapiens
aagaacaacaaaga

SEQ ID NO: 5822185 - DNA, 14 bp, Homo sapiens
aagaacaagaaatg

SEQ ID NO: 5822186 - DNA, 19 bp, Homo sapiens
aagaacaaggccctgaggg

SEQ ID NO: 5822187 - DNA, 17 bp, Homo sapiens
aagaacaatagaactgg

SEQ ID NO: 5822188 - DNA, 15 bp, Homo sapiens
aagaacaatattgac

SEQ ID NO: 5822189 - DNA, 21 bp, Homo sapiens
aagaacaattgtccatggtct

SEQ ID NO: 5822190 - DNA, 19 bp, Homo sapiens
aagaacacacacatataca

SEQ ID NO: 5822191 - DNA, 17 bp, Homo sapiens
aagaacacagcatgtgc

SEQ ID NO: 5822192 - DNA, 16 bp, Homo sapiens
aagaacacattttaaa

SEQ ID NO: 5822193 - DNA, 19 bp, Homo sapiens
aagaacaccctatattttg

SEQ ID NO: 5822194 - DNA, 21 bp, Homo sapiens
aagaacaccctatattttgca

SEQ ID NO: 5822195 - DNA, 22 bp, Homo sapiens
aagaacacctgacaacttctga

SEQ ID NO: 5822196 - DNA, 20 bp, Homo sapiens
aagaacacttttaataaact

SEQ ID NO: 5822197 - DNA, 12 bp, Homo sapiens
aagaacagatgg

SEQ ID NO: 5822198 - DNA, 12 bp, Homo sapiens
aagaacagcaga

SEQ ID NO: 5822199 - DNA, 23 bp, Homo sapiens
aagaacagccccggggccccctg

SEQ ID NO: 5822200 - DNA, 19 bp, Homo sapiens
aagaacagctaacaataaa

SEQ ID NO: 5822201 - DNA, 16 bp, Homo sapiens
aagaacagtacatttt

SEQ ID NO: 5822202 - DNA, 21 bp, Homo sapiens
aagaacagtgttgaaattgga

SEQ ID NO: 5822203 - DNA, 12 bp, Homo sapiens
aagaacatagaa

SEQ ID NO: 5822204 - DNA, 12 bp, Homo sapiens
aagaacatcaag

SEQ ID NO: 5822205 - DNA, 14 bp, Homo sapiens
aagaacatgaatct

SEQ ID NO: 5822206 - DNA, 16 bp, Homo sapiens
aagaacatgatgggcc

SEQ ID NO: 5822207 - DNA, 14 bp, Homo sapiens
aagaacatgcagtt

SEQ ID NO: 5822208 - DNA, 16 bp, Homo sapiens
aagaacatgcagtttg

SEQ ID NO: 5822209 - DNA, 19 bp, Homo sapiens
aagaacatgcagtttgaaa

SEQ ID NO: 5822210 - DNA, 15 bp, Homo sapiens
aagaacatttaaaat

SEQ ID NO: 5822211 - DNA, 17 bp, Homo sapiens
aagaacatttaaaatta

SEQ ID NO: 5822212 - DNA, 15 bp, Homo sapiens
aagaacattttgcct

SEQ ID NO: 5822213 - DNA, 11 bp, Homo sapiens
aagaaccaaaa

SEQ ID NO: 5822214 - DNA, 14 bp, Homo sapiens
aagaaccaaaaaaa

SEQ ID NO: 5822215 - DNA, 14 bp, Homo sapiens
aagaaccaaaactt

SEQ ID NO: 5822216 - DNA, 16 bp, Homo sapiens
aagaaccaaaacttcc

SEQ ID NO: 5822217 - DNA, 22 bp, Homo sapiens
aagaaccaaactcctatttcaa

SEQ ID NO: 5822218 - DNA, 13 bp, Homo sapiens
aagaaccacttgt

SEQ ID NO: 5822219 - DNA, 15 bp, Homo sapiens
aagaaccagcccagc

SEQ ID NO: 5822220 - DNA, 17 bp, Homo sapiens
aagaacccagggtggag

SEQ ID NO: 5822221 - DNA, 23 bp, Homo sapiens
aagaacccatttgccatgctgct

SEQ ID NO: 5822222 - DNA, 17 bp, Homo sapiens
aagaacccccctcccca

SEQ ID NO: 5822223 - DNA, 22 bp, Homo sapiens
aagaacccccctccccaaggaa

SEQ ID NO: 5822224 - DNA, 14 bp, Homo sapiens
aagaacccctctgc

SEQ ID NO: 5822225 - DNA, 15 bp, Homo sapiens
aagaacccctctgct

SEQ ID NO: 5822226 - DNA, 21 bp, Homo sapiens
aagaaccctctgtcccacccc

SEQ ID NO: 5822227 - DNA, 18 bp, Homo sapiens
aagaaccctgcagggccc

SEQ ID NO: 5822228 - DNA, 13 bp, Homo sapiens
aagaacccttctc

SEQ ID NO: 5822229 - DNA, 14 bp, Homo sapiens
aagaacccttctca

SEQ ID NO: 5822230 - DNA, 17 bp, Homo sapiens
aagaacctaacatttat

SEQ ID NO: 5822231 - DNA, 23 bp, Homo sapiens
aagaacctacagactccatctct

SEQ ID NO: 5822232 - DNA, 20 bp, Homo sapiens
aagaacctgacatccactgt

SEQ ID NO: 5822233 - DNA, 13 bp, Homo sapiens
aagaacctggaaa

SEQ ID NO: 5822234 - DNA, 15 bp, Homo sapiens
aagaacgaggtttat

SEQ ID NO: 5822235 - DNA, 20 bp, Homo sapiens
aagaacgcgacttccacaaa

SEQ ID NO: 5822236 - DNA, 22 bp, Homo sapiens
aagaacgcggtgtgtaacactg

SEQ ID NO: 5822237 - DNA, 21 bp, Homo sapiens
aagaacggggctcttctcatt

SEQ ID NO: 5822238 - DNA, 23 bp, Homo sapiens
aagaacggggctcttctcatttc

SEQ ID NO: 5822239 - DNA, 16 bp, Homo sapiens
aagaacgtcattttgg

SEQ ID NO: 5822240 - DNA, 12 bp, Homo sapiens
aagaactaagcc

SEQ ID NO: 5822241 - DNA, 22 bp, Homo sapiens
aagaactacccccttttcagct

SEQ ID NO: 5822242 - DNA, 14 bp, Homo sapiens
aagaactagcataa

SEQ ID NO: 5822243 - DNA, 20 bp, Homo sapiens
aagaactcaaacttctggct

SEQ ID NO: 5822244 - DNA, 18 bp, Homo sapiens
aagaactcaccagggttt

SEQ ID NO: 5822245 - DNA, 22 bp, Homo sapiens
aagaactcctgaaatcatatag

SEQ ID NO: 5822246 - DNA, 13 bp, Homo sapiens
aagaactctctgg

SEQ ID NO: 5822247 - DNA, 14 bp, Homo sapiens
aagaactctctgga

SEQ ID NO: 5822248 - DNA, 22 bp, Homo sapiens
aagaactctgggcacttttgaa

SEQ ID NO: 5822249 - DNA, 13 bp, Homo sapiens
aagaactcttttt

SEQ ID NO: 5822250 - DNA, 14 bp, Homo sapiens
aagaactgaaaaca

SEQ ID NO: 5822251 - DNA, 18 bp, Homo sapiens
aagaactgaaaacataaa

SEQ ID NO: 5822252 - DNA, 19 bp, Homo sapiens
aagaactgaaaacataaaa

SEQ ID NO: 5822253 - DNA, 17 bp, Homo sapiens
aagaactgaatccatat

SEQ ID NO: 5822254 - DNA, 20 bp, Homo sapiens
aagaactgaatccatatttc

SEQ ID NO: 5822255 - DNA, 17 bp, Homo sapiens
aagaactgcacatgaag

SEQ ID NO: 5822256 - DNA, 12 bp, Homo sapiens
aagaactgcact

SEQ ID NO: 5822257 - DNA, 22 bp, Homo sapiens
aagaactgcagatagcccagga

SEQ ID NO: 5822258 - DNA, 23 bp, Homo sapiens
aagaactgcagatagcccaggag

SEQ ID NO: 5822259 - DNA, 18 bp, Homo sapiens
aagaactgcaggccctgg

SEQ ID NO: 5822260 - DNA, 23 bp, Homo sapiens
aagaactgcatggacctaacatt

SEQ ID NO: 5822261 - DNA, 16 bp, Homo sapiens
aagaactgtacattgt

SEQ ID NO: 5822262 - DNA, 20 bp, Homo sapiens
aagaactgtacattgtgagc

SEQ ID NO: 5822263 - DNA, 19 bp, Homo sapiens
aagaactgtcatgtaaaca

SEQ ID NO: 5822264 - DNA, 18 bp, Homo sapiens
aagaactgttgcctaatt

SEQ ID NO: 5822265 - DNA, 23 bp, Homo sapiens
aagaactgttgcctaattggaaa

SEQ ID NO: 5822266 - DNA, 22 bp, Homo sapiens
aagaacttcagtgtagagaaaa

SEQ ID NO: 5822267 - DNA, 13 bp, Homo sapiens
aagaacttgaagt

SEQ ID NO: 5822268 - DNA, 17 bp, Homo sapiens
aagaacttgatttgcat

SEQ ID NO: 5822269 - DNA, 18 bp, Homo sapiens
aagaacttgatttgcatg

SEQ ID NO: 5822270 - DNA, 23 bp, Homo sapiens
aagaacttgatttgcatggattt

SEQ ID NO: 5822271 - DNA, 16 bp, Homo sapiens
aagaacttgtttacaa

SEQ ID NO: 5822272 - DNA, 18 bp, Homo sapiens
aagaactttgcacacttc

SEQ ID NO: 5822273 - DNA, 19 bp, Homo sapiens
aagaactttttcttttccc

SEQ ID NO: 5822274 - DNA, 9 bp, Homo sapiens
aagaagaaa

SEQ ID NO: 5822275 - DNA, 13 bp, Homo sapiens
aagaagaaaaaaa

SEQ ID NO: 5822276 - DNA, 14 bp, Homo sapiens
aagaagaaaaagaa

SEQ ID NO: 5822277 - DNA, 14 bp, Homo sapiens
aagaagaaaaaggt

SEQ ID NO: 5822278 - DNA, 13 bp, Homo sapiens
aagaagaaaacac

SEQ ID NO: 5822279 - DNA, 14 bp, Homo sapiens
aagaatattttgat

SEQ ID NO: 5822280 - DNA, 23 bp, Homo sapiens
aagaatattttgatgcagataaa

SEQ ID NO: 5822281 - DNA, 18 bp, Homo sapiens
aagaatcacagtactttc

SEQ ID NO: 5822282 - DNA, 19 bp, Homo sapiens
aagaatcacctcaaattgt

SEQ ID NO: 5822283 - DNA, 23 bp, Homo sapiens
aagaatcagagaaggaacatacc

SEQ ID NO: 5822284 - DNA, 16 bp, Homo sapiens
aagaatcagagtagaa

SEQ ID NO: 5822285 - DNA, 11 bp, Homo sapiens
aagaatcatgg

SEQ ID NO: 5822286 - DNA, 16 bp, Homo sapiens
aagaatccacaaggac

SEQ ID NO: 5822287 - DNA, 21 bp, Homo sapiens
aagaatccacatttctaaaat

SEQ ID NO: 5822288 - DNA, 21 bp, Homo sapiens
aagaatccttagatgcctaaa

SEQ ID NO: 5822289 - DNA, 22 bp, Homo sapiens
aagaatcggcagtattttctgt

SEQ ID NO: 5822290 - DNA, 16 bp, Homo sapiens
aagaatcggcatgtat

SEQ ID NO: 5822291 - DNA, 23 bp, Homo sapiens
aagaatctaaaccttacatgtgt

SEQ ID NO: 5822292 - DNA, 16 bp, Homo sapiens
aagaatctatctgctt

SEQ ID NO: 5822293 - DNA, 23 bp, Homo sapiens
aagaatctctatgccctgttaaa

SEQ ID NO: 5822294 - DNA, 14 bp, Homo sapiens
aagaatctgcccct

SEQ ID NO: 5822295 - DNA, 13 bp, Homo sapiens
aagaatcttcctg

SEQ ID NO: 5822296 - DNA, 21 bp, Homo sapiens
aagaatcttggtttgccttcc

SEQ ID NO: 5822297 - DNA, 13 bp, Homo sapiens
aagaatctttata

SEQ ID NO: 5822298 - DNA, 19 bp, Homo sapiens
aagaatgaaaaatataatg

SEQ ID NO: 5822299 - DNA, 13 bp, Homo sapiens
aagaatgaaaaca

SEQ ID NO: 5822300 - DNA, 14 bp, Homo sapiens
aagaatgaaagagt

SEQ ID NO: 5822301 - DNA, 13 bp, Homo sapiens
aagaatgaaagct

SEQ ID NO: 5822302 - DNA, 19 bp, Homo sapiens
aagaatgaaagctgttcct

SEQ ID NO: 5822303 - DNA, 12 bp, Homo sapiens
aagaatgaaagt

SEQ ID NO: 5822304 - DNA, 15 bp, Homo sapiens
aagaatgaaagtagc

SEQ ID NO: 5822305 - DNA, 13 bp, Homo sapiens
aagaatgaaatga

SEQ ID NO: 5822306 - DNA, 11 bp, Homo sapiens
aagaatgaaca

SEQ ID NO: 5822307 - DNA, 19 bp, Homo sapiens
aagaatgaacaaattgaac

SEQ ID NO: 5822308 - DNA, 20 bp, Homo sapiens
aagaatgaacacaatcacgt

SEQ ID NO: 5822309 - DNA, 21 bp, Homo sapiens
aagaatgaaggtttttgtaaa

SEQ ID NO: 5822310 - DNA, 13 bp, Homo sapiens
aagaatgaatcca

SEQ ID NO: 5822311 - DNA, 18 bp, Homo sapiens
aagaatgactatataatt

SEQ ID NO: 5822312 - DNA, 15 bp, Homo sapiens
aagaatgagaaacat

SEQ ID NO: 5822313 - DNA, 14 bp, Homo sapiens
aagaatgagcctgt

SEQ ID NO: 5822314 - DNA, 18 bp, Homo sapiens
aagaatgagcctgtccaa

SEQ ID NO: 5822315 - DNA, 16 bp, Homo sapiens
aagaatgagtaatgtg

SEQ ID NO: 5822316 - DNA, 17 bp, Homo sapiens
aagaatgcacaagaatg

SEQ ID NO: 5822317 - DNA, 22 bp, Homo sapiens
aagaatgcacaagaatggatca

SEQ ID NO: 5822318 - DNA, 15 bp, Homo sapiens
aagaatgcatgcttt

SEQ ID NO: 5822319 - DNA, 13 bp, Homo sapiens
aagaatgcattga

SEQ ID NO: 5822320 - DNA, 20 bp, Homo sapiens
aagaatgcattgatattgtg

SEQ ID NO: 5822321 - DNA, 15 bp, Homo sapiens
aagaatgccatttct

SEQ ID NO: 5822322 - DNA, 13 bp, Homo sapiens
aagaatgctgaaa

SEQ ID NO: 5822323 - DNA, 18 bp, Homo sapiens
aagaatgctggttttcct

SEQ ID NO: 5822324 - DNA, 22 bp, Homo sapiens
aagaatgctggttttcctaaat

SEQ ID NO: 5822325 - DNA, 22 bp, Homo sapiens
aagaatgctgttctgatttact

SEQ ID NO: 5822326 - DNA, 13 bp, Homo sapiens
aagaatgcttaaa

SEQ ID NO: 5822327 - DNA, 13 bp, Homo sapiens
aagaatgcttaat

SEQ ID NO: 5822328 - DNA, 15 bp, Homo sapiens
aagaatgctttgcca

SEQ ID NO: 5822329 - DNA, 19 bp, Homo sapiens
aagaatggaagcctgaact

SEQ ID NO: 5822330 - DNA, 16 bp, Homo sapiens
aagaatggagcagtac

SEQ ID NO: 5822331 - DNA, 17 bp, Homo sapiens
aagaatgggcagttaca

SEQ ID NO: 5822332 - DNA, 19 bp, Homo sapiens
aagaatgggctgcagaaga

SEQ ID NO: 5822333 - DNA, 18 bp, Homo sapiens
aagaatggtttgtaaaat

SEQ ID NO: 5822334 - DNA, 21 bp, Homo sapiens
aagaatgtacagaaaatagct

SEQ ID NO: 5822335 - DNA, 22 bp, Homo sapiens
aagaatgtacagaaaatagctt

SEQ ID NO: 5822336 - DNA, 18 bp, Homo sapiens
aagaatgtgtgtgcagaa

SEQ ID NO: 5822337 - DNA, 13 bp, Homo sapiens
aagaatgtgtttc

SEQ ID NO: 5822338 - DNA, 22 bp, Homo sapiens
aagaatgttaatattttacttt

SEQ ID NO: 5822339 - DNA, 20 bp, Homo sapiens
aagaatgttagagtaatgaa

SEQ ID NO: 5822340 - DNA, 18 bp, Homo sapiens
aagaatgttagtaaagga

SEQ ID NO: 5822341 - DNA, 14 bp, Homo sapiens
aagaatgttggttt

SEQ ID NO: 5822342 - DNA, 18 bp, Homo sapiens
aagaatgttggtttactt

SEQ ID NO: 5822343 - DNA, 20 bp, Homo sapiens
aagaatgttggtttactttc

SEQ ID NO: 5822344 - DNA, 20 bp, Homo sapiens
aagaatgtttaatagaaaat

SEQ ID NO: 5822345 - DNA, 15 bp, Homo sapiens
aagaatgtttcagtt

SEQ ID NO: 5822346 - DNA, 13 bp, Homo sapiens
aagaatgtttctg

SEQ ID NO: 5822347 - DNA, 15 bp, Homo sapiens
aagaatgtttctgga

SEQ ID NO: 5822348 - DNA, 18 bp, Homo sapiens
aagaattaagatacaaat

SEQ ID NO: 5822349 - DNA, 15 bp, Homo sapiens
aagaattaatattta

SEQ ID NO: 5822350 - DNA, 12 bp, Homo sapiens
aagaattaatga

SEQ ID NO: 5822351 - DNA, 18 bp, Homo sapiens
aagaattaatgacaacaa

SEQ ID NO: 5822352 - DNA, 12 bp, Homo sapiens
aagaattacagt

SEQ ID NO: 5822353 - DNA, 13 bp, Homo sapiens
aagaattacagta

SEQ ID NO: 5822354 - DNA, 14 bp, Homo sapiens
aagaattacagtac

SEQ ID NO: 5822355 - DNA, 19 bp, Homo sapiens
aagaattattcagtgaatt

SEQ ID NO: 5822356 - DNA, 17 bp, Homo sapiens
aagaattatttttgtgt

SEQ ID NO: 5822357 - DNA, 12 bp, Homo sapiens
aagaattcaaat

SEQ ID NO: 5822358 - DNA, 21 bp, Homo sapiens
aagaattcaaatttgtaataa

SEQ ID NO: 5822359 - DNA, 22 bp, Homo sapiens
aagaattcaaatttgtaataaa

SEQ ID NO: 5822360 - DNA, 17 bp, Homo sapiens
aagaattcaaattttat

SEQ ID NO: 5822361 - DNA, 23 bp, Homo sapiens
aagaattcctacaatatatattc

SEQ ID NO: 5822362 - DNA, 17 bp, Homo sapiens
aagaattctagcatgct

SEQ ID NO: 5822363 - DNA, 15 bp, Homo sapiens
aagaattctattttg

SEQ ID NO: 5822364 - DNA, 19 bp, Homo sapiens
aagaattctgattgatttg

SEQ ID NO: 5822365 - DNA, 20 bp, Homo sapiens
aagaattctgattgatttga

SEQ ID NO: 5822366 - DNA, 15 bp, Homo sapiens
aagaattcttaacat

SEQ ID NO: 5822367 - DNA, 12 bp, Homo sapiens
aagaattcttat

SEQ ID NO: 5822368 - DNA, 19 bp, Homo sapiens
aagaattcttatacacatt

SEQ ID NO: 5822369 - DNA, 18 bp, Homo sapiens
aagaattgaacccaggag

SEQ ID NO: 5822370 - DNA, 12 bp, Homo sapiens
aagaattgaaga

SEQ ID NO: 5822371 - DNA, 22 bp, Homo sapiens
aagaattgaccatctgctttta

SEQ ID NO: 5822372 - DNA, 23 bp, Homo sapiens
aagaattgattgggcacatcatt

SEQ ID NO: 5822373 - DNA, 15 bp, Homo sapiens
aagaattgcagtaaa

SEQ ID NO: 5822374 - DNA, 21 bp, Homo sapiens
aagaattggccatcttaaaaa

SEQ ID NO: 5822375 - DNA, 22 bp, Homo sapiens
aagaattgtggtttatatattt

SEQ ID NO: 5822376 - DNA, 22 bp, Homo sapiens
aagaattgtttttgaatttaaa

SEQ ID NO: 5822377 - DNA, 16 bp, Homo sapiens
aagaatttaaaaaagt

SEQ ID NO: 5822378 - DNA, 18 bp, Homo sapiens
aagaatttaatggactgt

SEQ ID NO: 5822379 - DNA, 20 bp, Homo sapiens
aagaatttaatggactgtga

SEQ ID NO: 5822380 - DNA, 16 bp, Homo sapiens
aagaatttactttgga

SEQ ID NO: 5822381 - DNA, 21 bp, Homo sapiens
aagaatttattgaatatttat

SEQ ID NO: 5822382 - DNA, 15 bp, Homo sapiens
aagaatttcaatttg

SEQ ID NO: 5822383 - DNA, 13 bp, Homo sapiens
aagaatttctaaa

SEQ ID NO: 5822384 - DNA, 24 bp, Homo sapiens
aagaatttctaggactgaattatg

SEQ ID NO: 5822385 - DNA, 16 bp, Homo sapiens
aagaatttctggaaga

SEQ ID NO: 5822386 - DNA, 17 bp, Homo sapiens
aagaatttctggaagaa

SEQ ID NO: 5822387 - DNA, 21 bp, Homo sapiens
aagaatttctggaagaaaggc

SEQ ID NO: 5822388 - DNA, 20 bp, Homo sapiens
aagaatttcttggtaagaag

SEQ ID NO: 5822389 - DNA, 22 bp, Homo sapiens
aagaatttgaaagtttccttat

SEQ ID NO: 5822390 - DNA, 14 bp, Homo sapiens
aagaatttgcatac

SEQ ID NO: 5822391 - DNA, 17 bp, Homo sapiens
aagaatttggggcagga

SEQ ID NO: 5822392 - DNA, 14 bp, Homo sapiens
aagaatttgtttaa

SEQ ID NO: 5822393 - DNA, 13 bp, Homo sapiens
aagaatttgtttt

SEQ ID NO: 5822394 - DNA, 17 bp, Homo sapiens
aagaattttaaaaatga

SEQ ID NO: 5822395 - DNA, 20 bp, Homo sapiens
aagaattttaaaaatgaatc

SEQ ID NO: 5822396 - DNA, 17 bp, Homo sapiens
aagaattttatttttct

SEQ ID NO: 5822397 - DNA, 20 bp, Homo sapiens
aagaattttcagaccccagc

SEQ ID NO: 5822398 - DNA, 17 bp, Homo sapiens
aagaattttgagtgaat

SEQ ID NO: 5822399 - DNA, 20 bp, Homo sapiens
aagaatttttcattctcaga

SEQ ID NO: 5822400 - DNA, 13 bp, Homo sapiens
aagaatttttgcc

SEQ ID NO: 5822401 - DNA, 21 bp, Homo sapiens
aagaatttttgcccatatctg

SEQ ID NO: 5822402 - DNA, 23 bp, Homo sapiens
aagaatttttgtttggactgttt

SEQ ID NO: 5822403 - DNA, 15 bp, Homo sapiens
aagaatttttttaat

SEQ ID NO: 5822404 - DNA, 18 bp, Homo sapiens
aagacaaaaagccttgaa

SEQ ID NO: 5822405 - DNA, 22 bp, Homo sapiens
aagacaaaattgtaagccagag

SEQ ID NO: 5822406 - DNA, 23 bp, Homo sapiens
aagacaaaatttaattgtgtaac

SEQ ID NO: 5822407 - DNA, 22 bp, Homo sapiens
aagacaaacactgccatattgt

SEQ ID NO: 5822408 - DNA, 17 bp, Homo sapiens
aagacaaaccactgtac

SEQ ID NO: 5822409 - DNA, 22 bp, Homo sapiens
aagacaaaccactgtacatata

SEQ ID NO: 5822410 - DNA, 15 bp, Homo sapiens
aagacaaactttgca

SEQ ID NO: 5822411 - DNA, 18 bp, Homo sapiens
aagacaaactttgcatct

SEQ ID NO: 5822412 - DNA, 14 bp, Homo sapiens
aagacaaagaagga

SEQ ID NO: 5822413 - DNA, 17 bp, Homo sapiens
aagacaaaggttttcct

SEQ ID NO: 5822414 - DNA, 18 bp, Homo sapiens
aagacaaagtcccagaat

SEQ ID NO: 5822415 - DNA, 21 bp, Homo sapiens
aagacaaagtcccagaattgt

SEQ ID NO: 5822416 - DNA, 21 bp, Homo sapiens
aagacaaataaatgattatat

SEQ ID NO: 5822417 - DNA, 13 bp, Homo sapiens
aagacaaatgcag

SEQ ID NO: 5822418 - DNA, 14 bp, Homo sapiens
aagacaaatgggac

SEQ ID NO: 5822419 - DNA, 13 bp, Homo sapiens
aagacaaattttg

SEQ ID NO: 5822420 - DNA, 15 bp, Homo sapiens
aagacaaattttgca

SEQ ID NO: 5822421 - DNA, 12 bp, Homo sapiens
aagacaacacaa

SEQ ID NO: 5822422 - DNA, 13 bp, Homo sapiens
aagacaacagaaa

SEQ ID NO: 5822423 - DNA, 17 bp, Homo sapiens
aagacaacatcttaaat

SEQ ID NO: 5822424 - DNA, 17 bp, Homo sapiens
aagacaacattgtaaga

SEQ ID NO: 5822425 - DNA, 13 bp, Homo sapiens
aagacaagaaaat

SEQ ID NO: 5822426 - DNA, 13 bp, Homo sapiens
aagacaagctcct

SEQ ID NO: 5822427 - DNA, 13 bp, Homo sapiens
aagacaagctgca

SEQ ID NO: 5822428 - DNA, 12 bp, Homo sapiens
aagacaaggctg

SEQ ID NO: 5822429 - DNA, 14 bp, Homo sapiens
aagacaagtctgag

SEQ ID NO: 5822430 - DNA, 23 bp, Homo sapiens
aagacaagtgatgctaaaacctg

SEQ ID NO: 5822431 - DNA, 17 bp, Homo sapiens
aagacaataattacatt

SEQ ID NO: 5822432 - DNA, 17 bp, Homo sapiens
aagacaatagtatttct

SEQ ID NO: 5822433 - DNA, 19 bp, Homo sapiens
aagacaatcactgaaacaa

SEQ ID NO: 5822434 - DNA, 22 bp, Homo sapiens
aagacaatgacttactgtacat

SEQ ID NO: 5822435 - DNA, 20 bp, Homo sapiens
aagacaatttgatacataat

SEQ ID NO: 5822436 - DNA, 20 bp, Homo sapiens
aagacaattttttttcaaat

SEQ ID NO: 5822437 - DNA, 21 bp, Homo sapiens
aagacacaaggtgatttcaga

SEQ ID NO: 5822438 - DNA, 13 bp, Homo sapiens
aagacacacagcc

SEQ ID NO: 5822439 - DNA, 14 bp, Homo sapiens
aagacacacagcct

SEQ ID NO: 5822440 - DNA, 17 bp, Homo sapiens
aagacacacagcctttc

SEQ ID NO: 5822441 - DNA, 22 bp, Homo sapiens
aagacacacagcctttctgtat

SEQ ID NO: 5822442 - DNA, 23 bp, Homo sapiens
aagacacacaggagtcctttctt

SEQ ID NO: 5822443 - DNA, 19 bp, Homo sapiens
aagacacagaatagtttac

SEQ ID NO: 5822444 - DNA, 14 bp, Homo sapiens
aagacacaggctca

SEQ ID NO: 5822445 - DNA, 23 bp, Homo sapiens
aagacacaggggacacccagaaa

SEQ ID NO: 5822446 - DNA, 20 bp, Homo sapiens
aagacacatgctgaggtttt

SEQ ID NO: 5822447 - DNA, 16 bp, Homo sapiens
aagacaccaaatataa

SEQ ID NO: 5822448 - DNA, 14 bp, Homo sapiens
aagacaccagagca

SEQ ID NO: 5822449 - DNA, 21 bp, Homo sapiens
aagacaccagagcagatgcag

SEQ ID NO: 5822450 - DNA, 20 bp, Homo sapiens
aagacaccagagtgtatgca

SEQ ID NO: 5822451 - DNA, 21 bp, Homo sapiens
aagacaccagagtgtatgcat

SEQ ID NO: 5822452 - DNA, 22 bp, Homo sapiens
aagacaccagagtgtatgcata

SEQ ID NO: 5822453 - DNA, 12 bp, Homo sapiens
aagacacccagt

SEQ ID NO: 5822454 - DNA, 14 bp, Homo sapiens
aagacacctgcagc

SEQ ID NO: 5822455 - DNA, 20 bp, Homo sapiens
aagacacctgccttatgcaa

SEQ ID NO: 5822456 - DNA, 21 bp, Homo sapiens
aagacaccttctgagtattct

SEQ ID NO: 5822457 - DNA, 19 bp, Homo sapiens
aagacgcaaggtgtgctct

SEQ ID NO: 5822458 - DNA, 16 bp, Homo sapiens
aagacgcaccagccca

SEQ ID NO: 5822459 - DNA, 14 bp, Homo sapiens
aagacgcctgagct

SEQ ID NO: 5822460 - DNA, 21 bp, Homo sapiens
aagacgctcaagaatcctctg

SEQ ID NO: 5822461 - DNA, 17 bp, Homo sapiens
aagacgctgtgctgccc

SEQ ID NO: 5822462 - DNA, 18 bp, Homo sapiens
aagacgctgtgctgccct

SEQ ID NO: 5822463 - DNA, 19 bp, Homo sapiens
aagacgctgtgctgccctg

SEQ ID NO: 5822464 - DNA, 21 bp, Homo sapiens
aagacggattatctagagaat

SEQ ID NO: 5822465 - DNA, 12 bp, Homo sapiens
aagacggccttg

SEQ ID NO: 5822466 - DNA, 15 bp, Homo sapiens
aagacgtctcccctt

SEQ ID NO: 5822467 - DNA, 16 bp, Homo sapiens
aagacgtgattttgct

SEQ ID NO: 5822468 - DNA, 23 bp, Homo sapiens
aagacgtggtctagaccagggct

SEQ ID NO: 5822469 - DNA, 23 bp, Homo sapiens
aagacgtgtttgtgtttgtgtgt

SEQ ID NO: 5822470 - DNA, 12 bp, Homo sapiens
aagacgtttttg

SEQ ID NO: 5822471 - DNA, 14 bp, Homo sapiens
aagactaacaaagg

SEQ ID NO: 5822472 - DNA, 18 bp, Homo sapiens
aagactaacaaaggcagc

SEQ ID NO: 5822473 - DNA, 15 bp, Homo sapiens
aagactaactaaaat

SEQ ID NO: 5822474 - DNA, 23 bp, Homo sapiens
aagactaagcaccataaccaaga

SEQ ID NO: 5822475 - DNA, 15 bp, Homo sapiens
aagactacaataaaa

SEQ ID NO: 5822476 - DNA, 12 bp, Homo sapiens
aagactacctgg

SEQ ID NO: 5822477 - DNA, 22 bp, Homo sapiens
aagactactattcctttccaga

SEQ ID NO: 5822478 - DNA, 15 bp, Homo sapiens
aagactagccagcca

SEQ ID NO: 5822479 - DNA, 18 bp, Homo sapiens
aagactagttatatattc

SEQ ID NO: 5822480 - DNA, 20 bp, Homo sapiens
aagactatatatataaatgt

SEQ ID NO: 5822481 - DNA, 22 bp, Homo sapiens
aagactatatatataaatgtat

SEQ ID NO: 5822482 - DNA, 20 bp, Homo sapiens
aagactatccaacttaacat

SEQ ID NO: 5822483 - DNA, 17 bp, Homo sapiens
aagactatctaaatgtt

SEQ ID NO: 5822484 - DNA, 16 bp, Homo sapiens
aagactatctacaaaa

SEQ ID NO: 5822485 - DNA, 22 bp, Homo sapiens
aagactatcttactatttcaca

SEQ ID NO: 5822486 - DNA, 21 bp, Homo sapiens
aagactattaagagcaataaa

SEQ ID NO: 5822487 - DNA, 14 bp, Homo sapiens
aagactattcaaac

SEQ ID NO: 5822488 - DNA, 14 bp, Homo sapiens
aagactatttacca

SEQ ID NO: 5822489 - DNA, 19 bp, Homo sapiens
aagactcaaatgttctaag

SEQ ID NO: 5822490 - DNA, 14 bp, Homo sapiens
aagactcagatgat

SEQ ID NO: 5822491 - DNA, 11 bp, Homo sapiens
aagactcagcc

SEQ ID NO: 5822492 - DNA, 12 bp, Homo sapiens
aagactcagcca

SEQ ID NO: 5822493 - DNA, 16 bp, Homo sapiens
aagactccaaagaaat

SEQ ID NO: 5822494 - DNA, 17 bp, Homo sapiens
aagactccaaagaaatg

SEQ ID NO: 5822495 - DNA, 16 bp, Homo sapiens
aagactcctcggcctg

SEQ ID NO: 5822496 - DNA, 13 bp, Homo sapiens
aagactcctctgg

SEQ ID NO: 5822497 - DNA, 14 bp, Homo sapiens
aagactcctctggg

SEQ ID NO: 5822498 - DNA, 12 bp, Homo sapiens
aagactcctgca

SEQ ID NO: 5822499 - DNA, 16 bp, Homo sapiens
aagactcgaataaaat

SEQ ID NO: 5822500 - DNA, 22 bp, Homo sapiens
aagactctaccagactgtgtat

SEQ ID NO: 5822501 - DNA, 16 bp, Homo sapiens
aagactctatgctctg

SEQ ID NO: 5822502 - DNA, 18 bp, Homo sapiens
aagactctatgctctgga

SEQ ID NO: 5822503 - DNA, 17 bp, Homo sapiens
aagactctattctcaaa

SEQ ID NO: 5822504 - DNA, 20 bp, Homo sapiens
aagactctccactgacctgg

SEQ ID NO: 5822505 - DNA, 10 bp, Homo sapiens
aagactctga

SEQ ID NO: 5822506 - DNA, 12 bp, Homo sapiens
aagactctgagc

SEQ ID NO: 5822507 - DNA, 13 bp, Homo sapiens
aagactctgagcc

SEQ ID NO: 5822508 - DNA, 17 bp, Homo sapiens
aagactctgcagccctc

SEQ ID NO: 5822509 - DNA, 13 bp, Homo sapiens
aagactctgctct

SEQ ID NO: 5822510 - DNA, 22 bp, Homo sapiens
aagactctggaggtcatctggc

SEQ ID NO: 5822511 - DNA, 16 bp, Homo sapiens
aagactctgtgtggct

SEQ ID NO: 5822512 - DNA, 13 bp, Homo sapiens
aagactcttggac

SEQ ID NO: 5822513 - DNA, 22 bp, Homo sapiens
aagactctttttggttgtcctc

SEQ ID NO: 5822514 - DNA, 14 bp, Homo sapiens
aagactgaaacggc

SEQ ID NO: 5822515 - DNA, 12 bp, Homo sapiens
aagactgaaaga

SEQ ID NO: 5822516 - DNA, 14 bp, Homo sapiens
aagactgaaagaat

SEQ ID NO: 5822517 - DNA, 16 bp, Homo sapiens
aagactgaacatgttt

SEQ ID NO: 5822518 - DNA, 17 bp, Homo sapiens
aagactgaacatgttta

SEQ ID NO: 5822519 - DNA, 12 bp, Homo sapiens
aagactgaagac

SEQ ID NO: 5822520 - DNA, 19 bp, Homo sapiens
aagactgaagatggctttt

SEQ ID NO: 5822521 - DNA, 21 bp, Homo sapiens
aagactgagccagattggcca

SEQ ID NO: 5822522 - DNA, 18 bp, Homo sapiens
aagactgagccagcttag

SEQ ID NO: 5822523 - DNA, 17 bp, Homo sapiens
aagactgagtacgttgt

SEQ ID NO: 5822524 - DNA, 22 bp, Homo sapiens
aagactgagtacgttgtgcatt

SEQ ID NO: 5822525 - DNA, 15 bp, Homo sapiens
aagactgataacaac

SEQ ID NO: 5822526 - DNA, 20 bp, Homo sapiens
aagactgatgaagaaattta

SEQ ID NO: 5822527 - DNA, 18 bp, Homo sapiens
aagactgcaaactttttt

SEQ ID NO: 5822528 - DNA, 12 bp, Homo sapiens
aagactgcagct

SEQ ID NO: 5822529 - DNA, 13 bp, Homo sapiens
aagactgcagctg

SEQ ID NO: 5822530 - DNA, 16 bp, Homo sapiens
aagactgcagctgctg

SEQ ID NO: 5822531 - DNA, 23 bp, Homo sapiens
aagactgccacgtgccttaggaa

SEQ ID NO: 5822532 - DNA, 15 bp, Homo sapiens
aagactgccaggtgg

SEQ ID NO: 5822533 - DNA, 22 bp, Homo sapiens
aagactgcctcaaaaaaaaaac

SEQ ID NO: 5822534 - DNA, 12 bp, Homo sapiens
aagactgctggt

SEQ ID NO: 5822535 - DNA, 18 bp, Homo sapiens
aagactgctgtggccagg

SEQ ID NO: 5822536 - DNA, 24 bp, Homo sapiens
aagactggacatttaacttttcta

SEQ ID NO: 5822537 - DNA, 13 bp, Homo sapiens
aagactggagaaa

SEQ ID NO: 5822538 - DNA, 23 bp, Homo sapiens
aagactggagactgtccacttct

SEQ ID NO: 5822539 - DNA, 11 bp, Homo sapiens
aagactggctt

SEQ ID NO: 5822540 - DNA, 12 bp, Homo sapiens
aagactgggctg

SEQ ID NO: 5822541 - DNA, 19 bp, Homo sapiens
aagactggtttgtttgctt

SEQ ID NO: 5822542 - DNA, 21 bp, Homo sapiens
aagactggtttgtttgcttaa

SEQ ID NO: 5822543 - DNA, 18 bp, Homo sapiens
aagactgtaaattccaaa

SEQ ID NO: 5822544 - DNA, 20 bp, Homo sapiens
aagactgtactggccagtgt

SEQ ID NO: 5822545 - DNA, 17 bp, Homo sapiens
aagactgtagatatgta

SEQ ID NO: 5822546 - DNA, 21 bp, Homo sapiens
aagactgtcaaatgaactttt

SEQ ID NO: 5822547 - DNA, 21 bp, Homo sapiens
aagactgtgaacagcttgctg

SEQ ID NO: 5822548 - DNA, 19 bp, Homo sapiens
aagactgtggaaatgccaa

SEQ ID NO: 5822549 - DNA, 12 bp, Homo sapiens
aagactgtggct

SEQ ID NO: 5822550 - DNA, 17 bp, Homo sapiens
aagactgttgctcaaat

SEQ ID NO: 5822551 - DNA, 17 bp, Homo sapiens
aagactgttgtgatctt

SEQ ID NO: 5822552 - DNA, 21 bp, Homo sapiens
aagactgttgtgatcttgcat

SEQ ID NO: 5822553 - DNA, 17 bp, Homo sapiens
aagactgttgtgctcca

SEQ ID NO: 5822554 - DNA, 22 bp, Homo sapiens
aagacttaaagggcccaatgaa

SEQ ID NO: 5822555 - DNA, 21 bp, Homo sapiens
aagacttaactggcccagaag

SEQ ID NO: 5822556 - DNA, 21 bp, Homo sapiens
aagacttaatcatatcaactt

SEQ ID NO: 5822557 - DNA, 19 bp, Homo sapiens
aagacttaatctttgctga

SEQ ID NO: 5822558 - DNA, 16 bp, Homo sapiens
aagacttaatgagact

SEQ ID NO: 5822559 - DNA, 17 bp, Homo sapiens
aagacttagattgtgct

SEQ ID NO: 5822560 - DNA, 17 bp, Homo sapiens
aagacttcactgcagcc

SEQ ID NO: 5822561 - DNA, 18 bp, Homo sapiens
aagacttcactgcagcct

SEQ ID NO: 5822562 - DNA, 20 bp, Homo sapiens
aagacttcactgcagccttt

SEQ ID NO: 5822563 - DNA, 15 bp, Homo sapiens
aagacttcagatttc

SEQ ID NO: 5822564 - DNA, 16 bp, Homo sapiens
aagacttcagatttca

SEQ ID NO: 5822565 - DNA, 17 bp, Homo sapiens
aagacttcagatttcaa

SEQ ID NO: 5822566 - DNA, 18 bp, Homo sapiens
aagacttcagatttcaaa

SEQ ID NO: 5822567 - DNA, 18 bp, Homo sapiens
aagacttcagtatgttgt

SEQ ID NO: 5822568 - DNA, 21 bp, Homo sapiens
aagacttcagtatgttgtcaa

SEQ ID NO: 5822569 - DNA, 13 bp, Homo sapiens
aagacttcatgtt

SEQ ID NO: 5822570 - DNA, 21 bp, Homo sapiens
aagacttcattgtccctcttc

SEQ ID NO: 5822571 - DNA, 18 bp, Homo sapiens
aagacttccaaagaatgt

SEQ ID NO: 5822572 - DNA, 13 bp, Homo sapiens
aagacttccagct

SEQ ID NO: 5822573 - DNA, 22 bp, Homo sapiens
aagacttccagctttctctttg

SEQ ID NO: 5822574 - DNA, 18 bp, Homo sapiens
aagacttccctaacactt

SEQ ID NO: 5822575 - DNA, 12 bp, Homo sapiens
aagacttcctct

SEQ ID NO: 5822576 - DNA, 23 bp, Homo sapiens
aagacttcctctctaccccccac

SEQ ID NO: 5822577 - DNA, 15 bp, Homo sapiens
aagacttcctctggc

SEQ ID NO: 5822578 - DNA, 22 bp, Homo sapiens
aagacttctcaaagagaattgt

SEQ ID NO: 5822579 - DNA, 13 bp, Homo sapiens
aagacttgacagt

SEQ ID NO: 5822580 - DNA, 14 bp, Homo sapiens
aagacttgacagtg

SEQ ID NO: 5822581 - DNA, 21 bp, Homo sapiens
aagacttgacgcagcccccca

SEQ ID NO: 5822582 - DNA, 17 bp, Homo sapiens
aagacttgagacaatgt

SEQ ID NO: 5822583 - DNA, 20 bp, Homo sapiens
aagacttgagacaatgtttt

SEQ ID NO: 5822584 - DNA, 21 bp, Homo sapiens
aagacttgagacaatgttttc

SEQ ID NO: 5822585 - DNA, 16 bp, Homo sapiens
aagacttgagccatcc

SEQ ID NO: 5822586 - DNA, 14 bp, Homo sapiens
aagacttgctttaa

SEQ ID NO: 5822587 - DNA, 16 bp, Homo sapiens
aagacttggcaacaga

SEQ ID NO: 5822588 - DNA, 17 bp, Homo sapiens
aagacttggcaacagaa

SEQ ID NO: 5822589 - DNA, 12 bp, Homo sapiens
aagacttgtttt

SEQ ID NO: 5822590 - DNA, 20 bp, Homo sapiens
aagactttagcttttccttc

SEQ ID NO: 5822591 - DNA, 23 bp, Homo sapiens
aagactttccccatactctgtct

SEQ ID NO: 5822592 - DNA, 11 bp, Homo sapiens
aagactttgat

SEQ ID NO: 5822593 - DNA, 19 bp, Homo sapiens
aagactttgatccatgtat

SEQ ID NO: 5822594 - DNA, 14 bp, Homo sapiens
aagactttgatcct

SEQ ID NO: 5822595 - DNA, 19 bp, Homo sapiens
aagactttgatccttggaa

SEQ ID NO: 5822596 - DNA, 22 bp, Homo sapiens
aagactttgatccttggaaacc

SEQ ID NO: 5822597 - DNA, 16 bp, Homo sapiens
aagactttggaaagac

SEQ ID NO: 5822598 - DNA, 15 bp, Homo sapiens
aagactttggttatt

SEQ ID NO: 5822599 - DNA, 13 bp, Homo sapiens
aagacttttaaaa

SEQ ID NO: 5822600 - DNA, 23 bp, Homo sapiens
aagacttttagcggtttgcaaac

SEQ ID NO: 5822601 - DNA, 16 bp, Homo sapiens
aagacttttatgtgag

SEQ ID NO: 5822602 - DNA, 16 bp, Homo sapiens
aagacttttctttcct

SEQ ID NO: 5822603 - DNA, 20 bp, Homo sapiens
aagacttttggtagagaagg

SEQ ID NO: 5822604 - DNA, 11 bp, Homo sapiens
aagagaaaaaa

SEQ ID NO: 5822605 - DNA, 12 bp, Homo sapiens
aagagaaaaaaa

SEQ ID NO: 5822606 - DNA, 16 bp, Homo sapiens
aagagaaaaaaaaaca

SEQ ID NO: 5822607 - DNA, 22 bp, Homo sapiens
aagagaaaaaaagtttgccaga

SEQ ID NO: 5822608 - DNA, 22 bp, Homo sapiens
aagagaaaaaaatataaaattt

SEQ ID NO: 5822609 - DNA, 13 bp, Homo sapiens
aagagaaaaaata

SEQ ID NO: 5822610 - DNA, 15 bp, Homo sapiens
aagagaaaaagccct

SEQ ID NO: 5822611 - DNA, 18 bp, Homo sapiens
aagagaaaacatctcatc

SEQ ID NO: 5822612 - DNA, 11 bp, Homo sapiens
aagagaaaaga

SEQ ID NO: 5822613 - DNA, 14 bp, Homo sapiens
aagagaaaagaaaa

SEQ ID NO: 5822614 - DNA, 15 bp, Homo sapiens
aagagaaaagaaaaa

SEQ ID NO: 5822615 - DNA, 15 bp, Homo sapiens
aagagaaaagacagg

SEQ ID NO: 5822616 - DNA, 13 bp, Homo sapiens
aagagaaaatata

SEQ ID NO: 5822617 - DNA, 19 bp, Homo sapiens
aagagaaaccttgcaaact

SEQ ID NO: 5822618 - DNA, 21 bp, Homo sapiens
aagagaaagagacagagactg

SEQ ID NO: 5822619 - DNA, 15 bp, Homo sapiens
aagagaaagaggcca

SEQ ID NO: 5822620 - DNA, 18 bp, Homo sapiens
aagagaaagagtttgaaa

SEQ ID NO: 5822621 - DNA, 22 bp, Homo sapiens
aagagaaatacaagatactttt

SEQ ID NO: 5822622 - DNA, 11 bp, Homo sapiens
aagagaaatct

SEQ ID NO: 5822623 - DNA, 13 bp, Homo sapiens
aagagaaatggta

SEQ ID NO: 5822624 - DNA, 21 bp, Homo sapiens
aagagaacaagcaaatataaa

SEQ ID NO: 5822625 - DNA, 13 bp, Homo sapiens
aagagaacatttt

SEQ ID NO: 5822626 - DNA, 15 bp, Homo sapiens
aagagaacattttac

SEQ ID NO: 5822627 - DNA, 17 bp, Homo sapiens
aagagaacattttactg

SEQ ID NO: 5822628 - DNA, 24 bp, Homo sapiens
aagagaacattttactgttgtaca

SEQ ID NO: 5822629 - DNA, 15 bp, Homo sapiens
aagagaagaaaaaat

SEQ ID NO: 5822630 - DNA, 22 bp, Homo sapiens
aagagaagaaaaaattaagaga

SEQ ID NO: 5822631 - DNA, 13 bp, Homo sapiens
aagagaagaaaga

SEQ ID NO: 5822632 - DNA, 11 bp, Homo sapiens
aagagaagaag

SEQ ID NO: 5822633 - DNA, 13 bp, Homo sapiens
aagagaagaagaa

SEQ ID NO: 5822634 - DNA, 16 bp, Homo sapiens
aagagaagacaaaacg

SEQ ID NO: 5822635 - DNA, 15 bp, Homo sapiens
aagagaagagaaagg

SEQ ID NO: 5822636 - DNA, 17 bp, Homo sapiens
aagagaagatgcctgtt

SEQ ID NO: 5822637 - DNA, 21 bp, Homo sapiens
aagaggttactttagttagca

SEQ ID NO: 5822638 - DNA, 21 bp, Homo sapiens
aagaggttagaaatacttttc

SEQ ID NO: 5822639 - DNA, 18 bp, Homo sapiens
aagaggttctcagcaagt

SEQ ID NO: 5822640 - DNA, 13 bp, Homo sapiens
aagaggttctgca

SEQ ID NO: 5822641 - DNA, 14 bp, Homo sapiens
aagaggttctgcac

SEQ ID NO: 5822642 - DNA, 22 bp, Homo sapiens
aagaggttgggcttccatgcct

SEQ ID NO: 5822643 - DNA, 23 bp, Homo sapiens
aagaggttgggcttccatgcctg

SEQ ID NO: 5822644 - DNA, 15 bp, Homo sapiens
aagaggtttcagcat

SEQ ID NO: 5822645 - DNA, 18 bp, Homo sapiens
aagaggttttaaaaaaat

SEQ ID NO: 5822646 - DNA, 17 bp, Homo sapiens
aagagtaaaaatatgtg

SEQ ID NO: 5822647 - DNA, 14 bp, Homo sapiens
aagagtaaaacatt

SEQ ID NO: 5822648 - DNA, 15 bp, Homo sapiens
aagagtaacacttga

SEQ ID NO: 5822649 - DNA, 20 bp, Homo sapiens
aagagtaacacttgaaaagt

SEQ ID NO: 5822650 - DNA, 22 bp, Homo sapiens
aagagtaagcacctttagaata

SEQ ID NO: 5822651 - DNA, 19 bp, Homo sapiens
aagagtaatggtattttct

SEQ ID NO: 5822652 - DNA, 19 bp, Homo sapiens
aagagtacactcagccact

SEQ ID NO: 5822653 - DNA, 21 bp, Homo sapiens
aagagtacactcagccactgt

SEQ ID NO: 5822654 - DNA, 13 bp, Homo sapiens
aagagtagaaaag

SEQ ID NO: 5822655 - DNA, 20 bp, Homo sapiens
aagagtagaaactgcaggga

SEQ ID NO: 5822656 - DNA, 15 bp, Homo sapiens
aagagtagaattgca

SEQ ID NO: 5822657 - DNA, 18 bp, Homo sapiens
aagagtagcatttcattc

SEQ ID NO: 5822658 - DNA, 15 bp, Homo sapiens
aagagtagccgattt

SEQ ID NO: 5822659 - DNA, 16 bp, Homo sapiens
aagagtaggaagactt

SEQ ID NO: 5822660 - DNA, 18 bp, Homo sapiens
aagagtaggaagactttg

SEQ ID NO: 5822661 - DNA, 20 bp, Homo sapiens
aagagtaggaagactttgga

SEQ ID NO: 5822662 - DNA, 19 bp, Homo sapiens
aagagtagttgatgttgca

SEQ ID NO: 5822663 - DNA, 23 bp, Homo sapiens
aagagtatcaaaggcagaaagga

SEQ ID NO: 5822664 - DNA, 14 bp, Homo sapiens
aagagtatgagaaa

SEQ ID NO: 5822665 - DNA, 22 bp, Homo sapiens
aagagtatgagaaatacagtgc

SEQ ID NO: 5822666 - DNA, 14 bp, Homo sapiens
aagagtatgtagtg

SEQ ID NO: 5822667 - DNA, 21 bp, Homo sapiens
aagagtatgtggcaaaacata

SEQ ID NO: 5822668 - DNA, 15 bp, Homo sapiens
aagagtattccattt

SEQ ID NO: 5822669 - DNA, 12 bp, Homo sapiens
aagagtattttt

SEQ ID NO: 5822670 - DNA, 17 bp, Homo sapiens
aagagtccaactcactt

SEQ ID NO: 5822671 - DNA, 23 bp, Homo sapiens
aagagtccaactcacttccagtg

SEQ ID NO: 5822672 - DNA, 18 bp, Homo sapiens
aagagtccattgtttaaa

SEQ ID NO: 5822673 - DNA, 14 bp, Homo sapiens
aagagtcctccttc

SEQ ID NO: 5822674 - DNA, 17 bp, Homo sapiens
aagagtcctccttccca

SEQ ID NO: 5822675 - DNA, 15 bp, Homo sapiens
aagagtcctctgaat

SEQ ID NO: 5822676 - DNA, 12 bp, Homo sapiens
aagagtcctgag

SEQ ID NO: 5822677 - DNA, 23 bp, Homo sapiens
aagagtcctgaggcagaacctgg

SEQ ID NO: 5822678 - DNA, 22 bp, Homo sapiens
aagagtcgctgtgccacaggct

SEQ ID NO: 5822679 - DNA, 13 bp, Homo sapiens
aagagtctaaaga

SEQ ID NO: 5822680 - DNA, 14 bp, Homo sapiens
aagagtctaaagat

SEQ ID NO: 5822681 - DNA, 24 bp, Homo sapiens
aagagtctaaagatggagtttcta

SEQ ID NO: 5822682 - DNA, 20 bp, Homo sapiens
aagagtctagattcaaaggt

SEQ ID NO: 5822683 - DNA, 19 bp, Homo sapiens
aagagtctctccagcctca

SEQ ID NO: 5822684 - DNA, 19 bp, Homo sapiens
aagagtctctggctcagct

SEQ ID NO: 5822685 - DNA, 22 bp, Homo sapiens
aagagtctctggctcagctgtg

SEQ ID NO: 5822686 - DNA, 14 bp, Homo sapiens
aagagtctgggacc

SEQ ID NO: 5822687 - DNA, 22 bp, Homo sapiens
aagagtctgtattcctgatatg

SEQ ID NO: 5822688 - DNA, 15 bp, Homo sapiens
aagagtctgtctcaa

SEQ ID NO: 5822689 - DNA, 13 bp, Homo sapiens
aagagtctgtctt

SEQ ID NO: 5822690 - DNA, 14 bp, Homo sapiens
aagagtcttcaaca

SEQ ID NO: 5822691 - DNA, 14 bp, Homo sapiens
aagagtcttccaat

SEQ ID NO: 5822692 - DNA, 16 bp, Homo sapiens
aagagtctttcttctt

SEQ ID NO: 5822693 - DNA, 20 bp, Homo sapiens
aagagtgactagtacaaatt

SEQ ID NO: 5822694 - DNA, 22 bp, Homo sapiens
aagagtgactctccaggggtcc

SEQ ID NO: 5822695 - DNA, 15 bp, Homo sapiens
aagagtgagaactag

SEQ ID NO: 5822696 - DNA, 19 bp, Homo sapiens
aagagtgagctctggtgga

SEQ ID NO: 5822697 - DNA, 23 bp, Homo sapiens
aagagtgatagtcttttgctttt

SEQ ID NO: 5822698 - DNA, 17 bp, Homo sapiens
aagagtgatgggaaaga

SEQ ID NO: 5822699 - DNA, 13 bp, Homo sapiens
aagagtgattgca

SEQ ID NO: 5822700 - DNA, 17 bp, Homo sapiens
aagagtgattgcagctt

SEQ ID NO: 5822701 - DNA, 12 bp, Homo sapiens
aagagtgccctg

SEQ ID NO: 5822702 - DNA, 19 bp, Homo sapiens
aagagtgccctgctttgca

SEQ ID NO: 5822703 - DNA, 14 bp, Homo sapiens
aagagtgctaagca

SEQ ID NO: 5822704 - DNA, 14 bp, Homo sapiens
aagagtgctgagaa

SEQ ID NO: 5822705 - DNA, 19 bp, Homo sapiens
aagagtggcatataatttt

SEQ ID NO: 5822706 - DNA, 16 bp, Homo sapiens
aagagtggccccacct

SEQ ID NO: 5822707 - DNA, 22 bp, Homo sapiens
aagagtggccccacctggccct

SEQ ID NO: 5822708 - DNA, 19 bp, Homo sapiens
aagagtgggctttgtggaa

SEQ ID NO: 5822709 - DNA, 19 bp, Homo sapiens
aagagtgggggagagcagg

SEQ ID NO: 5822710 - DNA, 15 bp, Homo sapiens
aagagtggggggagg

SEQ ID NO: 5822711 - DNA, 16 bp, Homo sapiens
aagagtggggggagga

SEQ ID NO: 5822712 - DNA, 17 bp, Homo sapiens
aagagtgtaaaatattt

SEQ ID NO: 5822713 - DNA, 12 bp, Homo sapiens
aagagtgtactg

SEQ ID NO: 5822714 - DNA, 13 bp, Homo sapiens
aagagtgtactgg

SEQ ID NO: 5822715 - DNA, 14 bp, Homo sapiens
aagagtgtactggg

SEQ ID NO: 5822716 - DNA, 15 bp, Homo sapiens
aagagtgtactgggg

SEQ ID NO: 5822717 - DNA, 18 bp, Homo sapiens
aagagtgtcactgagctg

SEQ ID NO: 5822718 - DNA, 18 bp, Homo sapiens
aagagtgtctatggagca

SEQ ID NO: 5822719 - DNA, 17 bp, Homo sapiens
aagagtgtgaaatctca

SEQ ID NO: 5822720 - DNA, 12 bp, Homo sapiens
aagagtgtggca

SEQ ID NO: 5822721 - DNA, 13 bp, Homo sapiens
aagagtgtgtgtg

SEQ ID NO: 5822722 - DNA, 18 bp, Homo sapiens
aagagtgtgttataaaat

SEQ ID NO: 5822723 - DNA, 21 bp, Homo sapiens
aagagtgttatcatattggtg

SEQ ID NO: 5822724 - DNA, 13 bp, Homo sapiens
aagagtgttcttt

SEQ ID NO: 5822725 - DNA, 22 bp, Homo sapiens
aagagttacaataaagtttaca

SEQ ID NO: 5822726 - DNA, 17 bp, Homo sapiens
aagagttattcaaatga

SEQ ID NO: 5822727 - DNA, 16 bp, Homo sapiens
aagagttcaagaaata

SEQ ID NO: 5822728 - DNA, 16 bp, Homo sapiens
aagagttcccttgaaa

SEQ ID NO: 5822729 - DNA, 20 bp, Homo sapiens
aagagttctatccccaagct

SEQ ID NO: 5822730 - DNA, 21 bp, Homo sapiens
aagagttctttaggtgcctcc

SEQ ID NO: 5822731 - DNA, 14 bp, Homo sapiens
aagagttggctggt

SEQ ID NO: 5822732 - DNA, 19 bp, Homo sapiens
aagagttggggacagaact

SEQ ID NO: 5822733 - DNA, 14 bp, Homo sapiens
aagagttgtcctga

SEQ ID NO: 5822734 - DNA, 14 bp, Homo sapiens
aagagttgtttata

SEQ ID NO: 5822735 - DNA, 15 bp, Homo sapiens
aagagtttaaaatca

SEQ ID NO: 5822736 - DNA, 19 bp, Homo sapiens
aagagtttaaacaaaaaac

SEQ ID NO: 5822737 - DNA, 18 bp, Homo sapiens
aagagtttaaagagaaaa

SEQ ID NO: 5822738 - DNA, 13 bp, Homo sapiens
aagagtttacaag

SEQ ID NO: 5822739 - DNA, 19 bp, Homo sapiens
aagagtttattattgtact

SEQ ID NO: 5822740 - DNA, 21 bp, Homo sapiens
aagagtttgagacctgaatag

SEQ ID NO: 5822741 - DNA, 19 bp, Homo sapiens
aagagtttgccttataaat

SEQ ID NO: 5822742 - DNA, 18 bp, Homo sapiens
aagagtttgttctgttct

SEQ ID NO: 5822743 - DNA, 13 bp, Homo sapiens
aagagttttctca

SEQ ID NO: 5822744 - DNA, 15 bp, Homo sapiens
aagagttttctcaga

SEQ ID NO: 5822745 - DNA, 13 bp, Homo sapiens
aagagttttggga

SEQ ID NO: 5822746 - DNA, 22 bp, Homo sapiens
aagagtttttttctgtttataa

SEQ ID NO: 5822747 - DNA, 17 bp, Homo sapiens
aagataaaaataataat

SEQ ID NO: 5822748 - DNA, 13 bp, Homo sapiens
aagataaaaatca

SEQ ID NO: 5822749 - DNA, 20 bp, Homo sapiens
aagataaaaggataggaaaa

SEQ ID NO: 5822750 - DNA, 16 bp, Homo sapiens
aagataaacacaaaat

SEQ ID NO: 5822751 - DNA, 17 bp, Homo sapiens
aagataaacacaagatt

SEQ ID NO: 5822752 - DNA, 22 bp, Homo sapiens
aagataaaccgtttttaacaca

SEQ ID NO: 5822753 - DNA, 21 bp, Homo sapiens
aagataaacgtggatgttact

SEQ ID NO: 5822754 - DNA, 17 bp, Homo sapiens
aagataaagatgatcta

SEQ ID NO: 5822755 - DNA, 12 bp, Homo sapiens
aagataaatgag

SEQ ID NO: 5822756 - DNA, 12 bp, Homo sapiens
aagataaatgat

SEQ ID NO: 5822757 - DNA, 19 bp, Homo sapiens
aagataacaagatctttca

SEQ ID NO: 5822758 - DNA, 20 bp, Homo sapiens
aagataacaagatctttcag

SEQ ID NO: 5822759 - DNA, 18 bp, Homo sapiens
aagataacccttattcca

SEQ ID NO: 5822760 - DNA, 18 bp, Homo sapiens
aagataacgcaggagaga

SEQ ID NO: 5822761 - DNA, 21 bp, Homo sapiens
aagataacgcaggagagagag

SEQ ID NO: 5822762 - DNA, 15 bp, Homo sapiens
aagataacttgagca

SEQ ID NO: 5822763 - DNA, 14 bp, Homo sapiens
aagataagcctgag

SEQ ID NO: 5822764 - DNA, 17 bp, Homo sapiens
aagataagcctgagcct

SEQ ID NO: 5822765 - DNA, 20 bp, Homo sapiens
aagataaggactagatacta

SEQ ID NO: 5822766 - DNA, 21 bp, Homo sapiens
aagataagtgtatttttcaat

SEQ ID NO: 5822767 - DNA, 15 bp, Homo sapiens
aagataagttggaaa

SEQ ID NO: 5822768 - DNA, 16 bp, Homo sapiens
aagataagttggaaac

SEQ ID NO: 5822769 - DNA, 18 bp, Homo sapiens
aagataataaattgattt

SEQ ID NO: 5822770 - DNA, 16 bp, Homo sapiens
aagataataatatatg

SEQ ID NO: 5822771 - DNA, 18 bp, Homo sapiens
aagataatattttacata

SEQ ID NO: 5822772 - DNA, 21 bp, Homo sapiens
aagataatcgaagcaaaagta

SEQ ID NO: 5822773 - DNA, 22 bp, Homo sapiens
aagataatgaaatagttatttt

SEQ ID NO: 5822774 - DNA, 16 bp, Homo sapiens
aagataatgcatattt

SEQ ID NO: 5822775 - DNA, 23 bp, Homo sapiens
aagataatgttatacatcctatt

SEQ ID NO: 5822776 - DNA, 16 bp, Homo sapiens
aagataatgttcttta

SEQ ID NO: 5822777 - DNA, 19 bp, Homo sapiens
aagataatttatttcaata

SEQ ID NO: 5822778 - DNA, 19 bp, Homo sapiens
aagataatttgcatattct

SEQ ID NO: 5822779 - DNA, 15 bp, Homo sapiens
aagataattttatgt

SEQ ID NO: 5822780 - DNA, 16 bp, Homo sapiens
aagataattttatgtg

SEQ ID NO: 5822781 - DNA, 14 bp, Homo sapiens
aagatacaaaatgt

SEQ ID NO: 5822782 - DNA, 13 bp, Homo sapiens
aagatacaaataa

SEQ ID NO: 5822783 - DNA, 20 bp, Homo sapiens
aagatacaaattaattttac

SEQ ID NO: 5822784 - DNA, 22 bp, Homo sapiens
aagatacaagaaaaagtagaaa

SEQ ID NO: 5822785 - DNA, 18 bp, Homo sapiens
aagatacacaagagggac

SEQ ID NO: 5822786 - DNA, 22 bp, Homo sapiens
aagatacacattacagccaggt

SEQ ID NO: 5822787 - DNA, 17 bp, Homo sapiens
aagatacactcctgctg

SEQ ID NO: 5822788 - DNA, 20 bp, Homo sapiens
aagatacactgcactttgtt

SEQ ID NO: 5822789 - DNA, 21 bp, Homo sapiens
aagatacactgcactttgttt

SEQ ID NO: 5822790 - DNA, 23 bp, Homo sapiens
aagatacactgcactttgtttag

SEQ ID NO: 5822791 - DNA, 19 bp, Homo sapiens
aagatacactgcagctgaa

SEQ ID NO: 5822792 - DNA, 17 bp, Homo sapiens
aagatacacttgtaaat

SEQ ID NO: 5822793 - DNA, 17 bp, Homo sapiens
aagataccatcagcaaa

SEQ ID NO: 5822794 - DNA, 18 bp, Homo sapiens
aagataccatcagcaaag

SEQ ID NO: 5822795 - DNA, 15 bp, Homo sapiens
aagatacccaaattt

SEQ ID NO: 5822796 - DNA, 22 bp, Homo sapiens
aagatacctaaaagagatttca

SEQ ID NO: 5822797 - DNA, 15 bp, Homo sapiens
aagataccttaaaat

SEQ ID NO: 5822798 - DNA, 16 bp, Homo sapiens
aagataccttaaaatt

SEQ ID NO: 5822799 - DNA, 21 bp, Homo sapiens
aagataccttaaaatttgaaa

SEQ ID NO: 5822800 - DNA, 23 bp, Homo sapiens
aagataccttaaaatttgaaaca

SEQ ID NO: 5822801 - DNA, 18 bp, Homo sapiens
aagatacctttttttttc

SEQ ID NO: 5822802 - DNA, 20 bp, Homo sapiens
aagatacctttttttttctt

SEQ ID NO: 5822803 - DNA, 15 bp, Homo sapiens
aagatacgactttat

SEQ ID NO: 5822804 - DNA, 20 bp, Homo sapiens
aagatactaaggacgttgtt

SEQ ID NO: 5822805 - DNA, 20 bp, Homo sapiens
aagatactaatagagtactt

SEQ ID NO: 5822806 - DNA, 14 bp, Homo sapiens
aagatactgaaata

SEQ ID NO: 5822807 - DNA, 20 bp, Homo sapiens
aagatactgaaataaacgtc

SEQ ID NO: 5822808 - DNA, 23 bp, Homo sapiens
aagatactgctgatgctgaaata

SEQ ID NO: 5822809 - DNA, 23 bp, Homo sapiens
aagatactgtatatgtcaaaaat

SEQ ID NO: 5822810 - DNA, 12 bp, Homo sapiens
aagatactgttt

SEQ ID NO: 5822811 - DNA, 16 bp, Homo sapiens
aagatacttacatgtt

SEQ ID NO: 5822812 - DNA, 17 bp, Homo sapiens
aagatacttacatgttc

SEQ ID NO: 5822813 - DNA, 14 bp, Homo sapiens
aagatactttgtat

SEQ ID NO: 5822814 - DNA, 17 bp, Homo sapiens
aagatgcttctcactgc

SEQ ID NO: 5822815 - DNA, 19 bp, Homo sapiens
aagatgcttctcactgcca

SEQ ID NO: 5822816 - DNA, 14 bp, Homo sapiens
aagatgctttaatt

SEQ ID NO: 5822817 - DNA, 14 bp, Homo sapiens
aagatgcttttcaa

SEQ ID NO: 5822818 - DNA, 13 bp, Homo sapiens
aagatggaaaaaa

SEQ ID NO: 5822819 - DNA, 20 bp, Homo sapiens
aagatggaaaaaaaaaacaa

SEQ ID NO: 5822820 - DNA, 16 bp, Homo sapiens
aagatggactctgaaa

SEQ ID NO: 5822821 - DNA, 21 bp, Homo sapiens
aagatggagaataaattattg

SEQ ID NO: 5822822 - DNA, 20 bp, Homo sapiens
aagatggagacaccctctgg

SEQ ID NO: 5822823 - DNA, 21 bp, Homo sapiens
aagatggagacaccctctggg

SEQ ID NO: 5822824 - DNA, 22 bp, Homo sapiens
aagatggagacaccctctgggg

SEQ ID NO: 5822825 - DNA, 15 bp, Homo sapiens
aagatggagaggaag

SEQ ID NO: 5822826 - DNA, 17 bp, Homo sapiens
aagatggagaggaagaa

SEQ ID NO: 5822827 - DNA, 21 bp, Homo sapiens
aagatggagcaaacctagccc

SEQ ID NO: 5822828 - DNA, 18 bp, Homo sapiens
aagatggagtttctaagg

SEQ ID NO: 5822829 - DNA, 21 bp, Homo sapiens
aagatggataaactgagcctc

SEQ ID NO: 5822830 - DNA, 16 bp, Homo sapiens
aagatggattctcaga

SEQ ID NO: 5822831 - DNA, 17 bp, Homo sapiens
aagatggattctcagat

SEQ ID NO: 5822832 - DNA, 21 bp, Homo sapiens
aagatggatttgacacactca

SEQ ID NO: 5822833 - DNA, 22 bp, Homo sapiens
aagatggcaactgtattaaaga

SEQ ID NO: 5822834 - DNA, 18 bp, Homo sapiens
aagatggcagatacagga

SEQ ID NO: 5822835 - DNA, 20 bp, Homo sapiens
aagatggcgaccaccaaagt

SEQ ID NO: 5822836 - DNA, 21 bp, Homo sapiens
aagatggcgaccaccaaagtc

SEQ ID NO: 5822837 - DNA, 19 bp, Homo sapiens
aagatggctattataatgg

SEQ ID NO: 5822838 - DNA, 17 bp, Homo sapiens
aagatggctgactttgc

SEQ ID NO: 5822839 - DNA, 16 bp, Homo sapiens
aagatggctgctgcct

SEQ ID NO: 5822840 - DNA, 18 bp, Homo sapiens
aagatggctgtgcctctg

SEQ ID NO: 5822841 - DNA, 23 bp, Homo sapiens
aagatggctgtgcctctgcctgt

SEQ ID NO: 5822842 - DNA, 21 bp, Homo sapiens
aagatggcttatttgtataat

SEQ ID NO: 5822843 - DNA, 15 bp, Homo sapiens
aagatggcttttcct

SEQ ID NO: 5822844 - DNA, 21 bp, Homo sapiens
aagatgggaacgcagatgatc

SEQ ID NO: 5822845 - DNA, 12 bp, Homo sapiens
aagatgggagga

SEQ ID NO: 5822846 - DNA, 13 bp, Homo sapiens
aagatgggaggag

SEQ ID NO: 5822847 - DNA, 13 bp, Homo sapiens
aagatgggcacat

SEQ ID NO: 5822848 - DNA, 22 bp, Homo sapiens
aagatgggcacatgaggagggt

SEQ ID NO: 5822849 - DNA, 19 bp, Homo sapiens
aagatgggcatcttttgta

SEQ ID NO: 5822850 - DNA, 20 bp, Homo sapiens
aagatgggcatcttttgtat

SEQ ID NO: 5822851 - DNA, 18 bp, Homo sapiens
aagatggggaccagcagc

SEQ ID NO: 5822852 - DNA, 21 bp, Homo sapiens
aagatgggggcagggctgtgc

SEQ ID NO: 5822853 - DNA, 18 bp, Homo sapiens
aagatggggtctgtaaaa

SEQ ID NO: 5822854 - DNA, 20 bp, Homo sapiens
aagatggggtctgtaaaatc

SEQ ID NO: 5822855 - DNA, 22 bp, Homo sapiens
aagatgggtccaggattcctct

SEQ ID NO: 5822856 - DNA, 21 bp, Homo sapiens
aagatgggtccctggccacca

SEQ ID NO: 5822857 - DNA, 17 bp, Homo sapiens
aagatgggtgattatga

SEQ ID NO: 5822858 - DNA, 18 bp, Homo sapiens
aagatgggtgattatgaa

SEQ ID NO: 5822859 - DNA, 21 bp, Homo sapiens
aagatgggtgattatgaaatg

SEQ ID NO: 5822860 - DNA, 20 bp, Homo sapiens
aagatggtgaagacagaaac

SEQ ID NO: 5822861 - DNA, 21 bp, Homo sapiens
aagatggtggccacagactga

SEQ ID NO: 5822862 - DNA, 21 bp, Homo sapiens
aagatggtggctgtgtctctc

SEQ ID NO: 5822863 - DNA, 19 bp, Homo sapiens
aagatggttcaaagataca

SEQ ID NO: 5822864 - DNA, 19 bp, Homo sapiens
aagatggtttatgcatgta

SEQ ID NO: 5822865 - DNA, 17 bp, Homo sapiens
aagatggtttcaattca

SEQ ID NO: 5822866 - DNA, 18 bp, Homo sapiens
aagatgtaaattgaagaa

SEQ ID NO: 5822867 - DNA, 20 bp, Homo sapiens
aagatgtaataatcatttta

SEQ ID NO: 5822868 - DNA, 22 bp, Homo sapiens
aagatgtaataatcattttaga

SEQ ID NO: 5822869 - DNA, 19 bp, Homo sapiens
aagatgtacatttaataat

SEQ ID NO: 5822870 - DNA, 17 bp, Homo sapiens
aagatgtactataacat

SEQ ID NO: 5822871 - DNA, 20 bp, Homo sapiens
aagatgtactgagaggaggg

SEQ ID NO: 5822872 - DNA, 21 bp, Homo sapiens
aagatgtactgagaggagggg

SEQ ID NO: 5822873 - DNA, 17 bp, Homo sapiens
aagatgtacttctctgt

SEQ ID NO: 5822874 - DNA, 16 bp, Homo sapiens
aagatgtagatttatt

SEQ ID NO: 5822875 - DNA, 22 bp, Homo sapiens
aagatgtagatttatttcatca

SEQ ID NO: 5822876 - DNA, 14 bp, Homo sapiens
aagatgtagcaaac

SEQ ID NO: 5822877 - DNA, 15 bp, Homo sapiens
aagatgtatgttgct

SEQ ID NO: 5822878 - DNA, 21 bp, Homo sapiens
aagatgtattaacctacctgt

SEQ ID NO: 5822879 - DNA, 20 bp, Homo sapiens
aagatgtcaaataaagcaaa

SEQ ID NO: 5822880 - DNA, 19 bp, Homo sapiens
aagatgtcaagctggccgt

SEQ ID NO: 5822881 - DNA, 23 bp, Homo sapiens
aagatgtcccccaggggcccagg

SEQ ID NO: 5822882 - DNA, 12 bp, Homo sapiens
aagatgtctcct

SEQ ID NO: 5822883 - DNA, 21 bp, Homo sapiens
aagatgtcttaacctcaggga

SEQ ID NO: 5822884 - DNA, 12 bp, Homo sapiens
aagatgtgaatt

SEQ ID NO: 5822885 - DNA, 16 bp, Homo sapiens
aagatgtgaattattg

SEQ ID NO: 5822886 - DNA, 20 bp, Homo sapiens
aagatgtgaattattgacac

SEQ ID NO: 5822887 - DNA, 14 bp, Homo sapiens
aagatgtgatattc

SEQ ID NO: 5822888 - DNA, 16 bp, Homo sapiens
aagatgtgatattcta

SEQ ID NO: 5822889 - DNA, 18 bp, Homo sapiens
aagatgtgatattctaag

SEQ ID NO: 5822890 - DNA, 17 bp, Homo sapiens
aagatgtggatcccttt

SEQ ID NO: 5822891 - DNA, 18 bp, Homo sapiens
aagatgtgggttcttttt

SEQ ID NO: 5822892 - DNA, 16 bp, Homo sapiens
aagatgtgtaaacagg

SEQ ID NO: 5822893 - DNA, 14 bp, Homo sapiens
aagatgtgtaaata

SEQ ID NO: 5822894 - DNA, 21 bp, Homo sapiens
aagatgtgtcatgaaaacagc

SEQ ID NO: 5822895 - DNA, 15 bp, Homo sapiens
aagatgtgtcttcaa

SEQ ID NO: 5822896 - DNA, 17 bp, Homo sapiens
aagatgtgtcttcaatt

SEQ ID NO: 5822897 - DNA, 19 bp, Homo sapiens
aagatgtgtcttcaatttg

SEQ ID NO: 5822898 - DNA, 22 bp, Homo sapiens
aagatgtgttcaggcattccag

SEQ ID NO: 5822899 - DNA, 16 bp, Homo sapiens
aagatgtgttcttatt

SEQ ID NO: 5822900 - DNA, 12 bp, Homo sapiens
aagatgtgttgt

SEQ ID NO: 5822901 - DNA, 23 bp, Homo sapiens
aagatgttaacagtattttaaga

SEQ ID NO: 5822902 - DNA, 17 bp, Homo sapiens
aagatgttaagcattta

SEQ ID NO: 5822903 - DNA, 18 bp, Homo sapiens
aagatgttaatctcccag

SEQ ID NO: 5822904 - DNA, 23 bp, Homo sapiens
aagatgttaatctcccagcccac

SEQ ID NO: 5822905 - DNA, 20 bp, Homo sapiens
aagatgttaattacttttga

SEQ ID NO: 5822906 - DNA, 12 bp, Homo sapiens
aagatgttatat

SEQ ID NO: 5822907 - DNA, 18 bp, Homo sapiens
aagatgttatattaaaga

SEQ ID NO: 5822908 - DNA, 21 bp, Homo sapiens
aagatgttatattaaagaaaa

SEQ ID NO: 5822909 - DNA, 16 bp, Homo sapiens
aagatgttatattttt

SEQ ID NO: 5822910 - DNA, 22 bp, Homo sapiens
aagatgttatatttttcttaaa

SEQ ID NO: 5822911 - DNA, 17 bp, Homo sapiens
aagatgttcaatagaac

SEQ ID NO: 5822912 - DNA, 13 bp, Homo sapiens
aagatgttccagt

SEQ ID NO: 5822913 - DNA, 15 bp, Homo sapiens
aagatgttctcctga

SEQ ID NO: 5822914 - DNA, 16 bp, Homo sapiens
aagatgttctcctgat

SEQ ID NO: 5822915 - DNA, 15 bp, Homo sapiens
aagatgttgaagaat

SEQ ID NO: 5822916 - DNA, 21 bp, Homo sapiens
aagatgttgaagaatacagtt

SEQ ID NO: 5822917 - DNA, 22 bp, Homo sapiens
aagatgttgatttttactgtgt

SEQ ID NO: 5822918 - DNA, 18 bp, Homo sapiens
aagatgttgtcttgcgat

SEQ ID NO: 5822919 - DNA, 18 bp, Homo sapiens
aagatgtttaacttaatc

SEQ ID NO: 5822920 - DNA, 15 bp, Homo sapiens
aagatgtttcttata

SEQ ID NO: 5822921 - DNA, 18 bp, Homo sapiens
aagatgttttgtataaaa

SEQ ID NO: 5822922 - DNA, 20 bp, Homo sapiens
aagatgttttgtataaaatc

SEQ ID NO: 5822923 - DNA, 21 bp, Homo sapiens
aagatgttttgtataaaatct

SEQ ID NO: 5822924 - DNA, 12 bp, Homo sapiens
aagattaaagga

SEQ ID NO: 5822925 - DNA, 16 bp, Homo sapiens
aagattaacactaatt

SEQ ID NO: 5822926 - DNA, 19 bp, Homo sapiens
aagattaacactcatttcc

SEQ ID NO: 5822927 - DNA, 20 bp, Homo sapiens
aagattaacactcatttcca

SEQ ID NO: 5822928 - DNA, 22 bp, Homo sapiens
aagattaacactcatttccaat

SEQ ID NO: 5822929 - DNA, 16 bp, Homo sapiens
aagattaacttttcct

SEQ ID NO: 5822930 - DNA, 20 bp, Homo sapiens
aagattaagttataccagca

SEQ ID NO: 5822931 - DNA, 21 bp, Homo sapiens
aagattaataagatttttcaa

SEQ ID NO: 5822932 - DNA, 22 bp, Homo sapiens
aagattaataagatttttcaaa

SEQ ID NO: 5822933 - DNA, 18 bp, Homo sapiens
aagattaatctttaaacc

SEQ ID NO: 5822934 - DNA, 19 bp, Homo sapiens
aagattaatctttaaacca

SEQ ID NO: 5822935 - DNA, 20 bp, Homo sapiens
aagattacaaatcagaagtc

SEQ ID NO: 5822936 - DNA, 18 bp, Homo sapiens
aagattacaacatctgtt

SEQ ID NO: 5822937 - DNA, 20 bp, Homo sapiens
aagattactcagtaatttgt

SEQ ID NO: 5822938 - DNA, 18 bp, Homo sapiens
aagattagaaagaattag

SEQ ID NO: 5822939 - DNA, 15 bp, Homo sapiens
aagattagaggtttg

SEQ ID NO: 5822940 - DNA, 16 bp, Homo sapiens
aagattagaggtttgt

SEQ ID NO: 5822941 - DNA, 17 bp, Homo sapiens
aagattagaggtttgtc

SEQ ID NO: 5822942 - DNA, 24 bp, Homo sapiens
aagattagcaaggtcatttcttca

SEQ ID NO: 5822943 - DNA, 18 bp, Homo sapiens
aagattaggagaaacaca

SEQ ID NO: 5822944 - DNA, 21 bp, Homo sapiens
aagattaggtactatctgtga

SEQ ID NO: 5822945 - DNA, 19 bp, Homo sapiens
aagattagttggacagttt

SEQ ID NO: 5822946 - DNA, 13 bp, Homo sapiens
aagattagtttca

SEQ ID NO: 5822947 - DNA, 17 bp, Homo sapiens
aagattagtttcaatgt

SEQ ID NO: 5822948 - DNA, 19 bp, Homo sapiens
aagattataattgttgcat

SEQ ID NO: 5822949 - DNA, 15 bp, Homo sapiens
aagattatagattct

SEQ ID NO: 5822950 - DNA, 20 bp, Homo sapiens
aagattatagattctaaaga

SEQ ID NO: 5822951 - DNA, 20 bp, Homo sapiens
aagattatatacaaagctgt

SEQ ID NO: 5822952 - DNA, 15 bp, Homo sapiens
aagattatatatcat

SEQ ID NO: 5822953 - DNA, 21 bp, Homo sapiens
aagattatatatcataaagta

SEQ ID NO: 5822954 - DNA, 18 bp, Homo sapiens
aagattatattataataa

SEQ ID NO: 5822955 - DNA, 19 bp, Homo sapiens
aagattatattataataat

SEQ ID NO: 5822956 - DNA, 21 bp, Homo sapiens
aagattatcctgttactgaat

SEQ ID NO: 5822957 - DNA, 19 bp, Homo sapiens
aagattatctgattccttt

SEQ ID NO: 5822958 - DNA, 21 bp, Homo sapiens
aagattatgatgcatacagtt

SEQ ID NO: 5822959 - DNA, 12 bp, Homo sapiens
aagattatgtat

SEQ ID NO: 5822960 - DNA, 22 bp, Homo sapiens
aagattattgtgacttcactgt

SEQ ID NO: 5822961 - DNA, 23 bp, Homo sapiens
aagattattgtgacttcactgta

SEQ ID NO: 5822962 - DNA, 18 bp, Homo sapiens
aagattatttgtgcattt

SEQ ID NO: 5822963 - DNA, 21 bp, Homo sapiens
aagattatttgtgcattttat

SEQ ID NO: 5822964 - DNA, 17 bp, Homo sapiens
aagattattttattatg

SEQ ID NO: 5822965 - DNA, 18 bp, Homo sapiens
aagattattttttaaaaa

SEQ ID NO: 5822966 - DNA, 14 bp, Homo sapiens
aagattcaaagaga

SEQ ID NO: 5822967 - DNA, 16 bp, Homo sapiens
aagattcaagaggata

SEQ ID NO: 5822968 - DNA, 19 bp, Homo sapiens
aagattcacacctgactct

SEQ ID NO: 5822969 - DNA, 14 bp, Homo sapiens
aagattcagctagt

SEQ ID NO: 5822970 - DNA, 15 bp, Homo sapiens
aagattcagctagtg

SEQ ID NO: 5822971 - DNA, 13 bp, Homo sapiens
aagattcagttca

SEQ ID NO: 5822972 - DNA, 24 bp, Homo sapiens
aagattcagttcaaatgttatcct

SEQ ID NO: 5822973 - DNA, 20 bp, Homo sapiens
aagattcatttttaatcatg

SEQ ID NO: 5822974 - DNA, 22 bp, Homo sapiens
aagattccagagctctttgatc

SEQ ID NO: 5822975 - DNA, 14 bp, Homo sapiens
aagattccatttta

SEQ ID NO: 5822976 - DNA, 18 bp, Homo sapiens
aagattccattttggaaa

SEQ ID NO: 5822977 - DNA, 12 bp, Homo sapiens
aagattcccaga

SEQ ID NO: 5822978 - DNA, 20 bp, Homo sapiens
aagattcccagagacaggaa

SEQ ID NO: 5822979 - DNA, 17 bp, Homo sapiens
aagattcccaggagttc

SEQ ID NO: 5822980 - DNA, 20 bp, Homo sapiens
aagattcccggctggacttt

SEQ ID NO: 5822981 - DNA, 23 bp, Homo sapiens
aagattcctcgttattgttgttg

SEQ ID NO: 5822982 - DNA, 14 bp, Homo sapiens
aagattcctgtcct

SEQ ID NO: 5822983 - DNA, 17 bp, Homo sapiens
aagattcgccaatctca

SEQ ID NO: 5822984 - DNA, 21 bp, Homo sapiens
aagattcgccaatctcataca

SEQ ID NO: 5822985 - DNA, 11 bp, Homo sapiens
aagattctaaa

SEQ ID NO: 5822986 - DNA, 14 bp, Homo sapiens
aagattctaatgat

SEQ ID NO: 5822987 - DNA, 11 bp, Homo sapiens
aagattctact

SEQ ID NO: 5822988 - DNA, 11 bp, Homo sapiens
aagattctaga

SEQ ID NO: 5822989 - DNA, 18 bp, Homo sapiens
aagcaacaaaactatgga

SEQ ID NO: 5822990 - DNA, 19 bp, Homo sapiens
aagcaacaaaactatggaa

SEQ ID NO: 5822991 - DNA, 21 bp, Homo sapiens
aagcaacaaagattgagaagc

SEQ ID NO: 5822992 - DNA, 12 bp, Homo sapiens
aagcaacagcac

SEQ ID NO: 5822993 - DNA, 16 bp, Homo sapiens
aagcaacagctggaca

SEQ ID NO: 5822994 - DNA, 22 bp, Homo sapiens
aagcaacagctggacaccccct

SEQ ID NO: 5822995 - DNA, 19 bp, Homo sapiens
aagcaacagtaatctatgt

SEQ ID NO: 5822996 - DNA, 21 bp, Homo sapiens
aagcaacctcagtaatttaga

SEQ ID NO: 5822997 - DNA, 23 bp, Homo sapiens
aagcaacctgggtccaaataaaa

SEQ ID NO: 5822998 - DNA, 17 bp, Homo sapiens
aagcaacctttcccttc

SEQ ID NO: 5822999 - DNA, 16 bp, Homo sapiens
aagcaacgactacttt

SEQ ID NO: 5823000 - DNA, 13 bp, Homo sapiens
aagcaactaattt

SEQ ID NO: 5823001 - DNA, 22 bp, Homo sapiens
aagcaactgtctatttctgctg

SEQ ID NO: 5823002 - DNA, 17 bp, Homo sapiens
aagcaactgtgaattca

SEQ ID NO: 5823003 - DNA, 22 bp, Homo sapiens
aagcaacttcatcccagctgct

SEQ ID NO: 5823004 - DNA, 16 bp, Homo sapiens
aagcaacttttccaac

SEQ ID NO: 5823005 - DNA, 15 bp, Homo sapiens
aagcaagaatggagg

SEQ ID NO: 5823006 - DNA, 15 bp, Homo sapiens
aagcaagacacgtgg

SEQ ID NO: 5823007 - DNA, 19 bp, Homo sapiens
aagcaagacgtcctggaat

SEQ ID NO: 5823008 - DNA, 23 bp, Homo sapiens
aagcaagacgtcctggaatgaag

SEQ ID NO: 5823009 - DNA, 15 bp, Homo sapiens
aagcaagagagatgt

SEQ ID NO: 5823010 - DNA, 22 bp, Homo sapiens
aagcaagaggcaagctgaaatt

SEQ ID NO: 5823011 - DNA, 22 bp, Homo sapiens
aagcaagaggccgtggctgctg

SEQ ID NO: 5823012 - DNA, 21 bp, Homo sapiens
aagcaagatgttttgtataaa

SEQ ID NO: 5823013 - DNA, 14 bp, Homo sapiens
aagcaagcacctgg

SEQ ID NO: 5823014 - DNA, 12 bp, Homo sapiens
aagcaagcaggg

SEQ ID NO: 5823015 - DNA, 13 bp, Homo sapiens
aagcaagcagggg

SEQ ID NO: 5823016 - DNA, 17 bp, Homo sapiens
aagcaagccaatttgga

SEQ ID NO: 5823017 - DNA, 12 bp, Homo sapiens
aagcaagccaga

SEQ ID NO: 5823018 - DNA, 13 bp, Homo sapiens
aagcaagccggca

SEQ ID NO: 5823019 - DNA, 16 bp, Homo sapiens
aagcaagctctcttgc

SEQ ID NO: 5823020 - DNA, 15 bp, Homo sapiens
aagcaagctgtgtta

SEQ ID NO: 5823021 - DNA, 18 bp, Homo sapiens
aagcaagctgtgttactt

SEQ ID NO: 5823022 - DNA, 20 bp, Homo sapiens
aagcaaggaagatatacatg

SEQ ID NO: 5823023 - DNA, 22 bp, Homo sapiens
aagcaaggaagtaagggagtca

SEQ ID NO: 5823024 - DNA, 16 bp, Homo sapiens
aagcaaggatctttca

SEQ ID NO: 5823025 - DNA, 14 bp, Homo sapiens
aagcaaggccagcc

SEQ ID NO: 5823026 - DNA, 22 bp, Homo sapiens
aagcaagggagaaaagagaaac

SEQ ID NO: 5823027 - DNA, 17 bp, Homo sapiens
aagcaagggctccagca

SEQ ID NO: 5823028 - DNA, 15 bp, Homo sapiens
aagcaagggggtgat

SEQ ID NO: 5823029 - DNA, 15 bp, Homo sapiens
aagcaagtatattta

SEQ ID NO: 5823030 - DNA, 20 bp, Homo sapiens
aagcaagtatatttatttct

SEQ ID NO: 5823031 - DNA, 14 bp, Homo sapiens
aagcaataaaactg

SEQ ID NO: 5823032 - DNA, 20 bp, Homo sapiens
aagcaataaaatttttttgg

SEQ ID NO: 5823033 - DNA, 16 bp, Homo sapiens
aagcaataaatgaatg

SEQ ID NO: 5823034 - DNA, 16 bp, Homo sapiens
aagcaataactccaag

SEQ ID NO: 5823035 - DNA, 18 bp, Homo sapiens
aagcaataactccaagca

SEQ ID NO: 5823036 - DNA, 21 bp, Homo sapiens
aagcaataagttcattaaaca

SEQ ID NO: 5823037 - DNA, 13 bp, Homo sapiens
aagcaatacaact

SEQ ID NO: 5823038 - DNA, 23 bp, Homo sapiens
aagcaatacgtttgtgcagaatc

SEQ ID NO: 5823039 - DNA, 14 bp, Homo sapiens
aagcaatactgttt

SEQ ID NO: 5823040 - DNA, 19 bp, Homo sapiens
aagcaatatgcatttaaat

SEQ ID NO: 5823041 - DNA, 14 bp, Homo sapiens
aagcaatattgtat

SEQ ID NO: 5823042 - DNA, 13 bp, Homo sapiens
aagcaatatttcc

SEQ ID NO: 5823043 - DNA, 14 bp, Homo sapiens
aagcaatatttccc

SEQ ID NO: 5823044 - DNA, 19 bp, Homo sapiens
aagcaatcactgggcccag

SEQ ID NO: 5823045 - DNA, 19 bp, Homo sapiens
aagcaatcagcaaacacaa

SEQ ID NO: 5823046 - DNA, 21 bp, Homo sapiens
aagcaatcagcaaacacaata

SEQ ID NO: 5823047 - DNA, 14 bp, Homo sapiens
aagcaatcatttta

SEQ ID NO: 5823048 - DNA, 15 bp, Homo sapiens
aagcaatcattttat

SEQ ID NO: 5823049 - DNA, 19 bp, Homo sapiens
aagcaatccacctgccttg

SEQ ID NO: 5823050 - DNA, 17 bp, Homo sapiens
aagcaatcctcctacct

SEQ ID NO: 5823051 - DNA, 14 bp, Homo sapiens
aagcaatcctcctg

SEQ ID NO: 5823052 - DNA, 17 bp, Homo sapiens
aagcaatcctcctgcct

SEQ ID NO: 5823053 - DNA, 17 bp, Homo sapiens
aagcaatccttctgcct

SEQ ID NO: 5823054 - DNA, 21 bp, Homo sapiens
aagcaatctgattcagcatca

SEQ ID NO: 5823055 - DNA, 23 bp, Homo sapiens
aagcaatctgattcagcatcact

SEQ ID NO: 5823056 - DNA, 13 bp, Homo sapiens
aagcaatgcattt

SEQ ID NO: 5823057 - DNA, 22 bp, Homo sapiens
aagcaatgctgatgaatcactg

SEQ ID NO: 5823058 - DNA, 22 bp, Homo sapiens
aagcaatgggcactggtatttg

SEQ ID NO: 5823059 - DNA, 23 bp, Homo sapiens
aagcaattagtctgaaactggct

SEQ ID NO: 5823060 - DNA, 20 bp, Homo sapiens
aagcaattatttaaagaaag

SEQ ID NO: 5823061 - DNA, 21 bp, Homo sapiens
aagcaattatttaaagaaagt

SEQ ID NO: 5823062 - DNA, 23 bp, Homo sapiens
aagcaattatttaaagaaagtga

SEQ ID NO: 5823063 - DNA, 12 bp, Homo sapiens
aagcaattctga

SEQ ID NO: 5823064 - DNA, 15 bp, Homo sapiens
aagcaattgccctgt

SEQ ID NO: 5823065 - DNA, 13 bp, Homo sapiens
aagcaattgctgc

SEQ ID NO: 5823066 - DNA, 18 bp, Homo sapiens
aagcaatttatatcttta

SEQ ID NO: 5823067 - DNA, 17 bp, Homo sapiens
aagcaatttcagtttta

SEQ ID NO: 5823068 - DNA, 21 bp, Homo sapiens
aagcaatttcagttttaaaaa

SEQ ID NO: 5823069 - DNA, 13 bp, Homo sapiens
aagcaatttgaaa

SEQ ID NO: 5823070 - DNA, 14 bp, Homo sapiens
aagcaattttcctt

SEQ ID NO: 5823071 - DNA, 19 bp, Homo sapiens
aagcaattttccttgaagc

SEQ ID NO: 5823072 - DNA, 19 bp, Homo sapiens
aagcacaaaaaatttaaga

SEQ ID NO: 5823073 - DNA, 21 bp, Homo sapiens
aagcacaaagcagtttttccc

SEQ ID NO: 5823074 - DNA, 20 bp, Homo sapiens
aagcacaacccaccacaaca

SEQ ID NO: 5823075 - DNA, 14 bp, Homo sapiens
aagcacaagacaca

SEQ ID NO: 5823076 - DNA, 23 bp, Homo sapiens
aagcacaagcagagtgcacagct

SEQ ID NO: 5823077 - DNA, 21 bp, Homo sapiens
aagcacaatggtttcaaagaa

SEQ ID NO: 5823078 - DNA, 22 bp, Homo sapiens
aagcacaatggtttcaaagaaa

SEQ ID NO: 5823079 - DNA, 11 bp, Homo sapiens
aagcacacaca

SEQ ID NO: 5823080 - DNA, 15 bp, Homo sapiens
aagcacacacatctg

SEQ ID NO: 5823081 - DNA, 16 bp, Homo sapiens
aagcacacacatctgg

SEQ ID NO: 5823082 - DNA, 19 bp, Homo sapiens
aagcacaccaatcttactt

SEQ ID NO: 5823083 - DNA, 17 bp, Homo sapiens
aagcacaccacaattct

SEQ ID NO: 5823084 - DNA, 22 bp, Homo sapiens
aagcacactgcagggctgctgt

SEQ ID NO: 5823085 - DNA, 24 bp, Homo sapiens
aagcacactgcagggctgctgtgg

SEQ ID NO: 5823086 - DNA, 15 bp, Homo sapiens
aagcacagaaatctg

SEQ ID NO: 5823087 - DNA, 19 bp, Homo sapiens
aagcacagacaattctaat

SEQ ID NO: 5823088 - DNA, 22 bp, Homo sapiens
aagcacagacaattctaatggt

SEQ ID NO: 5823089 - DNA, 11 bp, Homo sapiens
aagcacagagg

SEQ ID NO: 5823090 - DNA, 13 bp, Homo sapiens
aagcacagccctt

SEQ ID NO: 5823091 - DNA, 17 bp, Homo sapiens
aagcacagcctcgggga

SEQ ID NO: 5823092 - DNA, 17 bp, Homo sapiens
aagcacagctcctgcca

SEQ ID NO: 5823093 - DNA, 22 bp, Homo sapiens
aagcacagctctcactggccag

SEQ ID NO: 5823094 - DNA, 13 bp, Homo sapiens
aagcacagctggg

SEQ ID NO: 5823095 - DNA, 19 bp, Homo sapiens
aagcacagcttgggtcagg

SEQ ID NO: 5823096 - DNA, 13 bp, Homo sapiens
aagcacagtcagg

SEQ ID NO: 5823097 - DNA, 15 bp, Homo sapiens
aagcacagtgcctgc

SEQ ID NO: 5823098 - DNA, 12 bp, Homo sapiens
aagcacagtggt

SEQ ID NO: 5823099 - DNA, 11 bp, Homo sapiens
aagcacataca

SEQ ID NO: 5823100 - DNA, 16 bp, Homo sapiens
aagcacatacattaaa

SEQ ID NO: 5823101 - DNA, 20 bp, Homo sapiens
aagcacatacattaaaacta

SEQ ID NO: 5823102 - DNA, 19 bp, Homo sapiens
aagcacatgaataatttca

SEQ ID NO: 5823103 - DNA, 22 bp, Homo sapiens
aagcacatgcttagcttatctt

SEQ ID NO: 5823104 - DNA, 18 bp, Homo sapiens
aagcacatggttcaaatc

SEQ ID NO: 5823105 - DNA, 13 bp, Homo sapiens
aagcacattatgt

SEQ ID NO: 5823106 - DNA, 18 bp, Homo sapiens
aagcacattttaaaagtg

SEQ ID NO: 5823107 - DNA, 21 bp, Homo sapiens
aagcaccaaaataagaaaaga

SEQ ID NO: 5823108 - DNA, 22 bp, Homo sapiens
aagcaccaaaataagaaaagat

SEQ ID NO: 5823109 - DNA, 13 bp, Homo sapiens
aagcaccaaattc

SEQ ID NO: 5823110 - DNA, 20 bp, Homo sapiens
aagcaccaacctccagactc

SEQ ID NO: 5823111 - DNA, 17 bp, Homo sapiens
aagcaccactctgggca

SEQ ID NO: 5823112 - DNA, 14 bp, Homo sapiens
aagcaccagcctca

SEQ ID NO: 5823113 - DNA, 20 bp, Homo sapiens
aagcaccaggaagtgtttat

SEQ ID NO: 5823114 - DNA, 20 bp, Homo sapiens
aagcaccagtgggactgtgg

SEQ ID NO: 5823115 - DNA, 15 bp, Homo sapiens
aagcacccatttcaa

SEQ ID NO: 5823116 - DNA, 18 bp, Homo sapiens
aagcaccccagtcactag

SEQ ID NO: 5823117 - DNA, 12 bp, Homo sapiens
aagcacccttga

SEQ ID NO: 5823118 - DNA, 16 bp, Homo sapiens
aagcaccgcagcatgt

SEQ ID NO: 5823119 - DNA, 17 bp, Homo sapiens
aagcaccgcagcatgtg

SEQ ID NO: 5823120 - DNA, 18 bp, Homo sapiens
aagcaccgcagcatgtgg

SEQ ID NO: 5823121 - DNA, 21 bp, Homo sapiens
aagcacctaaaacccaaaggt

SEQ ID NO: 5823122 - DNA, 14 bp, Homo sapiens
aagcacctatgaaa

SEQ ID NO: 5823123 - DNA, 11 bp, Homo sapiens
aagcacctcaa

SEQ ID NO: 5823124 - DNA, 14 bp, Homo sapiens
aagcacctcctgcc

SEQ ID NO: 5823125 - DNA, 16 bp, Homo sapiens
aagcacctcctgcctc

SEQ ID NO: 5823126 - DNA, 17 bp, Homo sapiens
aagcacctcctgcctcg

SEQ ID NO: 5823127 - DNA, 15 bp, Homo sapiens
aagcacctctcagcc

SEQ ID NO: 5823128 - DNA, 21 bp, Homo sapiens
aagcacctcttgaagaactga

SEQ ID NO: 5823129 - DNA, 21 bp, Homo sapiens
aagcacctgaaccactgtggc

SEQ ID NO: 5823130 - DNA, 12 bp, Homo sapiens
aagcacctgccg

SEQ ID NO: 5823131 - DNA, 13 bp, Homo sapiens
aagcacctgccga

SEQ ID NO: 5823132 - DNA, 17 bp, Homo sapiens
aagcacctgccgacctc

SEQ ID NO: 5823133 - DNA, 14 bp, Homo sapiens
aagcacctgggtgt

SEQ ID NO: 5823134 - DNA, 16 bp, Homo sapiens
aagcaccttagctggc

SEQ ID NO: 5823135 - DNA, 17 bp, Homo sapiens
aagcaccttgaatggaa

SEQ ID NO: 5823136 - DNA, 20 bp, Homo sapiens
aagcacctttagaatattaa

SEQ ID NO: 5823137 - DNA, 19 bp, Homo sapiens
aagcactaagactgcttct

SEQ ID NO: 5823138 - DNA, 16 bp, Homo sapiens
aagcactacaatcatg

SEQ ID NO: 5823139 - DNA, 23 bp, Homo sapiens
aagcactacagagcatcccacag

SEQ ID NO: 5823140 - DNA, 19 bp, Homo sapiens
aagcactatgcccttttat

SEQ ID NO: 5823141 - DNA, 21 bp, Homo sapiens
aagcactattgtttagatatt

SEQ ID NO: 5823142 - DNA, 23 bp, Homo sapiens
aagcactcccttaggcattattt

SEQ ID NO: 5823143 - DNA, 14 bp, Homo sapiens
aagcactctctgca

SEQ ID NO: 5823144 - DNA, 17 bp, Homo sapiens
aagcactcttaaagcaa

SEQ ID NO: 5823145 - DNA, 22 bp, Homo sapiens
aagcactgactgggaccaggca

SEQ ID NO: 5823146 - DNA, 16 bp, Homo sapiens
aagcactgacttctaa

SEQ ID NO: 5823147 - DNA, 17 bp, Homo sapiens
aagcactgacttctaag

SEQ ID NO: 5823148 - DNA, 12 bp, Homo sapiens
aagcactgagca

SEQ ID NO: 5823149 - DNA, 12 bp, Homo sapiens
aagcactgctca

SEQ ID NO: 5823150 - DNA, 22 bp, Homo sapiens
aagcactgctcacgtctctgcc

SEQ ID NO: 5823151 - DNA, 13 bp, Homo sapiens
aagcactgctgtg

SEQ ID NO: 5823152 - DNA, 14 bp, Homo sapiens
aagcactggccttg

SEQ ID NO: 5823153 - DNA, 21 bp, Homo sapiens
aagcactggccttgcctccag

SEQ ID NO: 5823154 - DNA, 22 bp, Homo sapiens
aagcactggccttgcctccagg

SEQ ID NO: 5823155 - DNA, 13 bp, Homo sapiens
aagcactgtgcta

SEQ ID NO: 5823156 - DNA, 16 bp, Homo sapiens
aagcactgtttttcca

SEQ ID NO: 5823157 - DNA, 19 bp, Homo sapiens
aagcacttgaatcagtttt

SEQ ID NO: 5823158 - DNA, 15 bp, Homo sapiens
aagcacttgcctgga

SEQ ID NO: 5823159 - DNA, 18 bp, Homo sapiens
aagcacttgcctggaata

SEQ ID NO: 5823160 - DNA, 19 bp, Homo sapiens
aagcacttgttccttctgc

SEQ ID NO: 5823161 - DNA, 20 bp, Homo sapiens
aagcacttgttccttctgct

SEQ ID NO: 5823162 - DNA, 22 bp, Homo sapiens
aagcacttgttccttctgcttc

SEQ ID NO: 5823163 - DNA, 20 bp, Homo sapiens
aagcactttacgctgtctgt

SEQ ID NO: 5823164 - DNA, 22 bp, Homo sapiens
aagcactttgaaaatatttcta

SEQ ID NO: 5823165 - DNA, 23 bp, Homo sapiens
aagcacttttcctgtctcagcct

SEQ ID NO: 5823166 - DNA, 20 bp, Homo sapiens
aagccaaccttcaaagaaac

SEQ ID NO: 5823167 - DNA, 14 bp, Homo sapiens
aagccaactggtat

SEQ ID NO: 5823168 - DNA, 14 bp, Homo sapiens
aagccaagaaagta

SEQ ID NO: 5823169 - DNA, 20 bp, Homo sapiens
aagccaagaagtgaggcctg

SEQ ID NO: 5823170 - DNA, 22 bp, Homo sapiens
aagccaagaggctgcagccagg

SEQ ID NO: 5823171 - DNA, 9 bp, Homo sapiens
aagccaagc

SEQ ID NO: 5823172 - DNA, 14 bp, Homo sapiens
aagccaagcagcca

SEQ ID NO: 5823173 - DNA, 16 bp, Homo sapiens
aagccaagcagccaag

SEQ ID NO: 5823174 - DNA, 12 bp, Homo sapiens
aagccaagcctg

SEQ ID NO: 5823175 - DNA, 13 bp, Homo sapiens
aagccaagcctgg

SEQ ID NO: 5823176 - DNA, 15 bp, Homo sapiens
aagccaagcctggag

SEQ ID NO: 5823177 - DNA, 16 bp, Homo sapiens
aagccaagcctggagt

SEQ ID NO: 5823178 - DNA, 23 bp, Homo sapiens
aagccaagctccctggagccctg

SEQ ID NO: 5823179 - DNA, 15 bp, Homo sapiens
aagccaagctgtgtt

SEQ ID NO: 5823180 - DNA, 21 bp, Homo sapiens
aagccaagctgtgttcatcca

SEQ ID NO: 5823181 - DNA, 19 bp, Homo sapiens
aagccaagggctaggctct

SEQ ID NO: 5823182 - DNA, 13 bp, Homo sapiens
aagccaagtgggg

SEQ ID NO: 5823183 - DNA, 19 bp, Homo sapiens
aagccaagtggggtgctgg

SEQ ID NO: 5823184 - DNA, 16 bp, Homo sapiens
aagccaagttttctca

SEQ ID NO: 5823185 - DNA, 14 bp, Homo sapiens
aagccaataaataa

SEQ ID NO: 5823186 - DNA, 16 bp, Homo sapiens
aagccaatattttaag

SEQ ID NO: 5823187 - DNA, 16 bp, Homo sapiens
aagccaatcccctcct

SEQ ID NO: 5823188 - DNA, 17 bp, Homo sapiens
aagccaattcagacagg

SEQ ID NO: 5823189 - DNA, 21 bp, Homo sapiens
aagccaatttcaatcttattt

SEQ ID NO: 5823190 - DNA, 11 bp, Homo sapiens
aagccaatttt

SEQ ID NO: 5823191 - DNA, 17 bp, Homo sapiens
aagccaatttttctgca

SEQ ID NO: 5823192 - DNA, 16 bp, Homo sapiens
aagccacaagaaattt

SEQ ID NO: 5823193 - DNA, 21 bp, Homo sapiens
aagccacaaggctggccagca

SEQ ID NO: 5823194 - DNA, 12 bp, Homo sapiens
aagccacacagc

SEQ ID NO: 5823195 - DNA, 16 bp, Homo sapiens
aagccacacagcccag

SEQ ID NO: 5823196 - DNA, 18 bp, Homo sapiens
aagccacacagcccagaa

SEQ ID NO: 5823197 - DNA, 16 bp, Homo sapiens
aagccacagcagagca

SEQ ID NO: 5823198 - DNA, 14 bp, Homo sapiens
aagccacagcccag

SEQ ID NO: 5823199 - DNA, 14 bp, Homo sapiens
aagccacagcttct

SEQ ID NO: 5823200 - DNA, 19 bp, Homo sapiens
aagccacaggcctgagatt

SEQ ID NO: 5823201 - DNA, 22 bp, Homo sapiens
aagccacaggcctgagatttca

SEQ ID NO: 5823202 - DNA, 19 bp, Homo sapiens
aagccacaggcctggcctc

SEQ ID NO: 5823203 - DNA, 14 bp, Homo sapiens
aagccacagtgccc

SEQ ID NO: 5823204 - DNA, 20 bp, Homo sapiens
aagccacagtgcccacctgc

SEQ ID NO: 5823205 - DNA, 16 bp, Homo sapiens
aagccacatcttgctc

SEQ ID NO: 5823206 - DNA, 20 bp, Homo sapiens
aagccacatcttgctctgca

SEQ ID NO: 5823207 - DNA, 22 bp, Homo sapiens
aagccacatcttgctctgcatt

SEQ ID NO: 5823208 - DNA, 19 bp, Homo sapiens
aagccacattatttctagt

SEQ ID NO: 5823209 - DNA, 18 bp, Homo sapiens
aagccaccaagggcctca

SEQ ID NO: 5823210 - DNA, 16 bp, Homo sapiens
aagccaccacacactg

SEQ ID NO: 5823211 - DNA, 14 bp, Homo sapiens
aagccaccagatgt

SEQ ID NO: 5823212 - DNA, 11 bp, Homo sapiens
aagccaccctc

SEQ ID NO: 5823213 - DNA, 18 bp, Homo sapiens
aagccacccttccctgcc

SEQ ID NO: 5823214 - DNA, 12 bp, Homo sapiens
aagccaccgcag

SEQ ID NO: 5823215 - DNA, 16 bp, Homo sapiens
aagccaccgcagctgc

SEQ ID NO: 5823216 - DNA, 21 bp, Homo sapiens
aagccacctctctgcctgttc

SEQ ID NO: 5823217 - DNA, 13 bp, Homo sapiens
aagccacctgctg

SEQ ID NO: 5823218 - DNA, 17 bp, Homo sapiens
aagccacgccctccctg

SEQ ID NO: 5823219 - DNA, 17 bp, Homo sapiens
aagccacgcctgcgatg

SEQ ID NO: 5823220 - DNA, 19 bp, Homo sapiens
aagccacgttgcagaaaaa

SEQ ID NO: 5823221 - DNA, 14 bp, Homo sapiens
aagccactggaagg

SEQ ID NO: 5823222 - DNA, 15 bp, Homo sapiens
aagccactggaagga

SEQ ID NO: 5823223 - DNA, 16 bp, Homo sapiens
aagccactggaaggag

SEQ ID NO: 5823224 - DNA, 17 bp, Homo sapiens
aagccactggaaggagc

SEQ ID NO: 5823225 - DNA, 13 bp, Homo sapiens
aagccacttgaaa

SEQ ID NO: 5823226 - DNA, 18 bp, Homo sapiens
aagccacttggcccagaa

SEQ ID NO: 5823227 - DNA, 14 bp, Homo sapiens
aagccactttcctc

SEQ ID NO: 5823228 - DNA, 14 bp, Homo sapiens
aagccagaagctga

SEQ ID NO: 5823229 - DNA, 14 bp, Homo sapiens
aagccagacaactt

SEQ ID NO: 5823230 - DNA, 16 bp, Homo sapiens
aagccagacaacttct

SEQ ID NO: 5823231 - DNA, 23 bp, Homo sapiens
aagccagactctgccaaaaccaa

SEQ ID NO: 5823232 - DNA, 19 bp, Homo sapiens
aagccagagccgcaccctg

SEQ ID NO: 5823233 - DNA, 12 bp, Homo sapiens
aagccagagcct

SEQ ID NO: 5823234 - DNA, 15 bp, Homo sapiens
aagccagagcctggg

SEQ ID NO: 5823235 - DNA, 16 bp, Homo sapiens
aagccagaggctgggt

SEQ ID NO: 5823236 - DNA, 14 bp, Homo sapiens
aagccagagggtgg

SEQ ID NO: 5823237 - DNA, 15 bp, Homo sapiens
aagccagagggtggg

SEQ ID NO: 5823238 - DNA, 10 bp, Homo sapiens
aagccagagt

SEQ ID NO: 5823239 - DNA, 11 bp, Homo sapiens
aagccagagtc

SEQ ID NO: 5823240 - DNA, 19 bp, Homo sapiens
aagccagcaggctctcagg

SEQ ID NO: 5823241 - DNA, 20 bp, Homo sapiens
aagccagcaggctctcaggc

SEQ ID NO: 5823242 - DNA, 23 bp, Homo sapiens
aagccagcaggctctcaggccag

SEQ ID NO: 5823243 - DNA, 22 bp, Homo sapiens
aagccagccaagctttaaatta

SEQ ID NO: 5823244 - DNA, 12 bp, Homo sapiens
aagccagccaca

SEQ ID NO: 5823245 - DNA, 13 bp, Homo sapiens
aagccagccacag

SEQ ID NO: 5823246 - DNA, 19 bp, Homo sapiens
aagccagccacagacccct

SEQ ID NO: 5823247 - DNA, 20 bp, Homo sapiens
aagccagccacagacccctg

SEQ ID NO: 5823248 - DNA, 18 bp, Homo sapiens
aagccagccccctccagc

SEQ ID NO: 5823249 - DNA, 11 bp, Homo sapiens
aagccagcctt

SEQ ID NO: 5823250 - DNA, 10 bp, Homo sapiens
aagccagctg

SEQ ID NO: 5823251 - DNA, 19 bp, Homo sapiens
aagccagctgcccccagag

SEQ ID NO: 5823252 - DNA, 20 bp, Homo sapiens
aagccagctgcccccagagc

SEQ ID NO: 5823253 - DNA, 16 bp, Homo sapiens
aagccagctgccctat

SEQ ID NO: 5823254 - DNA, 14 bp, Homo sapiens
aagccagcttcctg

SEQ ID NO: 5823255 - DNA, 23 bp, Homo sapiens
aagccagcttcctgtgcagaagg

SEQ ID NO: 5823256 - DNA, 14 bp, Homo sapiens
aagccagcttgttt

SEQ ID NO: 5823257 - DNA, 14 bp, Homo sapiens
aagccagctttccc

SEQ ID NO: 5823258 - DNA, 15 bp, Homo sapiens
aagccagctttccct

SEQ ID NO: 5823259 - DNA, 23 bp, Homo sapiens
aagccagctttccctgcctctca

SEQ ID NO: 5823260 - DNA, 12 bp, Homo sapiens
aagccaggaaca

SEQ ID NO: 5823261 - DNA, 15 bp, Homo sapiens
aagccaggaacaggg

SEQ ID NO: 5823262 - DNA, 20 bp, Homo sapiens
aagccaggaatttcccagga

SEQ ID NO: 5823263 - DNA, 23 bp, Homo sapiens
aagccaggaatttcccaggaccc

SEQ ID NO: 5823264 - DNA, 14 bp, Homo sapiens
aagccaggagaccc

SEQ ID NO: 5823265 - DNA, 21 bp, Homo sapiens
aagccaggagcaaatgtttct

SEQ ID NO: 5823266 - DNA, 18 bp, Homo sapiens
aagccaggagcagccctg

SEQ ID NO: 5823267 - DNA, 19 bp, Homo sapiens
aagccaggagcagccctgg

SEQ ID NO: 5823268 - DNA, 17 bp, Homo sapiens
aagccaggattggggac

SEQ ID NO: 5823269 - DNA, 15 bp, Homo sapiens
aagccaggccctctc

SEQ ID NO: 5823270 - DNA, 18 bp, Homo sapiens
aagccaggctcactcaca

SEQ ID NO: 5823271 - DNA, 14 bp, Homo sapiens
aagccaggctcagg

SEQ ID NO: 5823272 - DNA, 15 bp, Homo sapiens
aagccaggctcagga

SEQ ID NO: 5823273 - DNA, 18 bp, Homo sapiens
aagccaggctgagtgagc

SEQ ID NO: 5823274 - DNA, 12 bp, Homo sapiens
aagccagggccc

SEQ ID NO: 5823275 - DNA, 14 bp, Homo sapiens
aagccagggcccag

SEQ ID NO: 5823276 - DNA, 20 bp, Homo sapiens
aagccagggcccagagccct

SEQ ID NO: 5823277 - DNA, 20 bp, Homo sapiens
aagccagggcccctggatct

SEQ ID NO: 5823278 - DNA, 20 bp, Homo sapiens
aagccagggcccgggaagca

SEQ ID NO: 5823279 - DNA, 21 bp, Homo sapiens
aagccagggtcctgagtggct

SEQ ID NO: 5823280 - DNA, 19 bp, Homo sapiens
aagccagggttccagacag

SEQ ID NO: 5823281 - DNA, 14 bp, Homo sapiens
aagccaggtacagg

SEQ ID NO: 5823282 - DNA, 17 bp, Homo sapiens
aagccaggtgagctctg

SEQ ID NO: 5823283 - DNA, 19 bp, Homo sapiens
aagccaggtgagctctgac

SEQ ID NO: 5823284 - DNA, 23 bp, Homo sapiens
aagccaggtgtggtggtatgtgc

SEQ ID NO: 5823285 - DNA, 17 bp, Homo sapiens
aagccagtgcggcaggt

SEQ ID NO: 5823286 - DNA, 15 bp, Homo sapiens
aagccagtggagctg

SEQ ID NO: 5823287 - DNA, 13 bp, Homo sapiens
aagccagtggcag

SEQ ID NO: 5823288 - DNA, 16 bp, Homo sapiens
aagccagtgtccttcg

SEQ ID NO: 5823289 - DNA, 17 bp, Homo sapiens
aagccagtgtctaggca

SEQ ID NO: 5823290 - DNA, 18 bp, Homo sapiens
aagccagtgttgcctaag

SEQ ID NO: 5823291 - DNA, 17 bp, Homo sapiens
aagccagttagtaaact

SEQ ID NO: 5823292 - DNA, 23 bp, Homo sapiens
aagccagttggatctctggttgt

SEQ ID NO: 5823293 - DNA, 20 bp, Homo sapiens
aagccagtttgggtaaaata

SEQ ID NO: 5823294 - DNA, 18 bp, Homo sapiens
aagccataattgttctta

SEQ ID NO: 5823295 - DNA, 20 bp, Homo sapiens
aagccatagatgctggctgg

SEQ ID NO: 5823296 - DNA, 19 bp, Homo sapiens
aagccatagccccaggccc

SEQ ID NO: 5823297 - DNA, 19 bp, Homo sapiens
aagccatagcctccacgga

SEQ ID NO: 5823298 - DNA, 15 bp, Homo sapiens
aagccatagggggct

SEQ ID NO: 5823299 - DNA, 22 bp, Homo sapiens
aagccatatctagtcaataact

SEQ ID NO: 5823300 - DNA, 17 bp, Homo sapiens
aagccatatgaacagct

SEQ ID NO: 5823301 - DNA, 18 bp, Homo sapiens
aagccatatgacaatttc

SEQ ID NO: 5823302 - DNA, 21 bp, Homo sapiens
aagccatatgacaatttcaaa

SEQ ID NO: 5823303 - DNA, 15 bp, Homo sapiens
aagccatatggacac

SEQ ID NO: 5823304 - DNA, 19 bp, Homo sapiens
aagccatattccagcagtg

SEQ ID NO: 5823305 - DNA, 19 bp, Homo sapiens
aagccatcaattttaacat

SEQ ID NO: 5823306 - DNA, 22 bp, Homo sapiens
aagccatcaattttaacatttg

SEQ ID NO: 5823307 - DNA, 23 bp, Homo sapiens
aagccatcatcagcttaatttaa

SEQ ID NO: 5823308 - DNA, 20 bp, Homo sapiens
aagccatctcagattctgtc

SEQ ID NO: 5823309 - DNA, 18 bp, Homo sapiens
aagccatctgacagcagg

SEQ ID NO: 5823310 - DNA, 15 bp, Homo sapiens
aagccatcttcccgc

SEQ ID NO: 5823311 - DNA, 22 bp, Homo sapiens
aagccatcttcccgcctcagcc

SEQ ID NO: 5823312 - DNA, 23 bp, Homo sapiens
aagccatcttcccgcctcagcct

SEQ ID NO: 5823313 - DNA, 20 bp, Homo sapiens
aagccatcttgagtggtcat

SEQ ID NO: 5823314 - DNA, 15 bp, Homo sapiens
aagccatctttcttt

SEQ ID NO: 5823315 - DNA, 16 bp, Homo sapiens
aagccatgagaatgtt

SEQ ID NO: 5823316 - DNA, 15 bp, Homo sapiens
aagccatgccaataa

SEQ ID NO: 5823317 - DNA, 21 bp, Homo sapiens
aagccatgggacctcctccct

SEQ ID NO: 5823318 - DNA, 16 bp, Homo sapiens
aagccatgtataaatg

SEQ ID NO: 5823319 - DNA, 21 bp, Homo sapiens
aagccatgtatttcagggacc

SEQ ID NO: 5823320 - DNA, 22 bp, Homo sapiens
aagccatgtatttcagggacct

SEQ ID NO: 5823321 - DNA, 13 bp, Homo sapiens
aagccatgtgctg

SEQ ID NO: 5823322 - DNA, 19 bp, Homo sapiens
aagccatgtggggttgctg

SEQ ID NO: 5823323 - DNA, 20 bp, Homo sapiens
aagccatgtggggttgctga

SEQ ID NO: 5823324 - DNA, 19 bp, Homo sapiens
aagccatgttaaatgactt

SEQ ID NO: 5823325 - DNA, 12 bp, Homo sapiens
aagccatgttta

SEQ ID NO: 5823326 - DNA, 16 bp, Homo sapiens
aagccatgtttaagat

SEQ ID NO: 5823327 - DNA, 19 bp, Homo sapiens
aagccatgtttaagattta

SEQ ID NO: 5823328 - DNA, 16 bp, Homo sapiens
aagccatgtttattac

SEQ ID NO: 5823329 - DNA, 22 bp, Homo sapiens
aagccatgtttattacagtata

SEQ ID NO: 5823330 - DNA, 22 bp, Homo sapiens
aagccattctgcctcagcctcc

SEQ ID NO: 5823331 - DNA, 16 bp, Homo sapiens
aagccatttaactgga

SEQ ID NO: 5823332 - DNA, 17 bp, Homo sapiens
aagccatttactttgca

SEQ ID NO: 5823333 - DNA, 19 bp, Homo sapiens
aagccatttactttgcaag

SEQ ID NO: 5823334 - DNA, 16 bp, Homo sapiens
aagccattttctgtta

SEQ ID NO: 5823335 - DNA, 22 bp, Homo sapiens
aagcccaaactcctttcttatc

SEQ ID NO: 5823336 - DNA, 17 bp, Homo sapiens
aagcccaaatggctctg

SEQ ID NO: 5823337 - DNA, 17 bp, Homo sapiens
aagcccaaggtgctgat

SEQ ID NO: 5823338 - DNA, 18 bp, Homo sapiens
aagcccaatattataatt

SEQ ID NO: 5823339 - DNA, 21 bp, Homo sapiens
aagcccacaggcctgttccct

SEQ ID NO: 5823340 - DNA, 10 bp, Homo sapiens
aagcccaccc

SEQ ID NO: 5823341 - DNA, 13 bp, Homo sapiens
aagcccacccgcc

SEQ ID NO: 5823342 - DNA, 21 bp, Homo sapiens
aagcccacccgccccagagac

SEQ ID NO: 5823343 - DNA, 12 bp, Homo sapiens
aagcccacctga

SEQ ID NO: 5823344 - DNA, 13 bp, Homo sapiens
aagcccacctggg

SEQ ID NO: 5823345 - DNA, 21 bp, Homo sapiens
aagctaatgtgcagggatatt

SEQ ID NO: 5823346 - DNA, 19 bp, Homo sapiens
aagctaatgtggtagtgaa

SEQ ID NO: 5823347 - DNA, 17 bp, Homo sapiens
aagctaattattttaat

SEQ ID NO: 5823348 - DNA, 14 bp, Homo sapiens
aagctaatttgcat

SEQ ID NO: 5823349 - DNA, 17 bp, Homo sapiens
aagctacaatctgttca

SEQ ID NO: 5823350 - DNA, 14 bp, Homo sapiens
aagctacaggttac

SEQ ID NO: 5823351 - DNA, 18 bp, Homo sapiens
aagctacaggttgtgaaa

SEQ ID NO: 5823352 - DNA, 22 bp, Homo sapiens
aagctacatatgtaggaaaatt

SEQ ID NO: 5823353 - DNA, 21 bp, Homo sapiens
aagctacccctcaaactgcac

SEQ ID NO: 5823354 - DNA, 23 bp, Homo sapiens
aagctacccctcaaactgcacat

SEQ ID NO: 5823355 - DNA, 15 bp, Homo sapiens
aagctaccttgtcat

SEQ ID NO: 5823356 - DNA, 17 bp, Homo sapiens
aagctactagcaaaata

SEQ ID NO: 5823357 - DNA, 14 bp, Homo sapiens
aagctactattttg

SEQ ID NO: 5823358 - DNA, 12 bp, Homo sapiens
aagctactgaat

SEQ ID NO: 5823359 - DNA, 18 bp, Homo sapiens
aagctactgaatttattg

SEQ ID NO: 5823360 - DNA, 14 bp, Homo sapiens
aagctactgtagaa

SEQ ID NO: 5823361 - DNA, 21 bp, Homo sapiens
aagctacttgccttgagttta

SEQ ID NO: 5823362 - DNA, 13 bp, Homo sapiens
aagctagaaatga

SEQ ID NO: 5823363 - DNA, 16 bp, Homo sapiens
aagctagaacctggag

SEQ ID NO: 5823364 - DNA, 17 bp, Homo sapiens
aagctagaaggccacat

SEQ ID NO: 5823365 - DNA, 17 bp, Homo sapiens
aagctagaatggtggga

SEQ ID NO: 5823366 - DNA, 19 bp, Homo sapiens
aagctagaattgagtgttt

SEQ ID NO: 5823367 - DNA, 18 bp, Homo sapiens
aagctagacaaaggccca

SEQ ID NO: 5823368 - DNA, 21 bp, Homo sapiens
aagctagacaaaggcccagaa

SEQ ID NO: 5823369 - DNA, 22 bp, Homo sapiens
aagctagacgagcaggcttctt

SEQ ID NO: 5823370 - DNA, 17 bp, Homo sapiens
aagctagagagaaaaag

SEQ ID NO: 5823371 - DNA, 21 bp, Homo sapiens
aagctagagagaaaaagaaag

SEQ ID NO: 5823372 - DNA, 21 bp, Homo sapiens
aagctagatacgaaatcagtt

SEQ ID NO: 5823373 - DNA, 23 bp, Homo sapiens
aagctagatacgaaatcagtttc

SEQ ID NO: 5823374 - DNA, 17 bp, Homo sapiens
aagctagatatgcctta

SEQ ID NO: 5823375 - DNA, 13 bp, Homo sapiens
aagctagctcccc

SEQ ID NO: 5823376 - DNA, 18 bp, Homo sapiens
aagctagctcccctcctc

SEQ ID NO: 5823377 - DNA, 20 bp, Homo sapiens
aagctaggaaaagaaatcta

SEQ ID NO: 5823378 - DNA, 21 bp, Homo sapiens
aagctaggaaaagaaatctat

SEQ ID NO: 5823379 - DNA, 18 bp, Homo sapiens
aagctaggcctggccaga

SEQ ID NO: 5823380 - DNA, 15 bp, Homo sapiens
aagctaggtgctaat

SEQ ID NO: 5823381 - DNA, 21 bp, Homo sapiens
aagctaggtgctatttgtcat

SEQ ID NO: 5823382 - DNA, 20 bp, Homo sapiens
aagctagtcttttgcttttg

SEQ ID NO: 5823383 - DNA, 21 bp, Homo sapiens
aagctagtcttttgcttttgc

SEQ ID NO: 5823384 - DNA, 19 bp, Homo sapiens
aagctagtggcttcaaaat

SEQ ID NO: 5823385 - DNA, 20 bp, Homo sapiens
aagctagtgtacctcctctc

SEQ ID NO: 5823386 - DNA, 12 bp, Homo sapiens
aagctagtgttt

SEQ ID NO: 5823387 - DNA, 13 bp, Homo sapiens
aagctagtgtttc

SEQ ID NO: 5823388 - DNA, 16 bp, Homo sapiens
aagctataaaagccca

SEQ ID NO: 5823389 - DNA, 13 bp, Homo sapiens
aagctataaagca

SEQ ID NO: 5823390 - DNA, 20 bp, Homo sapiens
aagctataaagcagtatttt

SEQ ID NO: 5823391 - DNA, 19 bp, Homo sapiens
aagctataaagtatatatt

SEQ ID NO: 5823392 - DNA, 18 bp, Homo sapiens
aagctataacatatttat

SEQ ID NO: 5823393 - DNA, 19 bp, Homo sapiens
aagctataacatatttatt

SEQ ID NO: 5823394 - DNA, 17 bp, Homo sapiens
aagctatatatgaataa

SEQ ID NO: 5823395 - DNA, 12 bp, Homo sapiens
aagctatatcta

SEQ ID NO: 5823396 - DNA, 19 bp, Homo sapiens
aagctatatctatttgaga

SEQ ID NO: 5823397 - DNA, 15 bp, Homo sapiens
aagctatattagctg

SEQ ID NO: 5823398 - DNA, 15 bp, Homo sapiens
aagctatcagcaata

SEQ ID NO: 5823399 - DNA, 17 bp, Homo sapiens
aagctatcctggctctt

SEQ ID NO: 5823400 - DNA, 17 bp, Homo sapiens
aagctatcttaaaatat

SEQ ID NO: 5823401 - DNA, 21 bp, Homo sapiens
aagctatcttaggtggagcta

SEQ ID NO: 5823402 - DNA, 15 bp, Homo sapiens
aagctatcttcatgt

SEQ ID NO: 5823403 - DNA, 22 bp, Homo sapiens
aagctatcttcatgtaaattga

SEQ ID NO: 5823404 - DNA, 18 bp, Homo sapiens
aagctatgagaataactt

SEQ ID NO: 5823405 - DNA, 19 bp, Homo sapiens
aagctatgagaataacttc

SEQ ID NO: 5823406 - DNA, 15 bp, Homo sapiens
aagctatggtgagat

SEQ ID NO: 5823407 - DNA, 18 bp, Homo sapiens
aagctatggtgagatgca

SEQ ID NO: 5823408 - DNA, 21 bp, Homo sapiens
aagctatggtgagatgcagct

SEQ ID NO: 5823409 - DNA, 23 bp, Homo sapiens
aagctatggtgagatgcagctgg

SEQ ID NO: 5823410 - DNA, 23 bp, Homo sapiens
aagctatgtatcgctcctattga

SEQ ID NO: 5823411 - DNA, 18 bp, Homo sapiens
aagctatgtttttaaagt

SEQ ID NO: 5823412 - DNA, 19 bp, Homo sapiens
aagctattagccaggatca

SEQ ID NO: 5823413 - DNA, 18 bp, Homo sapiens
aagctattcacattgtta

SEQ ID NO: 5823414 - DNA, 21 bp, Homo sapiens
aagctattccctcaaatctga

SEQ ID NO: 5823415 - DNA, 13 bp, Homo sapiens
aagctattccttt

SEQ ID NO: 5823416 - DNA, 20 bp, Homo sapiens
aagctattcctttcccttcc

SEQ ID NO: 5823417 - DNA, 21 bp, Homo sapiens
aagctattcctttcccttcct

SEQ ID NO: 5823418 - DNA, 16 bp, Homo sapiens
aagctattgagaaaga

SEQ ID NO: 5823419 - DNA, 18 bp, Homo sapiens
aagctattgatgtttcca

SEQ ID NO: 5823420 - DNA, 22 bp, Homo sapiens
aagctattgatgtttccagaaa

SEQ ID NO: 5823421 - DNA, 22 bp, Homo sapiens
aagctatttaagtggactgtat

SEQ ID NO: 5823422 - DNA, 23 bp, Homo sapiens
aagctatttaatatctggcactg

SEQ ID NO: 5823423 - DNA, 19 bp, Homo sapiens
aagctatttctctggatct

SEQ ID NO: 5823424 - DNA, 18 bp, Homo sapiens
aagctatttgatgtaata

SEQ ID NO: 5823425 - DNA, 23 bp, Homo sapiens
aagctatttgatgtaatacttct

SEQ ID NO: 5823426 - DNA, 21 bp, Homo sapiens
aagctatttttctaactacaa

SEQ ID NO: 5823427 - DNA, 20 bp, Homo sapiens
aagctcaaaggtttggaagg

SEQ ID NO: 5823428 - DNA, 21 bp, Homo sapiens
aagctcaaaggtttggaagga

SEQ ID NO: 5823429 - DNA, 17 bp, Homo sapiens
aagctcaaatgaaatgt

SEQ ID NO: 5823430 - DNA, 15 bp, Homo sapiens
aagctcaaatgtata

SEQ ID NO: 5823431 - DNA, 20 bp, Homo sapiens
aagctcaagatgacagctct

SEQ ID NO: 5823432 - DNA, 15 bp, Homo sapiens
aagctcaaggctgca

SEQ ID NO: 5823433 - DNA, 19 bp, Homo sapiens
aagctcaagtgttcacaac

SEQ ID NO: 5823434 - DNA, 20 bp, Homo sapiens
aagctcacacctgtccttct

SEQ ID NO: 5823435 - DNA, 12 bp, Homo sapiens
aagctcacactg

SEQ ID NO: 5823436 - DNA, 20 bp, Homo sapiens
aagctcacagacctttgaac

SEQ ID NO: 5823437 - DNA, 15 bp, Homo sapiens
aagctcacagttcct

SEQ ID NO: 5823438 - DNA, 20 bp, Homo sapiens
aagctcacagttcctcgccc

SEQ ID NO: 5823439 - DNA, 23 bp, Homo sapiens
aagctcacagttcctcgccctgg

SEQ ID NO: 5823440 - DNA, 21 bp, Homo sapiens
aagctcacatccagccttgga

SEQ ID NO: 5823441 - DNA, 14 bp, Homo sapiens
aagctcacttctgg

SEQ ID NO: 5823442 - DNA, 14 bp, Homo sapiens
aagctcagaataga

SEQ ID NO: 5823443 - DNA, 12 bp, Homo sapiens
aagctcagaatc

SEQ ID NO: 5823444 - DNA, 14 bp, Homo sapiens
aagctcagaatcca

SEQ ID NO: 5823445 - DNA, 14 bp, Homo sapiens
aagctcagagcagc

SEQ ID NO: 5823446 - DNA, 16 bp, Homo sapiens
aagctcagagcagcct

SEQ ID NO: 5823447 - DNA, 18 bp, Homo sapiens
aagctcagagcagcctct

SEQ ID NO: 5823448 - DNA, 13 bp, Homo sapiens
aagctcagcccac

SEQ ID NO: 5823449 - DNA, 14 bp, Homo sapiens
aagctcagcccacc

SEQ ID NO: 5823450 - DNA, 15 bp, Homo sapiens
aagctcagcccaccc

SEQ ID NO: 5823451 - DNA, 21 bp, Homo sapiens
aagctcagcccacccccctca

SEQ ID NO: 5823452 - DNA, 11 bp, Homo sapiens
aagctcagcct

SEQ ID NO: 5823453 - DNA, 18 bp, Homo sapiens
aagctcagccttctcctc

SEQ ID NO: 5823454 - DNA, 17 bp, Homo sapiens
aagctcaggaccaggca

SEQ ID NO: 5823455 - DNA, 23 bp, Homo sapiens
aagctcaggaggcgaataaatgt

SEQ ID NO: 5823456 - DNA, 23 bp, Homo sapiens
aagctcaggagggtgacgcccag

SEQ ID NO: 5823457 - DNA, 17 bp, Homo sapiens
aagctcaggatatggct

SEQ ID NO: 5823458 - DNA, 19 bp, Homo sapiens
aagctcagggccctgtgcc

SEQ ID NO: 5823459 - DNA, 13 bp, Homo sapiens
aagctcagggcct

SEQ ID NO: 5823460 - DNA, 17 bp, Homo sapiens
aagctcagggcctggct

SEQ ID NO: 5823461 - DNA, 20 bp, Homo sapiens
aagctcagggcctggctcag

SEQ ID NO: 5823462 - DNA, 19 bp, Homo sapiens
aagctcaggttccctgcca

SEQ ID NO: 5823463 - DNA, 21 bp, Homo sapiens
aagctcaggttccctgccaca

SEQ ID NO: 5823464 - DNA, 14 bp, Homo sapiens
aagctcagtggcaa

SEQ ID NO: 5823465 - DNA, 21 bp, Homo sapiens
aagctcagtttggctgtaatt

SEQ ID NO: 5823466 - DNA, 16 bp, Homo sapiens
aagctcatagcacatg

SEQ ID NO: 5823467 - DNA, 12 bp, Homo sapiens
aagctcatattt

SEQ ID NO: 5823468 - DNA, 16 bp, Homo sapiens
aagctcatccctggac

SEQ ID NO: 5823469 - DNA, 15 bp, Homo sapiens
aagctcatttcatgc

SEQ ID NO: 5823470 - DNA, 19 bp, Homo sapiens
aagctcatttcatgctctg

SEQ ID NO: 5823471 - DNA, 18 bp, Homo sapiens
aagctccaagctcccagg

SEQ ID NO: 5823472 - DNA, 14 bp, Homo sapiens
aagctccaggtgcc

SEQ ID NO: 5823473 - DNA, 21 bp, Homo sapiens
aagctccaggtgccctgtggg

SEQ ID NO: 5823474 - DNA, 19 bp, Homo sapiens
aagctccagtcctgctctc

SEQ ID NO: 5823475 - DNA, 22 bp, Homo sapiens
aagctccagtgctttatccaca

SEQ ID NO: 5823476 - DNA, 18 bp, Homo sapiens
aagctccatgtgcctctt

SEQ ID NO: 5823477 - DNA, 22 bp, Homo sapiens
aagctccatgtttagaaataaa

SEQ ID NO: 5823478 - DNA, 17 bp, Homo sapiens
aagctcccaagggatgg

SEQ ID NO: 5823479 - DNA, 19 bp, Homo sapiens
aagctcccaagggatggtg

SEQ ID NO: 5823480 - DNA, 15 bp, Homo sapiens
aagctcccacaccca

SEQ ID NO: 5823481 - DNA, 22 bp, Homo sapiens
aagctcccacacccacctctgc

SEQ ID NO: 5823482 - DNA, 23 bp, Homo sapiens
aagctcccacacccacctctgcc

SEQ ID NO: 5823483 - DNA, 15 bp, Homo sapiens
aagctcccaccccac

SEQ ID NO: 5823484 - DNA, 16 bp, Homo sapiens
aagctcccaccccact

SEQ ID NO: 5823485 - DNA, 18 bp, Homo sapiens
aagctcccagatgctggg

SEQ ID NO: 5823486 - DNA, 23 bp, Homo sapiens
aagctcccaggcattccccagga

SEQ ID NO: 5823487 - DNA, 23 bp, Homo sapiens
aagctcccccagcaaagccccca

SEQ ID NO: 5823488 - DNA, 11 bp, Homo sapiens
aagctccctgc

SEQ ID NO: 5823489 - DNA, 17 bp, Homo sapiens
aagctccctgccccaaa

SEQ ID NO: 5823490 - DNA, 12 bp, Homo sapiens
aagctccctgga

SEQ ID NO: 5823491 - DNA, 14 bp, Homo sapiens
aagctccctggagc

SEQ ID NO: 5823492 - DNA, 18 bp, Homo sapiens
aagctccctggagccctg

SEQ ID NO: 5823493 - DNA, 17 bp, Homo sapiens
aagctcctattagaaaa

SEQ ID NO: 5823494 - DNA, 14 bp, Homo sapiens
aagctcctcctcgg

SEQ ID NO: 5823495 - DNA, 17 bp, Homo sapiens
aagctcctcctcggaac

SEQ ID NO: 5823496 - DNA, 19 bp, Homo sapiens
aagctcctctccccagccc

SEQ ID NO: 5823497 - DNA, 23 bp, Homo sapiens
aagctcctctccccagcccagag

SEQ ID NO: 5823498 - DNA, 21 bp, Homo sapiens
aagctcctgaatccctttcag

SEQ ID NO: 5823499 - DNA, 12 bp, Homo sapiens
aagctcctgcta

SEQ ID NO: 5823500 - DNA, 15 bp, Homo sapiens
aagctcctgtcctcc

SEQ ID NO: 5823501 - DNA, 14 bp, Homo sapiens
aagctccttccaga

SEQ ID NO: 5823502 - DNA, 14 bp, Homo sapiens
aagctccttcctgt

SEQ ID NO: 5823503 - DNA, 13 bp, Homo sapiens
aagctcgcatcca

SEQ ID NO: 5823504 - DNA, 19 bp, Homo sapiens
aagctcgcatccagacagt

SEQ ID NO: 5823505 - DNA, 22 bp, Homo sapiens
aagctcgccccacctccacctg

SEQ ID NO: 5823506 - DNA, 18 bp, Homo sapiens
aagctcgtagaaacaaga

SEQ ID NO: 5823507 - DNA, 22 bp, Homo sapiens
aagctcgtagaaacaagacaag

SEQ ID NO: 5823508 - DNA, 21 bp, Homo sapiens
aagctctactgaggtgctatg

SEQ ID NO: 5823509 - DNA, 15 bp, Homo sapiens
aagctctagaatctg

SEQ ID NO: 5823510 - DNA, 20 bp, Homo sapiens
aagctctagttcttaacaac

SEQ ID NO: 5823511 - DNA, 22 bp, Homo sapiens
aagctctatggattatccactg

SEQ ID NO: 5823512 - DNA, 22 bp, Homo sapiens
aagctctcagcaagtgcccagt

SEQ ID NO: 5823513 - DNA, 16 bp, Homo sapiens
aagctctcatagctca

SEQ ID NO: 5823514 - DNA, 17 bp, Homo sapiens
aagctctcatagctcat

SEQ ID NO: 5823515 - DNA, 20 bp, Homo sapiens
aagctctcgggactagctgc

SEQ ID NO: 5823516 - DNA, 22 bp, Homo sapiens
aagctctcgggactagctgcct

SEQ ID NO: 5823517 - DNA, 12 bp, Homo sapiens
aagctctcttaa

SEQ ID NO: 5823518 - DNA, 9 bp, Homo sapiens
aagctctga

SEQ ID NO: 5823519 - DNA, 15 bp, Homo sapiens
aagctctgaaaacaa

SEQ ID NO: 5823520 - DNA, 12 bp, Homo sapiens
aagctctgacat

SEQ ID NO: 5823521 - DNA, 22 bp, Homo sapiens
aagctgttgatggtaggtggca

SEQ ID NO: 5823522 - DNA, 20 bp, Homo sapiens
aagctgttgggagaaagcaa

SEQ ID NO: 5823523 - DNA, 14 bp, Homo sapiens
aagctgttgtacat

SEQ ID NO: 5823524 - DNA, 12 bp, Homo sapiens
aagctgtttcta

SEQ ID NO: 5823525 - DNA, 21 bp, Homo sapiens
aagctgtttggttttaaaata

SEQ ID NO: 5823526 - DNA, 13 bp, Homo sapiens
aagctgtttttat

SEQ ID NO: 5823527 - DNA, 15 bp, Homo sapiens
aagcttaaaaagagc

SEQ ID NO: 5823528 - DNA, 18 bp, Homo sapiens
aagcttaaataggaaagt

SEQ ID NO: 5823529 - DNA, 12 bp, Homo sapiens
aagcttaaattt

SEQ ID NO: 5823530 - DNA, 20 bp, Homo sapiens
aagcttaaattttatatcat

SEQ ID NO: 5823531 - DNA, 17 bp, Homo sapiens
aagcttaacatttcatg

SEQ ID NO: 5823532 - DNA, 14 bp, Homo sapiens
aagcttaaggagag

SEQ ID NO: 5823533 - DNA, 16 bp, Homo sapiens
aagcttaataaaaaca

SEQ ID NO: 5823534 - DNA, 14 bp, Homo sapiens
aagcttaatatgtg

SEQ ID NO: 5823535 - DNA, 14 bp, Homo sapiens
aagcttaatgattc

SEQ ID NO: 5823536 - DNA, 21 bp, Homo sapiens
aagcttaatggctgataattt

SEQ ID NO: 5823537 - DNA, 22 bp, Homo sapiens
aagcttaatttttaaaaacaaa

SEQ ID NO: 5823538 - DNA, 13 bp, Homo sapiens
aagcttactaaag

SEQ ID NO: 5823539 - DNA, 14 bp, Homo sapiens
aagcttagaagcca

SEQ ID NO: 5823540 - DNA, 15 bp, Homo sapiens
aagcttagaagccac

SEQ ID NO: 5823541 - DNA, 20 bp, Homo sapiens
aagcttagaagccaccatgt

SEQ ID NO: 5823542 - DNA, 16 bp, Homo sapiens
aagcttagcaggagag

SEQ ID NO: 5823543 - DNA, 14 bp, Homo sapiens
aagcttatgtttct

SEQ ID NO: 5823544 - DNA, 15 bp, Homo sapiens
aagcttatgtttctt

SEQ ID NO: 5823545 - DNA, 16 bp, Homo sapiens
aagcttattaatgcta

SEQ ID NO: 5823546 - DNA, 19 bp, Homo sapiens
aagcttattaatgctaagg

SEQ ID NO: 5823547 - DNA, 20 bp, Homo sapiens
aagcttcaaagtttatatgc

SEQ ID NO: 5823548 - DNA, 21 bp, Homo sapiens
aagcttcaaagtttatatgcc

SEQ ID NO: 5823549 - DNA, 21 bp, Homo sapiens
aagcttcaaattatagaaaca

SEQ ID NO: 5823550 - DNA, 12 bp, Homo sapiens
aagcttcaaccc

SEQ ID NO: 5823551 - DNA, 22 bp, Homo sapiens
aagcttcaaccctcagccttga

SEQ ID NO: 5823552 - DNA, 19 bp, Homo sapiens
aagcttcaagtgatatatg

SEQ ID NO: 5823553 - DNA, 16 bp, Homo sapiens
aagcttcaatattttt

SEQ ID NO: 5823554 - DNA, 12 bp, Homo sapiens
aagcttcagagc

SEQ ID NO: 5823555 - DNA, 16 bp, Homo sapiens
aagcttcagttgcttg

SEQ ID NO: 5823556 - DNA, 16 bp, Homo sapiens
aagcttcatccacagc

SEQ ID NO: 5823557 - DNA, 23 bp, Homo sapiens
aagcttcattagcttgtctatta

SEQ ID NO: 5823558 - DNA, 19 bp, Homo sapiens
aagcttcattataaaatat

SEQ ID NO: 5823559 - DNA, 21 bp, Homo sapiens
aagcttcattctccttgttgt

SEQ ID NO: 5823560 - DNA, 20 bp, Homo sapiens
aagcttccacaaaattagaa

SEQ ID NO: 5823561 - DNA, 15 bp, Homo sapiens
aagcttccaggaaaa

SEQ ID NO: 5823562 - DNA, 20 bp, Homo sapiens
aagcttccatgattctattt

SEQ ID NO: 5823563 - DNA, 21 bp, Homo sapiens
aagcttccatgattctattta

SEQ ID NO: 5823564 - DNA, 14 bp, Homo sapiens
aagcttcccaacag

SEQ ID NO: 5823565 - DNA, 18 bp, Homo sapiens
aagcttcccaagtagctg

SEQ ID NO: 5823566 - DNA, 23 bp, Homo sapiens
aagcttcccacggcctttctagc

SEQ ID NO: 5823567 - DNA, 13 bp, Homo sapiens
aagcttccttggc

SEQ ID NO: 5823568 - DNA, 17 bp, Homo sapiens
aagcttcgttagaatgt

SEQ ID NO: 5823569 - DNA, 13 bp, Homo sapiens
aagcttctaaagc

SEQ ID NO: 5823570 - DNA, 19 bp, Homo sapiens
aagcttctaataaattata

SEQ ID NO: 5823571 - DNA, 17 bp, Homo sapiens
aagcttctagacactcc

SEQ ID NO: 5823572 - DNA, 13 bp, Homo sapiens
aagcttctcagac

SEQ ID NO: 5823573 - DNA, 19 bp, Homo sapiens
aagcttcttaattaatttg

SEQ ID NO: 5823574 - DNA, 15 bp, Homo sapiens
aagcttgaaaagatt

SEQ ID NO: 5823575 - DNA, 17 bp, Homo sapiens
aagcttgactcccaagt

SEQ ID NO: 5823576 - DNA, 18 bp, Homo sapiens
aagcttgactcccaagtt

SEQ ID NO: 5823577 - DNA, 14 bp, Homo sapiens
aagcttgagcctcc

SEQ ID NO: 5823578 - DNA, 21 bp, Homo sapiens
aagcttgaggccaagatggct

SEQ ID NO: 5823579 - DNA, 22 bp, Homo sapiens
aagcttgaggccaagatggctg

SEQ ID NO: 5823580 - DNA, 20 bp, Homo sapiens
aagcttgatttgatctttgt

SEQ ID NO: 5823581 - DNA, 14 bp, Homo sapiens
aagcttgctcacat

SEQ ID NO: 5823582 - DNA, 16 bp, Homo sapiens
aagcttggaggagggt

SEQ ID NO: 5823583 - DNA, 21 bp, Homo sapiens
aagcttggcagccgagctcgt

SEQ ID NO: 5823584 - DNA, 17 bp, Homo sapiens
aagcttggtcaaacttt

SEQ ID NO: 5823585 - DNA, 19 bp, Homo sapiens
aagcttgtatatacatatt

SEQ ID NO: 5823586 - DNA, 15 bp, Homo sapiens
aagcttgtatctgat

SEQ ID NO: 5823587 - DNA, 13 bp, Homo sapiens
aagcttgtgagag

SEQ ID NO: 5823588 - DNA, 19 bp, Homo sapiens
aagcttgtggtgttcctga

SEQ ID NO: 5823589 - DNA, 22 bp, Homo sapiens
aagcttgtggtgttcctgaagc

SEQ ID NO: 5823590 - DNA, 14 bp, Homo sapiens
aagcttgtgtactt

SEQ ID NO: 5823591 - DNA, 17 bp, Homo sapiens
aagcttgtgtatcttga

SEQ ID NO: 5823592 - DNA, 20 bp, Homo sapiens
aagcttgtgtatcttgatta

SEQ ID NO: 5823593 - DNA, 20 bp, Homo sapiens
aagcttgtgtgggcccaaca

SEQ ID NO: 5823594 - DNA, 22 bp, Homo sapiens
aagcttgttgaaaacccagact

SEQ ID NO: 5823595 - DNA, 13 bp, Homo sapiens
aagcttgtttccc

SEQ ID NO: 5823596 - DNA, 20 bp, Homo sapiens
aagctttaaatgacagtaat

SEQ ID NO: 5823597 - DNA, 14 bp, Homo sapiens
aagctttaacagac

SEQ ID NO: 5823598 - DNA, 15 bp, Homo sapiens
aagctttaccagctg

SEQ ID NO: 5823599 - DNA, 10 bp, Homo sapiens
aagctttact

SEQ ID NO: 5823600 - DNA, 22 bp, Homo sapiens
aagctttactggggctggggaa

SEQ ID NO: 5823601 - DNA, 20 bp, Homo sapiens
aagctttatacgtgtagcta

SEQ ID NO: 5823602 - DNA, 17 bp, Homo sapiens
aagctttatctgtcttg

SEQ ID NO: 5823603 - DNA, 16 bp, Homo sapiens
aagctttatctttgtg

SEQ ID NO: 5823604 - DNA, 17 bp, Homo sapiens
aagctttatctttgtgt

SEQ ID NO: 5823605 - DNA, 18 bp, Homo sapiens
aagctttattgttcacac

SEQ ID NO: 5823606 - DNA, 16 bp, Homo sapiens
aagctttcaccagcca

SEQ ID NO: 5823607 - DNA, 22 bp, Homo sapiens
aagctttcatgtaaactgtgca

SEQ ID NO: 5823608 - DNA, 11 bp, Homo sapiens
aagctttctca

SEQ ID NO: 5823609 - DNA, 12 bp, Homo sapiens
aagctttctcct

SEQ ID NO: 5823610 - DNA, 11 bp, Homo sapiens
aagctttctct

SEQ ID NO: 5823611 - DNA, 20 bp, Homo sapiens
aagctttgaatacccccaga

SEQ ID NO: 5823612 - DNA, 21 bp, Homo sapiens
aagctttgaatacccccagag

SEQ ID NO: 5823613 - DNA, 14 bp, Homo sapiens
aagctttgacactg

SEQ ID NO: 5823614 - DNA, 22 bp, Homo sapiens
aagctttgatttagattgagta

SEQ ID NO: 5823615 - DNA, 20 bp, Homo sapiens
aagctttgctccttcagttc

SEQ ID NO: 5823616 - DNA, 14 bp, Homo sapiens
aagctttggaaaaa

SEQ ID NO: 5823617 - DNA, 18 bp, Homo sapiens
aagctttggaagcagcaa

SEQ ID NO: 5823618 - DNA, 21 bp, Homo sapiens
aagctttggacccaaggaaaa

SEQ ID NO: 5823619 - DNA, 14 bp, Homo sapiens
aagctttggctgag

SEQ ID NO: 5823620 - DNA, 18 bp, Homo sapiens
aagctttggttatgaaac

SEQ ID NO: 5823621 - DNA, 15 bp, Homo sapiens
aagctttgtcccctg

SEQ ID NO: 5823622 - DNA, 19 bp, Homo sapiens
aagctttgtcccctgcttc

SEQ ID NO: 5823623 - DNA, 22 bp, Homo sapiens
aagctttgtcccctgcttcaga

SEQ ID NO: 5823624 - DNA, 20 bp, Homo sapiens
aagctttgttgaaagaaagt

SEQ ID NO: 5823625 - DNA, 14 bp, Homo sapiens
aagcttttaacttt

SEQ ID NO: 5823626 - DNA, 19 bp, Homo sapiens
aagcttttaagaaaaacaa

SEQ ID NO: 5823627 - DNA, 20 bp, Homo sapiens
aagcttttcattttaatata

SEQ ID NO: 5823628 - DNA, 15 bp, Homo sapiens
aagcttttgcatatt

SEQ ID NO: 5823629 - DNA, 22 bp, Homo sapiens
aagcttttgcatattgcatact

SEQ ID NO: 5823630 - DNA, 13 bp, Homo sapiens
aagcttttgctca

SEQ ID NO: 5823631 - DNA, 13 bp, Homo sapiens
aagcttttggaag

SEQ ID NO: 5823632 - DNA, 14 bp, Homo sapiens
aagcttttgttttg

SEQ ID NO: 5823633 - DNA, 14 bp, Homo sapiens
aagctttttaatgc

SEQ ID NO: 5823634 - DNA, 18 bp, Homo sapiens
aagctttttaatgctgta

SEQ ID NO: 5823635 - DNA, 13 bp, Homo sapiens
aagctttttgaaa

SEQ ID NO: 5823636 - DNA, 17 bp, Homo sapiens
aagctttttgtgagaaa

SEQ ID NO: 5823637 - DNA, 19 bp, Homo sapiens
aagctttttgtttgcatca

SEQ ID NO: 5823638 - DNA, 17 bp, Homo sapiens
aagctttttttcttgct

SEQ ID NO: 5823639 - DNA, 21 bp, Homo sapiens
aagctttttttttttgaaccc

SEQ ID NO: 5823640 - DNA, 19 bp, Homo sapiens
aaggaaaaaaaacacaaaa

SEQ ID NO: 5823641 - DNA, 21 bp, Homo sapiens
aaggaaaaaaaacacaaaaca

SEQ ID NO: 5823642 - DNA, 14 bp, Homo sapiens
aaggaaaaaaagac

SEQ ID NO: 5823643 - DNA, 14 bp, Homo sapiens
aaggaaaaaagaaa

SEQ ID NO: 5823644 - DNA, 15 bp, Homo sapiens
aaggaaaaaagcaag

SEQ ID NO: 5823645 - DNA, 20 bp, Homo sapiens
aaggaaaaaaggaggataga

SEQ ID NO: 5823646 - DNA, 12 bp, Homo sapiens
aaggaaaaaata

SEQ ID NO: 5823647 - DNA, 19 bp, Homo sapiens
aaggaaaaaataacaatga

SEQ ID NO: 5823648 - DNA, 16 bp, Homo sapiens
aaggaaaaaataatat

SEQ ID NO: 5823649 - DNA, 17 bp, Homo sapiens
aaggaaaaaatgttgga

SEQ ID NO: 5823650 - DNA, 20 bp, Homo sapiens
aaggaaaaacacaagcaaaa

SEQ ID NO: 5823651 - DNA, 22 bp, Homo sapiens
aaggaaaaacagaacatttctc

SEQ ID NO: 5823652 - DNA, 16 bp, Homo sapiens
aaggaaaaacatgctt

SEQ ID NO: 5823653 - DNA, 17 bp, Homo sapiens
aaggaaaaacatgctta

SEQ ID NO: 5823654 - DNA, 10 bp, Homo sapiens
aaggaaaaag

SEQ ID NO: 5823655 - DNA, 16 bp, Homo sapiens
aaggaaaaagcacaag

SEQ ID NO: 5823656 - DNA, 14 bp, Homo sapiens
aaggaaaaagctcc

SEQ ID NO: 5823657 - DNA, 15 bp, Homo sapiens
aaggaaaaagctcca

SEQ ID NO: 5823658 - DNA, 16 bp, Homo sapiens
aaggaaaaatgtgtaa

SEQ ID NO: 5823659 - DNA, 18 bp, Homo sapiens
aaggaaaaatttttttgt

SEQ ID NO: 5823660 - DNA, 19 bp, Homo sapiens
aaggaaaacaaaaaacttt

SEQ ID NO: 5823661 - DNA, 23 bp, Homo sapiens
aaggaaaactacctgtatttaaa

SEQ ID NO: 5823662 - DNA, 14 bp, Homo sapiens
aaggaaaagaaaaa

SEQ ID NO: 5823663 - DNA, 15 bp, Homo sapiens
aaggaaaagaaaaaa

SEQ ID NO: 5823664 - DNA, 14 bp, Homo sapiens
aaggaaaagaacac

SEQ ID NO: 5823665 - DNA, 21 bp, Homo sapiens
aaggaaaagaagttgcaagac

SEQ ID NO: 5823666 - DNA, 19 bp, Homo sapiens
aaggaaaagaggcccaagt

SEQ ID NO: 5823667 - DNA, 13 bp, Homo sapiens
aaggaaaagcaca

SEQ ID NO: 5823668 - DNA, 17 bp, Homo sapiens
aaggaaaagttctttca

SEQ ID NO: 5823669 - DNA, 12 bp, Homo sapiens
aaggaaaagttt

SEQ ID NO: 5823670 - DNA, 15 bp, Homo sapiens
aaggaaaataagtga

SEQ ID NO: 5823671 - DNA, 12 bp, Homo sapiens
aaggaaaataat

SEQ ID NO: 5823672 - DNA, 12 bp, Homo sapiens
aaggaaaatgat

SEQ ID NO: 5823673 - DNA, 13 bp, Homo sapiens
aaggaaaatgatc

SEQ ID NO: 5823674 - DNA, 17 bp, Homo sapiens
aaggaaacaaagcaata

SEQ ID NO: 5823675 - DNA, 17 bp, Homo sapiens
aaggaaacaaatgtgta

SEQ ID NO: 5823676 - DNA, 19 bp, Homo sapiens
aaggaaacaaatgtgtata

SEQ ID NO: 5823677 - DNA, 18 bp, Homo sapiens
aaggaaacaacaaaggaa

SEQ ID NO: 5823678 - DNA, 18 bp, Homo sapiens
aaggaaacacgtttagaa

SEQ ID NO: 5823679 - DNA, 22 bp, Homo sapiens
aaggaaacacgtttagaaatga

SEQ ID NO: 5823680 - DNA, 13 bp, Homo sapiens
aaggaaacataga

SEQ ID NO: 5823681 - DNA, 14 bp, Homo sapiens
aaggaaacatagaa

SEQ ID NO: 5823682 - DNA, 19 bp, Homo sapiens
aaggaaacatagaaagaca

SEQ ID NO: 5823683 - DNA, 21 bp, Homo sapiens
aaggaaaccacagtgagcctg

SEQ ID NO: 5823684 - DNA, 22 bp, Homo sapiens
aaggaaaccacagtgagcctga

SEQ ID NO: 5823685 - DNA, 15 bp, Homo sapiens
aaggaaacccagctc

SEQ ID NO: 5823686 - DNA, 18 bp, Homo sapiens
aaggaaaccttttcttgt

SEQ ID NO: 5823687 - DNA, 12 bp, Homo sapiens
aaggaaactctt

SEQ ID NO: 5823688 - DNA, 16 bp, Homo sapiens
aaggaaactcttatct

SEQ ID NO: 5823689 - DNA, 21 bp, Homo sapiens
aaggaaacttgaatcaaagca

SEQ ID NO: 5823690 - DNA, 21 bp, Homo sapiens
aaggaaactttcctttaactc

SEQ ID NO: 5823691 - DNA, 22 bp, Homo sapiens
aaggaaagaaaactaacaacca

SEQ ID NO: 5823692 - DNA, 12 bp, Homo sapiens
aaggaaagaaac

SEQ ID NO: 5823693 - DNA, 13 bp, Homo sapiens
aaggaaagaaggg

SEQ ID NO: 5823694 - DNA, 18 bp, Homo sapiens
aaggaaagatgatgctca

SEQ ID NO: 5823695 - DNA, 20 bp, Homo sapiens
aaggaaagatgatgctcagt

SEQ ID NO: 5823696 - DNA, 20 bp, Homo sapiens
aaggaaagcaataaatgaat

SEQ ID NO: 5823697 - DNA, 13 bp, Homo sapiens
aaggaaaggcaaa

SEQ ID NO: 5823698 - DNA, 21 bp, Homo sapiens
aaggaaaggctcatttaaaac

SEQ ID NO: 5823699 - DNA, 22 bp, Homo sapiens
aaggaaaggctcatttaaaaca

SEQ ID NO: 5823700 - DNA, 22 bp, Homo sapiens
aaggatcaacaacatccactgt

SEQ ID NO: 5823701 - DNA, 17 bp, Homo sapiens
aaggatcacagattttt

SEQ ID NO: 5823702 - DNA, 21 bp, Homo sapiens
aaggatcagaagtatggaatt

SEQ ID NO: 5823703 - DNA, 13 bp, Homo sapiens
aaggatcagaatg

SEQ ID NO: 5823704 - DNA, 14 bp, Homo sapiens
aaggatcagattct

SEQ ID NO: 5823705 - DNA, 19 bp, Homo sapiens
aaggatcagattcttgctg

SEQ ID NO: 5823706 - DNA, 15 bp, Homo sapiens
aaggatcaggctgct

SEQ ID NO: 5823707 - DNA, 20 bp, Homo sapiens
aaggatccagatagcctagg

SEQ ID NO: 5823708 - DNA, 20 bp, Homo sapiens
aaggatcctctccactccat

SEQ ID NO: 5823709 - DNA, 20 bp, Homo sapiens
aaggatcctgagccagattt

SEQ ID NO: 5823710 - DNA, 13 bp, Homo sapiens
aaggatctccttt

SEQ ID NO: 5823711 - DNA, 16 bp, Homo sapiens
aaggatctctcaggag

SEQ ID NO: 5823712 - DNA, 22 bp, Homo sapiens
aaggatctctcaggagcacagg

SEQ ID NO: 5823713 - DNA, 14 bp, Homo sapiens
aaggatctgctgag

SEQ ID NO: 5823714 - DNA, 15 bp, Homo sapiens
aaggatctgctgagg

SEQ ID NO: 5823715 - DNA, 24 bp, Homo sapiens
aaggatctgctgaggcccagtgca

SEQ ID NO: 5823716 - DNA, 21 bp, Homo sapiens
aaggatctgtgattggctggt

SEQ ID NO: 5823717 - DNA, 16 bp, Homo sapiens
aaggatctttgtggcc

SEQ ID NO: 5823718 - DNA, 18 bp, Homo sapiens
aaggatctttgtggccaa

SEQ ID NO: 5823719 - DNA, 20 bp, Homo sapiens
aaggatgaaagacaaagaag

SEQ ID NO: 5823720 - DNA, 13 bp, Homo sapiens
aaggatgaaagct

SEQ ID NO: 5823721 - DNA, 20 bp, Homo sapiens
aaggatgacaaaatggaaat

SEQ ID NO: 5823722 - DNA, 15 bp, Homo sapiens
aaggatgagaatgtg

SEQ ID NO: 5823723 - DNA, 16 bp, Homo sapiens
aaggatgagaatgtga

SEQ ID NO: 5823724 - DNA, 15 bp, Homo sapiens
aaggatgagcagagc

SEQ ID NO: 5823725 - DNA, 13 bp, Homo sapiens
aaggatgagggtt

SEQ ID NO: 5823726 - DNA, 20 bp, Homo sapiens
aaggatgccaagaagtttaa

SEQ ID NO: 5823727 - DNA, 17 bp, Homo sapiens
aaggatgccacttggga

SEQ ID NO: 5823728 - DNA, 15 bp, Homo sapiens
aaggatgctctttcc

SEQ ID NO: 5823729 - DNA, 18 bp, Homo sapiens
aaggatggaagaaagaag

SEQ ID NO: 5823730 - DNA, 19 bp, Homo sapiens
aaggatggaagaaagaagc

SEQ ID NO: 5823731 - DNA, 20 bp, Homo sapiens
aaggatggaagaaagaagca

SEQ ID NO: 5823732 - DNA, 19 bp, Homo sapiens
aaggatggatgagtcagac

SEQ ID NO: 5823733 - DNA, 19 bp, Homo sapiens
aaggatggatggcaccctg

SEQ ID NO: 5823734 - DNA, 15 bp, Homo sapiens
aaggatggcaagcac

SEQ ID NO: 5823735 - DNA, 22 bp, Homo sapiens
aaggatggcaagcacgggacag

SEQ ID NO: 5823736 - DNA, 17 bp, Homo sapiens
aaggatggggttatgaa

SEQ ID NO: 5823737 - DNA, 17 bp, Homo sapiens
aaggatgggtcccctcc

SEQ ID NO: 5823738 - DNA, 21 bp, Homo sapiens
aaggatgggtcccctccgcca

SEQ ID NO: 5823739 - DNA, 21 bp, Homo sapiens
aaggatggtggttattttaaa

SEQ ID NO: 5823740 - DNA, 15 bp, Homo sapiens
aaggatgtagaaaca

SEQ ID NO: 5823741 - DNA, 20 bp, Homo sapiens
aaggatgttaacttggttct

SEQ ID NO: 5823742 - DNA, 16 bp, Homo sapiens
aaggatgttacaagtt

SEQ ID NO: 5823743 - DNA, 18 bp, Homo sapiens
aaggatgttctggcttta

SEQ ID NO: 5823744 - DNA, 22 bp, Homo sapiens
aaggatgttctggctttacatt

SEQ ID NO: 5823745 - DNA, 22 bp, Homo sapiens
aaggatgttttgtcccatttcc

SEQ ID NO: 5823746 - DNA, 18 bp, Homo sapiens
aaggattaagatacactc

SEQ ID NO: 5823747 - DNA, 14 bp, Homo sapiens
aaggattacagaaa

SEQ ID NO: 5823748 - DNA, 19 bp, Homo sapiens
aaggattacagaaactgat

SEQ ID NO: 5823749 - DNA, 20 bp, Homo sapiens
aaggattcagttttgcttat

SEQ ID NO: 5823750 - DNA, 21 bp, Homo sapiens
aaggattcctctttgtttatc

SEQ ID NO: 5823751 - DNA, 14 bp, Homo sapiens
aaggattctgggaa

SEQ ID NO: 5823752 - DNA, 22 bp, Homo sapiens
aaggattctgttctgcaactcc

SEQ ID NO: 5823753 - DNA, 22 bp, Homo sapiens
aaggattcttttttcaatgtac

SEQ ID NO: 5823754 - DNA, 19 bp, Homo sapiens
aaggattgcatcctgctgg

SEQ ID NO: 5823755 - DNA, 14 bp, Homo sapiens
aaggattgcctttg

SEQ ID NO: 5823756 - DNA, 15 bp, Homo sapiens
aaggattgctactgt

SEQ ID NO: 5823757 - DNA, 13 bp, Homo sapiens
aaggattgtaaaa

SEQ ID NO: 5823758 - DNA, 14 bp, Homo sapiens
aaggattgtaaaaa

SEQ ID NO: 5823759 - DNA, 21 bp, Homo sapiens
aaggatttaagcaaaggctcc

SEQ ID NO: 5823760 - DNA, 21 bp, Homo sapiens
aaggatttactttttgtaaaa

SEQ ID NO: 5823761 - DNA, 16 bp, Homo sapiens
aaggatttcttatttt

SEQ ID NO: 5823762 - DNA, 18 bp, Homo sapiens
aaggattttaaatgctgt

SEQ ID NO: 5823763 - DNA, 23 bp, Homo sapiens
aaggattttaaatgctgtatgtc

SEQ ID NO: 5823764 - DNA, 18 bp, Homo sapiens
aaggattttaccaaagca

SEQ ID NO: 5823765 - DNA, 12 bp, Homo sapiens
aaggattttatg

SEQ ID NO: 5823766 - DNA, 21 bp, Homo sapiens
aaggattttatgctttaaaca

SEQ ID NO: 5823767 - DNA, 12 bp, Homo sapiens
aaggattttctt

SEQ ID NO: 5823768 - DNA, 15 bp, Homo sapiens
aaggattttcttttt

SEQ ID NO: 5823769 - DNA, 14 bp, Homo sapiens
aaggattttgcagt

SEQ ID NO: 5823770 - DNA, 15 bp, Homo sapiens
aaggattttgcagtt

SEQ ID NO: 5823771 - DNA, 16 bp, Homo sapiens
aaggatttttccatgg

SEQ ID NO: 5823772 - DNA, 21 bp, Homo sapiens
aaggattttttaaagtttttt

SEQ ID NO: 5823773 - DNA, 14 bp, Homo sapiens
aaggcaaaaatatc

SEQ ID NO: 5823774 - DNA, 15 bp, Homo sapiens
aaggcaaaaatgtaa

SEQ ID NO: 5823775 - DNA, 20 bp, Homo sapiens
aaggcaaagcacgaaatgtt

SEQ ID NO: 5823776 - DNA, 11 bp, Homo sapiens
aaggcaaaggc

SEQ ID NO: 5823777 - DNA, 13 bp, Homo sapiens
aaggcaaaggcag

SEQ ID NO: 5823778 - DNA, 16 bp, Homo sapiens
aaggcaaaggcagagg

SEQ ID NO: 5823779 - DNA, 17 bp, Homo sapiens
aaggcaaaggcagagga

SEQ ID NO: 5823780 - DNA, 19 bp, Homo sapiens
aaggcaaaggcagaggaat

SEQ ID NO: 5823781 - DNA, 18 bp, Homo sapiens
aaggcaaagtacattgta

SEQ ID NO: 5823782 - DNA, 12 bp, Homo sapiens
aaggcaaataat

SEQ ID NO: 5823783 - DNA, 22 bp, Homo sapiens
aaggcaaatattatccagcaag

SEQ ID NO: 5823784 - DNA, 13 bp, Homo sapiens
aaggcaaatcatt

SEQ ID NO: 5823785 - DNA, 13 bp, Homo sapiens
aaggcaaatctcc

SEQ ID NO: 5823786 - DNA, 19 bp, Homo sapiens
aaggcaaatctcctttgtc

SEQ ID NO: 5823787 - DNA, 16 bp, Homo sapiens
aaggcaaatgcccaag

SEQ ID NO: 5823788 - DNA, 17 bp, Homo sapiens
aaggcaaatgcccaagg

SEQ ID NO: 5823789 - DNA, 21 bp, Homo sapiens
aaggcaaattgattcaaatgt

SEQ ID NO: 5823790 - DNA, 22 bp, Homo sapiens
aaggcaactagtggagagaact

SEQ ID NO: 5823791 - DNA, 15 bp, Homo sapiens
aaggcaagaagtggg

SEQ ID NO: 5823792 - DNA, 23 bp, Homo sapiens
aaggcaagattggaaagacagga

SEQ ID NO: 5823793 - DNA, 16 bp, Homo sapiens
aaggcaagcatgaata

SEQ ID NO: 5823794 - DNA, 11 bp, Homo sapiens
aaggcaagcca

SEQ ID NO: 5823795 - DNA, 13 bp, Homo sapiens
aaggcaaggaaat

SEQ ID NO: 5823796 - DNA, 17 bp, Homo sapiens
aaggcaagtgcaataat

SEQ ID NO: 5823797 - DNA, 15 bp, Homo sapiens
aaggcaagttaagag

SEQ ID NO: 5823798 - DNA, 17 bp, Homo sapiens
aaggcaagttaagagaa

SEQ ID NO: 5823799 - DNA, 20 bp, Homo sapiens
aaggcaagtttctagctaga

SEQ ID NO: 5823800 - DNA, 13 bp, Homo sapiens
aaggcaatggaaa

SEQ ID NO: 5823801 - DNA, 15 bp, Homo sapiens
aaggcacaatatggg

SEQ ID NO: 5823802 - DNA, 21 bp, Homo sapiens
aaggcacacagagattctgga

SEQ ID NO: 5823803 - DNA, 14 bp, Homo sapiens
aaggcacagtggga

SEQ ID NO: 5823804 - DNA, 19 bp, Homo sapiens
aaggcacccacaaataaat

SEQ ID NO: 5823805 - DNA, 20 bp, Homo sapiens
aaggcacccacaaataaatg

SEQ ID NO: 5823806 - DNA, 22 bp, Homo sapiens
aaggcacctataaaacaggtca

SEQ ID NO: 5823807 - DNA, 20 bp, Homo sapiens
aaggcacctgcccccacagc

SEQ ID NO: 5823808 - DNA, 14 bp, Homo sapiens
aaggcacctgctcc

SEQ ID NO: 5823809 - DNA, 21 bp, Homo sapiens
aaggcaccttcttaaaagaaa

SEQ ID NO: 5823810 - DNA, 18 bp, Homo sapiens
aaggcacgtttggcattt

SEQ ID NO: 5823811 - DNA, 16 bp, Homo sapiens
aaggcactaatgatgt

SEQ ID NO: 5823812 - DNA, 19 bp, Homo sapiens
aaggcactctagattccat

SEQ ID NO: 5823813 - DNA, 21 bp, Homo sapiens
aaggcactgcacataatttgc

SEQ ID NO: 5823814 - DNA, 12 bp, Homo sapiens
aaggcactgcct

SEQ ID NO: 5823815 - DNA, 13 bp, Homo sapiens
aaggcactgcctg

SEQ ID NO: 5823816 - DNA, 22 bp, Homo sapiens
aaggcagaaacacaaccactca

SEQ ID NO: 5823817 - DNA, 13 bp, Homo sapiens
aaggcagaaagga

SEQ ID NO: 5823818 - DNA, 15 bp, Homo sapiens
aaggcagaaggccag

SEQ ID NO: 5823819 - DNA, 12 bp, Homo sapiens
aaggcagacaca

SEQ ID NO: 5823820 - DNA, 14 bp, Homo sapiens
aaggcagacagcag

SEQ ID NO: 5823821 - DNA, 17 bp, Homo sapiens
aaggcagacaggaagga

SEQ ID NO: 5823822 - DNA, 21 bp, Homo sapiens
aaggcagacccagtatgaaat

SEQ ID NO: 5823823 - DNA, 23 bp, Homo sapiens
aaggcagactttctacatgcaaa

SEQ ID NO: 5823824 - DNA, 15 bp, Homo sapiens
aaggcagagaaaaca

SEQ ID NO: 5823825 - DNA, 22 bp, Homo sapiens
aaggcagagaaatctaagctgt

SEQ ID NO: 5823826 - DNA, 20 bp, Homo sapiens
aaggcagagaagttctcaaa

SEQ ID NO: 5823827 - DNA, 15 bp, Homo sapiens
aaggcagaggaattt

SEQ ID NO: 5823828 - DNA, 14 bp, Homo sapiens
aaggcagaggcctg

SEQ ID NO: 5823829 - DNA, 12 bp, Homo sapiens
aaggcagaggct

SEQ ID NO: 5823830 - DNA, 15 bp, Homo sapiens
aaggcagaggctggc

SEQ ID NO: 5823831 - DNA, 16 bp, Homo sapiens
aaggcagaggctggca

SEQ ID NO: 5823832 - DNA, 13 bp, Homo sapiens
aaggcagagggga

SEQ ID NO: 5823833 - DNA, 20 bp, Homo sapiens
aaggcagattttacagagcg

SEQ ID NO: 5823834 - DNA, 16 bp, Homo sapiens
aaggcagcaaggcccg

SEQ ID NO: 5823835 - DNA, 19 bp, Homo sapiens
aaggcagcaaggcccgagc

SEQ ID NO: 5823836 - DNA, 11 bp, Homo sapiens
aaggcagccac

SEQ ID NO: 5823837 - DNA, 14 bp, Homo sapiens
aaggcagccaccag

SEQ ID NO: 5823838 - DNA, 12 bp, Homo sapiens
aaggcagccaga

SEQ ID NO: 5823839 - DNA, 16 bp, Homo sapiens
aaggcagccagatccc

SEQ ID NO: 5823840 - DNA, 22 bp, Homo sapiens
aaggcagccagatccccagggc

SEQ ID NO: 5823841 - DNA, 16 bp, Homo sapiens
aaggcagcctccagag

SEQ ID NO: 5823842 - DNA, 22 bp, Homo sapiens
aaggcagcctccagagccagcc

SEQ ID NO: 5823843 - DNA, 16 bp, Homo sapiens
aaggcagctcacccct

SEQ ID NO: 5823844 - DNA, 20 bp, Homo sapiens
aaggcagctcacccctgggc

SEQ ID NO: 5823845 - DNA, 22 bp, Homo sapiens
aaggcagctcacccctgggcag

SEQ ID NO: 5823846 - DNA, 19 bp, Homo sapiens
aaggcagctcttctggagt

SEQ ID NO: 5823847 - DNA, 20 bp, Homo sapiens
aaggcagctgaaaagtaaat

SEQ ID NO: 5823848 - DNA, 12 bp, Homo sapiens
aaggcagctgcc

SEQ ID NO: 5823849 - DNA, 15 bp, Homo sapiens
aaggcagctgcctct

SEQ ID NO: 5823850 - DNA, 16 bp, Homo sapiens
aaggcagctgcctctg

SEQ ID NO: 5823851 - DNA, 20 bp, Homo sapiens
aaggcagctgcctctgctcc

SEQ ID NO: 5823852 - DNA, 22 bp, Homo sapiens
aaggcagctgcctctgctccct

SEQ ID NO: 5823853 - DNA, 11 bp, Homo sapiens
aaggcagctgt

SEQ ID NO: 5823854 - DNA, 18 bp, Homo sapiens
aaggcagctgtgtctgag

SEQ ID NO: 5823855 - DNA, 22 bp, Homo sapiens
aaggcagctgtgtctgagccca

SEQ ID NO: 5823856 - DNA, 22 bp, Homo sapiens
aaggcagctgttgtctcttctc

SEQ ID NO: 5823857 - DNA, 12 bp, Homo sapiens
aaggcaggaaga

SEQ ID NO: 5823858 - DNA, 13 bp, Homo sapiens
aaggcaggaagag

SEQ ID NO: 5823859 - DNA, 14 bp, Homo sapiens
aaggcaggaagaga

SEQ ID NO: 5823860 - DNA, 14 bp, Homo sapiens
aaggcaggcagggc

SEQ ID NO: 5823861 - DNA, 18 bp, Homo sapiens
aaggcaggcagggctctc

SEQ ID NO: 5823862 - DNA, 16 bp, Homo sapiens
aaggcaggcatatcaa

SEQ ID NO: 5823863 - DNA, 17 bp, Homo sapiens
aaggcaggcctatttca

SEQ ID NO: 5823864 - DNA, 12 bp, Homo sapiens
aaggcaggcctg

SEQ ID NO: 5823865 - DNA, 14 bp, Homo sapiens
aaggcagggaggag

SEQ ID NO: 5823866 - DNA, 16 bp, Homo sapiens
aaggcagggcaagaac

SEQ ID NO: 5823867 - DNA, 22 bp, Homo sapiens
aaggcagggcaagaacagaagt

SEQ ID NO: 5823868 - DNA, 12 bp, Homo sapiens
aaggcagggcag

SEQ ID NO: 5823869 - DNA, 13 bp, Homo sapiens
aaggcagggccct

SEQ ID NO: 5823870 - DNA, 15 bp, Homo sapiens
aaggcagggccctga

SEQ ID NO: 5823871 - DNA, 20 bp, Homo sapiens
aaggcagggccctgaaatgg

SEQ ID NO: 5823872 - DNA, 15 bp, Homo sapiens
aaggcagggctcctc

SEQ ID NO: 5823873 - DNA, 20 bp, Homo sapiens
aaggcaggggaatgtatgtg

SEQ ID NO: 5823874 - DNA, 14 bp, Homo sapiens
aaggcaggtgcctc

SEQ ID NO: 5823875 - DNA, 17 bp, Homo sapiens
aaggcaggtgcctccag

SEQ ID NO: 5823876 - DNA, 22 bp, Homo sapiens
aaggcaggttggatgggagtgg

SEQ ID NO: 5823877 - DNA, 18 bp, Homo sapiens
aaggcaggtttgggaagg

SEQ ID NO: 5823878 - DNA, 23 bp, Homo sapiens
aaggcagtatggcggaggccatg

SEQ ID NO: 5823879 - DNA, 17 bp, Homo sapiens
aagggagagcggggcag

SEQ ID NO: 5823880 - DNA, 14 bp, Homo sapiens
aagggagagctgag

SEQ ID NO: 5823881 - DNA, 14 bp, Homo sapiens
aagggagagggaaa

SEQ ID NO: 5823882 - DNA, 18 bp, Homo sapiens
aagggagagggagggagc

SEQ ID NO: 5823883 - DNA, 23 bp, Homo sapiens
aagggagagttctttgctgcccc

SEQ ID NO: 5823884 - DNA, 24 bp, Homo sapiens
aagggagcactgggttgactttca

SEQ ID NO: 5823885 - DNA, 17 bp, Homo sapiens
aagggagcagaactgaa

SEQ ID NO: 5823886 - DNA, 13 bp, Homo sapiens
aagggagccaagg

SEQ ID NO: 5823887 - DNA, 14 bp, Homo sapiens
aagggagccaaggg

SEQ ID NO: 5823888 - DNA, 18 bp, Homo sapiens
aagggagccaagggatgg

SEQ ID NO: 5823889 - DNA, 17 bp, Homo sapiens
aagggagccatgctctt

SEQ ID NO: 5823890 - DNA, 20 bp, Homo sapiens
aagggagcccctcctctgag

SEQ ID NO: 5823891 - DNA, 16 bp, Homo sapiens
aagggagcgaggtcag

SEQ ID NO: 5823892 - DNA, 18 bp, Homo sapiens
aagggagctatcaggaac

SEQ ID NO: 5823893 - DNA, 18 bp, Homo sapiens
aagggagctggctccagc

SEQ ID NO: 5823894 - DNA, 19 bp, Homo sapiens
aagggaggaaggcctttct

SEQ ID NO: 5823895 - DNA, 18 bp, Homo sapiens
aagggaggacgggagctg

SEQ ID NO: 5823896 - DNA, 21 bp, Homo sapiens
aagggaggaggagcttctggg

SEQ ID NO: 5823897 - DNA, 16 bp, Homo sapiens
aagggaggcagtggct

SEQ ID NO: 5823898 - DNA, 20 bp, Homo sapiens
aagggaggcccagccgcagg

SEQ ID NO: 5823899 - DNA, 13 bp, Homo sapiens
aagggaggcctga

SEQ ID NO: 5823900 - DNA, 16 bp, Homo sapiens
aagggaggcctgaggg

SEQ ID NO: 5823901 - DNA, 17 bp, Homo sapiens
aagggagggagcaagcc

SEQ ID NO: 5823902 - DNA, 18 bp, Homo sapiens
aagggagggagcaagccc

SEQ ID NO: 5823903 - DNA, 19 bp, Homo sapiens
aagggagggagctgaggcc

SEQ ID NO: 5823904 - DNA, 21 bp, Homo sapiens
aagggagggcagagctggtgc

SEQ ID NO: 5823905 - DNA, 14 bp, Homo sapiens
aagggagggctctg

SEQ ID NO: 5823906 - DNA, 17 bp, Homo sapiens
aagggagggctctgagg

SEQ ID NO: 5823907 - DNA, 21 bp, Homo sapiens
aagggagggctctgaggcgcc

SEQ ID NO: 5823908 - DNA, 16 bp, Homo sapiens
aagggaggggaagaga

SEQ ID NO: 5823909 - DNA, 17 bp, Homo sapiens
aagggaggggaaggggc

SEQ ID NO: 5823910 - DNA, 13 bp, Homo sapiens
aagggagggggag

SEQ ID NO: 5823911 - DNA, 16 bp, Homo sapiens
aagggaggggtggtat

SEQ ID NO: 5823912 - DNA, 19 bp, Homo sapiens
aagggagggtgcagccctc

SEQ ID NO: 5823913 - DNA, 18 bp, Homo sapiens
aagggagggtggcagaga

SEQ ID NO: 5823914 - DNA, 15 bp, Homo sapiens
aagggagtctctctt

SEQ ID NO: 5823915 - DNA, 19 bp, Homo sapiens
aagggagtgtactcccagg

SEQ ID NO: 5823916 - DNA, 21 bp, Homo sapiens
aagggagttgctcactcagga

SEQ ID NO: 5823917 - DNA, 15 bp, Homo sapiens
aagggagtttaaaaa

SEQ ID NO: 5823918 - DNA, 15 bp, Homo sapiens
aagggatataaaatg

SEQ ID NO: 5823919 - DNA, 17 bp, Homo sapiens
aagggatataaaatgaa

SEQ ID NO: 5823920 - DNA, 20 bp, Homo sapiens
aagggatataaaatgaaaga

SEQ ID NO: 5823921 - DNA, 14 bp, Homo sapiens
aagggatccagaga

SEQ ID NO: 5823922 - DNA, 15 bp, Homo sapiens
aagggatccagagac

SEQ ID NO: 5823923 - DNA, 16 bp, Homo sapiens
aagggatccagagacc

SEQ ID NO: 5823924 - DNA, 23 bp, Homo sapiens
aagggatccagagacctgctcca

SEQ ID NO: 5823925 - DNA, 14 bp, Homo sapiens
aagggatctgctta

SEQ ID NO: 5823926 - DNA, 16 bp, Homo sapiens
aagggatgagtgttgg

SEQ ID NO: 5823927 - DNA, 17 bp, Homo sapiens
aagggatggccacaagt

SEQ ID NO: 5823928 - DNA, 15 bp, Homo sapiens
aagggatgggggaag

SEQ ID NO: 5823929 - DNA, 15 bp, Homo sapiens
aagggatggtattga

SEQ ID NO: 5823930 - DNA, 15 bp, Homo sapiens
aagggatggtcaggc

SEQ ID NO: 5823931 - DNA, 14 bp, Homo sapiens
aagggatggtggag

SEQ ID NO: 5823932 - DNA, 18 bp, Homo sapiens
aagggattactagagaaa

SEQ ID NO: 5823933 - DNA, 23 bp, Homo sapiens
aagggattactagagaaagacaa

SEQ ID NO: 5823934 - DNA, 17 bp, Homo sapiens
aagggattgaggagttg

SEQ ID NO: 5823935 - DNA, 22 bp, Homo sapiens
aagggattgaggagttgcctga

SEQ ID NO: 5823936 - DNA, 15 bp, Homo sapiens
aagggattgctgagg

SEQ ID NO: 5823937 - DNA, 15 bp, Homo sapiens
aagggatttcttagg

SEQ ID NO: 5823938 - DNA, 21 bp, Homo sapiens
aagggattttcagccctcaga

SEQ ID NO: 5823939 - DNA, 18 bp, Homo sapiens
aagggcaaaattcccagg

SEQ ID NO: 5823940 - DNA, 20 bp, Homo sapiens
aagggcaaaccatttcaaat

SEQ ID NO: 5823941 - DNA, 15 bp, Homo sapiens
aagggcaaataatga

SEQ ID NO: 5823942 - DNA, 14 bp, Homo sapiens
aagggcaaatctgc

SEQ ID NO: 5823943 - DNA, 20 bp, Homo sapiens
aagggcaacagatcagtaaa

SEQ ID NO: 5823944 - DNA, 15 bp, Homo sapiens
aagggcaagaaatgg

SEQ ID NO: 5823945 - DNA, 17 bp, Homo sapiens
aagggcaagctggagtt

SEQ ID NO: 5823946 - DNA, 16 bp, Homo sapiens
aagggcaaggggtgag

SEQ ID NO: 5823947 - DNA, 13 bp, Homo sapiens
aagggcaataaat

SEQ ID NO: 5823948 - DNA, 20 bp, Homo sapiens
aagggcacaaactgcagctg

SEQ ID NO: 5823949 - DNA, 21 bp, Homo sapiens
aagggcacagacactacatat

SEQ ID NO: 5823950 - DNA, 16 bp, Homo sapiens
aagggcactatatttt

SEQ ID NO: 5823951 - DNA, 21 bp, Homo sapiens
aagggcacttaatttgtaaac

SEQ ID NO: 5823952 - DNA, 19 bp, Homo sapiens
aagggcagaacactaacct

SEQ ID NO: 5823953 - DNA, 13 bp, Homo sapiens
aagggcagaatga

SEQ ID NO: 5823954 - DNA, 20 bp, Homo sapiens
aagggcagagaactgtcttt

SEQ ID NO: 5823955 - DNA, 22 bp, Homo sapiens
aagggcagaggcaaggatggtg

SEQ ID NO: 5823956 - DNA, 15 bp, Homo sapiens
aagggcagaggggtg

SEQ ID NO: 5823957 - DNA, 13 bp, Homo sapiens
aagggcagagtta

SEQ ID NO: 5823958 - DNA, 19 bp, Homo sapiens
aagggcagagttacttgat

SEQ ID NO: 5823959 - DNA, 14 bp, Homo sapiens
aagggcagccaggg

SEQ ID NO: 5823960 - DNA, 19 bp, Homo sapiens
aagggcagccaggggctgc

SEQ ID NO: 5823961 - DNA, 22 bp, Homo sapiens
aagggcagccaggggctgctca

SEQ ID NO: 5823962 - DNA, 12 bp, Homo sapiens
aagggcagcccc

SEQ ID NO: 5823963 - DNA, 17 bp, Homo sapiens
aagggcagcccctcccc

SEQ ID NO: 5823964 - DNA, 14 bp, Homo sapiens
aagggcagcttcag

SEQ ID NO: 5823965 - DNA, 15 bp, Homo sapiens
aagggcaggagccta

SEQ ID NO: 5823966 - DNA, 17 bp, Homo sapiens
aagggcaggagctcaca

SEQ ID NO: 5823967 - DNA, 12 bp, Homo sapiens
aagggcaggcct

SEQ ID NO: 5823968 - DNA, 13 bp, Homo sapiens
aagggcaggcctg

SEQ ID NO: 5823969 - DNA, 15 bp, Homo sapiens
aagggcaggcctgtt

SEQ ID NO: 5823970 - DNA, 14 bp, Homo sapiens
aagggcagggacag

SEQ ID NO: 5823971 - DNA, 22 bp, Homo sapiens
aagggcagggcatctcctgtgc

SEQ ID NO: 5823972 - DNA, 22 bp, Homo sapiens
aagggcagggcccacgtgtata

SEQ ID NO: 5823973 - DNA, 17 bp, Homo sapiens
aagggcaggtcttcata

SEQ ID NO: 5823974 - DNA, 17 bp, Homo sapiens
aagggcataaaacagct

SEQ ID NO: 5823975 - DNA, 21 bp, Homo sapiens
aagggcataaagtaaatacat

SEQ ID NO: 5823976 - DNA, 19 bp, Homo sapiens
aagggcataccttgtgcat

SEQ ID NO: 5823977 - DNA, 20 bp, Homo sapiens
aagggcatcatcctcagcag

SEQ ID NO: 5823978 - DNA, 22 bp, Homo sapiens
aagggcatcatcctcagcagca

SEQ ID NO: 5823979 - DNA, 13 bp, Homo sapiens
aagggcatgcctt

SEQ ID NO: 5823980 - DNA, 15 bp, Homo sapiens
aagggcatgccttgt

SEQ ID NO: 5823981 - DNA, 19 bp, Homo sapiens
aagggcatgccttgtgctg

SEQ ID NO: 5823982 - DNA, 13 bp, Homo sapiens
aagggccaccctg

SEQ ID NO: 5823983 - DNA, 18 bp, Homo sapiens
aagggccaccctgagcag

SEQ ID NO: 5823984 - DNA, 17 bp, Homo sapiens
aagggccaccctgctgc

SEQ ID NO: 5823985 - DNA, 18 bp, Homo sapiens
aagggccaccctgctgca

SEQ ID NO: 5823986 - DNA, 21 bp, Homo sapiens
aagggccaccctgctgcacta

SEQ ID NO: 5823987 - DNA, 22 bp, Homo sapiens
aagggccaccctgctgcactag

SEQ ID NO: 5823988 - DNA, 18 bp, Homo sapiens
aagggccagacagacctt

SEQ ID NO: 5823989 - DNA, 13 bp, Homo sapiens
aagggccagagcc

SEQ ID NO: 5823990 - DNA, 13 bp, Homo sapiens
aagggccaggaga

SEQ ID NO: 5823991 - DNA, 14 bp, Homo sapiens
aagggccaggagag

SEQ ID NO: 5823992 - DNA, 17 bp, Homo sapiens
aagggccaggagagaga

SEQ ID NO: 5823993 - DNA, 17 bp, Homo sapiens
aagggccaggagatgga

SEQ ID NO: 5823994 - DNA, 13 bp, Homo sapiens
aagggccaggtgc

SEQ ID NO: 5823995 - DNA, 20 bp, Homo sapiens
aagggccaggtgcggcctgg

SEQ ID NO: 5823996 - DNA, 14 bp, Homo sapiens
aagggcccagaccc

SEQ ID NO: 5823997 - DNA, 15 bp, Homo sapiens
aagggcccagaccct

SEQ ID NO: 5823998 - DNA, 18 bp, Homo sapiens
aagggccctcactcagga

SEQ ID NO: 5823999 - DNA, 16 bp, Homo sapiens
aagggccctccttcct

SEQ ID NO: 5824000 - DNA, 16 bp, Homo sapiens
aagggccctgccctgt

SEQ ID NO: 5824001 - DNA, 12 bp, Homo sapiens
aagggccctggg

SEQ ID NO: 5824002 - DNA, 15 bp, Homo sapiens
aagggccggggatgg

SEQ ID NO: 5824003 - DNA, 20 bp, Homo sapiens
aagggccggggatggatctt

SEQ ID NO: 5824004 - DNA, 22 bp, Homo sapiens
aagggccgtgcccgcccacctc

SEQ ID NO: 5824005 - DNA, 16 bp, Homo sapiens
aagggccgtgcccttg

SEQ ID NO: 5824006 - DNA, 19 bp, Homo sapiens
aagggcctcacctttccca

SEQ ID NO: 5824007 - DNA, 16 bp, Homo sapiens
aagggcctcccagccc

SEQ ID NO: 5824008 - DNA, 16 bp, Homo sapiens
aagggcctgctggaga

SEQ ID NO: 5824009 - DNA, 11 bp, Homo sapiens
aagggcctggc

SEQ ID NO: 5824010 - DNA, 17 bp, Homo sapiens
aagggcctggccagtcc

SEQ ID NO: 5824011 - DNA, 20 bp, Homo sapiens
aagggcctggccagtcctgg

SEQ ID NO: 5824012 - DNA, 19 bp, Homo sapiens
aagggcgcaaagggcatgg

SEQ ID NO: 5824013 - DNA, 21 bp, Homo sapiens
aagggcgcaaagggcatgggt

SEQ ID NO: 5824014 - DNA, 23 bp, Homo sapiens
aagggcgcctactcttcagggtc

SEQ ID NO: 5824015 - DNA, 19 bp, Homo sapiens
aagggcggaagagttacaa

SEQ ID NO: 5824016 - DNA, 21 bp, Homo sapiens
aagggcgggcaaggagtgggg

SEQ ID NO: 5824017 - DNA, 15 bp, Homo sapiens
aagggcgtggctctg

SEQ ID NO: 5824018 - DNA, 19 bp, Homo sapiens
aagggcgtggctctgggtg

SEQ ID NO: 5824019 - DNA, 20 bp, Homo sapiens
aagggcgtggctctgggtgg

SEQ ID NO: 5824020 - DNA, 17 bp, Homo sapiens
aagggctacctctgagt

SEQ ID NO: 5824021 - DNA, 17 bp, Homo sapiens
aagggctagaacctgga

SEQ ID NO: 5824022 - DNA, 15 bp, Homo sapiens
aagggctccagcatc

SEQ ID NO: 5824023 - DNA, 22 bp, Homo sapiens
aagggctccagcatccagcctg

SEQ ID NO: 5824024 - DNA, 15 bp, Homo sapiens
aagggctgaaccctc

SEQ ID NO: 5824025 - DNA, 20 bp, Homo sapiens
aagggctgaaccctcagcct

SEQ ID NO: 5824026 - DNA, 14 bp, Homo sapiens
aagggctgcatgat

SEQ ID NO: 5824027 - DNA, 19 bp, Homo sapiens
aagggctgccggggcagcc

SEQ ID NO: 5824028 - DNA, 21 bp, Homo sapiens
aagggctgccggggcagcccc

SEQ ID NO: 5824029 - DNA, 13 bp, Homo sapiens
aagggctgccttg

SEQ ID NO: 5824030 - DNA, 9 bp, Homo sapiens
aagggctgg

SEQ ID NO: 5824031 - DNA, 12 bp, Homo sapiens
aagggctggctc

SEQ ID NO: 5824032 - DNA, 17 bp, Homo sapiens
aagggctggctccccct

SEQ ID NO: 5824033 - DNA, 23 bp, Homo sapiens
aagggctggctccccctccccag

SEQ ID NO: 5824034 - DNA, 15 bp, Homo sapiens
aagggctggctgcaa

SEQ ID NO: 5824035 - DNA, 11 bp, Homo sapiens
aagggctgggc

SEQ ID NO: 5824036 - DNA, 12 bp, Homo sapiens
aagggctgggcc

SEQ ID NO: 5824037 - DNA, 17 bp, Homo sapiens
aagggctggggcggagc

SEQ ID NO: 5824038 - DNA, 15 bp, Homo sapiens
aagggcttactattt

SEQ ID NO: 5824039 - DNA, 18 bp, Homo sapiens
aagggcttctgcaccctc

SEQ ID NO: 5824040 - DNA, 13 bp, Homo sapiens
aagggcttgaatt

SEQ ID NO: 5824041 - DNA, 20 bp, Homo sapiens
aagggctttggttccttctc

SEQ ID NO: 5824042 - DNA, 20 bp, Homo sapiens
aagggcttttcaaaatcatt

SEQ ID NO: 5824043 - DNA, 14 bp, Homo sapiens
aagggcttttcttt

SEQ ID NO: 5824044 - DNA, 16 bp, Homo sapiens
aaggggaaaacctcag

SEQ ID NO: 5824045 - DNA, 21 bp, Homo sapiens
aaggggaaaatgtgaagctga

SEQ ID NO: 5824046 - DNA, 18 bp, Homo sapiens
aaggggaaacgtctccca

SEQ ID NO: 5824047 - DNA, 21 bp, Homo sapiens
aaggggaatctggaggtagcc

SEQ ID NO: 5824048 - DNA, 22 bp, Homo sapiens
aaggggaatgtttgcctctgcc

SEQ ID NO: 5824049 - DNA, 23 bp, Homo sapiens
aaggggaatgtttgcctctgcct

SEQ ID NO: 5824050 - DNA, 17 bp, Homo sapiens
aaggggaattgaggaca

SEQ ID NO: 5824051 - DNA, 17 bp, Homo sapiens
aaggggacacctgtaca

SEQ ID NO: 5824052 - DNA, 12 bp, Homo sapiens
aaggggacaggc

SEQ ID NO: 5824053 - DNA, 19 bp, Homo sapiens
aaggggacgcgggctgtgc

SEQ ID NO: 5824054 - DNA, 17 bp, Homo sapiens
aaggggactgccacctc

SEQ ID NO: 5824055 - DNA, 17 bp, Homo sapiens
aaggggacttgtgccag

SEQ ID NO: 5824056 - DNA, 12 bp, Homo sapiens
aaggggagaagg

SEQ ID NO: 5824057 - DNA, 18 bp, Homo sapiens
aaggggagaagggccagc

SEQ ID NO: 5824058 - DNA, 14 bp, Homo sapiens
aaggggagagcctg

SEQ ID NO: 5824059 - DNA, 15 bp, Homo sapiens
aaggggagagcctgc

SEQ ID NO: 5824060 - DNA, 18 bp, Homo sapiens
aaggggagagcctgctgg

SEQ ID NO: 5824061 - DNA, 13 bp, Homo sapiens
aaggggaggaccc

SEQ ID NO: 5824062 - DNA, 13 bp, Homo sapiens
aaggggaggagaa

SEQ ID NO: 5824063 - DNA, 16 bp, Homo sapiens
aaggggagtaggtggg

SEQ ID NO: 5824064 - DNA, 19 bp, Homo sapiens
aaggggagtcaccttccct

SEQ ID NO: 5824065 - DNA, 13 bp, Homo sapiens
aaggggagttgag

SEQ ID NO: 5824066 - DNA, 18 bp, Homo sapiens
aaggggatcataaagtta

SEQ ID NO: 5824067 - DNA, 12 bp, Homo sapiens
aaggggatggag

SEQ ID NO: 5824068 - DNA, 14 bp, Homo sapiens
aaggggatggaggc

SEQ ID NO: 5824069 - DNA, 15 bp, Homo sapiens
aaggggatggaggcc

SEQ ID NO: 5824070 - DNA, 18 bp, Homo sapiens
aaggggatggaggccaga

SEQ ID NO: 5824071 - DNA, 20 bp, Homo sapiens
aaggggatggaggccagagt

SEQ ID NO: 5824072 - DNA, 14 bp, Homo sapiens
aaggggcaaatttt

SEQ ID NO: 5824073 - DNA, 18 bp, Homo sapiens
aaggggcaaatttttatt

SEQ ID NO: 5824074 - DNA, 14 bp, Homo sapiens
aaggggcacaccac

SEQ ID NO: 5824075 - DNA, 12 bp, Homo sapiens
aaggggcacctc

SEQ ID NO: 5824076 - DNA, 15 bp, Homo sapiens
aaggggcacctggga

SEQ ID NO: 5824077 - DNA, 21 bp, Homo sapiens
aaggggcacctgggaaaacag

SEQ ID NO: 5824078 - DNA, 19 bp, Homo sapiens
aaggggcacgcctgcccag

SEQ ID NO: 5824079 - DNA, 16 bp, Homo sapiens
aaggggcagataaagg

SEQ ID NO: 5824080 - DNA, 13 bp, Homo sapiens
aaggggcagcagg

SEQ ID NO: 5824081 - DNA, 14 bp, Homo sapiens
aaggggcagcagga

SEQ ID NO: 5824082 - DNA, 22 bp, Homo sapiens
aaggggcagcagttgaggtggg

SEQ ID NO: 5824083 - DNA, 13 bp, Homo sapiens
aaggggcagccag

SEQ ID NO: 5824084 - DNA, 21 bp, Homo sapiens
aaggggcagccagccctggct

SEQ ID NO: 5824085 - DNA, 17 bp, Homo sapiens
aaggggcagccctgagt

SEQ ID NO: 5824086 - DNA, 16 bp, Homo sapiens
aaggggcagctcctga

SEQ ID NO: 5824087 - DNA, 15 bp, Homo sapiens
aaggggcaggaatca

SEQ ID NO: 5824088 - DNA, 21 bp, Homo sapiens
aaggggcaggaatcaaggagc

SEQ ID NO: 5824089 - DNA, 18 bp, Homo sapiens
aaggggcaggattctgca

SEQ ID NO: 5824090 - DNA, 20 bp, Homo sapiens
aaggggcagtctggaggggc

SEQ ID NO: 5824091 - DNA, 14 bp, Homo sapiens
aaggggcagtggtg

SEQ ID NO: 5824092 - DNA, 13 bp, Homo sapiens
aaggggccagacc

SEQ ID NO: 5824093 - DNA, 15 bp, Homo sapiens
aaggggccagctgcc

SEQ ID NO: 5824094 - DNA, 19 bp, Homo sapiens
aaggggccaggaaggggac

SEQ ID NO: 5824095 - DNA, 16 bp, Homo sapiens
aaggggcccaagagag

SEQ ID NO: 5824096 - DNA, 18 bp, Homo sapiens
aaggggcccaagagagac

SEQ ID NO: 5824097 - DNA, 18 bp, Homo sapiens
aaggggccccggggctgg

SEQ ID NO: 5824098 - DNA, 20 bp, Homo sapiens
aaggggccccggggctggca

SEQ ID NO: 5824099 - DNA, 13 bp, Homo sapiens
aaggggccctggt

SEQ ID NO: 5824100 - DNA, 21 bp, Homo sapiens
aaggggccctggtccttccag

SEQ ID NO: 5824101 - DNA, 16 bp, Homo sapiens
aaggggcccttggagc

SEQ ID NO: 5824102 - DNA, 13 bp, Homo sapiens
aaggggcctccct

SEQ ID NO: 5824103 - DNA, 15 bp, Homo sapiens
aaggggcctgagcag

SEQ ID NO: 5824104 - DNA, 15 bp, Homo sapiens
aaggggcctgggctg

SEQ ID NO: 5824105 - DNA, 16 bp, Homo sapiens
aaggggcgagcaccca

SEQ ID NO: 5824106 - DNA, 20 bp, Homo sapiens
aaggggcgctcctcccagct

SEQ ID NO: 5824107 - DNA, 20 bp, Homo sapiens
aaggggcggtgcccacaccg

SEQ ID NO: 5824108 - DNA, 16 bp, Homo sapiens
aaggggctgaaagaac

SEQ ID NO: 5824109 - DNA, 21 bp, Homo sapiens
aaggggctgcgctagcagccc

SEQ ID NO: 5824110 - DNA, 12 bp, Homo sapiens
aaggggctgctg

SEQ ID NO: 5824111 - DNA, 22 bp, Homo sapiens
aaggggctgcttctggggctcc

SEQ ID NO: 5824112 - DNA, 14 bp, Homo sapiens
aaggggctggctgg

SEQ ID NO: 5824113 - DNA, 13 bp, Homo sapiens
aaggggcttcagg

SEQ ID NO: 5824114 - DNA, 22 bp, Homo sapiens
aaggggcttcaggtccaggctg

SEQ ID NO: 5824115 - DNA, 17 bp, Homo sapiens
aaggggcttctaatgac

SEQ ID NO: 5824116 - DNA, 23 bp, Homo sapiens
aaggggcttggaaccagtccgcc

SEQ ID NO: 5824117 - DNA, 21 bp, Homo sapiens
aagggggacgtttctggaact

SEQ ID NO: 5824118 - DNA, 11 bp, Homo sapiens
aagggggagga

SEQ ID NO: 5824119 - DNA, 18 bp, Homo sapiens
aagggggaggggaagtcc

SEQ ID NO: 5824120 - DNA, 15 bp, Homo sapiens
aagggggatgcaggc

SEQ ID NO: 5824121 - DNA, 12 bp, Homo sapiens
aagggggcaggc

SEQ ID NO: 5824122 - DNA, 13 bp, Homo sapiens
aagggggcaggcc

SEQ ID NO: 5824123 - DNA, 14 bp, Homo sapiens
aagggggccctgct

SEQ ID NO: 5824124 - DNA, 22 bp, Homo sapiens
aagggggcggcctatgacttgg

SEQ ID NO: 5824125 - DNA, 22 bp, Homo sapiens
aagggggctattccctggagac

SEQ ID NO: 5824126 - DNA, 19 bp, Homo sapiens
aagggggctctgccccagg

SEQ ID NO: 5824127 - DNA, 22 bp, Homo sapiens
aagggggctctgccccaggccc

SEQ ID NO: 5824128 - DNA, 16 bp, Homo sapiens
aaggggggagggggag

SEQ ID NO: 5824129 - DNA, 22 bp, Homo sapiens
aaggggggggcaatctctctct

SEQ ID NO: 5824130 - DNA, 15 bp, Homo sapiens
aagggggtagaagta

SEQ ID NO: 5824131 - DNA, 15 bp, Homo sapiens
aagggggtagggaaa

SEQ ID NO: 5824132 - DNA, 16 bp, Homo sapiens
aagggggtgactggaa

SEQ ID NO: 5824133 - DNA, 11 bp, Homo sapiens
aagggggtggg

SEQ ID NO: 5824134 - DNA, 21 bp, Homo sapiens
aaggggtaggattactaggtg

SEQ ID NO: 5824135 - DNA, 17 bp, Homo sapiens
aaggggtcaaaatttgc

SEQ ID NO: 5824136 - DNA, 18 bp, Homo sapiens
aaggggtcccatcagtga

SEQ ID NO: 5824137 - DNA, 20 bp, Homo sapiens
aaggggtcggctaagtggga

SEQ ID NO: 5824138 - DNA, 17 bp, Homo sapiens
aaggggtctgctcctgt

SEQ ID NO: 5824139 - DNA, 18 bp, Homo sapiens
aaggggtctgctcctgtg

SEQ ID NO: 5824140 - DNA, 18 bp, Homo sapiens
aaggggtgattgaaagaa

SEQ ID NO: 5824141 - DNA, 19 bp, Homo sapiens
aaggggtgattgaaagaaa

SEQ ID NO: 5824142 - DNA, 13 bp, Homo sapiens
aaggggtgccctc

SEQ ID NO: 5824143 - DNA, 18 bp, Homo sapiens
aaggggtgccctctggat

SEQ ID NO: 5824144 - DNA, 17 bp, Homo sapiens
aaggggtgctgtgaggc

SEQ ID NO: 5824145 - DNA, 20 bp, Homo sapiens
aaggggtgggtcagaacatg

SEQ ID NO: 5824146 - DNA, 13 bp, Homo sapiens
aaggggtgtgcat

SEQ ID NO: 5824147 - DNA, 20 bp, Homo sapiens
aaggggttcccactggctcc

SEQ ID NO: 5824148 - DNA, 19 bp, Homo sapiens
aaggggttggggtgacagt

SEQ ID NO: 5824149 - DNA, 12 bp, Homo sapiens
aaggggttttct

SEQ ID NO: 5824150 - DNA, 13 bp, Homo sapiens
aagggtaaaaaag

SEQ ID NO: 5824151 - DNA, 17 bp, Homo sapiens
aagggtaaaaaagataa

SEQ ID NO: 5824152 - DNA, 18 bp, Homo sapiens
aagggtaacttgttttta

SEQ ID NO: 5824153 - DNA, 21 bp, Homo sapiens
aagggtacagatccccagccc

SEQ ID NO: 5824154 - DNA, 17 bp, Homo sapiens
aagggtagaaacctgcc

SEQ ID NO: 5824155 - DNA, 23 bp, Homo sapiens
aagggtagccccctcatctgcag

SEQ ID NO: 5824156 - DNA, 22 bp, Homo sapiens
aagggtaggatgttgcttctga

SEQ ID NO: 5824157 - DNA, 17 bp, Homo sapiens
aagggtatcctgtgcta

SEQ ID NO: 5824158 - DNA, 17 bp, Homo sapiens
aagggtatgagctggag

SEQ ID NO: 5824159 - DNA, 22 bp, Homo sapiens
aagggtatgtcacaaagagctg

SEQ ID NO: 5824160 - DNA, 16 bp, Homo sapiens
aagggtcaaacctgta

SEQ ID NO: 5824161 - DNA, 12 bp, Homo sapiens
aagggtcaggcc

SEQ ID NO: 5824162 - DNA, 14 bp, Homo sapiens
aagggtcaggcctt

SEQ ID NO: 5824163 - DNA, 16 bp, Homo sapiens
aagggtcaggcctttg

SEQ ID NO: 5824164 - DNA, 19 bp, Homo sapiens
aagggtccggcttggctag

SEQ ID NO: 5824165 - DNA, 21 bp, Homo sapiens
aagggtcctacggagggacca

SEQ ID NO: 5824166 - DNA, 19 bp, Homo sapiens
aagggtccttccctctccc

SEQ ID NO: 5824167 - DNA, 18 bp, Homo sapiens
aagggtctagggagagac

SEQ ID NO: 5824168 - DNA, 22 bp, Homo sapiens
aagggtctctctccaggtcagc

SEQ ID NO: 5824169 - DNA, 20 bp, Homo sapiens
aagggtctgttgtaaatgac

SEQ ID NO: 5824170 - DNA, 14 bp, Homo sapiens
aagggtcttcttgg

SEQ ID NO: 5824171 - DNA, 16 bp, Homo sapiens
aagggtgacatcccag

SEQ ID NO: 5824172 - DNA, 18 bp, Homo sapiens
aagggtgagactccatct

SEQ ID NO: 5824173 - DNA, 19 bp, Homo sapiens
aagggtgatgtacacatgt

SEQ ID NO: 5824174 - DNA, 12 bp, Homo sapiens
aagggtgcctgg

SEQ ID NO: 5824175 - DNA, 18 bp, Homo sapiens
aagggtgcctggctgggc

SEQ ID NO: 5824176 - DNA, 20 bp, Homo sapiens
aagggtgctgcttccctctg

SEQ ID NO: 5824177 - DNA, 12 bp, Homo sapiens
aagggtggaaat

SEQ ID NO: 5824178 - DNA, 13 bp, Homo sapiens
aagggtggagagt

SEQ ID NO: 5824179 - DNA, 17 bp, Homo sapiens
aagggtggagagttggg

SEQ ID NO: 5824180 - DNA, 21 bp, Homo sapiens
aagggtggatgacagggcaga

SEQ ID NO: 5824181 - DNA, 20 bp, Homo sapiens
aagggtggcctgttccctag

SEQ ID NO: 5824182 - DNA, 17 bp, Homo sapiens
aagggtgggccctggag

SEQ ID NO: 5824183 - DNA, 23 bp, Homo sapiens
aagggtggggttttatgtgtggg

SEQ ID NO: 5824184 - DNA, 18 bp, Homo sapiens
aagggtgggtgctcagaa

SEQ ID NO: 5824185 - DNA, 19 bp, Homo sapiens
aagggtgggtgctcagaat

SEQ ID NO: 5824186 - DNA, 15 bp, Homo sapiens
aagggtgtatagtgt

SEQ ID NO: 5824187 - DNA, 14 bp, Homo sapiens
aagggtgtggcttg

SEQ ID NO: 5824188 - DNA, 22 bp, Homo sapiens
aagggtgtgggtcagggagggg

SEQ ID NO: 5824189 - DNA, 14 bp, Homo sapiens
aagggttaagaaaa

SEQ ID NO: 5824190 - DNA, 15 bp, Homo sapiens
aagggttaaggcctg

SEQ ID NO: 5824191 - DNA, 21 bp, Homo sapiens
aagggttaatcatatttgaaa

SEQ ID NO: 5824192 - DNA, 23 bp, Homo sapiens
aagggttacttgctgctcacact

SEQ ID NO: 5824193 - DNA, 18 bp, Homo sapiens
aagggttagacaagcctg

SEQ ID NO: 5824194 - DNA, 20 bp, Homo sapiens
aagggttagacaagcctgga

SEQ ID NO: 5824195 - DNA, 23 bp, Homo sapiens
aagggttagacaagcctggagga

SEQ ID NO: 5824196 - DNA, 21 bp, Homo sapiens
aagggttctgccctgcctgag

SEQ ID NO: 5824197 - DNA, 16 bp, Homo sapiens
aagggttctgtaaaat

SEQ ID NO: 5824198 - DNA, 17 bp, Homo sapiens
aagggttgaaggcagtc

SEQ ID NO: 5824199 - DNA, 18 bp, Homo sapiens
aagggttgagagccagtg

SEQ ID NO: 5824200 - DNA, 22 bp, Homo sapiens
aagggttgagagccagtggcgg

SEQ ID NO: 5824201 - DNA, 18 bp, Homo sapiens
aagggttggtgggctggc

SEQ ID NO: 5824202 - DNA, 20 bp, Homo sapiens
aagggttggtgggctggccc

SEQ ID NO: 5824203 - DNA, 20 bp, Homo sapiens
aagggtttgtaatactttac

SEQ ID NO: 5824204 - DNA, 16 bp, Homo sapiens
aagggttttaatgtag

SEQ ID NO: 5824205 - DNA, 19 bp, Homo sapiens
aagggttttccaccctgga

SEQ ID NO: 5824206 - DNA, 21 bp, Homo sapiens
aagggttttccaccctggaat

SEQ ID NO: 5824207 - DNA, 16 bp, Homo sapiens
aagggttttcttttct

SEQ ID NO: 5824208 - DNA, 17 bp, Homo sapiens
aagggttttcttttctt

SEQ ID NO: 5824209 - DNA, 22 bp, Homo sapiens
aaggtaaaatcacttcagatct

SEQ ID NO: 5824210 - DNA, 14 bp, Homo sapiens
aaggtaaaatgcca

SEQ ID NO: 5824211 - DNA, 12 bp, Homo sapiens
aaggtaaaattg

SEQ ID NO: 5824212 - DNA, 16 bp, Homo sapiens
aaggtaaaattgaaag

SEQ ID NO: 5824213 - DNA, 19 bp, Homo sapiens
aaggtaaataaaaagaaag

SEQ ID NO: 5824214 - DNA, 19 bp, Homo sapiens
aaggtaacatttatagaag

SEQ ID NO: 5824215 - DNA, 20 bp, Homo sapiens
aaggtaacttctcccttctc

SEQ ID NO: 5824216 - DNA, 18 bp, Homo sapiens
aaggtaagctcaggatat

SEQ ID NO: 5824217 - DNA, 14 bp, Homo sapiens
aaggtaataaatac

SEQ ID NO: 5824218 - DNA, 21 bp, Homo sapiens
aaggtaataacattttataca

SEQ ID NO: 5824219 - DNA, 14 bp, Homo sapiens
aaggtaatactata

SEQ ID NO: 5824220 - DNA, 21 bp, Homo sapiens
aaggtaataggaagaacagta

SEQ ID NO: 5824221 - DNA, 13 bp, Homo sapiens
aaggtaattgttt

SEQ ID NO: 5824222 - DNA, 19 bp, Homo sapiens
aaggtaatttctgtgtatt

SEQ ID NO: 5824223 - DNA, 21 bp, Homo sapiens
aaggtaatttttttttgtaaa

SEQ ID NO: 5824224 - DNA, 18 bp, Homo sapiens
aaggtacaagaagcattt

SEQ ID NO: 5824225 - DNA, 13 bp, Homo sapiens
aaggtacatcatt

SEQ ID NO: 5824226 - DNA, 15 bp, Homo sapiens
aaggtacatcattat

SEQ ID NO: 5824227 - DNA, 19 bp, Homo sapiens
aaggtaccaagatcacaaa

SEQ ID NO: 5824228 - DNA, 20 bp, Homo sapiens
aaggtaccaagatcacaaat

SEQ ID NO: 5824229 - DNA, 19 bp, Homo sapiens
aaggtaccgatttctgcta

SEQ ID NO: 5824230 - DNA, 22 bp, Homo sapiens
aaggtacggtgagactctgagg

SEQ ID NO: 5824231 - DNA, 17 bp, Homo sapiens
aaggtactgaagcttta

SEQ ID NO: 5824232 - DNA, 15 bp, Homo sapiens
aaggtactggtgagg

SEQ ID NO: 5824233 - DNA, 17 bp, Homo sapiens
aaggtactgtatgatca

SEQ ID NO: 5824234 - DNA, 11 bp, Homo sapiens
aaggtactgtg

SEQ ID NO: 5824235 - DNA, 19 bp, Homo sapiens
aaggtactgtggggtggac

SEQ ID NO: 5824236 - DNA, 13 bp, Homo sapiens
aagtaatgaagaa

SEQ ID NO: 5824237 - DNA, 16 bp, Homo sapiens
aagtaatgaagaatca

SEQ ID NO: 5824238 - DNA, 17 bp, Homo sapiens
aagtaatgacagaacat

SEQ ID NO: 5824239 - DNA, 18 bp, Homo sapiens
aagtaatgacagaacatg

SEQ ID NO: 5824240 - DNA, 17 bp, Homo sapiens
aagtaatgacttagaaa

SEQ ID NO: 5824241 - DNA, 14 bp, Homo sapiens
aagtaatgataact

SEQ ID NO: 5824242 - DNA, 15 bp, Homo sapiens
aagtaatgatactgt

SEQ ID NO: 5824243 - DNA, 14 bp, Homo sapiens
aagtaatgcatttg

SEQ ID NO: 5824244 - DNA, 15 bp, Homo sapiens
aagtaatgtattagt

SEQ ID NO: 5824245 - DNA, 15 bp, Homo sapiens
aagtaattaattgct

SEQ ID NO: 5824246 - DNA, 11 bp, Homo sapiens
aagtaattatc

SEQ ID NO: 5824247 - DNA, 15 bp, Homo sapiens
aagtaattatcggga

SEQ ID NO: 5824248 - DNA, 23 bp, Homo sapiens
aagtaattatcgggaacagtgtt

SEQ ID NO: 5824249 - DNA, 22 bp, Homo sapiens
aagtaattctgctgtctcagcc

SEQ ID NO: 5824250 - DNA, 22 bp, Homo sapiens
aagtaattgacagggaaaatat

SEQ ID NO: 5824251 - DNA, 12 bp, Homo sapiens
aagtaattgcca

SEQ ID NO: 5824252 - DNA, 13 bp, Homo sapiens
aagtaatttcaag

SEQ ID NO: 5824253 - DNA, 19 bp, Homo sapiens
aagtaatttccccactctg

SEQ ID NO: 5824254 - DNA, 22 bp, Homo sapiens
aagtaatttcttctcaaagggt

SEQ ID NO: 5824255 - DNA, 15 bp, Homo sapiens
aagtaattttcttct

SEQ ID NO: 5824256 - DNA, 20 bp, Homo sapiens
aagtaattttgcacagacat

SEQ ID NO: 5824257 - DNA, 14 bp, Homo sapiens
aagtaattttgtca

SEQ ID NO: 5824258 - DNA, 13 bp, Homo sapiens
aagtacaaaattg

SEQ ID NO: 5824259 - DNA, 13 bp, Homo sapiens
aagtacaaacatg

SEQ ID NO: 5824260 - DNA, 16 bp, Homo sapiens
aagtacaaacatgaaa

SEQ ID NO: 5824261 - DNA, 17 bp, Homo sapiens
aagtacaaacatgaaaa

SEQ ID NO: 5824262 - DNA, 21 bp, Homo sapiens
aagtacaataattcatattct

SEQ ID NO: 5824263 - DNA, 12 bp, Homo sapiens
aagtacaatgaa

SEQ ID NO: 5824264 - DNA, 18 bp, Homo sapiens
aagtacaatgaactgctt

SEQ ID NO: 5824265 - DNA, 16 bp, Homo sapiens
aagtacaattcattgt

SEQ ID NO: 5824266 - DNA, 19 bp, Homo sapiens
aagtacacaataagcaaaa

SEQ ID NO: 5824267 - DNA, 23 bp, Homo sapiens
aagtacactgaatttttatgtgt

SEQ ID NO: 5824268 - DNA, 23 bp, Homo sapiens
aagtacactgtttcaaactttac

SEQ ID NO: 5824269 - DNA, 16 bp, Homo sapiens
aagtacagaatttgaa

SEQ ID NO: 5824270 - DNA, 12 bp, Homo sapiens
aagtacagagaa

SEQ ID NO: 5824271 - DNA, 14 bp, Homo sapiens
aagtacagccttca

SEQ ID NO: 5824272 - DNA, 19 bp, Homo sapiens
aagtacagcggctcccctc

SEQ ID NO: 5824273 - DNA, 23 bp, Homo sapiens
aagtacagctgacggtttctccc

SEQ ID NO: 5824274 - DNA, 12 bp, Homo sapiens
aagtacaggcag

SEQ ID NO: 5824275 - DNA, 18 bp, Homo sapiens
aagtacaggtactttgtc

SEQ ID NO: 5824276 - DNA, 20 bp, Homo sapiens
aagtacaggtcatctgctgg

SEQ ID NO: 5824277 - DNA, 13 bp, Homo sapiens
aagtacatagtga

SEQ ID NO: 5824278 - DNA, 15 bp, Homo sapiens
aagtacatagtgaat

SEQ ID NO: 5824279 - DNA, 21 bp, Homo sapiens
aagtacatagtgaattttaaa

SEQ ID NO: 5824280 - DNA, 14 bp, Homo sapiens
aagtacattgctta

SEQ ID NO: 5824281 - DNA, 13 bp, Homo sapiens
aagtacatttaat

SEQ ID NO: 5824282 - DNA, 17 bp, Homo sapiens
aagtacattttttgaaa

SEQ ID NO: 5824283 - DNA, 19 bp, Homo sapiens
aagtaccaactgagccaaa

SEQ ID NO: 5824284 - DNA, 18 bp, Homo sapiens
aagtaccaatgctgttgt

SEQ ID NO: 5824285 - DNA, 24 bp, Homo sapiens
aagtaccaatgctgttgtaaacaa

SEQ ID NO: 5824286 - DNA, 17 bp, Homo sapiens
aagtaccaatgggaagc

SEQ ID NO: 5824287 - DNA, 19 bp, Homo sapiens
aagtaccacattccatgac

SEQ ID NO: 5824288 - DNA, 19 bp, Homo sapiens
aagtaccagcatgttaact

SEQ ID NO: 5824289 - DNA, 21 bp, Homo sapiens
aagtaccctcttttaccaact

SEQ ID NO: 5824290 - DNA, 19 bp, Homo sapiens
aagtacctattgaacatgt

SEQ ID NO: 5824291 - DNA, 20 bp, Homo sapiens
aagtacctttcctacatttt

SEQ ID NO: 5824292 - DNA, 21 bp, Homo sapiens
aagtacctttcctacattttc

SEQ ID NO: 5824293 - DNA, 23 bp, Homo sapiens
aagtacggctggctacaactgct

SEQ ID NO: 5824294 - DNA, 22 bp, Homo sapiens
aagtactaaaactagataactt

SEQ ID NO: 5824295 - DNA, 17 bp, Homo sapiens
aagtactataatttacc

SEQ ID NO: 5824296 - DNA, 18 bp, Homo sapiens
aagtactatctttgtcta

SEQ ID NO: 5824297 - DNA, 13 bp, Homo sapiens
aagtactatgtat

SEQ ID NO: 5824298 - DNA, 19 bp, Homo sapiens
aagtactcctcacttttca

SEQ ID NO: 5824299 - DNA, 23 bp, Homo sapiens
aagtactcctcacttttcaattt

SEQ ID NO: 5824300 - DNA, 14 bp, Homo sapiens
aagtactctggagc

SEQ ID NO: 5824301 - DNA, 15 bp, Homo sapiens
aagtactgagcagta

SEQ ID NO: 5824302 - DNA, 17 bp, Homo sapiens
aagtactgtaagaataa

SEQ ID NO: 5824303 - DNA, 21 bp, Homo sapiens
aagtactgtaataatacctca

SEQ ID NO: 5824304 - DNA, 22 bp, Homo sapiens
aagtactgtaataatacctcaa

SEQ ID NO: 5824305 - DNA, 14 bp, Homo sapiens
aagtactgtttacc

SEQ ID NO: 5824306 - DNA, 13 bp, Homo sapiens
aagtacttaaact

SEQ ID NO: 5824307 - DNA, 22 bp, Homo sapiens
aagtacttctccaccctgctct

SEQ ID NO: 5824308 - DNA, 11 bp, Homo sapiens
aagtacttctt

SEQ ID NO: 5824309 - DNA, 17 bp, Homo sapiens
aagtacttgctctctga

SEQ ID NO: 5824310 - DNA, 22 bp, Homo sapiens
aagtacttggcccccttcagga

SEQ ID NO: 5824311 - DNA, 22 bp, Homo sapiens
aagtacttgtcatagactcctt

SEQ ID NO: 5824312 - DNA, 17 bp, Homo sapiens
aagtactttaaaaagga

SEQ ID NO: 5824313 - DNA, 19 bp, Homo sapiens
aagtactttaaaaaggaaa

SEQ ID NO: 5824314 - DNA, 20 bp, Homo sapiens
aagtactttaaaaaggaaat

SEQ ID NO: 5824315 - DNA, 15 bp, Homo sapiens
aagtacttttggcat

SEQ ID NO: 5824316 - DNA, 9 bp, Homo sapiens
aagtagaaa

SEQ ID NO: 5824317 - DNA, 21 bp, Homo sapiens
aagtagaaaaaaaaataacac

SEQ ID NO: 5824318 - DNA, 19 bp, Homo sapiens
aagtagaaaaattgtttcc

SEQ ID NO: 5824319 - DNA, 18 bp, Homo sapiens
aagtagaaaagttgcaga

SEQ ID NO: 5824320 - DNA, 23 bp, Homo sapiens
aagtagaaaagttgcagatgtat

SEQ ID NO: 5824321 - DNA, 23 bp, Homo sapiens
aagtagaactcttaaatactttt

SEQ ID NO: 5824322 - DNA, 17 bp, Homo sapiens
aagtagaactttgtata

SEQ ID NO: 5824323 - DNA, 18 bp, Homo sapiens
aagtagaactttgtatag

SEQ ID NO: 5824324 - DNA, 20 bp, Homo sapiens
aagtagaagtcttagatgta

SEQ ID NO: 5824325 - DNA, 21 bp, Homo sapiens
aagtagaagtcttagatgtat

SEQ ID NO: 5824326 - DNA, 15 bp, Homo sapiens
aagtagaatctcttt

SEQ ID NO: 5824327 - DNA, 19 bp, Homo sapiens
aagtagaatctcttttctg

SEQ ID NO: 5824328 - DNA, 19 bp, Homo sapiens
aagtagaattatatctaat

SEQ ID NO: 5824329 - DNA, 21 bp, Homo sapiens
aagtagaattatatctaattt

SEQ ID NO: 5824330 - DNA, 23 bp, Homo sapiens
aagtagaattatatctaatttat

SEQ ID NO: 5824331 - DNA, 22 bp, Homo sapiens
aagtagaattcttaccatctta

SEQ ID NO: 5824332 - DNA, 15 bp, Homo sapiens
aagtagacaatcaca

SEQ ID NO: 5824333 - DNA, 18 bp, Homo sapiens
aagtagacaatcattgtt

SEQ ID NO: 5824334 - DNA, 19 bp, Homo sapiens
aagtagacaatcattgttt

SEQ ID NO: 5824335 - DNA, 21 bp, Homo sapiens
aagtagacaatcattgttttg

SEQ ID NO: 5824336 - DNA, 17 bp, Homo sapiens
aagtagaggtggcttca

SEQ ID NO: 5824337 - DNA, 20 bp, Homo sapiens
aagtagagtatattgaaaag

SEQ ID NO: 5824338 - DNA, 19 bp, Homo sapiens
aagtagatcatggcagcat

SEQ ID NO: 5824339 - DNA, 14 bp, Homo sapiens
aagtagatctgctt

SEQ ID NO: 5824340 - DNA, 22 bp, Homo sapiens
aagtagatctgctttctgttca

SEQ ID NO: 5824341 - DNA, 16 bp, Homo sapiens
aagtagatgaaacatt

SEQ ID NO: 5824342 - DNA, 22 bp, Homo sapiens
aagtagattaaaatatttgcct

SEQ ID NO: 5824343 - DNA, 20 bp, Homo sapiens
aagtagattatggccttttt

SEQ ID NO: 5824344 - DNA, 22 bp, Homo sapiens
aagtagattgatctaaggcatg

SEQ ID NO: 5824345 - DNA, 21 bp, Homo sapiens
aagtagcaaatgagacagcag

SEQ ID NO: 5824346 - DNA, 14 bp, Homo sapiens
aagtagcaaatgtt

SEQ ID NO: 5824347 - DNA, 18 bp, Homo sapiens
aagtagcaaatgtttact

SEQ ID NO: 5824348 - DNA, 18 bp, Homo sapiens
aagtagcaaccctgtgat

SEQ ID NO: 5824349 - DNA, 20 bp, Homo sapiens
aagtagcaaccttcatttta

SEQ ID NO: 5824350 - DNA, 17 bp, Homo sapiens
aagtagcaactgctggt

SEQ ID NO: 5824351 - DNA, 14 bp, Homo sapiens
aagtagcacaggct

SEQ ID NO: 5824352 - DNA, 18 bp, Homo sapiens
aagtagcacatggtttaa

SEQ ID NO: 5824353 - DNA, 17 bp, Homo sapiens
aagtagcaccaaataaa

SEQ ID NO: 5824354 - DNA, 22 bp, Homo sapiens
aagtagcagggggggaaatgca

SEQ ID NO: 5824355 - DNA, 14 bp, Homo sapiens
aagtagcattcatg

SEQ ID NO: 5824356 - DNA, 22 bp, Homo sapiens
aagtagccgctctggttgaagc

SEQ ID NO: 5824357 - DNA, 21 bp, Homo sapiens
aagtagctagtagcaatgtgc

SEQ ID NO: 5824358 - DNA, 12 bp, Homo sapiens
aagtagctgaga

SEQ ID NO: 5824359 - DNA, 12 bp, Homo sapiens
aagtagctgcta

SEQ ID NO: 5824360 - DNA, 17 bp, Homo sapiens
aagtagctgctaccttc

SEQ ID NO: 5824361 - DNA, 15 bp, Homo sapiens
aagtagctgggatta

SEQ ID NO: 5824362 - DNA, 18 bp, Homo sapiens
aagtagctgggattacag

SEQ ID NO: 5824363 - DNA, 15 bp, Homo sapiens
aagtaggaaaaataa

SEQ ID NO: 5824364 - DNA, 19 bp, Homo sapiens
aagtaggaaggaaaaaata

SEQ ID NO: 5824365 - DNA, 18 bp, Homo sapiens
aagtaggaggaaacagtt

SEQ ID NO: 5824366 - DNA, 14 bp, Homo sapiens
aagtaggagtggct

SEQ ID NO: 5824367 - DNA, 14 bp, Homo sapiens
aagtaggcaggacc

SEQ ID NO: 5824368 - DNA, 15 bp, Homo sapiens
aagtaggcaggacca

SEQ ID NO: 5824369 - DNA, 16 bp, Homo sapiens
aagtaggcatatatca

SEQ ID NO: 5824370 - DNA, 23 bp, Homo sapiens
aagtaggccgctgatgatatatt

SEQ ID NO: 5824371 - DNA, 13 bp, Homo sapiens
aagtaggctgccg

SEQ ID NO: 5824372 - DNA, 21 bp, Homo sapiens
aagtaggctgccgccaccacg

SEQ ID NO: 5824373 - DNA, 18 bp, Homo sapiens
aagtaggggcagtgatgg

SEQ ID NO: 5824374 - DNA, 19 bp, Homo sapiens
aagtaggggttgtgggtga

SEQ ID NO: 5824375 - DNA, 19 bp, Homo sapiens
aagtaggtggcttgagcta

SEQ ID NO: 5824376 - DNA, 18 bp, Homo sapiens
aagtagtaaaaattaaaa

SEQ ID NO: 5824377 - DNA, 15 bp, Homo sapiens
aagtagtaaattttg

SEQ ID NO: 5824378 - DNA, 19 bp, Homo sapiens
aagtagtacttcttctgta

SEQ ID NO: 5824379 - DNA, 20 bp, Homo sapiens
aagtagtacttcttctgtaa

SEQ ID NO: 5824380 - DNA, 14 bp, Homo sapiens
aagtagtagtgtct

SEQ ID NO: 5824381 - DNA, 15 bp, Homo sapiens
aagtagtctgctcac

SEQ ID NO: 5824382 - DNA, 20 bp, Homo sapiens
aagtagtgagttaaagctac

SEQ ID NO: 5824383 - DNA, 14 bp, Homo sapiens
aagtagtgatgaaa

SEQ ID NO: 5824384 - DNA, 21 bp, Homo sapiens
aagtagtgcttattgtttgca

SEQ ID NO: 5824385 - DNA, 14 bp, Homo sapiens
aagtagtgtcattc

SEQ ID NO: 5824386 - DNA, 23 bp, Homo sapiens
aagtagtgtctggatcagtaaaa

SEQ ID NO: 5824387 - DNA, 17 bp, Homo sapiens
aagtagtgtgagtgtta

SEQ ID NO: 5824388 - DNA, 15 bp, Homo sapiens
aagtagtgtgcagtt

SEQ ID NO: 5824389 - DNA, 14 bp, Homo sapiens
aagtagttctgtat

SEQ ID NO: 5824390 - DNA, 23 bp, Homo sapiens
aagtagttctgtttggtgtgtcc

SEQ ID NO: 5824391 - DNA, 22 bp, Homo sapiens
aagtagtttctccaagtacttt

SEQ ID NO: 5824392 - DNA, 20 bp, Homo sapiens
aagtagtttgtataacttct

SEQ ID NO: 5824393 - DNA, 15 bp, Homo sapiens
aagtagttttatttt

SEQ ID NO: 5824394 - DNA, 22 bp, Homo sapiens
aagtataaaatagtatgaaaat

SEQ ID NO: 5824395 - DNA, 15 bp, Homo sapiens
aagtataaactttta

SEQ ID NO: 5824396 - DNA, 13 bp, Homo sapiens
aagtataaagtca

SEQ ID NO: 5824397 - DNA, 23 bp, Homo sapiens
aagtataaagtcacttccagtgt

SEQ ID NO: 5824398 - DNA, 15 bp, Homo sapiens
aagtataaatttgtg

SEQ ID NO: 5824399 - DNA, 16 bp, Homo sapiens
aagtataaatttgtgt

SEQ ID NO: 5824400 - DNA, 12 bp, Homo sapiens
aagtataacaaa

SEQ ID NO: 5824401 - DNA, 20 bp, Homo sapiens
aagtataacaattaaaatct

SEQ ID NO: 5824402 - DNA, 18 bp, Homo sapiens
aagtataatctttctata

SEQ ID NO: 5824403 - DNA, 16 bp, Homo sapiens
aagtataatttcagtg

SEQ ID NO: 5824404 - DNA, 21 bp, Homo sapiens
aagtatacagttcaataaact

SEQ ID NO: 5824405 - DNA, 15 bp, Homo sapiens
aagtatacttatatt

SEQ ID NO: 5824406 - DNA, 16 bp, Homo sapiens
aagtatagaaaatctt

SEQ ID NO: 5824407 - DNA, 13 bp, Homo sapiens
aagtatagaaata

SEQ ID NO: 5824408 - DNA, 20 bp, Homo sapiens
aagtatagatacaaaacctt

SEQ ID NO: 5824409 - DNA, 23 bp, Homo sapiens
aagtataggataaattacattaa

SEQ ID NO: 5824410 - DNA, 14 bp, Homo sapiens
aagtatataaagtt

SEQ ID NO: 5824411 - DNA, 14 bp, Homo sapiens
aagtatataaatac

SEQ ID NO: 5824412 - DNA, 23 bp, Homo sapiens
aagtatataaatactatagttat

SEQ ID NO: 5824413 - DNA, 13 bp, Homo sapiens
aagtctcttcctg

SEQ ID NO: 5824414 - DNA, 12 bp, Homo sapiens
aagtctgaatca

SEQ ID NO: 5824415 - DNA, 15 bp, Homo sapiens
aagtctgagaaattt

SEQ ID NO: 5824416 - DNA, 15 bp, Homo sapiens
aagtctgagcccatt

SEQ ID NO: 5824417 - DNA, 19 bp, Homo sapiens
aagtctgagcccatttctg

SEQ ID NO: 5824418 - DNA, 21 bp, Homo sapiens
aagtctgagcccatttctggg

SEQ ID NO: 5824419 - DNA, 22 bp, Homo sapiens
aagtctgatgttctttccatga

SEQ ID NO: 5824420 - DNA, 16 bp, Homo sapiens
aagtctgatttttaag

SEQ ID NO: 5824421 - DNA, 18 bp, Homo sapiens
aagtctgatttttaagat

SEQ ID NO: 5824422 - DNA, 21 bp, Homo sapiens
aagtctgcaactttaagcagc

SEQ ID NO: 5824423 - DNA, 22 bp, Homo sapiens
aagtctgcctatcctggccagg

SEQ ID NO: 5824424 - DNA, 22 bp, Homo sapiens
aagtctgctctcatataagaca

SEQ ID NO: 5824425 - DNA, 20 bp, Homo sapiens
aagtctgggatgtagaactt

SEQ ID NO: 5824426 - DNA, 12 bp, Homo sapiens
aagtctgggcca

SEQ ID NO: 5824427 - DNA, 14 bp, Homo sapiens
aagtctgtacctca

SEQ ID NO: 5824428 - DNA, 15 bp, Homo sapiens
aagtctgtacctcaa

SEQ ID NO: 5824429 - DNA, 18 bp, Homo sapiens
aagtctgtccttgaagga

SEQ ID NO: 5824430 - DNA, 21 bp, Homo sapiens
aagtctgtccttgaaggacta

SEQ ID NO: 5824431 - DNA, 15 bp, Homo sapiens
aagtctgtctttcct

SEQ ID NO: 5824432 - DNA, 23 bp, Homo sapiens
aagtctgtgagtgcgtctgaggg

SEQ ID NO: 5824433 - DNA, 19 bp, Homo sapiens
aagtctgtggcccaagaga

SEQ ID NO: 5824434 - DNA, 14 bp, Homo sapiens
aagtctgtgtccaa

SEQ ID NO: 5824435 - DNA, 20 bp, Homo sapiens
aagtctgttattgttttgtt

SEQ ID NO: 5824436 - DNA, 21 bp, Homo sapiens
aagtctgttattgttttgtta

SEQ ID NO: 5824437 - DNA, 13 bp, Homo sapiens
aagtctgttctca

SEQ ID NO: 5824438 - DNA, 12 bp, Homo sapiens
aagtctgtttta

SEQ ID NO: 5824439 - DNA, 14 bp, Homo sapiens
aagtctgttttatg

SEQ ID NO: 5824440 - DNA, 18 bp, Homo sapiens
aagtctgttttatgactt

SEQ ID NO: 5824441 - DNA, 19 bp, Homo sapiens
aagtctgttttatgacttc

SEQ ID NO: 5824442 - DNA, 21 bp, Homo sapiens
aagtctgttttgggaaacact

SEQ ID NO: 5824443 - DNA, 16 bp, Homo sapiens
aagtcttagatgtata

SEQ ID NO: 5824444 - DNA, 17 bp, Homo sapiens
aagtcttatcaagcagc

SEQ ID NO: 5824445 - DNA, 17 bp, Homo sapiens
aagtcttcaaatttgat

SEQ ID NO: 5824446 - DNA, 20 bp, Homo sapiens
aagtcttcactctctgaaga

SEQ ID NO: 5824447 - DNA, 13 bp, Homo sapiens
aagtcttcatgaa

SEQ ID NO: 5824448 - DNA, 22 bp, Homo sapiens
aagtcttcatgaaatgctatgt

SEQ ID NO: 5824449 - DNA, 20 bp, Homo sapiens
aagtcttcatggtctcttcc

SEQ ID NO: 5824450 - DNA, 15 bp, Homo sapiens
aagtcttccctcaga

SEQ ID NO: 5824451 - DNA, 16 bp, Homo sapiens
aagtcttccctcagat

SEQ ID NO: 5824452 - DNA, 22 bp, Homo sapiens
aagtcttccctgatcaagtcac

SEQ ID NO: 5824453 - DNA, 22 bp, Homo sapiens
aagtcttcctaattgtgcccct

SEQ ID NO: 5824454 - DNA, 22 bp, Homo sapiens
aagtcttctcccaactcagcct

SEQ ID NO: 5824455 - DNA, 15 bp, Homo sapiens
aagtcttctttcatg

SEQ ID NO: 5824456 - DNA, 18 bp, Homo sapiens
aagtcttctttcatgtaa

SEQ ID NO: 5824457 - DNA, 16 bp, Homo sapiens
aagtcttgagcaatgt

SEQ ID NO: 5824458 - DNA, 17 bp, Homo sapiens
aagtcttgagcaatgtt

SEQ ID NO: 5824459 - DNA, 13 bp, Homo sapiens
aagtcttgctgtg

SEQ ID NO: 5824460 - DNA, 17 bp, Homo sapiens
aagtcttgctgtggtct

SEQ ID NO: 5824461 - DNA, 14 bp, Homo sapiens
aagtcttggtaaca

SEQ ID NO: 5824462 - DNA, 20 bp, Homo sapiens
aagtcttggttttatcttaa

SEQ ID NO: 5824463 - DNA, 11 bp, Homo sapiens
aagtcttgtat

SEQ ID NO: 5824464 - DNA, 21 bp, Homo sapiens
aagtcttgtgactagtgctga

SEQ ID NO: 5824465 - DNA, 14 bp, Homo sapiens
aagtctttaataaa

SEQ ID NO: 5824466 - DNA, 23 bp, Homo sapiens
aagtctttagtgttcaaatactt

SEQ ID NO: 5824467 - DNA, 13 bp, Homo sapiens
aagtctttcagat

SEQ ID NO: 5824468 - DNA, 16 bp, Homo sapiens
aagtctttctctttcc

SEQ ID NO: 5824469 - DNA, 20 bp, Homo sapiens
aagtctttctctttccctgg

SEQ ID NO: 5824470 - DNA, 11 bp, Homo sapiens
aagtctttgct

SEQ ID NO: 5824471 - DNA, 12 bp, Homo sapiens
aagtcttttaaa

SEQ ID NO: 5824472 - DNA, 16 bp, Homo sapiens
aagtcttttaaaaagt

SEQ ID NO: 5824473 - DNA, 17 bp, Homo sapiens
aagtcttttaaaaagta

SEQ ID NO: 5824474 - DNA, 15 bp, Homo sapiens
aagtcttttctgtca

SEQ ID NO: 5824475 - DNA, 22 bp, Homo sapiens
aagtctttttcattttgcagaa

SEQ ID NO: 5824476 - DNA, 16 bp, Homo sapiens
aagtcttttttgatca

SEQ ID NO: 5824477 - DNA, 22 bp, Homo sapiens
aagtgaaaaaaagaaacgaaaa

SEQ ID NO: 5824478 - DNA, 12 bp, Homo sapiens
aagtgaaaactt

SEQ ID NO: 5824479 - DNA, 14 bp, Homo sapiens
aagtgaaaatctta

SEQ ID NO: 5824480 - DNA, 14 bp, Homo sapiens
aagtgaaagacatt

SEQ ID NO: 5824481 - DNA, 18 bp, Homo sapiens
aagtgaaagacttgaatt

SEQ ID NO: 5824482 - DNA, 19 bp, Homo sapiens
aagtgaaagacttgaattt

SEQ ID NO: 5824483 - DNA, 17 bp, Homo sapiens
aagtgaaagtaactgtt

SEQ ID NO: 5824484 - DNA, 18 bp, Homo sapiens
aagtgaaataacaaaatg

SEQ ID NO: 5824485 - DNA, 19 bp, Homo sapiens
aagtgaaataacaaaatgg

SEQ ID NO: 5824486 - DNA, 14 bp, Homo sapiens
aagtgaaataatat

SEQ ID NO: 5824487 - DNA, 14 bp, Homo sapiens
aagtgaaataatgt

SEQ ID NO: 5824488 - DNA, 16 bp, Homo sapiens
aagtgaaatcaaaggt

SEQ ID NO: 5824489 - DNA, 12 bp, Homo sapiens
aagtgaaatctg

SEQ ID NO: 5824490 - DNA, 10 bp, Homo sapiens
aagtgaaatt

SEQ ID NO: 5824491 - DNA, 11 bp, Homo sapiens
aagtgaaatta

SEQ ID NO: 5824492 - DNA, 15 bp, Homo sapiens
aagtgaaatttattg

SEQ ID NO: 5824493 - DNA, 20 bp, Homo sapiens
aagtgaaatttattgaggaa

SEQ ID NO: 5824494 - DNA, 14 bp, Homo sapiens
aagtgaaattttaa

SEQ ID NO: 5824495 - DNA, 20 bp, Homo sapiens
aagtgaaattttaaaagtca

SEQ ID NO: 5824496 - DNA, 14 bp, Homo sapiens
aagtgaacaaagtg

SEQ ID NO: 5824497 - DNA, 18 bp, Homo sapiens
aagtgaacaaatttcaaa

SEQ ID NO: 5824498 - DNA, 19 bp, Homo sapiens
aagtgaacacattgtgtca

SEQ ID NO: 5824499 - DNA, 16 bp, Homo sapiens
aagtgaacactagcca

SEQ ID NO: 5824500 - DNA, 17 bp, Homo sapiens
aagtgaacccatatttt

SEQ ID NO: 5824501 - DNA, 14 bp, Homo sapiens
aagtgaactttgtt

SEQ ID NO: 5824502 - DNA, 19 bp, Homo sapiens
aagtgaacttttgtaattt

SEQ ID NO: 5824503 - DNA, 19 bp, Homo sapiens
aagtgaagacaatgactta

SEQ ID NO: 5824504 - DNA, 13 bp, Homo sapiens
aagtgaagagtca

SEQ ID NO: 5824505 - DNA, 22 bp, Homo sapiens
aagtgaagccccttgtcctctc

SEQ ID NO: 5824506 - DNA, 14 bp, Homo sapiens
aagtgaaggaaata

SEQ ID NO: 5824507 - DNA, 18 bp, Homo sapiens
aagtgaaggggaaacaca

SEQ ID NO: 5824508 - DNA, 14 bp, Homo sapiens
aagtgaagtgatac

SEQ ID NO: 5824509 - DNA, 14 bp, Homo sapiens
aagtgaataaaaat

SEQ ID NO: 5824510 - DNA, 12 bp, Homo sapiens
aagtgaataaac

SEQ ID NO: 5824511 - DNA, 16 bp, Homo sapiens
aagtgaatctaataaa

SEQ ID NO: 5824512 - DNA, 17 bp, Homo sapiens
aagtgaatctaataaaa

SEQ ID NO: 5824513 - DNA, 16 bp, Homo sapiens
aagtgaatgaaagatt

SEQ ID NO: 5824514 - DNA, 19 bp, Homo sapiens
aagtgaatgaaagattaaa

SEQ ID NO: 5824515 - DNA, 18 bp, Homo sapiens
aagtgaatgctcaagttt

SEQ ID NO: 5824516 - DNA, 14 bp, Homo sapiens
aagtgaattgaagt

SEQ ID NO: 5824517 - DNA, 16 bp, Homo sapiens
aagtgaatttgaatga

SEQ ID NO: 5824518 - DNA, 20 bp, Homo sapiens
aagtgaatttgcctgtaaca

SEQ ID NO: 5824519 - DNA, 14 bp, Homo sapiens
aagtgaatttttct

SEQ ID NO: 5824520 - DNA, 19 bp, Homo sapiens
aagtgacaaggccccagag

SEQ ID NO: 5824521 - DNA, 20 bp, Homo sapiens
aagtgacaaggccccagaga

SEQ ID NO: 5824522 - DNA, 14 bp, Homo sapiens
aagtgacacagaca

SEQ ID NO: 5824523 - DNA, 24 bp, Homo sapiens
aagtgacacagcagcttcaccaga

SEQ ID NO: 5824524 - DNA, 18 bp, Homo sapiens
aagtgacacattaatgat

SEQ ID NO: 5824525 - DNA, 20 bp, Homo sapiens
aagtgacaccaataaatgtt

SEQ ID NO: 5824526 - DNA, 22 bp, Homo sapiens
aagtgacagatcctccattttt

SEQ ID NO: 5824527 - DNA, 22 bp, Homo sapiens
aagtgacagatgttatttttgt

SEQ ID NO: 5824528 - DNA, 19 bp, Homo sapiens
aagtgacagggaagctaca

SEQ ID NO: 5824529 - DNA, 22 bp, Homo sapiens
aagtgacagtatcttttttcct

SEQ ID NO: 5824530 - DNA, 12 bp, Homo sapiens
aagtgacataat

SEQ ID NO: 5824531 - DNA, 22 bp, Homo sapiens
aagtgacattgcatcaaagcat

SEQ ID NO: 5824532 - DNA, 13 bp, Homo sapiens
aagtgaccaaatt

SEQ ID NO: 5824533 - DNA, 19 bp, Homo sapiens
aagtgaccaaattgggaga

SEQ ID NO: 5824534 - DNA, 20 bp, Homo sapiens
aagtgaccaaattgggagat

SEQ ID NO: 5824535 - DNA, 18 bp, Homo sapiens
aagtgaccacagaagcag

SEQ ID NO: 5824536 - DNA, 15 bp, Homo sapiens
aagtgaccccagctc

SEQ ID NO: 5824537 - DNA, 16 bp, Homo sapiens
aagtgaccccagctcc

SEQ ID NO: 5824538 - DNA, 20 bp, Homo sapiens
aagtgaccccagctccaggc

SEQ ID NO: 5824539 - DNA, 21 bp, Homo sapiens
aagtgaccccagctccaggca

SEQ ID NO: 5824540 - DNA, 21 bp, Homo sapiens
aagtgaccgacaaaattccag

SEQ ID NO: 5824541 - DNA, 20 bp, Homo sapiens
aagtgacctatacctgtgtt

SEQ ID NO: 5824542 - DNA, 20 bp, Homo sapiens
aagtgacctcactggcctgc

SEQ ID NO: 5824543 - DNA, 15 bp, Homo sapiens
aagtgacggttccta

SEQ ID NO: 5824544 - DNA, 22 bp, Homo sapiens
aagtgactaccacttatttcta

SEQ ID NO: 5824545 - DNA, 20 bp, Homo sapiens
aagtgactaccagaaagtga

SEQ ID NO: 5824546 - DNA, 17 bp, Homo sapiens
aagtgactatttgttct

SEQ ID NO: 5824547 - DNA, 16 bp, Homo sapiens
aagtgactgtatctgt

SEQ ID NO: 5824548 - DNA, 18 bp, Homo sapiens
aagtgactgtatctgtgt

SEQ ID NO: 5824549 - DNA, 19 bp, Homo sapiens
aagtgacttagcagatgct

SEQ ID NO: 5824550 - DNA, 21 bp, Homo sapiens
aagtgacttagcagatgctgg

SEQ ID NO: 5824551 - DNA, 18 bp, Homo sapiens
aagtgacttctggagaaa

SEQ ID NO: 5824552 - DNA, 16 bp, Homo sapiens
aagtgacttgaatgta

SEQ ID NO: 5824553 - DNA, 22 bp, Homo sapiens
aagtgacttgaatgtacaaaga

SEQ ID NO: 5824554 - DNA, 15 bp, Homo sapiens
aagtgactttaaact

SEQ ID NO: 5824555 - DNA, 14 bp, Homo sapiens
aagtgagaaagaca

SEQ ID NO: 5824556 - DNA, 14 bp, Homo sapiens
aagtgagaactcca

SEQ ID NO: 5824557 - DNA, 20 bp, Homo sapiens
aagtgagacagtccagcctg

SEQ ID NO: 5824558 - DNA, 16 bp, Homo sapiens
aagtgagaccttcctt

SEQ ID NO: 5824559 - DNA, 14 bp, Homo sapiens
aagtgagagaaaaa

SEQ ID NO: 5824560 - DNA, 12 bp, Homo sapiens
aagtgagagagg

SEQ ID NO: 5824561 - DNA, 18 bp, Homo sapiens
aagtgagagccagcagca

SEQ ID NO: 5824562 - DNA, 15 bp, Homo sapiens
aagtgagaggggagg

SEQ ID NO: 5824563 - DNA, 17 bp, Homo sapiens
aagtgagaggggaggga

SEQ ID NO: 5824564 - DNA, 19 bp, Homo sapiens
aagtgagagtagtcagaac

SEQ ID NO: 5824565 - DNA, 17 bp, Homo sapiens
aagtgagagttggggag

SEQ ID NO: 5824566 - DNA, 19 bp, Homo sapiens
aagtgagatggtatgaaat

SEQ ID NO: 5824567 - DNA, 15 bp, Homo sapiens
aagtgagatgtttgg

SEQ ID NO: 5824568 - DNA, 15 bp, Homo sapiens
aagtgagcagaacag

SEQ ID NO: 5824569 - DNA, 16 bp, Homo sapiens
aagtgagcagaacagg

SEQ ID NO: 5824570 - DNA, 18 bp, Homo sapiens
aagtgagcagatgggaca

SEQ ID NO: 5824571 - DNA, 20 bp, Homo sapiens
aagtgagcagtcgcctgcct

SEQ ID NO: 5824572 - DNA, 18 bp, Homo sapiens
aagtgagcgattagttga

SEQ ID NO: 5824573 - DNA, 20 bp, Homo sapiens
aagtgagcgtgtagcgtcct

SEQ ID NO: 5824574 - DNA, 18 bp, Homo sapiens
aagtgaggaaatgttttg

SEQ ID NO: 5824575 - DNA, 17 bp, Homo sapiens
aagtgaggatgagaccc

SEQ ID NO: 5824576 - DNA, 23 bp, Homo sapiens
aagtgaggatgagacccagcccc

SEQ ID NO: 5824577 - DNA, 15 bp, Homo sapiens
aagtgaggccactga

SEQ ID NO: 5824578 - DNA, 18 bp, Homo sapiens
aagtgaggccactgaaga

SEQ ID NO: 5824579 - DNA, 13 bp, Homo sapiens
aagtgaggcccaa

SEQ ID NO: 5824580 - DNA, 16 bp, Homo sapiens
aagtgaggcccaagga

SEQ ID NO: 5824581 - DNA, 21 bp, Homo sapiens
aagtgagggctcactcagcca

SEQ ID NO: 5824582 - DNA, 17 bp, Homo sapiens
aagtgaggtgacactcc

SEQ ID NO: 5824583 - DNA, 18 bp, Homo sapiens
aagtgagtactgttaaga

SEQ ID NO: 5824584 - DNA, 17 bp, Homo sapiens
aagtgagtctctctggg

SEQ ID NO: 5824585 - DNA, 13 bp, Homo sapiens
aagtgagtggcat

SEQ ID NO: 5824586 - DNA, 17 bp, Homo sapiens
aagtgagtggcatgtgg

SEQ ID NO: 5824587 - DNA, 18 bp, Homo sapiens
aagtgagtgtttctatga

SEQ ID NO: 5824588 - DNA, 18 bp, Homo sapiens
aagtgagtttgtaaatat

SEQ ID NO: 5824589 - DNA, 16 bp, Homo sapiens
aagtgagttttacacg

SEQ ID NO: 5824590 - DNA, 18 bp, Homo sapiens
aagtgataggataaagtt

SEQ ID NO: 5824591 - DNA, 13 bp, Homo sapiens
aagtgatatatgt

SEQ ID NO: 5824592 - DNA, 19 bp, Homo sapiens
aagtggacgttaggccagg

SEQ ID NO: 5824593 - DNA, 17 bp, Homo sapiens
aagtggactcagggcag

SEQ ID NO: 5824594 - DNA, 18 bp, Homo sapiens
aagtggactctctgacaa

SEQ ID NO: 5824595 - DNA, 23 bp, Homo sapiens
aagtggactctttggtggctttg

SEQ ID NO: 5824596 - DNA, 23 bp, Homo sapiens
aagtggactggtgtcataaactt

SEQ ID NO: 5824597 - DNA, 13 bp, Homo sapiens
aagtggactgtat

SEQ ID NO: 5824598 - DNA, 18 bp, Homo sapiens
aagtggacttctgaaaaa

SEQ ID NO: 5824599 - DNA, 14 bp, Homo sapiens
aagtggagctgtct

SEQ ID NO: 5824600 - DNA, 21 bp, Homo sapiens
aagtggaggaaatgttggaac

SEQ ID NO: 5824601 - DNA, 16 bp, Homo sapiens
aagtggaggcacttta

SEQ ID NO: 5824602 - DNA, 12 bp, Homo sapiens
aagtggaggggg

SEQ ID NO: 5824603 - DNA, 15 bp, Homo sapiens
aagtggatctaaatg

SEQ ID NO: 5824604 - DNA, 14 bp, Homo sapiens
aagtggatggaagt

SEQ ID NO: 5824605 - DNA, 16 bp, Homo sapiens
aagtggatggaagtgt

SEQ ID NO: 5824606 - DNA, 16 bp, Homo sapiens
aagtggatggcccagc

SEQ ID NO: 5824607 - DNA, 13 bp, Homo sapiens
aagtggatgggaa

SEQ ID NO: 5824608 - DNA, 16 bp, Homo sapiens
aagtggatgtttttaa

SEQ ID NO: 5824609 - DNA, 16 bp, Homo sapiens
aagtggattggctttg

SEQ ID NO: 5824610 - DNA, 21 bp, Homo sapiens
aagtggcacctgtctgctcca

SEQ ID NO: 5824611 - DNA, 14 bp, Homo sapiens
aagtggcaggagga

SEQ ID NO: 5824612 - DNA, 12 bp, Homo sapiens
aagtggcaggga

SEQ ID NO: 5824613 - DNA, 15 bp, Homo sapiens
aagtggcagggaccg

SEQ ID NO: 5824614 - DNA, 22 bp, Homo sapiens
aagtggcagggaccggcagagc

SEQ ID NO: 5824615 - DNA, 13 bp, Homo sapiens
aagtggcagttct

SEQ ID NO: 5824616 - DNA, 20 bp, Homo sapiens
aagtggcagtttttaaaatt

SEQ ID NO: 5824617 - DNA, 21 bp, Homo sapiens
aagtggcatagagaatacaca

SEQ ID NO: 5824618 - DNA, 19 bp, Homo sapiens
aagtggccaagaagcagtg

SEQ ID NO: 5824619 - DNA, 13 bp, Homo sapiens
aagtggccctccc

SEQ ID NO: 5824620 - DNA, 23 bp, Homo sapiens
aagtggcctccgtcactacctgg

SEQ ID NO: 5824621 - DNA, 19 bp, Homo sapiens
aagtggctaattcaattta

SEQ ID NO: 5824622 - DNA, 18 bp, Homo sapiens
aagtggctccccacctgg

SEQ ID NO: 5824623 - DNA, 13 bp, Homo sapiens
aagtggctgcctt

SEQ ID NO: 5824624 - DNA, 21 bp, Homo sapiens
aagtggctgggtgccctctca

SEQ ID NO: 5824625 - DNA, 14 bp, Homo sapiens
aagtgggaaaaaat

SEQ ID NO: 5824626 - DNA, 16 bp, Homo sapiens
aagtgggacctggtgg

SEQ ID NO: 5824627 - DNA, 18 bp, Homo sapiens
aagtgggagatgaaaacc

SEQ ID NO: 5824628 - DNA, 13 bp, Homo sapiens
aagtgggagcagc

SEQ ID NO: 5824629 - DNA, 15 bp, Homo sapiens
aagtgggagcagctt

SEQ ID NO: 5824630 - DNA, 19 bp, Homo sapiens
aagtgggaggtcaggaaac

SEQ ID NO: 5824631 - DNA, 21 bp, Homo sapiens
aagtgggagtgggagaggaag

SEQ ID NO: 5824632 - DNA, 20 bp, Homo sapiens
aagtgggatttggggcctca

SEQ ID NO: 5824633 - DNA, 13 bp, Homo sapiens
aagtgggcccacc

SEQ ID NO: 5824634 - DNA, 17 bp, Homo sapiens
aagtggggcagagcctc

SEQ ID NO: 5824635 - DNA, 20 bp, Homo sapiens
aagtggggcagcagcagtgg

SEQ ID NO: 5824636 - DNA, 22 bp, Homo sapiens
aagtggggcctccttgtccagg

SEQ ID NO: 5824637 - DNA, 15 bp, Homo sapiens
aagtggggctcgcca

SEQ ID NO: 5824638 - DNA, 22 bp, Homo sapiens
aagtgggggcaggtttggagag

SEQ ID NO: 5824639 - DNA, 16 bp, Homo sapiens
aagtgggggccgctgg

SEQ ID NO: 5824640 - DNA, 19 bp, Homo sapiens
aagtgggggccgctggccc

SEQ ID NO: 5824641 - DNA, 14 bp, Homo sapiens
aagtgggggcgggg

SEQ ID NO: 5824642 - DNA, 15 bp, Homo sapiens
aagtgggggcgggga

SEQ ID NO: 5824643 - DNA, 14 bp, Homo sapiens
aagtggggtgttga

SEQ ID NO: 5824644 - DNA, 15 bp, Homo sapiens
aagtggggtgttgaa

SEQ ID NO: 5824645 - DNA, 17 bp, Homo sapiens
aagtgggtactttctga

SEQ ID NO: 5824646 - DNA, 19 bp, Homo sapiens
aagtgggtgagatgctgga

SEQ ID NO: 5824647 - DNA, 17 bp, Homo sapiens
aagtgggtttcaattta

SEQ ID NO: 5824648 - DNA, 16 bp, Homo sapiens
aagtgggtttttatga

SEQ ID NO: 5824649 - DNA, 18 bp, Homo sapiens
aagtggtaaatactgtga

SEQ ID NO: 5824650 - DNA, 14 bp, Homo sapiens
aagtggtacaggaa

SEQ ID NO: 5824651 - DNA, 15 bp, Homo sapiens
aagtggtagtaattt

SEQ ID NO: 5824652 - DNA, 21 bp, Homo sapiens
aagtggtagtaatttccttta

SEQ ID NO: 5824653 - DNA, 20 bp, Homo sapiens
aagtggtccagaaacaaaaa

SEQ ID NO: 5824654 - DNA, 12 bp, Homo sapiens
aagtggtccagc

SEQ ID NO: 5824655 - DNA, 17 bp, Homo sapiens
aagtggtctctgctggg

SEQ ID NO: 5824656 - DNA, 20 bp, Homo sapiens
aagtggtctgaactgcttgc

SEQ ID NO: 5824657 - DNA, 14 bp, Homo sapiens
aagtggtgaccaaa

SEQ ID NO: 5824658 - DNA, 22 bp, Homo sapiens
aagtggtgctataagttttaga

SEQ ID NO: 5824659 - DNA, 23 bp, Homo sapiens
aagtggtgctataagttttagaa

SEQ ID NO: 5824660 - DNA, 19 bp, Homo sapiens
aagtggtgcttagaaaatt

SEQ ID NO: 5824661 - DNA, 17 bp, Homo sapiens
aagtggtggtaaccctg

SEQ ID NO: 5824662 - DNA, 13 bp, Homo sapiens
aagtggtgttttt

SEQ ID NO: 5824663 - DNA, 13 bp, Homo sapiens
aagtggttgtttt

SEQ ID NO: 5824664 - DNA, 13 bp, Homo sapiens
aagtggtttctaa

SEQ ID NO: 5824665 - DNA, 14 bp, Homo sapiens
aagtgtaaagcatt

SEQ ID NO: 5824666 - DNA, 18 bp, Homo sapiens
aagtgtaaagcattccaa

SEQ ID NO: 5824667 - DNA, 22 bp, Homo sapiens
aagtgtaaataatataaaatgt

SEQ ID NO: 5824668 - DNA, 14 bp, Homo sapiens
aagtgtaaatgaag

SEQ ID NO: 5824669 - DNA, 14 bp, Homo sapiens
aagtgtaaatgtta

SEQ ID NO: 5824670 - DNA, 15 bp, Homo sapiens
aagtgtaacagctga

SEQ ID NO: 5824671 - DNA, 16 bp, Homo sapiens
aagtgtaacagctgag

SEQ ID NO: 5824672 - DNA, 10 bp, Homo sapiens
aagtgtaacc

SEQ ID NO: 5824673 - DNA, 16 bp, Homo sapiens
aagtgtaacctcagta

SEQ ID NO: 5824674 - DNA, 14 bp, Homo sapiens
aagtgtaatgaata

SEQ ID NO: 5824675 - DNA, 11 bp, Homo sapiens
aagtgtaatta

SEQ ID NO: 5824676 - DNA, 12 bp, Homo sapiens
aagtgtacaatt

SEQ ID NO: 5824677 - DNA, 15 bp, Homo sapiens
aagtgtacagactct

SEQ ID NO: 5824678 - DNA, 19 bp, Homo sapiens
aagtgtacagactcttcac

SEQ ID NO: 5824679 - DNA, 11 bp, Homo sapiens
aagtgtacata

SEQ ID NO: 5824680 - DNA, 14 bp, Homo sapiens
aagtgtacatatgt

SEQ ID NO: 5824681 - DNA, 12 bp, Homo sapiens
aagtgtacattt

SEQ ID NO: 5824682 - DNA, 14 bp, Homo sapiens
aagtgtacatttga

SEQ ID NO: 5824683 - DNA, 21 bp, Homo sapiens
aagtgtacttcataagatatt

SEQ ID NO: 5824684 - DNA, 19 bp, Homo sapiens
aagtgtagatgtagcattg

SEQ ID NO: 5824685 - DNA, 15 bp, Homo sapiens
aagtgtagggcaagg

SEQ ID NO: 5824686 - DNA, 10 bp, Homo sapiens
aagtgtataa

SEQ ID NO: 5824687 - DNA, 14 bp, Homo sapiens
aagtgtataatata

SEQ ID NO: 5824688 - DNA, 15 bp, Homo sapiens
aagtgtataatgttg

SEQ ID NO: 5824689 - DNA, 20 bp, Homo sapiens
aagtgtataatgttggtgtg

SEQ ID NO: 5824690 - DNA, 17 bp, Homo sapiens
aagtgtatgatcttagg

SEQ ID NO: 5824691 - DNA, 16 bp, Homo sapiens
aagtgtatgcagtatt

SEQ ID NO: 5824692 - DNA, 19 bp, Homo sapiens
aagtgtatggtaggggctt

SEQ ID NO: 5824693 - DNA, 17 bp, Homo sapiens
aagtgtatgtgtgaatt

SEQ ID NO: 5824694 - DNA, 18 bp, Homo sapiens
aagtgtattagatgtggt

SEQ ID NO: 5824695 - DNA, 21 bp, Homo sapiens
aagtgtattatttctggcttt

SEQ ID NO: 5824696 - DNA, 20 bp, Homo sapiens
aagtgtattgcaagtgaaat

SEQ ID NO: 5824697 - DNA, 23 bp, Homo sapiens
aagtgtattggtttctgtttgaa

SEQ ID NO: 5824698 - DNA, 13 bp, Homo sapiens
aagtgtattgtaa

SEQ ID NO: 5824699 - DNA, 17 bp, Homo sapiens
aagtgtattttgaaatt

SEQ ID NO: 5824700 - DNA, 21 bp, Homo sapiens
aagtgtattttgaaattgttt

SEQ ID NO: 5824701 - DNA, 22 bp, Homo sapiens
aagtgtatttttcaataaagca

SEQ ID NO: 5824702 - DNA, 18 bp, Homo sapiens
aagtgtatttttttacta

SEQ ID NO: 5824703 - DNA, 21 bp, Homo sapiens
aagtgtatttttttactaata

SEQ ID NO: 5824704 - DNA, 17 bp, Homo sapiens
aagtgtcaactctttgt

SEQ ID NO: 5824705 - DNA, 19 bp, Homo sapiens
aagtgtcaaggggccctag

SEQ ID NO: 5824706 - DNA, 15 bp, Homo sapiens
aagtgtcaccctgtg

SEQ ID NO: 5824707 - DNA, 16 bp, Homo sapiens
aagtgtcaccctgtgg

SEQ ID NO: 5824708 - DNA, 18 bp, Homo sapiens
aagtgtcaccctgtgggt

SEQ ID NO: 5824709 - DNA, 18 bp, Homo sapiens
aagtgtcacctccttccc

SEQ ID NO: 5824710 - DNA, 22 bp, Homo sapiens
aagtgtcacctccttccccagc

SEQ ID NO: 5824711 - DNA, 20 bp, Homo sapiens
aagtgtcactccataaaaag

SEQ ID NO: 5824712 - DNA, 13 bp, Homo sapiens
aagtgtcatcaat

SEQ ID NO: 5824713 - DNA, 13 bp, Homo sapiens
aagtgtcatgttt

SEQ ID NO: 5824714 - DNA, 18 bp, Homo sapiens
aagtgtccacaagaaggg

SEQ ID NO: 5824715 - DNA, 18 bp, Homo sapiens
aagtgtccattgacatgt

SEQ ID NO: 5824716 - DNA, 19 bp, Homo sapiens
aagtgtccattgacatgta

SEQ ID NO: 5824717 - DNA, 23 bp, Homo sapiens
aagtgtccattgacatgtacaga

SEQ ID NO: 5824718 - DNA, 17 bp, Homo sapiens
aagtgtcctggaccctg

SEQ ID NO: 5824719 - DNA, 21 bp, Homo sapiens
aagtgtcctggaccctggcct

SEQ ID NO: 5824720 - DNA, 19 bp, Homo sapiens
aagtgtctcattctcagag

SEQ ID NO: 5824721 - DNA, 20 bp, Homo sapiens
aagtgtctcttgactggctc

SEQ ID NO: 5824722 - DNA, 14 bp, Homo sapiens
aagtgtctggagcg

SEQ ID NO: 5824723 - DNA, 23 bp, Homo sapiens
aagtgtctggcccgcaatactgt

SEQ ID NO: 5824724 - DNA, 18 bp, Homo sapiens
aagtgtctttgtttaaaa

SEQ ID NO: 5824725 - DNA, 21 bp, Homo sapiens
aagtgtgaactggaccctgtt

SEQ ID NO: 5824726 - DNA, 21 bp, Homo sapiens
aagtgtgaagacccaaaacag

SEQ ID NO: 5824727 - DNA, 22 bp, Homo sapiens
aagtgtgaagacccaaaacagc

SEQ ID NO: 5824728 - DNA, 16 bp, Homo sapiens
aagtgtgaagtgcaga

SEQ ID NO: 5824729 - DNA, 20 bp, Homo sapiens
aagtgtgaatactgcttgaa

SEQ ID NO: 5824730 - DNA, 13 bp, Homo sapiens
aagtgtgagcaaa

SEQ ID NO: 5824731 - DNA, 17 bp, Homo sapiens
aagtgtgagcgccttgg

SEQ ID NO: 5824732 - DNA, 18 bp, Homo sapiens
aagtgtgagcgccttggt

SEQ ID NO: 5824733 - DNA, 19 bp, Homo sapiens
aagtgtgagcgccttggta

SEQ ID NO: 5824734 - DNA, 19 bp, Homo sapiens
aagtgtgagctcttccctt

SEQ ID NO: 5824735 - DNA, 11 bp, Homo sapiens
aagtgtgagta

SEQ ID NO: 5824736 - DNA, 20 bp, Homo sapiens
aagtgtgagtaagagctggt

SEQ ID NO: 5824737 - DNA, 20 bp, Homo sapiens
aagtgtgattgggaataaat

SEQ ID NO: 5824738 - DNA, 21 bp, Homo sapiens
aagtgtgattgggaataaata

SEQ ID NO: 5824739 - DNA, 19 bp, Homo sapiens
aagtgtgcagccatagttt

SEQ ID NO: 5824740 - DNA, 17 bp, Homo sapiens
aagtgtgcatattgtac

SEQ ID NO: 5824741 - DNA, 19 bp, Homo sapiens
aagtgtgcatattgtacac

SEQ ID NO: 5824742 - DNA, 13 bp, Homo sapiens
aagtgtgcctgct

SEQ ID NO: 5824743 - DNA, 23 bp, Homo sapiens
aagtgtgctctttttttaaaagg

SEQ ID NO: 5824744 - DNA, 18 bp, Homo sapiens
aagtgtgctgtgacaagc

SEQ ID NO: 5824745 - DNA, 22 bp, Homo sapiens
aagtgtggatgttcagaatttt

SEQ ID NO: 5824746 - DNA, 12 bp, Homo sapiens
aagtgtggctgg

SEQ ID NO: 5824747 - DNA, 13 bp, Homo sapiens
aagtgtggggcgg

SEQ ID NO: 5824748 - DNA, 16 bp, Homo sapiens
aagtgtggtgtctttt

SEQ ID NO: 5824749 - DNA, 19 bp, Homo sapiens
aagtgtggtttgcagatga

SEQ ID NO: 5824750 - DNA, 21 bp, Homo sapiens
aagtgtggttttgtaatttaa

SEQ ID NO: 5824751 - DNA, 17 bp, Homo sapiens
aagtgtgtatctagctt

SEQ ID NO: 5824752 - DNA, 18 bp, Homo sapiens
aagtgtgtgattgaaggt

SEQ ID NO: 5824753 - DNA, 17 bp, Homo sapiens
aagtgtgtggctgggcg

SEQ ID NO: 5824754 - DNA, 11 bp, Homo sapiens
aagtgtgtgtg

SEQ ID NO: 5824755 - DNA, 21 bp, Homo sapiens
aagtgtgtgtttcttgctttg

SEQ ID NO: 5824756 - DNA, 11 bp, Homo sapiens
aagtgtgttct

SEQ ID NO: 5824757 - DNA, 12 bp, Homo sapiens
aagtgtgttctg

SEQ ID NO: 5824758 - DNA, 19 bp, Homo sapiens
aagtgtgtttcttcccctt

SEQ ID NO: 5824759 - DNA, 13 bp, Homo sapiens
aagtgttacagag

SEQ ID NO: 5824760 - DNA, 18 bp, Homo sapiens
aagtgttacgttttattg

SEQ ID NO: 5824761 - DNA, 11 bp, Homo sapiens
aagtgttactt

SEQ ID NO: 5824762 - DNA, 22 bp, Homo sapiens
aagtgttatttcatccagggaa

SEQ ID NO: 5824763 - DNA, 18 bp, Homo sapiens
aagtgttcactgctcctt

SEQ ID NO: 5824764 - DNA, 15 bp, Homo sapiens
aagtgttcagtgttg

SEQ ID NO: 5824765 - DNA, 16 bp, Homo sapiens
aagtgttcagtgttga

SEQ ID NO: 5824766 - DNA, 17 bp, Homo sapiens
aagtgttcagtgttgac

SEQ ID NO: 5824767 - DNA, 18 bp, Homo sapiens
aagtgttcagtgttgaca

SEQ ID NO: 5824768 - DNA, 22 bp, Homo sapiens
aagtgttcagtgttgacatagc

SEQ ID NO: 5824769 - DNA, 11 bp, Homo sapiens
aagtgttcatt

SEQ ID NO: 5824770 - DNA, 18 bp, Homo sapiens
aagtgttccctttttcat

SEQ ID NO: 5824771 - DNA, 23 bp, Homo sapiens
aagttcatattccatatttattc

SEQ ID NO: 5824772 - DNA, 15 bp, Homo sapiens
aagttcatcaaacat

SEQ ID NO: 5824773 - DNA, 18 bp, Homo sapiens
aagttcatcctttgactg

SEQ ID NO: 5824774 - DNA, 16 bp, Homo sapiens
aagttcatcttgcagc

SEQ ID NO: 5824775 - DNA, 21 bp, Homo sapiens
aagttcatgggcacctcatgg

SEQ ID NO: 5824776 - DNA, 21 bp, Homo sapiens
aagttcatgtccaaacgtcct

SEQ ID NO: 5824777 - DNA, 17 bp, Homo sapiens
aagttcatgtttgtaaa

SEQ ID NO: 5824778 - DNA, 20 bp, Homo sapiens
aagttcatgtttgtaaatta

SEQ ID NO: 5824779 - DNA, 16 bp, Homo sapiens
aagttcattaaacaga

SEQ ID NO: 5824780 - DNA, 15 bp, Homo sapiens
aagttcattcctgtc

SEQ ID NO: 5824781 - DNA, 18 bp, Homo sapiens
aagttcattttaaatgaa

SEQ ID NO: 5824782 - DNA, 16 bp, Homo sapiens
aagttcatttttatcc

SEQ ID NO: 5824783 - DNA, 21 bp, Homo sapiens
aagttccaagagtctaaagat

SEQ ID NO: 5824784 - DNA, 21 bp, Homo sapiens
aagttccacttccaggtctgc

SEQ ID NO: 5824785 - DNA, 15 bp, Homo sapiens
aagttccattatgaa

SEQ ID NO: 5824786 - DNA, 18 bp, Homo sapiens
aagttccgtctcctctcc

SEQ ID NO: 5824787 - DNA, 14 bp, Homo sapiens
aagttcctctagtg

SEQ ID NO: 5824788 - DNA, 13 bp, Homo sapiens
aagttcctgcact

SEQ ID NO: 5824789 - DNA, 17 bp, Homo sapiens
aagttcctgcactccag

SEQ ID NO: 5824790 - DNA, 12 bp, Homo sapiens
aagttcctgctg

SEQ ID NO: 5824791 - DNA, 13 bp, Homo sapiens
aagttcctgctgc

SEQ ID NO: 5824792 - DNA, 16 bp, Homo sapiens
aagttctaagattcta

SEQ ID NO: 5824793 - DNA, 21 bp, Homo sapiens
aagttctaagattctaatgat

SEQ ID NO: 5824794 - DNA, 18 bp, Homo sapiens
aagttctaataatttcta

SEQ ID NO: 5824795 - DNA, 14 bp, Homo sapiens
aagttctagtgttt

SEQ ID NO: 5824796 - DNA, 21 bp, Homo sapiens
aagttctagtgttttcaattt

SEQ ID NO: 5824797 - DNA, 14 bp, Homo sapiens
aagttctataacta

SEQ ID NO: 5824798 - DNA, 16 bp, Homo sapiens
aagttctatgaagagt

SEQ ID NO: 5824799 - DNA, 12 bp, Homo sapiens
aagttctattta

SEQ ID NO: 5824800 - DNA, 17 bp, Homo sapiens
aagttctatttaagtgt

SEQ ID NO: 5824801 - DNA, 22 bp, Homo sapiens
aagttctattttactgtcttga

SEQ ID NO: 5824802 - DNA, 21 bp, Homo sapiens
aagttctcagaataactacct

SEQ ID NO: 5824803 - DNA, 22 bp, Homo sapiens
aagttctcagaataactacctc

SEQ ID NO: 5824804 - DNA, 14 bp, Homo sapiens
aagttctcagagct

SEQ ID NO: 5824805 - DNA, 17 bp, Homo sapiens
aagttctccagcttcag

SEQ ID NO: 5824806 - DNA, 18 bp, Homo sapiens
aagttctccagcttcagc

SEQ ID NO: 5824807 - DNA, 19 bp, Homo sapiens
aagttctccttttgaactt

SEQ ID NO: 5824808 - DNA, 20 bp, Homo sapiens
aagttctccttttgaacttg

SEQ ID NO: 5824809 - DNA, 19 bp, Homo sapiens
aagttctgaaaactgttta

SEQ ID NO: 5824810 - DNA, 17 bp, Homo sapiens
aagttctgaaatttaac

SEQ ID NO: 5824811 - DNA, 15 bp, Homo sapiens
aagttctgacttgac

SEQ ID NO: 5824812 - DNA, 16 bp, Homo sapiens
aagttctgcctctgat

SEQ ID NO: 5824813 - DNA, 13 bp, Homo sapiens
aagttctgctttc

SEQ ID NO: 5824814 - DNA, 16 bp, Homo sapiens
aagttctgctttctcc

SEQ ID NO: 5824815 - DNA, 19 bp, Homo sapiens
aagttctggcaagagcaga

SEQ ID NO: 5824816 - DNA, 21 bp, Homo sapiens
aagttctgtgcagtttggtat

SEQ ID NO: 5824817 - DNA, 18 bp, Homo sapiens
aagttctgtggttccagt

SEQ ID NO: 5824818 - DNA, 16 bp, Homo sapiens
aagttctgtgtattta

SEQ ID NO: 5824819 - DNA, 22 bp, Homo sapiens
aagttctgtgtttaatttcttc

SEQ ID NO: 5824820 - DNA, 23 bp, Homo sapiens
aagttctgtgtttaatttcttca

SEQ ID NO: 5824821 - DNA, 14 bp, Homo sapiens
aagttcttagatat

SEQ ID NO: 5824822 - DNA, 15 bp, Homo sapiens
aagttcttagatatc

SEQ ID NO: 5824823 - DNA, 17 bp, Homo sapiens
aagttcttagatatctt

SEQ ID NO: 5824824 - DNA, 22 bp, Homo sapiens
aagttcttagttgctgtatgtc

SEQ ID NO: 5824825 - DNA, 11 bp, Homo sapiens
aagttcttatg

SEQ ID NO: 5824826 - DNA, 19 bp, Homo sapiens
aagttcttatgaggagggg

SEQ ID NO: 5824827 - DNA, 20 bp, Homo sapiens
aagttcttatgaggagggga

SEQ ID NO: 5824828 - DNA, 22 bp, Homo sapiens
aagttcttatgaggaggggagg

SEQ ID NO: 5824829 - DNA, 17 bp, Homo sapiens
aagttcttattttagta

SEQ ID NO: 5824830 - DNA, 13 bp, Homo sapiens
aagttcttcaaga

SEQ ID NO: 5824831 - DNA, 18 bp, Homo sapiens
aagttcttcaagaggaaa

SEQ ID NO: 5824832 - DNA, 15 bp, Homo sapiens
aagttcttcacctct

SEQ ID NO: 5824833 - DNA, 20 bp, Homo sapiens
aagttcttggaccagtttgc

SEQ ID NO: 5824834 - DNA, 19 bp, Homo sapiens
aagttcttggattacttta

SEQ ID NO: 5824835 - DNA, 15 bp, Homo sapiens
aagttctttgattct

SEQ ID NO: 5824836 - DNA, 18 bp, Homo sapiens
aagttctttgatttgtac

SEQ ID NO: 5824837 - DNA, 20 bp, Homo sapiens
aagttctttgatttgtacca

SEQ ID NO: 5824838 - DNA, 21 bp, Homo sapiens
aagttctttgatttgtaccat

SEQ ID NO: 5824839 - DNA, 21 bp, Homo sapiens
aagttgaaaaaggaaatattc

SEQ ID NO: 5824840 - DNA, 15 bp, Homo sapiens
aagttgaaaagccaa

SEQ ID NO: 5824841 - DNA, 13 bp, Homo sapiens
aagttgaaaagta

SEQ ID NO: 5824842 - DNA, 18 bp, Homo sapiens
aagttgaaaagtaaaaaa

SEQ ID NO: 5824843 - DNA, 14 bp, Homo sapiens
aagttgaaaataca

SEQ ID NO: 5824844 - DNA, 20 bp, Homo sapiens
aagttgaaaatacattctta

SEQ ID NO: 5824845 - DNA, 20 bp, Homo sapiens
aagttgaaccattatacttt

SEQ ID NO: 5824846 - DNA, 23 bp, Homo sapiens
aagttgaaccattatactttata

SEQ ID NO: 5824847 - DNA, 12 bp, Homo sapiens
aagttgaaggaa

SEQ ID NO: 5824848 - DNA, 14 bp, Homo sapiens
aagttgaagggaaa

SEQ ID NO: 5824849 - DNA, 15 bp, Homo sapiens
aagttgaagggaaat

SEQ ID NO: 5824850 - DNA, 18 bp, Homo sapiens
aagttgaatattatatat

SEQ ID NO: 5824851 - DNA, 14 bp, Homo sapiens
aagttgaatgataa

SEQ ID NO: 5824852 - DNA, 19 bp, Homo sapiens
aagttgaatgataatagct

SEQ ID NO: 5824853 - DNA, 12 bp, Homo sapiens
aagttgaccttt

SEQ ID NO: 5824854 - DNA, 20 bp, Homo sapiens
aagttgacctttatttatta

SEQ ID NO: 5824855 - DNA, 20 bp, Homo sapiens
aagttgactctgctcttgca

SEQ ID NO: 5824856 - DNA, 21 bp, Homo sapiens
aagttgactctgctcttgcat

SEQ ID NO: 5824857 - DNA, 19 bp, Homo sapiens
aagttgacttatagtacat

SEQ ID NO: 5824858 - DNA, 21 bp, Homo sapiens
aagttgagaaggtgcctgcca

SEQ ID NO: 5824859 - DNA, 16 bp, Homo sapiens
aagttgaggggagagg

SEQ ID NO: 5824860 - DNA, 22 bp, Homo sapiens
aagttgataggagacttgtaca

SEQ ID NO: 5824861 - DNA, 22 bp, Homo sapiens
aagttgatatgccttttcccaa

SEQ ID NO: 5824862 - DNA, 14 bp, Homo sapiens
aagttgatgcaatc

SEQ ID NO: 5824863 - DNA, 15 bp, Homo sapiens
aagttgatgttttct

SEQ ID NO: 5824864 - DNA, 20 bp, Homo sapiens
aagttgattaagaaaggaag

SEQ ID NO: 5824865 - DNA, 16 bp, Homo sapiens
aagttgattctgtccc

SEQ ID NO: 5824866 - DNA, 17 bp, Homo sapiens
aagttgattttgaactt

SEQ ID NO: 5824867 - DNA, 21 bp, Homo sapiens
aagttgattttgaacttttta

SEQ ID NO: 5824868 - DNA, 15 bp, Homo sapiens
aagttgcacggctgc

SEQ ID NO: 5824869 - DNA, 16 bp, Homo sapiens
aagttgcacggctgct

SEQ ID NO: 5824870 - DNA, 15 bp, Homo sapiens
aagttgcagctgttt

SEQ ID NO: 5824871 - DNA, 17 bp, Homo sapiens
aagttgcagctgttttg

SEQ ID NO: 5824872 - DNA, 16 bp, Homo sapiens
aagttgcagtcagaag

SEQ ID NO: 5824873 - DNA, 17 bp, Homo sapiens
aagttgcagtctttttt

SEQ ID NO: 5824874 - DNA, 16 bp, Homo sapiens
aagttgcagtgagctg

SEQ ID NO: 5824875 - DNA, 16 bp, Homo sapiens
aagttgcatttaatgt

SEQ ID NO: 5824876 - DNA, 23 bp, Homo sapiens
aagttgcatttagaaatcaagca

SEQ ID NO: 5824877 - DNA, 14 bp, Homo sapiens
aagttgccaagagt

SEQ ID NO: 5824878 - DNA, 21 bp, Homo sapiens
aagttgccattattctatgta

SEQ ID NO: 5824879 - DNA, 22 bp, Homo sapiens
aagttgccattattctatgtag

SEQ ID NO: 5824880 - DNA, 15 bp, Homo sapiens
aagttgccattttgt

SEQ ID NO: 5824881 - DNA, 17 bp, Homo sapiens
aagttgcctaaatccat

SEQ ID NO: 5824882 - DNA, 15 bp, Homo sapiens
aagttgctaagtgtg

SEQ ID NO: 5824883 - DNA, 13 bp, Homo sapiens
aagttgctctgta

SEQ ID NO: 5824884 - DNA, 14 bp, Homo sapiens
aagttgctgcttct

SEQ ID NO: 5824885 - DNA, 19 bp, Homo sapiens
aagttgctgtaagcacctg

SEQ ID NO: 5824886 - DNA, 21 bp, Homo sapiens
aagttgctgtaagcacctggg

SEQ ID NO: 5824887 - DNA, 17 bp, Homo sapiens
aagttgcttttttgact

SEQ ID NO: 5824888 - DNA, 19 bp, Homo sapiens
aagttggaaggatctgctg

SEQ ID NO: 5824889 - DNA, 23 bp, Homo sapiens
aagttggagttttgtttcctctg

SEQ ID NO: 5824890 - DNA, 11 bp, Homo sapiens
aagttggcttc

SEQ ID NO: 5824891 - DNA, 21 bp, Homo sapiens
aagttggcttctgtttctagt

SEQ ID NO: 5824892 - DNA, 16 bp, Homo sapiens
aagttgggagcctgaa

SEQ ID NO: 5824893 - DNA, 16 bp, Homo sapiens
aagttgggcaatataa

SEQ ID NO: 5824894 - DNA, 18 bp, Homo sapiens
aagttgggcccctgagga

SEQ ID NO: 5824895 - DNA, 21 bp, Homo sapiens
aagttgggcttgctattctgt

SEQ ID NO: 5824896 - DNA, 19 bp, Homo sapiens
aagttggggcactgggcgt

SEQ ID NO: 5824897 - DNA, 21 bp, Homo sapiens
aagttgggttaataccagctt

SEQ ID NO: 5824898 - DNA, 20 bp, Homo sapiens
aagttggtatcgaaatttgt

SEQ ID NO: 5824899 - DNA, 16 bp, Homo sapiens
aagttggtattaataa

SEQ ID NO: 5824900 - DNA, 21 bp, Homo sapiens
aagttggtcttatagaaagca

SEQ ID NO: 5824901 - DNA, 21 bp, Homo sapiens
aagttggtttagctttggaaa

SEQ ID NO: 5824902 - DNA, 15 bp, Homo sapiens
aagttgtaaaaatga

SEQ ID NO: 5824903 - DNA, 14 bp, Homo sapiens
aagttgtaaaatgt

SEQ ID NO: 5824904 - DNA, 17 bp, Homo sapiens
aagttgtaaacacagtg

SEQ ID NO: 5824905 - DNA, 15 bp, Homo sapiens
aagttgtaaacgtct

SEQ ID NO: 5824906 - DNA, 11 bp, Homo sapiens
aagttgtaaca

SEQ ID NO: 5824907 - DNA, 19 bp, Homo sapiens
aagttgtaacttatattga

SEQ ID NO: 5824908 - DNA, 21 bp, Homo sapiens
aagttgtaatagagaatattt

SEQ ID NO: 5824909 - DNA, 20 bp, Homo sapiens
aagttgtacaaatgtatttt

SEQ ID NO: 5824910 - DNA, 13 bp, Homo sapiens
aagttgtacatga

SEQ ID NO: 5824911 - DNA, 15 bp, Homo sapiens
aagttgtacatgaaa

SEQ ID NO: 5824912 - DNA, 16 bp, Homo sapiens
aagttgtacatgaaat

SEQ ID NO: 5824913 - DNA, 19 bp, Homo sapiens
aagttgtaccaaaacatcc

SEQ ID NO: 5824914 - DNA, 14 bp, Homo sapiens
aagttgtacctttt

SEQ ID NO: 5824915 - DNA, 21 bp, Homo sapiens
aagttgtactccaatggctga

SEQ ID NO: 5824916 - DNA, 14 bp, Homo sapiens
aagttgtactgtat

SEQ ID NO: 5824917 - DNA, 15 bp, Homo sapiens
aagttgtataaaaac

SEQ ID NO: 5824918 - DNA, 21 bp, Homo sapiens
aagttgtataggctaaatgtt

SEQ ID NO: 5824919 - DNA, 13 bp, Homo sapiens
aagttgtctcctt

SEQ ID NO: 5824920 - DNA, 14 bp, Homo sapiens
aagttgtctccttc

SEQ ID NO: 5824921 - DNA, 14 bp, Homo sapiens
aagttgtctggctt

SEQ ID NO: 5824922 - DNA, 17 bp, Homo sapiens
aagttgtgatctgttgt

SEQ ID NO: 5824923 - DNA, 19 bp, Homo sapiens
aagttgtgcaacggccagg

SEQ ID NO: 5824924 - DNA, 18 bp, Homo sapiens
aagttgtgccttttatag

SEQ ID NO: 5824925 - DNA, 14 bp, Homo sapiens
aagttgtggatatc

SEQ ID NO: 5824926 - DNA, 18 bp, Homo sapiens
aagttgtggggagatcca

SEQ ID NO: 5824927 - DNA, 23 bp, Homo sapiens
aagttgtgtctgaaaatatctct

SEQ ID NO: 5824928 - DNA, 19 bp, Homo sapiens
aagttgtgtgctattcgta

SEQ ID NO: 5824929 - DNA, 21 bp, Homo sapiens
aagttgttactaactaaactc

SEQ ID NO: 5824930 - DNA, 23 bp, Homo sapiens
aagttgttactaactaaactctc

SEQ ID NO: 5824931 - DNA, 18 bp, Homo sapiens
aagttgttcacatatatg

SEQ ID NO: 5824932 - DNA, 20 bp, Homo sapiens
aagttgttcacatatatgta

SEQ ID NO: 5824933 - DNA, 14 bp, Homo sapiens
aagttgttgactgt

SEQ ID NO: 5824934 - DNA, 17 bp, Homo sapiens
aagttgttgactgtgat

SEQ ID NO: 5824935 - DNA, 11 bp, Homo sapiens
aagttgtttat

SEQ ID NO: 5824936 - DNA, 17 bp, Homo sapiens
aagttgtttatcaactt

SEQ ID NO: 5824937 - DNA, 22 bp, Homo sapiens
aagttgtttcagataaatttca

SEQ ID NO: 5824938 - DNA, 13 bp, Homo sapiens
aagttgttttttt

SEQ ID NO: 5824939 - DNA, 13 bp, Homo sapiens
aagtttaaaaaat

SEQ ID NO: 5824940 - DNA, 19 bp, Homo sapiens
aagtttaaaagccatgtat

SEQ ID NO: 5824941 - DNA, 13 bp, Homo sapiens
aagtttaaaatgt

SEQ ID NO: 5824942 - DNA, 13 bp, Homo sapiens
aagtttaaagaag

SEQ ID NO: 5824943 - DNA, 16 bp, Homo sapiens
aagtttaaataccagt

SEQ ID NO: 5824944 - DNA, 15 bp, Homo sapiens
aagtttaaatgtatt

SEQ ID NO: 5824945 - DNA, 18 bp, Homo sapiens
aagtttaacctaaataat

SEQ ID NO: 5824946 - DNA, 19 bp, Homo sapiens
aagtttaagtgtgcagcca

SEQ ID NO: 5824947 - DNA, 15 bp, Homo sapiens
aagtttaataaaata

SEQ ID NO: 5824948 - DNA, 15 bp, Homo sapiens
aagtttaatattaaa

SEQ ID NO: 5824949 - DNA, 15 bp, Homo sapiens
aataaacttgtgcct

SEQ ID NO: 5824950 - DNA, 16 bp, Homo sapiens
aataaacttgtgcctc

SEQ ID NO: 5824951 - DNA, 13 bp, Homo sapiens
aataaactttaat

SEQ ID NO: 5824952 - DNA, 13 bp, Homo sapiens
aataaactttatt

SEQ ID NO: 5824953 - DNA, 18 bp, Homo sapiens
aataaactttcaaattga

SEQ ID NO: 5824954 - DNA, 22 bp, Homo sapiens
aataaactttgggaaaaggtgt

SEQ ID NO: 5824955 - DNA, 23 bp, Homo sapiens
aataaacttttaccacaaattga

SEQ ID NO: 5824956 - DNA, 19 bp, Homo sapiens
aataaactttttttcaatg

SEQ ID NO: 5824957 - DNA, 20 bp, Homo sapiens
aataaagaaaaaaatagttt

SEQ ID NO: 5824958 - DNA, 21 bp, Homo sapiens
aataaagaaaaaaatagtttt

SEQ ID NO: 5824959 - DNA, 20 bp, Homo sapiens
aataaagaaaagatgcactt

SEQ ID NO: 5824960 - DNA, 17 bp, Homo sapiens
aataaagaaaattctct

SEQ ID NO: 5824961 - DNA, 15 bp, Homo sapiens
aataaagaaatttgg

SEQ ID NO: 5824962 - DNA, 20 bp, Homo sapiens
aataaagaactccttatttt

SEQ ID NO: 5824963 - DNA, 22 bp, Homo sapiens
aataaagaactccttattttgt

SEQ ID NO: 5824964 - DNA, 23 bp, Homo sapiens
aataaagaactccttattttgta

SEQ ID NO: 5824965 - DNA, 13 bp, Homo sapiens
aataaagaagaaa

SEQ ID NO: 5824966 - DNA, 13 bp, Homo sapiens
aataaagaattta

SEQ ID NO: 5824967 - DNA, 16 bp, Homo sapiens
aataaagaatttaaag

SEQ ID NO: 5824968 - DNA, 20 bp, Homo sapiens
aataaagacaaccatattta

SEQ ID NO: 5824969 - DNA, 16 bp, Homo sapiens
aataaagactcttgga

SEQ ID NO: 5824970 - DNA, 12 bp, Homo sapiens
aataaagagaaa

SEQ ID NO: 5824971 - DNA, 18 bp, Homo sapiens
aataaagagatagttcta

SEQ ID NO: 5824972 - DNA, 14 bp, Homo sapiens
aataaagagatttt

SEQ ID NO: 5824973 - DNA, 11 bp, Homo sapiens
aataaagagga

SEQ ID NO: 5824974 - DNA, 21 bp, Homo sapiens
aataaagaggagtgttattgc

SEQ ID NO: 5824975 - DNA, 11 bp, Homo sapiens
aataaagatgg

SEQ ID NO: 5824976 - DNA, 12 bp, Homo sapiens
aataaagcaaat

SEQ ID NO: 5824977 - DNA, 14 bp, Homo sapiens
aataaagcaatgaa

SEQ ID NO: 5824978 - DNA, 12 bp, Homo sapiens
aataaagcaatt

SEQ ID NO: 5824979 - DNA, 15 bp, Homo sapiens
aataaagcaattttc

SEQ ID NO: 5824980 - DNA, 18 bp, Homo sapiens
aataaagcaattttcctt

SEQ ID NO: 5824981 - DNA, 21 bp, Homo sapiens
aataaagcacgcagttatgtt

SEQ ID NO: 5824982 - DNA, 23 bp, Homo sapiens
aataaagcactattgtttagata

SEQ ID NO: 5824983 - DNA, 15 bp, Homo sapiens
aataaagcactgagc

SEQ ID NO: 5824984 - DNA, 10 bp, Homo sapiens
aataaagcag

SEQ ID NO: 5824985 - DNA, 14 bp, Homo sapiens
aataaagcagagcc

SEQ ID NO: 5824986 - DNA, 15 bp, Homo sapiens
aataaagcagagcca

SEQ ID NO: 5824987 - DNA, 13 bp, Homo sapiens
aataaagcagagt

SEQ ID NO: 5824988 - DNA, 11 bp, Homo sapiens
aataaagcagc

SEQ ID NO: 5824989 - DNA, 20 bp, Homo sapiens
aataaagcattctttaacag

SEQ ID NO: 5824990 - DNA, 17 bp, Homo sapiens
aataaagcattttgcaa

SEQ ID NO: 5824991 - DNA, 16 bp, Homo sapiens
aataaagccatttctt

SEQ ID NO: 5824992 - DNA, 19 bp, Homo sapiens
aataaagcctatttttcaa

SEQ ID NO: 5824993 - DNA, 18 bp, Homo sapiens
aataaagcctttgtatct

SEQ ID NO: 5824994 - DNA, 17 bp, Homo sapiens
aataaagcgaaaaactc

SEQ ID NO: 5824995 - DNA, 17 bp, Homo sapiens
aataaagctactgaatt

SEQ ID NO: 5824996 - DNA, 19 bp, Homo sapiens
aataaagctactgaattta

SEQ ID NO: 5824997 - DNA, 18 bp, Homo sapiens
aataaagctcctctgctc

SEQ ID NO: 5824998 - DNA, 14 bp, Homo sapiens
aataaagctgctga

SEQ ID NO: 5824999 - DNA, 21 bp, Homo sapiens
aataaagctggacaagaagct

SEQ ID NO: 5825000 - DNA, 23 bp, Homo sapiens
aataaagctggacaagaagctgc

SEQ ID NO: 5825001 - DNA, 14 bp, Homo sapiens
aataaagctgtgag

SEQ ID NO: 5825002 - DNA, 19 bp, Homo sapiens
aataaagctgtgtggcagt

SEQ ID NO: 5825003 - DNA, 15 bp, Homo sapiens
aataaagctgttctc

SEQ ID NO: 5825004 - DNA, 10 bp, Homo sapiens
aataaagctt

SEQ ID NO: 5825005 - DNA, 20 bp, Homo sapiens
aataaagcttctctctgagc

SEQ ID NO: 5825006 - DNA, 18 bp, Homo sapiens
aataaagcttgtggcccc

SEQ ID NO: 5825007 - DNA, 18 bp, Homo sapiens
aataaaggaaaacaaaaa

SEQ ID NO: 5825008 - DNA, 22 bp, Homo sapiens
aataaaggactgtaatcttatt

SEQ ID NO: 5825009 - DNA, 16 bp, Homo sapiens
aataaaggaggaatca

SEQ ID NO: 5825010 - DNA, 24 bp, Homo sapiens
aataaaggataactctgtattaca

SEQ ID NO: 5825011 - DNA, 11 bp, Homo sapiens
aataaaggcag

SEQ ID NO: 5825012 - DNA, 13 bp, Homo sapiens
aataaaggcagct

SEQ ID NO: 5825013 - DNA, 17 bp, Homo sapiens
aataaaggcagctgcct

SEQ ID NO: 5825014 - DNA, 16 bp, Homo sapiens
aataaaggcagttttc

SEQ ID NO: 5825015 - DNA, 15 bp, Homo sapiens
aataaaggctctgtg

SEQ ID NO: 5825016 - DNA, 11 bp, Homo sapiens
aataaaggctg

SEQ ID NO: 5825017 - DNA, 13 bp, Homo sapiens
aataaaggctgag

SEQ ID NO: 5825018 - DNA, 15 bp, Homo sapiens
aataaaggtaaaatc

SEQ ID NO: 5825019 - DNA, 14 bp, Homo sapiens
aataaaggtcacat

SEQ ID NO: 5825020 - DNA, 19 bp, Homo sapiens
aataaaggtcttaaataat

SEQ ID NO: 5825021 - DNA, 16 bp, Homo sapiens
aataaaggtgtagaaa

SEQ ID NO: 5825022 - DNA, 20 bp, Homo sapiens
aataaaggtttcgttgcatg

SEQ ID NO: 5825023 - DNA, 9 bp, Homo sapiens
aataaagta

SEQ ID NO: 5825024 - DNA, 14 bp, Homo sapiens
aataaagtaattat

SEQ ID NO: 5825025 - DNA, 12 bp, Homo sapiens
aataaagtactt

SEQ ID NO: 5825026 - DNA, 18 bp, Homo sapiens
aataaagtaggaaagaat

SEQ ID NO: 5825027 - DNA, 15 bp, Homo sapiens
aataaagtataatgt

SEQ ID NO: 5825028 - DNA, 14 bp, Homo sapiens
aataaagtatataa

SEQ ID NO: 5825029 - DNA, 15 bp, Homo sapiens
aataaagtatatata

SEQ ID NO: 5825030 - DNA, 15 bp, Homo sapiens
aataaagtatcatgc

SEQ ID NO: 5825031 - DNA, 16 bp, Homo sapiens
aataaagtatcatgca

SEQ ID NO: 5825032 - DNA, 18 bp, Homo sapiens
aataaagtatgaatattt

SEQ ID NO: 5825033 - DNA, 11 bp, Homo sapiens
aataaagtatt

SEQ ID NO: 5825034 - DNA, 15 bp, Homo sapiens
aataaagtattccac

SEQ ID NO: 5825035 - DNA, 22 bp, Homo sapiens
aataaagtatttaattagtgct

SEQ ID NO: 5825036 - DNA, 16 bp, Homo sapiens
aataaagtattttctt

SEQ ID NO: 5825037 - DNA, 15 bp, Homo sapiens
aataaagtctctttt

SEQ ID NO: 5825038 - DNA, 16 bp, Homo sapiens
aataaagtctgtcatg

SEQ ID NO: 5825039 - DNA, 13 bp, Homo sapiens
aataaagtgacaa

SEQ ID NO: 5825040 - DNA, 11 bp, Homo sapiens
aataaagtgat

SEQ ID NO: 5825041 - DNA, 18 bp, Homo sapiens
aataaagtgccttctggg

SEQ ID NO: 5825042 - DNA, 15 bp, Homo sapiens
aataaagtgtaacaa

SEQ ID NO: 5825043 - DNA, 13 bp, Homo sapiens
aataaagtgtgtg

SEQ ID NO: 5825044 - DNA, 16 bp, Homo sapiens
aataaagtgtgtgtgc

SEQ ID NO: 5825045 - DNA, 23 bp, Homo sapiens
aataaagtgttacgttttattgg

SEQ ID NO: 5825046 - DNA, 18 bp, Homo sapiens
aataaagttaaactgatt

SEQ ID NO: 5825047 - DNA, 19 bp, Homo sapiens
aataaagttctgttttctg

SEQ ID NO: 5825048 - DNA, 20 bp, Homo sapiens
aataaagttctgttttctgt

SEQ ID NO: 5825049 - DNA, 15 bp, Homo sapiens
aataaagttgaatat

SEQ ID NO: 5825050 - DNA, 13 bp, Homo sapiens
aataaagttgctt

SEQ ID NO: 5825051 - DNA, 11 bp, Homo sapiens
aataaagttgt

SEQ ID NO: 5825052 - DNA, 13 bp, Homo sapiens
aataaagttgttg

SEQ ID NO: 5825053 - DNA, 14 bp, Homo sapiens
aataaagtttacaa

SEQ ID NO: 5825054 - DNA, 15 bp, Homo sapiens
aataaagtttggact

SEQ ID NO: 5825055 - DNA, 18 bp, Homo sapiens
aataaataaaaactaatt

SEQ ID NO: 5825056 - DNA, 17 bp, Homo sapiens
aataaataaataacttt

SEQ ID NO: 5825057 - DNA, 12 bp, Homo sapiens
aataaataaatg

SEQ ID NO: 5825058 - DNA, 19 bp, Homo sapiens
aataaataaggaaaagctt

SEQ ID NO: 5825059 - DNA, 16 bp, Homo sapiens
aataaataatattata

SEQ ID NO: 5825060 - DNA, 14 bp, Homo sapiens
aataaataatttta

SEQ ID NO: 5825061 - DNA, 16 bp, Homo sapiens
aataaatacattcttg

SEQ ID NO: 5825062 - DNA, 14 bp, Homo sapiens
aataaataccaaag

SEQ ID NO: 5825063 - DNA, 14 bp, Homo sapiens
aataaatagaaaga

SEQ ID NO: 5825064 - DNA, 14 bp, Homo sapiens
aataaatagagcaa

SEQ ID NO: 5825065 - DNA, 15 bp, Homo sapiens
aataaatagttcttc

SEQ ID NO: 5825066 - DNA, 14 bp, Homo sapiens
aataaatatactaa

SEQ ID NO: 5825067 - DNA, 19 bp, Homo sapiens
aataaatatactaataaaa

SEQ ID NO: 5825068 - DNA, 20 bp, Homo sapiens
aataaatatactaataaaaa

SEQ ID NO: 5825069 - DNA, 12 bp, Homo sapiens
aataaatatata

SEQ ID NO: 5825070 - DNA, 14 bp, Homo sapiens
aataaatatatata

SEQ ID NO: 5825071 - DNA, 16 bp, Homo sapiens
aataaatatatatatc

SEQ ID NO: 5825072 - DNA, 20 bp, Homo sapiens
aataaatatcctttaattga

SEQ ID NO: 5825073 - DNA, 15 bp, Homo sapiens
aataaatatctgtac

SEQ ID NO: 5825074 - DNA, 11 bp, Homo sapiens
aataaatatga

SEQ ID NO: 5825075 - DNA, 13 bp, Homo sapiens
aataaatatgagt

SEQ ID NO: 5825076 - DNA, 18 bp, Homo sapiens
aataaatattatttgatg

SEQ ID NO: 5825077 - DNA, 14 bp, Homo sapiens
aataaatattctgc

SEQ ID NO: 5825078 - DNA, 23 bp, Homo sapiens
aataaatattgtctttttgtatg

SEQ ID NO: 5825079 - DNA, 14 bp, Homo sapiens
aataaatattttac

SEQ ID NO: 5825080 - DNA, 14 bp, Homo sapiens
aataaatcacacat

SEQ ID NO: 5825081 - DNA, 13 bp, Homo sapiens
aataaatcacaga

SEQ ID NO: 5825082 - DNA, 15 bp, Homo sapiens
aataaatcatcctca

SEQ ID NO: 5825083 - DNA, 12 bp, Homo sapiens
aataaatctaaa

SEQ ID NO: 5825084 - DNA, 16 bp, Homo sapiens
aataaatctaggatgt

SEQ ID NO: 5825085 - DNA, 21 bp, Homo sapiens
aataaatctatatttttgtga

SEQ ID NO: 5825086 - DNA, 22 bp, Homo sapiens
aataaatctcttctttgctgca

SEQ ID NO: 5825087 - DNA, 20 bp, Homo sapiens
aataaatctgacccagtgcc

SEQ ID NO: 5825088 - DNA, 14 bp, Homo sapiens
aataaatctgccat

SEQ ID NO: 5825089 - DNA, 22 bp, Homo sapiens
aataaatctgttgccaagctgg

SEQ ID NO: 5825090 - DNA, 14 bp, Homo sapiens
aataaatctttcaa

SEQ ID NO: 5825091 - DNA, 15 bp, Homo sapiens
aataaatctttcaaa

SEQ ID NO: 5825092 - DNA, 13 bp, Homo sapiens
aataaatgaaaaa

SEQ ID NO: 5825093 - DNA, 17 bp, Homo sapiens
aataaatgacacccaga

SEQ ID NO: 5825094 - DNA, 14 bp, Homo sapiens
aataaatgaccagt

SEQ ID NO: 5825095 - DNA, 19 bp, Homo sapiens
aataaatgagaaaaaatgc

SEQ ID NO: 5825096 - DNA, 18 bp, Homo sapiens
aataaatgagctatgtat

SEQ ID NO: 5825097 - DNA, 18 bp, Homo sapiens
aataaatgagctgttgga

SEQ ID NO: 5825098 - DNA, 17 bp, Homo sapiens
aataaatgattatattc

SEQ ID NO: 5825099 - DNA, 21 bp, Homo sapiens
aataaatgattatattcacag

SEQ ID NO: 5825100 - DNA, 21 bp, Homo sapiens
aataaatgcatagagcaatta

SEQ ID NO: 5825101 - DNA, 14 bp, Homo sapiens
aataaatgccttta

SEQ ID NO: 5825102 - DNA, 22 bp, Homo sapiens
aataaatgcctttatatttcac

SEQ ID NO: 5825103 - DNA, 23 bp, Homo sapiens
aataaatgcctttatatttcaca

SEQ ID NO: 5825104 - DNA, 13 bp, Homo sapiens
aataaatgctgct

SEQ ID NO: 5825105 - DNA, 15 bp, Homo sapiens
aataaatggaaatca

SEQ ID NO: 5825106 - DNA, 23 bp, Homo sapiens
aataaatggcccggacatgtctt

SEQ ID NO: 5825107 - DNA, 11 bp, Homo sapiens
aataaatggga

SEQ ID NO: 5825108 - DNA, 23 bp, Homo sapiens
aataaatggtatagcaaatgttt

SEQ ID NO: 5825109 - DNA, 22 bp, Homo sapiens
aataaatggtttggtgcttttt

SEQ ID NO: 5825110 - DNA, 14 bp, Homo sapiens
aataaatgtacctg

SEQ ID NO: 5825111 - DNA, 14 bp, Homo sapiens
aataaatgtatcat

SEQ ID NO: 5825112 - DNA, 20 bp, Homo sapiens
aataaatgtatcttattcac

SEQ ID NO: 5825113 - DNA, 21 bp, Homo sapiens
aataaatgtatcttattcaca

SEQ ID NO: 5825114 - DNA, 12 bp, Homo sapiens
aataaatgtatt

SEQ ID NO: 5825115 - DNA, 18 bp, Homo sapiens
aataaatgtattaactga

SEQ ID NO: 5825116 - DNA, 11 bp, Homo sapiens
aataaatgtca

SEQ ID NO: 5825117 - DNA, 13 bp, Homo sapiens
aataaatgtcact

SEQ ID NO: 5825118 - DNA, 15 bp, Homo sapiens
aataaatgtcacttt

SEQ ID NO: 5825119 - DNA, 17 bp, Homo sapiens
aataaatgtcattaaaa

SEQ ID NO: 5825120 - DNA, 20 bp, Homo sapiens
aataaatgtcccaaataaat

SEQ ID NO: 5825121 - DNA, 22 bp, Homo sapiens
aataaatgtcccaaataaattt

SEQ ID NO: 5825122 - DNA, 22 bp, Homo sapiens
aataaatgtgaaacatcttctc

SEQ ID NO: 5825123 - DNA, 14 bp, Homo sapiens
aataaatgtgtaaa

SEQ ID NO: 5825124 - DNA, 12 bp, Homo sapiens
aataaatgtgtt

SEQ ID NO: 5825125 - DNA, 18 bp, Homo sapiens
aataaatgttcaaactgt

SEQ ID NO: 5825126 - DNA, 18 bp, Homo sapiens
aataaatgttcatgattt

SEQ ID NO: 5825127 - DNA, 12 bp, Homo sapiens
aataaatgttga

SEQ ID NO: 5825128 - DNA, 14 bp, Homo sapiens
aataaatgttgaaa

SEQ ID NO: 5825129 - DNA, 15 bp, Homo sapiens
aataaatgtttcaaa

SEQ ID NO: 5825130 - DNA, 16 bp, Homo sapiens
aataaatgtttccccc

SEQ ID NO: 5825131 - DNA, 20 bp, Homo sapiens
aataaggctccttcatgtgg

SEQ ID NO: 5825132 - DNA, 15 bp, Homo sapiens
aataagggaataaaa

SEQ ID NO: 5825133 - DNA, 15 bp, Homo sapiens
aataaggtacaagaa

SEQ ID NO: 5825134 - DNA, 19 bp, Homo sapiens
aataaggtacaagaagcat

SEQ ID NO: 5825135 - DNA, 16 bp, Homo sapiens
aataaggtcaatgcca

SEQ ID NO: 5825136 - DNA, 16 bp, Homo sapiens
aataagtcaacagtaa

SEQ ID NO: 5825137 - DNA, 22 bp, Homo sapiens
aataagtcaacagtaaaccact

SEQ ID NO: 5825138 - DNA, 14 bp, Homo sapiens
aataagtgaaaata

SEQ ID NO: 5825139 - DNA, 21 bp, Homo sapiens
aataagtgaaattttaaaagt

SEQ ID NO: 5825140 - DNA, 15 bp, Homo sapiens
aataagtgaagaata

SEQ ID NO: 5825141 - DNA, 17 bp, Homo sapiens
aataagtgaagaataca

SEQ ID NO: 5825142 - DNA, 19 bp, Homo sapiens
aataagtgaatctaataaa

SEQ ID NO: 5825143 - DNA, 20 bp, Homo sapiens
aataagtgaatctaataaaa

SEQ ID NO: 5825144 - DNA, 20 bp, Homo sapiens
aataagtgacaaataagatt

SEQ ID NO: 5825145 - DNA, 18 bp, Homo sapiens
aataagtgctgtttgaga

SEQ ID NO: 5825146 - DNA, 17 bp, Homo sapiens
aataagtggttatttct

SEQ ID NO: 5825147 - DNA, 17 bp, Homo sapiens
aataagtgtacatatgt

SEQ ID NO: 5825148 - DNA, 14 bp, Homo sapiens
aataagtgtatttt

SEQ ID NO: 5825149 - DNA, 15 bp, Homo sapiens
aataagtgtctttct

SEQ ID NO: 5825150 - DNA, 22 bp, Homo sapiens
aataagtgtgtggtagaaacaa

SEQ ID NO: 5825151 - DNA, 22 bp, Homo sapiens
aataagtgttgtaccatatgta

SEQ ID NO: 5825152 - DNA, 23 bp, Homo sapiens
aataagttaaaggcagtccagag

SEQ ID NO: 5825153 - DNA, 11 bp, Homo sapiens
aataagttatt

SEQ ID NO: 5825154 - DNA, 12 bp, Homo sapiens
aataagttctta

SEQ ID NO: 5825155 - DNA, 16 bp, Homo sapiens
aataagttgaatgata

SEQ ID NO: 5825156 - DNA, 14 bp, Homo sapiens
aataagtttgaacc

SEQ ID NO: 5825157 - DNA, 14 bp, Homo sapiens
aataagttttgata

SEQ ID NO: 5825158 - DNA, 15 bp, Homo sapiens
aataagttttgatat

SEQ ID NO: 5825159 - DNA, 17 bp, Homo sapiens
aataagttttgatataa

SEQ ID NO: 5825160 - DNA, 13 bp, Homo sapiens
aataagttttttt

SEQ ID NO: 5825161 - DNA, 23 bp, Homo sapiens
aataataaaaaaatatatacaga

SEQ ID NO: 5825162 - DNA, 21 bp, Homo sapiens
aataataaaagattcacctga

SEQ ID NO: 5825163 - DNA, 18 bp, Homo sapiens
aataataaaatgcaaatg

SEQ ID NO: 5825164 - DNA, 12 bp, Homo sapiens
aataataaagaa

SEQ ID NO: 5825165 - DNA, 13 bp, Homo sapiens
aataataaagaca

SEQ ID NO: 5825166 - DNA, 13 bp, Homo sapiens
aataataaagaga

SEQ ID NO: 5825167 - DNA, 19 bp, Homo sapiens
aataataaagatggttttg

SEQ ID NO: 5825168 - DNA, 12 bp, Homo sapiens
aataataaaggt

SEQ ID NO: 5825169 - DNA, 13 bp, Homo sapiens
aataataaaggtt

SEQ ID NO: 5825170 - DNA, 19 bp, Homo sapiens
aataataaaggttctatga

SEQ ID NO: 5825171 - DNA, 16 bp, Homo sapiens
aataataaatgcatag

SEQ ID NO: 5825172 - DNA, 12 bp, Homo sapiens
aataataaatgt

SEQ ID NO: 5825173 - DNA, 12 bp, Homo sapiens
aataataaatta

SEQ ID NO: 5825174 - DNA, 13 bp, Homo sapiens
aataataaattaa

SEQ ID NO: 5825175 - DNA, 18 bp, Homo sapiens
aataataaattaacatta

SEQ ID NO: 5825176 - DNA, 22 bp, Homo sapiens
aataataaattaacattatatt

SEQ ID NO: 5825177 - DNA, 21 bp, Homo sapiens
aataataaattgcatgctgct

SEQ ID NO: 5825178 - DNA, 21 bp, Homo sapiens
aataataacaacaacttaatg

SEQ ID NO: 5825179 - DNA, 12 bp, Homo sapiens
aataataataat

SEQ ID NO: 5825180 - DNA, 15 bp, Homo sapiens
aataataataataat

SEQ ID NO: 5825181 - DNA, 21 bp, Homo sapiens
aataataattatccagagttt

SEQ ID NO: 5825182 - DNA, 16 bp, Homo sapiens
aataataattgaagaa

SEQ ID NO: 5825183 - DNA, 14 bp, Homo sapiens
aataatacactaat

SEQ ID NO: 5825184 - DNA, 17 bp, Homo sapiens
aataatacatactaatg

SEQ ID NO: 5825185 - DNA, 14 bp, Homo sapiens
aataatacatcttt

SEQ ID NO: 5825186 - DNA, 15 bp, Homo sapiens
aataataccaagact

SEQ ID NO: 5825187 - DNA, 22 bp, Homo sapiens
aataataccccaacagatgagc

SEQ ID NO: 5825188 - DNA, 20 bp, Homo sapiens
aataatacctcaatgtttga

SEQ ID NO: 5825189 - DNA, 15 bp, Homo sapiens
aataataccttagaa

SEQ ID NO: 5825190 - DNA, 16 bp, Homo sapiens
aataataccttagaag

SEQ ID NO: 5825191 - DNA, 16 bp, Homo sapiens
aataatacttcataca

SEQ ID NO: 5825192 - DNA, 21 bp, Homo sapiens
aataatagcaatgtaaaaatg

SEQ ID NO: 5825193 - DNA, 18 bp, Homo sapiens
aataatagcacatgattt

SEQ ID NO: 5825194 - DNA, 16 bp, Homo sapiens
aataatagccatcctt

SEQ ID NO: 5825195 - DNA, 15 bp, Homo sapiens
aataatagggaaaat

SEQ ID NO: 5825196 - DNA, 17 bp, Homo sapiens
aataatagtatgagtaa

SEQ ID NO: 5825197 - DNA, 16 bp, Homo sapiens
aataatataatgaatt

SEQ ID NO: 5825198 - DNA, 19 bp, Homo sapiens
aataatatattttctgttt

SEQ ID NO: 5825199 - DNA, 11 bp, Homo sapiens
aataatatgca

SEQ ID NO: 5825200 - DNA, 12 bp, Homo sapiens
aataatatgcat

SEQ ID NO: 5825201 - DNA, 19 bp, Homo sapiens
aataatatggctatgctta

SEQ ID NO: 5825202 - DNA, 17 bp, Homo sapiens
aataatatgtacaaata

SEQ ID NO: 5825203 - DNA, 20 bp, Homo sapiens
aataatatgtttccttccct

SEQ ID NO: 5825204 - DNA, 17 bp, Homo sapiens
aataatattaatttatt

SEQ ID NO: 5825205 - DNA, 14 bp, Homo sapiens
aataatattatatt

SEQ ID NO: 5825206 - DNA, 18 bp, Homo sapiens
aataatattcatgaagag

SEQ ID NO: 5825207 - DNA, 15 bp, Homo sapiens
aataatattgtatat

SEQ ID NO: 5825208 - DNA, 14 bp, Homo sapiens
aataatattgttgt

SEQ ID NO: 5825209 - DNA, 16 bp, Homo sapiens
aataatattgtttttc

SEQ ID NO: 5825210 - DNA, 14 bp, Homo sapiens
aataatatttatgt

SEQ ID NO: 5825211 - DNA, 19 bp, Homo sapiens
aataatatttcaagtgcct

SEQ ID NO: 5825212 - DNA, 14 bp, Homo sapiens
aataatattttaga

SEQ ID NO: 5825213 - DNA, 18 bp, Homo sapiens
aataatcaagattttagg

SEQ ID NO: 5825214 - DNA, 15 bp, Homo sapiens
aataatcacacacac

SEQ ID NO: 5825215 - DNA, 15 bp, Homo sapiens
aataatcacattgac

SEQ ID NO: 5825216 - DNA, 20 bp, Homo sapiens
aataatcacgctttcctgaa

SEQ ID NO: 5825217 - DNA, 22 bp, Homo sapiens
aataatcataaactatattctg

SEQ ID NO: 5825218 - DNA, 16 bp, Homo sapiens
aataatccagtattgc

SEQ ID NO: 5825219 - DNA, 20 bp, Homo sapiens
aataatccagtattgctgat

SEQ ID NO: 5825220 - DNA, 15 bp, Homo sapiens
aataatccatgaaag

SEQ ID NO: 5825221 - DNA, 12 bp, Homo sapiens
aataatccattt

SEQ ID NO: 5825222 - DNA, 18 bp, Homo sapiens
aataatccattttcacta

SEQ ID NO: 5825223 - DNA, 14 bp, Homo sapiens
aataatcctgcaaa

SEQ ID NO: 5825224 - DNA, 19 bp, Homo sapiens
aataatcctgcaaagtaca

SEQ ID NO: 5825225 - DNA, 13 bp, Homo sapiens
aataatctacatc

SEQ ID NO: 5825226 - DNA, 14 bp, Homo sapiens
aataatctatatta

SEQ ID NO: 5825227 - DNA, 16 bp, Homo sapiens
aataatctatttctat

SEQ ID NO: 5825228 - DNA, 21 bp, Homo sapiens
aataatctcacaaaacatatt

SEQ ID NO: 5825229 - DNA, 18 bp, Homo sapiens
aataatctggtgttcttg

SEQ ID NO: 5825230 - DNA, 13 bp, Homo sapiens
aataatcttggct

SEQ ID NO: 5825231 - DNA, 12 bp, Homo sapiens
aataatgaaaat

SEQ ID NO: 5825232 - DNA, 12 bp, Homo sapiens
aataatgaagat

SEQ ID NO: 5825233 - DNA, 18 bp, Homo sapiens
aataatgaagatctttgt

SEQ ID NO: 5825234 - DNA, 18 bp, Homo sapiens
aataatgaagtagaagtt

SEQ ID NO: 5825235 - DNA, 18 bp, Homo sapiens
aataatgaagttattctt

SEQ ID NO: 5825236 - DNA, 18 bp, Homo sapiens
aataatgaataaactgaa

SEQ ID NO: 5825237 - DNA, 19 bp, Homo sapiens
aataatgaataaactgaat

SEQ ID NO: 5825238 - DNA, 22 bp, Homo sapiens
aataatgaatggactcaaactg

SEQ ID NO: 5825239 - DNA, 22 bp, Homo sapiens
aataatgacgtattgtgaaatt

SEQ ID NO: 5825240 - DNA, 23 bp, Homo sapiens
aataatgacgtattgtgaaattt

SEQ ID NO: 5825241 - DNA, 14 bp, Homo sapiens
aataatgactctaa

SEQ ID NO: 5825242 - DNA, 14 bp, Homo sapiens
aataatgagagcaa

SEQ ID NO: 5825243 - DNA, 11 bp, Homo sapiens
aataatgattt

SEQ ID NO: 5825244 - DNA, 10 bp, Homo sapiens
aataatgcag

SEQ ID NO: 5825245 - DNA, 15 bp, Homo sapiens
aataatgcagtatgg

SEQ ID NO: 5825246 - DNA, 19 bp, Homo sapiens
aataatgcagtatggtaca

SEQ ID NO: 5825247 - DNA, 18 bp, Homo sapiens
aataatgcctttgtaacc

SEQ ID NO: 5825248 - DNA, 19 bp, Homo sapiens
aataatgctacaattttaa

SEQ ID NO: 5825249 - DNA, 12 bp, Homo sapiens
aataatgctgca

SEQ ID NO: 5825250 - DNA, 23 bp, Homo sapiens
aataatgcttaacataaacttgt

SEQ ID NO: 5825251 - DNA, 15 bp, Homo sapiens
aataatgcttaataa

SEQ ID NO: 5825252 - DNA, 15 bp, Homo sapiens
aataatgctttgaaa

SEQ ID NO: 5825253 - DNA, 15 bp, Homo sapiens
aataatgcttttcta

SEQ ID NO: 5825254 - DNA, 18 bp, Homo sapiens
aataatgcttttctaatt

SEQ ID NO: 5825255 - DNA, 19 bp, Homo sapiens
aataatgcttttctaatta

SEQ ID NO: 5825256 - DNA, 18 bp, Homo sapiens
aataatggaaaaatagta

SEQ ID NO: 5825257 - DNA, 15 bp, Homo sapiens
aataatggaaacatt

SEQ ID NO: 5825258 - DNA, 17 bp, Homo sapiens
aataatggagaacaagt

SEQ ID NO: 5825259 - DNA, 20 bp, Homo sapiens
aataatgggcttagagcagt

SEQ ID NO: 5825260 - DNA, 17 bp, Homo sapiens
aataatggtaccagata

SEQ ID NO: 5825261 - DNA, 21 bp, Homo sapiens
aataatggtaccagataaaat

SEQ ID NO: 5825262 - DNA, 16 bp, Homo sapiens
aataatgtaacatgat

SEQ ID NO: 5825263 - DNA, 19 bp, Homo sapiens
aataatgtaagacaaatat

SEQ ID NO: 5825264 - DNA, 16 bp, Homo sapiens
aataatgtaatactgt

SEQ ID NO: 5825265 - DNA, 14 bp, Homo sapiens
aataatgtaattta

SEQ ID NO: 5825266 - DNA, 14 bp, Homo sapiens
aataatgtacatag

SEQ ID NO: 5825267 - DNA, 19 bp, Homo sapiens
aataatgtacatctggcct

SEQ ID NO: 5825268 - DNA, 13 bp, Homo sapiens
aataatgtactca

SEQ ID NO: 5825269 - DNA, 15 bp, Homo sapiens
aataatgtactcaca

SEQ ID NO: 5825270 - DNA, 22 bp, Homo sapiens
aataatgtactcacatataaca

SEQ ID NO: 5825271 - DNA, 22 bp, Homo sapiens
aataatgtagttttgtttatgc

SEQ ID NO: 5825272 - DNA, 16 bp, Homo sapiens
aataatgtctagattt

SEQ ID NO: 5825273 - DNA, 19 bp, Homo sapiens
aataatgtctagattttga

SEQ ID NO: 5825274 - DNA, 13 bp, Homo sapiens
aataatgtctctg

SEQ ID NO: 5825275 - DNA, 15 bp, Homo sapiens
aataatgtcttgtta

SEQ ID NO: 5825276 - DNA, 22 bp, Homo sapiens
aataatgtgaaactggattaaa

SEQ ID NO: 5825277 - DNA, 14 bp, Homo sapiens
aataatgtgcaaat

SEQ ID NO: 5825278 - DNA, 23 bp, Homo sapiens
aataatgtgcaaatctgacaata

SEQ ID NO: 5825279 - DNA, 19 bp, Homo sapiens
aataatgtgcaaattttgc

SEQ ID NO: 5825280 - DNA, 22 bp, Homo sapiens
aataatgtgtagttcatgtaaa

SEQ ID NO: 5825281 - DNA, 19 bp, Homo sapiens
aataatgttaacatggaca

SEQ ID NO: 5825282 - DNA, 21 bp, Homo sapiens
aataatgttaaccaaggaaat

SEQ ID NO: 5825283 - DNA, 16 bp, Homo sapiens
aataatgttctattgt

SEQ ID NO: 5825284 - DNA, 16 bp, Homo sapiens
aataatgttgccttgg

SEQ ID NO: 5825285 - DNA, 22 bp, Homo sapiens
aataatgtttataagctgggca

SEQ ID NO: 5825286 - DNA, 19 bp, Homo sapiens
aataatgtttcaaacatat

SEQ ID NO: 5825287 - DNA, 12 bp, Homo sapiens
aataattaaaac

SEQ ID NO: 5825288 - DNA, 15 bp, Homo sapiens
aataattaaataaat

SEQ ID NO: 5825289 - DNA, 19 bp, Homo sapiens
aataattaaccaaccttgt

SEQ ID NO: 5825290 - DNA, 19 bp, Homo sapiens
aataattacaaattttgca

SEQ ID NO: 5825291 - DNA, 16 bp, Homo sapiens
aataattacttaatgt

SEQ ID NO: 5825292 - DNA, 17 bp, Homo sapiens
aataattacttaatgtg

SEQ ID NO: 5825293 - DNA, 13 bp, Homo sapiens
aataattagaaac

SEQ ID NO: 5825294 - DNA, 14 bp, Homo sapiens
aataattagctata

SEQ ID NO: 5825295 - DNA, 16 bp, Homo sapiens
aataattaggatctat

SEQ ID NO: 5825296 - DNA, 20 bp, Homo sapiens
aataattaggttaacattgt

SEQ ID NO: 5825297 - DNA, 15 bp, Homo sapiens
aataattatatgaag

SEQ ID NO: 5825298 - DNA, 14 bp, Homo sapiens
aataattatatgct

SEQ ID NO: 5825299 - DNA, 15 bp, Homo sapiens
aataattatatgcta

SEQ ID NO: 5825300 - DNA, 23 bp, Homo sapiens
aataattatatgctatttctata

SEQ ID NO: 5825301 - DNA, 19 bp, Homo sapiens
aataattattcatctaatg

SEQ ID NO: 5825302 - DNA, 16 bp, Homo sapiens
aataattatttattac

SEQ ID NO: 5825303 - DNA, 20 bp, Homo sapiens
aataattatttttaatttaa

SEQ ID NO: 5825304 - DNA, 17 bp, Homo sapiens
aataattcatattcttc

SEQ ID NO: 5825305 - DNA, 15 bp, Homo sapiens
aataattctacatgt

SEQ ID NO: 5825306 - DNA, 17 bp, Homo sapiens
aataattctgagttttg

SEQ ID NO: 5825307 - DNA, 22 bp, Homo sapiens
aataattctgagttttgtgttt

SEQ ID NO: 5825308 - DNA, 15 bp, Homo sapiens
aataattctttttta

SEQ ID NO: 5825309 - DNA, 23 bp, Homo sapiens
aataattgaaaagattttaacaa

SEQ ID NO: 5825310 - DNA, 19 bp, Homo sapiens
aataattggccttcgattt

SEQ ID NO: 5825311 - DNA, 12 bp, Homo sapiens
aatacattcttg

SEQ ID NO: 5825312 - DNA, 16 bp, Homo sapiens
aatacattctttgcta

SEQ ID NO: 5825313 - DNA, 17 bp, Homo sapiens
aatacattctttgctag

SEQ ID NO: 5825314 - DNA, 13 bp, Homo sapiens
aatacattctttt

SEQ ID NO: 5825315 - DNA, 19 bp, Homo sapiens
aatacattgatacaaagta

SEQ ID NO: 5825316 - DNA, 13 bp, Homo sapiens
aatacattgtact

SEQ ID NO: 5825317 - DNA, 20 bp, Homo sapiens
aatacattgtgttttcctaa

SEQ ID NO: 5825318 - DNA, 20 bp, Homo sapiens
aatacatttaaaacattaaa

SEQ ID NO: 5825319 - DNA, 22 bp, Homo sapiens
aatacatttaaaacattaaaat

SEQ ID NO: 5825320 - DNA, 23 bp, Homo sapiens
aatacatttaaaacattaaaata

SEQ ID NO: 5825321 - DNA, 15 bp, Homo sapiens
aatacatttgatttg

SEQ ID NO: 5825322 - DNA, 12 bp, Homo sapiens
aatacatttgta

SEQ ID NO: 5825323 - DNA, 17 bp, Homo sapiens
aatacatttgtaagtgt

SEQ ID NO: 5825324 - DNA, 18 bp, Homo sapiens
aatacatttgtattttgt

SEQ ID NO: 5825325 - DNA, 20 bp, Homo sapiens
aatacatttgtattttgtga

SEQ ID NO: 5825326 - DNA, 14 bp, Homo sapiens
aataccaaatgcct

SEQ ID NO: 5825327 - DNA, 18 bp, Homo sapiens
aataccaactatttcaat

SEQ ID NO: 5825328 - DNA, 17 bp, Homo sapiens
aataccaattatggaaa

SEQ ID NO: 5825329 - DNA, 23 bp, Homo sapiens
aataccacaggaaccacaagact

SEQ ID NO: 5825330 - DNA, 17 bp, Homo sapiens
aataccaccaacaaata

SEQ ID NO: 5825331 - DNA, 20 bp, Homo sapiens
aataccacctcgagatgggt

SEQ ID NO: 5825332 - DNA, 20 bp, Homo sapiens
aataccactagtggaaagtc

SEQ ID NO: 5825333 - DNA, 22 bp, Homo sapiens
aataccactagtggaaagtcag

SEQ ID NO: 5825334 - DNA, 19 bp, Homo sapiens
aataccactggttaaaata

SEQ ID NO: 5825335 - DNA, 15 bp, Homo sapiens
aataccactgtaatt

SEQ ID NO: 5825336 - DNA, 18 bp, Homo sapiens
aataccacttacctcaaa

SEQ ID NO: 5825337 - DNA, 13 bp, Homo sapiens
aataccaggattt

SEQ ID NO: 5825338 - DNA, 19 bp, Homo sapiens
aataccatacccagatgtt

SEQ ID NO: 5825339 - DNA, 22 bp, Homo sapiens
aataccataggaagacataaaa

SEQ ID NO: 5825340 - DNA, 13 bp, Homo sapiens
aataccattgaaa

SEQ ID NO: 5825341 - DNA, 16 bp, Homo sapiens
aataccattgacacat

SEQ ID NO: 5825342 - DNA, 22 bp, Homo sapiens
aataccattttttaaggaaaca

SEQ ID NO: 5825343 - DNA, 23 bp, Homo sapiens
aataccattttttaaggaaacaa

SEQ ID NO: 5825344 - DNA, 14 bp, Homo sapiens
aatacccaaaccct

SEQ ID NO: 5825345 - DNA, 20 bp, Homo sapiens
aataccccaagactcccatg

SEQ ID NO: 5825346 - DNA, 13 bp, Homo sapiens
aatacccccagag

SEQ ID NO: 5825347 - DNA, 21 bp, Homo sapiens
aataccccgactcaccttgtg

SEQ ID NO: 5825348 - DNA, 23 bp, Homo sapiens
aatacccgtcctctcggctgcca

SEQ ID NO: 5825349 - DNA, 22 bp, Homo sapiens
aataccctgtacatatctttga

SEQ ID NO: 5825350 - DNA, 14 bp, Homo sapiens
aatacccttctttt

SEQ ID NO: 5825351 - DNA, 23 bp, Homo sapiens
aatacccttgttttttatagttg

SEQ ID NO: 5825352 - DNA, 21 bp, Homo sapiens
aatacctagtgatacggattt

SEQ ID NO: 5825353 - DNA, 16 bp, Homo sapiens
aatacctcaggaaaga

SEQ ID NO: 5825354 - DNA, 23 bp, Homo sapiens
aatacctccctcatttaagaaaa

SEQ ID NO: 5825355 - DNA, 18 bp, Homo sapiens
aatacctctaataaacac

SEQ ID NO: 5825356 - DNA, 14 bp, Homo sapiens
aatacctctgtgtg

SEQ ID NO: 5825357 - DNA, 16 bp, Homo sapiens
aatacctctgtgtgct

SEQ ID NO: 5825358 - DNA, 16 bp, Homo sapiens
aatacctcttagctga

SEQ ID NO: 5825359 - DNA, 15 bp, Homo sapiens
aatacctctttgaaa

SEQ ID NO: 5825360 - DNA, 17 bp, Homo sapiens
aatacctgacctcacag

SEQ ID NO: 5825361 - DNA, 14 bp, Homo sapiens
aatacctggcctca

SEQ ID NO: 5825362 - DNA, 19 bp, Homo sapiens
aatacctgtccccctgaca

SEQ ID NO: 5825363 - DNA, 13 bp, Homo sapiens
aataccttagaag

SEQ ID NO: 5825364 - DNA, 13 bp, Homo sapiens
aatacctttaaat

SEQ ID NO: 5825365 - DNA, 14 bp, Homo sapiens
aatacctttctaag

SEQ ID NO: 5825366 - DNA, 19 bp, Homo sapiens
aatacctttctaagggaaa

SEQ ID NO: 5825367 - DNA, 19 bp, Homo sapiens
aatacctttgtagttactc

SEQ ID NO: 5825368 - DNA, 22 bp, Homo sapiens
aatacctttgtagttactcaag

SEQ ID NO: 5825369 - DNA, 16 bp, Homo sapiens
aatacgcactacatgt

SEQ ID NO: 5825370 - DNA, 19 bp, Homo sapiens
aatacgcaggcatctgatt

SEQ ID NO: 5825371 - DNA, 20 bp, Homo sapiens
aatacgccagaactgcttta

SEQ ID NO: 5825372 - DNA, 23 bp, Homo sapiens
aatacgctaagcctggaagccat

SEQ ID NO: 5825373 - DNA, 18 bp, Homo sapiens
aatacgtgccagatataa

SEQ ID NO: 5825374 - DNA, 19 bp, Homo sapiens
aatacgtgggcattcaaat

SEQ ID NO: 5825375 - DNA, 19 bp, Homo sapiens
aatacgtgtcaaaaaagaa

SEQ ID NO: 5825376 - DNA, 15 bp, Homo sapiens
aatacgtgttcaaaa

SEQ ID NO: 5825377 - DNA, 19 bp, Homo sapiens
aatacgtgttcaaaaattt

SEQ ID NO: 5825378 - DNA, 13 bp, Homo sapiens
aatacgtttgtgt

SEQ ID NO: 5825379 - DNA, 17 bp, Homo sapiens
aatacgtttgtgtttct

SEQ ID NO: 5825380 - DNA, 11 bp, Homo sapiens
aatactaaaag

SEQ ID NO: 5825381 - DNA, 14 bp, Homo sapiens
aatactaaaagcaa

SEQ ID NO: 5825382 - DNA, 15 bp, Homo sapiens
aatactaaaatatgt

SEQ ID NO: 5825383 - DNA, 15 bp, Homo sapiens
aatactaaggaacca

SEQ ID NO: 5825384 - DNA, 13 bp, Homo sapiens
aatactaataaaa

SEQ ID NO: 5825385 - DNA, 13 bp, Homo sapiens
aatactaatgaaa

SEQ ID NO: 5825386 - DNA, 20 bp, Homo sapiens
aatactaatgtaaagattgt

SEQ ID NO: 5825387 - DNA, 16 bp, Homo sapiens
aatactaccttgaaaa

SEQ ID NO: 5825388 - DNA, 18 bp, Homo sapiens
aatactaccttgaaaata

SEQ ID NO: 5825389 - DNA, 15 bp, Homo sapiens
aatactactactgtt

SEQ ID NO: 5825390 - DNA, 17 bp, Homo sapiens
aatactagtcaccccaa

SEQ ID NO: 5825391 - DNA, 18 bp, Homo sapiens
aatactatccatgtaata

SEQ ID NO: 5825392 - DNA, 22 bp, Homo sapiens
aatactatgaaatgaaagaact

SEQ ID NO: 5825393 - DNA, 20 bp, Homo sapiens
aatactattggacagacaca

SEQ ID NO: 5825394 - DNA, 22 bp, Homo sapiens
aatactattggacagacacaga

SEQ ID NO: 5825395 - DNA, 19 bp, Homo sapiens
aatactatttaagatgtga

SEQ ID NO: 5825396 - DNA, 20 bp, Homo sapiens
aatactatttaagatgtgaa

SEQ ID NO: 5825397 - DNA, 13 bp, Homo sapiens
aatactcaccaaa

SEQ ID NO: 5825398 - DNA, 21 bp, Homo sapiens
aatactcagggaaagcattta

SEQ ID NO: 5825399 - DNA, 17 bp, Homo sapiens
aatactcataatgtgaa

SEQ ID NO: 5825400 - DNA, 19 bp, Homo sapiens
aatactcatgaatgaaaat

SEQ ID NO: 5825401 - DNA, 16 bp, Homo sapiens
aatactcatttttcat

SEQ ID NO: 5825402 - DNA, 16 bp, Homo sapiens
aatactccaaagatga

SEQ ID NO: 5825403 - DNA, 17 bp, Homo sapiens
aatactccaagcttcaa

SEQ ID NO: 5825404 - DNA, 20 bp, Homo sapiens
aatactctaccctcttagaa

SEQ ID NO: 5825405 - DNA, 23 bp, Homo sapiens
aatactctgccctctagagcctt

SEQ ID NO: 5825406 - DNA, 23 bp, Homo sapiens
aatactctgctatttctcttgct

SEQ ID NO: 5825407 - DNA, 17 bp, Homo sapiens
aatactcttaaatttta

SEQ ID NO: 5825408 - DNA, 18 bp, Homo sapiens
aatactcttaaattttat

SEQ ID NO: 5825409 - DNA, 13 bp, Homo sapiens
aatactcttatat

SEQ ID NO: 5825410 - DNA, 14 bp, Homo sapiens
aatactcttgaaag

SEQ ID NO: 5825411 - DNA, 22 bp, Homo sapiens
aatactcttgaaatgtagaatt

SEQ ID NO: 5825412 - DNA, 18 bp, Homo sapiens
aatactcttgatttcaca

SEQ ID NO: 5825413 - DNA, 14 bp, Homo sapiens
aatactctttattt

SEQ ID NO: 5825414 - DNA, 15 bp, Homo sapiens
aatactgaaatgctt

SEQ ID NO: 5825415 - DNA, 20 bp, Homo sapiens
aatactgaaccacttgtaga

SEQ ID NO: 5825416 - DNA, 18 bp, Homo sapiens
aatactgaaccactttga

SEQ ID NO: 5825417 - DNA, 16 bp, Homo sapiens
aatactgacaatgtat

SEQ ID NO: 5825418 - DNA, 23 bp, Homo sapiens
aatactgactccaaccattcaaa

SEQ ID NO: 5825419 - DNA, 14 bp, Homo sapiens
aatactgagaaaaa

SEQ ID NO: 5825420 - DNA, 16 bp, Homo sapiens
aatactgagaaaaagt

SEQ ID NO: 5825421 - DNA, 18 bp, Homo sapiens
aatactgatggaattttt

SEQ ID NO: 5825422 - DNA, 23 bp, Homo sapiens
aatactgcacactgcacatttgc

SEQ ID NO: 5825423 - DNA, 22 bp, Homo sapiens
aatactgccaaaacatttatga

SEQ ID NO: 5825424 - DNA, 24 bp, Homo sapiens
aatactgccagatgctgatgttca

SEQ ID NO: 5825425 - DNA, 22 bp, Homo sapiens
aatactgctctgaatattttgt

SEQ ID NO: 5825426 - DNA, 18 bp, Homo sapiens
aatactgctgagatacat

SEQ ID NO: 5825427 - DNA, 19 bp, Homo sapiens
aatactggaataatttgta

SEQ ID NO: 5825428 - DNA, 20 bp, Homo sapiens
aatactggaataatttgtaa

SEQ ID NO: 5825429 - DNA, 21 bp, Homo sapiens
aatactggaataatttgtaaa

SEQ ID NO: 5825430 - DNA, 11 bp, Homo sapiens
aatactggtct

SEQ ID NO: 5825431 - DNA, 13 bp, Homo sapiens
aatactggtctca

SEQ ID NO: 5825432 - DNA, 15 bp, Homo sapiens
aatactggtctcagg

SEQ ID NO: 5825433 - DNA, 15 bp, Homo sapiens
aatactgtacagggg

SEQ ID NO: 5825434 - DNA, 16 bp, Homo sapiens
aatactgtacatagat

SEQ ID NO: 5825435 - DNA, 19 bp, Homo sapiens
aatactgtatcagatgtga

SEQ ID NO: 5825436 - DNA, 19 bp, Homo sapiens
aatactgtatgccttctgt

SEQ ID NO: 5825437 - DNA, 18 bp, Homo sapiens
aatactgtattgttacag

SEQ ID NO: 5825438 - DNA, 15 bp, Homo sapiens
aatactgtctgtatc

SEQ ID NO: 5825439 - DNA, 15 bp, Homo sapiens
aatactgtgtggaac

SEQ ID NO: 5825440 - DNA, 19 bp, Homo sapiens
aatactgtgttacctttta

SEQ ID NO: 5825441 - DNA, 22 bp, Homo sapiens
aatactgttatatctaaattta

SEQ ID NO: 5825442 - DNA, 15 bp, Homo sapiens
aatactgttttaaaa

SEQ ID NO: 5825443 - DNA, 15 bp, Homo sapiens
aatactgttttatct

SEQ ID NO: 5825444 - DNA, 18 bp, Homo sapiens
aatacttaaaaatagtct

SEQ ID NO: 5825445 - DNA, 23 bp, Homo sapiens
aatacttaaaaatatgtgagcat

SEQ ID NO: 5825446 - DNA, 17 bp, Homo sapiens
aatacttaaatatttgt

SEQ ID NO: 5825447 - DNA, 14 bp, Homo sapiens
aatacttacctaat

SEQ ID NO: 5825448 - DNA, 19 bp, Homo sapiens
aatacttactgttaactgt

SEQ ID NO: 5825449 - DNA, 21 bp, Homo sapiens
aatacttattaaaaaatttgt

SEQ ID NO: 5825450 - DNA, 13 bp, Homo sapiens
aatacttattcat

SEQ ID NO: 5825451 - DNA, 11 bp, Homo sapiens
aatacttattt

SEQ ID NO: 5825452 - DNA, 21 bp, Homo sapiens
aatacttattttcagtgcatc

SEQ ID NO: 5825453 - DNA, 11 bp, Homo sapiens
aatacttcatg

SEQ ID NO: 5825454 - DNA, 13 bp, Homo sapiens
aatacttcatgat

SEQ ID NO: 5825455 - DNA, 20 bp, Homo sapiens
aatacttcatttggtgctgg

SEQ ID NO: 5825456 - DNA, 22 bp, Homo sapiens
aatacttccttataaaaattct

SEQ ID NO: 5825457 - DNA, 17 bp, Homo sapiens
aatacttcgatgatgat

SEQ ID NO: 5825458 - DNA, 22 bp, Homo sapiens
aatacttctcattttttaaaaa

SEQ ID NO: 5825459 - DNA, 23 bp, Homo sapiens
aatacttctgagaccttgtttca

SEQ ID NO: 5825460 - DNA, 18 bp, Homo sapiens
aatacttctgcaactcat

SEQ ID NO: 5825461 - DNA, 17 bp, Homo sapiens
aatacttcttgtgtgta

SEQ ID NO: 5825462 - DNA, 21 bp, Homo sapiens
aatacttgaaaacttctcatt

SEQ ID NO: 5825463 - DNA, 13 bp, Homo sapiens
aatacttgaactt

SEQ ID NO: 5825464 - DNA, 16 bp, Homo sapiens
aatacttgaatatgga

SEQ ID NO: 5825465 - DNA, 17 bp, Homo sapiens
aatacttgaatatggaa

SEQ ID NO: 5825466 - DNA, 15 bp, Homo sapiens
aatacttgactcatt

SEQ ID NO: 5825467 - DNA, 16 bp, Homo sapiens
aatacttgagaaattt

SEQ ID NO: 5825468 - DNA, 11 bp, Homo sapiens
aatacttgagc

SEQ ID NO: 5825469 - DNA, 12 bp, Homo sapiens
aatacttgcaac

SEQ ID NO: 5825470 - DNA, 20 bp, Homo sapiens
aatacttgcaactaaggaca

SEQ ID NO: 5825471 - DNA, 12 bp, Homo sapiens
aatacttgcagt

SEQ ID NO: 5825472 - DNA, 13 bp, Homo sapiens
aatacttgtaatt

SEQ ID NO: 5825473 - DNA, 17 bp, Homo sapiens
aatacttgtcaatattt

SEQ ID NO: 5825474 - DNA, 15 bp, Homo sapiens
aatacttgtctgttt

SEQ ID NO: 5825475 - DNA, 14 bp, Homo sapiens
aatactttatttct

SEQ ID NO: 5825476 - DNA, 17 bp, Homo sapiens
aatactttccatgtttt

SEQ ID NO: 5825477 - DNA, 23 bp, Homo sapiens
aatactttctatgtgacatttct

SEQ ID NO: 5825478 - DNA, 17 bp, Homo sapiens
aatactttgaatgtgtt

SEQ ID NO: 5825479 - DNA, 20 bp, Homo sapiens
aatactttgaatgtgtttca

SEQ ID NO: 5825480 - DNA, 17 bp, Homo sapiens
aatactttgaatgttgt

SEQ ID NO: 5825481 - DNA, 16 bp, Homo sapiens
aatactttgcttcata

SEQ ID NO: 5825482 - DNA, 23 bp, Homo sapiens
aatactttgtcctaagagattta

SEQ ID NO: 5825483 - DNA, 15 bp, Homo sapiens
aatactttgtgtctt

SEQ ID NO: 5825484 - DNA, 20 bp, Homo sapiens
aatactttgtttattgtaaa

SEQ ID NO: 5825485 - DNA, 22 bp, Homo sapiens
aatactttgtttattgtaaaac

SEQ ID NO: 5825486 - DNA, 18 bp, Homo sapiens
aatacttttactctgcct

SEQ ID NO: 5825487 - DNA, 13 bp, Homo sapiens
aatacttttcctt

SEQ ID NO: 5825488 - DNA, 17 bp, Homo sapiens
aatataaccaatgttta

SEQ ID NO: 5825489 - DNA, 21 bp, Homo sapiens
aatataaccaatgtttaaaaa

SEQ ID NO: 5825490 - DNA, 19 bp, Homo sapiens
aatataaccattacatgtt

SEQ ID NO: 5825491 - DNA, 18 bp, Homo sapiens
aatataactatgtggctg

SEQ ID NO: 5825492 - DNA, 16 bp, Homo sapiens
aatataagaaaatgct

SEQ ID NO: 5825493 - DNA, 16 bp, Homo sapiens
aatataagaataaaat

SEQ ID NO: 5825494 - DNA, 12 bp, Homo sapiens
aatataagaatc

SEQ ID NO: 5825495 - DNA, 11 bp, Homo sapiens
aatataagaca

SEQ ID NO: 5825496 - DNA, 18 bp, Homo sapiens
aatataagacaagtctga

SEQ ID NO: 5825497 - DNA, 23 bp, Homo sapiens
aatataagacatttgtttgctgt

SEQ ID NO: 5825498 - DNA, 14 bp, Homo sapiens
aatataagcataaa

SEQ ID NO: 5825499 - DNA, 17 bp, Homo sapiens
aatataagcataaaaga

SEQ ID NO: 5825500 - DNA, 17 bp, Homo sapiens
aatataagcttaaaata

SEQ ID NO: 5825501 - DNA, 17 bp, Homo sapiens
aatataagtaaagtgat

SEQ ID NO: 5825502 - DNA, 14 bp, Homo sapiens
aatataagtaatga

SEQ ID NO: 5825503 - DNA, 16 bp, Homo sapiens
aatataagtaatgaag

SEQ ID NO: 5825504 - DNA, 21 bp, Homo sapiens
aatataagtggtgcttagaaa

SEQ ID NO: 5825505 - DNA, 17 bp, Homo sapiens
aatataagtttctttgc

SEQ ID NO: 5825506 - DNA, 15 bp, Homo sapiens
aatataataaaagtt

SEQ ID NO: 5825507 - DNA, 17 bp, Homo sapiens
aatataataatgatgat

SEQ ID NO: 5825508 - DNA, 23 bp, Homo sapiens
aatataataatgtcctttccctg

SEQ ID NO: 5825509 - DNA, 17 bp, Homo sapiens
aatataatacacaaaat

SEQ ID NO: 5825510 - DNA, 13 bp, Homo sapiens
aatataatattgt

SEQ ID NO: 5825511 - DNA, 20 bp, Homo sapiens
aatataatggcctcttaaaa

SEQ ID NO: 5825512 - DNA, 17 bp, Homo sapiens
aatataatgtattttct

SEQ ID NO: 5825513 - DNA, 16 bp, Homo sapiens
aatataattctgtaaa

SEQ ID NO: 5825514 - DNA, 15 bp, Homo sapiens
aatataattgtttta

SEQ ID NO: 5825515 - DNA, 14 bp, Homo sapiens
aatataatttaaca

SEQ ID NO: 5825516 - DNA, 19 bp, Homo sapiens
aatataatttataagcatt

SEQ ID NO: 5825517 - DNA, 23 bp, Homo sapiens
aatataattttggtaattttgat

SEQ ID NO: 5825518 - DNA, 16 bp, Homo sapiens
aatatacaaacatgtg

SEQ ID NO: 5825519 - DNA, 14 bp, Homo sapiens
aatatacaatctat

SEQ ID NO: 5825520 - DNA, 16 bp, Homo sapiens
aatatacacattttgt

SEQ ID NO: 5825521 - DNA, 16 bp, Homo sapiens
aatatacactttacat

SEQ ID NO: 5825522 - DNA, 14 bp, Homo sapiens
aatatacagtttga

SEQ ID NO: 5825523 - DNA, 17 bp, Homo sapiens
aatatacagtttgactt

SEQ ID NO: 5825524 - DNA, 23 bp, Homo sapiens
aatatacatgaagaatagaaaca

SEQ ID NO: 5825525 - DNA, 19 bp, Homo sapiens
aatatacattcaaacttaa

SEQ ID NO: 5825526 - DNA, 20 bp, Homo sapiens
aatataccccaaattgtgta

SEQ ID NO: 5825527 - DNA, 15 bp, Homo sapiens
aatataccttattta

SEQ ID NO: 5825528 - DNA, 16 bp, Homo sapiens
aatataccttatttat

SEQ ID NO: 5825529 - DNA, 21 bp, Homo sapiens
aatataccttttttgttccac

SEQ ID NO: 5825530 - DNA, 19 bp, Homo sapiens
aatatactaaccatttctt

SEQ ID NO: 5825531 - DNA, 22 bp, Homo sapiens
aatatactaaccatttcttatg

SEQ ID NO: 5825532 - DNA, 12 bp, Homo sapiens
aatatactaata

SEQ ID NO: 5825533 - DNA, 13 bp, Homo sapiens
aatatactaataa

SEQ ID NO: 5825534 - DNA, 21 bp, Homo sapiens
aatatactcaagtttcaggta

SEQ ID NO: 5825535 - DNA, 19 bp, Homo sapiens
aatatactccttaaaaatg

SEQ ID NO: 5825536 - DNA, 21 bp, Homo sapiens
aatatactgagctgctaaaat

SEQ ID NO: 5825537 - DNA, 22 bp, Homo sapiens
aatatactgagctgctaaaata

SEQ ID NO: 5825538 - DNA, 11 bp, Homo sapiens
aatatactgta

SEQ ID NO: 5825539 - DNA, 15 bp, Homo sapiens
aatatactgtcttgt

SEQ ID NO: 5825540 - DNA, 13 bp, Homo sapiens
aatatacttaaaa

SEQ ID NO: 5825541 - DNA, 17 bp, Homo sapiens
aatatacttctgctgtg

SEQ ID NO: 5825542 - DNA, 14 bp, Homo sapiens
aatatactttactt

SEQ ID NO: 5825543 - DNA, 19 bp, Homo sapiens
aatatacttttacaagtaa

SEQ ID NO: 5825544 - DNA, 22 bp, Homo sapiens
aatatagaaaaaaacattctat

SEQ ID NO: 5825545 - DNA, 13 bp, Homo sapiens
aatatagaaacac

SEQ ID NO: 5825546 - DNA, 14 bp, Homo sapiens
aatatagaaacacg

SEQ ID NO: 5825547 - DNA, 15 bp, Homo sapiens
aatatagaagcattt

SEQ ID NO: 5825548 - DNA, 20 bp, Homo sapiens
aatatagaatttttaatgtt

SEQ ID NO: 5825549 - DNA, 16 bp, Homo sapiens
aatatagacagtgccc

SEQ ID NO: 5825550 - DNA, 20 bp, Homo sapiens
aatatagagacaggacagaa

SEQ ID NO: 5825551 - DNA, 12 bp, Homo sapiens
aatatagatgtt

SEQ ID NO: 5825552 - DNA, 15 bp, Homo sapiens
aatatagcaaatgca

SEQ ID NO: 5825553 - DNA, 19 bp, Homo sapiens
aatatagcagacgtatatt

SEQ ID NO: 5825554 - DNA, 14 bp, Homo sapiens
aatatagcatcttt

SEQ ID NO: 5825555 - DNA, 14 bp, Homo sapiens
aatatagcctgcct

SEQ ID NO: 5825556 - DNA, 15 bp, Homo sapiens
aatatagctgagact

SEQ ID NO: 5825557 - DNA, 16 bp, Homo sapiens
aatataggaacttaaa

SEQ ID NO: 5825558 - DNA, 14 bp, Homo sapiens
aatataggaagcat

SEQ ID NO: 5825559 - DNA, 23 bp, Homo sapiens
aatataggataagaaataagaat

SEQ ID NO: 5825560 - DNA, 20 bp, Homo sapiens
aatataggatagacactgga

SEQ ID NO: 5825561 - DNA, 21 bp, Homo sapiens
aatataggatagacactggac

SEQ ID NO: 5825562 - DNA, 18 bp, Homo sapiens
aatatagggtttgtttgc

SEQ ID NO: 5825563 - DNA, 21 bp, Homo sapiens
aatatagggttttttttaatg

SEQ ID NO: 5825564 - DNA, 18 bp, Homo sapiens
aatataggtcctgtgtta

SEQ ID NO: 5825565 - DNA, 23 bp, Homo sapiens
aatataggtctcttctcccagaa

SEQ ID NO: 5825566 - DNA, 20 bp, Homo sapiens
aatatagtaggggttgaaga

SEQ ID NO: 5825567 - DNA, 22 bp, Homo sapiens
aatatagtaggggttgaagaaa

SEQ ID NO: 5825568 - DNA, 16 bp, Homo sapiens
aatatagtgaagcaat

SEQ ID NO: 5825569 - DNA, 12 bp, Homo sapiens
aatatagttaat

SEQ ID NO: 5825570 - DNA, 22 bp, Homo sapiens
aatatagttaattgtggcttta

SEQ ID NO: 5825571 - DNA, 16 bp, Homo sapiens
aatatagttgaaagta

SEQ ID NO: 5825572 - DNA, 18 bp, Homo sapiens
aatatagttgaacaagat

SEQ ID NO: 5825573 - DNA, 13 bp, Homo sapiens
aatatagttgtct

SEQ ID NO: 5825574 - DNA, 21 bp, Homo sapiens
aatatagttgtctttctttgc

SEQ ID NO: 5825575 - DNA, 23 bp, Homo sapiens
aatatagtttggaaataaaaatg

SEQ ID NO: 5825576 - DNA, 21 bp, Homo sapiens
aatatagttttctaactcctg

SEQ ID NO: 5825577 - DNA, 23 bp, Homo sapiens
aatatagttttttctttcccatg

SEQ ID NO: 5825578 - DNA, 12 bp, Homo sapiens
aatatataaaaa

SEQ ID NO: 5825579 - DNA, 19 bp, Homo sapiens
aatatataaaagaaatata

SEQ ID NO: 5825580 - DNA, 22 bp, Homo sapiens
aatatataaaagaaatatatct

SEQ ID NO: 5825581 - DNA, 12 bp, Homo sapiens
aatatataaaca

SEQ ID NO: 5825582 - DNA, 23 bp, Homo sapiens
aatatataaacaaacaaacaaaa

SEQ ID NO: 5825583 - DNA, 15 bp, Homo sapiens
aatatataaacactc

SEQ ID NO: 5825584 - DNA, 21 bp, Homo sapiens
aatatataaacactccacagt

SEQ ID NO: 5825585 - DNA, 13 bp, Homo sapiens
aatatataaacga

SEQ ID NO: 5825586 - DNA, 11 bp, Homo sapiens
aatatataaat

SEQ ID NO: 5825587 - DNA, 12 bp, Homo sapiens
aatatataatat

SEQ ID NO: 5825588 - DNA, 14 bp, Homo sapiens
aatatataatattc

SEQ ID NO: 5825589 - DNA, 14 bp, Homo sapiens
aatatataatggtt

SEQ ID NO: 5825590 - DNA, 20 bp, Homo sapiens
aatatataatggtttactgc

SEQ ID NO: 5825591 - DNA, 14 bp, Homo sapiens
aatatataatttaa

SEQ ID NO: 5825592 - DNA, 23 bp, Homo sapiens
aatatatacacatagttctgtaa

SEQ ID NO: 5825593 - DNA, 23 bp, Homo sapiens
aatatatacagattcctgttgtg

SEQ ID NO: 5825594 - DNA, 20 bp, Homo sapiens
aatatatacatattcaaagt

SEQ ID NO: 5825595 - DNA, 21 bp, Homo sapiens
aatatatacatattcaaagta

SEQ ID NO: 5825596 - DNA, 15 bp, Homo sapiens
aatatatacattttt

SEQ ID NO: 5825597 - DNA, 19 bp, Homo sapiens
aatatatacgaacaaaaca

SEQ ID NO: 5825598 - DNA, 23 bp, Homo sapiens
aatatatagaatgatctattgct

SEQ ID NO: 5825599 - DNA, 21 bp, Homo sapiens
aatatatagtgggtacatcaa

SEQ ID NO: 5825600 - DNA, 16 bp, Homo sapiens
aatatatataaagaat

SEQ ID NO: 5825601 - DNA, 14 bp, Homo sapiens
aatatatataaata

SEQ ID NO: 5825602 - DNA, 20 bp, Homo sapiens
aatatatataaataaatgtt

SEQ ID NO: 5825603 - DNA, 16 bp, Homo sapiens
aatatatataaattga

SEQ ID NO: 5825604 - DNA, 14 bp, Homo sapiens
aatatatataatac

SEQ ID NO: 5825605 - DNA, 17 bp, Homo sapiens
aatatatatataaaata

SEQ ID NO: 5825606 - DNA, 18 bp, Homo sapiens
aatatatatatatataaa

SEQ ID NO: 5825607 - DNA, 21 bp, Homo sapiens
aatatatatatatatcagttt

SEQ ID NO: 5825608 - DNA, 16 bp, Homo sapiens
aatatatatcaaatat

SEQ ID NO: 5825609 - DNA, 12 bp, Homo sapiens
aatatatatcta

SEQ ID NO: 5825610 - DNA, 15 bp, Homo sapiens
aatatatatgatcat

SEQ ID NO: 5825611 - DNA, 19 bp, Homo sapiens
aatatatatgatcattgaa

SEQ ID NO: 5825612 - DNA, 15 bp, Homo sapiens
aatatatatggaata

SEQ ID NO: 5825613 - DNA, 18 bp, Homo sapiens
aatatatatggaataagt

SEQ ID NO: 5825614 - DNA, 15 bp, Homo sapiens
aatatatatggtcat

SEQ ID NO: 5825615 - DNA, 19 bp, Homo sapiens
aatatatatgtatataaaa

SEQ ID NO: 5825616 - DNA, 18 bp, Homo sapiens
aatatatatgttgatttc

SEQ ID NO: 5825617 - DNA, 22 bp, Homo sapiens
aatatatatgttgatttcttgt

SEQ ID NO: 5825618 - DNA, 13 bp, Homo sapiens
aatatatattaag

SEQ ID NO: 5825619 - DNA, 23 bp, Homo sapiens
aatatatattactactcctttgg

SEQ ID NO: 5825620 - DNA, 14 bp, Homo sapiens
aatatatattatac

SEQ ID NO: 5825621 - DNA, 23 bp, Homo sapiens
aatatatattatacttgtaatta

SEQ ID NO: 5825622 - DNA, 18 bp, Homo sapiens
aatatatattatcttttc

SEQ ID NO: 5825623 - DNA, 14 bp, Homo sapiens
aatatatattattc

SEQ ID NO: 5825624 - DNA, 14 bp, Homo sapiens
aatatatatttatc

SEQ ID NO: 5825625 - DNA, 14 bp, Homo sapiens
aatatatattttaa

SEQ ID NO: 5825626 - DNA, 16 bp, Homo sapiens
aatatatattttaagg

SEQ ID NO: 5825627 - DNA, 14 bp, Homo sapiens
aatatatatttttc

SEQ ID NO: 5825628 - DNA, 22 bp, Homo sapiens
aatatatcccagaaattagaaa

SEQ ID NO: 5825629 - DNA, 19 bp, Homo sapiens
aatatatcctgaaagcatt

SEQ ID NO: 5825630 - DNA, 16 bp, Homo sapiens
aatatatcctgtttgt

SEQ ID NO: 5825631 - DNA, 21 bp, Homo sapiens
aatatatcctgtttgtatttt

SEQ ID NO: 5825632 - DNA, 17 bp, Homo sapiens
aatatatctaaattgaa

SEQ ID NO: 5825633 - DNA, 18 bp, Homo sapiens
aatatatctaaattgaat

SEQ ID NO: 5825634 - DNA, 19 bp, Homo sapiens
aatatatctagaactatca

SEQ ID NO: 5825635 - DNA, 16 bp, Homo sapiens
aatatatctgtaaaga

SEQ ID NO: 5825636 - DNA, 20 bp, Homo sapiens
aatatatctgtaaagataat

SEQ ID NO: 5825637 - DNA, 22 bp, Homo sapiens
aatatatctgttggagaaagaa

SEQ ID NO: 5825638 - DNA, 13 bp, Homo sapiens
aatatatctttgt

SEQ ID NO: 5825639 - DNA, 16 bp, Homo sapiens
aatatatctttgtaaa

SEQ ID NO: 5825640 - DNA, 14 bp, Homo sapiens
aatatatgaaataa

SEQ ID NO: 5825641 - DNA, 16 bp, Homo sapiens
aatatatgaacattag

SEQ ID NO: 5825642 - DNA, 21 bp, Homo sapiens
aatatatgaagacaataattc

SEQ ID NO: 5825643 - DNA, 21 bp, Homo sapiens
aatatatgccttgtataatat

SEQ ID NO: 5825644 - DNA, 19 bp, Homo sapiens
aatatatggcagagttgta

SEQ ID NO: 5825645 - DNA, 20 bp, Homo sapiens
aatatatggcagagttgtaa

SEQ ID NO: 5825646 - DNA, 13 bp, Homo sapiens
aatatatggcatt

SEQ ID NO: 5825647 - DNA, 14 bp, Homo sapiens
aatatatggcattt

SEQ ID NO: 5825648 - DNA, 16 bp, Homo sapiens
aatatatggcatttgc

SEQ ID NO: 5825649 - DNA, 22 bp, Homo sapiens
aatatatggcatttgcagattt

SEQ ID NO: 5825650 - DNA, 17 bp, Homo sapiens
aatatatggtctaatgt

SEQ ID NO: 5825651 - DNA, 19 bp, Homo sapiens
aatatatggtctaatgttt

SEQ ID NO: 5825652 - DNA, 21 bp, Homo sapiens
aatatatgtaaattataagta

SEQ ID NO: 5825653 - DNA, 14 bp, Homo sapiens
aatatatgtaatat

SEQ ID NO: 5825654 - DNA, 15 bp, Homo sapiens
aatatatgtaatata

SEQ ID NO: 5825655 - DNA, 13 bp, Homo sapiens
aatatatgtatgt

SEQ ID NO: 5825656 - DNA, 21 bp, Homo sapiens
aatatatgtattatttataat

SEQ ID NO: 5825657 - DNA, 13 bp, Homo sapiens
aatatatgtattt

SEQ ID NO: 5825658 - DNA, 13 bp, Homo sapiens
aatatatgtctat

SEQ ID NO: 5825659 - DNA, 14 bp, Homo sapiens
aatatatgtgaaag

SEQ ID NO: 5825660 - DNA, 15 bp, Homo sapiens
aatatatgttctgca

SEQ ID NO: 5825661 - DNA, 23 bp, Homo sapiens
aatatatgttctgcaagaattaa

SEQ ID NO: 5825662 - DNA, 18 bp, Homo sapiens
aatatatgttgaatgtta

SEQ ID NO: 5825663 - DNA, 13 bp, Homo sapiens
aatatatgtttac

SEQ ID NO: 5825664 - DNA, 22 bp, Homo sapiens
aatatatgtttggctgaaatta

SEQ ID NO: 5825665 - DNA, 11 bp, Homo sapiens
aatatattaaa

SEQ ID NO: 5825666 - DNA, 22 bp, Homo sapiens
aatattaccaactacattggaa

SEQ ID NO: 5825667 - DNA, 15 bp, Homo sapiens
aatattaccatctta

SEQ ID NO: 5825668 - DNA, 20 bp, Homo sapiens
aatattaccatcttaatctt

SEQ ID NO: 5825669 - DNA, 22 bp, Homo sapiens
aatattactcagtttatgttgt

SEQ ID NO: 5825670 - DNA, 21 bp, Homo sapiens
aatattactgtctttattctt

SEQ ID NO: 5825671 - DNA, 16 bp, Homo sapiens
aatattactttaacat

SEQ ID NO: 5825672 - DNA, 22 bp, Homo sapiens
aatattagaataaagttcctgt

SEQ ID NO: 5825673 - DNA, 16 bp, Homo sapiens
aatattagatgctctg

SEQ ID NO: 5825674 - DNA, 21 bp, Homo sapiens
aatattagatgctctgagaaa

SEQ ID NO: 5825675 - DNA, 22 bp, Homo sapiens
aatattagatgctctgagaaat

SEQ ID NO: 5825676 - DNA, 14 bp, Homo sapiens
aatattagatgtga

SEQ ID NO: 5825677 - DNA, 18 bp, Homo sapiens
aatattagatgtgattta

SEQ ID NO: 5825678 - DNA, 19 bp, Homo sapiens
aatattagatgtgatttaa

SEQ ID NO: 5825679 - DNA, 15 bp, Homo sapiens
aatattagctttact

SEQ ID NO: 5825680 - DNA, 18 bp, Homo sapiens
aatattagctttactgtt

SEQ ID NO: 5825681 - DNA, 18 bp, Homo sapiens
aatattaggcataaatta

SEQ ID NO: 5825682 - DNA, 15 bp, Homo sapiens
aatattagtgattct

SEQ ID NO: 5825683 - DNA, 18 bp, Homo sapiens
aatattagtgattctgat

SEQ ID NO: 5825684 - DNA, 19 bp, Homo sapiens
aatattagtgattctgatt

SEQ ID NO: 5825685 - DNA, 20 bp, Homo sapiens
aatattagtgattctgattt

SEQ ID NO: 5825686 - DNA, 14 bp, Homo sapiens
aatattagttaatg

SEQ ID NO: 5825687 - DNA, 21 bp, Homo sapiens
aatattataaatccaaagtaa

SEQ ID NO: 5825688 - DNA, 16 bp, Homo sapiens
aatattatactaagaa

SEQ ID NO: 5825689 - DNA, 15 bp, Homo sapiens
aatattatctttgta

SEQ ID NO: 5825690 - DNA, 16 bp, Homo sapiens
aatattatgattttat

SEQ ID NO: 5825691 - DNA, 19 bp, Homo sapiens
aatattatttgatgatact

SEQ ID NO: 5825692 - DNA, 20 bp, Homo sapiens
aatattatttgtgtttccta

SEQ ID NO: 5825693 - DNA, 13 bp, Homo sapiens
aatattcaagtaa

SEQ ID NO: 5825694 - DNA, 15 bp, Homo sapiens
aatattcaataaagc

SEQ ID NO: 5825695 - DNA, 12 bp, Homo sapiens
aatattcactct

SEQ ID NO: 5825696 - DNA, 16 bp, Homo sapiens
aatattcactctccat

SEQ ID NO: 5825697 - DNA, 16 bp, Homo sapiens
aatattcactgggcca

SEQ ID NO: 5825698 - DNA, 19 bp, Homo sapiens
aatattcagacaaaatgga

SEQ ID NO: 5825699 - DNA, 21 bp, Homo sapiens
aatattcagacaaaatggata

SEQ ID NO: 5825700 - DNA, 23 bp, Homo sapiens
aatattcagacaaaatggataca

SEQ ID NO: 5825701 - DNA, 18 bp, Homo sapiens
aatattcagccagcttaa

SEQ ID NO: 5825702 - DNA, 19 bp, Homo sapiens
aatattcagtaacttgttt

SEQ ID NO: 5825703 - DNA, 19 bp, Homo sapiens
aatattcatacaacaaaga

SEQ ID NO: 5825704 - DNA, 20 bp, Homo sapiens
aatattcatattggaaaaat

SEQ ID NO: 5825705 - DNA, 12 bp, Homo sapiens
aatattcatctg

SEQ ID NO: 5825706 - DNA, 15 bp, Homo sapiens
aatattcatgctgcc

SEQ ID NO: 5825707 - DNA, 18 bp, Homo sapiens
aatattcatgctgcctgc

SEQ ID NO: 5825708 - DNA, 18 bp, Homo sapiens
aatattcatgcttgccat

SEQ ID NO: 5825709 - DNA, 18 bp, Homo sapiens
aatattctaaaaaagata

SEQ ID NO: 5825710 - DNA, 15 bp, Homo sapiens
aatattctaacattt

SEQ ID NO: 5825711 - DNA, 17 bp, Homo sapiens
aatattctacacatgta

SEQ ID NO: 5825712 - DNA, 18 bp, Homo sapiens
aatattctacacatgtaa

SEQ ID NO: 5825713 - DNA, 12 bp, Homo sapiens
aatattctagaa

SEQ ID NO: 5825714 - DNA, 19 bp, Homo sapiens
aatattctattttgcagat

SEQ ID NO: 5825715 - DNA, 22 bp, Homo sapiens
aatattctattttgcagataga

SEQ ID NO: 5825716 - DNA, 19 bp, Homo sapiens
aatattctccccacccacc

SEQ ID NO: 5825717 - DNA, 14 bp, Homo sapiens
aatattctctattt

SEQ ID NO: 5825718 - DNA, 18 bp, Homo sapiens
aatattctctatttgaat

SEQ ID NO: 5825719 - DNA, 16 bp, Homo sapiens
aatattctctccgcca

SEQ ID NO: 5825720 - DNA, 21 bp, Homo sapiens
aatattctctgtacatattag

SEQ ID NO: 5825721 - DNA, 17 bp, Homo sapiens
aatattctgaatcacca

SEQ ID NO: 5825722 - DNA, 19 bp, Homo sapiens
aatattctgaatcaccaat

SEQ ID NO: 5825723 - DNA, 18 bp, Homo sapiens
aatattctgttttgttaa

SEQ ID NO: 5825724 - DNA, 23 bp, Homo sapiens
aatattcttgtccacattctact

SEQ ID NO: 5825725 - DNA, 14 bp, Homo sapiens
aatattctttctca

SEQ ID NO: 5825726 - DNA, 13 bp, Homo sapiens
aatattcttttgt

SEQ ID NO: 5825727 - DNA, 16 bp, Homo sapiens
aatattcttttgttat

SEQ ID NO: 5825728 - DNA, 18 bp, Homo sapiens
aatattcttttgtttcca

SEQ ID NO: 5825729 - DNA, 15 bp, Homo sapiens
aatattgaaaattga

SEQ ID NO: 5825730 - DNA, 15 bp, Homo sapiens
aatattgaacttttt

SEQ ID NO: 5825731 - DNA, 16 bp, Homo sapiens
aatattgaagaatttg

SEQ ID NO: 5825732 - DNA, 14 bp, Homo sapiens
aatattgaagtact

SEQ ID NO: 5825733 - DNA, 14 bp, Homo sapiens
aatattgaagttgt

SEQ ID NO: 5825734 - DNA, 24 bp, Homo sapiens
aatattgaagttgtttatcaactt

SEQ ID NO: 5825735 - DNA, 22 bp, Homo sapiens
aatattgaataagtattcttca

SEQ ID NO: 5825736 - DNA, 15 bp, Homo sapiens
aatattgaatgcctt

SEQ ID NO: 5825737 - DNA, 16 bp, Homo sapiens
aatattgaatgcctta

SEQ ID NO: 5825738 - DNA, 13 bp, Homo sapiens
aatattgaatttt

SEQ ID NO: 5825739 - DNA, 22 bp, Homo sapiens
aatattgaatttttatttttga

SEQ ID NO: 5825740 - DNA, 14 bp, Homo sapiens
aatattgacactta

SEQ ID NO: 5825741 - DNA, 12 bp, Homo sapiens
aatattgacatt

SEQ ID NO: 5825742 - DNA, 16 bp, Homo sapiens
aatattgacatttgta

SEQ ID NO: 5825743 - DNA, 18 bp, Homo sapiens
aatattgactcaaaccat

SEQ ID NO: 5825744 - DNA, 20 bp, Homo sapiens
aatattgagaaagaaactaa

SEQ ID NO: 5825745 - DNA, 16 bp, Homo sapiens
aatattgaggctgcag

SEQ ID NO: 5825746 - DNA, 20 bp, Homo sapiens
aatattgaggctgcagcagg

SEQ ID NO: 5825747 - DNA, 18 bp, Homo sapiens
aatattgaggctttgtgt

SEQ ID NO: 5825748 - DNA, 20 bp, Homo sapiens
aatattgaggctttgtgttg

SEQ ID NO: 5825749 - DNA, 18 bp, Homo sapiens
aatattgatctgtattaa

SEQ ID NO: 5825750 - DNA, 16 bp, Homo sapiens
aatattgattgggaaa

SEQ ID NO: 5825751 - DNA, 20 bp, Homo sapiens
aatattgattgggaaaacat

SEQ ID NO: 5825752 - DNA, 12 bp, Homo sapiens
aatattgatttc

SEQ ID NO: 5825753 - DNA, 17 bp, Homo sapiens
aatattgattttaaata

SEQ ID NO: 5825754 - DNA, 14 bp, Homo sapiens
aatattgcaaaata

SEQ ID NO: 5825755 - DNA, 18 bp, Homo sapiens
aatattgcaaaatacatg

SEQ ID NO: 5825756 - DNA, 19 bp, Homo sapiens
aatattgcaaaatacatga

SEQ ID NO: 5825757 - DNA, 21 bp, Homo sapiens
aatattgcccaaataatattt

SEQ ID NO: 5825758 - DNA, 20 bp, Homo sapiens
aatattgccttgatgtttct

SEQ ID NO: 5825759 - DNA, 21 bp, Homo sapiens
aatattgccttgatgtttcta

SEQ ID NO: 5825760 - DNA, 12 bp, Homo sapiens
aatattgctaaa

SEQ ID NO: 5825761 - DNA, 16 bp, Homo sapiens
aatattgctaaaagca

SEQ ID NO: 5825762 - DNA, 17 bp, Homo sapiens
aatattgctaaaagcat

SEQ ID NO: 5825763 - DNA, 16 bp, Homo sapiens
aatattgctaaaagtg

SEQ ID NO: 5825764 - DNA, 13 bp, Homo sapiens
aatattgctgatg

SEQ ID NO: 5825765 - DNA, 22 bp, Homo sapiens
aatattgctgtgtcttcatttt

SEQ ID NO: 5825766 - DNA, 13 bp, Homo sapiens
aatattgcttcaa

SEQ ID NO: 5825767 - DNA, 16 bp, Homo sapiens
aatattgcttcaattt

SEQ ID NO: 5825768 - DNA, 20 bp, Homo sapiens
aatattgcttcaatttcaaa

SEQ ID NO: 5825769 - DNA, 11 bp, Homo sapiens
aatattgcttg

SEQ ID NO: 5825770 - DNA, 20 bp, Homo sapiens
aatattgctttggtcatatg

SEQ ID NO: 5825771 - DNA, 16 bp, Homo sapiens
aatattggtattaaag

SEQ ID NO: 5825772 - DNA, 21 bp, Homo sapiens
aatattggtgctatttaacat

SEQ ID NO: 5825773 - DNA, 14 bp, Homo sapiens
aatattggttagta

SEQ ID NO: 5825774 - DNA, 21 bp, Homo sapiens
aatattgtaaatgctattata

SEQ ID NO: 5825775 - DNA, 14 bp, Homo sapiens
aatattgtacagtt

SEQ ID NO: 5825776 - DNA, 17 bp, Homo sapiens
aatattgtacagttttt

SEQ ID NO: 5825777 - DNA, 23 bp, Homo sapiens
aatattgtacagtttttattgct

SEQ ID NO: 5825778 - DNA, 14 bp, Homo sapiens
aatattgtatattt

SEQ ID NO: 5825779 - DNA, 19 bp, Homo sapiens
aatattgtattgctgctgt

SEQ ID NO: 5825780 - DNA, 21 bp, Homo sapiens
aatattgtattgctgctgtgc

SEQ ID NO: 5825781 - DNA, 23 bp, Homo sapiens
aatattgtattttagatatattc

SEQ ID NO: 5825782 - DNA, 14 bp, Homo sapiens
aatattgtcatctt

SEQ ID NO: 5825783 - DNA, 16 bp, Homo sapiens
aatattgtcatgttta

SEQ ID NO: 5825784 - DNA, 21 bp, Homo sapiens
aatattgtgcatgctagtgtt

SEQ ID NO: 5825785 - DNA, 18 bp, Homo sapiens
aatattgtggctccctgg

SEQ ID NO: 5825786 - DNA, 10 bp, Homo sapiens
aatattgtgt

SEQ ID NO: 5825787 - DNA, 17 bp, Homo sapiens
aatattgtgttgtgaat

SEQ ID NO: 5825788 - DNA, 14 bp, Homo sapiens
aatattgttaaggg

SEQ ID NO: 5825789 - DNA, 20 bp, Homo sapiens
aatattgttgacaactgtga

SEQ ID NO: 5825790 - DNA, 22 bp, Homo sapiens
aatattgttgacaactgtgact

SEQ ID NO: 5825791 - DNA, 19 bp, Homo sapiens
aatattgttgtataatttc

SEQ ID NO: 5825792 - DNA, 17 bp, Homo sapiens
aatattgttgtttacca

SEQ ID NO: 5825793 - DNA, 12 bp, Homo sapiens
aatattgtttaa

SEQ ID NO: 5825794 - DNA, 18 bp, Homo sapiens
aatattgtttaatgcaaa

SEQ ID NO: 5825795 - DNA, 22 bp, Homo sapiens
aatattgtttaatgcaaatgaa

SEQ ID NO: 5825796 - DNA, 23 bp, Homo sapiens
aatattgtttctgcattcatttt

SEQ ID NO: 5825797 - DNA, 19 bp, Homo sapiens
aatattgtttctttatcac

SEQ ID NO: 5825798 - DNA, 14 bp, Homo sapiens
aatattgtttttct

SEQ ID NO: 5825799 - DNA, 14 bp, Homo sapiens
aatatttaaaaatg

SEQ ID NO: 5825800 - DNA, 16 bp, Homo sapiens
aatatttaaacagcag

SEQ ID NO: 5825801 - DNA, 17 bp, Homo sapiens
aatatttaaacagcagt

SEQ ID NO: 5825802 - DNA, 13 bp, Homo sapiens
aatatttaaacat

SEQ ID NO: 5825803 - DNA, 20 bp, Homo sapiens
aatatttaaacctttttctt

SEQ ID NO: 5825804 - DNA, 15 bp, Homo sapiens
aatatttaaatttat

SEQ ID NO: 5825805 - DNA, 21 bp, Homo sapiens
aatatttaacattatttatat

SEQ ID NO: 5825806 - DNA, 16 bp, Homo sapiens
aatatttaagaaaagc

SEQ ID NO: 5825807 - DNA, 17 bp, Homo sapiens
aatatttaagaaaagca

SEQ ID NO: 5825808 - DNA, 18 bp, Homo sapiens
aatatttaagaaaagcac

SEQ ID NO: 5825809 - DNA, 17 bp, Homo sapiens
aatatttaagatagttt

SEQ ID NO: 5825810 - DNA, 23 bp, Homo sapiens
aatatttaagcaataaaactgct

SEQ ID NO: 5825811 - DNA, 16 bp, Homo sapiens
aatatttaagtatata

SEQ ID NO: 5825812 - DNA, 23 bp, Homo sapiens
aatatttaagtatatagtatatt

SEQ ID NO: 5825813 - DNA, 13 bp, Homo sapiens
aatatttaagtga

SEQ ID NO: 5825814 - DNA, 18 bp, Homo sapiens
aatatttaagtttgttgc

SEQ ID NO: 5825815 - DNA, 15 bp, Homo sapiens
aatatttaatgatgt

SEQ ID NO: 5825816 - DNA, 16 bp, Homo sapiens
aatatttacaatgtat

SEQ ID NO: 5825817 - DNA, 17 bp, Homo sapiens
aatatttacaatgtatt

SEQ ID NO: 5825818 - DNA, 15 bp, Homo sapiens
aatatttacatatga

SEQ ID NO: 5825819 - DNA, 14 bp, Homo sapiens
aatatttaccttga

SEQ ID NO: 5825820 - DNA, 16 bp, Homo sapiens
aatatttactatttca

SEQ ID NO: 5825821 - DNA, 12 bp, Homo sapiens
aatatttagaaa

SEQ ID NO: 5825822 - DNA, 14 bp, Homo sapiens
aatatttagctgta

SEQ ID NO: 5825823 - DNA, 15 bp, Homo sapiens
aatatttaggcaaga

SEQ ID NO: 5825824 - DNA, 23 bp, Homo sapiens
aatatttagtctaagatgattca

SEQ ID NO: 5825825 - DNA, 13 bp, Homo sapiens
aatatttataaaa

SEQ ID NO: 5825826 - DNA, 16 bp, Homo sapiens
aatatttataaatgaa

SEQ ID NO: 5825827 - DNA, 23 bp, Homo sapiens
aatatttataaatgaagatgcat

SEQ ID NO: 5825828 - DNA, 12 bp, Homo sapiens
aatatttataac

SEQ ID NO: 5825829 - DNA, 18 bp, Homo sapiens
aatatttataattaaaga

SEQ ID NO: 5825830 - DNA, 19 bp, Homo sapiens
aatatttataattaaagaa

SEQ ID NO: 5825831 - DNA, 15 bp, Homo sapiens
aatatttataggtca

SEQ ID NO: 5825832 - DNA, 14 bp, Homo sapiens
aatatttatatatt

SEQ ID NO: 5825833 - DNA, 14 bp, Homo sapiens
aatatttatgaaga

SEQ ID NO: 5825834 - DNA, 15 bp, Homo sapiens
aatatttatgaagaa

SEQ ID NO: 5825835 - DNA, 22 bp, Homo sapiens
aatatttatgaagaaaatactt

SEQ ID NO: 5825836 - DNA, 15 bp, Homo sapiens
aatatttatgacctc

SEQ ID NO: 5825837 - DNA, 16 bp, Homo sapiens
aatatttatgactttc

SEQ ID NO: 5825838 - DNA, 13 bp, Homo sapiens
aatatttatggat

SEQ ID NO: 5825839 - DNA, 15 bp, Homo sapiens
aatatttattaaatt

SEQ ID NO: 5825840 - DNA, 16 bp, Homo sapiens
aatatttattaaattt

SEQ ID NO: 5825841 - DNA, 14 bp, Homo sapiens
aatatttattacct

SEQ ID NO: 5825842 - DNA, 18 bp, Homo sapiens
aatatttattacctctga

SEQ ID NO: 5825843 - DNA, 14 bp, Homo sapiens
aatatttattgctt

SEQ ID NO: 5825844 - DNA, 11 bp, Homo sapiens
aatatttattt

SEQ ID NO: 5825845 - DNA, 17 bp, Homo sapiens
aatcagagtagaaataa

SEQ ID NO: 5825846 - DNA, 18 bp, Homo sapiens
aatcagagtagaaataaa

SEQ ID NO: 5825847 - DNA, 19 bp, Homo sapiens
aatcagagtgtacaaattg

SEQ ID NO: 5825848 - DNA, 22 bp, Homo sapiens
aatcagatgatggccatttcta

SEQ ID NO: 5825849 - DNA, 18 bp, Homo sapiens
aatcagatgcctcagagg

SEQ ID NO: 5825850 - DNA, 19 bp, Homo sapiens
aatcagatggtgtcattta

SEQ ID NO: 5825851 - DNA, 17 bp, Homo sapiens
aatcagattagaccagt

SEQ ID NO: 5825852 - DNA, 20 bp, Homo sapiens
aatcagattgacagcatata

SEQ ID NO: 5825853 - DNA, 20 bp, Homo sapiens
aatcagcaaacacaataaga

SEQ ID NO: 5825854 - DNA, 22 bp, Homo sapiens
aatcagcaacttctagcatata

SEQ ID NO: 5825855 - DNA, 18 bp, Homo sapiens
aatcagcaatattgcctg

SEQ ID NO: 5825856 - DNA, 20 bp, Homo sapiens
aatcagcacagataaaaagt

SEQ ID NO: 5825857 - DNA, 14 bp, Homo sapiens
aatcagcactgaaa

SEQ ID NO: 5825858 - DNA, 18 bp, Homo sapiens
aatcagcattctcactcc

SEQ ID NO: 5825859 - DNA, 19 bp, Homo sapiens
aatcagcattctcactcct

SEQ ID NO: 5825860 - DNA, 18 bp, Homo sapiens
aatcagccaattatgtta

SEQ ID NO: 5825861 - DNA, 21 bp, Homo sapiens
aatcagccaattatgttaaac

SEQ ID NO: 5825862 - DNA, 16 bp, Homo sapiens
aatcagcccccagcct

SEQ ID NO: 5825863 - DNA, 22 bp, Homo sapiens
aatcagccgcaaggatccttcc

SEQ ID NO: 5825864 - DNA, 16 bp, Homo sapiens
aatcagcctagttgat

SEQ ID NO: 5825865 - DNA, 16 bp, Homo sapiens
aatcagcctcttaaag

SEQ ID NO: 5825866 - DNA, 11 bp, Homo sapiens
aatcagcctgc

SEQ ID NO: 5825867 - DNA, 11 bp, Homo sapiens
aatcagccttt

SEQ ID NO: 5825868 - DNA, 21 bp, Homo sapiens
aatcagcctttaggtctttag

SEQ ID NO: 5825869 - DNA, 15 bp, Homo sapiens
aatcagcgctctgta

SEQ ID NO: 5825870 - DNA, 23 bp, Homo sapiens
aatcagctatttactgccaaagg

SEQ ID NO: 5825871 - DNA, 16 bp, Homo sapiens
aatcagctattttgtg

SEQ ID NO: 5825872 - DNA, 17 bp, Homo sapiens
aatcagctgcagctgct

SEQ ID NO: 5825873 - DNA, 19 bp, Homo sapiens
aatcagctgctttgttacc

SEQ ID NO: 5825874 - DNA, 11 bp, Homo sapiens
aatcagctgga

SEQ ID NO: 5825875 - DNA, 14 bp, Homo sapiens
aatcagctggacat

SEQ ID NO: 5825876 - DNA, 14 bp, Homo sapiens
aatcagctgttgca

SEQ ID NO: 5825877 - DNA, 19 bp, Homo sapiens
aatcagctgttgcaggcag

SEQ ID NO: 5825878 - DNA, 18 bp, Homo sapiens
aatcagcttttaataaaa

SEQ ID NO: 5825879 - DNA, 20 bp, Homo sapiens
aatcagcttttaataaaatt

SEQ ID NO: 5825880 - DNA, 21 bp, Homo sapiens
aatcagcttttaataaaattg

SEQ ID NO: 5825881 - DNA, 21 bp, Homo sapiens
aatcagcttttgttctagact

SEQ ID NO: 5825882 - DNA, 24 bp, Homo sapiens
aatcaggaaagagattagaacatt

SEQ ID NO: 5825883 - DNA, 16 bp, Homo sapiens
aatcaggaaaggctgt

SEQ ID NO: 5825884 - DNA, 21 bp, Homo sapiens
aatcaggaatgagtcaatcag

SEQ ID NO: 5825885 - DNA, 11 bp, Homo sapiens
aatcaggagcc

SEQ ID NO: 5825886 - DNA, 14 bp, Homo sapiens
aatcaggagcctgc

SEQ ID NO: 5825887 - DNA, 18 bp, Homo sapiens
aatcaggagcctgctaag

SEQ ID NO: 5825888 - DNA, 17 bp, Homo sapiens
aatcaggattccttctt

SEQ ID NO: 5825889 - DNA, 23 bp, Homo sapiens
aatcaggattttagtgcttgcca

SEQ ID NO: 5825890 - DNA, 22 bp, Homo sapiens
aatcaggcaaggaggaggagtc

SEQ ID NO: 5825891 - DNA, 19 bp, Homo sapiens
aatcaggcccaatatcagt

SEQ ID NO: 5825892 - DNA, 16 bp, Homo sapiens
aatcagggaaactaat

SEQ ID NO: 5825893 - DNA, 22 bp, Homo sapiens
aatcagggaccagctttactgg

SEQ ID NO: 5825894 - DNA, 20 bp, Homo sapiens
aatcagggagcactggaggc

SEQ ID NO: 5825895 - DNA, 18 bp, Homo sapiens
aatcagggaggtcatttt

SEQ ID NO: 5825896 - DNA, 19 bp, Homo sapiens
aatcagggaggtcattttg

SEQ ID NO: 5825897 - DNA, 15 bp, Homo sapiens
aatcaggggccagag

SEQ ID NO: 5825898 - DNA, 16 bp, Homo sapiens
aatcaggtaagatcat

SEQ ID NO: 5825899 - DNA, 19 bp, Homo sapiens
aatcaggttgacagtccct

SEQ ID NO: 5825900 - DNA, 22 bp, Homo sapiens
aatcagtaagaggtgttatttg

SEQ ID NO: 5825901 - DNA, 21 bp, Homo sapiens
aatcagtaatatttatatatt

SEQ ID NO: 5825902 - DNA, 20 bp, Homo sapiens
aatcagtaattaacatatca

SEQ ID NO: 5825903 - DNA, 18 bp, Homo sapiens
aatcagtagaaagctaaa

SEQ ID NO: 5825904 - DNA, 21 bp, Homo sapiens
aatcagtatatttggtttcta

SEQ ID NO: 5825905 - DNA, 21 bp, Homo sapiens
aatcagtatattttctgtatt

SEQ ID NO: 5825906 - DNA, 13 bp, Homo sapiens
aatcagtatcaga

SEQ ID NO: 5825907 - DNA, 18 bp, Homo sapiens
aatcagtatcagaatact

SEQ ID NO: 5825908 - DNA, 19 bp, Homo sapiens
aatcagtatcagaatactt

SEQ ID NO: 5825909 - DNA, 16 bp, Homo sapiens
aatcagtatttccttc

SEQ ID NO: 5825910 - DNA, 19 bp, Homo sapiens
aatcagtcagtgcaaatgt

SEQ ID NO: 5825911 - DNA, 15 bp, Homo sapiens
aatcagtcccctccc

SEQ ID NO: 5825912 - DNA, 17 bp, Homo sapiens
aatcagtcccctcccat

SEQ ID NO: 5825913 - DNA, 17 bp, Homo sapiens
aatcagtctatccacag

SEQ ID NO: 5825914 - DNA, 24 bp, Homo sapiens
aatcagtctcagaatgtcattttg

SEQ ID NO: 5825915 - DNA, 16 bp, Homo sapiens
aatcagtgacatctga

SEQ ID NO: 5825916 - DNA, 16 bp, Homo sapiens
aatcagtgaggtgaga

SEQ ID NO: 5825917 - DNA, 18 bp, Homo sapiens
aatcagtgagtaaataga

SEQ ID NO: 5825918 - DNA, 12 bp, Homo sapiens
aatcagtgatta

SEQ ID NO: 5825919 - DNA, 22 bp, Homo sapiens
aatcagtgccccagatgtacat

SEQ ID NO: 5825920 - DNA, 21 bp, Homo sapiens
aatcagtgcctggtgttctga

SEQ ID NO: 5825921 - DNA, 23 bp, Homo sapiens
aatcagtgcctggtgttctgaag

SEQ ID NO: 5825922 - DNA, 19 bp, Homo sapiens
aatcagtggtgttacattt

SEQ ID NO: 5825923 - DNA, 21 bp, Homo sapiens
aatcagtggtgttacattttc

SEQ ID NO: 5825924 - DNA, 17 bp, Homo sapiens
aatcagtgtagccccaa

SEQ ID NO: 5825925 - DNA, 16 bp, Homo sapiens
aatcagtgtgttacta

SEQ ID NO: 5825926 - DNA, 14 bp, Homo sapiens
aatcagtgttgatt

SEQ ID NO: 5825927 - DNA, 17 bp, Homo sapiens
aatcagtgtttaaataa

SEQ ID NO: 5825928 - DNA, 22 bp, Homo sapiens
aatcagtgtttaaataaagacc

SEQ ID NO: 5825929 - DNA, 17 bp, Homo sapiens
aatcagtgtttggtgta

SEQ ID NO: 5825930 - DNA, 21 bp, Homo sapiens
aatcagttagataaaaataaa

SEQ ID NO: 5825931 - DNA, 18 bp, Homo sapiens
aatcagttatattcttta

SEQ ID NO: 5825932 - DNA, 21 bp, Homo sapiens
aatcagttatattctttaaat

SEQ ID NO: 5825933 - DNA, 22 bp, Homo sapiens
aatcagttatattctttaaatt

SEQ ID NO: 5825934 - DNA, 18 bp, Homo sapiens
aatcagttcattagaaat

SEQ ID NO: 5825935 - DNA, 19 bp, Homo sapiens
aatcagttcattagaaata

SEQ ID NO: 5825936 - DNA, 13 bp, Homo sapiens
aatcagttctgtg

SEQ ID NO: 5825937 - DNA, 14 bp, Homo sapiens
aatcagttctgtgt

SEQ ID NO: 5825938 - DNA, 16 bp, Homo sapiens
aatcagttctgtgtgg

SEQ ID NO: 5825939 - DNA, 19 bp, Homo sapiens
aatcagttctgtgtggtgc

SEQ ID NO: 5825940 - DNA, 23 bp, Homo sapiens
aatcagttctgtgtggtgcattc

SEQ ID NO: 5825941 - DNA, 18 bp, Homo sapiens
aatcagttttgtataact

SEQ ID NO: 5825942 - DNA, 15 bp, Homo sapiens
aatcagttttgtgta

SEQ ID NO: 5825943 - DNA, 14 bp, Homo sapiens
aatcagtttttcat

SEQ ID NO: 5825944 - DNA, 19 bp, Homo sapiens
aatcataacatagttgaaa

SEQ ID NO: 5825945 - DNA, 20 bp, Homo sapiens
aatcataagatatttttcat

SEQ ID NO: 5825946 - DNA, 23 bp, Homo sapiens
aatcataagatatttttcatgat

SEQ ID NO: 5825947 - DNA, 20 bp, Homo sapiens
aatcataattttcaagagaa

SEQ ID NO: 5825948 - DNA, 14 bp, Homo sapiens
aatcatacacagaa

SEQ ID NO: 5825949 - DNA, 13 bp, Homo sapiens
aatcataccagtt

SEQ ID NO: 5825950 - DNA, 22 bp, Homo sapiens
aatcatactgcctactgttact

SEQ ID NO: 5825951 - DNA, 15 bp, Homo sapiens
aatcatacttaacat

SEQ ID NO: 5825952 - DNA, 19 bp, Homo sapiens
aatcatagattattataaa

SEQ ID NO: 5825953 - DNA, 15 bp, Homo sapiens
aatcatagctgtctg

SEQ ID NO: 5825954 - DNA, 15 bp, Homo sapiens
aatcatagtgccata

SEQ ID NO: 5825955 - DNA, 22 bp, Homo sapiens
aatcatagttactgtgtaaact

SEQ ID NO: 5825956 - DNA, 18 bp, Homo sapiens
aatcatataataaatgta

SEQ ID NO: 5825957 - DNA, 16 bp, Homo sapiens
aatcatatagaccaat

SEQ ID NO: 5825958 - DNA, 17 bp, Homo sapiens
aatcatatataataaat

SEQ ID NO: 5825959 - DNA, 16 bp, Homo sapiens
aatcatatcaacttaa

SEQ ID NO: 5825960 - DNA, 15 bp, Homo sapiens
aatcatatgattctg

SEQ ID NO: 5825961 - DNA, 14 bp, Homo sapiens
aatcatatgtgatc

SEQ ID NO: 5825962 - DNA, 17 bp, Homo sapiens
aatcatatgtgatctgt

SEQ ID NO: 5825963 - DNA, 15 bp, Homo sapiens
aatcatatgtgtctt

SEQ ID NO: 5825964 - DNA, 17 bp, Homo sapiens
aatcatattagacttct

SEQ ID NO: 5825965 - DNA, 11 bp, Homo sapiens
aatcatattct

SEQ ID NO: 5825966 - DNA, 15 bp, Homo sapiens
aatcatattctcatg

SEQ ID NO: 5825967 - DNA, 14 bp, Homo sapiens
aatcatattgagaa

SEQ ID NO: 5825968 - DNA, 21 bp, Homo sapiens
aatcatattgagaataattat

SEQ ID NO: 5825969 - DNA, 18 bp, Homo sapiens
aatcatattgatgaaaag

SEQ ID NO: 5825970 - DNA, 19 bp, Homo sapiens
aatcatattgatgaaaaga

SEQ ID NO: 5825971 - DNA, 23 bp, Homo sapiens
aatcatattgatgaaaagattta

SEQ ID NO: 5825972 - DNA, 22 bp, Homo sapiens
aatcatcaaaaagtaattataa

SEQ ID NO: 5825973 - DNA, 19 bp, Homo sapiens
aatcatcaaagtgtttaat

SEQ ID NO: 5825974 - DNA, 12 bp, Homo sapiens
aatcatcaagaa

SEQ ID NO: 5825975 - DNA, 21 bp, Homo sapiens
aatcatcaagagaatttgggg

SEQ ID NO: 5825976 - DNA, 23 bp, Homo sapiens
aatcatcaagagaatttggggct

SEQ ID NO: 5825977 - DNA, 12 bp, Homo sapiens
aatcatcaagta

SEQ ID NO: 5825978 - DNA, 15 bp, Homo sapiens
aatcatcaagtcttt

SEQ ID NO: 5825979 - DNA, 20 bp, Homo sapiens
aatcatcctgaatctgatct

SEQ ID NO: 5825980 - DNA, 19 bp, Homo sapiens
aatcatcctgtcacaaggc

SEQ ID NO: 5825981 - DNA, 23 bp, Homo sapiens
aatcatcctgttttctctgtgac

SEQ ID NO: 5825982 - DNA, 19 bp, Homo sapiens
aatcatccttttttaaaaa

SEQ ID NO: 5825983 - DNA, 14 bp, Homo sapiens
aatcatcgaaaatt

SEQ ID NO: 5825984 - DNA, 21 bp, Homo sapiens
aatcatcgaaaattcatttca

SEQ ID NO: 5825985 - DNA, 22 bp, Homo sapiens
aatcatcgaggtatgtttatat

SEQ ID NO: 5825986 - DNA, 23 bp, Homo sapiens
aatcatcgaggtatgtttatatt

SEQ ID NO: 5825987 - DNA, 20 bp, Homo sapiens
aatcatctattttgatgcag

SEQ ID NO: 5825988 - DNA, 20 bp, Homo sapiens
aatcatctcctttgcagaat

SEQ ID NO: 5825989 - DNA, 15 bp, Homo sapiens
aatcatctgtgtgaa

SEQ ID NO: 5825990 - DNA, 16 bp, Homo sapiens
aatcatcttataatta

SEQ ID NO: 5825991 - DNA, 17 bp, Homo sapiens
aatcatcttataattag

SEQ ID NO: 5825992 - DNA, 13 bp, Homo sapiens
aatcatcttctcc

SEQ ID NO: 5825993 - DNA, 15 bp, Homo sapiens
aatcatcttctcttt

SEQ ID NO: 5825994 - DNA, 21 bp, Homo sapiens
aatcatctttattaagtagat

SEQ ID NO: 5825995 - DNA, 15 bp, Homo sapiens
aatcatctttgtgaa

SEQ ID NO: 5825996 - DNA, 17 bp, Homo sapiens
aatcatgaacagctctg

SEQ ID NO: 5825997 - DNA, 23 bp, Homo sapiens
aatcatgaagtgatataaaagct

SEQ ID NO: 5825998 - DNA, 22 bp, Homo sapiens
aatcatgaatatttcaaaataa

SEQ ID NO: 5825999 - DNA, 22 bp, Homo sapiens
aatcatgaatgtgtaacacagt

SEQ ID NO: 5826000 - DNA, 19 bp, Homo sapiens
aatcatgaattagttttat

SEQ ID NO: 5826001 - DNA, 21 bp, Homo sapiens
aatcatgcctacattagtgag

SEQ ID NO: 5826002 - DNA, 19 bp, Homo sapiens
aatcatgctcatgtatatt

SEQ ID NO: 5826003 - DNA, 23 bp, Homo sapiens
aatcatgctgttctctttgctga

SEQ ID NO: 5826004 - DNA, 21 bp, Homo sapiens
aatcatggaatggttataaaa

SEQ ID NO: 5826005 - DNA, 21 bp, Homo sapiens
aatcatggatttattttttgt

SEQ ID NO: 5826006 - DNA, 22 bp, Homo sapiens
aatcatggatttattttttgta

SEQ ID NO: 5826007 - DNA, 18 bp, Homo sapiens
aatcatgggaattttaac

SEQ ID NO: 5826008 - DNA, 13 bp, Homo sapiens
aatcatgggcatt

SEQ ID NO: 5826009 - DNA, 19 bp, Homo sapiens
aatcatgggcattgctgga

SEQ ID NO: 5826010 - DNA, 22 bp, Homo sapiens
aatcatgggcattgctggactg

SEQ ID NO: 5826011 - DNA, 17 bp, Homo sapiens
aatcatggtgctcagag

SEQ ID NO: 5826012 - DNA, 15 bp, Homo sapiens
aatcatggtttttct

SEQ ID NO: 5826013 - DNA, 13 bp, Homo sapiens
aatcatgtaaatg

SEQ ID NO: 5826014 - DNA, 14 bp, Homo sapiens
aatcatgtacattt

SEQ ID NO: 5826015 - DNA, 13 bp, Homo sapiens
aatcatgtagtat

SEQ ID NO: 5826016 - DNA, 22 bp, Homo sapiens
aatcatgtagtatcaaatatta

SEQ ID NO: 5826017 - DNA, 13 bp, Homo sapiens
aatcatgtagttt

SEQ ID NO: 5826018 - DNA, 16 bp, Homo sapiens
aatcatgtattttgta

SEQ ID NO: 5826019 - DNA, 17 bp, Homo sapiens
aatcatgtccatacact

SEQ ID NO: 5826020 - DNA, 15 bp, Homo sapiens
aatcgtttaatgttt

SEQ ID NO: 5826021 - DNA, 19 bp, Homo sapiens
aatcgtttttgttttaagg

SEQ ID NO: 5826022 - DNA, 20 bp, Homo sapiens
aatctaaaacaaaatctgaa

SEQ ID NO: 5826023 - DNA, 20 bp, Homo sapiens
aatctaaaagctctgttcca

SEQ ID NO: 5826024 - DNA, 13 bp, Homo sapiens
aatctaaaatgat

SEQ ID NO: 5826025 - DNA, 14 bp, Homo sapiens
aatctaaaatgatt

SEQ ID NO: 5826026 - DNA, 14 bp, Homo sapiens
aatctaaaatgtgt

SEQ ID NO: 5826027 - DNA, 13 bp, Homo sapiens
aatctaaaatgtt

SEQ ID NO: 5826028 - DNA, 14 bp, Homo sapiens
aatctaaaatgttt

SEQ ID NO: 5826029 - DNA, 19 bp, Homo sapiens
aatctaaaatgttttatga

SEQ ID NO: 5826030 - DNA, 19 bp, Homo sapiens
aatctaaaatttaaaatta

SEQ ID NO: 5826031 - DNA, 21 bp, Homo sapiens
aatctaaaatttaaaattaat

SEQ ID NO: 5826032 - DNA, 13 bp, Homo sapiens
aatctaaaatttc

SEQ ID NO: 5826033 - DNA, 22 bp, Homo sapiens
aatctaaacctctctaggggaa

SEQ ID NO: 5826034 - DNA, 14 bp, Homo sapiens
aatctaaagccagt

SEQ ID NO: 5826035 - DNA, 16 bp, Homo sapiens
aatctaaatctattta

SEQ ID NO: 5826036 - DNA, 20 bp, Homo sapiens
aatctaaatgattatcttga

SEQ ID NO: 5826037 - DNA, 12 bp, Homo sapiens
aatctaaatgga

SEQ ID NO: 5826038 - DNA, 18 bp, Homo sapiens
aatctaaatggaaccact

SEQ ID NO: 5826039 - DNA, 20 bp, Homo sapiens
aatctaaattaaaaaagaaa

SEQ ID NO: 5826040 - DNA, 20 bp, Homo sapiens
aatctaacaataatatttca

SEQ ID NO: 5826041 - DNA, 13 bp, Homo sapiens
aatctaactacaa

SEQ ID NO: 5826042 - DNA, 20 bp, Homo sapiens
aatctaagaaaaggggagag

SEQ ID NO: 5826043 - DNA, 20 bp, Homo sapiens
aatctaagcagcttattgtt

SEQ ID NO: 5826044 - DNA, 19 bp, Homo sapiens
aatctaagctgtttgccaa

SEQ ID NO: 5826045 - DNA, 23 bp, Homo sapiens
aatctaaggaaaattaatcctca

SEQ ID NO: 5826046 - DNA, 21 bp, Homo sapiens
aatctaaggataatgaaataa

SEQ ID NO: 5826047 - DNA, 15 bp, Homo sapiens
aatctaaggccttcc

SEQ ID NO: 5826048 - DNA, 15 bp, Homo sapiens
aatctaagtgatata

SEQ ID NO: 5826049 - DNA, 20 bp, Homo sapiens
aatctaatattaaaaatatg

SEQ ID NO: 5826050 - DNA, 17 bp, Homo sapiens
aatctaatatttctagt

SEQ ID NO: 5826051 - DNA, 15 bp, Homo sapiens
aatctaatctgaact

SEQ ID NO: 5826052 - DNA, 14 bp, Homo sapiens
aatctaattttttc

SEQ ID NO: 5826053 - DNA, 19 bp, Homo sapiens
aatctacaaacttttataa

SEQ ID NO: 5826054 - DNA, 20 bp, Homo sapiens
aatctacaatctctttttgt

SEQ ID NO: 5826055 - DNA, 17 bp, Homo sapiens
aatctacaccaatgaaa

SEQ ID NO: 5826056 - DNA, 18 bp, Homo sapiens
aatctacaccaatgaaaa

SEQ ID NO: 5826057 - DNA, 23 bp, Homo sapiens
aatctacaccaatgaaaacatgt

SEQ ID NO: 5826058 - DNA, 12 bp, Homo sapiens
aatctacagtgt

SEQ ID NO: 5826059 - DNA, 15 bp, Homo sapiens
aatctacccaaagga

SEQ ID NO: 5826060 - DNA, 15 bp, Homo sapiens
aatctaccttctgta

SEQ ID NO: 5826061 - DNA, 16 bp, Homo sapiens
aatctacgatgttaaa

SEQ ID NO: 5826062 - DNA, 15 bp, Homo sapiens
aatctactaattcca

SEQ ID NO: 5826063 - DNA, 14 bp, Homo sapiens
aatctactccaaat

SEQ ID NO: 5826064 - DNA, 18 bp, Homo sapiens
aatctactcttaaatata

SEQ ID NO: 5826065 - DNA, 20 bp, Homo sapiens
aatctactcttaaatataca

SEQ ID NO: 5826066 - DNA, 22 bp, Homo sapiens
aatctactcttaaatatacaac

SEQ ID NO: 5826067 - DNA, 23 bp, Homo sapiens
aatctactggaaatgtagcactt

SEQ ID NO: 5826068 - DNA, 15 bp, Homo sapiens
aatctactgtatcaa

SEQ ID NO: 5826069 - DNA, 20 bp, Homo sapiens
aatctactgtatcaataaaa

SEQ ID NO: 5826070 - DNA, 21 bp, Homo sapiens
aatctactgtatcaataaaat

SEQ ID NO: 5826071 - DNA, 20 bp, Homo sapiens
aatctactgtggtgttttgt

SEQ ID NO: 5826072 - DNA, 21 bp, Homo sapiens
aatctacttaaccctgacaaa

SEQ ID NO: 5826073 - DNA, 15 bp, Homo sapiens
aatctacttcctaca

SEQ ID NO: 5826074 - DNA, 23 bp, Homo sapiens
aatctacttcctacagagccaaa

SEQ ID NO: 5826075 - DNA, 17 bp, Homo sapiens
aatctacttgttaaaaa

SEQ ID NO: 5826076 - DNA, 17 bp, Homo sapiens
aatctactttaatttat

SEQ ID NO: 5826077 - DNA, 12 bp, Homo sapiens
aatctagaagaa

SEQ ID NO: 5826078 - DNA, 16 bp, Homo sapiens
aatctagaagaaatga

SEQ ID NO: 5826079 - DNA, 17 bp, Homo sapiens
aatctagaagaaatgaa

SEQ ID NO: 5826080 - DNA, 14 bp, Homo sapiens
aatctagaagatgt

SEQ ID NO: 5826081 - DNA, 21 bp, Homo sapiens
aatctagaagatgtgtaaaca

SEQ ID NO: 5826082 - DNA, 15 bp, Homo sapiens
aatctagaatttagt

SEQ ID NO: 5826083 - DNA, 23 bp, Homo sapiens
aatctagagtttatacagtgtac

SEQ ID NO: 5826084 - DNA, 22 bp, Homo sapiens
aatctagatatcgacttgtttt

SEQ ID NO: 5826085 - DNA, 19 bp, Homo sapiens
aatctaggtgtggctgtga

SEQ ID NO: 5826086 - DNA, 15 bp, Homo sapiens
aatctagtatttgta

SEQ ID NO: 5826087 - DNA, 21 bp, Homo sapiens
aatctagttgtcaataaatgg

SEQ ID NO: 5826088 - DNA, 14 bp, Homo sapiens
aatctagtttccta

SEQ ID NO: 5826089 - DNA, 19 bp, Homo sapiens
aatctagttttttttgtaa

SEQ ID NO: 5826090 - DNA, 21 bp, Homo sapiens
aatctataaagaaggataaat

SEQ ID NO: 5826091 - DNA, 12 bp, Homo sapiens
aatctataacat

SEQ ID NO: 5826092 - DNA, 14 bp, Homo sapiens
aatctatagaaagt

SEQ ID NO: 5826093 - DNA, 15 bp, Homo sapiens
aatctatagaaagtg

SEQ ID NO: 5826094 - DNA, 16 bp, Homo sapiens
aatctatagaaagtgt

SEQ ID NO: 5826095 - DNA, 17 bp, Homo sapiens
aatctatagaaagtgtt

SEQ ID NO: 5826096 - DNA, 18 bp, Homo sapiens
aatctatagaaagtgttc

SEQ ID NO: 5826097 - DNA, 16 bp, Homo sapiens
aatctatagcatttaa

SEQ ID NO: 5826098 - DNA, 22 bp, Homo sapiens
aatctatatgattaaagaaaat

SEQ ID NO: 5826099 - DNA, 16 bp, Homo sapiens
aatctatattaaatga

SEQ ID NO: 5826100 - DNA, 22 bp, Homo sapiens
aatctatattaaatgagggttt

SEQ ID NO: 5826101 - DNA, 21 bp, Homo sapiens
aatctatccaaatctgaagat

SEQ ID NO: 5826102 - DNA, 16 bp, Homo sapiens
aatctatctctatata

SEQ ID NO: 5826103 - DNA, 22 bp, Homo sapiens
aatctatgaacctgaaaagggt

SEQ ID NO: 5826104 - DNA, 18 bp, Homo sapiens
aatctatgattccaggtg

SEQ ID NO: 5826105 - DNA, 16 bp, Homo sapiens
aatctatgccaaagat

SEQ ID NO: 5826106 - DNA, 18 bp, Homo sapiens
aatctatggcttatttct

SEQ ID NO: 5826107 - DNA, 22 bp, Homo sapiens
aatctatggcttatttctatga

SEQ ID NO: 5826108 - DNA, 23 bp, Homo sapiens
aatctatgtcgtgttttcaagga

SEQ ID NO: 5826109 - DNA, 15 bp, Homo sapiens
aatctatgtgatttg

SEQ ID NO: 5826110 - DNA, 17 bp, Homo sapiens
aatctatgtgtttctgt

SEQ ID NO: 5826111 - DNA, 18 bp, Homo sapiens
aatctatgtgtttctgta

SEQ ID NO: 5826112 - DNA, 15 bp, Homo sapiens
aatctatgtttataa

SEQ ID NO: 5826113 - DNA, 16 bp, Homo sapiens
aatctattagatttta

SEQ ID NO: 5826114 - DNA, 12 bp, Homo sapiens
aatctattatac

SEQ ID NO: 5826115 - DNA, 22 bp, Homo sapiens
aatctattcataagtctttggt

SEQ ID NO: 5826116 - DNA, 22 bp, Homo sapiens
aatctattcctgtaaataagag

SEQ ID NO: 5826117 - DNA, 18 bp, Homo sapiens
aatctattctcaaagtta

SEQ ID NO: 5826118 - DNA, 21 bp, Homo sapiens
aatctattctgtgttgcatta

SEQ ID NO: 5826119 - DNA, 19 bp, Homo sapiens
aatctattgggattttcta

SEQ ID NO: 5826120 - DNA, 15 bp, Homo sapiens
aatctattgggttca

SEQ ID NO: 5826121 - DNA, 16 bp, Homo sapiens
aatctattgggttcat

SEQ ID NO: 5826122 - DNA, 19 bp, Homo sapiens
aatctattgggttcattat

SEQ ID NO: 5826123 - DNA, 17 bp, Homo sapiens
aatctattgtttctcct

SEQ ID NO: 5826124 - DNA, 13 bp, Homo sapiens
aatctatttaaaa

SEQ ID NO: 5826125 - DNA, 14 bp, Homo sapiens
aatctatttaaaaa

SEQ ID NO: 5826126 - DNA, 20 bp, Homo sapiens
aatctatttaattaggaaaa

SEQ ID NO: 5826127 - DNA, 20 bp, Homo sapiens
aatctatttattaatattta

SEQ ID NO: 5826128 - DNA, 21 bp, Homo sapiens
aatctatttattaatatttaa

SEQ ID NO: 5826129 - DNA, 22 bp, Homo sapiens
aatctatttattggacatgtcc

SEQ ID NO: 5826130 - DNA, 13 bp, Homo sapiens
aatctattttcag

SEQ ID NO: 5826131 - DNA, 14 bp, Homo sapiens
aatctattttgtaa

SEQ ID NO: 5826132 - DNA, 17 bp, Homo sapiens
aatctattttgtaactt

SEQ ID NO: 5826133 - DNA, 15 bp, Homo sapiens
aatctcaaaggagaa

SEQ ID NO: 5826134 - DNA, 22 bp, Homo sapiens
aatctcaaaggagaaaaaaaac

SEQ ID NO: 5826135 - DNA, 12 bp, Homo sapiens
aatctcaaatag

SEQ ID NO: 5826136 - DNA, 19 bp, Homo sapiens
aatctcaatgaagccagct

SEQ ID NO: 5826137 - DNA, 14 bp, Homo sapiens
aatctcaatgcaag

SEQ ID NO: 5826138 - DNA, 17 bp, Homo sapiens
aatctcaattcttccct

SEQ ID NO: 5826139 - DNA, 14 bp, Homo sapiens
aatctcacagcatt

SEQ ID NO: 5826140 - DNA, 16 bp, Homo sapiens
aatctcacagcatttg

SEQ ID NO: 5826141 - DNA, 21 bp, Homo sapiens
aatctcagaatttatctccct

SEQ ID NO: 5826142 - DNA, 13 bp, Homo sapiens
aatctcagacaca

SEQ ID NO: 5826143 - DNA, 22 bp, Homo sapiens
aatctcagaggtagggctgcca

SEQ ID NO: 5826144 - DNA, 19 bp, Homo sapiens
aatctcagcactttgtttc

SEQ ID NO: 5826145 - DNA, 16 bp, Homo sapiens
aatctcagtgctttcc

SEQ ID NO: 5826146 - DNA, 16 bp, Homo sapiens
aatctcagttgatttt

SEQ ID NO: 5826147 - DNA, 22 bp, Homo sapiens
aatctcagttgattttctggat

SEQ ID NO: 5826148 - DNA, 20 bp, Homo sapiens
aatctcagttgtttgcttct

SEQ ID NO: 5826149 - DNA, 16 bp, Homo sapiens
aatctcataatttata

SEQ ID NO: 5826150 - DNA, 22 bp, Homo sapiens
aatctcatacctctgaccaaca

SEQ ID NO: 5826151 - DNA, 19 bp, Homo sapiens
aatctcatctctacaaaaa

SEQ ID NO: 5826152 - DNA, 15 bp, Homo sapiens
aatctcattactgct

SEQ ID NO: 5826153 - DNA, 19 bp, Homo sapiens
aatctcattactgcttcat

SEQ ID NO: 5826154 - DNA, 21 bp, Homo sapiens
aatctcattactgcttcattt

SEQ ID NO: 5826155 - DNA, 15 bp, Homo sapiens
aatctcattatttca

SEQ ID NO: 5826156 - DNA, 20 bp, Homo sapiens
aatctcattatttcaaaatg

SEQ ID NO: 5826157 - DNA, 11 bp, Homo sapiens
aatctcattcc

SEQ ID NO: 5826158 - DNA, 20 bp, Homo sapiens
aatctcatttcaatttataa

SEQ ID NO: 5826159 - DNA, 14 bp, Homo sapiens
aatctccaaaataa

SEQ ID NO: 5826160 - DNA, 18 bp, Homo sapiens
aatctccaaaataaaact

SEQ ID NO: 5826161 - DNA, 15 bp, Homo sapiens
aatctccaactttat

SEQ ID NO: 5826162 - DNA, 20 bp, Homo sapiens
aatctccaactttattttga

SEQ ID NO: 5826163 - DNA, 22 bp, Homo sapiens
aatctccaactttattttgaat

SEQ ID NO: 5826164 - DNA, 23 bp, Homo sapiens
aatctccaactttattttgaatg

SEQ ID NO: 5826165 - DNA, 21 bp, Homo sapiens
aatctccacccaatgaatgat

SEQ ID NO: 5826166 - DNA, 16 bp, Homo sapiens
aatctccagggctcca

SEQ ID NO: 5826167 - DNA, 23 bp, Homo sapiens
aatctccagggctgcccctgtag

SEQ ID NO: 5826168 - DNA, 15 bp, Homo sapiens
aatctccatgtgtac

SEQ ID NO: 5826169 - DNA, 11 bp, Homo sapiens
aatctccatta

SEQ ID NO: 5826170 - DNA, 13 bp, Homo sapiens
aatctccatttct

SEQ ID NO: 5826171 - DNA, 20 bp, Homo sapiens
aatctcccagacttgtttcc

SEQ ID NO: 5826172 - DNA, 16 bp, Homo sapiens
aatctcccatgtgcat

SEQ ID NO: 5826173 - DNA, 19 bp, Homo sapiens
aatctcccgctgctgctgc

SEQ ID NO: 5826174 - DNA, 18 bp, Homo sapiens
aatctcccttcacaagtt

SEQ ID NO: 5826175 - DNA, 16 bp, Homo sapiens
aatctccgtagaattt

SEQ ID NO: 5826176 - DNA, 18 bp, Homo sapiens
aatctcctcttttatctt

SEQ ID NO: 5826177 - DNA, 19 bp, Homo sapiens
aatctcctgagttgtataa

SEQ ID NO: 5826178 - DNA, 13 bp, Homo sapiens
aatctcctgctga

SEQ ID NO: 5826179 - DNA, 15 bp, Homo sapiens
aatctcctggcttta

SEQ ID NO: 5826180 - DNA, 21 bp, Homo sapiens
aatctcctggctttacagaca

SEQ ID NO: 5826181 - DNA, 17 bp, Homo sapiens
aatctcgactctcgtga

SEQ ID NO: 5826182 - DNA, 18 bp, Homo sapiens
aatctcggctcactgcat

SEQ ID NO: 5826183 - DNA, 19 bp, Homo sapiens
aatctcgtcaggctgccag

SEQ ID NO: 5826184 - DNA, 16 bp, Homo sapiens
aatctctaaaattcta

SEQ ID NO: 5826185 - DNA, 22 bp, Homo sapiens
aatctctacccctttcttctcg

SEQ ID NO: 5826186 - DNA, 14 bp, Homo sapiens
aatctctaggaagt

SEQ ID NO: 5826187 - DNA, 13 bp, Homo sapiens
aatctctatactg

SEQ ID NO: 5826188 - DNA, 15 bp, Homo sapiens
aatctctcaaaatgt

SEQ ID NO: 5826189 - DNA, 17 bp, Homo sapiens
aatctctcaaaatgtgc

SEQ ID NO: 5826190 - DNA, 22 bp, Homo sapiens
aatctctcaaaatgtgccgtct

SEQ ID NO: 5826191 - DNA, 22 bp, Homo sapiens
aatctctcaaacggcaacattc

SEQ ID NO: 5826192 - DNA, 19 bp, Homo sapiens
aatctctcaaatctgttat

SEQ ID NO: 5826193 - DNA, 19 bp, Homo sapiens
aatctctcacccagttcag

SEQ ID NO: 5826194 - DNA, 19 bp, Homo sapiens
aatctctcatattcgctag

SEQ ID NO: 5826195 - DNA, 18 bp, Homo sapiens
aatctctccactttcagc

SEQ ID NO: 5826196 - DNA, 14 bp, Homo sapiens
aatctctctctgtt

SEQ ID NO: 5826197 - DNA, 22 bp, Homo sapiens
aatgaatgcaaaattgttttca

SEQ ID NO: 5826198 - DNA, 13 bp, Homo sapiens
aatgaatgcattg

SEQ ID NO: 5826199 - DNA, 19 bp, Homo sapiens
aatgaatgcccaggaagta

SEQ ID NO: 5826200 - DNA, 18 bp, Homo sapiens
aatgaatgccgaatttgg

SEQ ID NO: 5826201 - DNA, 21 bp, Homo sapiens
aatgaatggaggaactttcca

SEQ ID NO: 5826202 - DNA, 22 bp, Homo sapiens
aatgaatggctaagcaaaatgt

SEQ ID NO: 5826203 - DNA, 15 bp, Homo sapiens
aatgaatgtcagtgt

SEQ ID NO: 5826204 - DNA, 20 bp, Homo sapiens
aatgaatgtcagtgtgactg

SEQ ID NO: 5826205 - DNA, 13 bp, Homo sapiens
aatgaatgtcttt

SEQ ID NO: 5826206 - DNA, 13 bp, Homo sapiens
aatgaatgtgtgt

SEQ ID NO: 5826207 - DNA, 16 bp, Homo sapiens
aatgaatgtgtgtggt

SEQ ID NO: 5826208 - DNA, 20 bp, Homo sapiens
aatgaatgtgtgtggttttt

SEQ ID NO: 5826209 - DNA, 17 bp, Homo sapiens
aatgaattaaataaacc

SEQ ID NO: 5826210 - DNA, 15 bp, Homo sapiens
aatgaattaaatatt

SEQ ID NO: 5826211 - DNA, 18 bp, Homo sapiens
aatgaattagttgcattg

SEQ ID NO: 5826212 - DNA, 16 bp, Homo sapiens
aatgaattataacagt

SEQ ID NO: 5826213 - DNA, 17 bp, Homo sapiens
aatgaattataacagtt

SEQ ID NO: 5826214 - DNA, 19 bp, Homo sapiens
aatgaattataacagttat

SEQ ID NO: 5826215 - DNA, 16 bp, Homo sapiens
aatgaattcacccctc

SEQ ID NO: 5826216 - DNA, 23 bp, Homo sapiens
aatgaattcgatgcgtattctgt

SEQ ID NO: 5826217 - DNA, 13 bp, Homo sapiens
aatgaattcttca

SEQ ID NO: 5826218 - DNA, 12 bp, Homo sapiens
aatgaattgaaa

SEQ ID NO: 5826219 - DNA, 18 bp, Homo sapiens
aatgaattgaaaaacaat

SEQ ID NO: 5826220 - DNA, 18 bp, Homo sapiens
aatgaattgaatgctcta

SEQ ID NO: 5826221 - DNA, 17 bp, Homo sapiens
aatgaattgcctttgat

SEQ ID NO: 5826222 - DNA, 15 bp, Homo sapiens
aatgaattgtatttt

SEQ ID NO: 5826223 - DNA, 13 bp, Homo sapiens
aatgaattgtcct

SEQ ID NO: 5826224 - DNA, 23 bp, Homo sapiens
aatgaatttagtgagcataggtg

SEQ ID NO: 5826225 - DNA, 16 bp, Homo sapiens
aatgaatttatcattt

SEQ ID NO: 5826226 - DNA, 18 bp, Homo sapiens
aatgaatttatctttacc

SEQ ID NO: 5826227 - DNA, 17 bp, Homo sapiens
aatgaatttgactggtt

SEQ ID NO: 5826228 - DNA, 17 bp, Homo sapiens
aatgaatttgttctttc

SEQ ID NO: 5826229 - DNA, 23 bp, Homo sapiens
aatgaatttgttctttctgattt

SEQ ID NO: 5826230 - DNA, 13 bp, Homo sapiens
aatgaattttaaa

SEQ ID NO: 5826231 - DNA, 18 bp, Homo sapiens
aatgaattttaaaagcat

SEQ ID NO: 5826232 - DNA, 18 bp, Homo sapiens
aatgacaaagtgttgaaa

SEQ ID NO: 5826233 - DNA, 19 bp, Homo sapiens
aatgacaaatgtattaatg

SEQ ID NO: 5826234 - DNA, 13 bp, Homo sapiens
aatgacaacactt

SEQ ID NO: 5826235 - DNA, 21 bp, Homo sapiens
aatgacaacagaaaaacaatc

SEQ ID NO: 5826236 - DNA, 14 bp, Homo sapiens
aatgacaacagaag

SEQ ID NO: 5826237 - DNA, 16 bp, Homo sapiens
aatgacaacattgcat

SEQ ID NO: 5826238 - DNA, 23 bp, Homo sapiens
aatgacaaggggagggccaggat

SEQ ID NO: 5826239 - DNA, 13 bp, Homo sapiens
aatgacaatatca

SEQ ID NO: 5826240 - DNA, 21 bp, Homo sapiens
aatgacaatatcaatcacatt

SEQ ID NO: 5826241 - DNA, 16 bp, Homo sapiens
aatgacaatcatgtgt

SEQ ID NO: 5826242 - DNA, 23 bp, Homo sapiens
aatgacacactgcggtgtctgca

SEQ ID NO: 5826243 - DNA, 17 bp, Homo sapiens
aatgacactcatataat

SEQ ID NO: 5826244 - DNA, 11 bp, Homo sapiens
aatgacactgt

SEQ ID NO: 5826245 - DNA, 14 bp, Homo sapiens
aatgacagaatgct

SEQ ID NO: 5826246 - DNA, 16 bp, Homo sapiens
aatgacagatgcaagt

SEQ ID NO: 5826247 - DNA, 13 bp, Homo sapiens
aatgacagatggt

SEQ ID NO: 5826248 - DNA, 16 bp, Homo sapiens
aatgacagatttctgt

SEQ ID NO: 5826249 - DNA, 22 bp, Homo sapiens
aatgacaggaacccatcactgt

SEQ ID NO: 5826250 - DNA, 22 bp, Homo sapiens
aatgacaggtttgggacccctg

SEQ ID NO: 5826251 - DNA, 17 bp, Homo sapiens
aatgacagtcaaaagat

SEQ ID NO: 5826252 - DNA, 18 bp, Homo sapiens
aatgacatcaccacagtt

SEQ ID NO: 5826253 - DNA, 18 bp, Homo sapiens
aatgacatcttcaaagct

SEQ ID NO: 5826254 - DNA, 19 bp, Homo sapiens
aatgacatctttttaaagc

SEQ ID NO: 5826255 - DNA, 22 bp, Homo sapiens
aatgacatctttttaaagctta

SEQ ID NO: 5826256 - DNA, 18 bp, Homo sapiens
aatgacatgttcctttaa

SEQ ID NO: 5826257 - DNA, 13 bp, Homo sapiens
aatgacattatta

SEQ ID NO: 5826258 - DNA, 15 bp, Homo sapiens
aatgacattttgcca

SEQ ID NO: 5826259 - DNA, 13 bp, Homo sapiens
aatgacattttgt

SEQ ID NO: 5826260 - DNA, 12 bp, Homo sapiens
aatgaccaaaga

SEQ ID NO: 5826261 - DNA, 18 bp, Homo sapiens
aatgaccaacgaaattgt

SEQ ID NO: 5826262 - DNA, 18 bp, Homo sapiens
aatgaccacgggcctcag

SEQ ID NO: 5826263 - DNA, 19 bp, Homo sapiens
aatgaccacgggcctcagt

SEQ ID NO: 5826264 - DNA, 22 bp, Homo sapiens
aatgaccagaaaatttttgtct

SEQ ID NO: 5826265 - DNA, 14 bp, Homo sapiens
aatgaccagtttac

SEQ ID NO: 5826266 - DNA, 17 bp, Homo sapiens
aatgaccagtttacctg

SEQ ID NO: 5826267 - DNA, 16 bp, Homo sapiens
aatgaccatgttatat

SEQ ID NO: 5826268 - DNA, 19 bp, Homo sapiens
aatgaccattcaattagtg

SEQ ID NO: 5826269 - DNA, 16 bp, Homo sapiens
aatgacccaaacataa

SEQ ID NO: 5826270 - DNA, 16 bp, Homo sapiens
aatgacccaaagacca

SEQ ID NO: 5826271 - DNA, 13 bp, Homo sapiens
aatgacccagata

SEQ ID NO: 5826272 - DNA, 15 bp, Homo sapiens
aatgaccctgtcaag

SEQ ID NO: 5826273 - DNA, 17 bp, Homo sapiens
aatgaccgagccctgga

SEQ ID NO: 5826274 - DNA, 20 bp, Homo sapiens
aatgaccgagccctggagag

SEQ ID NO: 5826275 - DNA, 14 bp, Homo sapiens
aatgacctcagcaa

SEQ ID NO: 5826276 - DNA, 13 bp, Homo sapiens
aatgaccttgagt

SEQ ID NO: 5826277 - DNA, 16 bp, Homo sapiens
aatgaccttgtaatgt

SEQ ID NO: 5826278 - DNA, 20 bp, Homo sapiens
aatgaccttgtaatgtaact

SEQ ID NO: 5826279 - DNA, 17 bp, Homo sapiens
aatgacctttcaatagg

SEQ ID NO: 5826280 - DNA, 22 bp, Homo sapiens
aatgacggctaccacactcatg

SEQ ID NO: 5826281 - DNA, 23 bp, Homo sapiens
aatgacggtaagtgttctcatga

SEQ ID NO: 5826282 - DNA, 14 bp, Homo sapiens
aatgacggtgttaa

SEQ ID NO: 5826283 - DNA, 14 bp, Homo sapiens
aatgacgtatacat

SEQ ID NO: 5826284 - DNA, 14 bp, Homo sapiens
aatgacgtgtgtgg

SEQ ID NO: 5826285 - DNA, 19 bp, Homo sapiens
aatgacgtgtgtggctggg

SEQ ID NO: 5826286 - DNA, 17 bp, Homo sapiens
aatgactaaaaaacaaa

SEQ ID NO: 5826287 - DNA, 17 bp, Homo sapiens
aatgactaaaaatatta

SEQ ID NO: 5826288 - DNA, 14 bp, Homo sapiens
aatgactaagccaa

SEQ ID NO: 5826289 - DNA, 17 bp, Homo sapiens
aatgactaagccaagct

SEQ ID NO: 5826290 - DNA, 21 bp, Homo sapiens
aatgactaagccaagctgtgt

SEQ ID NO: 5826291 - DNA, 16 bp, Homo sapiens
aatgactaattagggt

SEQ ID NO: 5826292 - DNA, 12 bp, Homo sapiens
aatgactactta

SEQ ID NO: 5826293 - DNA, 16 bp, Homo sapiens
aatgactataaacatt

SEQ ID NO: 5826294 - DNA, 15 bp, Homo sapiens
aatgactatataatt

SEQ ID NO: 5826295 - DNA, 18 bp, Homo sapiens
aatgactatgtccagatt

SEQ ID NO: 5826296 - DNA, 16 bp, Homo sapiens
aatgactattgtaatg

SEQ ID NO: 5826297 - DNA, 16 bp, Homo sapiens
aatgactctaaagaaa

SEQ ID NO: 5826298 - DNA, 13 bp, Homo sapiens
aatgactcttccc

SEQ ID NO: 5826299 - DNA, 15 bp, Homo sapiens
aatgactgaaagaag

SEQ ID NO: 5826300 - DNA, 13 bp, Homo sapiens
aatgactgaccca

SEQ ID NO: 5826301 - DNA, 22 bp, Homo sapiens
aatgactgacccaaaatgtgaa

SEQ ID NO: 5826302 - DNA, 12 bp, Homo sapiens
aatgactgagat

SEQ ID NO: 5826303 - DNA, 21 bp, Homo sapiens
aatgactgccctgtttctgtt

SEQ ID NO: 5826304 - DNA, 20 bp, Homo sapiens
aatgactgcgcagagtggat

SEQ ID NO: 5826305 - DNA, 19 bp, Homo sapiens
aatgactggctcctgactt

SEQ ID NO: 5826306 - DNA, 18 bp, Homo sapiens
aatgactggtcttcctta

SEQ ID NO: 5826307 - DNA, 17 bp, Homo sapiens
aatgacttactgtacat

SEQ ID NO: 5826308 - DNA, 18 bp, Homo sapiens
aatgacttactgtacatg

SEQ ID NO: 5826309 - DNA, 13 bp, Homo sapiens
aatgacttagaaa

SEQ ID NO: 5826310 - DNA, 16 bp, Homo sapiens
aatgacttagaaactg

SEQ ID NO: 5826311 - DNA, 22 bp, Homo sapiens
aatgacttattgtggataacaa

SEQ ID NO: 5826312 - DNA, 16 bp, Homo sapiens
aatgacttcatttctg

SEQ ID NO: 5826313 - DNA, 19 bp, Homo sapiens
aatgacttccccaatatct

SEQ ID NO: 5826314 - DNA, 17 bp, Homo sapiens
aatgacttgattgtact

SEQ ID NO: 5826315 - DNA, 19 bp, Homo sapiens
aatgacttgattgtacttg

SEQ ID NO: 5826316 - DNA, 13 bp, Homo sapiens
aatgactttatgt

SEQ ID NO: 5826317 - DNA, 14 bp, Homo sapiens
aatgactttattat

SEQ ID NO: 5826318 - DNA, 20 bp, Homo sapiens
aatgactttatttttctaag

SEQ ID NO: 5826319 - DNA, 12 bp, Homo sapiens
aatgactttgaa

SEQ ID NO: 5826320 - DNA, 13 bp, Homo sapiens
aatgactttgaac

SEQ ID NO: 5826321 - DNA, 12 bp, Homo sapiens
aatgagaaaaaa

SEQ ID NO: 5826322 - DNA, 12 bp, Homo sapiens
aatgagaaagaa

SEQ ID NO: 5826323 - DNA, 16 bp, Homo sapiens
aatgagaaaggacaga

SEQ ID NO: 5826324 - DNA, 12 bp, Homo sapiens
aatgagaaatca

SEQ ID NO: 5826325 - DNA, 12 bp, Homo sapiens
aatgagaaatct

SEQ ID NO: 5826326 - DNA, 14 bp, Homo sapiens
aatgagaaattgtg

SEQ ID NO: 5826327 - DNA, 15 bp, Homo sapiens
aatgagaagagtttt

SEQ ID NO: 5826328 - DNA, 21 bp, Homo sapiens
aatgagaaggccaatagtttt

SEQ ID NO: 5826329 - DNA, 18 bp, Homo sapiens
aatgagaagtaaattatt

SEQ ID NO: 5826330 - DNA, 21 bp, Homo sapiens
aatgagaatgtgccatgtata

SEQ ID NO: 5826331 - DNA, 13 bp, Homo sapiens
aatgagacacata

SEQ ID NO: 5826332 - DNA, 13 bp, Homo sapiens
aatgagacatcca

SEQ ID NO: 5826333 - DNA, 14 bp, Homo sapiens
aatgagactatgcg

SEQ ID NO: 5826334 - DNA, 19 bp, Homo sapiens
aatgagactctagggtcca

SEQ ID NO: 5826335 - DNA, 22 bp, Homo sapiens
aatgagacttgagtctattttt

SEQ ID NO: 5826336 - DNA, 15 bp, Homo sapiens
aatgagacttgctct

SEQ ID NO: 5826337 - DNA, 16 bp, Homo sapiens
aatgagacttgctctc

SEQ ID NO: 5826338 - DNA, 18 bp, Homo sapiens
aatgagacttgttttccc

SEQ ID NO: 5826339 - DNA, 17 bp, Homo sapiens
aatgagactttaaaagc

SEQ ID NO: 5826340 - DNA, 21 bp, Homo sapiens
aatgagactttctaaatcaaa

SEQ ID NO: 5826341 - DNA, 18 bp, Homo sapiens
aatgagagcaaatgcaaa

SEQ ID NO: 5826342 - DNA, 18 bp, Homo sapiens
aatgagagcgacacagac

SEQ ID NO: 5826343 - DNA, 19 bp, Homo sapiens
aatgagagggcagtgtttc

SEQ ID NO: 5826344 - DNA, 20 bp, Homo sapiens
aatgagatatgcaataaata

SEQ ID NO: 5826345 - DNA, 16 bp, Homo sapiens
aatgagatcaggctct

SEQ ID NO: 5826346 - DNA, 21 bp, Homo sapiens
aatgagatcccagagttattt

SEQ ID NO: 5826347 - DNA, 19 bp, Homo sapiens
aatgagatgtgagccttgt

SEQ ID NO: 5826348 - DNA, 19 bp, Homo sapiens
aatgagatgttattactgt

SEQ ID NO: 5826349 - DNA, 15 bp, Homo sapiens
aatgagattcagtga

SEQ ID NO: 5826350 - DNA, 24 bp, Homo sapiens
aatgagattcagtgaactaatttg

SEQ ID NO: 5826351 - DNA, 22 bp, Homo sapiens
aatgagatttctttgaatgtat

SEQ ID NO: 5826352 - DNA, 15 bp, Homo sapiens
aatgagcaaatggaa

SEQ ID NO: 5826353 - DNA, 17 bp, Homo sapiens
aatgagcaagactgggc

SEQ ID NO: 5826354 - DNA, 13 bp, Homo sapiens
aatgagcacctcc

SEQ ID NO: 5826355 - DNA, 16 bp, Homo sapiens
aatgagcagttagaaa

SEQ ID NO: 5826356 - DNA, 13 bp, Homo sapiens
aatgagcatcaga

SEQ ID NO: 5826357 - DNA, 23 bp, Homo sapiens
aatgagcatctcaaatgttttct

SEQ ID NO: 5826358 - DNA, 16 bp, Homo sapiens
aatgagcatgtttaga

SEQ ID NO: 5826359 - DNA, 14 bp, Homo sapiens
aatgagcattagct

SEQ ID NO: 5826360 - DNA, 22 bp, Homo sapiens
aatgagcattgagacggtgctc

SEQ ID NO: 5826361 - DNA, 23 bp, Homo sapiens
aatgagccaataaagctcacact

SEQ ID NO: 5826362 - DNA, 21 bp, Homo sapiens
aatgagccatcactagaagaa

SEQ ID NO: 5826363 - DNA, 14 bp, Homo sapiens
aatgagcccagaga

SEQ ID NO: 5826364 - DNA, 23 bp, Homo sapiens
aatgagccccttcatccgcctgt

SEQ ID NO: 5826365 - DNA, 14 bp, Homo sapiens
aatgagccctggct

SEQ ID NO: 5826366 - DNA, 16 bp, Homo sapiens
aatgagccctggctcc

SEQ ID NO: 5826367 - DNA, 19 bp, Homo sapiens
aatgagccctggctcccac

SEQ ID NO: 5826368 - DNA, 21 bp, Homo sapiens
aatgagcctacgctgaagatg

SEQ ID NO: 5826369 - DNA, 14 bp, Homo sapiens
aatgagcctggcaa

SEQ ID NO: 5826370 - DNA, 15 bp, Homo sapiens
aatgagcctggcaag

SEQ ID NO: 5826371 - DNA, 14 bp, Homo sapiens
aatgagccttaaga

SEQ ID NO: 5826372 - DNA, 15 bp, Homo sapiens
aatgagcctttgtgc

SEQ ID NO: 5826373 - DNA, 13 bp, Homo sapiens
aatgagctgggcc

SEQ ID NO: 5826374 - DNA, 14 bp, Homo sapiens
aatgagctgggccc

SEQ ID NO: 5826375 - DNA, 14 bp, Homo sapiens
aatgagcttaagaa

SEQ ID NO: 5826376 - DNA, 19 bp, Homo sapiens
aatgagcttgattaaatca

SEQ ID NO: 5826377 - DNA, 20 bp, Homo sapiens
aatgccaagtaacaatgcat

SEQ ID NO: 5826378 - DNA, 13 bp, Homo sapiens
aatgccaatctct

SEQ ID NO: 5826379 - DNA, 12 bp, Homo sapiens
aatgccaatgtc

SEQ ID NO: 5826380 - DNA, 13 bp, Homo sapiens
aatgccacagcca

SEQ ID NO: 5826381 - DNA, 17 bp, Homo sapiens
aatgccacagccaagcc

SEQ ID NO: 5826382 - DNA, 18 bp, Homo sapiens
aatgccacagccaagccc

SEQ ID NO: 5826383 - DNA, 16 bp, Homo sapiens
aatgccacagccctgt

SEQ ID NO: 5826384 - DNA, 20 bp, Homo sapiens
aatgccacattttgctttat

SEQ ID NO: 5826385 - DNA, 15 bp, Homo sapiens
aatgccaccaaagga

SEQ ID NO: 5826386 - DNA, 22 bp, Homo sapiens
aatgccacggcagccaccctgc

SEQ ID NO: 5826387 - DNA, 13 bp, Homo sapiens
aatgccactctgg

SEQ ID NO: 5826388 - DNA, 21 bp, Homo sapiens
aatgccactgggacagctggc

SEQ ID NO: 5826389 - DNA, 14 bp, Homo sapiens
aatgccacttaaca

SEQ ID NO: 5826390 - DNA, 15 bp, Homo sapiens
aatgccactttttca

SEQ ID NO: 5826391 - DNA, 16 bp, Homo sapiens
aatgccagaatataat

SEQ ID NO: 5826392 - DNA, 17 bp, Homo sapiens
aatgccagacttctaaa

SEQ ID NO: 5826393 - DNA, 11 bp, Homo sapiens
aatgccagagc

SEQ ID NO: 5826394 - DNA, 15 bp, Homo sapiens
aatgccagagccaac

SEQ ID NO: 5826395 - DNA, 19 bp, Homo sapiens
aatgccagagccaacctgg

SEQ ID NO: 5826396 - DNA, 22 bp, Homo sapiens
aatgccagagccaacctggact

SEQ ID NO: 5826397 - DNA, 12 bp, Homo sapiens
aatgccagccca

SEQ ID NO: 5826398 - DNA, 13 bp, Homo sapiens
aatgccagcccaa

SEQ ID NO: 5826399 - DNA, 19 bp, Homo sapiens
aatgccaggcggacaaagt

SEQ ID NO: 5826400 - DNA, 12 bp, Homo sapiens
aatgccagggcc

SEQ ID NO: 5826401 - DNA, 15 bp, Homo sapiens
aatgccagggcccag

SEQ ID NO: 5826402 - DNA, 13 bp, Homo sapiens
aatgccagtgtgc

SEQ ID NO: 5826403 - DNA, 13 bp, Homo sapiens
aatgccataatac

SEQ ID NO: 5826404 - DNA, 18 bp, Homo sapiens
aatgccataatacaaaag

SEQ ID NO: 5826405 - DNA, 16 bp, Homo sapiens
aatgccatcaataaaa

SEQ ID NO: 5826406 - DNA, 14 bp, Homo sapiens
aatgccatcagccc

SEQ ID NO: 5826407 - DNA, 16 bp, Homo sapiens
aatgccatcagcccct

SEQ ID NO: 5826408 - DNA, 17 bp, Homo sapiens
aatgccatctatctagt

SEQ ID NO: 5826409 - DNA, 21 bp, Homo sapiens
aatgccatgaacaaattcttt

SEQ ID NO: 5826410 - DNA, 13 bp, Homo sapiens
aatgccatgaatt

SEQ ID NO: 5826411 - DNA, 15 bp, Homo sapiens
aatgccatgactgct

SEQ ID NO: 5826412 - DNA, 16 bp, Homo sapiens
aatgccatgactgctc

SEQ ID NO: 5826413 - DNA, 19 bp, Homo sapiens
aatgccatgactgctcagg

SEQ ID NO: 5826414 - DNA, 16 bp, Homo sapiens
aatgccattatccctg

SEQ ID NO: 5826415 - DNA, 20 bp, Homo sapiens
aatgccatttagaatctaga

SEQ ID NO: 5826416 - DNA, 22 bp, Homo sapiens
aatgccattttaaggaaaacta

SEQ ID NO: 5826417 - DNA, 21 bp, Homo sapiens
aatgcccaacagggcaaccaa

SEQ ID NO: 5826418 - DNA, 21 bp, Homo sapiens
aatgcccaactcttcattttg

SEQ ID NO: 5826419 - DNA, 22 bp, Homo sapiens
aatgcccagccagccacccctg

SEQ ID NO: 5826420 - DNA, 22 bp, Homo sapiens
aatgcccagccccttctgaccc

SEQ ID NO: 5826421 - DNA, 24 bp, Homo sapiens
aatgcccagccccttctgacccat

SEQ ID NO: 5826422 - DNA, 22 bp, Homo sapiens
aatgcccaggaagtaattttct

SEQ ID NO: 5826423 - DNA, 22 bp, Homo sapiens
aatgcccagtaaaatttcagga

SEQ ID NO: 5826424 - DNA, 17 bp, Homo sapiens
aatgcccatttttgcta

SEQ ID NO: 5826425 - DNA, 15 bp, Homo sapiens
aatgccccaaacttt

SEQ ID NO: 5826426 - DNA, 14 bp, Homo sapiens
aatgccccaaggac

SEQ ID NO: 5826427 - DNA, 16 bp, Homo sapiens
aatgccccaaggacaa

SEQ ID NO: 5826428 - DNA, 14 bp, Homo sapiens
aatgccccagtgtt

SEQ ID NO: 5826429 - DNA, 14 bp, Homo sapiens
aatgcccccattct

SEQ ID NO: 5826430 - DNA, 18 bp, Homo sapiens
aatgcccgtaatgcttag

SEQ ID NO: 5826431 - DNA, 19 bp, Homo sapiens
aatgcccgtaatgcttaga

SEQ ID NO: 5826432 - DNA, 17 bp, Homo sapiens
aatgccctatgtgtata

SEQ ID NO: 5826433 - DNA, 13 bp, Homo sapiens
aatgccctcagct

SEQ ID NO: 5826434 - DNA, 13 bp, Homo sapiens
aatgccctctctg

SEQ ID NO: 5826435 - DNA, 13 bp, Homo sapiens
aatgccctgccat

SEQ ID NO: 5826436 - DNA, 17 bp, Homo sapiens
aatgccctgccttgctg

SEQ ID NO: 5826437 - DNA, 18 bp, Homo sapiens
aatgcccttacacttact

SEQ ID NO: 5826438 - DNA, 18 bp, Homo sapiens
aatgcccttcactttctc

SEQ ID NO: 5826439 - DNA, 15 bp, Homo sapiens
aatgccgaatttggt

SEQ ID NO: 5826440 - DNA, 22 bp, Homo sapiens
aatgccgaatttggtacacatg

SEQ ID NO: 5826441 - DNA, 15 bp, Homo sapiens
aatgccgctgtctct

SEQ ID NO: 5826442 - DNA, 17 bp, Homo sapiens
aatgccgctgtctctga

SEQ ID NO: 5826443 - DNA, 16 bp, Homo sapiens
aatgcctaaaagtttt

SEQ ID NO: 5826444 - DNA, 14 bp, Homo sapiens
aatgcctaggccag

SEQ ID NO: 5826445 - DNA, 15 bp, Homo sapiens
aatgcctaggccagc

SEQ ID NO: 5826446 - DNA, 18 bp, Homo sapiens
aatgcctcacgagatttg

SEQ ID NO: 5826447 - DNA, 21 bp, Homo sapiens
aatgcctcagtgtatttgtat

SEQ ID NO: 5826448 - DNA, 23 bp, Homo sapiens
aatgcctcagtgtatttgtattt

SEQ ID NO: 5826449 - DNA, 15 bp, Homo sapiens
aatgcctcctgtggg

SEQ ID NO: 5826450 - DNA, 19 bp, Homo sapiens
aatgcctcgctcccttcaa

SEQ ID NO: 5826451 - DNA, 22 bp, Homo sapiens
aatgcctctgccttgatggaga

SEQ ID NO: 5826452 - DNA, 23 bp, Homo sapiens
aatgcctcttaaattatatattt

SEQ ID NO: 5826453 - DNA, 13 bp, Homo sapiens
aatgcctgctgct

SEQ ID NO: 5826454 - DNA, 14 bp, Homo sapiens
aatgcctgctgctg

SEQ ID NO: 5826455 - DNA, 21 bp, Homo sapiens
aatgcctgctttttggaaagt

SEQ ID NO: 5826456 - DNA, 19 bp, Homo sapiens
aatgcctgtgaaaaagaaa

SEQ ID NO: 5826457 - DNA, 15 bp, Homo sapiens
aatgccttactttgt

SEQ ID NO: 5826458 - DNA, 16 bp, Homo sapiens
aatgccttatttttga

SEQ ID NO: 5826459 - DNA, 18 bp, Homo sapiens
aatgccttatttttgaat

SEQ ID NO: 5826460 - DNA, 20 bp, Homo sapiens
aatgccttatttttgaattc

SEQ ID NO: 5826461 - DNA, 18 bp, Homo sapiens
aatgccttcatgaatctt

SEQ ID NO: 5826462 - DNA, 17 bp, Homo sapiens
aatgccttgggagagat

SEQ ID NO: 5826463 - DNA, 13 bp, Homo sapiens
aatgccttggttt

SEQ ID NO: 5826464 - DNA, 18 bp, Homo sapiens
aatgccttggtttgattt

SEQ ID NO: 5826465 - DNA, 17 bp, Homo sapiens
aatgccttgttgtattc

SEQ ID NO: 5826466 - DNA, 18 bp, Homo sapiens
aatgcctttatatttcac

SEQ ID NO: 5826467 - DNA, 21 bp, Homo sapiens
aatgcctttctagcaattgct

SEQ ID NO: 5826468 - DNA, 13 bp, Homo sapiens
aatgcctttgtaa

SEQ ID NO: 5826469 - DNA, 19 bp, Homo sapiens
aatgcgaatggtagtctaa

SEQ ID NO: 5826470 - DNA, 20 bp, Homo sapiens
aatgcgaatggtagtctaac

SEQ ID NO: 5826471 - DNA, 15 bp, Homo sapiens
aatgcgatttcttcc

SEQ ID NO: 5826472 - DNA, 17 bp, Homo sapiens
aatgcgatttcttcctt

SEQ ID NO: 5826473 - DNA, 14 bp, Homo sapiens
aatgcgcaggctgg

SEQ ID NO: 5826474 - DNA, 19 bp, Homo sapiens
aatgcgcaggctggccctg

SEQ ID NO: 5826475 - DNA, 22 bp, Homo sapiens
aatgcgcaggctggccctgccc

SEQ ID NO: 5826476 - DNA, 15 bp, Homo sapiens
aatgcgccaataaac

SEQ ID NO: 5826477 - DNA, 18 bp, Homo sapiens
aatgcgctcttcaccagg

SEQ ID NO: 5826478 - DNA, 22 bp, Homo sapiens
aatgcgctcttcaccaggaaga

SEQ ID NO: 5826479 - DNA, 14 bp, Homo sapiens
aatgcgctttattg

SEQ ID NO: 5826480 - DNA, 18 bp, Homo sapiens
aatgcgggggagcaggca

SEQ ID NO: 5826481 - DNA, 22 bp, Homo sapiens
aatgcggttataaaaaatggtt

SEQ ID NO: 5826482 - DNA, 16 bp, Homo sapiens
aatgcggttgggaggc

SEQ ID NO: 5826483 - DNA, 15 bp, Homo sapiens
aatgcgtcttgtgaa

SEQ ID NO: 5826484 - DNA, 17 bp, Homo sapiens
aatgcgtcttgtgaaat

SEQ ID NO: 5826485 - DNA, 21 bp, Homo sapiens
aatgcgtcttgtgaaattgtg

SEQ ID NO: 5826486 - DNA, 22 bp, Homo sapiens
aatgcgtcttgtgaaattgtgt

SEQ ID NO: 5826487 - DNA, 18 bp, Homo sapiens
aatgcgtgcataccactt

SEQ ID NO: 5826488 - DNA, 21 bp, Homo sapiens
aatgcgtgcataccacttttg

SEQ ID NO: 5826489 - DNA, 21 bp, Homo sapiens
aatgctaaatgtaagaatcat

SEQ ID NO: 5826490 - DNA, 13 bp, Homo sapiens
aatgctaagtcca

SEQ ID NO: 5826491 - DNA, 19 bp, Homo sapiens
aatgctaatttaaagagac

SEQ ID NO: 5826492 - DNA, 16 bp, Homo sapiens
aatgctacaattttaa

SEQ ID NO: 5826493 - DNA, 15 bp, Homo sapiens
aatgctaccaggatg

SEQ ID NO: 5826494 - DNA, 22 bp, Homo sapiens
aatgctaccggggaccgggacc

SEQ ID NO: 5826495 - DNA, 14 bp, Homo sapiens
aatgctacctctga

SEQ ID NO: 5826496 - DNA, 19 bp, Homo sapiens
aatgctacctctgatcaaa

SEQ ID NO: 5826497 - DNA, 20 bp, Homo sapiens
aatgctacctctgatcaaag

SEQ ID NO: 5826498 - DNA, 23 bp, Homo sapiens
aatgctacctctgatcaaagcac

SEQ ID NO: 5826499 - DNA, 19 bp, Homo sapiens
aatgctacgtgtgattttt

SEQ ID NO: 5826500 - DNA, 15 bp, Homo sapiens
aatgctagaaaaatt

SEQ ID NO: 5826501 - DNA, 19 bp, Homo sapiens
aatgctagaaaatcgagtt

SEQ ID NO: 5826502 - DNA, 18 bp, Homo sapiens
aatgctaggttaattcca

SEQ ID NO: 5826503 - DNA, 21 bp, Homo sapiens
aatgctaggttaattccaatt

SEQ ID NO: 5826504 - DNA, 18 bp, Homo sapiens
aatgctatcactgtcttt

SEQ ID NO: 5826505 - DNA, 21 bp, Homo sapiens
aatgctatcagaaatagattt

SEQ ID NO: 5826506 - DNA, 18 bp, Homo sapiens
aatgctatggaaatacat

SEQ ID NO: 5826507 - DNA, 21 bp, Homo sapiens
aatgctatggaaatacattta

SEQ ID NO: 5826508 - DNA, 14 bp, Homo sapiens
aatgctatggactg

SEQ ID NO: 5826509 - DNA, 15 bp, Homo sapiens
aatgctatggactgc

SEQ ID NO: 5826510 - DNA, 16 bp, Homo sapiens
aatgctatgtcatttc

SEQ ID NO: 5826511 - DNA, 22 bp, Homo sapiens
aatgctattatactgttatcca

SEQ ID NO: 5826512 - DNA, 20 bp, Homo sapiens
aatgctatttgtgtaactga

SEQ ID NO: 5826513 - DNA, 18 bp, Homo sapiens
aatgctatttttgttttt

SEQ ID NO: 5826514 - DNA, 23 bp, Homo sapiens
aatgctatttttgtttttagaat

SEQ ID NO: 5826515 - DNA, 17 bp, Homo sapiens
aatgctcaatgtgctgt

SEQ ID NO: 5826516 - DNA, 15 bp, Homo sapiens
aatgctcagaccagc

SEQ ID NO: 5826517 - DNA, 16 bp, Homo sapiens
aatgctcatacacagt

SEQ ID NO: 5826518 - DNA, 18 bp, Homo sapiens
aatgctcattttctggtt

SEQ ID NO: 5826519 - DNA, 21 bp, Homo sapiens
aatgctcattttctttaggac

SEQ ID NO: 5826520 - DNA, 12 bp, Homo sapiens
aatgctccaggc

SEQ ID NO: 5826521 - DNA, 11 bp, Homo sapiens
aatgctccccc

SEQ ID NO: 5826522 - DNA, 23 bp, Homo sapiens
aatgctccttgtggcctttttta

SEQ ID NO: 5826523 - DNA, 21 bp, Homo sapiens
aatgctcgtatctccttgatt

SEQ ID NO: 5826524 - DNA, 16 bp, Homo sapiens
aatgctcgtgtgattt

SEQ ID NO: 5826525 - DNA, 17 bp, Homo sapiens
aatgctcgtgtgatttc

SEQ ID NO: 5826526 - DNA, 14 bp, Homo sapiens
aatgctctatgttt

SEQ ID NO: 5826527 - DNA, 20 bp, Homo sapiens
aatgctctatgtttgtattt

SEQ ID NO: 5826528 - DNA, 21 bp, Homo sapiens
aatgctctatgtttgtatttg

SEQ ID NO: 5826529 - DNA, 19 bp, Homo sapiens
aatgctctctcaaattgtc

SEQ ID NO: 5826530 - DNA, 13 bp, Homo sapiens
aatgctctctctt

SEQ ID NO: 5826531 - DNA, 14 bp, Homo sapiens
aatgctctggagtg

SEQ ID NO: 5826532 - DNA, 13 bp, Homo sapiens
aatgctctgtgcc

SEQ ID NO: 5826533 - DNA, 14 bp, Homo sapiens
aatgctctgtgcca

SEQ ID NO: 5826534 - DNA, 14 bp, Homo sapiens
aatgctcttatttc

SEQ ID NO: 5826535 - DNA, 18 bp, Homo sapiens
aatgctcttttgcacaag

SEQ ID NO: 5826536 - DNA, 18 bp, Homo sapiens
aatgctgaaaatcaaagt

SEQ ID NO: 5826537 - DNA, 15 bp, Homo sapiens
aatgctgaaaattgc

SEQ ID NO: 5826538 - DNA, 18 bp, Homo sapiens
aatgctgaactccttgtt

SEQ ID NO: 5826539 - DNA, 18 bp, Homo sapiens
aatgctgacaatgctgcc

SEQ ID NO: 5826540 - DNA, 12 bp, Homo sapiens
aatgctgagcca

SEQ ID NO: 5826541 - DNA, 16 bp, Homo sapiens
aatgctgagctgaaga

SEQ ID NO: 5826542 - DNA, 19 bp, Homo sapiens
aatgctgagctgaagaaat

SEQ ID NO: 5826543 - DNA, 23 bp, Homo sapiens
aatgctgagctgaagaaattata

SEQ ID NO: 5826544 - DNA, 14 bp, Homo sapiens
aatgctgatattta

SEQ ID NO: 5826545 - DNA, 22 bp, Homo sapiens
aatgctgcacaccagttactgt

SEQ ID NO: 5826546 - DNA, 16 bp, Homo sapiens
aatgctgcattttaat

SEQ ID NO: 5826547 - DNA, 21 bp, Homo sapiens
aatgctgcattttaattttaa

SEQ ID NO: 5826548 - DNA, 11 bp, Homo sapiens
aatgctgccag

SEQ ID NO: 5826549 - DNA, 15 bp, Homo sapiens
aatgctgcctcagga

SEQ ID NO: 5826550 - DNA, 17 bp, Homo sapiens
aatgctgcctcaggacc

SEQ ID NO: 5826551 - DNA, 12 bp, Homo sapiens
aatgctgcctgc

SEQ ID NO: 5826552 - DNA, 14 bp, Homo sapiens
aatgctgcctgcct

SEQ ID NO: 5826553 - DNA, 22 bp, Homo sapiens
aatgctgccttcccatgaatct

SEQ ID NO: 5826554 - DNA, 23 bp, Homo sapiens
aatgctgccttttctttaacttt

SEQ ID NO: 5826555 - DNA, 18 bp, Homo sapiens
aatggtattttttgtgaa

SEQ ID NO: 5826556 - DNA, 19 bp, Homo sapiens
aatggtattttttgtgaat

SEQ ID NO: 5826557 - DNA, 16 bp, Homo sapiens
aatggtcaaatctctc

SEQ ID NO: 5826558 - DNA, 14 bp, Homo sapiens
aatggtccaggaga

SEQ ID NO: 5826559 - DNA, 19 bp, Homo sapiens
aatggtcccatccaggcag

SEQ ID NO: 5826560 - DNA, 21 bp, Homo sapiens
aatggtccgctttcctggagc

SEQ ID NO: 5826561 - DNA, 22 bp, Homo sapiens
aatggtccgtgctaaggacttg

SEQ ID NO: 5826562 - DNA, 17 bp, Homo sapiens
aatggtcctatttttgt

SEQ ID NO: 5826563 - DNA, 14 bp, Homo sapiens
aatggtctctgtca

SEQ ID NO: 5826564 - DNA, 18 bp, Homo sapiens
aatggtgacttaatccgt

SEQ ID NO: 5826565 - DNA, 18 bp, Homo sapiens
aatggtgagaattaaaat

SEQ ID NO: 5826566 - DNA, 19 bp, Homo sapiens
aatggtgagaattaaaata

SEQ ID NO: 5826567 - DNA, 21 bp, Homo sapiens
aatggtgcaaaaaaaaactta

SEQ ID NO: 5826568 - DNA, 17 bp, Homo sapiens
aatggtgcaatgaatta

SEQ ID NO: 5826569 - DNA, 16 bp, Homo sapiens
aatggtgccttcattt

SEQ ID NO: 5826570 - DNA, 22 bp, Homo sapiens
aatggtgcgtggcttccctgtc

SEQ ID NO: 5826571 - DNA, 17 bp, Homo sapiens
aatggtgctataataaa

SEQ ID NO: 5826572 - DNA, 16 bp, Homo sapiens
aatggtgctcatttca

SEQ ID NO: 5826573 - DNA, 18 bp, Homo sapiens
aatggtgctcatttcatg

SEQ ID NO: 5826574 - DNA, 17 bp, Homo sapiens
aatggtgcttaagttcc

SEQ ID NO: 5826575 - DNA, 13 bp, Homo sapiens
aatggtgcttatt

SEQ ID NO: 5826576 - DNA, 13 bp, Homo sapiens
aatggtgcttccc

SEQ ID NO: 5826577 - DNA, 18 bp, Homo sapiens
aatggtgcttggaggggg

SEQ ID NO: 5826578 - DNA, 20 bp, Homo sapiens
aatggtggcttcagctccag

SEQ ID NO: 5826579 - DNA, 23 bp, Homo sapiens
aatggtggcttcagctccagccc

SEQ ID NO: 5826580 - DNA, 15 bp, Homo sapiens
aatggtggcttcttt

SEQ ID NO: 5826581 - DNA, 20 bp, Homo sapiens
aatggtgggaaccctcccca

SEQ ID NO: 5826582 - DNA, 13 bp, Homo sapiens
aatggtgggatta

SEQ ID NO: 5826583 - DNA, 18 bp, Homo sapiens
aatggtgggctccagagt

SEQ ID NO: 5826584 - DNA, 21 bp, Homo sapiens
aatggtggtcttctccaccag

SEQ ID NO: 5826585 - DNA, 15 bp, Homo sapiens
aatggtggtttgtca

SEQ ID NO: 5826586 - DNA, 17 bp, Homo sapiens
aatggtggtttgtcata

SEQ ID NO: 5826587 - DNA, 21 bp, Homo sapiens
aatggtggtttgtcatatatt

SEQ ID NO: 5826588 - DNA, 16 bp, Homo sapiens
aatggtgtacataatg

SEQ ID NO: 5826589 - DNA, 15 bp, Homo sapiens
aatggtgtagaacac

SEQ ID NO: 5826590 - DNA, 21 bp, Homo sapiens
aatggtgtcataactagagca

SEQ ID NO: 5826591 - DNA, 22 bp, Homo sapiens
aatggtgtgaacccgggagcgg

SEQ ID NO: 5826592 - DNA, 18 bp, Homo sapiens
aatggtgtggtgaatgtg

SEQ ID NO: 5826593 - DNA, 16 bp, Homo sapiens
aatggtgtgtttccct

SEQ ID NO: 5826594 - DNA, 18 bp, Homo sapiens
aatggtgttacattaaag

SEQ ID NO: 5826595 - DNA, 18 bp, Homo sapiens
aatggtgttactaaagtc

SEQ ID NO: 5826596 - DNA, 19 bp, Homo sapiens
aatggtgttactaaagtca

SEQ ID NO: 5826597 - DNA, 19 bp, Homo sapiens
aatggtgttgtatgccttt

SEQ ID NO: 5826598 - DNA, 17 bp, Homo sapiens
aatggtgtttttttaat

SEQ ID NO: 5826599 - DNA, 17 bp, Homo sapiens
aatggttaaaatcacta

SEQ ID NO: 5826600 - DNA, 23 bp, Homo sapiens
aatggttaataaaactgcacagt

SEQ ID NO: 5826601 - DNA, 16 bp, Homo sapiens
aatggttataaaagtg

SEQ ID NO: 5826602 - DNA, 22 bp, Homo sapiens
aatggttcagaattaaactttt

SEQ ID NO: 5826603 - DNA, 14 bp, Homo sapiens
aatggttccatgcc

SEQ ID NO: 5826604 - DNA, 15 bp, Homo sapiens
aatggttctgaaata

SEQ ID NO: 5826605 - DNA, 17 bp, Homo sapiens
aatggttgaatgaataa

SEQ ID NO: 5826606 - DNA, 21 bp, Homo sapiens
aatggttgaatgaataaaaca

SEQ ID NO: 5826607 - DNA, 17 bp, Homo sapiens
aatggttgatggaaaat

SEQ ID NO: 5826608 - DNA, 19 bp, Homo sapiens
aatggttgatggaaaataa

SEQ ID NO: 5826609 - DNA, 20 bp, Homo sapiens
aatggttgatggaaaataaa

SEQ ID NO: 5826610 - DNA, 18 bp, Homo sapiens
aatggttgccttaaagaa

SEQ ID NO: 5826611 - DNA, 19 bp, Homo sapiens
aatggttgggacaatggca

SEQ ID NO: 5826612 - DNA, 13 bp, Homo sapiens
aatggttgtatta

SEQ ID NO: 5826613 - DNA, 15 bp, Homo sapiens
aatggttgtattaga

SEQ ID NO: 5826614 - DNA, 18 bp, Homo sapiens
aatggttgtattagatgt

SEQ ID NO: 5826615 - DNA, 19 bp, Homo sapiens
aatggttgtattagatgtt

SEQ ID NO: 5826616 - DNA, 23 bp, Homo sapiens
aatggttgtattagatgttctct

SEQ ID NO: 5826617 - DNA, 12 bp, Homo sapiens
aatggttgtgaa

SEQ ID NO: 5826618 - DNA, 16 bp, Homo sapiens
aatggtttaaatggtc

SEQ ID NO: 5826619 - DNA, 17 bp, Homo sapiens
aatggtttaacttctgc

SEQ ID NO: 5826620 - DNA, 18 bp, Homo sapiens
aatggtttacatgaacac

SEQ ID NO: 5826621 - DNA, 15 bp, Homo sapiens
aatggtttactgctg

SEQ ID NO: 5826622 - DNA, 17 bp, Homo sapiens
aatggtttactgctgtc

SEQ ID NO: 5826623 - DNA, 18 bp, Homo sapiens
aatggtttactgctgtca

SEQ ID NO: 5826624 - DNA, 22 bp, Homo sapiens
aatggtttatagccctgtgaag

SEQ ID NO: 5826625 - DNA, 23 bp, Homo sapiens
aatggtttatagccctgtgaagt

SEQ ID NO: 5826626 - DNA, 22 bp, Homo sapiens
aatggtttattttgtattgtgg

SEQ ID NO: 5826627 - DNA, 14 bp, Homo sapiens
aatggtttcctctg

SEQ ID NO: 5826628 - DNA, 17 bp, Homo sapiens
aatggtttggtgctttt

SEQ ID NO: 5826629 - DNA, 23 bp, Homo sapiens
aatggtttggtgctttttataaa

SEQ ID NO: 5826630 - DNA, 16 bp, Homo sapiens
aatggttttcaaaata

SEQ ID NO: 5826631 - DNA, 16 bp, Homo sapiens
aatggttttcaacaag

SEQ ID NO: 5826632 - DNA, 16 bp, Homo sapiens
aatggttttcttgtgt

SEQ ID NO: 5826633 - DNA, 22 bp, Homo sapiens
aatggttttcttgtgtgtttat

SEQ ID NO: 5826634 - DNA, 15 bp, Homo sapiens
aatggttttgttttg

SEQ ID NO: 5826635 - DNA, 13 bp, Homo sapiens
aatggtttttaaa

SEQ ID NO: 5826636 - DNA, 18 bp, Homo sapiens
aatggtttttatttctcg

SEQ ID NO: 5826637 - DNA, 22 bp, Homo sapiens
aatggtttttgcctaaaatata

SEQ ID NO: 5826638 - DNA, 17 bp, Homo sapiens
aatgtaaaaaagaaaaa

SEQ ID NO: 5826639 - DNA, 19 bp, Homo sapiens
aatgtaaaaagatctacat

SEQ ID NO: 5826640 - DNA, 20 bp, Homo sapiens
aatgtaaaaagatctacata

SEQ ID NO: 5826641 - DNA, 22 bp, Homo sapiens
aatgtaaaaatccttttgaatg

SEQ ID NO: 5826642 - DNA, 21 bp, Homo sapiens
aatgtaaaacacatacaaaag

SEQ ID NO: 5826643 - DNA, 21 bp, Homo sapiens
aatgtaaaagacactggtgta

SEQ ID NO: 5826644 - DNA, 22 bp, Homo sapiens
aatgtaaaataaaggctctgtg

SEQ ID NO: 5826645 - DNA, 17 bp, Homo sapiens
aatgtaaaatgttgaat

SEQ ID NO: 5826646 - DNA, 14 bp, Homo sapiens
aatgtaaactgcca

SEQ ID NO: 5826647 - DNA, 14 bp, Homo sapiens
aatgtaaactgctc

SEQ ID NO: 5826648 - DNA, 14 bp, Homo sapiens
aatgtaaactgttt

SEQ ID NO: 5826649 - DNA, 15 bp, Homo sapiens
aatgtaaagatttgc

SEQ ID NO: 5826650 - DNA, 22 bp, Homo sapiens
aatgtaaagcaaccaaaaagaa

SEQ ID NO: 5826651 - DNA, 17 bp, Homo sapiens
aatgtaaaggagggaga

SEQ ID NO: 5826652 - DNA, 20 bp, Homo sapiens
aatgtaaaggagtcaaaact

SEQ ID NO: 5826653 - DNA, 22 bp, Homo sapiens
aatgtaaaggcaggtttgggaa

SEQ ID NO: 5826654 - DNA, 15 bp, Homo sapiens
aatgtaaataaaaca

SEQ ID NO: 5826655 - DNA, 19 bp, Homo sapiens
aatgtaaataaaacatcac

SEQ ID NO: 5826656 - DNA, 21 bp, Homo sapiens
aatgtaaataaaacatcacta

SEQ ID NO: 5826657 - DNA, 21 bp, Homo sapiens
aatgtaaataaactatttata

SEQ ID NO: 5826658 - DNA, 17 bp, Homo sapiens
aatgtaaatacatcaaa

SEQ ID NO: 5826659 - DNA, 17 bp, Homo sapiens
aatgtaaatattgctgt

SEQ ID NO: 5826660 - DNA, 21 bp, Homo sapiens
aatgtaaatattttaaagaat

SEQ ID NO: 5826661 - DNA, 19 bp, Homo sapiens
aatgtaaatcaaatttgaa

SEQ ID NO: 5826662 - DNA, 12 bp, Homo sapiens
aatgtaaatgtc

SEQ ID NO: 5826663 - DNA, 15 bp, Homo sapiens
aatgtaaatgtctca

SEQ ID NO: 5826664 - DNA, 21 bp, Homo sapiens
aatgtaaattagtttgacact

SEQ ID NO: 5826665 - DNA, 17 bp, Homo sapiens
aatgtaaatttactgag

SEQ ID NO: 5826666 - DNA, 12 bp, Homo sapiens
aatgtaaatttt

SEQ ID NO: 5826667 - DNA, 13 bp, Homo sapiens
aatgtaacactgg

SEQ ID NO: 5826668 - DNA, 22 bp, Homo sapiens
aatgtaacatcataattacatt

SEQ ID NO: 5826669 - DNA, 13 bp, Homo sapiens
aatgtaacatgaa

SEQ ID NO: 5826670 - DNA, 16 bp, Homo sapiens
aatgtaacatgaagca

SEQ ID NO: 5826671 - DNA, 22 bp, Homo sapiens
aatgtaactgaagcataaacat

SEQ ID NO: 5826672 - DNA, 16 bp, Homo sapiens
aatgtaactgctcttg

SEQ ID NO: 5826673 - DNA, 23 bp, Homo sapiens
aatgtaactgttaccattggaaa

SEQ ID NO: 5826674 - DNA, 16 bp, Homo sapiens
aatgtaacttttgtaa

SEQ ID NO: 5826675 - DNA, 12 bp, Homo sapiens
aatgtaagaaaa

SEQ ID NO: 5826676 - DNA, 16 bp, Homo sapiens
aatgtaagaaaacaaa

SEQ ID NO: 5826677 - DNA, 19 bp, Homo sapiens
aatgtaagaaaacaaaatc

SEQ ID NO: 5826678 - DNA, 21 bp, Homo sapiens
aatgtaagaaaacaaaatcta

SEQ ID NO: 5826679 - DNA, 16 bp, Homo sapiens
aatgtaagattataga

SEQ ID NO: 5826680 - DNA, 20 bp, Homo sapiens
aatgtaagattatagattct

SEQ ID NO: 5826681 - DNA, 23 bp, Homo sapiens
aatgtaagattatagattctaaa

SEQ ID NO: 5826682 - DNA, 13 bp, Homo sapiens
aatgtaagctcta

SEQ ID NO: 5826683 - DNA, 13 bp, Homo sapiens
aatgtaaggctgt

SEQ ID NO: 5826684 - DNA, 15 bp, Homo sapiens
aatgtaaggctgtgt

SEQ ID NO: 5826685 - DNA, 19 bp, Homo sapiens
aatgtaagggtctgttgta

SEQ ID NO: 5826686 - DNA, 20 bp, Homo sapiens
aatgtaagggtctgttgtaa

SEQ ID NO: 5826687 - DNA, 23 bp, Homo sapiens
aatgtaaggtatatcattctaaa

SEQ ID NO: 5826688 - DNA, 15 bp, Homo sapiens
aatgtaagtgggccc

SEQ ID NO: 5826689 - DNA, 17 bp, Homo sapiens
aatgtaagttatgtgtt

SEQ ID NO: 5826690 - DNA, 13 bp, Homo sapiens
aatgtaataaagt

SEQ ID NO: 5826691 - DNA, 14 bp, Homo sapiens
aatgtaataaagtg

SEQ ID NO: 5826692 - DNA, 17 bp, Homo sapiens
aatgtaataaagtgaac

SEQ ID NO: 5826693 - DNA, 23 bp, Homo sapiens
aatgtaataaagtgaactttgtt

SEQ ID NO: 5826694 - DNA, 20 bp, Homo sapiens
aatgtaataataatgaatgt

SEQ ID NO: 5826695 - DNA, 15 bp, Homo sapiens
aatgtaatactggaa

SEQ ID NO: 5826696 - DNA, 16 bp, Homo sapiens
aatgtaatactggaat

SEQ ID NO: 5826697 - DNA, 16 bp, Homo sapiens
aatgtaatagggaaaa

SEQ ID NO: 5826698 - DNA, 17 bp, Homo sapiens
aatgtaatataatgtat

SEQ ID NO: 5826699 - DNA, 20 bp, Homo sapiens
aatgtaatataatgtatttt

SEQ ID NO: 5826700 - DNA, 13 bp, Homo sapiens
aatgtaatcattt

SEQ ID NO: 5826701 - DNA, 14 bp, Homo sapiens
aatgtaatcattta

SEQ ID NO: 5826702 - DNA, 15 bp, Homo sapiens
aatgtaatgatcata

SEQ ID NO: 5826703 - DNA, 13 bp, Homo sapiens
aatgtaatgcgat

SEQ ID NO: 5826704 - DNA, 15 bp, Homo sapiens
aatgtaatgtcagac

SEQ ID NO: 5826705 - DNA, 18 bp, Homo sapiens
aatgtaattaaactgtta

SEQ ID NO: 5826706 - DNA, 16 bp, Homo sapiens
aatgtaattgaataaa

SEQ ID NO: 5826707 - DNA, 12 bp, Homo sapiens
aatgtaattgga

SEQ ID NO: 5826708 - DNA, 16 bp, Homo sapiens
aatgtaattggaatct

SEQ ID NO: 5826709 - DNA, 13 bp, Homo sapiens
aatgtaattgtaa

SEQ ID NO: 5826710 - DNA, 23 bp, Homo sapiens
aatgtaattgtaattttgaaatg

SEQ ID NO: 5826711 - DNA, 13 bp, Homo sapiens
aatgtaatttaaa

SEQ ID NO: 5826712 - DNA, 18 bp, Homo sapiens
aatgtaatttcagttcta

SEQ ID NO: 5826713 - DNA, 14 bp, Homo sapiens
aatgtaatttgtgt

SEQ ID NO: 5826714 - DNA, 16 bp, Homo sapiens
aatgtaatttgtgtaa

SEQ ID NO: 5826715 - DNA, 18 bp, Homo sapiens
aatgtaatttgtgtaata

SEQ ID NO: 5826716 - DNA, 13 bp, Homo sapiens
aatgtacaaaata

SEQ ID NO: 5826717 - DNA, 15 bp, Homo sapiens
aatgtacaaaataaa

SEQ ID NO: 5826718 - DNA, 12 bp, Homo sapiens
aatgtacaaaga

SEQ ID NO: 5826719 - DNA, 13 bp, Homo sapiens
aatgtacaaagat

SEQ ID NO: 5826720 - DNA, 16 bp, Homo sapiens
aatgtacaaagatact

SEQ ID NO: 5826721 - DNA, 17 bp, Homo sapiens
aatgtacaagttttgta

SEQ ID NO: 5826722 - DNA, 18 bp, Homo sapiens
aatgtacaagttttgtat

SEQ ID NO: 5826723 - DNA, 12 bp, Homo sapiens
aatgtacaatta

SEQ ID NO: 5826724 - DNA, 14 bp, Homo sapiens
aatgtacaattatg

SEQ ID NO: 5826725 - DNA, 20 bp, Homo sapiens
aatgtacaattttatataat

SEQ ID NO: 5826726 - DNA, 22 bp, Homo sapiens
aatgtacacactggtacttaga

SEQ ID NO: 5826727 - DNA, 21 bp, Homo sapiens
aatgtacacagtttaaacaca

SEQ ID NO: 5826728 - DNA, 16 bp, Homo sapiens
aatgtacactggatat

SEQ ID NO: 5826729 - DNA, 23 bp, Homo sapiens
aatgtacactttttacagcagca

SEQ ID NO: 5826730 - DNA, 14 bp, Homo sapiens
aatgtacagaaaat

SEQ ID NO: 5826731 - DNA, 15 bp, Homo sapiens
aatgtacaggttgga

SEQ ID NO: 5826732 - DNA, 16 bp, Homo sapiens
aatgtacagttgaaat

SEQ ID NO: 5826733 - DNA, 12 bp, Homo sapiens
aatgtgctctgt

SEQ ID NO: 5826734 - DNA, 16 bp, Homo sapiens
aatgtgctgaagcaaa

SEQ ID NO: 5826735 - DNA, 11 bp, Homo sapiens
aatgtgctgca

SEQ ID NO: 5826736 - DNA, 23 bp, Homo sapiens
aatgtgctggtgaacactgtgac

SEQ ID NO: 5826737 - DNA, 14 bp, Homo sapiens
aatgtgctgtgtaa

SEQ ID NO: 5826738 - DNA, 21 bp, Homo sapiens
aatgtgctgtgtaaagttagt

SEQ ID NO: 5826739 - DNA, 14 bp, Homo sapiens
aatgtgctgttgat

SEQ ID NO: 5826740 - DNA, 18 bp, Homo sapiens
aatgtgctgttgattctt

SEQ ID NO: 5826741 - DNA, 21 bp, Homo sapiens
aatgtgctgttgattctttca

SEQ ID NO: 5826742 - DNA, 21 bp, Homo sapiens
aatgtgcttcattgtttgatt

SEQ ID NO: 5826743 - DNA, 20 bp, Homo sapiens
aatgtggaaaaaatatttta

SEQ ID NO: 5826744 - DNA, 14 bp, Homo sapiens
aatgtggacgtgca

SEQ ID NO: 5826745 - DNA, 18 bp, Homo sapiens
aatgtggacgtgcactga

SEQ ID NO: 5826746 - DNA, 21 bp, Homo sapiens
aatgtggactcaatccctagg

SEQ ID NO: 5826747 - DNA, 10 bp, Homo sapiens
aatgtggaga

SEQ ID NO: 5826748 - DNA, 16 bp, Homo sapiens
aatgtggagaagagtg

SEQ ID NO: 5826749 - DNA, 22 bp, Homo sapiens
aatgtggagaagagtgccctgc

SEQ ID NO: 5826750 - DNA, 17 bp, Homo sapiens
aatgtggagcagcagcc

SEQ ID NO: 5826751 - DNA, 16 bp, Homo sapiens
aatgtggagtctccct

SEQ ID NO: 5826752 - DNA, 19 bp, Homo sapiens
aatgtggataaaactgtgt

SEQ ID NO: 5826753 - DNA, 16 bp, Homo sapiens
aatgtggctgaagttg

SEQ ID NO: 5826754 - DNA, 12 bp, Homo sapiens
aatgtggcttga

SEQ ID NO: 5826755 - DNA, 13 bp, Homo sapiens
aatgtgggcactg

SEQ ID NO: 5826756 - DNA, 14 bp, Homo sapiens
aatgtgggcagaga

SEQ ID NO: 5826757 - DNA, 15 bp, Homo sapiens
aatgtggtctcagga

SEQ ID NO: 5826758 - DNA, 23 bp, Homo sapiens
aatgtggtctgccaatctgtaca

SEQ ID NO: 5826759 - DNA, 21 bp, Homo sapiens
aatgtggttagttaactgaat

SEQ ID NO: 5826760 - DNA, 21 bp, Homo sapiens
aatgtggttatttctctgatt

SEQ ID NO: 5826761 - DNA, 18 bp, Homo sapiens
aatgtggttgcttaattc

SEQ ID NO: 5826762 - DNA, 12 bp, Homo sapiens
aatgtggttttt

SEQ ID NO: 5826763 - DNA, 17 bp, Homo sapiens
aatgtgtaagcattgta

SEQ ID NO: 5826764 - DNA, 23 bp, Homo sapiens
aatgtgtacagtgaattgtcttt

SEQ ID NO: 5826765 - DNA, 16 bp, Homo sapiens
aatgtgtagttcatgt

SEQ ID NO: 5826766 - DNA, 21 bp, Homo sapiens
aatgtgtagttcatgtaaata

SEQ ID NO: 5826767 - DNA, 16 bp, Homo sapiens
aatgtgtataaattgt

SEQ ID NO: 5826768 - DNA, 13 bp, Homo sapiens
aatgtgtataaga

SEQ ID NO: 5826769 - DNA, 19 bp, Homo sapiens
aatgtgtatcggatgcttt

SEQ ID NO: 5826770 - DNA, 19 bp, Homo sapiens
aatgtgtatggtatcatgt

SEQ ID NO: 5826771 - DNA, 15 bp, Homo sapiens
aatgtgtatgtctgg

SEQ ID NO: 5826772 - DNA, 23 bp, Homo sapiens
aatgtgtatgtgtggtttcagtt

SEQ ID NO: 5826773 - DNA, 13 bp, Homo sapiens
aatgtgtatttct

SEQ ID NO: 5826774 - DNA, 12 bp, Homo sapiens
aatgtgtatttt

SEQ ID NO: 5826775 - DNA, 22 bp, Homo sapiens
aatgtgtatttttcaaggcatt

SEQ ID NO: 5826776 - DNA, 16 bp, Homo sapiens
aatgtgtcaaagagat

SEQ ID NO: 5826777 - DNA, 19 bp, Homo sapiens
aatgtgtcaaatacaaaaa

SEQ ID NO: 5826778 - DNA, 13 bp, Homo sapiens
aatgtgtcagaat

SEQ ID NO: 5826779 - DNA, 14 bp, Homo sapiens
aatgtgtcctatct

SEQ ID NO: 5826780 - DNA, 19 bp, Homo sapiens
aatgtgtcctatctatctt

SEQ ID NO: 5826781 - DNA, 16 bp, Homo sapiens
aatgtgtcctcctgct

SEQ ID NO: 5826782 - DNA, 17 bp, Homo sapiens
aatgtgtcctcctgctc

SEQ ID NO: 5826783 - DNA, 19 bp, Homo sapiens
aatgtgtcctcctgctctg

SEQ ID NO: 5826784 - DNA, 21 bp, Homo sapiens
aatgtgtcctcctgctctgct

SEQ ID NO: 5826785 - DNA, 23 bp, Homo sapiens
aatgtgtcctcctgctctgcttc

SEQ ID NO: 5826786 - DNA, 19 bp, Homo sapiens
aatgtgtctatttctgaaa

SEQ ID NO: 5826787 - DNA, 20 bp, Homo sapiens
aatgtgtctatttctgaaag

SEQ ID NO: 5826788 - DNA, 14 bp, Homo sapiens
aatgtgtctcagga

SEQ ID NO: 5826789 - DNA, 17 bp, Homo sapiens
aatgtgtctgcaacatg

SEQ ID NO: 5826790 - DNA, 23 bp, Homo sapiens
aatgtgtctgcaacatggattcc

SEQ ID NO: 5826791 - DNA, 18 bp, Homo sapiens
aatgtgtctgtgttgctt

SEQ ID NO: 5826792 - DNA, 21 bp, Homo sapiens
aatgtgtcttgtattatcata

SEQ ID NO: 5826793 - DNA, 15 bp, Homo sapiens
aatgtgtctttagat

SEQ ID NO: 5826794 - DNA, 22 bp, Homo sapiens
aatgtgtgaaggtcttgcctga

SEQ ID NO: 5826795 - DNA, 16 bp, Homo sapiens
aatgtgtgagaaaaac

SEQ ID NO: 5826796 - DNA, 16 bp, Homo sapiens
aatgtgtgcttggaaa

SEQ ID NO: 5826797 - DNA, 12 bp, Homo sapiens
aatgtgtgcttt

SEQ ID NO: 5826798 - DNA, 21 bp, Homo sapiens
aatgtgtgggatcattgcatt

SEQ ID NO: 5826799 - DNA, 19 bp, Homo sapiens
aatgtgtgggcccaaggcc

SEQ ID NO: 5826800 - DNA, 17 bp, Homo sapiens
aatgtgtgtatatggac

SEQ ID NO: 5826801 - DNA, 18 bp, Homo sapiens
aatgtgtgtatgttaata

SEQ ID NO: 5826802 - DNA, 20 bp, Homo sapiens
aatgtgtgtgtgatggaggg

SEQ ID NO: 5826803 - DNA, 14 bp, Homo sapiens
aatgtgtgttcctg

SEQ ID NO: 5826804 - DNA, 20 bp, Homo sapiens
aatgtgtgttgtaacaaata

SEQ ID NO: 5826805 - DNA, 12 bp, Homo sapiens
aatgtgttctcg

SEQ ID NO: 5826806 - DNA, 15 bp, Homo sapiens
aatgtgttggaaact

SEQ ID NO: 5826807 - DNA, 18 bp, Homo sapiens
aatgtgtttaattttgga

SEQ ID NO: 5826808 - DNA, 23 bp, Homo sapiens
aatgtgtttcacagtttgaaata

SEQ ID NO: 5826809 - DNA, 14 bp, Homo sapiens
aatgtgtttccttt

SEQ ID NO: 5826810 - DNA, 13 bp, Homo sapiens
aatgtgtttctgt

SEQ ID NO: 5826811 - DNA, 15 bp, Homo sapiens
aatgtgtttgctgcc

SEQ ID NO: 5826812 - DNA, 16 bp, Homo sapiens
aatgtgttttctgtag

SEQ ID NO: 5826813 - DNA, 22 bp, Homo sapiens
aatgtgttttgtttattaaata

SEQ ID NO: 5826814 - DNA, 22 bp, Homo sapiens
aatgtgtttttctccagtgctg

SEQ ID NO: 5826815 - DNA, 12 bp, Homo sapiens
aatgttaaaaca

SEQ ID NO: 5826816 - DNA, 13 bp, Homo sapiens
aatgttaaaatgt

SEQ ID NO: 5826817 - DNA, 15 bp, Homo sapiens
aatgttaaaatgtgt

SEQ ID NO: 5826818 - DNA, 15 bp, Homo sapiens
aatgttaaactcttt

SEQ ID NO: 5826819 - DNA, 20 bp, Homo sapiens
aatgttaaagatgtagcaaa

SEQ ID NO: 5826820 - DNA, 18 bp, Homo sapiens
aatgttaaagggatattt

SEQ ID NO: 5826821 - DNA, 14 bp, Homo sapiens
aatgttaaagtcag

SEQ ID NO: 5826822 - DNA, 14 bp, Homo sapiens
aatgttaaatgcaa

SEQ ID NO: 5826823 - DNA, 17 bp, Homo sapiens
aatgttaaatttgtaag

SEQ ID NO: 5826824 - DNA, 18 bp, Homo sapiens
aatgttaacaggtatttt

SEQ ID NO: 5826825 - DNA, 16 bp, Homo sapiens
aatgttaacatttttg

SEQ ID NO: 5826826 - DNA, 14 bp, Homo sapiens
aatgttaactgttc

SEQ ID NO: 5826827 - DNA, 14 bp, Homo sapiens
aatgttaactttca

SEQ ID NO: 5826828 - DNA, 13 bp, Homo sapiens
aatgttaagaaag

SEQ ID NO: 5826829 - DNA, 22 bp, Homo sapiens
aatgttaagaaagaagaccctt

SEQ ID NO: 5826830 - DNA, 22 bp, Homo sapiens
aatgttaaggacttctgcagct

SEQ ID NO: 5826831 - DNA, 17 bp, Homo sapiens
aatgttaataaaggttt

SEQ ID NO: 5826832 - DNA, 16 bp, Homo sapiens
aatgttaatgatatgt

SEQ ID NO: 5826833 - DNA, 21 bp, Homo sapiens
aatgttaatggatttcagaag

SEQ ID NO: 5826834 - DNA, 12 bp, Homo sapiens
aatgttacaaaa

SEQ ID NO: 5826835 - DNA, 16 bp, Homo sapiens
aatgttacattattat

SEQ ID NO: 5826836 - DNA, 14 bp, Homo sapiens
aatgttaccagact

SEQ ID NO: 5826837 - DNA, 16 bp, Homo sapiens
aatgttaccagacttc

SEQ ID NO: 5826838 - DNA, 19 bp, Homo sapiens
aatgttaccagacttcaag

SEQ ID NO: 5826839 - DNA, 20 bp, Homo sapiens
aatgttaccagacttcaaga

SEQ ID NO: 5826840 - DNA, 18 bp, Homo sapiens
aatgttactaaattttct

SEQ ID NO: 5826841 - DNA, 17 bp, Homo sapiens
aatgttactgccttaat

SEQ ID NO: 5826842 - DNA, 18 bp, Homo sapiens
aatgttagaattgatttc

SEQ ID NO: 5826843 - DNA, 17 bp, Homo sapiens
aatgttagaggttttaa

SEQ ID NO: 5826844 - DNA, 18 bp, Homo sapiens
aatgttagagtttaattt

SEQ ID NO: 5826845 - DNA, 21 bp, Homo sapiens
aatgttagagtttaattttgt

SEQ ID NO: 5826846 - DNA, 22 bp, Homo sapiens
aatgttaggggtatttaatgta

SEQ ID NO: 5826847 - DNA, 22 bp, Homo sapiens
aatgttatagtgaattatccct

SEQ ID NO: 5826848 - DNA, 17 bp, Homo sapiens
aatgttatatcatatgt

SEQ ID NO: 5826849 - DNA, 23 bp, Homo sapiens
aatgttatcttatactgtacaat

SEQ ID NO: 5826850 - DNA, 17 bp, Homo sapiens
aatgttatcttctcaag

SEQ ID NO: 5826851 - DNA, 22 bp, Homo sapiens
aatgttatcttctcaagttcta

SEQ ID NO: 5826852 - DNA, 23 bp, Homo sapiens
aatgttatcttctcaagttctaa

SEQ ID NO: 5826853 - DNA, 15 bp, Homo sapiens
aatgttattattctt

SEQ ID NO: 5826854 - DNA, 20 bp, Homo sapiens
aatgttattgcctaatcact

SEQ ID NO: 5826855 - DNA, 14 bp, Homo sapiens
aatgttatttaaga

SEQ ID NO: 5826856 - DNA, 17 bp, Homo sapiens
aatgttatttctgcaaa

SEQ ID NO: 5826857 - DNA, 19 bp, Homo sapiens
aatgttatttctgcaaaca

SEQ ID NO: 5826858 - DNA, 20 bp, Homo sapiens
aatgttatttcttaaaattc

SEQ ID NO: 5826859 - DNA, 21 bp, Homo sapiens
aatgttatttggaattttaag

SEQ ID NO: 5826860 - DNA, 23 bp, Homo sapiens
aatgttatttgttattttcagta

SEQ ID NO: 5826861 - DNA, 17 bp, Homo sapiens
aatgttattttccttct

SEQ ID NO: 5826862 - DNA, 20 bp, Homo sapiens
aatgttattttccttctgaa

SEQ ID NO: 5826863 - DNA, 22 bp, Homo sapiens
aatgttattttccttctgaagt

SEQ ID NO: 5826864 - DNA, 21 bp, Homo sapiens
aatgttattttcttctaagtg

SEQ ID NO: 5826865 - DNA, 14 bp, Homo sapiens
aatgttcacaaggt

SEQ ID NO: 5826866 - DNA, 15 bp, Homo sapiens
aatgttcacattttt

SEQ ID NO: 5826867 - DNA, 13 bp, Homo sapiens
aatgttcatcaat

SEQ ID NO: 5826868 - DNA, 16 bp, Homo sapiens
aatgttcatcaatgaa

SEQ ID NO: 5826869 - DNA, 21 bp, Homo sapiens
aatgttcatcccatgatgtag

SEQ ID NO: 5826870 - DNA, 13 bp, Homo sapiens
aatgttcatcctc

SEQ ID NO: 5826871 - DNA, 23 bp, Homo sapiens
aatgttcatggaactagctcttt

SEQ ID NO: 5826872 - DNA, 17 bp, Homo sapiens
aatgttccagacattct

SEQ ID NO: 5826873 - DNA, 17 bp, Homo sapiens
aatgttcccaaaccaga

SEQ ID NO: 5826874 - DNA, 18 bp, Homo sapiens
aatgttccctgcaccctg

SEQ ID NO: 5826875 - DNA, 21 bp, Homo sapiens
aatgttccgttcatctgagga

SEQ ID NO: 5826876 - DNA, 15 bp, Homo sapiens
aatgttccttttgct

SEQ ID NO: 5826877 - DNA, 17 bp, Homo sapiens
aatgttctaaattctat

SEQ ID NO: 5826878 - DNA, 14 bp, Homo sapiens
aatgttctaagttt

SEQ ID NO: 5826879 - DNA, 16 bp, Homo sapiens
aatgttctaagtttct

SEQ ID NO: 5826880 - DNA, 19 bp, Homo sapiens
aatgttctaagtttctaag

SEQ ID NO: 5826881 - DNA, 20 bp, Homo sapiens
aatgttctaagtttctaaga

SEQ ID NO: 5826882 - DNA, 15 bp, Homo sapiens
aatgttctatatgca

SEQ ID NO: 5826883 - DNA, 20 bp, Homo sapiens
aatgttctgacattaacagt

SEQ ID NO: 5826884 - DNA, 21 bp, Homo sapiens
aatgttctgtgatacagaact

SEQ ID NO: 5826885 - DNA, 23 bp, Homo sapiens
aatgttctgttcaccctgcatta

SEQ ID NO: 5826886 - DNA, 14 bp, Homo sapiens
aatgttcttccagt

SEQ ID NO: 5826887 - DNA, 23 bp, Homo sapiens
aatgttcttggttcccattgtga

SEQ ID NO: 5826888 - DNA, 23 bp, Homo sapiens
aatgttctttatatacaataatg

SEQ ID NO: 5826889 - DNA, 13 bp, Homo sapiens
aatgttctttctg

SEQ ID NO: 5826890 - DNA, 14 bp, Homo sapiens
aatgttctttctgc

SEQ ID NO: 5826891 - DNA, 21 bp, Homo sapiens
aatgttctttggaaagtacac

SEQ ID NO: 5826892 - DNA, 14 bp, Homo sapiens
aatgttgaaaaaga

SEQ ID NO: 5826893 - DNA, 16 bp, Homo sapiens
aatgttgaaaaagaaa

SEQ ID NO: 5826894 - DNA, 19 bp, Homo sapiens
aatgttgaaaaagaaaaca

SEQ ID NO: 5826895 - DNA, 13 bp, Homo sapiens
aatgttgaaaagt

SEQ ID NO: 5826896 - DNA, 16 bp, Homo sapiens
aatgttgaaaagtcaa

SEQ ID NO: 5826897 - DNA, 17 bp, Homo sapiens
aatgttgaacaaaataa

SEQ ID NO: 5826898 - DNA, 16 bp, Homo sapiens
aatgttgaagaactca

SEQ ID NO: 5826899 - DNA, 18 bp, Homo sapiens
aatgttgacatgggacat

SEQ ID NO: 5826900 - DNA, 13 bp, Homo sapiens
aatgttgagaagt

SEQ ID NO: 5826901 - DNA, 14 bp, Homo sapiens
aatgttgagaagtt

SEQ ID NO: 5826902 - DNA, 16 bp, Homo sapiens
aatgttgatttctagt

SEQ ID NO: 5826903 - DNA, 17 bp, Homo sapiens
aatgttgatttctagtt

SEQ ID NO: 5826904 - DNA, 21 bp, Homo sapiens
aatgttgatttctagttattt

SEQ ID NO: 5826905 - DNA, 23 bp, Homo sapiens
aatgttgatttctagttatttat

SEQ ID NO: 5826906 - DNA, 13 bp, Homo sapiens
aatgttgcactga

SEQ ID NO: 5826907 - DNA, 18 bp, Homo sapiens
aatgttgcactgaaaacc

SEQ ID NO: 5826908 - DNA, 18 bp, Homo sapiens
aatgttgccttggaaaca

SEQ ID NO: 5826909 - DNA, 22 bp, Homo sapiens
aatgttgctagttttttgcttc

SEQ ID NO: 5826910 - DNA, 23 bp, Homo sapiens
aattacacacgtgtgatgtatgt

SEQ ID NO: 5826911 - DNA, 14 bp, Homo sapiens
aattacacagttca

SEQ ID NO: 5826912 - DNA, 17 bp, Homo sapiens
aattacaccacaagtat

SEQ ID NO: 5826913 - DNA, 12 bp, Homo sapiens
aattacagaaaa

SEQ ID NO: 5826914 - DNA, 15 bp, Homo sapiens
aattacagaaaattt

SEQ ID NO: 5826915 - DNA, 18 bp, Homo sapiens
aattacagaaaatttgca

SEQ ID NO: 5826916 - DNA, 22 bp, Homo sapiens
aattacagaaaatttgcaacat

SEQ ID NO: 5826917 - DNA, 20 bp, Homo sapiens
aattacagagatataaatga

SEQ ID NO: 5826918 - DNA, 17 bp, Homo sapiens
aattacagatgtgaaaa

SEQ ID NO: 5826919 - DNA, 18 bp, Homo sapiens
aattacagattaaaaaaa

SEQ ID NO: 5826920 - DNA, 17 bp, Homo sapiens
aattacagcttttatgg

SEQ ID NO: 5826921 - DNA, 18 bp, Homo sapiens
aattacaggagggaacat

SEQ ID NO: 5826922 - DNA, 17 bp, Homo sapiens
aattacagggaagaaat

SEQ ID NO: 5826923 - DNA, 23 bp, Homo sapiens
aattacagtgcctaaaataagaa

SEQ ID NO: 5826924 - DNA, 19 bp, Homo sapiens
aattacagtggattgctca

SEQ ID NO: 5826925 - DNA, 21 bp, Homo sapiens
aattacagttaaagaagcaat

SEQ ID NO: 5826926 - DNA, 13 bp, Homo sapiens
aattacagttcac

SEQ ID NO: 5826927 - DNA, 11 bp, Homo sapiens
aattacagttt

SEQ ID NO: 5826928 - DNA, 14 bp, Homo sapiens
aattacataacagg

SEQ ID NO: 5826929 - DNA, 14 bp, Homo sapiens
aattacataatttt

SEQ ID NO: 5826930 - DNA, 16 bp, Homo sapiens
aattacatacagattt

SEQ ID NO: 5826931 - DNA, 13 bp, Homo sapiens
aattacatatact

SEQ ID NO: 5826932 - DNA, 23 bp, Homo sapiens
aattacatatttgactctttcaa

SEQ ID NO: 5826933 - DNA, 15 bp, Homo sapiens
aattacatccagaaa

SEQ ID NO: 5826934 - DNA, 15 bp, Homo sapiens
aattacatgcatgag

SEQ ID NO: 5826935 - DNA, 12 bp, Homo sapiens
aattacatgtaa

SEQ ID NO: 5826936 - DNA, 16 bp, Homo sapiens
aattacatgttaatga

SEQ ID NO: 5826937 - DNA, 11 bp, Homo sapiens
aattacattat

SEQ ID NO: 5826938 - DNA, 13 bp, Homo sapiens
aattacatttgta

SEQ ID NO: 5826939 - DNA, 15 bp, Homo sapiens
aattacatttgtaat

SEQ ID NO: 5826940 - DNA, 17 bp, Homo sapiens
aattacatttgtaattt

SEQ ID NO: 5826941 - DNA, 18 bp, Homo sapiens
aattacatttgtaattta

SEQ ID NO: 5826942 - DNA, 15 bp, Homo sapiens
aattaccaacctgtt

SEQ ID NO: 5826943 - DNA, 23 bp, Homo sapiens
aattaccagtaaagtgtaacata

SEQ ID NO: 5826944 - DNA, 19 bp, Homo sapiens
aattaccatagagtaatga

SEQ ID NO: 5826945 - DNA, 22 bp, Homo sapiens
aattaccatagagtaatgatgt

SEQ ID NO: 5826946 - DNA, 15 bp, Homo sapiens
aattaccattaatta

SEQ ID NO: 5826947 - DNA, 15 bp, Homo sapiens
aattaccatttgtta

SEQ ID NO: 5826948 - DNA, 16 bp, Homo sapiens
aattaccatttgttaa

SEQ ID NO: 5826949 - DNA, 14 bp, Homo sapiens
aattacccactgtc

SEQ ID NO: 5826950 - DNA, 17 bp, Homo sapiens
aattacccataaacagc

SEQ ID NO: 5826951 - DNA, 19 bp, Homo sapiens
aattacccataaacagcac

SEQ ID NO: 5826952 - DNA, 23 bp, Homo sapiens
aattacccctatacctgagcctc

SEQ ID NO: 5826953 - DNA, 14 bp, Homo sapiens
aattacctactctg

SEQ ID NO: 5826954 - DNA, 18 bp, Homo sapiens
aattacctggatgttctt

SEQ ID NO: 5826955 - DNA, 19 bp, Homo sapiens
aattacctggtgagtaact

SEQ ID NO: 5826956 - DNA, 23 bp, Homo sapiens
aattacctggtgagtaacttaga

SEQ ID NO: 5826957 - DNA, 24 bp, Homo sapiens
aattacctggtgagtaacttagaa

SEQ ID NO: 5826958 - DNA, 14 bp, Homo sapiens
aattaccttctatt

SEQ ID NO: 5826959 - DNA, 20 bp, Homo sapiens
aattacctttacatatatag

SEQ ID NO: 5826960 - DNA, 20 bp, Homo sapiens
aattacgataaggaagaaac

SEQ ID NO: 5826961 - DNA, 22 bp, Homo sapiens
aattacggactctggatatttg

SEQ ID NO: 5826962 - DNA, 15 bp, Homo sapiens
aattacggtgtacag

SEQ ID NO: 5826963 - DNA, 23 bp, Homo sapiens
aattacgttcttacaagcttaaa

SEQ ID NO: 5826964 - DNA, 15 bp, Homo sapiens
aattacgtttaaagt

SEQ ID NO: 5826965 - DNA, 16 bp, Homo sapiens
aattacgtttgttatt

SEQ ID NO: 5826966 - DNA, 22 bp, Homo sapiens
aattacgtttgttattcctagt

SEQ ID NO: 5826967 - DNA, 24 bp, Homo sapiens
aattactaaattgtatacattttg

SEQ ID NO: 5826968 - DNA, 20 bp, Homo sapiens
aattactaacttctaaaact

SEQ ID NO: 5826969 - DNA, 14 bp, Homo sapiens
aattactaataaat

SEQ ID NO: 5826970 - DNA, 13 bp, Homo sapiens
aattactaatgat

SEQ ID NO: 5826971 - DNA, 16 bp, Homo sapiens
aattactacaaaattt

SEQ ID NO: 5826972 - DNA, 14 bp, Homo sapiens
aattactacattag

SEQ ID NO: 5826973 - DNA, 22 bp, Homo sapiens
aattactactaggtaataataa

SEQ ID NO: 5826974 - DNA, 13 bp, Homo sapiens
aattactataaag

SEQ ID NO: 5826975 - DNA, 16 bp, Homo sapiens
aattactatattttag

SEQ ID NO: 5826976 - DNA, 19 bp, Homo sapiens
aattactatctgttgaaaa

SEQ ID NO: 5826977 - DNA, 14 bp, Homo sapiens
aattactcaggttt

SEQ ID NO: 5826978 - DNA, 16 bp, Homo sapiens
aattactggacatatg

SEQ ID NO: 5826979 - DNA, 12 bp, Homo sapiens
aattactgtgag

SEQ ID NO: 5826980 - DNA, 20 bp, Homo sapiens
aattactgtgagaactgtga

SEQ ID NO: 5826981 - DNA, 15 bp, Homo sapiens
aattactgtttgaaa

SEQ ID NO: 5826982 - DNA, 14 bp, Homo sapiens
aattactgttttct

SEQ ID NO: 5826983 - DNA, 16 bp, Homo sapiens
aattactgttttgcca

SEQ ID NO: 5826984 - DNA, 12 bp, Homo sapiens
aattacttaaaa

SEQ ID NO: 5826985 - DNA, 12 bp, Homo sapiens
aattacttaatg

SEQ ID NO: 5826986 - DNA, 14 bp, Homo sapiens
aattacttaatgtg

SEQ ID NO: 5826987 - DNA, 16 bp, Homo sapiens
aattacttatattcat

SEQ ID NO: 5826988 - DNA, 13 bp, Homo sapiens
aattacttatttt

SEQ ID NO: 5826989 - DNA, 16 bp, Homo sapiens
aattacttctctctat

SEQ ID NO: 5826990 - DNA, 22 bp, Homo sapiens
aattacttgaagtatccacaga

SEQ ID NO: 5826991 - DNA, 17 bp, Homo sapiens
aattacttgtgttactt

SEQ ID NO: 5826992 - DNA, 18 bp, Homo sapiens
aattacttgtgttacttg

SEQ ID NO: 5826993 - DNA, 21 bp, Homo sapiens
aattacttgtgttacttgcca

SEQ ID NO: 5826994 - DNA, 22 bp, Homo sapiens
aattactttaacattttggaaa

SEQ ID NO: 5826995 - DNA, 15 bp, Homo sapiens
aattactttcagaat

SEQ ID NO: 5826996 - DNA, 15 bp, Homo sapiens
aattactttctgaat

SEQ ID NO: 5826997 - DNA, 15 bp, Homo sapiens
aattactttgaacat

SEQ ID NO: 5826998 - DNA, 16 bp, Homo sapiens
aattactttgaacatt

SEQ ID NO: 5826999 - DNA, 19 bp, Homo sapiens
aattactttgattccattt

SEQ ID NO: 5827000 - DNA, 16 bp, Homo sapiens
aattacttttaaatat

SEQ ID NO: 5827001 - DNA, 15 bp, Homo sapiens
aattacttttgaaaa

SEQ ID NO: 5827002 - DNA, 20 bp, Homo sapiens
aattacttttgaaaaaggat

SEQ ID NO: 5827003 - DNA, 20 bp, Homo sapiens
aattagaaaaaaattactaa

SEQ ID NO: 5827004 - DNA, 19 bp, Homo sapiens
aattagaaaaatatatgct

SEQ ID NO: 5827005 - DNA, 20 bp, Homo sapiens
aattagaaaagttaacattt

SEQ ID NO: 5827006 - DNA, 22 bp, Homo sapiens
aattagaaaatgttatttaaca

SEQ ID NO: 5827007 - DNA, 22 bp, Homo sapiens
aattagaaacgtgataaatata

SEQ ID NO: 5827008 - DNA, 13 bp, Homo sapiens
aattagaaatcaa

SEQ ID NO: 5827009 - DNA, 14 bp, Homo sapiens
aattagaagaaaat

SEQ ID NO: 5827010 - DNA, 18 bp, Homo sapiens
aattagaatgaatttatc

SEQ ID NO: 5827011 - DNA, 21 bp, Homo sapiens
aattagaatggataagatgat

SEQ ID NO: 5827012 - DNA, 16 bp, Homo sapiens
aattagacactttgga

SEQ ID NO: 5827013 - DNA, 13 bp, Homo sapiens
aattagaccttta

SEQ ID NO: 5827014 - DNA, 12 bp, Homo sapiens
aattagaggaga

SEQ ID NO: 5827015 - DNA, 14 bp, Homo sapiens
aattagatagaaaa

SEQ ID NO: 5827016 - DNA, 23 bp, Homo sapiens
aattagatcaacacttttctcca

SEQ ID NO: 5827017 - DNA, 20 bp, Homo sapiens
aattagatccattaatttaa

SEQ ID NO: 5827018 - DNA, 23 bp, Homo sapiens
aattagatcctgaaaattcacta

SEQ ID NO: 5827019 - DNA, 22 bp, Homo sapiens
aattagatctaaacagttattt

SEQ ID NO: 5827020 - DNA, 17 bp, Homo sapiens
aattagatgcaagtaaa

SEQ ID NO: 5827021 - DNA, 22 bp, Homo sapiens
aattagatgcatgttgaccatg

SEQ ID NO: 5827022 - DNA, 17 bp, Homo sapiens
aattagatgtttatatc

SEQ ID NO: 5827023 - DNA, 17 bp, Homo sapiens
aattagattatttctgt

SEQ ID NO: 5827024 - DNA, 14 bp, Homo sapiens
aattagatttctga

SEQ ID NO: 5827025 - DNA, 13 bp, Homo sapiens
aattagattttaa

SEQ ID NO: 5827026 - DNA, 19 bp, Homo sapiens
aattagcaatcattttata

SEQ ID NO: 5827027 - DNA, 15 bp, Homo sapiens
aattagcagaatgga

SEQ ID NO: 5827028 - DNA, 21 bp, Homo sapiens
aattagcagaatggagaaagt

SEQ ID NO: 5827029 - DNA, 16 bp, Homo sapiens
aattagcatggcggca

SEQ ID NO: 5827030 - DNA, 18 bp, Homo sapiens
aattagccaaaacactta

SEQ ID NO: 5827031 - DNA, 14 bp, Homo sapiens
aattagccagtaat

SEQ ID NO: 5827032 - DNA, 23 bp, Homo sapiens
aattagctctcgcctcaggcttt

SEQ ID NO: 5827033 - DNA, 11 bp, Homo sapiens
aattagctctg

SEQ ID NO: 5827034 - DNA, 14 bp, Homo sapiens
aattagctctgggg

SEQ ID NO: 5827035 - DNA, 15 bp, Homo sapiens
aattagctgcttcta

SEQ ID NO: 5827036 - DNA, 21 bp, Homo sapiens
aattagcttttggagagtggg

SEQ ID NO: 5827037 - DNA, 13 bp, Homo sapiens
aattaggaaaaaa

SEQ ID NO: 5827038 - DNA, 21 bp, Homo sapiens
aattaggaagtgtaacagctg

SEQ ID NO: 5827039 - DNA, 11 bp, Homo sapiens
aattaggaatt

SEQ ID NO: 5827040 - DNA, 21 bp, Homo sapiens
aattaggcagtgctaaagcct

SEQ ID NO: 5827041 - DNA, 15 bp, Homo sapiens
aattaggctgtaact

SEQ ID NO: 5827042 - DNA, 18 bp, Homo sapiens
aattaggctgtaactact

SEQ ID NO: 5827043 - DNA, 21 bp, Homo sapiens
aattaggctgtaactacttta

SEQ ID NO: 5827044 - DNA, 22 bp, Homo sapiens
aattaggctgtaactactttat

SEQ ID NO: 5827045 - DNA, 23 bp, Homo sapiens
aattaggctgtaactactttata

SEQ ID NO: 5827046 - DNA, 20 bp, Homo sapiens
aattagggctacattgtaat

SEQ ID NO: 5827047 - DNA, 21 bp, Homo sapiens
aattagggctacattgtaatc

SEQ ID NO: 5827048 - DNA, 19 bp, Homo sapiens
aattagggctctaatttcc

SEQ ID NO: 5827049 - DNA, 21 bp, Homo sapiens
aattaggggcaatagtagaat

SEQ ID NO: 5827050 - DNA, 16 bp, Homo sapiens
aattagggtacattta

SEQ ID NO: 5827051 - DNA, 19 bp, Homo sapiens
aattagggtacatttataa

SEQ ID NO: 5827052 - DNA, 15 bp, Homo sapiens
aattaggtagcacag

SEQ ID NO: 5827053 - DNA, 15 bp, Homo sapiens
aattaggtccacttc

SEQ ID NO: 5827054 - DNA, 20 bp, Homo sapiens
aattaggtgtactgtactga

SEQ ID NO: 5827055 - DNA, 17 bp, Homo sapiens
aattaggttgaaacata

SEQ ID NO: 5827056 - DNA, 19 bp, Homo sapiens
aattaggtttctttgaaga

SEQ ID NO: 5827057 - DNA, 15 bp, Homo sapiens
aattagtaatgtact

SEQ ID NO: 5827058 - DNA, 19 bp, Homo sapiens
aattagtacctcaaagtaa

SEQ ID NO: 5827059 - DNA, 17 bp, Homo sapiens
aattagtatttatttaa

SEQ ID NO: 5827060 - DNA, 15 bp, Homo sapiens
aattagtctatcaaa

SEQ ID NO: 5827061 - DNA, 17 bp, Homo sapiens
aattagtgaccattatt

SEQ ID NO: 5827062 - DNA, 20 bp, Homo sapiens
aattagtgagattaaaaatc

SEQ ID NO: 5827063 - DNA, 22 bp, Homo sapiens
aattagtgagattaaaaatcta

SEQ ID NO: 5827064 - DNA, 14 bp, Homo sapiens
aattagtgagattt

SEQ ID NO: 5827065 - DNA, 16 bp, Homo sapiens
aattagtgagatttgt

SEQ ID NO: 5827066 - DNA, 16 bp, Homo sapiens
aattagtgatatagtg

SEQ ID NO: 5827067 - DNA, 20 bp, Homo sapiens
aattagtgctaagtgtgaac

SEQ ID NO: 5827068 - DNA, 22 bp, Homo sapiens
aattagtgtgacagtttccaaa

SEQ ID NO: 5827069 - DNA, 22 bp, Homo sapiens
aattagtgttgtgcacttcatg

SEQ ID NO: 5827070 - DNA, 17 bp, Homo sapiens
aattagttccagtttct

SEQ ID NO: 5827071 - DNA, 19 bp, Homo sapiens
aattagttccagtttctcc

SEQ ID NO: 5827072 - DNA, 16 bp, Homo sapiens
aattagtttgacactg

SEQ ID NO: 5827073 - DNA, 17 bp, Homo sapiens
aattagtttgacactgc

SEQ ID NO: 5827074 - DNA, 14 bp, Homo sapiens
aattagtttgcact

SEQ ID NO: 5827075 - DNA, 24 bp, Homo sapiens
aattagttttaaaatgatattgtt

SEQ ID NO: 5827076 - DNA, 15 bp, Homo sapiens
aattataaaattgaa

SEQ ID NO: 5827077 - DNA, 17 bp, Homo sapiens
aattataaacagcaggg

SEQ ID NO: 5827078 - DNA, 20 bp, Homo sapiens
aattataaactcattttgct

SEQ ID NO: 5827079 - DNA, 18 bp, Homo sapiens
aattataaagataaagct

SEQ ID NO: 5827080 - DNA, 13 bp, Homo sapiens
aattataaatgac

SEQ ID NO: 5827081 - DNA, 16 bp, Homo sapiens
aattataaatgtgttt

SEQ ID NO: 5827082 - DNA, 15 bp, Homo sapiens
aattataaatgtttc

SEQ ID NO: 5827083 - DNA, 18 bp, Homo sapiens
aattataaatgtttcatg

SEQ ID NO: 5827084 - DNA, 21 bp, Homo sapiens
aattataagagacagacactt

SEQ ID NO: 5827085 - DNA, 20 bp, Homo sapiens
aattataagaggctgataat

SEQ ID NO: 5827086 - DNA, 12 bp, Homo sapiens
aattataagatg

SEQ ID NO: 5827087 - DNA, 14 bp, Homo sapiens
aattataagatgtc

SEQ ID NO: 5827088 - DNA, 13 bp, Homo sapiens
aattccactggac

SEQ ID NO: 5827089 - DNA, 11 bp, Homo sapiens
aattccactgt

SEQ ID NO: 5827090 - DNA, 22 bp, Homo sapiens
aattccacttataggaattgac

SEQ ID NO: 5827091 - DNA, 24 bp, Homo sapiens
aattccagactttctattaatatt

SEQ ID NO: 5827092 - DNA, 14 bp, Homo sapiens
aattccagatttgt

SEQ ID NO: 5827093 - DNA, 17 bp, Homo sapiens
aattccagcaataagaa

SEQ ID NO: 5827094 - DNA, 18 bp, Homo sapiens
aattccaggctgagccat

SEQ ID NO: 5827095 - DNA, 21 bp, Homo sapiens
aattccaggctgagccatgag

SEQ ID NO: 5827096 - DNA, 16 bp, Homo sapiens
aattccagtttaggag

SEQ ID NO: 5827097 - DNA, 11 bp, Homo sapiens
aattccatgaa

SEQ ID NO: 5827098 - DNA, 18 bp, Homo sapiens
aattccatgaatcgcttc

SEQ ID NO: 5827099 - DNA, 21 bp, Homo sapiens
aattccatttgaggatttaga

SEQ ID NO: 5827100 - DNA, 17 bp, Homo sapiens
aattcccaacaaacatt

SEQ ID NO: 5827101 - DNA, 15 bp, Homo sapiens
aattcccagatagtc

SEQ ID NO: 5827102 - DNA, 16 bp, Homo sapiens
aattcccatctgcttt

SEQ ID NO: 5827103 - DNA, 12 bp, Homo sapiens
aattccccctta

SEQ ID NO: 5827104 - DNA, 20 bp, Homo sapiens
aattcccgggcccttcagtc

SEQ ID NO: 5827105 - DNA, 21 bp, Homo sapiens
aattcccgttttgtcactttt

SEQ ID NO: 5827106 - DNA, 14 bp, Homo sapiens
aattccctaaagcc

SEQ ID NO: 5827107 - DNA, 20 bp, Homo sapiens
aattccctcactcgtctccc

SEQ ID NO: 5827108 - DNA, 13 bp, Homo sapiens
aattccctccccc

SEQ ID NO: 5827109 - DNA, 17 bp, Homo sapiens
aattccctccccctcct

SEQ ID NO: 5827110 - DNA, 16 bp, Homo sapiens
aattccctctctcagc

SEQ ID NO: 5827111 - DNA, 18 bp, Homo sapiens
aattccctctctcagcac

SEQ ID NO: 5827112 - DNA, 23 bp, Homo sapiens
aattccctctctctgactctcaa

SEQ ID NO: 5827113 - DNA, 11 bp, Homo sapiens
aattccctgtg

SEQ ID NO: 5827114 - DNA, 14 bp, Homo sapiens
aattcccttctttt

SEQ ID NO: 5827115 - DNA, 18 bp, Homo sapiens
aattcccttgaattgtgt

SEQ ID NO: 5827116 - DNA, 13 bp, Homo sapiens
aattccgtcacca

SEQ ID NO: 5827117 - DNA, 13 bp, Homo sapiens
aattcctaacttt

SEQ ID NO: 5827118 - DNA, 14 bp, Homo sapiens
aattcctaattcta

SEQ ID NO: 5827119 - DNA, 17 bp, Homo sapiens
aattcctagaattaaac

SEQ ID NO: 5827120 - DNA, 20 bp, Homo sapiens
aattcctagataaaaagatg

SEQ ID NO: 5827121 - DNA, 18 bp, Homo sapiens
aattcctagctgtaaata

SEQ ID NO: 5827122 - DNA, 12 bp, Homo sapiens
aattcctatgaa

SEQ ID NO: 5827123 - DNA, 15 bp, Homo sapiens
aattcctattgtgat

SEQ ID NO: 5827124 - DNA, 18 bp, Homo sapiens
aattcctattgtgatttg

SEQ ID NO: 5827125 - DNA, 19 bp, Homo sapiens
aattcctattgtgatttga

SEQ ID NO: 5827126 - DNA, 20 bp, Homo sapiens
aattcctattgtgatttgac

SEQ ID NO: 5827127 - DNA, 22 bp, Homo sapiens
aattcctcatcctcagatgctc

SEQ ID NO: 5827128 - DNA, 13 bp, Homo sapiens
aattcctcatttg

SEQ ID NO: 5827129 - DNA, 10 bp, Homo sapiens
aattcctcct

SEQ ID NO: 5827130 - DNA, 13 bp, Homo sapiens
aattcctctcaaa

SEQ ID NO: 5827131 - DNA, 15 bp, Homo sapiens
aattcctctccaggc

SEQ ID NO: 5827132 - DNA, 19 bp, Homo sapiens
aattcctctccaggccaga

SEQ ID NO: 5827133 - DNA, 23 bp, Homo sapiens
aattcctcttcattgtctacata

SEQ ID NO: 5827134 - DNA, 18 bp, Homo sapiens
aattcctctttgctttgc

SEQ ID NO: 5827135 - DNA, 20 bp, Homo sapiens
aattcctctttggccacaag

SEQ ID NO: 5827136 - DNA, 17 bp, Homo sapiens
aattcctgaagccagat

SEQ ID NO: 5827137 - DNA, 23 bp, Homo sapiens
aattcctgctatgacagctggct

SEQ ID NO: 5827138 - DNA, 16 bp, Homo sapiens
aattcctggaaaactg

SEQ ID NO: 5827139 - DNA, 12 bp, Homo sapiens
aattcctggaac

SEQ ID NO: 5827140 - DNA, 13 bp, Homo sapiens
aattcctggaata

SEQ ID NO: 5827141 - DNA, 21 bp, Homo sapiens
aattcctggcatgacactcta

SEQ ID NO: 5827142 - DNA, 21 bp, Homo sapiens
aattcctgtccttcacattta

SEQ ID NO: 5827143 - DNA, 16 bp, Homo sapiens
aattcctgttgacctt

SEQ ID NO: 5827144 - DNA, 22 bp, Homo sapiens
aattcctgtttttattattaac

SEQ ID NO: 5827145 - DNA, 16 bp, Homo sapiens
aattccttaaaatttt

SEQ ID NO: 5827146 - DNA, 17 bp, Homo sapiens
aattccttaaaattttc

SEQ ID NO: 5827147 - DNA, 13 bp, Homo sapiens
aattccttaaagt

SEQ ID NO: 5827148 - DNA, 15 bp, Homo sapiens
aattccttaaatgaa

SEQ ID NO: 5827149 - DNA, 18 bp, Homo sapiens
aattccttaccccagctg

SEQ ID NO: 5827150 - DNA, 22 bp, Homo sapiens
aattccttaggcttaagagaga

SEQ ID NO: 5827151 - DNA, 16 bp, Homo sapiens
aattccttcagggtga

SEQ ID NO: 5827152 - DNA, 19 bp, Homo sapiens
aattccttcgaaaggcctt

SEQ ID NO: 5827153 - DNA, 19 bp, Homo sapiens
aattccttgccccacagtt

SEQ ID NO: 5827154 - DNA, 17 bp, Homo sapiens
aattcctttacaactaa

SEQ ID NO: 5827155 - DNA, 13 bp, Homo sapiens
aattcctttcaga

SEQ ID NO: 5827156 - DNA, 13 bp, Homo sapiens
aattcgagacagg

SEQ ID NO: 5827157 - DNA, 14 bp, Homo sapiens
aattcgagacaggc

SEQ ID NO: 5827158 - DNA, 13 bp, Homo sapiens
aattcgatgcccc

SEQ ID NO: 5827159 - DNA, 15 bp, Homo sapiens
aattcgcccgagctg

SEQ ID NO: 5827160 - DNA, 14 bp, Homo sapiens
aattcggggcctgc

SEQ ID NO: 5827161 - DNA, 15 bp, Homo sapiens
aattcggtgtgcacc

SEQ ID NO: 5827162 - DNA, 18 bp, Homo sapiens
aattcgtgttatgaatct

SEQ ID NO: 5827163 - DNA, 20 bp, Homo sapiens
aattcgttgaaacgatttca

SEQ ID NO: 5827164 - DNA, 19 bp, Homo sapiens
aattctaaatattgacact

SEQ ID NO: 5827165 - DNA, 20 bp, Homo sapiens
aattctaaatccgacttgaa

SEQ ID NO: 5827166 - DNA, 13 bp, Homo sapiens
aattctaaatgaa

SEQ ID NO: 5827167 - DNA, 19 bp, Homo sapiens
aattctaaatgaatgttta

SEQ ID NO: 5827168 - DNA, 13 bp, Homo sapiens
aattctaaatgta

SEQ ID NO: 5827169 - DNA, 21 bp, Homo sapiens
aattctaacccaagacatgac

SEQ ID NO: 5827170 - DNA, 21 bp, Homo sapiens
aattctaacgcaaaaatagct

SEQ ID NO: 5827171 - DNA, 19 bp, Homo sapiens
aattctaagttatttactt

SEQ ID NO: 5827172 - DNA, 22 bp, Homo sapiens
aattctaatctaacaatggaag

SEQ ID NO: 5827173 - DNA, 15 bp, Homo sapiens
aattctaatggtaac

SEQ ID NO: 5827174 - DNA, 18 bp, Homo sapiens
aattctacagcatacaga

SEQ ID NO: 5827175 - DNA, 19 bp, Homo sapiens
aattctaccctggaaaagt

SEQ ID NO: 5827176 - DNA, 16 bp, Homo sapiens
aattctactggaaaaa

SEQ ID NO: 5827177 - DNA, 13 bp, Homo sapiens
aattctagcatgc

SEQ ID NO: 5827178 - DNA, 22 bp, Homo sapiens
aattctagcattttattactgt

SEQ ID NO: 5827179 - DNA, 15 bp, Homo sapiens
aattctagctttttt

SEQ ID NO: 5827180 - DNA, 23 bp, Homo sapiens
aattctaggcatcccaggggacc

SEQ ID NO: 5827181 - DNA, 20 bp, Homo sapiens
aattctagtgtccataaata

SEQ ID NO: 5827182 - DNA, 22 bp, Homo sapiens
aattctataaggccataaaaca

SEQ ID NO: 5827183 - DNA, 14 bp, Homo sapiens
aattctatactgtt

SEQ ID NO: 5827184 - DNA, 22 bp, Homo sapiens
aattctatcttttgtttccttt

SEQ ID NO: 5827185 - DNA, 23 bp, Homo sapiens
aattctatgattaaactgggaaa

SEQ ID NO: 5827186 - DNA, 17 bp, Homo sapiens
aattctatgttaaatac

SEQ ID NO: 5827187 - DNA, 21 bp, Homo sapiens
aattctatgttaaatactgtg

SEQ ID NO: 5827188 - DNA, 22 bp, Homo sapiens
aattctatgttaaatactgtgc

SEQ ID NO: 5827189 - DNA, 22 bp, Homo sapiens
aattctatgttggcattaacaa

SEQ ID NO: 5827190 - DNA, 15 bp, Homo sapiens
aattctattaaagtg

SEQ ID NO: 5827191 - DNA, 13 bp, Homo sapiens
aattctattgaaa

SEQ ID NO: 5827192 - DNA, 13 bp, Homo sapiens
aattctatttctc

SEQ ID NO: 5827193 - DNA, 17 bp, Homo sapiens
aattctattttgctgga

SEQ ID NO: 5827194 - DNA, 16 bp, Homo sapiens
aattctcaaataataa

SEQ ID NO: 5827195 - DNA, 22 bp, Homo sapiens
aattctcagaattacaggaaat

SEQ ID NO: 5827196 - DNA, 13 bp, Homo sapiens
aattctcagacga

SEQ ID NO: 5827197 - DNA, 20 bp, Homo sapiens
aattctcataggaattaaat

SEQ ID NO: 5827198 - DNA, 22 bp, Homo sapiens
aattctcattatgaagatgttt

SEQ ID NO: 5827199 - DNA, 13 bp, Homo sapiens
aattctcatttgt

SEQ ID NO: 5827200 - DNA, 13 bp, Homo sapiens
aattctccactgt

SEQ ID NO: 5827201 - DNA, 16 bp, Homo sapiens
aattctccaggatttt

SEQ ID NO: 5827202 - DNA, 13 bp, Homo sapiens
aattctcccagcg

SEQ ID NO: 5827203 - DNA, 21 bp, Homo sapiens
aattctcccctccctccagta

SEQ ID NO: 5827204 - DNA, 16 bp, Homo sapiens
aattctcctgataaaa

SEQ ID NO: 5827205 - DNA, 15 bp, Homo sapiens
aattctcctgcctca

SEQ ID NO: 5827206 - DNA, 19 bp, Homo sapiens
aattctcctgcctcagcct

SEQ ID NO: 5827207 - DNA, 20 bp, Homo sapiens
aattctcctgcctcagcctc

SEQ ID NO: 5827208 - DNA, 15 bp, Homo sapiens
aattctcctgccttt

SEQ ID NO: 5827209 - DNA, 12 bp, Homo sapiens
aattctcctgga

SEQ ID NO: 5827210 - DNA, 15 bp, Homo sapiens
aattctcctggaggt

SEQ ID NO: 5827211 - DNA, 16 bp, Homo sapiens
aattctctaggaaagt

SEQ ID NO: 5827212 - DNA, 17 bp, Homo sapiens
aattctctagtttgatt

SEQ ID NO: 5827213 - DNA, 18 bp, Homo sapiens
aattctctcaagacttct

SEQ ID NO: 5827214 - DNA, 23 bp, Homo sapiens
aattctctccccctatttattga

SEQ ID NO: 5827215 - DNA, 14 bp, Homo sapiens
aattctctcctaat

SEQ ID NO: 5827216 - DNA, 18 bp, Homo sapiens
aattctctgttccttttg

SEQ ID NO: 5827217 - DNA, 16 bp, Homo sapiens
aattctcttaaataaa

SEQ ID NO: 5827218 - DNA, 19 bp, Homo sapiens
aattctcttctttttcttt

SEQ ID NO: 5827219 - DNA, 19 bp, Homo sapiens
aattctcttttcaaacaca

SEQ ID NO: 5827220 - DNA, 20 bp, Homo sapiens
aattctgaaaactgaatgtc

SEQ ID NO: 5827221 - DNA, 17 bp, Homo sapiens
aattctgaaatactttt

SEQ ID NO: 5827222 - DNA, 20 bp, Homo sapiens
aattctgaaggggaaaacct

SEQ ID NO: 5827223 - DNA, 14 bp, Homo sapiens
aattctgaagttat

SEQ ID NO: 5827224 - DNA, 15 bp, Homo sapiens
aattctgaagttata

SEQ ID NO: 5827225 - DNA, 18 bp, Homo sapiens
aattctgaagttatattt

SEQ ID NO: 5827226 - DNA, 19 bp, Homo sapiens
aattctgaagttatatttc

SEQ ID NO: 5827227 - DNA, 21 bp, Homo sapiens
aattctgaagttatatttcct

SEQ ID NO: 5827228 - DNA, 17 bp, Homo sapiens
aattctgaatgcaattt

SEQ ID NO: 5827229 - DNA, 19 bp, Homo sapiens
aattctgaatttgcaaagt

SEQ ID NO: 5827230 - DNA, 15 bp, Homo sapiens
aattctgagatccag

SEQ ID NO: 5827231 - DNA, 17 bp, Homo sapiens
aattctgagctggccct

SEQ ID NO: 5827232 - DNA, 17 bp, Homo sapiens
aattctgagggaattta

SEQ ID NO: 5827233 - DNA, 21 bp, Homo sapiens
aattctgagggaatttaacca

SEQ ID NO: 5827234 - DNA, 23 bp, Homo sapiens
aattctgagttttgtgtttgttg

SEQ ID NO: 5827235 - DNA, 14 bp, Homo sapiens
aattctgatacatt

SEQ ID NO: 5827236 - DNA, 18 bp, Homo sapiens
aattctgatgtttctgtg

SEQ ID NO: 5827237 - DNA, 14 bp, Homo sapiens
aattctgattatta

SEQ ID NO: 5827238 - DNA, 14 bp, Homo sapiens
aattctgatttctt

SEQ ID NO: 5827239 - DNA, 22 bp, Homo sapiens
aattctgatttcttttcaccat

SEQ ID NO: 5827240 - DNA, 20 bp, Homo sapiens
aattctgcaactagccaagg

SEQ ID NO: 5827241 - DNA, 21 bp, Homo sapiens
aattctgcaactagccaaggc

SEQ ID NO: 5827242 - DNA, 12 bp, Homo sapiens
aattctgcagaa

SEQ ID NO: 5827243 - DNA, 16 bp, Homo sapiens
aattctgcatgtacta

SEQ ID NO: 5827244 - DNA, 12 bp, Homo sapiens
aattctgcctgc

SEQ ID NO: 5827245 - DNA, 21 bp, Homo sapiens
aattctgcctgcctcctccct

SEQ ID NO: 5827246 - DNA, 19 bp, Homo sapiens
aattctgctacctcactgg

SEQ ID NO: 5827247 - DNA, 22 bp, Homo sapiens
aattctgctgttacgacaaaga

SEQ ID NO: 5827248 - DNA, 10 bp, Homo sapiens
aattctgctt

SEQ ID NO: 5827249 - DNA, 18 bp, Homo sapiens
aattctgcttctctttca

SEQ ID NO: 5827250 - DNA, 19 bp, Homo sapiens
aattctggaaatgtctttc

SEQ ID NO: 5827251 - DNA, 18 bp, Homo sapiens
aattctgggagaatgaaa

SEQ ID NO: 5827252 - DNA, 12 bp, Homo sapiens
aattctgggtga

SEQ ID NO: 5827253 - DNA, 16 bp, Homo sapiens
aattctggtatacatt

SEQ ID NO: 5827254 - DNA, 19 bp, Homo sapiens
aattctgtaattacatatt

SEQ ID NO: 5827255 - DNA, 16 bp, Homo sapiens
aattctgtaatttgaa

SEQ ID NO: 5827256 - DNA, 19 bp, Homo sapiens
aattctgtcactcaccact

SEQ ID NO: 5827257 - DNA, 13 bp, Homo sapiens
aattctgtccctg

SEQ ID NO: 5827258 - DNA, 20 bp, Homo sapiens
aattctgtcttgttcatttt

SEQ ID NO: 5827259 - DNA, 14 bp, Homo sapiens
aattctgtgaagaa

SEQ ID NO: 5827260 - DNA, 18 bp, Homo sapiens
aattctgtgaagaatgaa

SEQ ID NO: 5827261 - DNA, 17 bp, Homo sapiens
aattctgtggctgccat

SEQ ID NO: 5827262 - DNA, 15 bp, Homo sapiens
aattctgttaaaatc

SEQ ID NO: 5827263 - DNA, 20 bp, Homo sapiens
aattctgttctgatattaat

SEQ ID NO: 5827264 - DNA, 23 bp, Homo sapiens
aattctgttgaaccacctgtgta

SEQ ID NO: 5827265 - DNA, 21 bp, Homo sapiens
aattctgttgtaatttaatga

SEQ ID NO: 5827266 - DNA, 15 bp, Homo sapiens
aattgtttgtcctca

SEQ ID NO: 5827267 - DNA, 16 bp, Homo sapiens
aattgtttgtctttaa

SEQ ID NO: 5827268 - DNA, 19 bp, Homo sapiens
aattgttttaaagagatac

SEQ ID NO: 5827269 - DNA, 19 bp, Homo sapiens
aattgttttacctgttctg

SEQ ID NO: 5827270 - DNA, 16 bp, Homo sapiens
aattgttttattttta

SEQ ID NO: 5827271 - DNA, 14 bp, Homo sapiens
aattgttttcttta

SEQ ID NO: 5827272 - DNA, 15 bp, Homo sapiens
aattgttttggaata

SEQ ID NO: 5827273 - DNA, 15 bp, Homo sapiens
aattgtttttgtaca

SEQ ID NO: 5827274 - DNA, 18 bp, Homo sapiens
aattgttttttatctttt

SEQ ID NO: 5827275 - DNA, 22 bp, Homo sapiens
aattgttttttatcttttctac

SEQ ID NO: 5827276 - DNA, 16 bp, Homo sapiens
aatttaaaaaagcaaa

SEQ ID NO: 5827277 - DNA, 14 bp, Homo sapiens
aatttaaaaaataa

SEQ ID NO: 5827278 - DNA, 18 bp, Homo sapiens
aatttaaaaaataaataa

SEQ ID NO: 5827279 - DNA, 18 bp, Homo sapiens
aatttaaaaacacaaaaa

SEQ ID NO: 5827280 - DNA, 14 bp, Homo sapiens
aatttaaaaactta

SEQ ID NO: 5827281 - DNA, 13 bp, Homo sapiens
aatttaaaacaaa

SEQ ID NO: 5827282 - DNA, 15 bp, Homo sapiens
aatttaaaacaaaca

SEQ ID NO: 5827283 - DNA, 20 bp, Homo sapiens
aatttaaaacacagtattgt

SEQ ID NO: 5827284 - DNA, 21 bp, Homo sapiens
aatttaaaacacagtattgta

SEQ ID NO: 5827285 - DNA, 18 bp, Homo sapiens
aatttaaaactgttattt

SEQ ID NO: 5827286 - DNA, 16 bp, Homo sapiens
aatttaaaagtaaaat

SEQ ID NO: 5827287 - DNA, 21 bp, Homo sapiens
aatttaaaagtaaaatgtctt

SEQ ID NO: 5827288 - DNA, 13 bp, Homo sapiens
aatttaaaattaa

SEQ ID NO: 5827289 - DNA, 18 bp, Homo sapiens
aatttaaaattaagtaga

SEQ ID NO: 5827290 - DNA, 9 bp, Homo sapiens
aatttaaac

SEQ ID NO: 5827291 - DNA, 11 bp, Homo sapiens
aatttaaacag

SEQ ID NO: 5827292 - DNA, 18 bp, Homo sapiens
aatttaaacaggcccagc

SEQ ID NO: 5827293 - DNA, 21 bp, Homo sapiens
aatttaaacatttgttcctgg

SEQ ID NO: 5827294 - DNA, 20 bp, Homo sapiens
aatttaaaccagcagaaaag

SEQ ID NO: 5827295 - DNA, 21 bp, Homo sapiens
aatttaaaccagcagaaaagt

SEQ ID NO: 5827296 - DNA, 22 bp, Homo sapiens
aatttaaaccagcagaaaagtg

SEQ ID NO: 5827297 - DNA, 17 bp, Homo sapiens
aatttaaacccatttta

SEQ ID NO: 5827298 - DNA, 11 bp, Homo sapiens
aatttaaagca

SEQ ID NO: 5827299 - DNA, 12 bp, Homo sapiens
aatttaaagcaa

SEQ ID NO: 5827300 - DNA, 20 bp, Homo sapiens
aatttaaagcaggttcttgt

SEQ ID NO: 5827301 - DNA, 19 bp, Homo sapiens
aatttaaagggtgtactta

SEQ ID NO: 5827302 - DNA, 12 bp, Homo sapiens
aatttaaataaa

SEQ ID NO: 5827303 - DNA, 15 bp, Homo sapiens
aatttaaatagcatt

SEQ ID NO: 5827304 - DNA, 16 bp, Homo sapiens
aatttaaatataattc

SEQ ID NO: 5827305 - DNA, 23 bp, Homo sapiens
aatttaaatataattctgtaaat

SEQ ID NO: 5827306 - DNA, 21 bp, Homo sapiens
aatttaaatcactcaaattgt

SEQ ID NO: 5827307 - DNA, 11 bp, Homo sapiens
aatttaaatga

SEQ ID NO: 5827308 - DNA, 19 bp, Homo sapiens
aatttaaatgaaagaaaat

SEQ ID NO: 5827309 - DNA, 14 bp, Homo sapiens
aatttaaatgttta

SEQ ID NO: 5827310 - DNA, 15 bp, Homo sapiens
aatttaaatgtttac

SEQ ID NO: 5827311 - DNA, 11 bp, Homo sapiens
aatttaaattg

SEQ ID NO: 5827312 - DNA, 16 bp, Homo sapiens
aatttaacaaactaaa

SEQ ID NO: 5827313 - DNA, 13 bp, Homo sapiens
aatttaacaatgc

SEQ ID NO: 5827314 - DNA, 16 bp, Homo sapiens
aatttaacaatgcgaa

SEQ ID NO: 5827315 - DNA, 19 bp, Homo sapiens
aatttaacaccctttagaa

SEQ ID NO: 5827316 - DNA, 13 bp, Homo sapiens
aatttaacagtat

SEQ ID NO: 5827317 - DNA, 15 bp, Homo sapiens
aatttaacatctgca

SEQ ID NO: 5827318 - DNA, 17 bp, Homo sapiens
aatttaacttcttcata

SEQ ID NO: 5827319 - DNA, 21 bp, Homo sapiens
aatttaagaatgaaactataa

SEQ ID NO: 5827320 - DNA, 23 bp, Homo sapiens
aatttaagagcagtccatttcta

SEQ ID NO: 5827321 - DNA, 18 bp, Homo sapiens
aatttaagatacaaataa

SEQ ID NO: 5827322 - DNA, 11 bp, Homo sapiens
aatttaagcaa

SEQ ID NO: 5827323 - DNA, 15 bp, Homo sapiens
aatttaagcacaaaa

SEQ ID NO: 5827324 - DNA, 12 bp, Homo sapiens
aatttaagcatt

SEQ ID NO: 5827325 - DNA, 14 bp, Homo sapiens
aatttaagcattgt

SEQ ID NO: 5827326 - DNA, 17 bp, Homo sapiens
aatttaagccaataaat

SEQ ID NO: 5827327 - DNA, 15 bp, Homo sapiens
aatttaagcttaagc

SEQ ID NO: 5827328 - DNA, 16 bp, Homo sapiens
aatttaaggtctgttt

SEQ ID NO: 5827329 - DNA, 19 bp, Homo sapiens
aatttaagtcattttcatg

SEQ ID NO: 5827330 - DNA, 17 bp, Homo sapiens
aatttaagtcgggaaat

SEQ ID NO: 5827331 - DNA, 17 bp, Homo sapiens
aatttaagtgacacaga

SEQ ID NO: 5827332 - DNA, 21 bp, Homo sapiens
aatttaagtgacacagacatt

SEQ ID NO: 5827333 - DNA, 14 bp, Homo sapiens
aatttaagtgcgtg

SEQ ID NO: 5827334 - DNA, 23 bp, Homo sapiens
aatttaagtgcgtgtgtagagtt

SEQ ID NO: 5827335 - DNA, 15 bp, Homo sapiens
aatttaagttttgac

SEQ ID NO: 5827336 - DNA, 20 bp, Homo sapiens
aatttaagttttgacaagct

SEQ ID NO: 5827337 - DNA, 23 bp, Homo sapiens
aatttaagttttgacaagctggc

SEQ ID NO: 5827338 - DNA, 20 bp, Homo sapiens
aatttaataccagatacctt

SEQ ID NO: 5827339 - DNA, 17 bp, Homo sapiens
aatttaatatactgcat

SEQ ID NO: 5827340 - DNA, 14 bp, Homo sapiens
aatttaatatagct

SEQ ID NO: 5827341 - DNA, 18 bp, Homo sapiens
aatttaatccttctttgt

SEQ ID NO: 5827342 - DNA, 21 bp, Homo sapiens
aatttaatccttctttgtaat

SEQ ID NO: 5827343 - DNA, 14 bp, Homo sapiens
aatttaatgctgcc

SEQ ID NO: 5827344 - DNA, 10 bp, Homo sapiens
aatttaatgg

SEQ ID NO: 5827345 - DNA, 18 bp, Homo sapiens
aatttaatggactgtgaa

SEQ ID NO: 5827346 - DNA, 21 bp, Homo sapiens
aatttaatggactgtgaattt

SEQ ID NO: 5827347 - DNA, 22 bp, Homo sapiens
aatttaatggactgtgaatttc

SEQ ID NO: 5827348 - DNA, 23 bp, Homo sapiens
aatttaatggactgtgaatttca

SEQ ID NO: 5827349 - DNA, 19 bp, Homo sapiens
aatttaatggatatttctc

SEQ ID NO: 5827350 - DNA, 14 bp, Homo sapiens
aatttaatggggtc

SEQ ID NO: 5827351 - DNA, 13 bp, Homo sapiens
aatttaatgtaaa

SEQ ID NO: 5827352 - DNA, 11 bp, Homo sapiens
aatttaattaa

SEQ ID NO: 5827353 - DNA, 14 bp, Homo sapiens
aatttaattacaaa

SEQ ID NO: 5827354 - DNA, 13 bp, Homo sapiens
aatttaattaggt

SEQ ID NO: 5827355 - DNA, 13 bp, Homo sapiens
aatttaattattt

SEQ ID NO: 5827356 - DNA, 15 bp, Homo sapiens
aatttaattcatgta

SEQ ID NO: 5827357 - DNA, 12 bp, Homo sapiens
aatttaattcca

SEQ ID NO: 5827358 - DNA, 16 bp, Homo sapiens
aatttaattgctttga

SEQ ID NO: 5827359 - DNA, 17 bp, Homo sapiens
aatttaattgtgtaact

SEQ ID NO: 5827360 - DNA, 18 bp, Homo sapiens
aatttaattgtgtaactg

SEQ ID NO: 5827361 - DNA, 20 bp, Homo sapiens
aatttaattgtgtaactgtt

SEQ ID NO: 5827362 - DNA, 23 bp, Homo sapiens
aatttaattgtgtaactgttctt

SEQ ID NO: 5827363 - DNA, 13 bp, Homo sapiens
aatttaatttttc

SEQ ID NO: 5827364 - DNA, 17 bp, Homo sapiens
aatttaatttttccttt

SEQ ID NO: 5827365 - DNA, 15 bp, Homo sapiens
aatttacaaaattta

SEQ ID NO: 5827366 - DNA, 19 bp, Homo sapiens
aatttacaaagtgtgtatt

SEQ ID NO: 5827367 - DNA, 21 bp, Homo sapiens
aatttacaaagtgtgtattaa

SEQ ID NO: 5827368 - DNA, 15 bp, Homo sapiens
aatttacaacttata

SEQ ID NO: 5827369 - DNA, 23 bp, Homo sapiens
aatttacaagatattattaattt

SEQ ID NO: 5827370 - DNA, 13 bp, Homo sapiens
aatttacacagtg

SEQ ID NO: 5827371 - DNA, 16 bp, Homo sapiens
aatttacacagtgaga

SEQ ID NO: 5827372 - DNA, 14 bp, Homo sapiens
aatttacacatctt

SEQ ID NO: 5827373 - DNA, 20 bp, Homo sapiens
aatttacacatcttaaaagt

SEQ ID NO: 5827374 - DNA, 17 bp, Homo sapiens
aatttacagagacagaa

SEQ ID NO: 5827375 - DNA, 19 bp, Homo sapiens
aatttacaggttcttaggc

SEQ ID NO: 5827376 - DNA, 23 bp, Homo sapiens
aatttacagtctagtacttatta

SEQ ID NO: 5827377 - DNA, 14 bp, Homo sapiens
aatttacatttaat

SEQ ID NO: 5827378 - DNA, 19 bp, Homo sapiens
aatttaccacaaaagcaaa

SEQ ID NO: 5827379 - DNA, 22 bp, Homo sapiens
aatttaccacaaaagcaaaatt

SEQ ID NO: 5827380 - DNA, 23 bp, Homo sapiens
aatttaccacaaaagcaaaattt

SEQ ID NO: 5827381 - DNA, 23 bp, Homo sapiens
aatttaccacaggatgcatatta

SEQ ID NO: 5827382 - DNA, 16 bp, Homo sapiens
aatttaccagaaatat

SEQ ID NO: 5827383 - DNA, 16 bp, Homo sapiens
aatttaccatcatctc

SEQ ID NO: 5827384 - DNA, 20 bp, Homo sapiens
aatttaccattattttacag

SEQ ID NO: 5827385 - DNA, 22 bp, Homo sapiens
aatttaccattattttacagtc

SEQ ID NO: 5827386 - DNA, 16 bp, Homo sapiens
aatttacctaagatta

SEQ ID NO: 5827387 - DNA, 20 bp, Homo sapiens
aatttacctctcattagaaa

SEQ ID NO: 5827388 - DNA, 15 bp, Homo sapiens
aatttacctgaagtc

SEQ ID NO: 5827389 - DNA, 17 bp, Homo sapiens
aatttacctttaaaata

SEQ ID NO: 5827390 - DNA, 18 bp, Homo sapiens
aatttacgtatatttcat

SEQ ID NO: 5827391 - DNA, 16 bp, Homo sapiens
aatttactacaatatg

SEQ ID NO: 5827392 - DNA, 23 bp, Homo sapiens
aatttactacaatatgtacattt

SEQ ID NO: 5827393 - DNA, 16 bp, Homo sapiens
aatttactatgtaaat

SEQ ID NO: 5827394 - DNA, 17 bp, Homo sapiens
aatttactatgtaaatg

SEQ ID NO: 5827395 - DNA, 16 bp, Homo sapiens
aatttactcacagcac

SEQ ID NO: 5827396 - DNA, 18 bp, Homo sapiens
aatttactcacagcactt

SEQ ID NO: 5827397 - DNA, 18 bp, Homo sapiens
aatttacttaagtgttca

SEQ ID NO: 5827398 - DNA, 22 bp, Homo sapiens
aatttacttaagtgttcatttt

SEQ ID NO: 5827399 - DNA, 13 bp, Homo sapiens
aatttacttgttt

SEQ ID NO: 5827400 - DNA, 16 bp, Homo sapiens
aatttacttgttttgg

SEQ ID NO: 5827401 - DNA, 16 bp, Homo sapiens
aatttactttaaacta

SEQ ID NO: 5827402 - DNA, 13 bp, Homo sapiens
aatttactttctg

SEQ ID NO: 5827403 - DNA, 15 bp, Homo sapiens
aatttactttctgca

SEQ ID NO: 5827404 - DNA, 23 bp, Homo sapiens
aatttactttttaaacagtgttt

SEQ ID NO: 5827405 - DNA, 12 bp, Homo sapiens
aatttagaaaac

SEQ ID NO: 5827406 - DNA, 18 bp, Homo sapiens
aatttagaaaacattcat

SEQ ID NO: 5827407 - DNA, 15 bp, Homo sapiens
aatttagaaaacttt

SEQ ID NO: 5827408 - DNA, 13 bp, Homo sapiens
aatttagaaacta

SEQ ID NO: 5827409 - DNA, 16 bp, Homo sapiens
aatttagaaactgaaa

SEQ ID NO: 5827410 - DNA, 19 bp, Homo sapiens
aatttagaaactgatttct

SEQ ID NO: 5827411 - DNA, 20 bp, Homo sapiens
aatttagaaataaaagatga

SEQ ID NO: 5827412 - DNA, 13 bp, Homo sapiens
aatttagaaatat

SEQ ID NO: 5827413 - DNA, 17 bp, Homo sapiens
aatttagaaatataatt

SEQ ID NO: 5827414 - DNA, 20 bp, Homo sapiens
aatttagaaatcattttgca

SEQ ID NO: 5827415 - DNA, 21 bp, Homo sapiens
aatttagaaatcattttgcaa

SEQ ID NO: 5827416 - DNA, 16 bp, Homo sapiens
aatttagacttggatt

SEQ ID NO: 5827417 - DNA, 21 bp, Homo sapiens
aatttagagataggaaactga

SEQ ID NO: 5827418 - DNA, 13 bp, Homo sapiens
aatttagagcgtt

SEQ ID NO: 5827419 - DNA, 20 bp, Homo sapiens
aatttagagcgtttggttaa

SEQ ID NO: 5827420 - DNA, 19 bp, Homo sapiens
aatttagagtcaatttgct

SEQ ID NO: 5827421 - DNA, 17 bp, Homo sapiens
aatttagatattcatac

SEQ ID NO: 5827422 - DNA, 15 bp, Homo sapiens
aatttagatcttata

SEQ ID NO: 5827423 - DNA, 16 bp, Homo sapiens
aatttagatcttatat

SEQ ID NO: 5827424 - DNA, 15 bp, Homo sapiens
aatttagatgaattt

SEQ ID NO: 5827425 - DNA, 22 bp, Homo sapiens
aatttagccagaatgtttcctg

SEQ ID NO: 5827426 - DNA, 20 bp, Homo sapiens
aatttagccctggtttgaaa

SEQ ID NO: 5827427 - DNA, 17 bp, Homo sapiens
aatttaggaatgctcaa

SEQ ID NO: 5827428 - DNA, 22 bp, Homo sapiens
aatttaggaatgctcaatgtgc

SEQ ID NO: 5827429 - DNA, 22 bp, Homo sapiens
aatttaggggaaaaaaaagtta

SEQ ID NO: 5827430 - DNA, 17 bp, Homo sapiens
aatttagggtactaaat

SEQ ID NO: 5827431 - DNA, 22 bp, Homo sapiens
aatttagggtactaaatttaaa

SEQ ID NO: 5827432 - DNA, 16 bp, Homo sapiens
aatttaggtaaataaa

SEQ ID NO: 5827433 - DNA, 18 bp, Homo sapiens
aatttaggtaaataaagc

SEQ ID NO: 5827434 - DNA, 14 bp, Homo sapiens
aatttagtaaatgt

SEQ ID NO: 5827435 - DNA, 16 bp, Homo sapiens
aatttagtctaacaca

SEQ ID NO: 5827436 - DNA, 13 bp, Homo sapiens
aatttagtgtata

SEQ ID NO: 5827437 - DNA, 20 bp, Homo sapiens
aatttagtgtatatgtgatt

SEQ ID NO: 5827438 - DNA, 17 bp, Homo sapiens
aatttagtgtatccata

SEQ ID NO: 5827439 - DNA, 13 bp, Homo sapiens
aatttagtgtttt

SEQ ID NO: 5827440 - DNA, 23 bp, Homo sapiens
aatttagtgtttttttatttcta

SEQ ID NO: 5827441 - DNA, 17 bp, Homo sapiens
aatttagttcatgcatt

SEQ ID NO: 5827442 - DNA, 14 bp, Homo sapiens
aatttagtttcata

SEQ ID NO: 5827443 - DNA, 22 bp, Homo sapiens
aatttagtttgttaaagcctgt

SEQ ID NO: 5827444 - DNA, 22 bp, Homo sapiens
aatttataaaaaggtgttttga

SEQ ID NO: 5827445 - DNA, 18 bp, Homo sapiens
aatttggcttctgttgtc

SEQ ID NO: 5827446 - DNA, 16 bp, Homo sapiens
aatttggctttcacat

SEQ ID NO: 5827447 - DNA, 18 bp, Homo sapiens
aatttgggaaaagaagct

SEQ ID NO: 5827448 - DNA, 18 bp, Homo sapiens
aatttgggaaaataaata

SEQ ID NO: 5827449 - DNA, 17 bp, Homo sapiens
aatttgggaccctgctt

SEQ ID NO: 5827450 - DNA, 18 bp, Homo sapiens
aatttgggaccctgcttt

SEQ ID NO: 5827451 - DNA, 18 bp, Homo sapiens
aatttgggacctgcttca

SEQ ID NO: 5827452 - DNA, 19 bp, Homo sapiens
aatttgggacctgcttcat

SEQ ID NO: 5827453 - DNA, 12 bp, Homo sapiens
aatttgggcaga

SEQ ID NO: 5827454 - DNA, 15 bp, Homo sapiens
aatttgggcctcttg

SEQ ID NO: 5827455 - DNA, 14 bp, Homo sapiens
aatttggggaaaat

SEQ ID NO: 5827456 - DNA, 11 bp, Homo sapiens
aatttggggac

SEQ ID NO: 5827457 - DNA, 19 bp, Homo sapiens
aatttggggctacttatat

SEQ ID NO: 5827458 - DNA, 21 bp, Homo sapiens
aatttgggggacttacatgat

SEQ ID NO: 5827459 - DNA, 17 bp, Homo sapiens
aatttgggtcccagcta

SEQ ID NO: 5827460 - DNA, 18 bp, Homo sapiens
aatttggtaaaaatgctg

SEQ ID NO: 5827461 - DNA, 21 bp, Homo sapiens
aatttggtaaaaatgctgctc

SEQ ID NO: 5827462 - DNA, 18 bp, Homo sapiens
aatttggtacacatgtgt

SEQ ID NO: 5827463 - DNA, 17 bp, Homo sapiens
aatttggtagatgacaa

SEQ ID NO: 5827464 - DNA, 20 bp, Homo sapiens
aatttggtcttagctttaca

SEQ ID NO: 5827465 - DNA, 16 bp, Homo sapiens
aatttggtgcttataa

SEQ ID NO: 5827466 - DNA, 19 bp, Homo sapiens
aatttggtgcttataagag

SEQ ID NO: 5827467 - DNA, 19 bp, Homo sapiens
aatttggtttttactcaac

SEQ ID NO: 5827468 - DNA, 22 bp, Homo sapiens
aatttgtaaacttctgaagact

SEQ ID NO: 5827469 - DNA, 22 bp, Homo sapiens
aatttgtaaagttggttggata

SEQ ID NO: 5827470 - DNA, 14 bp, Homo sapiens
aatttgtaaatatt

SEQ ID NO: 5827471 - DNA, 12 bp, Homo sapiens
aatttgtaaatg

SEQ ID NO: 5827472 - DNA, 16 bp, Homo sapiens
aatttgtaacctcagc

SEQ ID NO: 5827473 - DNA, 16 bp, Homo sapiens
aatttgtaagtttcag

SEQ ID NO: 5827474 - DNA, 13 bp, Homo sapiens
aatttgtaataaa

SEQ ID NO: 5827475 - DNA, 18 bp, Homo sapiens
aatttgtaataaaactat

SEQ ID NO: 5827476 - DNA, 12 bp, Homo sapiens
aatttgtaatat

SEQ ID NO: 5827477 - DNA, 21 bp, Homo sapiens
aatttgtaatatatcctgttt

SEQ ID NO: 5827478 - DNA, 17 bp, Homo sapiens
aatttgtaatgtcttga

SEQ ID NO: 5827479 - DNA, 19 bp, Homo sapiens
aatttgtaattgcttacat

SEQ ID NO: 5827480 - DNA, 19 bp, Homo sapiens
aatttgtacaggactgtaa

SEQ ID NO: 5827481 - DNA, 20 bp, Homo sapiens
aatttgtacatatgtaaaat

SEQ ID NO: 5827482 - DNA, 19 bp, Homo sapiens
aatttgtacccttgttatt

SEQ ID NO: 5827483 - DNA, 23 bp, Homo sapiens
aatttgtacttttttcttaaggc

SEQ ID NO: 5827484 - DNA, 13 bp, Homo sapiens
aatttgtatatca

SEQ ID NO: 5827485 - DNA, 14 bp, Homo sapiens
aatttgtatatgac

SEQ ID NO: 5827486 - DNA, 17 bp, Homo sapiens
aatttgtatatgactgc

SEQ ID NO: 5827487 - DNA, 21 bp, Homo sapiens
aatttgtatatgactgcattt

SEQ ID NO: 5827488 - DNA, 18 bp, Homo sapiens
aatttgtatctgaaggag

SEQ ID NO: 5827489 - DNA, 19 bp, Homo sapiens
aatttgtatctgaaggaga

SEQ ID NO: 5827490 - DNA, 18 bp, Homo sapiens
aatttgtatgctaaatga

SEQ ID NO: 5827491 - DNA, 13 bp, Homo sapiens
aatttgtattgaa

SEQ ID NO: 5827492 - DNA, 12 bp, Homo sapiens
aatttgtcactg

SEQ ID NO: 5827493 - DNA, 14 bp, Homo sapiens
aatttgtcatgtta

SEQ ID NO: 5827494 - DNA, 15 bp, Homo sapiens
aatttgtcatgttac

SEQ ID NO: 5827495 - DNA, 17 bp, Homo sapiens
aatttgtcattttgaag

SEQ ID NO: 5827496 - DNA, 20 bp, Homo sapiens
aatttgtcattttgaagcta

SEQ ID NO: 5827497 - DNA, 22 bp, Homo sapiens
aatttgtcattttgaagctaat

SEQ ID NO: 5827498 - DNA, 23 bp, Homo sapiens
aatttgtccaatggctgtaaact

SEQ ID NO: 5827499 - DNA, 16 bp, Homo sapiens
aatttgtctcctactc

SEQ ID NO: 5827500 - DNA, 20 bp, Homo sapiens
aatttgtctcctactctgtg

SEQ ID NO: 5827501 - DNA, 12 bp, Homo sapiens
aatttgtctttg

SEQ ID NO: 5827502 - DNA, 14 bp, Homo sapiens
aatttgtctttgga

SEQ ID NO: 5827503 - DNA, 15 bp, Homo sapiens
aatttgtctttggaa

SEQ ID NO: 5827504 - DNA, 16 bp, Homo sapiens
aatttgtctttggaaa

SEQ ID NO: 5827505 - DNA, 17 bp, Homo sapiens
aatttgtgaaaatgtaa

SEQ ID NO: 5827506 - DNA, 14 bp, Homo sapiens
aatttgtgaaagtg

SEQ ID NO: 5827507 - DNA, 21 bp, Homo sapiens
aatttgtgaaagtggcaagct

SEQ ID NO: 5827508 - DNA, 15 bp, Homo sapiens
aatttgtgaatttgc

SEQ ID NO: 5827509 - DNA, 16 bp, Homo sapiens
aatttgtgaatttgca

SEQ ID NO: 5827510 - DNA, 18 bp, Homo sapiens
aatttgtgatacaatgct

SEQ ID NO: 5827511 - DNA, 17 bp, Homo sapiens
aatttgtgtaaatttgt

SEQ ID NO: 5827512 - DNA, 19 bp, Homo sapiens
aatttgtgtaaatttgtat

SEQ ID NO: 5827513 - DNA, 16 bp, Homo sapiens
aatttgtgtaataaag

SEQ ID NO: 5827514 - DNA, 17 bp, Homo sapiens
aatttgtgtaataaagt

SEQ ID NO: 5827515 - DNA, 20 bp, Homo sapiens
aatttgtgtaataaagtgtt

SEQ ID NO: 5827516 - DNA, 17 bp, Homo sapiens
aatttgtgtctgtgttt

SEQ ID NO: 5827517 - DNA, 10 bp, Homo sapiens
aatttgtgtg

SEQ ID NO: 5827518 - DNA, 12 bp, Homo sapiens
aatttgtgtgct

SEQ ID NO: 5827519 - DNA, 21 bp, Homo sapiens
aatttgtgtgtttttagctgt

SEQ ID NO: 5827520 - DNA, 17 bp, Homo sapiens
aatttgttaacagagca

SEQ ID NO: 5827521 - DNA, 16 bp, Homo sapiens
aatttgttaatatata

SEQ ID NO: 5827522 - DNA, 20 bp, Homo sapiens
aatttgttaattcctatgaa

SEQ ID NO: 5827523 - DNA, 14 bp, Homo sapiens
aatttgttagacta

SEQ ID NO: 5827524 - DNA, 23 bp, Homo sapiens
aatttgttataaggtagtactga

SEQ ID NO: 5827525 - DNA, 16 bp, Homo sapiens
aatttgttataatgaa

SEQ ID NO: 5827526 - DNA, 18 bp, Homo sapiens
aatttgttatacttcaaa

SEQ ID NO: 5827527 - DNA, 16 bp, Homo sapiens
aatttgttctgtgcaa

SEQ ID NO: 5827528 - DNA, 12 bp, Homo sapiens
aatttgttcttt

SEQ ID NO: 5827529 - DNA, 21 bp, Homo sapiens
aatttgttggggctttacata

SEQ ID NO: 5827530 - DNA, 14 bp, Homo sapiens
aatttgttgtactt

SEQ ID NO: 5827531 - DNA, 18 bp, Homo sapiens
aatttgttgtcatgtgta

SEQ ID NO: 5827532 - DNA, 16 bp, Homo sapiens
aatttgtttaaaattc

SEQ ID NO: 5827533 - DNA, 20 bp, Homo sapiens
aatttgtttaaaattctctt

SEQ ID NO: 5827534 - DNA, 20 bp, Homo sapiens
aatttgtttaaagaataaag

SEQ ID NO: 5827535 - DNA, 21 bp, Homo sapiens
aatttgtttaattaaatttaa

SEQ ID NO: 5827536 - DNA, 17 bp, Homo sapiens
aatttgtttcatctatt

SEQ ID NO: 5827537 - DNA, 18 bp, Homo sapiens
aatttgtttcatctattt

SEQ ID NO: 5827538 - DNA, 18 bp, Homo sapiens
aatttgtttcttctgtct

SEQ ID NO: 5827539 - DNA, 21 bp, Homo sapiens
aatttgtttcttctgtcttta

SEQ ID NO: 5827540 - DNA, 17 bp, Homo sapiens
aatttgtttgaaatctt

SEQ ID NO: 5827541 - DNA, 12 bp, Homo sapiens
aatttgtttgac

SEQ ID NO: 5827542 - DNA, 15 bp, Homo sapiens
aatttgtttgtgctt

SEQ ID NO: 5827543 - DNA, 19 bp, Homo sapiens
aatttgtttgtgttcaata

SEQ ID NO: 5827544 - DNA, 23 bp, Homo sapiens
aatttgtttgtgttcaatatcag

SEQ ID NO: 5827545 - DNA, 14 bp, Homo sapiens
aatttgttttcaac

SEQ ID NO: 5827546 - DNA, 17 bp, Homo sapiens
aatttgttttggatata

SEQ ID NO: 5827547 - DNA, 17 bp, Homo sapiens
aatttgttttgttttaa

SEQ ID NO: 5827548 - DNA, 20 bp, Homo sapiens
aatttgtttttgcatttttg

SEQ ID NO: 5827549 - DNA, 12 bp, Homo sapiens
aattttaaaaaa

SEQ ID NO: 5827550 - DNA, 17 bp, Homo sapiens
aattttaaaaaataaca

SEQ ID NO: 5827551 - DNA, 18 bp, Homo sapiens
aattttaaaaatacatat

SEQ ID NO: 5827552 - DNA, 18 bp, Homo sapiens
aattttaaaaataccaat

SEQ ID NO: 5827553 - DNA, 14 bp, Homo sapiens
aattttaaaaatga

SEQ ID NO: 5827554 - DNA, 20 bp, Homo sapiens
aattttaaaaatggtggctt

SEQ ID NO: 5827555 - DNA, 16 bp, Homo sapiens
aattttaaaagcatat

SEQ ID NO: 5827556 - DNA, 19 bp, Homo sapiens
aattttaaaagcatatata

SEQ ID NO: 5827557 - DNA, 15 bp, Homo sapiens
aattttaaaatctga

SEQ ID NO: 5827558 - DNA, 14 bp, Homo sapiens
aattttaaaatgta

SEQ ID NO: 5827559 - DNA, 15 bp, Homo sapiens
aattttaaaatgttt

SEQ ID NO: 5827560 - DNA, 21 bp, Homo sapiens
aattttaaaatgtttaggaaa

SEQ ID NO: 5827561 - DNA, 14 bp, Homo sapiens
aattttaaacatat

SEQ ID NO: 5827562 - DNA, 12 bp, Homo sapiens
aattttaaagcc

SEQ ID NO: 5827563 - DNA, 12 bp, Homo sapiens
aattttaaagta

SEQ ID NO: 5827564 - DNA, 19 bp, Homo sapiens
aattttaaagtaatttcta

SEQ ID NO: 5827565 - DNA, 16 bp, Homo sapiens
aattttaaagtgcaaa

SEQ ID NO: 5827566 - DNA, 12 bp, Homo sapiens
aattttaaagtt

SEQ ID NO: 5827567 - DNA, 22 bp, Homo sapiens
aattttaaataacctctggccc

SEQ ID NO: 5827568 - DNA, 17 bp, Homo sapiens
aattttaaataatttct

SEQ ID NO: 5827569 - DNA, 12 bp, Homo sapiens
aattttaaatgc

SEQ ID NO: 5827570 - DNA, 19 bp, Homo sapiens
aattttaacactaaccaaa

SEQ ID NO: 5827571 - DNA, 21 bp, Homo sapiens
aattttaacagacatgtatac

SEQ ID NO: 5827572 - DNA, 11 bp, Homo sapiens
aattttaactg

SEQ ID NO: 5827573 - DNA, 13 bp, Homo sapiens
aattttaactttt

SEQ ID NO: 5827574 - DNA, 16 bp, Homo sapiens
aattttaagattcctt

SEQ ID NO: 5827575 - DNA, 17 bp, Homo sapiens
aattttaagattccttt

SEQ ID NO: 5827576 - DNA, 19 bp, Homo sapiens
aattttaagattccttttc

SEQ ID NO: 5827577 - DNA, 21 bp, Homo sapiens
aattttaaggcatatttaaca

SEQ ID NO: 5827578 - DNA, 22 bp, Homo sapiens
aattttaaggtagaacctcacc

SEQ ID NO: 5827579 - DNA, 20 bp, Homo sapiens
aattttaatattcttttgtt

SEQ ID NO: 5827580 - DNA, 20 bp, Homo sapiens
aattttaatctgaaaattta

SEQ ID NO: 5827581 - DNA, 16 bp, Homo sapiens
aattttaatgaagaaa

SEQ ID NO: 5827582 - DNA, 23 bp, Homo sapiens
aattttaatgtaaaattcatagc

SEQ ID NO: 5827583 - DNA, 16 bp, Homo sapiens
aattttaatgtgaaga

SEQ ID NO: 5827584 - DNA, 12 bp, Homo sapiens
aattttaattta

SEQ ID NO: 5827585 - DNA, 13 bp, Homo sapiens
aattttaatttat

SEQ ID NO: 5827586 - DNA, 15 bp, Homo sapiens
aattttaatttattt

SEQ ID NO: 5827587 - DNA, 16 bp, Homo sapiens
aattttaatttctgat

SEQ ID NO: 5827588 - DNA, 13 bp, Homo sapiens
aattttacaaagt

SEQ ID NO: 5827589 - DNA, 23 bp, Homo sapiens
aattttacaagggcataaagtaa

SEQ ID NO: 5827590 - DNA, 19 bp, Homo sapiens
aattttacaattatggaaa

SEQ ID NO: 5827591 - DNA, 16 bp, Homo sapiens
aattttacaatttata

SEQ ID NO: 5827592 - DNA, 16 bp, Homo sapiens
aattttacatgtctca

SEQ ID NO: 5827593 - DNA, 17 bp, Homo sapiens
aattttaccaagttata

SEQ ID NO: 5827594 - DNA, 23 bp, Homo sapiens
aattttaccctgaggtcactgct

SEQ ID NO: 5827595 - DNA, 18 bp, Homo sapiens
aattttaccctttagact

SEQ ID NO: 5827596 - DNA, 21 bp, Homo sapiens
aattttaccctttagactgta

SEQ ID NO: 5827597 - DNA, 17 bp, Homo sapiens
aattttacctattctga

SEQ ID NO: 5827598 - DNA, 23 bp, Homo sapiens
aattttactccataaacagactg

SEQ ID NO: 5827599 - DNA, 21 bp, Homo sapiens
aattttactgacagaaatgca

SEQ ID NO: 5827600 - DNA, 15 bp, Homo sapiens
aattttactgtgaaa

SEQ ID NO: 5827601 - DNA, 14 bp, Homo sapiens
aattttacttccat

SEQ ID NO: 5827602 - DNA, 14 bp, Homo sapiens
aattttacttttta

SEQ ID NO: 5827603 - DNA, 21 bp, Homo sapiens
aattttagaaaacacccaata

SEQ ID NO: 5827604 - DNA, 18 bp, Homo sapiens
aattttagaaagaaaatt

SEQ ID NO: 5827605 - DNA, 13 bp, Homo sapiens
aattttagaaata

SEQ ID NO: 5827606 - DNA, 20 bp, Homo sapiens
aattttagacgatcacagaa

SEQ ID NO: 5827607 - DNA, 14 bp, Homo sapiens
aattttagcttttg

SEQ ID NO: 5827608 - DNA, 12 bp, Homo sapiens
aattttaggaac

SEQ ID NO: 5827609 - DNA, 21 bp, Homo sapiens
aattttaggaacttcagagat

SEQ ID NO: 5827610 - DNA, 22 bp, Homo sapiens
aattttagtattaactctgtaa

SEQ ID NO: 5827611 - DNA, 17 bp, Homo sapiens
aattttagtccaaataa

SEQ ID NO: 5827612 - DNA, 14 bp, Homo sapiens
aattttagtgtatt

SEQ ID NO: 5827613 - DNA, 15 bp, Homo sapiens
aattttagtgtatta

SEQ ID NO: 5827614 - DNA, 18 bp, Homo sapiens
aattttagtttttcatta

SEQ ID NO: 5827615 - DNA, 21 bp, Homo sapiens
aattttataaggacttcctga

SEQ ID NO: 5827616 - DNA, 20 bp, Homo sapiens
aattttatactttccctacc

SEQ ID NO: 5827617 - DNA, 19 bp, Homo sapiens
aattttatagctcagttta

SEQ ID NO: 5827618 - DNA, 20 bp, Homo sapiens
aattttatagctcagtttat

SEQ ID NO: 5827619 - DNA, 18 bp, Homo sapiens
aattttatagtagtggga

SEQ ID NO: 5827620 - DNA, 16 bp, Homo sapiens
aattttatatgtaaat

SEQ ID NO: 5827621 - DNA, 17 bp, Homo sapiens
aattttatatgtaaatg

SEQ ID NO: 5827622 - DNA, 19 bp, Homo sapiens
aattttatatgtaaatgtg

SEQ ID NO: 5827623 - DNA, 16 bp, Homo sapiens
aattttatctcttatt

SEQ ID NO: 5827624 - DNA, 18 bp, Homo sapiens
acaaacttttataaatgt

SEQ ID NO: 5827625 - DNA, 13 bp, Homo sapiens
acaaagaaaataa

SEQ ID NO: 5827626 - DNA, 12 bp, Homo sapiens
acaaagaaaatt

SEQ ID NO: 5827627 - DNA, 17 bp, Homo sapiens
acaaagaaacaaagatg

SEQ ID NO: 5827628 - DNA, 21 bp, Homo sapiens
acaaagaaaggtgccatgtct

SEQ ID NO: 5827629 - DNA, 22 bp, Homo sapiens
acaaagaaatccccccttcaga

SEQ ID NO: 5827630 - DNA, 21 bp, Homo sapiens
acaaagaaatccggagaagct

SEQ ID NO: 5827631 - DNA, 22 bp, Homo sapiens
acaaagaaatccggagaagctg

SEQ ID NO: 5827632 - DNA, 20 bp, Homo sapiens
acaaagaaccatgcaggaag

SEQ ID NO: 5827633 - DNA, 15 bp, Homo sapiens
acaaagaacttgctg

SEQ ID NO: 5827634 - DNA, 19 bp, Homo sapiens
acaaagaacttgctgctgc

SEQ ID NO: 5827635 - DNA, 16 bp, Homo sapiens
acaaagaagaaccatc

SEQ ID NO: 5827636 - DNA, 18 bp, Homo sapiens
acaaagaagacaacatta

SEQ ID NO: 5827637 - DNA, 15 bp, Homo sapiens
acaaagaagacatgt

SEQ ID NO: 5827638 - DNA, 13 bp, Homo sapiens
acaaagaaggaaa

SEQ ID NO: 5827639 - DNA, 15 bp, Homo sapiens
acaaagaaggaaata

SEQ ID NO: 5827640 - DNA, 14 bp, Homo sapiens
acaaagaatttaaa

SEQ ID NO: 5827641 - DNA, 17 bp, Homo sapiens
acaaagacaaaagtctg

SEQ ID NO: 5827642 - DNA, 18 bp, Homo sapiens
acaaagacaaaagtctgt

SEQ ID NO: 5827643 - DNA, 18 bp, Homo sapiens
acaaagacaaattctgtt

SEQ ID NO: 5827644 - DNA, 19 bp, Homo sapiens
acaaagacatgctttccat

SEQ ID NO: 5827645 - DNA, 15 bp, Homo sapiens
acaaagacatggaag

SEQ ID NO: 5827646 - DNA, 16 bp, Homo sapiens
acaaagacattgacag

SEQ ID NO: 5827647 - DNA, 18 bp, Homo sapiens
acaaagacattgacagca

SEQ ID NO: 5827648 - DNA, 15 bp, Homo sapiens
acaaagacattgatt

SEQ ID NO: 5827649 - DNA, 13 bp, Homo sapiens
acaaagacattta

SEQ ID NO: 5827650 - DNA, 21 bp, Homo sapiens
acaaagacatttatatgggtt

SEQ ID NO: 5827651 - DNA, 16 bp, Homo sapiens
acaaagaccaaaatga

SEQ ID NO: 5827652 - DNA, 18 bp, Homo sapiens
acaaagacgcaaggtgtg

SEQ ID NO: 5827653 - DNA, 20 bp, Homo sapiens
acaaagactcctctgggcct

SEQ ID NO: 5827654 - DNA, 17 bp, Homo sapiens
acaaagacttgctttaa

SEQ ID NO: 5827655 - DNA, 20 bp, Homo sapiens
acaaagagaaaaagaaatgc

SEQ ID NO: 5827656 - DNA, 21 bp, Homo sapiens
acaaagagaaaaagaaatgca

SEQ ID NO: 5827657 - DNA, 14 bp, Homo sapiens
acaaagagaccagg

SEQ ID NO: 5827658 - DNA, 16 bp, Homo sapiens
acaaagagatatttag

SEQ ID NO: 5827659 - DNA, 17 bp, Homo sapiens
acaaagagatgtccttg

SEQ ID NO: 5827660 - DNA, 20 bp, Homo sapiens
acaaagagctgacagtgctt

SEQ ID NO: 5827661 - DNA, 22 bp, Homo sapiens
acaaagagggagttggctggat

SEQ ID NO: 5827662 - DNA, 13 bp, Homo sapiens
acaaagagtgaaa

SEQ ID NO: 5827663 - DNA, 15 bp, Homo sapiens
acaaagagtgaaata

SEQ ID NO: 5827664 - DNA, 20 bp, Homo sapiens
acaaagagtgaaatattgta

SEQ ID NO: 5827665 - DNA, 19 bp, Homo sapiens
acaaagagttcaagaaata

SEQ ID NO: 5827666 - DNA, 21 bp, Homo sapiens
acaaagagttcaagaaataag

SEQ ID NO: 5827667 - DNA, 21 bp, Homo sapiens
acaaagataacgcaggagaga

SEQ ID NO: 5827668 - DNA, 22 bp, Homo sapiens
acaaagatacttgatgcactta

SEQ ID NO: 5827669 - DNA, 20 bp, Homo sapiens
acaaagatgagctctgaaca

SEQ ID NO: 5827670 - DNA, 21 bp, Homo sapiens
acaaagatgtttgtcagatat

SEQ ID NO: 5827671 - DNA, 22 bp, Homo sapiens
acaaagatgtttgtcagatatg

SEQ ID NO: 5827672 - DNA, 23 bp, Homo sapiens
acaaagatgtttgtcagatatga

SEQ ID NO: 5827673 - DNA, 19 bp, Homo sapiens
acaaagattctctatgtat

SEQ ID NO: 5827674 - DNA, 16 bp, Homo sapiens
acaaagcaaaggcagt

SEQ ID NO: 5827675 - DNA, 15 bp, Homo sapiens
acaaagcacagtgtt

SEQ ID NO: 5827676 - DNA, 16 bp, Homo sapiens
acaaagcacagtttga

SEQ ID NO: 5827677 - DNA, 17 bp, Homo sapiens
acaaagcacagtttgaa

SEQ ID NO: 5827678 - DNA, 19 bp, Homo sapiens
acaaagcacagtttgaaca

SEQ ID NO: 5827679 - DNA, 19 bp, Homo sapiens
acaaagcacataactggat

SEQ ID NO: 5827680 - DNA, 15 bp, Homo sapiens
acaaagcactagaga

SEQ ID NO: 5827681 - DNA, 17 bp, Homo sapiens
acaaagcactggccttg

SEQ ID NO: 5827682 - DNA, 14 bp, Homo sapiens
acaaagcagccacg

SEQ ID NO: 5827683 - DNA, 12 bp, Homo sapiens
acaaagcatgct

SEQ ID NO: 5827684 - DNA, 14 bp, Homo sapiens
acaaagcatgctca

SEQ ID NO: 5827685 - DNA, 15 bp, Homo sapiens
acaaagcatgctcag

SEQ ID NO: 5827686 - DNA, 20 bp, Homo sapiens
acaaagcatgctcagtattg

SEQ ID NO: 5827687 - DNA, 21 bp, Homo sapiens
acaaagcatgctcagtattga

SEQ ID NO: 5827688 - DNA, 17 bp, Homo sapiens
acaaagcatgggaaaaa

SEQ ID NO: 5827689 - DNA, 18 bp, Homo sapiens
acaaagcatgggaaaaag

SEQ ID NO: 5827690 - DNA, 22 bp, Homo sapiens
acaaagcatgggaaaaagagac

SEQ ID NO: 5827691 - DNA, 17 bp, Homo sapiens
acaaagccaacagtcaa

SEQ ID NO: 5827692 - DNA, 18 bp, Homo sapiens
acaaagccactttcaatc

SEQ ID NO: 5827693 - DNA, 11 bp, Homo sapiens
acaaagccaga

SEQ ID NO: 5827694 - DNA, 13 bp, Homo sapiens
acaaagcccaagg

SEQ ID NO: 5827695 - DNA, 18 bp, Homo sapiens
acaaagccccccagctcc

SEQ ID NO: 5827696 - DNA, 20 bp, Homo sapiens
acaaagccccccagctccca

SEQ ID NO: 5827697 - DNA, 18 bp, Homo sapiens
acaaagcccttccatgtc

SEQ ID NO: 5827698 - DNA, 16 bp, Homo sapiens
acaaagcccttttata

SEQ ID NO: 5827699 - DNA, 18 bp, Homo sapiens
acaaagccttaaaatgca

SEQ ID NO: 5827700 - DNA, 22 bp, Homo sapiens
acaaagcggctttctaatagag

SEQ ID NO: 5827701 - DNA, 15 bp, Homo sapiens
acaaagcgtgcacaa

SEQ ID NO: 5827702 - DNA, 22 bp, Homo sapiens
acaaagctaaatacatggaaat

SEQ ID NO: 5827703 - DNA, 23 bp, Homo sapiens
acaaagctaggatggttctgtga

SEQ ID NO: 5827704 - DNA, 15 bp, Homo sapiens
acaaagctcaaaaca

SEQ ID NO: 5827705 - DNA, 18 bp, Homo sapiens
acaaagctcaagatgaca

SEQ ID NO: 5827706 - DNA, 22 bp, Homo sapiens
acaaagctcaagatgacagctc

SEQ ID NO: 5827707 - DNA, 20 bp, Homo sapiens
acaaagctcaggaatcctac

SEQ ID NO: 5827708 - DNA, 16 bp, Homo sapiens
acaaagctgctaaatc

SEQ ID NO: 5827709 - DNA, 17 bp, Homo sapiens
acaaagctgctaaatct

SEQ ID NO: 5827710 - DNA, 16 bp, Homo sapiens
acaaagctgtgaaatg

SEQ ID NO: 5827711 - DNA, 17 bp, Homo sapiens
acaaagctgtgaaatgt

SEQ ID NO: 5827712 - DNA, 20 bp, Homo sapiens
acaaagctgttaaactgtta

SEQ ID NO: 5827713 - DNA, 16 bp, Homo sapiens
acaaagcttagcagga

SEQ ID NO: 5827714 - DNA, 15 bp, Homo sapiens
acaaagcttctaaag

SEQ ID NO: 5827715 - DNA, 17 bp, Homo sapiens
acaaagcttctaaagca

SEQ ID NO: 5827716 - DNA, 18 bp, Homo sapiens
acaaaggaatggaggctc

SEQ ID NO: 5827717 - DNA, 14 bp, Homo sapiens
acaaaggagcctgt

SEQ ID NO: 5827718 - DNA, 13 bp, Homo sapiens
acaaaggagcctt

SEQ ID NO: 5827719 - DNA, 15 bp, Homo sapiens
acaaaggagccttga

SEQ ID NO: 5827720 - DNA, 15 bp, Homo sapiens
acaaaggaggaattt

SEQ ID NO: 5827721 - DNA, 18 bp, Homo sapiens
acaaaggagtgagtgaaa

SEQ ID NO: 5827722 - DNA, 21 bp, Homo sapiens
acaaaggatgaagaacacagc

SEQ ID NO: 5827723 - DNA, 19 bp, Homo sapiens
acaaaggatttgaaaacac

SEQ ID NO: 5827724 - DNA, 18 bp, Homo sapiens
acaaaggcaaagggtcca

SEQ ID NO: 5827725 - DNA, 11 bp, Homo sapiens
acaaaggcaag

SEQ ID NO: 5827726 - DNA, 13 bp, Homo sapiens
acaaaggcagctg

SEQ ID NO: 5827727 - DNA, 19 bp, Homo sapiens
acaaaggcagctgtgtctg

SEQ ID NO: 5827728 - DNA, 22 bp, Homo sapiens
acaaaggcagctgtgtctgagc

SEQ ID NO: 5827729 - DNA, 17 bp, Homo sapiens
acaaaggcatgctggag

SEQ ID NO: 5827730 - DNA, 14 bp, Homo sapiens
acaaaggccaaact

SEQ ID NO: 5827731 - DNA, 13 bp, Homo sapiens
acaaaggccacag

SEQ ID NO: 5827732 - DNA, 14 bp, Homo sapiens
acaaaggccacagg

SEQ ID NO: 5827733 - DNA, 13 bp, Homo sapiens
acaaaggcccaga

SEQ ID NO: 5827734 - DNA, 20 bp, Homo sapiens
acaaaggctgtattcagcaa

SEQ ID NO: 5827735 - DNA, 22 bp, Homo sapiens
acaaagggaaaaaagagtttaa

SEQ ID NO: 5827736 - DNA, 15 bp, Homo sapiens
acaaagggaaagcct

SEQ ID NO: 5827737 - DNA, 19 bp, Homo sapiens
acaaagggaaagcctctgg

SEQ ID NO: 5827738 - DNA, 20 bp, Homo sapiens
acaaagggaaagcctctggc

SEQ ID NO: 5827739 - DNA, 16 bp, Homo sapiens
acaaagggacacacag

SEQ ID NO: 5827740 - DNA, 21 bp, Homo sapiens
acaaagggagggagcaagccc

SEQ ID NO: 5827741 - DNA, 15 bp, Homo sapiens
acaaagggcaggcct

SEQ ID NO: 5827742 - DNA, 13 bp, Homo sapiens
acaaaggggagaa

SEQ ID NO: 5827743 - DNA, 23 bp, Homo sapiens
acaaaggggagaagggccagccc

SEQ ID NO: 5827744 - DNA, 15 bp, Homo sapiens
acaaagggttttctt

SEQ ID NO: 5827745 - DNA, 16 bp, Homo sapiens
acaaaggtaagagaaa

SEQ ID NO: 5827746 - DNA, 19 bp, Homo sapiens
acaaaggtataattttatg

SEQ ID NO: 5827747 - DNA, 22 bp, Homo sapiens
acaaaggtggaataaacattaa

SEQ ID NO: 5827748 - DNA, 14 bp, Homo sapiens
acaaaggttccatt

SEQ ID NO: 5827749 - DNA, 19 bp, Homo sapiens
acaaaggtttaaagtttga

SEQ ID NO: 5827750 - DNA, 23 bp, Homo sapiens
acaaaggtttaaatgaacaagag

SEQ ID NO: 5827751 - DNA, 15 bp, Homo sapiens
acaaagtaaaatgaa

SEQ ID NO: 5827752 - DNA, 20 bp, Homo sapiens
acaaagtaatttctttgatc

SEQ ID NO: 5827753 - DNA, 13 bp, Homo sapiens
acaaagtagagaa

SEQ ID NO: 5827754 - DNA, 15 bp, Homo sapiens
acaaagtagagaagt

SEQ ID NO: 5827755 - DNA, 16 bp, Homo sapiens
acaaagtattaagcat

SEQ ID NO: 5827756 - DNA, 20 bp, Homo sapiens
acaaagtattaagcatatat

SEQ ID NO: 5827757 - DNA, 20 bp, Homo sapiens
acaaagtcatcccctctcag

SEQ ID NO: 5827758 - DNA, 16 bp, Homo sapiens
acaaagtccaagtctg

SEQ ID NO: 5827759 - DNA, 17 bp, Homo sapiens
acaaagtgaaattagta

SEQ ID NO: 5827760 - DNA, 23 bp, Homo sapiens
acaaagtgaaattagtattttga

SEQ ID NO: 5827761 - DNA, 18 bp, Homo sapiens
acaaagtgactgtttggc

SEQ ID NO: 5827762 - DNA, 21 bp, Homo sapiens
acaaagtgactgtttggctta

SEQ ID NO: 5827763 - DNA, 16 bp, Homo sapiens
acaaagtgagaaatta

SEQ ID NO: 5827764 - DNA, 15 bp, Homo sapiens
acaaagtgcaaagct

SEQ ID NO: 5827765 - DNA, 17 bp, Homo sapiens
acaaagtgcaaagctgc

SEQ ID NO: 5827766 - DNA, 11 bp, Homo sapiens
acaaagtgcct

SEQ ID NO: 5827767 - DNA, 18 bp, Homo sapiens
acaaagtgctatgcggag

SEQ ID NO: 5827768 - DNA, 14 bp, Homo sapiens
acaaagtgctggga

SEQ ID NO: 5827769 - DNA, 17 bp, Homo sapiens
acaaagtggaaggaaag

SEQ ID NO: 5827770 - DNA, 19 bp, Homo sapiens
acaaagtggaaggaaagat

SEQ ID NO: 5827771 - DNA, 19 bp, Homo sapiens
acaaagtggcataaaaaac

SEQ ID NO: 5827772 - DNA, 23 bp, Homo sapiens
acaaagtgggtgtgtggcctccc

SEQ ID NO: 5827773 - DNA, 14 bp, Homo sapiens
acaaagtgtattca

SEQ ID NO: 5827774 - DNA, 23 bp, Homo sapiens
acaaagtgtattttataaaatta

SEQ ID NO: 5827775 - DNA, 15 bp, Homo sapiens
acaaagtgtgtaatt

SEQ ID NO: 5827776 - DNA, 20 bp, Homo sapiens
acaaagtgtgtaattatgta

SEQ ID NO: 5827777 - DNA, 13 bp, Homo sapiens
acaaagtgtgtat

SEQ ID NO: 5827778 - DNA, 14 bp, Homo sapiens
acaaagtgttgaaa

SEQ ID NO: 5827779 - DNA, 21 bp, Homo sapiens
acaaagttactggctctttgt

SEQ ID NO: 5827780 - DNA, 19 bp, Homo sapiens
acaaagttccaaaatgcca

SEQ ID NO: 5827781 - DNA, 14 bp, Homo sapiens
acaaagttctcaga

SEQ ID NO: 5827782 - DNA, 17 bp, Homo sapiens
acaaagttctcagagct

SEQ ID NO: 5827783 - DNA, 20 bp, Homo sapiens
acaaagtttacattgtcctg

SEQ ID NO: 5827784 - DNA, 19 bp, Homo sapiens
acaaagtttcaatttgttt

SEQ ID NO: 5827785 - DNA, 14 bp, Homo sapiens
acaaagtttcagag

SEQ ID NO: 5827786 - DNA, 22 bp, Homo sapiens
acaaagtttcagagtatattgt

SEQ ID NO: 5827787 - DNA, 18 bp, Homo sapiens
acaaagtttgtggtaatt

SEQ ID NO: 5827788 - DNA, 13 bp, Homo sapiens
acaaagtttgttc

SEQ ID NO: 5827789 - DNA, 19 bp, Homo sapiens
acaaagttttaaacgaaat

SEQ ID NO: 5827790 - DNA, 12 bp, Homo sapiens
acaaataaaagt

SEQ ID NO: 5827791 - DNA, 18 bp, Homo sapiens
acaaataaaatacttttt

SEQ ID NO: 5827792 - DNA, 12 bp, Homo sapiens
acaaataaagca

SEQ ID NO: 5827793 - DNA, 15 bp, Homo sapiens
acaaataaataaata

SEQ ID NO: 5827794 - DNA, 14 bp, Homo sapiens
acaaataaatgatt

SEQ ID NO: 5827795 - DNA, 14 bp, Homo sapiens
acaaataacaactt

SEQ ID NO: 5827796 - DNA, 22 bp, Homo sapiens
acaaataacaacttttttttct

SEQ ID NO: 5827797 - DNA, 17 bp, Homo sapiens
acaaataagattaataa

SEQ ID NO: 5827798 - DNA, 21 bp, Homo sapiens
acaaataagtcaaaataatct

SEQ ID NO: 5827799 - DNA, 18 bp, Homo sapiens
acaaataagtttttgcta

SEQ ID NO: 5827800 - DNA, 16 bp, Homo sapiens
acaaataataagcaaa

SEQ ID NO: 5827801 - DNA, 16 bp, Homo sapiens
acaaataatattgcct

SEQ ID NO: 5827802 - DNA, 14 bp, Homo sapiens
acaactggaagctt

SEQ ID NO: 5827803 - DNA, 16 bp, Homo sapiens
acaactggaagctttg

SEQ ID NO: 5827804 - DNA, 22 bp, Homo sapiens
acaactgtcagaataaagaaca

SEQ ID NO: 5827805 - DNA, 19 bp, Homo sapiens
acaactgtctaactttaga

SEQ ID NO: 5827806 - DNA, 14 bp, Homo sapiens
acaactgtgaagcc

SEQ ID NO: 5827807 - DNA, 19 bp, Homo sapiens
acaactgtttttgaagaag

SEQ ID NO: 5827808 - DNA, 15 bp, Homo sapiens
acaacttaaaaagtc

SEQ ID NO: 5827809 - DNA, 16 bp, Homo sapiens
acaacttaaaaagtct

SEQ ID NO: 5827810 - DNA, 14 bp, Homo sapiens
acaacttaaataat

SEQ ID NO: 5827811 - DNA, 22 bp, Homo sapiens
acaacttaagttggtcctttac

SEQ ID NO: 5827812 - DNA, 14 bp, Homo sapiens
acaacttagctcag

SEQ ID NO: 5827813 - DNA, 20 bp, Homo sapiens
acaacttagctcaggtgcct

SEQ ID NO: 5827814 - DNA, 16 bp, Homo sapiens
acaacttatttaaaaa

SEQ ID NO: 5827815 - DNA, 21 bp, Homo sapiens
acaacttatttaaaaatattt

SEQ ID NO: 5827816 - DNA, 17 bp, Homo sapiens
acaacttcaagtgcatg

SEQ ID NO: 5827817 - DNA, 17 bp, Homo sapiens
acaacttcaatatccaa

SEQ ID NO: 5827818 - DNA, 18 bp, Homo sapiens
acaacttcatataactga

SEQ ID NO: 5827819 - DNA, 18 bp, Homo sapiens
acaacttcccagtgaatt

SEQ ID NO: 5827820 - DNA, 17 bp, Homo sapiens
acaacttctaattgcca

SEQ ID NO: 5827821 - DNA, 15 bp, Homo sapiens
acaacttctgtttct

SEQ ID NO: 5827822 - DNA, 14 bp, Homo sapiens
acaacttctttgta

SEQ ID NO: 5827823 - DNA, 22 bp, Homo sapiens
acaacttgtacttgtttcatct

SEQ ID NO: 5827824 - DNA, 14 bp, Homo sapiens
acaacttgtagcag

SEQ ID NO: 5827825 - DNA, 16 bp, Homo sapiens
acaacttgtatttcca

SEQ ID NO: 5827826 - DNA, 13 bp, Homo sapiens
acaactttatgta

SEQ ID NO: 5827827 - DNA, 20 bp, Homo sapiens
acaactttattgattgaatt

SEQ ID NO: 5827828 - DNA, 14 bp, Homo sapiens
acaactttcacttc

SEQ ID NO: 5827829 - DNA, 21 bp, Homo sapiens
acaactttgcaaattatttat

SEQ ID NO: 5827830 - DNA, 16 bp, Homo sapiens
acaacttttaaagaaa

SEQ ID NO: 5827831 - DNA, 17 bp, Homo sapiens
acaacttttaaagaaaa

SEQ ID NO: 5827832 - DNA, 13 bp, Homo sapiens
acaacttttgttt

SEQ ID NO: 5827833 - DNA, 15 bp, Homo sapiens
acaacttttttttct

SEQ ID NO: 5827834 - DNA, 17 bp, Homo sapiens
acaagaaaaagtagaaa

SEQ ID NO: 5827835 - DNA, 16 bp, Homo sapiens
acaagaaaaataaaga

SEQ ID NO: 5827836 - DNA, 13 bp, Homo sapiens
acaagaaaactca

SEQ ID NO: 5827837 - DNA, 19 bp, Homo sapiens
acaagaaaataagagctca

SEQ ID NO: 5827838 - DNA, 13 bp, Homo sapiens
acaagaaaatcag

SEQ ID NO: 5827839 - DNA, 16 bp, Homo sapiens
acaagaaactttggaa

SEQ ID NO: 5827840 - DNA, 12 bp, Homo sapiens
acaagaaagagt

SEQ ID NO: 5827841 - DNA, 21 bp, Homo sapiens
acaagaaaggctgctgtactg

SEQ ID NO: 5827842 - DNA, 19 bp, Homo sapiens
acaagaaagggccaggaga

SEQ ID NO: 5827843 - DNA, 15 bp, Homo sapiens
acaagaaagtttccc

SEQ ID NO: 5827844 - DNA, 21 bp, Homo sapiens
acaagaaagtttccccaccag

SEQ ID NO: 5827845 - DNA, 23 bp, Homo sapiens
acaagaaatccctgtttaatatt

SEQ ID NO: 5827846 - DNA, 16 bp, Homo sapiens
acaagaaatgaaagca

SEQ ID NO: 5827847 - DNA, 22 bp, Homo sapiens
acaagaaatgaaagcagggact

SEQ ID NO: 5827848 - DNA, 14 bp, Homo sapiens
acaagaacattctc

SEQ ID NO: 5827849 - DNA, 14 bp, Homo sapiens
acaagaaccatttg

SEQ ID NO: 5827850 - DNA, 17 bp, Homo sapiens
acaagaaccatttgcaa

SEQ ID NO: 5827851 - DNA, 14 bp, Homo sapiens
acaagaactcctcc

SEQ ID NO: 5827852 - DNA, 15 bp, Homo sapiens
acaagaactgaaacc

SEQ ID NO: 5827853 - DNA, 18 bp, Homo sapiens
acaagaagaaatatgaaa

SEQ ID NO: 5827854 - DNA, 20 bp, Homo sapiens
acaagaagaaatatgaaatt

SEQ ID NO: 5827855 - DNA, 15 bp, Homo sapiens
acaagaagcattttg

SEQ ID NO: 5827856 - DNA, 18 bp, Homo sapiens
acaagaagcattttgtaa

SEQ ID NO: 5827857 - DNA, 14 bp, Homo sapiens
acaagaagcccagt

SEQ ID NO: 5827858 - DNA, 22 bp, Homo sapiens
acaagaagctcccagatgctgg

SEQ ID NO: 5827859 - DNA, 17 bp, Homo sapiens
acaagaaggatacaagg

SEQ ID NO: 5827860 - DNA, 17 bp, Homo sapiens
acaagaagggagattca

SEQ ID NO: 5827861 - DNA, 23 bp, Homo sapiens
acaagaagggttttccaccctgg

SEQ ID NO: 5827862 - DNA, 22 bp, Homo sapiens
acaagaatactacttatgaaat

SEQ ID NO: 5827863 - DNA, 13 bp, Homo sapiens
acaagaatatgtt

SEQ ID NO: 5827864 - DNA, 19 bp, Homo sapiens
acaagaatgcattccctga

SEQ ID NO: 5827865 - DNA, 20 bp, Homo sapiens
acaagacaagctcctccctt

SEQ ID NO: 5827866 - DNA, 13 bp, Homo sapiens
acaagacacagtg

SEQ ID NO: 5827867 - DNA, 15 bp, Homo sapiens
acaagacagagggga

SEQ ID NO: 5827868 - DNA, 23 bp, Homo sapiens
acaagacagaggggagcagtggc

SEQ ID NO: 5827869 - DNA, 19 bp, Homo sapiens
acaagaccacgtttctaaa

SEQ ID NO: 5827870 - DNA, 22 bp, Homo sapiens
acaagacccaagtagctgctac

SEQ ID NO: 5827871 - DNA, 19 bp, Homo sapiens
acaagacccccaggaagga

SEQ ID NO: 5827872 - DNA, 19 bp, Homo sapiens
acaagaccccgtctcaaaa

SEQ ID NO: 5827873 - DNA, 19 bp, Homo sapiens
acaagaccgccccagggct

SEQ ID NO: 5827874 - DNA, 14 bp, Homo sapiens
acaagactaacctt

SEQ ID NO: 5827875 - DNA, 14 bp, Homo sapiens
acaagactgccagg

SEQ ID NO: 5827876 - DNA, 15 bp, Homo sapiens
acaagactgcctccc

SEQ ID NO: 5827877 - DNA, 13 bp, Homo sapiens
acaagactggccc

SEQ ID NO: 5827878 - DNA, 13 bp, Homo sapiens
acaagactgttgt

SEQ ID NO: 5827879 - DNA, 17 bp, Homo sapiens
acaagacttcagattcc

SEQ ID NO: 5827880 - DNA, 17 bp, Homo sapiens
acaagacttcagtatgt

SEQ ID NO: 5827881 - DNA, 21 bp, Homo sapiens
acaagacttcagtatgttgtc

SEQ ID NO: 5827882 - DNA, 21 bp, Homo sapiens
acaagagaccacttccttaac

SEQ ID NO: 5827883 - DNA, 20 bp, Homo sapiens
acaagagatctacacatgtt

SEQ ID NO: 5827884 - DNA, 20 bp, Homo sapiens
acaagagcaaaactccgtct

SEQ ID NO: 5827885 - DNA, 21 bp, Homo sapiens
acaagagcactacattcattt

SEQ ID NO: 5827886 - DNA, 18 bp, Homo sapiens
acaagagcagcctgtggc

SEQ ID NO: 5827887 - DNA, 23 bp, Homo sapiens
acaagagccatgtaccagtgtac

SEQ ID NO: 5827888 - DNA, 13 bp, Homo sapiens
acaagagcccagc

SEQ ID NO: 5827889 - DNA, 20 bp, Homo sapiens
acaagagcccagcagggcct

SEQ ID NO: 5827890 - DNA, 22 bp, Homo sapiens
acaagagcccaggcctcctaca

SEQ ID NO: 5827891 - DNA, 16 bp, Homo sapiens
acaagagcgaaactcc

SEQ ID NO: 5827892 - DNA, 13 bp, Homo sapiens
acaagagctgctg

SEQ ID NO: 5827893 - DNA, 17 bp, Homo sapiens
acaagagctgctgtcct

SEQ ID NO: 5827894 - DNA, 13 bp, Homo sapiens
acaagagctgtta

SEQ ID NO: 5827895 - DNA, 17 bp, Homo sapiens
acaagagctgttatgct

SEQ ID NO: 5827896 - DNA, 19 bp, Homo sapiens
acaagagcttaacagtgtg

SEQ ID NO: 5827897 - DNA, 12 bp, Homo sapiens
acaagaggaaaa

SEQ ID NO: 5827898 - DNA, 13 bp, Homo sapiens
acaagaggaaaaa

SEQ ID NO: 5827899 - DNA, 15 bp, Homo sapiens
acaagaggacacaat

SEQ ID NO: 5827900 - DNA, 18 bp, Homo sapiens
acaagaggagcaggaagc

SEQ ID NO: 5827901 - DNA, 23 bp, Homo sapiens
acaagaggagcaggaagcaaggc

SEQ ID NO: 5827902 - DNA, 19 bp, Homo sapiens
acaagaggattgtaaaatg

SEQ ID NO: 5827903 - DNA, 17 bp, Homo sapiens
acaagagggactgtatt

SEQ ID NO: 5827904 - DNA, 19 bp, Homo sapiens
acaagagggactgtatttc

SEQ ID NO: 5827905 - DNA, 22 bp, Homo sapiens
acaagagggactgtatttctgt

SEQ ID NO: 5827906 - DNA, 17 bp, Homo sapiens
acaagagggcaaagctg

SEQ ID NO: 5827907 - DNA, 19 bp, Homo sapiens
acaagagggcaaagctgat

SEQ ID NO: 5827908 - DNA, 19 bp, Homo sapiens
acaagagggcaagcctcta

SEQ ID NO: 5827909 - DNA, 16 bp, Homo sapiens
acaagaggtacagggt

SEQ ID NO: 5827910 - DNA, 19 bp, Homo sapiens
acaagaggttagaaatact

SEQ ID NO: 5827911 - DNA, 18 bp, Homo sapiens
acaagagtccccagactc

SEQ ID NO: 5827912 - DNA, 13 bp, Homo sapiens
acaagagtgaatt

SEQ ID NO: 5827913 - DNA, 22 bp, Homo sapiens
acaagagtggagagaagctctt

SEQ ID NO: 5827914 - DNA, 22 bp, Homo sapiens
acaagagtttatttccaaataa

SEQ ID NO: 5827915 - DNA, 14 bp, Homo sapiens
acaagataaattga

SEQ ID NO: 5827916 - DNA, 13 bp, Homo sapiens
acaagatattatt

SEQ ID NO: 5827917 - DNA, 17 bp, Homo sapiens
acaagatattgatgata

SEQ ID NO: 5827918 - DNA, 16 bp, Homo sapiens
acaagatattgtacat

SEQ ID NO: 5827919 - DNA, 17 bp, Homo sapiens
acaagatattgtacata

SEQ ID NO: 5827920 - DNA, 15 bp, Homo sapiens
acaagatatttatat

SEQ ID NO: 5827921 - DNA, 17 bp, Homo sapiens
acaagatatttatatgt

SEQ ID NO: 5827922 - DNA, 21 bp, Homo sapiens
acaagatatttatatgttatt

SEQ ID NO: 5827923 - DNA, 20 bp, Homo sapiens
acaagatccaggcagaagga

SEQ ID NO: 5827924 - DNA, 13 bp, Homo sapiens
acaagatctttca

SEQ ID NO: 5827925 - DNA, 16 bp, Homo sapiens
acaagatctttcagga

SEQ ID NO: 5827926 - DNA, 23 bp, Homo sapiens
acaagatgcactcgctgtgattt

SEQ ID NO: 5827927 - DNA, 15 bp, Homo sapiens
acaagatgccaagga

SEQ ID NO: 5827928 - DNA, 19 bp, Homo sapiens
acaagatgccaaggaggtc

SEQ ID NO: 5827929 - DNA, 17 bp, Homo sapiens
acaagatgccccaggga

SEQ ID NO: 5827930 - DNA, 22 bp, Homo sapiens
acaagatggaaaaaaaaaacaa

SEQ ID NO: 5827931 - DNA, 22 bp, Homo sapiens
acaagatggcgaccaccaaagt

SEQ ID NO: 5827932 - DNA, 14 bp, Homo sapiens
acaagatggtccat

SEQ ID NO: 5827933 - DNA, 23 bp, Homo sapiens
acaagatggtccatttgttcctg

SEQ ID NO: 5827934 - DNA, 17 bp, Homo sapiens
acaagatggttctagca

SEQ ID NO: 5827935 - DNA, 21 bp, Homo sapiens
acaagattcccagagacagga

SEQ ID NO: 5827936 - DNA, 19 bp, Homo sapiens
acaagattggtgttttttt

SEQ ID NO: 5827937 - DNA, 16 bp, Homo sapiens
acaagatttagaaaaa

SEQ ID NO: 5827938 - DNA, 20 bp, Homo sapiens
acaagatttccttgtgcaaa

SEQ ID NO: 5827939 - DNA, 22 bp, Homo sapiens
acaagattttttaattgtttaa

SEQ ID NO: 5827940 - DNA, 19 bp, Homo sapiens
acaagcaaacccagacggc

SEQ ID NO: 5827941 - DNA, 18 bp, Homo sapiens
acaagcaaactgaaatta

SEQ ID NO: 5827942 - DNA, 15 bp, Homo sapiens
acaagcaagctccca

SEQ ID NO: 5827943 - DNA, 21 bp, Homo sapiens
acaagcaataattaggatcta

SEQ ID NO: 5827944 - DNA, 17 bp, Homo sapiens
acaagcaatgcaagaaa

SEQ ID NO: 5827945 - DNA, 19 bp, Homo sapiens
acaagcacaaagctcaaga

SEQ ID NO: 5827946 - DNA, 13 bp, Homo sapiens
acaagcaccccag

SEQ ID NO: 5827947 - DNA, 22 bp, Homo sapiens
acaagcacctagtaagtgcctg

SEQ ID NO: 5827948 - DNA, 17 bp, Homo sapiens
acaagcacgaggcctca

SEQ ID NO: 5827949 - DNA, 18 bp, Homo sapiens
acaagcactaaacaaaga

SEQ ID NO: 5827950 - DNA, 16 bp, Homo sapiens
acaagcactattttat

SEQ ID NO: 5827951 - DNA, 14 bp, Homo sapiens
acaagcagacacac

SEQ ID NO: 5827952 - DNA, 11 bp, Homo sapiens
acaagcagagg

SEQ ID NO: 5827953 - DNA, 13 bp, Homo sapiens
acaagcagccctt

SEQ ID NO: 5827954 - DNA, 18 bp, Homo sapiens
acaagcagtgtctgtcag

SEQ ID NO: 5827955 - DNA, 15 bp, Homo sapiens
acaagcatataaaat

SEQ ID NO: 5827956 - DNA, 17 bp, Homo sapiens
acaagcatatttgagaa

SEQ ID NO: 5827957 - DNA, 22 bp, Homo sapiens
acaagcatcatggatcaaccaa

SEQ ID NO: 5827958 - DNA, 11 bp, Homo sapiens
acaagcatctc

SEQ ID NO: 5827959 - DNA, 16 bp, Homo sapiens
acaagcatgcataaat

SEQ ID NO: 5827960 - DNA, 18 bp, Homo sapiens
acaagcatgtctctctgc

SEQ ID NO: 5827961 - DNA, 21 bp, Homo sapiens
acaagcatgtctctctgccaa

SEQ ID NO: 5827962 - DNA, 21 bp, Homo sapiens
acaagccaaaagtccctccct

SEQ ID NO: 5827963 - DNA, 23 bp, Homo sapiens
acaagccaaagagcctcccacca

SEQ ID NO: 5827964 - DNA, 14 bp, Homo sapiens
acaagccaacttgt

SEQ ID NO: 5827965 - DNA, 12 bp, Homo sapiens
acaagccacaga

SEQ ID NO: 5827966 - DNA, 13 bp, Homo sapiens
acaagccacagaa

SEQ ID NO: 5827967 - DNA, 15 bp, Homo sapiens
acaagccacgcctgc

SEQ ID NO: 5827968 - DNA, 17 bp, Homo sapiens
acaagccacgttgcaga

SEQ ID NO: 5827969 - DNA, 14 bp, Homo sapiens
acaagccagagccg

SEQ ID NO: 5827970 - DNA, 12 bp, Homo sapiens
acaagccagcca

SEQ ID NO: 5827971 - DNA, 15 bp, Homo sapiens
acaagccagggtgtg

SEQ ID NO: 5827972 - DNA, 16 bp, Homo sapiens
acaagcccacagcaca

SEQ ID NO: 5827973 - DNA, 12 bp, Homo sapiens
acaagcccagga

SEQ ID NO: 5827974 - DNA, 19 bp, Homo sapiens
acaagcccaggacactgcc

SEQ ID NO: 5827975 - DNA, 19 bp, Homo sapiens
acaagccccaggcaggctg

SEQ ID NO: 5827976 - DNA, 14 bp, Homo sapiens
acaagccccccctt

SEQ ID NO: 5827977 - DNA, 22 bp, Homo sapiens
acaagcccgttagccccaggga

SEQ ID NO: 5827978 - DNA, 18 bp, Homo sapiens
acaagccctgcttttgca

SEQ ID NO: 5827979 - DNA, 14 bp, Homo sapiens
acaagcctcctgta

SEQ ID NO: 5827980 - DNA, 22 bp, Homo sapiens
acaatcatgaacagctctgaga

SEQ ID NO: 5827981 - DNA, 22 bp, Homo sapiens
acaatcatgcctacattagtga

SEQ ID NO: 5827982 - DNA, 20 bp, Homo sapiens
acaatcatggtcaagttccc

SEQ ID NO: 5827983 - DNA, 21 bp, Homo sapiens
acaatcatggtcaagttccca

SEQ ID NO: 5827984 - DNA, 12 bp, Homo sapiens
acaatcatgttc

SEQ ID NO: 5827985 - DNA, 15 bp, Homo sapiens
acaatcatgttctgg

SEQ ID NO: 5827986 - DNA, 18 bp, Homo sapiens
acaatcattgctgaaaat

SEQ ID NO: 5827987 - DNA, 16 bp, Homo sapiens
acaatcattgttttga

SEQ ID NO: 5827988 - DNA, 20 bp, Homo sapiens
acaatcattgttttgaatat

SEQ ID NO: 5827989 - DNA, 18 bp, Homo sapiens
acaatccaaatgcattca

SEQ ID NO: 5827990 - DNA, 22 bp, Homo sapiens
acaatccaaatgcattcatgtt

SEQ ID NO: 5827991 - DNA, 22 bp, Homo sapiens
acaatccacgcttctccggatc

SEQ ID NO: 5827992 - DNA, 13 bp, Homo sapiens
acaatccactctc

SEQ ID NO: 5827993 - DNA, 14 bp, Homo sapiens
acaatccactctca

SEQ ID NO: 5827994 - DNA, 15 bp, Homo sapiens
acaatccactctcag

SEQ ID NO: 5827995 - DNA, 17 bp, Homo sapiens
acaatccactctcagga

SEQ ID NO: 5827996 - DNA, 18 bp, Homo sapiens
acaatccactctcaggag

SEQ ID NO: 5827997 - DNA, 15 bp, Homo sapiens
acaatccattcacaa

SEQ ID NO: 5827998 - DNA, 18 bp, Homo sapiens
acaatcccaatctttcta

SEQ ID NO: 5827999 - DNA, 16 bp, Homo sapiens
acaatcccacctagcc

SEQ ID NO: 5828000 - DNA, 19 bp, Homo sapiens
acaatccctggggctgtgc

SEQ ID NO: 5828001 - DNA, 20 bp, Homo sapiens
acaatccctggggctgtgca

SEQ ID NO: 5828002 - DNA, 15 bp, Homo sapiens
acaatccgagcagtg

SEQ ID NO: 5828003 - DNA, 15 bp, Homo sapiens
acaatcctagtgctt

SEQ ID NO: 5828004 - DNA, 16 bp, Homo sapiens
acaatcctataaatgt

SEQ ID NO: 5828005 - DNA, 17 bp, Homo sapiens
acaatcctgtccctcac

SEQ ID NO: 5828006 - DNA, 15 bp, Homo sapiens
acaatccttttgata

SEQ ID NO: 5828007 - DNA, 17 bp, Homo sapiens
acaatcgatggccttgc

SEQ ID NO: 5828008 - DNA, 21 bp, Homo sapiens
acaatcgtattacataaaaca

SEQ ID NO: 5828009 - DNA, 15 bp, Homo sapiens
acaatcgttctgtgt

SEQ ID NO: 5828010 - DNA, 20 bp, Homo sapiens
acaatctaaaaaatatctta

SEQ ID NO: 5828011 - DNA, 12 bp, Homo sapiens
acaatctaacaa

SEQ ID NO: 5828012 - DNA, 21 bp, Homo sapiens
acaatctaacaataatatttc

SEQ ID NO: 5828013 - DNA, 16 bp, Homo sapiens
acaatctaccaactgt

SEQ ID NO: 5828014 - DNA, 12 bp, Homo sapiens
acaatctatagt

SEQ ID NO: 5828015 - DNA, 16 bp, Homo sapiens
acaatctatggcaagc

SEQ ID NO: 5828016 - DNA, 20 bp, Homo sapiens
acaatctatggcttatttct

SEQ ID NO: 5828017 - DNA, 20 bp, Homo sapiens
acaatctatttaaaaaactg

SEQ ID NO: 5828018 - DNA, 17 bp, Homo sapiens
acaatctatttattgga

SEQ ID NO: 5828019 - DNA, 20 bp, Homo sapiens
acaatctcagctcactgtga

SEQ ID NO: 5828020 - DNA, 23 bp, Homo sapiens
acaatctcagctcactgtgacct

SEQ ID NO: 5828021 - DNA, 18 bp, Homo sapiens
acaatctcggctcactgc

SEQ ID NO: 5828022 - DNA, 13 bp, Homo sapiens
acaatctcttaaa

SEQ ID NO: 5828023 - DNA, 12 bp, Homo sapiens
acaatctgagca

SEQ ID NO: 5828024 - DNA, 16 bp, Homo sapiens
acaatctgagcacgct

SEQ ID NO: 5828025 - DNA, 20 bp, Homo sapiens
acaatctggcttagtgccac

SEQ ID NO: 5828026 - DNA, 19 bp, Homo sapiens
acaatcttaaggggcagct

SEQ ID NO: 5828027 - DNA, 12 bp, Homo sapiens
acaatcttctgt

SEQ ID NO: 5828028 - DNA, 12 bp, Homo sapiens
acaatcttggga

SEQ ID NO: 5828029 - DNA, 15 bp, Homo sapiens
acaatcttggggctg

SEQ ID NO: 5828030 - DNA, 15 bp, Homo sapiens
acaatctttcaccaa

SEQ ID NO: 5828031 - DNA, 14 bp, Homo sapiens
acaatctttcatgt

SEQ ID NO: 5828032 - DNA, 15 bp, Homo sapiens
acaatctttcatgtc

SEQ ID NO: 5828033 - DNA, 16 bp, Homo sapiens
acaatctttccttgtc

SEQ ID NO: 5828034 - DNA, 21 bp, Homo sapiens
acaatgaaaactctttgctgc

SEQ ID NO: 5828035 - DNA, 14 bp, Homo sapiens
acaatgaaattttt

SEQ ID NO: 5828036 - DNA, 14 bp, Homo sapiens
acaatgaactgctt

SEQ ID NO: 5828037 - DNA, 14 bp, Homo sapiens
acaatgaagggaaa

SEQ ID NO: 5828038 - DNA, 20 bp, Homo sapiens
acaatgaagttgaaaatcat

SEQ ID NO: 5828039 - DNA, 23 bp, Homo sapiens
acaatgaataaaaactcaaggag

SEQ ID NO: 5828040 - DNA, 12 bp, Homo sapiens
acaatgaatgta

SEQ ID NO: 5828041 - DNA, 15 bp, Homo sapiens
acaatgaatgtatat

SEQ ID NO: 5828042 - DNA, 15 bp, Homo sapiens
acaatgacaaagcag

SEQ ID NO: 5828043 - DNA, 15 bp, Homo sapiens
acaatgacaagatgt

SEQ ID NO: 5828044 - DNA, 22 bp, Homo sapiens
acaatgacatccagaaagctga

SEQ ID NO: 5828045 - DNA, 18 bp, Homo sapiens
acaatgactaagccaagc

SEQ ID NO: 5828046 - DNA, 19 bp, Homo sapiens
acaatgactaagccaagct

SEQ ID NO: 5828047 - DNA, 20 bp, Homo sapiens
acaatgacttactgtacatg

SEQ ID NO: 5828048 - DNA, 13 bp, Homo sapiens
acaatgactttat

SEQ ID NO: 5828049 - DNA, 14 bp, Homo sapiens
acaatgactttatt

SEQ ID NO: 5828050 - DNA, 21 bp, Homo sapiens
acaatgagaaaaataaatgga

SEQ ID NO: 5828051 - DNA, 14 bp, Homo sapiens
acaatgagatgcat

SEQ ID NO: 5828052 - DNA, 19 bp, Homo sapiens
acaatgagatgcatgattt

SEQ ID NO: 5828053 - DNA, 15 bp, Homo sapiens
acaatgagtaaaatc

SEQ ID NO: 5828054 - DNA, 20 bp, Homo sapiens
acaatgatatccaatattaa

SEQ ID NO: 5828055 - DNA, 20 bp, Homo sapiens
acaatgatcctgtattcaga

SEQ ID NO: 5828056 - DNA, 19 bp, Homo sapiens
acaatgatgattaaacacc

SEQ ID NO: 5828057 - DNA, 21 bp, Homo sapiens
acaatgatgattaaacacctg

SEQ ID NO: 5828058 - DNA, 20 bp, Homo sapiens
acaatgatgccgaacattag

SEQ ID NO: 5828059 - DNA, 20 bp, Homo sapiens
acaatgatgctatttgcaat

SEQ ID NO: 5828060 - DNA, 22 bp, Homo sapiens
acaatgatggtaaagccatgtt

SEQ ID NO: 5828061 - DNA, 14 bp, Homo sapiens
acaatgattaatca

SEQ ID NO: 5828062 - DNA, 23 bp, Homo sapiens
acaatgattaatcagctgttgca

SEQ ID NO: 5828063 - DNA, 12 bp, Homo sapiens
acaatgcaaaac

SEQ ID NO: 5828064 - DNA, 16 bp, Homo sapiens
acaatgcaaaccatca

SEQ ID NO: 5828065 - DNA, 21 bp, Homo sapiens
acaatgcaaaccatcattgaa

SEQ ID NO: 5828066 - DNA, 23 bp, Homo sapiens
acaatgcaaaccatcattgaaat

SEQ ID NO: 5828067 - DNA, 17 bp, Homo sapiens
acaatgcaacttttaat

SEQ ID NO: 5828068 - DNA, 19 bp, Homo sapiens
acaatgcacctagctgtgc

SEQ ID NO: 5828069 - DNA, 22 bp, Homo sapiens
acaatgcacctagctgtgcaag

SEQ ID NO: 5828070 - DNA, 15 bp, Homo sapiens
acaatgcagatgcca

SEQ ID NO: 5828071 - DNA, 20 bp, Homo sapiens
acaatgcagatgccagagca

SEQ ID NO: 5828072 - DNA, 24 bp, Homo sapiens
acaatgcagtacaggacatatatt

SEQ ID NO: 5828073 - DNA, 18 bp, Homo sapiens
acaatgcatgtgctgtct

SEQ ID NO: 5828074 - DNA, 12 bp, Homo sapiens
acaatgccaggg

SEQ ID NO: 5828075 - DNA, 17 bp, Homo sapiens
acaatgccagggcccag

SEQ ID NO: 5828076 - DNA, 14 bp, Homo sapiens
acaatgccatgaac

SEQ ID NO: 5828077 - DNA, 16 bp, Homo sapiens
acaatgccatgaacaa

SEQ ID NO: 5828078 - DNA, 16 bp, Homo sapiens
acaatgccctgctggc

SEQ ID NO: 5828079 - DNA, 20 bp, Homo sapiens
acaatgccgcctgtcaataa

SEQ ID NO: 5828080 - DNA, 21 bp, Homo sapiens
acaatgccgcctgtcaataaa

SEQ ID NO: 5828081 - DNA, 23 bp, Homo sapiens
acaatgccgcctgtcaataaatg

SEQ ID NO: 5828082 - DNA, 18 bp, Homo sapiens
acaatgcctacagctgtc

SEQ ID NO: 5828083 - DNA, 20 bp, Homo sapiens
acaatgcctattgtaatata

SEQ ID NO: 5828084 - DNA, 19 bp, Homo sapiens
acaatgcctcccagctaga

SEQ ID NO: 5828085 - DNA, 13 bp, Homo sapiens
acaatgcctctcc

SEQ ID NO: 5828086 - DNA, 19 bp, Homo sapiens
acaatgccttgggagagat

SEQ ID NO: 5828087 - DNA, 20 bp, Homo sapiens
acaatgcgtggcacatctaa

SEQ ID NO: 5828088 - DNA, 22 bp, Homo sapiens
acaatgctgtattttaaaagaa

SEQ ID NO: 5828089 - DNA, 15 bp, Homo sapiens
acaatgcttatggaa

SEQ ID NO: 5828090 - DNA, 20 bp, Homo sapiens
acaatggaaaacctggggga

SEQ ID NO: 5828091 - DNA, 16 bp, Homo sapiens
acaatggaaactgaat

SEQ ID NO: 5828092 - DNA, 18 bp, Homo sapiens
acaatggaccctttttgt

SEQ ID NO: 5828093 - DNA, 23 bp, Homo sapiens
acaatggaccggagagtgggggt

SEQ ID NO: 5828094 - DNA, 23 bp, Homo sapiens
acaatggacctctcagcagaaac

SEQ ID NO: 5828095 - DNA, 17 bp, Homo sapiens
acaatggagtctgcagt

SEQ ID NO: 5828096 - DNA, 19 bp, Homo sapiens
acaatggataggcacagga

SEQ ID NO: 5828097 - DNA, 15 bp, Homo sapiens
acaatggatattgcc

SEQ ID NO: 5828098 - DNA, 12 bp, Homo sapiens
acaatggcacct

SEQ ID NO: 5828099 - DNA, 21 bp, Homo sapiens
acaatggcaggttttacacgt

SEQ ID NO: 5828100 - DNA, 15 bp, Homo sapiens
acaatggccagccca

SEQ ID NO: 5828101 - DNA, 15 bp, Homo sapiens
acaatggccatggaa

SEQ ID NO: 5828102 - DNA, 21 bp, Homo sapiens
acaatggctaattcccagagt

SEQ ID NO: 5828103 - DNA, 21 bp, Homo sapiens
acaatggctgggagggggccc

SEQ ID NO: 5828104 - DNA, 14 bp, Homo sapiens
acaatgggaaaaga

SEQ ID NO: 5828105 - DNA, 15 bp, Homo sapiens
acaatgggaaaagag

SEQ ID NO: 5828106 - DNA, 17 bp, Homo sapiens
acaatggggatgttgtg

SEQ ID NO: 5828107 - DNA, 19 bp, Homo sapiens
acaatggtagctctgaagg

SEQ ID NO: 5828108 - DNA, 19 bp, Homo sapiens
acaatggtttacatgaaca

SEQ ID NO: 5828109 - DNA, 12 bp, Homo sapiens
acaatggtttat

SEQ ID NO: 5828110 - DNA, 18 bp, Homo sapiens
acaatggtttattcccaa

SEQ ID NO: 5828111 - DNA, 14 bp, Homo sapiens
acaatggtttcaaa

SEQ ID NO: 5828112 - DNA, 16 bp, Homo sapiens
acaatggtttttaaat

SEQ ID NO: 5828113 - DNA, 18 bp, Homo sapiens
acaatggtttttaaattt

SEQ ID NO: 5828114 - DNA, 12 bp, Homo sapiens
acaatgtaaagt

SEQ ID NO: 5828115 - DNA, 13 bp, Homo sapiens
acaatgtactata

SEQ ID NO: 5828116 - DNA, 12 bp, Homo sapiens
acaatgtataaa

SEQ ID NO: 5828117 - DNA, 19 bp, Homo sapiens
acaatgtataaagattgta

SEQ ID NO: 5828118 - DNA, 17 bp, Homo sapiens
acaatgtatacaatgca

SEQ ID NO: 5828119 - DNA, 15 bp, Homo sapiens
acaatgtatgtacaa

SEQ ID NO: 5828120 - DNA, 20 bp, Homo sapiens
acaatgtatgtgaaagtgta

SEQ ID NO: 5828121 - DNA, 11 bp, Homo sapiens
acaatgtattt

SEQ ID NO: 5828122 - DNA, 15 bp, Homo sapiens
acaatgtattttctt

SEQ ID NO: 5828123 - DNA, 18 bp, Homo sapiens
acaatgtattttggaaga

SEQ ID NO: 5828124 - DNA, 21 bp, Homo sapiens
acaatgtattttggaagacat

SEQ ID NO: 5828125 - DNA, 22 bp, Homo sapiens
acaatgtcaaggtgctgttgtc

SEQ ID NO: 5828126 - DNA, 18 bp, Homo sapiens
acaatgtcagtatttcag

SEQ ID NO: 5828127 - DNA, 22 bp, Homo sapiens
acaatgtcatatactgccatgt

SEQ ID NO: 5828128 - DNA, 22 bp, Homo sapiens
acaatgtcgagtatattattat

SEQ ID NO: 5828129 - DNA, 19 bp, Homo sapiens
acaatgtctggggacaggc

SEQ ID NO: 5828130 - DNA, 23 bp, Homo sapiens
acaatgtctggttagttaaaagc

SEQ ID NO: 5828131 - DNA, 17 bp, Homo sapiens
acaatgtgaaaagaaaa

SEQ ID NO: 5828132 - DNA, 19 bp, Homo sapiens
acaatgtgaaaagaaaaat

SEQ ID NO: 5828133 - DNA, 17 bp, Homo sapiens
acaatgtgaactttatt

SEQ ID NO: 5828134 - DNA, 22 bp, Homo sapiens
acaatgtgaactttattaaata

SEQ ID NO: 5828135 - DNA, 11 bp, Homo sapiens
acaatgtgaat

SEQ ID NO: 5828136 - DNA, 14 bp, Homo sapiens
acaatgtgaatagt

SEQ ID NO: 5828137 - DNA, 19 bp, Homo sapiens
acaatgtgatatgtgtaat

SEQ ID NO: 5828138 - DNA, 15 bp, Homo sapiens
acaatgtgcactgaa

SEQ ID NO: 5828139 - DNA, 14 bp, Homo sapiens
acaatgtggaatta

SEQ ID NO: 5828140 - DNA, 17 bp, Homo sapiens
acaatgtggaattacat

SEQ ID NO: 5828141 - DNA, 21 bp, Homo sapiens
acaatgtggagtctccctctg

SEQ ID NO: 5828142 - DNA, 14 bp, Homo sapiens
acaatgtgtattca

SEQ ID NO: 5828143 - DNA, 15 bp, Homo sapiens
acaatgtgtgttgct

SEQ ID NO: 5828144 - DNA, 11 bp, Homo sapiens
acaatgttaag

SEQ ID NO: 5828145 - DNA, 19 bp, Homo sapiens
acaatgttaaggaaactct

SEQ ID NO: 5828146 - DNA, 23 bp, Homo sapiens
acaatgttatcaaccaactgcac

SEQ ID NO: 5828147 - DNA, 15 bp, Homo sapiens
acaatgttcatccca

SEQ ID NO: 5828148 - DNA, 17 bp, Homo sapiens
acaatgttctgttgtaa

SEQ ID NO: 5828149 - DNA, 22 bp, Homo sapiens
acaatgttctgttgtaaagagt

SEQ ID NO: 5828150 - DNA, 13 bp, Homo sapiens
acaatgttcttta

SEQ ID NO: 5828151 - DNA, 14 bp, Homo sapiens
acaatgttgagaag

SEQ ID NO: 5828152 - DNA, 20 bp, Homo sapiens
acaatgttgcactgaaaacc

SEQ ID NO: 5828153 - DNA, 21 bp, Homo sapiens
acaatgttgctagttttttgc

SEQ ID NO: 5828154 - DNA, 15 bp, Homo sapiens
acaatgttggagcag

SEQ ID NO: 5828155 - DNA, 21 bp, Homo sapiens
acaatgttggagcagcaggcc

SEQ ID NO: 5828156 - DNA, 22 bp, Homo sapiens
acaatgttggagcagcaggcct

SEQ ID NO: 5828157 - DNA, 13 bp, Homo sapiens
acacaccctgagg

SEQ ID NO: 5828158 - DNA, 13 bp, Homo sapiens
acacaccctgccc

SEQ ID NO: 5828159 - DNA, 17 bp, Homo sapiens
acacaccctgcttcatt

SEQ ID NO: 5828160 - DNA, 16 bp, Homo sapiens
acacaccgcggccagg

SEQ ID NO: 5828161 - DNA, 14 bp, Homo sapiens
acacacctaactta

SEQ ID NO: 5828162 - DNA, 17 bp, Homo sapiens
acacacctaagggacat

SEQ ID NO: 5828163 - DNA, 22 bp, Homo sapiens
acacacctaagggacatgtttt

SEQ ID NO: 5828164 - DNA, 14 bp, Homo sapiens
acacacctccgaga

SEQ ID NO: 5828165 - DNA, 21 bp, Homo sapiens
acacacctccgagacagtcca

SEQ ID NO: 5828166 - DNA, 22 bp, Homo sapiens
acacacctccgagacagtccag

SEQ ID NO: 5828167 - DNA, 13 bp, Homo sapiens
acacacctctgct

SEQ ID NO: 5828168 - DNA, 16 bp, Homo sapiens
acacacctctgctcca

SEQ ID NO: 5828169 - DNA, 13 bp, Homo sapiens
acacacctgagaa

SEQ ID NO: 5828170 - DNA, 15 bp, Homo sapiens
acacacctgcacacc

SEQ ID NO: 5828171 - DNA, 21 bp, Homo sapiens
acacacctgcacacccctgca

SEQ ID NO: 5828172 - DNA, 17 bp, Homo sapiens
acacacctgcacaccgt

SEQ ID NO: 5828173 - DNA, 16 bp, Homo sapiens
acacaccttaaaacat

SEQ ID NO: 5828174 - DNA, 19 bp, Homo sapiens
acacacgagcaaacccaga

SEQ ID NO: 5828175 - DNA, 20 bp, Homo sapiens
acacacgagcaaacccagag

SEQ ID NO: 5828176 - DNA, 15 bp, Homo sapiens
acacacgatgcattt

SEQ ID NO: 5828177 - DNA, 23 bp, Homo sapiens
acacacgcacacacacacacagg

SEQ ID NO: 5828178 - DNA, 14 bp, Homo sapiens
acacacgcacgcac

SEQ ID NO: 5828179 - DNA, 15 bp, Homo sapiens
acacacgcacgcaca

SEQ ID NO: 5828180 - DNA, 16 bp, Homo sapiens
acacacgcacgcacac

SEQ ID NO: 5828181 - DNA, 17 bp, Homo sapiens
acacacgcacgcacaca

SEQ ID NO: 5828182 - DNA, 18 bp, Homo sapiens
acacacgcagacacacac

SEQ ID NO: 5828183 - DNA, 14 bp, Homo sapiens
acacacgcaggaac

SEQ ID NO: 5828184 - DNA, 13 bp, Homo sapiens
acacacgccagct

SEQ ID NO: 5828185 - DNA, 15 bp, Homo sapiens
acacacgccagctcc

SEQ ID NO: 5828186 - DNA, 16 bp, Homo sapiens
acacacgccagctcct

SEQ ID NO: 5828187 - DNA, 17 bp, Homo sapiens
acacacgcgtccacata

SEQ ID NO: 5828188 - DNA, 21 bp, Homo sapiens
acacacgcgtccacatacact

SEQ ID NO: 5828189 - DNA, 23 bp, Homo sapiens
acacacggatgcacacacagatg

SEQ ID NO: 5828190 - DNA, 22 bp, Homo sapiens
acacacggctcccccaggcctg

SEQ ID NO: 5828191 - DNA, 21 bp, Homo sapiens
acacacgtatttatatttgga

SEQ ID NO: 5828192 - DNA, 19 bp, Homo sapiens
acacactacaccacacaca

SEQ ID NO: 5828193 - DNA, 20 bp, Homo sapiens
acacactcaaaagacaaaca

SEQ ID NO: 5828194 - DNA, 13 bp, Homo sapiens
acacactcagcag

SEQ ID NO: 5828195 - DNA, 19 bp, Homo sapiens
acacactcagcagccccct

SEQ ID NO: 5828196 - DNA, 11 bp, Homo sapiens
acacactcggg

SEQ ID NO: 5828197 - DNA, 21 bp, Homo sapiens
acacactcgggttaagaaata

SEQ ID NO: 5828198 - DNA, 12 bp, Homo sapiens
acacactgaaag

SEQ ID NO: 5828199 - DNA, 13 bp, Homo sapiens
acacactgaagaa

SEQ ID NO: 5828200 - DNA, 14 bp, Homo sapiens
acacactgaagaag

SEQ ID NO: 5828201 - DNA, 18 bp, Homo sapiens
acacactgaggcagggaa

SEQ ID NO: 5828202 - DNA, 18 bp, Homo sapiens
acacactgagttgcacat

SEQ ID NO: 5828203 - DNA, 13 bp, Homo sapiens
acacactgatgct

SEQ ID NO: 5828204 - DNA, 15 bp, Homo sapiens
acacactggacccca

SEQ ID NO: 5828205 - DNA, 22 bp, Homo sapiens
acacactggaccccactggctg

SEQ ID NO: 5828206 - DNA, 12 bp, Homo sapiens
acacactggcca

SEQ ID NO: 5828207 - DNA, 13 bp, Homo sapiens
acacactggccat

SEQ ID NO: 5828208 - DNA, 18 bp, Homo sapiens
acacactgtaaacccctg

SEQ ID NO: 5828209 - DNA, 19 bp, Homo sapiens
acacactgtcatgcttcat

SEQ ID NO: 5828210 - DNA, 22 bp, Homo sapiens
acacactgtcatgcttcatcat

SEQ ID NO: 5828211 - DNA, 17 bp, Homo sapiens
acacactgtgccccaca

SEQ ID NO: 5828212 - DNA, 17 bp, Homo sapiens
acacactgtgctttcta

SEQ ID NO: 5828213 - DNA, 20 bp, Homo sapiens
acacactgtgtcctggtgct

SEQ ID NO: 5828214 - DNA, 18 bp, Homo sapiens
acacacttcttccaaaag

SEQ ID NO: 5828215 - DNA, 21 bp, Homo sapiens
acacacttcttccaaaaggaa

SEQ ID NO: 5828216 - DNA, 13 bp, Homo sapiens
acacacttgacct

SEQ ID NO: 5828217 - DNA, 20 bp, Homo sapiens
acacactttccatctctgcc

SEQ ID NO: 5828218 - DNA, 13 bp, Homo sapiens
acacacttttgca

SEQ ID NO: 5828219 - DNA, 15 bp, Homo sapiens
acacacttttgcaca

SEQ ID NO: 5828220 - DNA, 19 bp, Homo sapiens
acacactttttaagaaata

SEQ ID NO: 5828221 - DNA, 16 bp, Homo sapiens
acacagaaaatatact

SEQ ID NO: 5828222 - DNA, 18 bp, Homo sapiens
acacagaaaatatactgt

SEQ ID NO: 5828223 - DNA, 21 bp, Homo sapiens
acacagaaaatatactgtaaa

SEQ ID NO: 5828224 - DNA, 23 bp, Homo sapiens
acacagaaaatatactgtaaaga

SEQ ID NO: 5828225 - DNA, 13 bp, Homo sapiens
acacagaaacact

SEQ ID NO: 5828226 - DNA, 16 bp, Homo sapiens
acacagaaacactgcc

SEQ ID NO: 5828227 - DNA, 17 bp, Homo sapiens
acacagaaagcctatca

SEQ ID NO: 5828228 - DNA, 14 bp, Homo sapiens
acacagaaatatat

SEQ ID NO: 5828229 - DNA, 16 bp, Homo sapiens
acacagaaatatatat

SEQ ID NO: 5828230 - DNA, 14 bp, Homo sapiens
acacagaaatgctg

SEQ ID NO: 5828231 - DNA, 17 bp, Homo sapiens
acacagaaatgctgctg

SEQ ID NO: 5828232 - DNA, 18 bp, Homo sapiens
acacagaaatgctgctgg

SEQ ID NO: 5828233 - DNA, 20 bp, Homo sapiens
acacagaaatgctgctggcc

SEQ ID NO: 5828234 - DNA, 20 bp, Homo sapiens
acacagaactggcaggagcc

SEQ ID NO: 5828235 - DNA, 23 bp, Homo sapiens
acacagacattctgccaggcccc

SEQ ID NO: 5828236 - DNA, 16 bp, Homo sapiens
acacagacattttgtg

SEQ ID NO: 5828237 - DNA, 12 bp, Homo sapiens
acacagaccacc

SEQ ID NO: 5828238 - DNA, 17 bp, Homo sapiens
acacagacccctaggga

SEQ ID NO: 5828239 - DNA, 22 bp, Homo sapiens
acacagacctcgagtttctggt

SEQ ID NO: 5828240 - DNA, 15 bp, Homo sapiens
acacagacggcctag

SEQ ID NO: 5828241 - DNA, 14 bp, Homo sapiens
acacagactatttt

SEQ ID NO: 5828242 - DNA, 23 bp, Homo sapiens
acacagactcatcctgaacagca

SEQ ID NO: 5828243 - DNA, 16 bp, Homo sapiens
acacagactggcaata

SEQ ID NO: 5828244 - DNA, 20 bp, Homo sapiens
acacagactggcaataaact

SEQ ID NO: 5828245 - DNA, 15 bp, Homo sapiens
acacagactttctgt

SEQ ID NO: 5828246 - DNA, 15 bp, Homo sapiens
acacagagaaataca

SEQ ID NO: 5828247 - DNA, 21 bp, Homo sapiens
acacagagaatgggtaattca

SEQ ID NO: 5828248 - DNA, 17 bp, Homo sapiens
acacagagatatgcaca

SEQ ID NO: 5828249 - DNA, 17 bp, Homo sapiens
acacagagattctggat

SEQ ID NO: 5828250 - DNA, 16 bp, Homo sapiens
acacagagatttgaga

SEQ ID NO: 5828251 - DNA, 19 bp, Homo sapiens
acacagagcctgcctcagc

SEQ ID NO: 5828252 - DNA, 23 bp, Homo sapiens
acacagagcgcctcacctgcatc

SEQ ID NO: 5828253 - DNA, 13 bp, Homo sapiens
acacagaggaaga

SEQ ID NO: 5828254 - DNA, 21 bp, Homo sapiens
acacagaggaagagcaggcac

SEQ ID NO: 5828255 - DNA, 20 bp, Homo sapiens
acacagaggacagcttcccc

SEQ ID NO: 5828256 - DNA, 17 bp, Homo sapiens
acacagaggagtgcagc

SEQ ID NO: 5828257 - DNA, 19 bp, Homo sapiens
acacagaggctgcctctcc

SEQ ID NO: 5828258 - DNA, 23 bp, Homo sapiens
acacagagggacttgagccagtt

SEQ ID NO: 5828259 - DNA, 15 bp, Homo sapiens
acacagagtgaggga

SEQ ID NO: 5828260 - DNA, 21 bp, Homo sapiens
acacagagtggtctttctgga

SEQ ID NO: 5828261 - DNA, 16 bp, Homo sapiens
acacagatacacacac

SEQ ID NO: 5828262 - DNA, 15 bp, Homo sapiens
acacagatctcttgt

SEQ ID NO: 5828263 - DNA, 18 bp, Homo sapiens
acacagatgacaaattat

SEQ ID NO: 5828264 - DNA, 20 bp, Homo sapiens
acacagattatgttcctgct

SEQ ID NO: 5828265 - DNA, 14 bp, Homo sapiens
acacagattatttg

SEQ ID NO: 5828266 - DNA, 15 bp, Homo sapiens
acacagattatttgt

SEQ ID NO: 5828267 - DNA, 15 bp, Homo sapiens
acacagatttttaca

SEQ ID NO: 5828268 - DNA, 22 bp, Homo sapiens
acacagatttttacactaatat

SEQ ID NO: 5828269 - DNA, 19 bp, Homo sapiens
acacagcacaccagccgct

SEQ ID NO: 5828270 - DNA, 15 bp, Homo sapiens
acacagcagacctag

SEQ ID NO: 5828271 - DNA, 11 bp, Homo sapiens
acacagcagcg

SEQ ID NO: 5828272 - DNA, 12 bp, Homo sapiens
acacagcagctc

SEQ ID NO: 5828273 - DNA, 13 bp, Homo sapiens
acacagcagctcc

SEQ ID NO: 5828274 - DNA, 14 bp, Homo sapiens
acacagcagctcca

SEQ ID NO: 5828275 - DNA, 16 bp, Homo sapiens
acacagcagctccaac

SEQ ID NO: 5828276 - DNA, 20 bp, Homo sapiens
acacagcagctccaacctgg

SEQ ID NO: 5828277 - DNA, 13 bp, Homo sapiens
acacagcagtatt

SEQ ID NO: 5828278 - DNA, 14 bp, Homo sapiens
acacagcagtgtcc

SEQ ID NO: 5828279 - DNA, 18 bp, Homo sapiens
acacagcagtgtcccctg

SEQ ID NO: 5828280 - DNA, 20 bp, Homo sapiens
acacagcagtgtcccctgcc

SEQ ID NO: 5828281 - DNA, 16 bp, Homo sapiens
acacagcatcagctca

SEQ ID NO: 5828282 - DNA, 15 bp, Homo sapiens
acacagcatgtgcca

SEQ ID NO: 5828283 - DNA, 14 bp, Homo sapiens
acacagcatgtgta

SEQ ID NO: 5828284 - DNA, 15 bp, Homo sapiens
acacagccacacaca

SEQ ID NO: 5828285 - DNA, 18 bp, Homo sapiens
acacagccacacacacag

SEQ ID NO: 5828286 - DNA, 20 bp, Homo sapiens
acacagccacacacacagaa

SEQ ID NO: 5828287 - DNA, 21 bp, Homo sapiens
acacagccacacacacagaaa

SEQ ID NO: 5828288 - DNA, 18 bp, Homo sapiens
acacagccaggagtgggt

SEQ ID NO: 5828289 - DNA, 20 bp, Homo sapiens
acacagccaggtgccttgga

SEQ ID NO: 5828290 - DNA, 22 bp, Homo sapiens
acacagccattcatctgggctg

SEQ ID NO: 5828291 - DNA, 11 bp, Homo sapiens
acacagcccag

SEQ ID NO: 5828292 - DNA, 17 bp, Homo sapiens
acacagcccagaaggcc

SEQ ID NO: 5828293 - DNA, 19 bp, Homo sapiens
acacagcccagaaggccag

SEQ ID NO: 5828294 - DNA, 20 bp, Homo sapiens
acacagcccagttcccgtga

SEQ ID NO: 5828295 - DNA, 20 bp, Homo sapiens
acacagcccctatagcactg

SEQ ID NO: 5828296 - DNA, 13 bp, Homo sapiens
acacagcccgagc

SEQ ID NO: 5828297 - DNA, 14 bp, Homo sapiens
acacagcctccccc

SEQ ID NO: 5828298 - DNA, 22 bp, Homo sapiens
acacagcctcccccgccagccc

SEQ ID NO: 5828299 - DNA, 14 bp, Homo sapiens
acacagcctccctg

SEQ ID NO: 5828300 - DNA, 18 bp, Homo sapiens
acacagcctccctgagcc

SEQ ID NO: 5828301 - DNA, 19 bp, Homo sapiens
acacagcctccctgagcct

SEQ ID NO: 5828302 - DNA, 14 bp, Homo sapiens
acacagcctggact

SEQ ID NO: 5828303 - DNA, 15 bp, Homo sapiens
acacagcctggactt

SEQ ID NO: 5828304 - DNA, 13 bp, Homo sapiens
acacagcctggcc

SEQ ID NO: 5828305 - DNA, 15 bp, Homo sapiens
acacagcctggcctc

SEQ ID NO: 5828306 - DNA, 22 bp, Homo sapiens
acacagcctgggaccagggcat

SEQ ID NO: 5828307 - DNA, 20 bp, Homo sapiens
acacagcctgggccccagct

SEQ ID NO: 5828308 - DNA, 12 bp, Homo sapiens
acacagcctgtc

SEQ ID NO: 5828309 - DNA, 22 bp, Homo sapiens
acacagcctgtcttcagatcct

SEQ ID NO: 5828310 - DNA, 11 bp, Homo sapiens
acacagccttc

SEQ ID NO: 5828311 - DNA, 17 bp, Homo sapiens
acacagccttccttctg

SEQ ID NO: 5828312 - DNA, 15 bp, Homo sapiens
acacagcctttctgt

SEQ ID NO: 5828313 - DNA, 21 bp, Homo sapiens
acacagcgacgctcccctgag

SEQ ID NO: 5828314 - DNA, 12 bp, Homo sapiens
acacagctctgt

SEQ ID NO: 5828315 - DNA, 11 bp, Homo sapiens
acacagctctt

SEQ ID NO: 5828316 - DNA, 13 bp, Homo sapiens
acacagctcttct

SEQ ID NO: 5828317 - DNA, 14 bp, Homo sapiens
acacagctcttctc

SEQ ID NO: 5828318 - DNA, 16 bp, Homo sapiens
acacagctcttctcca

SEQ ID NO: 5828319 - DNA, 18 bp, Homo sapiens
acacagctcttctccagg

SEQ ID NO: 5828320 - DNA, 14 bp, Homo sapiens
acacagctgcccta

SEQ ID NO: 5828321 - DNA, 19 bp, Homo sapiens
acacagctgggcaaagcca

SEQ ID NO: 5828322 - DNA, 15 bp, Homo sapiens
acacagctgggctgt

SEQ ID NO: 5828323 - DNA, 20 bp, Homo sapiens
acacagctggggctgtagca

SEQ ID NO: 5828324 - DNA, 18 bp, Homo sapiens
acacagctgttcttctgt

SEQ ID NO: 5828325 - DNA, 22 bp, Homo sapiens
acacagcttgtctcttgcctgc

SEQ ID NO: 5828326 - DNA, 14 bp, Homo sapiens
acacagcttgtgaa

SEQ ID NO: 5828327 - DNA, 23 bp, Homo sapiens
acacagcttttagtacccacctg

SEQ ID NO: 5828328 - DNA, 18 bp, Homo sapiens
acacaggaaaaataaacg

SEQ ID NO: 5828329 - DNA, 19 bp, Homo sapiens
acacaggaactctgtgtga

SEQ ID NO: 5828330 - DNA, 16 bp, Homo sapiens
acacaggacagcggga

SEQ ID NO: 5828331 - DNA, 17 bp, Homo sapiens
acacaggacccccttcc

SEQ ID NO: 5828332 - DNA, 19 bp, Homo sapiens
acacaggactgaaaaggga

SEQ ID NO: 5828333 - DNA, 16 bp, Homo sapiens
acacaggagaccaccc

SEQ ID NO: 5828334 - DNA, 20 bp, Homo sapiens
acacaggatagataactctt

SEQ ID NO: 5828335 - DNA, 18 bp, Homo sapiens
acacaggatcctggcctg

SEQ ID NO: 5828336 - DNA, 16 bp, Homo sapiens
acacccagcggccccc

SEQ ID NO: 5828337 - DNA, 18 bp, Homo sapiens
acacccagcggccccccg

SEQ ID NO: 5828338 - DNA, 13 bp, Homo sapiens
acacccaggaagg

SEQ ID NO: 5828339 - DNA, 17 bp, Homo sapiens
acacccaggaatgaccc

SEQ ID NO: 5828340 - DNA, 22 bp, Homo sapiens
acacccaggcccgagcgcctgc

SEQ ID NO: 5828341 - DNA, 12 bp, Homo sapiens
acacccagggaa

SEQ ID NO: 5828342 - DNA, 19 bp, Homo sapiens
acacccaggggaaggccct

SEQ ID NO: 5828343 - DNA, 18 bp, Homo sapiens
acacccaggtgatttcct

SEQ ID NO: 5828344 - DNA, 20 bp, Homo sapiens
acacccaggtgatttcctct

SEQ ID NO: 5828345 - DNA, 17 bp, Homo sapiens
acacccagttctgaata

SEQ ID NO: 5828346 - DNA, 17 bp, Homo sapiens
acacccatgactgcccc

SEQ ID NO: 5828347 - DNA, 22 bp, Homo sapiens
acacccatggcctcagccctgc

SEQ ID NO: 5828348 - DNA, 16 bp, Homo sapiens
acacccatgtaaatgt

SEQ ID NO: 5828349 - DNA, 16 bp, Homo sapiens
acacccatttttcctt

SEQ ID NO: 5828350 - DNA, 18 bp, Homo sapiens
acaccccacaccccagcc

SEQ ID NO: 5828351 - DNA, 19 bp, Homo sapiens
acaccccacaccccagccc

SEQ ID NO: 5828352 - DNA, 14 bp, Homo sapiens
acaccccagactcc

SEQ ID NO: 5828353 - DNA, 11 bp, Homo sapiens
acaccccagcc

SEQ ID NO: 5828354 - DNA, 14 bp, Homo sapiens
acaccccagcccac

SEQ ID NO: 5828355 - DNA, 12 bp, Homo sapiens
acaccccaggcc

SEQ ID NO: 5828356 - DNA, 20 bp, Homo sapiens
acaccccattggtggactac

SEQ ID NO: 5828357 - DNA, 12 bp, Homo sapiens
acacccccagag

SEQ ID NO: 5828358 - DNA, 12 bp, Homo sapiens
acacccccagct

SEQ ID NO: 5828359 - DNA, 13 bp, Homo sapiens
acacccccagctg

SEQ ID NO: 5828360 - DNA, 19 bp, Homo sapiens
acacccccagctgactgtt

SEQ ID NO: 5828361 - DNA, 19 bp, Homo sapiens
acacccccgacggcctcca

SEQ ID NO: 5828362 - DNA, 16 bp, Homo sapiens
acacccccttggtgct

SEQ ID NO: 5828363 - DNA, 17 bp, Homo sapiens
acaccccgcctgcctcc

SEQ ID NO: 5828364 - DNA, 15 bp, Homo sapiens
acaccccgtctgccc

SEQ ID NO: 5828365 - DNA, 16 bp, Homo sapiens
acaccccgtctgcccc

SEQ ID NO: 5828366 - DNA, 15 bp, Homo sapiens
acacccctacacaca

SEQ ID NO: 5828367 - DNA, 22 bp, Homo sapiens
acacccctcaaaaaaagccttt

SEQ ID NO: 5828368 - DNA, 14 bp, Homo sapiens
acacccctcagcgc

SEQ ID NO: 5828369 - DNA, 20 bp, Homo sapiens
acacccctccaaagccccac

SEQ ID NO: 5828370 - DNA, 15 bp, Homo sapiens
acacccctctgctgc

SEQ ID NO: 5828371 - DNA, 15 bp, Homo sapiens
acacccctgcacaca

SEQ ID NO: 5828372 - DNA, 13 bp, Homo sapiens
acacccctgcccc

SEQ ID NO: 5828373 - DNA, 13 bp, Homo sapiens
acacccctgccgg

SEQ ID NO: 5828374 - DNA, 12 bp, Homo sapiens
acacccctgtgc

SEQ ID NO: 5828375 - DNA, 19 bp, Homo sapiens
acaccccttatccaggact

SEQ ID NO: 5828376 - DNA, 23 bp, Homo sapiens
acaccccttttccagttgctgtg

SEQ ID NO: 5828377 - DNA, 21 bp, Homo sapiens
acacccgaagtcctgtcactg

SEQ ID NO: 5828378 - DNA, 17 bp, Homo sapiens
acacccgactcctcaaa

SEQ ID NO: 5828379 - DNA, 22 bp, Homo sapiens
acacccgccctgcccttccctg

SEQ ID NO: 5828380 - DNA, 18 bp, Homo sapiens
acacccgtgtgcacactc

SEQ ID NO: 5828381 - DNA, 20 bp, Homo sapiens
acaccctaactcttgctcac

SEQ ID NO: 5828382 - DNA, 22 bp, Homo sapiens
acaccctaactcttgctcactc

SEQ ID NO: 5828383 - DNA, 15 bp, Homo sapiens
acaccctacagcaga

SEQ ID NO: 5828384 - DNA, 13 bp, Homo sapiens
acaccctcacact

SEQ ID NO: 5828385 - DNA, 22 bp, Homo sapiens
acaccctcaccacccaacagtg

SEQ ID NO: 5828386 - DNA, 19 bp, Homo sapiens
acaccctcactctgccagg

SEQ ID NO: 5828387 - DNA, 18 bp, Homo sapiens
acaccctccagcacagac

SEQ ID NO: 5828388 - DNA, 13 bp, Homo sapiens
acaccctccccat

SEQ ID NO: 5828389 - DNA, 13 bp, Homo sapiens
acaccctcccccg

SEQ ID NO: 5828390 - DNA, 14 bp, Homo sapiens
acaccctcccccgc

SEQ ID NO: 5828391 - DNA, 22 bp, Homo sapiens
acaccctcgaagcgcgccactc

SEQ ID NO: 5828392 - DNA, 20 bp, Homo sapiens
acaccctcggggggtcacag

SEQ ID NO: 5828393 - DNA, 16 bp, Homo sapiens
acaccctctcccagga

SEQ ID NO: 5828394 - DNA, 17 bp, Homo sapiens
acaccctctcccaggac

SEQ ID NO: 5828395 - DNA, 13 bp, Homo sapiens
acaccctctgccg

SEQ ID NO: 5828396 - DNA, 20 bp, Homo sapiens
acaccctgcaaggcccacag

SEQ ID NO: 5828397 - DNA, 12 bp, Homo sapiens
acaccctgccct

SEQ ID NO: 5828398 - DNA, 11 bp, Homo sapiens
acaccctgcct

SEQ ID NO: 5828399 - DNA, 19 bp, Homo sapiens
acaccctgcctgctgtgga

SEQ ID NO: 5828400 - DNA, 14 bp, Homo sapiens
acaccctgcttctc

SEQ ID NO: 5828401 - DNA, 13 bp, Homo sapiens
acaccctggagtg

SEQ ID NO: 5828402 - DNA, 18 bp, Homo sapiens
acaccctggatgctgttg

SEQ ID NO: 5828403 - DNA, 13 bp, Homo sapiens
acaccctgggcca

SEQ ID NO: 5828404 - DNA, 11 bp, Homo sapiens
acaccctgtga

SEQ ID NO: 5828405 - DNA, 12 bp, Homo sapiens
acaccctgtgat

SEQ ID NO: 5828406 - DNA, 16 bp, Homo sapiens
acacccttggacttga

SEQ ID NO: 5828407 - DNA, 13 bp, Homo sapiens
acaccctttctgt

SEQ ID NO: 5828408 - DNA, 16 bp, Homo sapiens
acaccgactagccagg

SEQ ID NO: 5828409 - DNA, 15 bp, Homo sapiens
acaccgagggcgacc

SEQ ID NO: 5828410 - DNA, 18 bp, Homo sapiens
acaccgccatcctctgcc

SEQ ID NO: 5828411 - DNA, 13 bp, Homo sapiens
acaccgctggtcc

SEQ ID NO: 5828412 - DNA, 19 bp, Homo sapiens
acaccgctggtccctgccc

SEQ ID NO: 5828413 - DNA, 19 bp, Homo sapiens
acaccggagtatgtgcagt

SEQ ID NO: 5828414 - DNA, 23 bp, Homo sapiens
acaccggagtatgtgcagtgtgg

SEQ ID NO: 5828415 - DNA, 14 bp, Homo sapiens
acaccggcactgtg

SEQ ID NO: 5828416 - DNA, 14 bp, Homo sapiens
acaccgggcctgga

SEQ ID NO: 5828417 - DNA, 19 bp, Homo sapiens
acaccggggtggtgggaac

SEQ ID NO: 5828418 - DNA, 19 bp, Homo sapiens
acaccgtcccagggctctg

SEQ ID NO: 5828419 - DNA, 20 bp, Homo sapiens
acaccgtccctcagtgatac

SEQ ID NO: 5828420 - DNA, 15 bp, Homo sapiens
acaccgtcttccttc

SEQ ID NO: 5828421 - DNA, 22 bp, Homo sapiens
acaccgtggcagcttgctgggc

SEQ ID NO: 5828422 - DNA, 23 bp, Homo sapiens
acaccgtggcagcttgctgggct

SEQ ID NO: 5828423 - DNA, 13 bp, Homo sapiens
acaccgtggcctg

SEQ ID NO: 5828424 - DNA, 14 bp, Homo sapiens
acaccgtggcctgg

SEQ ID NO: 5828425 - DNA, 17 bp, Homo sapiens
acaccgtggcctgggct

SEQ ID NO: 5828426 - DNA, 19 bp, Homo sapiens
acaccgtgtaaaccaaagc

SEQ ID NO: 5828427 - DNA, 16 bp, Homo sapiens
acaccgtttagaaaaa

SEQ ID NO: 5828428 - DNA, 21 bp, Homo sapiens
acaccgtttagaaaaaacaat

SEQ ID NO: 5828429 - DNA, 21 bp, Homo sapiens
acacctaaaggtgtatttaaa

SEQ ID NO: 5828430 - DNA, 22 bp, Homo sapiens
acacctaaaggtgtatttaaac

SEQ ID NO: 5828431 - DNA, 15 bp, Homo sapiens
acacctaaattaaca

SEQ ID NO: 5828432 - DNA, 15 bp, Homo sapiens
acacctaactcacct

SEQ ID NO: 5828433 - DNA, 22 bp, Homo sapiens
acacctaagtgactaccactta

SEQ ID NO: 5828434 - DNA, 13 bp, Homo sapiens
acacctacagcag

SEQ ID NO: 5828435 - DNA, 16 bp, Homo sapiens
acacctaccatgctgc

SEQ ID NO: 5828436 - DNA, 22 bp, Homo sapiens
acacctagaaaggaactgcaat

SEQ ID NO: 5828437 - DNA, 21 bp, Homo sapiens
acacctagactctaaaactat

SEQ ID NO: 5828438 - DNA, 14 bp, Homo sapiens
acacctagatcaga

SEQ ID NO: 5828439 - DNA, 22 bp, Homo sapiens
acacctagctttattcttcaga

SEQ ID NO: 5828440 - DNA, 23 bp, Homo sapiens
acacctaggctagggtggggaga

SEQ ID NO: 5828441 - DNA, 18 bp, Homo sapiens
acacctattatcccagct

SEQ ID NO: 5828442 - DNA, 19 bp, Homo sapiens
acacctattatcccagctg

SEQ ID NO: 5828443 - DNA, 15 bp, Homo sapiens
acacctattttagac

SEQ ID NO: 5828444 - DNA, 17 bp, Homo sapiens
acacctcacacctcact

SEQ ID NO: 5828445 - DNA, 19 bp, Homo sapiens
acacctcacacctcactct

SEQ ID NO: 5828446 - DNA, 20 bp, Homo sapiens
acacctcactctgctacctt

SEQ ID NO: 5828447 - DNA, 16 bp, Homo sapiens
acacctcactctttat

SEQ ID NO: 5828448 - DNA, 15 bp, Homo sapiens
acacctcactgtcat

SEQ ID NO: 5828449 - DNA, 19 bp, Homo sapiens
acacctcactgtcatctgc

SEQ ID NO: 5828450 - DNA, 21 bp, Homo sapiens
acacctcactgtcatctgcca

SEQ ID NO: 5828451 - DNA, 16 bp, Homo sapiens
acacctcagaaattga

SEQ ID NO: 5828452 - DNA, 20 bp, Homo sapiens
acacctcagaaattgaaagc

SEQ ID NO: 5828453 - DNA, 12 bp, Homo sapiens
acacctcagagc

SEQ ID NO: 5828454 - DNA, 16 bp, Homo sapiens
acacctcagctgcctc

SEQ ID NO: 5828455 - DNA, 15 bp, Homo sapiens
acacctcagtgggaa

SEQ ID NO: 5828456 - DNA, 16 bp, Homo sapiens
acacctcagtgggaag

SEQ ID NO: 5828457 - DNA, 17 bp, Homo sapiens
acacctcagtgggaaga

SEQ ID NO: 5828458 - DNA, 18 bp, Homo sapiens
acacctcatgctagcctc

SEQ ID NO: 5828459 - DNA, 20 bp, Homo sapiens
acacctccacagttcagtgg

SEQ ID NO: 5828460 - DNA, 12 bp, Homo sapiens
acacctccaccg

SEQ ID NO: 5828461 - DNA, 16 bp, Homo sapiens
acacctccactcagca

SEQ ID NO: 5828462 - DNA, 17 bp, Homo sapiens
acacctccactcagcac

SEQ ID NO: 5828463 - DNA, 18 bp, Homo sapiens
acacctccactcagcact

SEQ ID NO: 5828464 - DNA, 20 bp, Homo sapiens
acacctcccaccccctgtat

SEQ ID NO: 5828465 - DNA, 11 bp, Homo sapiens
acacctcccag

SEQ ID NO: 5828466 - DNA, 23 bp, Homo sapiens
acacctcccaggggctccacctg

SEQ ID NO: 5828467 - DNA, 15 bp, Homo sapiens
acacctccccctgcg

SEQ ID NO: 5828468 - DNA, 22 bp, Homo sapiens
acacctccccctgcgccccgca

SEQ ID NO: 5828469 - DNA, 14 bp, Homo sapiens
acacctcccttcat

SEQ ID NO: 5828470 - DNA, 23 bp, Homo sapiens
acacctcccttcatcccagggta

SEQ ID NO: 5828471 - DNA, 19 bp, Homo sapiens
acacctccgagaggcagcc

SEQ ID NO: 5828472 - DNA, 20 bp, Homo sapiens
acacctcctcctgctgctca

SEQ ID NO: 5828473 - DNA, 11 bp, Homo sapiens
acacctccttc

SEQ ID NO: 5828474 - DNA, 15 bp, Homo sapiens
acacctccttttctt

SEQ ID NO: 5828475 - DNA, 18 bp, Homo sapiens
acacctccttttcttcta

SEQ ID NO: 5828476 - DNA, 12 bp, Homo sapiens
acacctcgcccc

SEQ ID NO: 5828477 - DNA, 18 bp, Homo sapiens
acacctctgcacaagctg

SEQ ID NO: 5828478 - DNA, 14 bp, Homo sapiens
acacctctgccaga

SEQ ID NO: 5828479 - DNA, 19 bp, Homo sapiens
acacctctggatccctgga

SEQ ID NO: 5828480 - DNA, 14 bp, Homo sapiens
acacctctggctgt

SEQ ID NO: 5828481 - DNA, 16 bp, Homo sapiens
acacctctggctgtct

SEQ ID NO: 5828482 - DNA, 15 bp, Homo sapiens
acacctctgggccct

SEQ ID NO: 5828483 - DNA, 18 bp, Homo sapiens
acacctctgggccctgca

SEQ ID NO: 5828484 - DNA, 16 bp, Homo sapiens
acacctcttggggagt

SEQ ID NO: 5828485 - DNA, 21 bp, Homo sapiens
acacctgaatcagctggacat

SEQ ID NO: 5828486 - DNA, 17 bp, Homo sapiens
acacctgacaaatggaa

SEQ ID NO: 5828487 - DNA, 17 bp, Homo sapiens
acacctgacaacttctg

SEQ ID NO: 5828488 - DNA, 18 bp, Homo sapiens
acacctgacaacttctga

SEQ ID NO: 5828489 - DNA, 16 bp, Homo sapiens
acacctgactctgaaa

SEQ ID NO: 5828490 - DNA, 19 bp, Homo sapiens
acacctgagaaacatctag

SEQ ID NO: 5828491 - DNA, 17 bp, Homo sapiens
acacctgagccagcctg

SEQ ID NO: 5828492 - DNA, 18 bp, Homo sapiens
acacctgagcgctgtgga

SEQ ID NO: 5828493 - DNA, 23 bp, Homo sapiens
acacctgagcgctgtggactgtc

SEQ ID NO: 5828494 - DNA, 19 bp, Homo sapiens
acacctgagttcacagctt

SEQ ID NO: 5828495 - DNA, 12 bp, Homo sapiens
acacctgatgtg

SEQ ID NO: 5828496 - DNA, 17 bp, Homo sapiens
acacctgatgtgtacat

SEQ ID NO: 5828497 - DNA, 19 bp, Homo sapiens
acacctgcaatcccagcac

SEQ ID NO: 5828498 - DNA, 23 bp, Homo sapiens
acacctgcacacccctgcacaca

SEQ ID NO: 5828499 - DNA, 14 bp, Homo sapiens
acacctgcacctcc

SEQ ID NO: 5828500 - DNA, 24 bp, Homo sapiens
acacctgcacctccccccactgca

SEQ ID NO: 5828501 - DNA, 19 bp, Homo sapiens
acacctgcagattctagga

SEQ ID NO: 5828502 - DNA, 22 bp, Homo sapiens
acacctgccccagcgcggcttg

SEQ ID NO: 5828503 - DNA, 19 bp, Homo sapiens
acacctgcccgctccccac

SEQ ID NO: 5828504 - DNA, 15 bp, Homo sapiens
acacctgccctgccc

SEQ ID NO: 5828505 - DNA, 22 bp, Homo sapiens
acacctgccctgccctgccacc

SEQ ID NO: 5828506 - DNA, 23 bp, Homo sapiens
acacctgccctgccctgccacct

SEQ ID NO: 5828507 - DNA, 17 bp, Homo sapiens
acacctgccctgggcat

SEQ ID NO: 5828508 - DNA, 15 bp, Homo sapiens
acacctgccgctgct

SEQ ID NO: 5828509 - DNA, 19 bp, Homo sapiens
acacctgcctctgaactgc

SEQ ID NO: 5828510 - DNA, 21 bp, Homo sapiens
acacctgcctctgaccccagc

SEQ ID NO: 5828511 - DNA, 20 bp, Homo sapiens
acacctgccttctaccctct

SEQ ID NO: 5828512 - DNA, 12 bp, Homo sapiens
acacctgctgcg

SEQ ID NO: 5828513 - DNA, 14 bp, Homo sapiens
acacctgctgcgct

SEQ ID NO: 5828514 - DNA, 22 bp, Homo sapiens
acacctggagactgtcccgaca

SEQ ID NO: 5828515 - DNA, 15 bp, Homo sapiens
acactgatgcaagga

SEQ ID NO: 5828516 - DNA, 17 bp, Homo sapiens
acactgatggctcaaga

SEQ ID NO: 5828517 - DNA, 22 bp, Homo sapiens
acactgatggctcaagacaagg

SEQ ID NO: 5828518 - DNA, 15 bp, Homo sapiens
acactgatgggctgg

SEQ ID NO: 5828519 - DNA, 17 bp, Homo sapiens
acactgatgggtcctgc

SEQ ID NO: 5828520 - DNA, 21 bp, Homo sapiens
acactgatttccccttttgca

SEQ ID NO: 5828521 - DNA, 13 bp, Homo sapiens
acactgattttgt

SEQ ID NO: 5828522 - DNA, 13 bp, Homo sapiens
acactgcaagaag

SEQ ID NO: 5828523 - DNA, 18 bp, Homo sapiens
acactgcaagagccttgg

SEQ ID NO: 5828524 - DNA, 23 bp, Homo sapiens
acactgcaccctccacaggagcc

SEQ ID NO: 5828525 - DNA, 13 bp, Homo sapiens
acactgcactttg

SEQ ID NO: 5828526 - DNA, 19 bp, Homo sapiens
acactgcactttgtttaga

SEQ ID NO: 5828527 - DNA, 14 bp, Homo sapiens
acactgcagacttg

SEQ ID NO: 5828528 - DNA, 23 bp, Homo sapiens
acactgcagcattttgctgcttt

SEQ ID NO: 5828529 - DNA, 11 bp, Homo sapiens
acactgcagcc

SEQ ID NO: 5828530 - DNA, 16 bp, Homo sapiens
acactgcagggctgct

SEQ ID NO: 5828531 - DNA, 15 bp, Homo sapiens
acactgcatgtttgt

SEQ ID NO: 5828532 - DNA, 18 bp, Homo sapiens
acactgccaaataaacag

SEQ ID NO: 5828533 - DNA, 19 bp, Homo sapiens
acactgccaaataaacagc

SEQ ID NO: 5828534 - DNA, 20 bp, Homo sapiens
acactgccaaataaacagct

SEQ ID NO: 5828535 - DNA, 16 bp, Homo sapiens
acactgccagaagtgt

SEQ ID NO: 5828536 - DNA, 21 bp, Homo sapiens
acactgccagaagtgtgtttt

SEQ ID NO: 5828537 - DNA, 19 bp, Homo sapiens
acactgccgacatcagcat

SEQ ID NO: 5828538 - DNA, 22 bp, Homo sapiens
acactgcctatatatgtaaata

SEQ ID NO: 5828539 - DNA, 20 bp, Homo sapiens
acactgcctgccttaagtga

SEQ ID NO: 5828540 - DNA, 15 bp, Homo sapiens
acactgcctggagga

SEQ ID NO: 5828541 - DNA, 12 bp, Homo sapiens
acactgcctggg

SEQ ID NO: 5828542 - DNA, 14 bp, Homo sapiens
acactgcctgggct

SEQ ID NO: 5828543 - DNA, 14 bp, Homo sapiens
acactgcctgtata

SEQ ID NO: 5828544 - DNA, 21 bp, Homo sapiens
acactgccttagcctcttgga

SEQ ID NO: 5828545 - DNA, 17 bp, Homo sapiens
acactgcctttgctgcc

SEQ ID NO: 5828546 - DNA, 20 bp, Homo sapiens
acactgcctttgctgccttc

SEQ ID NO: 5828547 - DNA, 19 bp, Homo sapiens
acactgcctttttatttat

SEQ ID NO: 5828548 - DNA, 22 bp, Homo sapiens
acactgcctttttatttatatg

SEQ ID NO: 5828549 - DNA, 17 bp, Homo sapiens
acactgcgcaggtctct

SEQ ID NO: 5828550 - DNA, 23 bp, Homo sapiens
acactgcgcaggtctcttctggg

SEQ ID NO: 5828551 - DNA, 18 bp, Homo sapiens
acactgcgctttattttc

SEQ ID NO: 5828552 - DNA, 18 bp, Homo sapiens
acactgcggaagccaaag

SEQ ID NO: 5828553 - DNA, 23 bp, Homo sapiens
acactgcggaagccaaaggcagc

SEQ ID NO: 5828554 - DNA, 21 bp, Homo sapiens
acactgcggtaggtcattctt

SEQ ID NO: 5828555 - DNA, 20 bp, Homo sapiens
acactgcggtgtctgcagct

SEQ ID NO: 5828556 - DNA, 12 bp, Homo sapiens
acactgctacac

SEQ ID NO: 5828557 - DNA, 13 bp, Homo sapiens
acactgctctaac

SEQ ID NO: 5828558 - DNA, 15 bp, Homo sapiens
acactgctcttaaga

SEQ ID NO: 5828559 - DNA, 19 bp, Homo sapiens
acactgctcttaagaaact

SEQ ID NO: 5828560 - DNA, 13 bp, Homo sapiens
acactgctgcacc

SEQ ID NO: 5828561 - DNA, 15 bp, Homo sapiens
acactgctgcaccag

SEQ ID NO: 5828562 - DNA, 21 bp, Homo sapiens
acactgctgtacccagatgcc

SEQ ID NO: 5828563 - DNA, 13 bp, Homo sapiens
acactgctgtcca

SEQ ID NO: 5828564 - DNA, 14 bp, Homo sapiens
acactgctgtccac

SEQ ID NO: 5828565 - DNA, 24 bp, Homo sapiens
acactgctgtccacatgacctcca

SEQ ID NO: 5828566 - DNA, 21 bp, Homo sapiens
acactgctgtcctctccccct

SEQ ID NO: 5828567 - DNA, 14 bp, Homo sapiens
acactgctgttaaa

SEQ ID NO: 5828568 - DNA, 16 bp, Homo sapiens
acactgctgttaaaga

SEQ ID NO: 5828569 - DNA, 18 bp, Homo sapiens
acactgcttctcggaggc

SEQ ID NO: 5828570 - DNA, 11 bp, Homo sapiens
acactgcttgg

SEQ ID NO: 5828571 - DNA, 23 bp, Homo sapiens
acactggaatataaaacagtcat

SEQ ID NO: 5828572 - DNA, 19 bp, Homo sapiens
acactggacaacattttac

SEQ ID NO: 5828573 - DNA, 23 bp, Homo sapiens
acactggaccaggtcctgctccg

SEQ ID NO: 5828574 - DNA, 19 bp, Homo sapiens
acactggaccccactggct

SEQ ID NO: 5828575 - DNA, 17 bp, Homo sapiens
acactggacctgggggt

SEQ ID NO: 5828576 - DNA, 19 bp, Homo sapiens
acactggaggagagaagaa

SEQ ID NO: 5828577 - DNA, 20 bp, Homo sapiens
acactggaggagagaagaat

SEQ ID NO: 5828578 - DNA, 11 bp, Homo sapiens
acactggatca

SEQ ID NO: 5828579 - DNA, 17 bp, Homo sapiens
acactggatcaagttca

SEQ ID NO: 5828580 - DNA, 21 bp, Homo sapiens
acactggatcaagttcagcca

SEQ ID NO: 5828581 - DNA, 18 bp, Homo sapiens
acactggatccagaagct

SEQ ID NO: 5828582 - DNA, 15 bp, Homo sapiens
acactggatgtttct

SEQ ID NO: 5828583 - DNA, 18 bp, Homo sapiens
acactggatgtttctcat

SEQ ID NO: 5828584 - DNA, 20 bp, Homo sapiens
acactggcaatggtagtttc

SEQ ID NO: 5828585 - DNA, 17 bp, Homo sapiens
acactggcatctccctg

SEQ ID NO: 5828586 - DNA, 16 bp, Homo sapiens
acactggccccacagg

SEQ ID NO: 5828587 - DNA, 12 bp, Homo sapiens
acactggcccct

SEQ ID NO: 5828588 - DNA, 15 bp, Homo sapiens
acactggccggccca

SEQ ID NO: 5828589 - DNA, 18 bp, Homo sapiens
acactggccggcccacgt

SEQ ID NO: 5828590 - DNA, 17 bp, Homo sapiens
acactggctaaagataa

SEQ ID NO: 5828591 - DNA, 20 bp, Homo sapiens
acactggctcacccagtcct

SEQ ID NO: 5828592 - DNA, 21 bp, Homo sapiens
acactggctcacccagtcctg

SEQ ID NO: 5828593 - DNA, 21 bp, Homo sapiens
acactggctcatattcctgca

SEQ ID NO: 5828594 - DNA, 22 bp, Homo sapiens
acactggctgccagctattttt

SEQ ID NO: 5828595 - DNA, 20 bp, Homo sapiens
acactggcttgaaggactgc

SEQ ID NO: 5828596 - DNA, 22 bp, Homo sapiens
acactggctttgggtagtgcca

SEQ ID NO: 5828597 - DNA, 22 bp, Homo sapiens
acactgggagaagagaacctca

SEQ ID NO: 5828598 - DNA, 15 bp, Homo sapiens
acactgggaggccag

SEQ ID NO: 5828599 - DNA, 16 bp, Homo sapiens
acactgggcagcaagg

SEQ ID NO: 5828600 - DNA, 18 bp, Homo sapiens
acactgggcagcaaggct

SEQ ID NO: 5828601 - DNA, 22 bp, Homo sapiens
acactgggcagcaaggctgctg

SEQ ID NO: 5828602 - DNA, 13 bp, Homo sapiens
acactgggcctgg

SEQ ID NO: 5828603 - DNA, 22 bp, Homo sapiens
acactgggctctgaggagtgga

SEQ ID NO: 5828604 - DNA, 17 bp, Homo sapiens
acactggggacttggcc

SEQ ID NO: 5828605 - DNA, 22 bp, Homo sapiens
acactggggctgacacccaggc

SEQ ID NO: 5828606 - DNA, 17 bp, Homo sapiens
acactgggtgcccaagc

SEQ ID NO: 5828607 - DNA, 20 bp, Homo sapiens
acactgggtggtggcctggt

SEQ ID NO: 5828608 - DNA, 16 bp, Homo sapiens
acactggtaaatgtta

SEQ ID NO: 5828609 - DNA, 18 bp, Homo sapiens
acactggtattcctgcct

SEQ ID NO: 5828610 - DNA, 21 bp, Homo sapiens
acactggtattcctgcctcca

SEQ ID NO: 5828611 - DNA, 11 bp, Homo sapiens
acactggtcta

SEQ ID NO: 5828612 - DNA, 18 bp, Homo sapiens
acactggtctaatgtttg

SEQ ID NO: 5828613 - DNA, 22 bp, Homo sapiens
acactggtggttctactgaccc

SEQ ID NO: 5828614 - DNA, 17 bp, Homo sapiens
acactggtgtgtccctc

SEQ ID NO: 5828615 - DNA, 15 bp, Homo sapiens
acactggttctcaat

SEQ ID NO: 5828616 - DNA, 18 bp, Homo sapiens
acactggttctcaatgaa

SEQ ID NO: 5828617 - DNA, 21 bp, Homo sapiens
acactggttctcaatgaaaaa

SEQ ID NO: 5828618 - DNA, 19 bp, Homo sapiens
acactggtttgccaggcca

SEQ ID NO: 5828619 - DNA, 20 bp, Homo sapiens
acactggtttgccaggccaa

SEQ ID NO: 5828620 - DNA, 18 bp, Homo sapiens
acactgtaaatatccaca

SEQ ID NO: 5828621 - DNA, 19 bp, Homo sapiens
acactgtaacatttacgaa

SEQ ID NO: 5828622 - DNA, 12 bp, Homo sapiens
acactgtaagaa

SEQ ID NO: 5828623 - DNA, 23 bp, Homo sapiens
acactgtaagctttgttctggga

SEQ ID NO: 5828624 - DNA, 13 bp, Homo sapiens
acactgtagtttt

SEQ ID NO: 5828625 - DNA, 18 bp, Homo sapiens
acactgtagtttttgaaa

SEQ ID NO: 5828626 - DNA, 22 bp, Homo sapiens
acactgtagtttttgaaaatta

SEQ ID NO: 5828627 - DNA, 18 bp, Homo sapiens
acactgtatctaaaaaat

SEQ ID NO: 5828628 - DNA, 19 bp, Homo sapiens
acactgtatctaaaaaata

SEQ ID NO: 5828629 - DNA, 20 bp, Homo sapiens
acactgtatgttatagaact

SEQ ID NO: 5828630 - DNA, 21 bp, Homo sapiens
acactgtatttgtatctctga

SEQ ID NO: 5828631 - DNA, 18 bp, Homo sapiens
acactgtcaagattaagt

SEQ ID NO: 5828632 - DNA, 17 bp, Homo sapiens
acactgtcatgcttcat

SEQ ID NO: 5828633 - DNA, 19 bp, Homo sapiens
acactgtcctgtccggagc

SEQ ID NO: 5828634 - DNA, 16 bp, Homo sapiens
acactgtccttccctg

SEQ ID NO: 5828635 - DNA, 19 bp, Homo sapiens
acactgtccttccctgcca

SEQ ID NO: 5828636 - DNA, 21 bp, Homo sapiens
acactgtccttccctgccact

SEQ ID NO: 5828637 - DNA, 15 bp, Homo sapiens
acactgtctgcccct

SEQ ID NO: 5828638 - DNA, 19 bp, Homo sapiens
acactgtgaaaatgtattt

SEQ ID NO: 5828639 - DNA, 12 bp, Homo sapiens
acactgtgaagg

SEQ ID NO: 5828640 - DNA, 14 bp, Homo sapiens
acactgtgacaatg

SEQ ID NO: 5828641 - DNA, 19 bp, Homo sapiens
acactgtgacacactacac

SEQ ID NO: 5828642 - DNA, 11 bp, Homo sapiens
acactgtgacc

SEQ ID NO: 5828643 - DNA, 16 bp, Homo sapiens
acactgtgaccaggct

SEQ ID NO: 5828644 - DNA, 13 bp, Homo sapiens
acactgtgaccct

SEQ ID NO: 5828645 - DNA, 15 bp, Homo sapiens
acactgtgagagttg

SEQ ID NO: 5828646 - DNA, 20 bp, Homo sapiens
acactgtgagagttgtctct

SEQ ID NO: 5828647 - DNA, 23 bp, Homo sapiens
acactgtgattactctttgcttt

SEQ ID NO: 5828648 - DNA, 22 bp, Homo sapiens
acactgtgattttgccctcctg

SEQ ID NO: 5828649 - DNA, 18 bp, Homo sapiens
acactgtgcaggcccagg

SEQ ID NO: 5828650 - DNA, 22 bp, Homo sapiens
acactgtgcccagcccggacct

SEQ ID NO: 5828651 - DNA, 15 bp, Homo sapiens
acactgtgccccaca

SEQ ID NO: 5828652 - DNA, 13 bp, Homo sapiens
acactgtgccctg

SEQ ID NO: 5828653 - DNA, 18 bp, Homo sapiens
acactgtgccctggtgga

SEQ ID NO: 5828654 - DNA, 13 bp, Homo sapiens
acactgtgctata

SEQ ID NO: 5828655 - DNA, 23 bp, Homo sapiens
acactgtgctttctattgtacag

SEQ ID NO: 5828656 - DNA, 12 bp, Homo sapiens
acactgtggaac

SEQ ID NO: 5828657 - DNA, 19 bp, Homo sapiens
acactgtggaactaataaa

SEQ ID NO: 5828658 - DNA, 20 bp, Homo sapiens
acactgtggaactaataaat

SEQ ID NO: 5828659 - DNA, 14 bp, Homo sapiens
acactgtggcagca

SEQ ID NO: 5828660 - DNA, 16 bp, Homo sapiens
acactgtggccaggcc

SEQ ID NO: 5828661 - DNA, 18 bp, Homo sapiens
acactgtggccaggcctt

SEQ ID NO: 5828662 - DNA, 23 bp, Homo sapiens
acactgtgggtctgactttctct

SEQ ID NO: 5828663 - DNA, 17 bp, Homo sapiens
acactgtgggtgtgtga

SEQ ID NO: 5828664 - DNA, 23 bp, Homo sapiens
acactgtgtaaatacccatatgt

SEQ ID NO: 5828665 - DNA, 12 bp, Homo sapiens
acactgtgtaag

SEQ ID NO: 5828666 - DNA, 11 bp, Homo sapiens
acactgtgtcc

SEQ ID NO: 5828667 - DNA, 22 bp, Homo sapiens
acactgtgtcccccccagtgca

SEQ ID NO: 5828668 - DNA, 19 bp, Homo sapiens
acactgtgtcctggtgctc

SEQ ID NO: 5828669 - DNA, 19 bp, Homo sapiens
acactgtgtctctatgtga

SEQ ID NO: 5828670 - DNA, 22 bp, Homo sapiens
acactgtgtctctatgtgaata

SEQ ID NO: 5828671 - DNA, 15 bp, Homo sapiens
acactgttctctgcc

SEQ ID NO: 5828672 - DNA, 16 bp, Homo sapiens
acactgttctctgccc

SEQ ID NO: 5828673 - DNA, 17 bp, Homo sapiens
acactgttctctgccct

SEQ ID NO: 5828674 - DNA, 18 bp, Homo sapiens
acactgttctctgccctc

SEQ ID NO: 5828675 - DNA, 17 bp, Homo sapiens
acactgttgataaaaac

SEQ ID NO: 5828676 - DNA, 18 bp, Homo sapiens
acactgttggcacttata

SEQ ID NO: 5828677 - DNA, 20 bp, Homo sapiens
acactgttgtccttaaaatt

SEQ ID NO: 5828678 - DNA, 15 bp, Homo sapiens
acactgtttcaaact

SEQ ID NO: 5828679 - DNA, 17 bp, Homo sapiens
acactgtttcaaacttt

SEQ ID NO: 5828680 - DNA, 15 bp, Homo sapiens
acactgtttccatgt

SEQ ID NO: 5828681 - DNA, 15 bp, Homo sapiens
acactgtttcctgat

SEQ ID NO: 5828682 - DNA, 19 bp, Homo sapiens
acactgtttgttccagaat

SEQ ID NO: 5828683 - DNA, 15 bp, Homo sapiens
acactgtttttcata

SEQ ID NO: 5828684 - DNA, 17 bp, Homo sapiens
acacttaaaagaaaaca

SEQ ID NO: 5828685 - DNA, 13 bp, Homo sapiens
acacttaacagat

SEQ ID NO: 5828686 - DNA, 14 bp, Homo sapiens
acacttaacagatg

SEQ ID NO: 5828687 - DNA, 13 bp, Homo sapiens
acacttaagcaga

SEQ ID NO: 5828688 - DNA, 14 bp, Homo sapiens
acacttacaagtaa

SEQ ID NO: 5828689 - DNA, 16 bp, Homo sapiens
acacttacactttatg

SEQ ID NO: 5828690 - DNA, 14 bp, Homo sapiens
acacttactgttgt

SEQ ID NO: 5828691 - DNA, 16 bp, Homo sapiens
acacttagaatactac

SEQ ID NO: 5828692 - DNA, 17 bp, Homo sapiens
acagaggccatggcaga

SEQ ID NO: 5828693 - DNA, 17 bp, Homo sapiens
acagaggccatgggcct

SEQ ID NO: 5828694 - DNA, 14 bp, Homo sapiens
acagaggccccacc

SEQ ID NO: 5828695 - DNA, 15 bp, Homo sapiens
acagaggccccacct

SEQ ID NO: 5828696 - DNA, 16 bp, Homo sapiens
acagaggccccagcct

SEQ ID NO: 5828697 - DNA, 17 bp, Homo sapiens
acagaggccccagcctc

SEQ ID NO: 5828698 - DNA, 20 bp, Homo sapiens
acagaggccctcaagtcttt

SEQ ID NO: 5828699 - DNA, 13 bp, Homo sapiens
acagaggccctgc

SEQ ID NO: 5828700 - DNA, 14 bp, Homo sapiens
acagaggccctgcc

SEQ ID NO: 5828701 - DNA, 12 bp, Homo sapiens
acagaggcctga

SEQ ID NO: 5828702 - DNA, 14 bp, Homo sapiens
acagaggcctgccc

SEQ ID NO: 5828703 - DNA, 22 bp, Homo sapiens
acagaggcggttgtaagaggat

SEQ ID NO: 5828704 - DNA, 22 bp, Homo sapiens
acagaggctgcacccctgggcc

SEQ ID NO: 5828705 - DNA, 24 bp, Homo sapiens
acagaggctgcacccctgggccag

SEQ ID NO: 5828706 - DNA, 19 bp, Homo sapiens
acagaggctgtggtcagag

SEQ ID NO: 5828707 - DNA, 20 bp, Homo sapiens
acagagggaagccagtcagg

SEQ ID NO: 5828708 - DNA, 17 bp, Homo sapiens
acagagggacagtgggc

SEQ ID NO: 5828709 - DNA, 19 bp, Homo sapiens
acagagggacagtgggcta

SEQ ID NO: 5828710 - DNA, 23 bp, Homo sapiens
acagagggaccaaattgcttcta

SEQ ID NO: 5828711 - DNA, 18 bp, Homo sapiens
acagagggagaagggaga

SEQ ID NO: 5828712 - DNA, 16 bp, Homo sapiens
acagagggagacaggg

SEQ ID NO: 5828713 - DNA, 23 bp, Homo sapiens
acagagggaggaatgtgtgcctt

SEQ ID NO: 5828714 - DNA, 12 bp, Homo sapiens
acagagggctgc

SEQ ID NO: 5828715 - DNA, 15 bp, Homo sapiens
acagaggggactctg

SEQ ID NO: 5828716 - DNA, 13 bp, Homo sapiens
acagaggggagca

SEQ ID NO: 5828717 - DNA, 20 bp, Homo sapiens
acagagggtaggaatgggta

SEQ ID NO: 5828718 - DNA, 19 bp, Homo sapiens
acagagggtcacagtgttt

SEQ ID NO: 5828719 - DNA, 23 bp, Homo sapiens
acagagggtcccattgtgcagaa

SEQ ID NO: 5828720 - DNA, 19 bp, Homo sapiens
acagaggtaaaaaaaagaa

SEQ ID NO: 5828721 - DNA, 14 bp, Homo sapiens
acagaggtaactat

SEQ ID NO: 5828722 - DNA, 24 bp, Homo sapiens
acagaggtcgtcgaaaggtgcagc

SEQ ID NO: 5828723 - DNA, 16 bp, Homo sapiens
acagaggttgtagtga

SEQ ID NO: 5828724 - DNA, 16 bp, Homo sapiens
acagaggtttcatttt

SEQ ID NO: 5828725 - DNA, 19 bp, Homo sapiens
acagaggtttcattttcat

SEQ ID NO: 5828726 - DNA, 22 bp, Homo sapiens
acagaggtttgaaggagaatgg

SEQ ID NO: 5828727 - DNA, 23 bp, Homo sapiens
acagaggtttgaaggagaatggc

SEQ ID NO: 5828728 - DNA, 12 bp, Homo sapiens
acagagtaacta

SEQ ID NO: 5828729 - DNA, 19 bp, Homo sapiens
acagagtaattataggaag

SEQ ID NO: 5828730 - DNA, 21 bp, Homo sapiens
acagagtagttttggttttta

SEQ ID NO: 5828731 - DNA, 15 bp, Homo sapiens
acagagtcaaggcct

SEQ ID NO: 5828732 - DNA, 16 bp, Homo sapiens
acagagtccgggagaa

SEQ ID NO: 5828733 - DNA, 12 bp, Homo sapiens
acagagtctcac

SEQ ID NO: 5828734 - DNA, 19 bp, Homo sapiens
acagagtctcactgttgcc

SEQ ID NO: 5828735 - DNA, 19 bp, Homo sapiens
acagagtctcgctctgtcg

SEQ ID NO: 5828736 - DNA, 17 bp, Homo sapiens
acagagtctgacaggaa

SEQ ID NO: 5828737 - DNA, 18 bp, Homo sapiens
acagagtctgacaggaag

SEQ ID NO: 5828738 - DNA, 19 bp, Homo sapiens
acagagtctgacaggaaga

SEQ ID NO: 5828739 - DNA, 14 bp, Homo sapiens
acagagtgaaaaat

SEQ ID NO: 5828740 - DNA, 17 bp, Homo sapiens
acagagtgaaaaatctt

SEQ ID NO: 5828741 - DNA, 16 bp, Homo sapiens
acagagtgagaccctg

SEQ ID NO: 5828742 - DNA, 19 bp, Homo sapiens
acagagtgccatccctgag

SEQ ID NO: 5828743 - DNA, 21 bp, Homo sapiens
acagagtgccatccctgagag

SEQ ID NO: 5828744 - DNA, 15 bp, Homo sapiens
acagagtgctggact

SEQ ID NO: 5828745 - DNA, 17 bp, Homo sapiens
acagagtgctggactgt

SEQ ID NO: 5828746 - DNA, 21 bp, Homo sapiens
acagagtggactcttccctct

SEQ ID NO: 5828747 - DNA, 22 bp, Homo sapiens
acagagtggactgttccctgag

SEQ ID NO: 5828748 - DNA, 17 bp, Homo sapiens
acagagtggagccctca

SEQ ID NO: 5828749 - DNA, 11 bp, Homo sapiens
acagagtggat

SEQ ID NO: 5828750 - DNA, 15 bp, Homo sapiens
acagagtggatctgg

SEQ ID NO: 5828751 - DNA, 17 bp, Homo sapiens
acagagtggatctggag

SEQ ID NO: 5828752 - DNA, 20 bp, Homo sapiens
acagagtggatctggagtct

SEQ ID NO: 5828753 - DNA, 14 bp, Homo sapiens
acagagtggccgtc

SEQ ID NO: 5828754 - DNA, 21 bp, Homo sapiens
acagagtggtctttctggaga

SEQ ID NO: 5828755 - DNA, 20 bp, Homo sapiens
acagagtgtagccaggtccc

SEQ ID NO: 5828756 - DNA, 16 bp, Homo sapiens
acagagtgtggtccct

SEQ ID NO: 5828757 - DNA, 23 bp, Homo sapiens
acagagtgtgtttttgcactgtc

SEQ ID NO: 5828758 - DNA, 20 bp, Homo sapiens
acagagttaaatatgcatct

SEQ ID NO: 5828759 - DNA, 14 bp, Homo sapiens
acagagttcacagg

SEQ ID NO: 5828760 - DNA, 13 bp, Homo sapiens
acagagttgattt

SEQ ID NO: 5828761 - DNA, 17 bp, Homo sapiens
acagagttggtgttcat

SEQ ID NO: 5828762 - DNA, 18 bp, Homo sapiens
acagagtttgtagtaaat

SEQ ID NO: 5828763 - DNA, 18 bp, Homo sapiens
acagagttttcactctta

SEQ ID NO: 5828764 - DNA, 20 bp, Homo sapiens
acagagttttcactcttatt

SEQ ID NO: 5828765 - DNA, 21 bp, Homo sapiens
acagagttttttaaacaaatg

SEQ ID NO: 5828766 - DNA, 23 bp, Homo sapiens
acagagttttttaaacaaatgag

SEQ ID NO: 5828767 - DNA, 22 bp, Homo sapiens
acagataaaaagtggaatttct

SEQ ID NO: 5828768 - DNA, 21 bp, Homo sapiens
acagataaagaaactgaggcc

SEQ ID NO: 5828769 - DNA, 23 bp, Homo sapiens
acagataaagaaactgaggccca

SEQ ID NO: 5828770 - DNA, 14 bp, Homo sapiens
acagataaatgatt

SEQ ID NO: 5828771 - DNA, 16 bp, Homo sapiens
acagataacataaata

SEQ ID NO: 5828772 - DNA, 16 bp, Homo sapiens
acagataacttcttta

SEQ ID NO: 5828773 - DNA, 18 bp, Homo sapiens
acagataagcaagagaga

SEQ ID NO: 5828774 - DNA, 21 bp, Homo sapiens
acagataagcaagagagatgt

SEQ ID NO: 5828775 - DNA, 22 bp, Homo sapiens
acagataagtgttcttcagtgt

SEQ ID NO: 5828776 - DNA, 21 bp, Homo sapiens
acagataataatgggtttctt

SEQ ID NO: 5828777 - DNA, 14 bp, Homo sapiens
acagataatgcttt

SEQ ID NO: 5828778 - DNA, 20 bp, Homo sapiens
acagataatgcttttactaa

SEQ ID NO: 5828779 - DNA, 18 bp, Homo sapiens
acagataattcatttgta

SEQ ID NO: 5828780 - DNA, 15 bp, Homo sapiens
acagatacacataca

SEQ ID NO: 5828781 - DNA, 13 bp, Homo sapiens
acagatacatttc

SEQ ID NO: 5828782 - DNA, 19 bp, Homo sapiens
acagatactgaaacatttg

SEQ ID NO: 5828783 - DNA, 16 bp, Homo sapiens
acagatactgtgagct

SEQ ID NO: 5828784 - DNA, 22 bp, Homo sapiens
acagatactgtgagcttacatt

SEQ ID NO: 5828785 - DNA, 19 bp, Homo sapiens
acagatagacagtgctgcc

SEQ ID NO: 5828786 - DNA, 20 bp, Homo sapiens
acagatagatatatgctctg

SEQ ID NO: 5828787 - DNA, 19 bp, Homo sapiens
acagatagatgttgctctt

SEQ ID NO: 5828788 - DNA, 16 bp, Homo sapiens
acagataggccttctt

SEQ ID NO: 5828789 - DNA, 15 bp, Homo sapiens
acagatatactttgt

SEQ ID NO: 5828790 - DNA, 13 bp, Homo sapiens
acagatatcgaga

SEQ ID NO: 5828791 - DNA, 15 bp, Homo sapiens
acagatatctttttc

SEQ ID NO: 5828792 - DNA, 18 bp, Homo sapiens
acagatattacagcttat

SEQ ID NO: 5828793 - DNA, 21 bp, Homo sapiens
acagatattgttataaataaa

SEQ ID NO: 5828794 - DNA, 14 bp, Homo sapiens
acagatatttaaag

SEQ ID NO: 5828795 - DNA, 22 bp, Homo sapiens
acagatatttaaagaatgagaa

SEQ ID NO: 5828796 - DNA, 22 bp, Homo sapiens
acagatatttaaatttagtgct

SEQ ID NO: 5828797 - DNA, 21 bp, Homo sapiens
acagatatttagctctgtgga

SEQ ID NO: 5828798 - DNA, 22 bp, Homo sapiens
acagatatttagctctgtggaa

SEQ ID NO: 5828799 - DNA, 18 bp, Homo sapiens
acagatatttcaaacatc

SEQ ID NO: 5828800 - DNA, 23 bp, Homo sapiens
acagatatttccatttcttcctc

SEQ ID NO: 5828801 - DNA, 14 bp, Homo sapiens
acagatcaagaaaa

SEQ ID NO: 5828802 - DNA, 14 bp, Homo sapiens
acagatcaagctgt

SEQ ID NO: 5828803 - DNA, 16 bp, Homo sapiens
acagatcaagctgtga

SEQ ID NO: 5828804 - DNA, 21 bp, Homo sapiens
acagatcacatgcccctctta

SEQ ID NO: 5828805 - DNA, 16 bp, Homo sapiens
acagatcactcctgga

SEQ ID NO: 5828806 - DNA, 18 bp, Homo sapiens
acagatcactcctggagg

SEQ ID NO: 5828807 - DNA, 12 bp, Homo sapiens
acagatcagtaa

SEQ ID NO: 5828808 - DNA, 23 bp, Homo sapiens
acagatcccatccatcagctccc

SEQ ID NO: 5828809 - DNA, 17 bp, Homo sapiens
acagatccccaagcctg

SEQ ID NO: 5828810 - DNA, 14 bp, Homo sapiens
acagatccccagcc

SEQ ID NO: 5828811 - DNA, 21 bp, Homo sapiens
acagatccccagcccctcctc

SEQ ID NO: 5828812 - DNA, 22 bp, Homo sapiens
acagatccccagcccctcctcc

SEQ ID NO: 5828813 - DNA, 15 bp, Homo sapiens
acagatccgcatgtg

SEQ ID NO: 5828814 - DNA, 16 bp, Homo sapiens
acagatccgcatgtgt

SEQ ID NO: 5828815 - DNA, 23 bp, Homo sapiens
acagatcctccgcggaggcccct

SEQ ID NO: 5828816 - DNA, 14 bp, Homo sapiens
acagatcctctggg

SEQ ID NO: 5828817 - DNA, 18 bp, Homo sapiens
acagatcgcatttcctaa

SEQ ID NO: 5828818 - DNA, 22 bp, Homo sapiens
acagatctagttctcttctcct

SEQ ID NO: 5828819 - DNA, 17 bp, Homo sapiens
acagatctcaattttat

SEQ ID NO: 5828820 - DNA, 14 bp, Homo sapiens
acagatcttgagca

SEQ ID NO: 5828821 - DNA, 12 bp, Homo sapiens
acagatgaaaag

SEQ ID NO: 5828822 - DNA, 23 bp, Homo sapiens
acagatgaaaatttgagactatt

SEQ ID NO: 5828823 - DNA, 19 bp, Homo sapiens
acagatgaactctttctgg

SEQ ID NO: 5828824 - DNA, 14 bp, Homo sapiens
acagatgaatgtat

SEQ ID NO: 5828825 - DNA, 16 bp, Homo sapiens
acagatgaccaaagtc

SEQ ID NO: 5828826 - DNA, 19 bp, Homo sapiens
acagatgaccataattttt

SEQ ID NO: 5828827 - DNA, 20 bp, Homo sapiens
acagatgagattccctctcc

SEQ ID NO: 5828828 - DNA, 22 bp, Homo sapiens
acagatgaggagcagctggggt

SEQ ID NO: 5828829 - DNA, 12 bp, Homo sapiens
acagatgatact

SEQ ID NO: 5828830 - DNA, 18 bp, Homo sapiens
acagatgatgaagaaatg

SEQ ID NO: 5828831 - DNA, 13 bp, Homo sapiens
acagatgcaagca

SEQ ID NO: 5828832 - DNA, 24 bp, Homo sapiens
acagatgcaagttattttatttgc

SEQ ID NO: 5828833 - DNA, 17 bp, Homo sapiens
acagatgcaatgtgcta

SEQ ID NO: 5828834 - DNA, 16 bp, Homo sapiens
acagatgcacacacag

SEQ ID NO: 5828835 - DNA, 18 bp, Homo sapiens
acagatgcatatagacac

SEQ ID NO: 5828836 - DNA, 18 bp, Homo sapiens
acagatgccaacttccca

SEQ ID NO: 5828837 - DNA, 17 bp, Homo sapiens
acagatgccatggcctg

SEQ ID NO: 5828838 - DNA, 21 bp, Homo sapiens
acagatgccatggcctgtgct

SEQ ID NO: 5828839 - DNA, 13 bp, Homo sapiens
acagatgcccacg

SEQ ID NO: 5828840 - DNA, 21 bp, Homo sapiens
acagatgcctacttttggcct

SEQ ID NO: 5828841 - DNA, 18 bp, Homo sapiens
acagatgcctccttcctc

SEQ ID NO: 5828842 - DNA, 20 bp, Homo sapiens
acagatgcctggtgagcagg

SEQ ID NO: 5828843 - DNA, 21 bp, Homo sapiens
acagatgcctggtgagcaggg

SEQ ID NO: 5828844 - DNA, 20 bp, Homo sapiens
acagatgctaataaactgtt

SEQ ID NO: 5828845 - DNA, 14 bp, Homo sapiens
acagatgctccagg

SEQ ID NO: 5828846 - DNA, 23 bp, Homo sapiens
acagatgctggcctcttggcacc

SEQ ID NO: 5828847 - DNA, 14 bp, Homo sapiens
acagatgcttttct

SEQ ID NO: 5828848 - DNA, 21 bp, Homo sapiens
acagatgcttttctgtctctg

SEQ ID NO: 5828849 - DNA, 21 bp, Homo sapiens
acagatggaaaaactgaggct

SEQ ID NO: 5828850 - DNA, 14 bp, Homo sapiens
acagatggaccaaa

SEQ ID NO: 5828851 - DNA, 22 bp, Homo sapiens
acagatggaccaaaagatgggt

SEQ ID NO: 5828852 - DNA, 21 bp, Homo sapiens
acagatggacgcaggccctgt

SEQ ID NO: 5828853 - DNA, 17 bp, Homo sapiens
acagatggatttgcctg

SEQ ID NO: 5828854 - DNA, 22 bp, Homo sapiens
acagatggcactttgaaggggc

SEQ ID NO: 5828855 - DNA, 20 bp, Homo sapiens
acagatggcatacctgtgcc

SEQ ID NO: 5828856 - DNA, 22 bp, Homo sapiens
acagatggcccaagggatggca

SEQ ID NO: 5828857 - DNA, 13 bp, Homo sapiens
acagatggctgtg

SEQ ID NO: 5828858 - DNA, 21 bp, Homo sapiens
acagatggctgtgaaaattac

SEQ ID NO: 5828859 - DNA, 23 bp, Homo sapiens
acagatggctgtgaaaattacac

SEQ ID NO: 5828860 - DNA, 22 bp, Homo sapiens
acagatggggtctgtgactgga

SEQ ID NO: 5828861 - DNA, 23 bp, Homo sapiens
acagatggggtctgtgactggat

SEQ ID NO: 5828862 - DNA, 19 bp, Homo sapiens
acagatgggtattaaactt

SEQ ID NO: 5828863 - DNA, 20 bp, Homo sapiens
acagatgggtattaaacttg

SEQ ID NO: 5828864 - DNA, 19 bp, Homo sapiens
acagatggtcacacagaga

SEQ ID NO: 5828865 - DNA, 12 bp, Homo sapiens
acagatgtaaat

SEQ ID NO: 5828866 - DNA, 14 bp, Homo sapiens
acagatgtaaatcg

SEQ ID NO: 5828867 - DNA, 18 bp, Homo sapiens
acagccgctcctgtctgc

SEQ ID NO: 5828868 - DNA, 23 bp, Homo sapiens
acagccgctcctgtctgccagcc

SEQ ID NO: 5828869 - DNA, 21 bp, Homo sapiens
acagccggagcagttggcctg

SEQ ID NO: 5828870 - DNA, 19 bp, Homo sapiens
acagccggtcagaggagcg

SEQ ID NO: 5828871 - DNA, 23 bp, Homo sapiens
acagccgtcccgcgttcaagact

SEQ ID NO: 5828872 - DNA, 18 bp, Homo sapiens
acagccgtttgttcccca

SEQ ID NO: 5828873 - DNA, 21 bp, Homo sapiens
acagcctaatcccgtgcccct

SEQ ID NO: 5828874 - DNA, 18 bp, Homo sapiens
acagcctaatgaaggcca

SEQ ID NO: 5828875 - DNA, 22 bp, Homo sapiens
acagcctaatgaaggccatcat

SEQ ID NO: 5828876 - DNA, 14 bp, Homo sapiens
acagcctagggcag

SEQ ID NO: 5828877 - DNA, 19 bp, Homo sapiens
acagcctatagtaaatgtg

SEQ ID NO: 5828878 - DNA, 14 bp, Homo sapiens
acagcctccaagtc

SEQ ID NO: 5828879 - DNA, 16 bp, Homo sapiens
acagcctccagggccc

SEQ ID NO: 5828880 - DNA, 15 bp, Homo sapiens
acagcctcccacccc

SEQ ID NO: 5828881 - DNA, 13 bp, Homo sapiens
acagcctcccccg

SEQ ID NO: 5828882 - DNA, 17 bp, Homo sapiens
acagcctcccctgccag

SEQ ID NO: 5828883 - DNA, 19 bp, Homo sapiens
acagcctcccctgccaggg

SEQ ID NO: 5828884 - DNA, 14 bp, Homo sapiens
acagcctccccttc

SEQ ID NO: 5828885 - DNA, 19 bp, Homo sapiens
acagcctccccttcccaga

SEQ ID NO: 5828886 - DNA, 13 bp, Homo sapiens
acagcctccctga

SEQ ID NO: 5828887 - DNA, 18 bp, Homo sapiens
acagcctccctgagcctg

SEQ ID NO: 5828888 - DNA, 18 bp, Homo sapiens
acagcctcctaggctccc

SEQ ID NO: 5828889 - DNA, 13 bp, Homo sapiens
acagcctcctctg

SEQ ID NO: 5828890 - DNA, 15 bp, Homo sapiens
acagcctcctctgtc

SEQ ID NO: 5828891 - DNA, 14 bp, Homo sapiens
acagcctctacagc

SEQ ID NO: 5828892 - DNA, 18 bp, Homo sapiens
acagcctctacagccgtc

SEQ ID NO: 5828893 - DNA, 13 bp, Homo sapiens
acagcctctctct

SEQ ID NO: 5828894 - DNA, 18 bp, Homo sapiens
acagcctctgacccctcc

SEQ ID NO: 5828895 - DNA, 22 bp, Homo sapiens
acagcctctgacccctcctcac

SEQ ID NO: 5828896 - DNA, 14 bp, Homo sapiens
acagcctctggctc

SEQ ID NO: 5828897 - DNA, 12 bp, Homo sapiens
acagcctctgtg

SEQ ID NO: 5828898 - DNA, 13 bp, Homo sapiens
acagcctctgtga

SEQ ID NO: 5828899 - DNA, 18 bp, Homo sapiens
acagcctcttcagcccct

SEQ ID NO: 5828900 - DNA, 14 bp, Homo sapiens
acagcctcttcctc

SEQ ID NO: 5828901 - DNA, 21 bp, Homo sapiens
acagcctcttctgtcccaagt

SEQ ID NO: 5828902 - DNA, 23 bp, Homo sapiens
acagcctctttcctaacttcctt

SEQ ID NO: 5828903 - DNA, 13 bp, Homo sapiens
acagcctcttttt

SEQ ID NO: 5828904 - DNA, 16 bp, Homo sapiens
acagcctgaaggaatt

SEQ ID NO: 5828905 - DNA, 21 bp, Homo sapiens
acagcctgaataaaccaagac

SEQ ID NO: 5828906 - DNA, 13 bp, Homo sapiens
acagcctgcacac

SEQ ID NO: 5828907 - DNA, 15 bp, Homo sapiens
acagcctgcacacac

SEQ ID NO: 5828908 - DNA, 21 bp, Homo sapiens
acagcctgcacacacctgcct

SEQ ID NO: 5828909 - DNA, 12 bp, Homo sapiens
acagcctgcctc

SEQ ID NO: 5828910 - DNA, 16 bp, Homo sapiens
acagcctgcctctgcc

SEQ ID NO: 5828911 - DNA, 21 bp, Homo sapiens
acagcctgcctctgccacagc

SEQ ID NO: 5828912 - DNA, 19 bp, Homo sapiens
acagcctgggaccagggca

SEQ ID NO: 5828913 - DNA, 20 bp, Homo sapiens
acagcctgggaccagggcat

SEQ ID NO: 5828914 - DNA, 15 bp, Homo sapiens
acagcctgggcccca

SEQ ID NO: 5828915 - DNA, 11 bp, Homo sapiens
acagcctgggg

SEQ ID NO: 5828916 - DNA, 20 bp, Homo sapiens
acagcctgggtgacggtcct

SEQ ID NO: 5828917 - DNA, 20 bp, Homo sapiens
acagcctggtcgccttccac

SEQ ID NO: 5828918 - DNA, 16 bp, Homo sapiens
acagcctgtcttcaga

SEQ ID NO: 5828919 - DNA, 21 bp, Homo sapiens
acagcctgtggcggtgcctgg

SEQ ID NO: 5828920 - DNA, 22 bp, Homo sapiens
acagcctgtggcggtgcctggg

SEQ ID NO: 5828921 - DNA, 21 bp, Homo sapiens
acagcctgtttgggaggctgg

SEQ ID NO: 5828922 - DNA, 22 bp, Homo sapiens
acagcctgtttgggaggctgga

SEQ ID NO: 5828923 - DNA, 11 bp, Homo sapiens
acagccttcag

SEQ ID NO: 5828924 - DNA, 18 bp, Homo sapiens
acagccttccctctgcat

SEQ ID NO: 5828925 - DNA, 19 bp, Homo sapiens
acagccttccctctgcatt

SEQ ID NO: 5828926 - DNA, 21 bp, Homo sapiens
acagccttccctctgcattga

SEQ ID NO: 5828927 - DNA, 23 bp, Homo sapiens
acagccttccttctgctcccacc

SEQ ID NO: 5828928 - DNA, 21 bp, Homo sapiens
acagccttctaaattcccaaa

SEQ ID NO: 5828929 - DNA, 22 bp, Homo sapiens
acagccttgcaacccaaggtga

SEQ ID NO: 5828930 - DNA, 15 bp, Homo sapiens
acagccttggctcct

SEQ ID NO: 5828931 - DNA, 21 bp, Homo sapiens
acagccttggctcctgagaaa

SEQ ID NO: 5828932 - DNA, 18 bp, Homo sapiens
acagccttgggcctttca

SEQ ID NO: 5828933 - DNA, 21 bp, Homo sapiens
acagcctttcgttctgctgac

SEQ ID NO: 5828934 - DNA, 13 bp, Homo sapiens
acagcctttctgt

SEQ ID NO: 5828935 - DNA, 20 bp, Homo sapiens
acagcctttgaatgtaacca

SEQ ID NO: 5828936 - DNA, 16 bp, Homo sapiens
acagcctttgcccaaa

SEQ ID NO: 5828937 - DNA, 20 bp, Homo sapiens
acagcctttgcgctctgggt

SEQ ID NO: 5828938 - DNA, 22 bp, Homo sapiens
acagcgacagaaaacctcaagg

SEQ ID NO: 5828939 - DNA, 19 bp, Homo sapiens
acagcgacgctcccctgag

SEQ ID NO: 5828940 - DNA, 17 bp, Homo sapiens
acagcgagactccgtct

SEQ ID NO: 5828941 - DNA, 15 bp, Homo sapiens
acagcgagaggcaga

SEQ ID NO: 5828942 - DNA, 15 bp, Homo sapiens
acagcgagcctgtgc

SEQ ID NO: 5828943 - DNA, 16 bp, Homo sapiens
acagcgagcctgtgcc

SEQ ID NO: 5828944 - DNA, 15 bp, Homo sapiens
acagcgagggcagct

SEQ ID NO: 5828945 - DNA, 16 bp, Homo sapiens
acagcgagggcagctg

SEQ ID NO: 5828946 - DNA, 19 bp, Homo sapiens
acagcgagggcagctgcta

SEQ ID NO: 5828947 - DNA, 18 bp, Homo sapiens
acagcgatggcaggcctg

SEQ ID NO: 5828948 - DNA, 23 bp, Homo sapiens
acagcgatggcaggcctgaccca

SEQ ID NO: 5828949 - DNA, 15 bp, Homo sapiens
acagcgccagcctca

SEQ ID NO: 5828950 - DNA, 23 bp, Homo sapiens
acagcgcccctgctgtcttcccc

SEQ ID NO: 5828951 - DNA, 19 bp, Homo sapiens
acagcgcggaggaggaggg

SEQ ID NO: 5828952 - DNA, 14 bp, Homo sapiens
acagcgcgggcgga

SEQ ID NO: 5828953 - DNA, 13 bp, Homo sapiens
acagcgctatgca

SEQ ID NO: 5828954 - DNA, 23 bp, Homo sapiens
acagcgctcgatggacctcagca

SEQ ID NO: 5828955 - DNA, 15 bp, Homo sapiens
acagcggaggagacc

SEQ ID NO: 5828956 - DNA, 21 bp, Homo sapiens
acagcggaggagaccagctca

SEQ ID NO: 5828957 - DNA, 15 bp, Homo sapiens
acagcggaggtgtgg

SEQ ID NO: 5828958 - DNA, 16 bp, Homo sapiens
acagcggaggtgtgga

SEQ ID NO: 5828959 - DNA, 15 bp, Homo sapiens
acagcggccccgcgg

SEQ ID NO: 5828960 - DNA, 23 bp, Homo sapiens
acagcggccccgcggagcccccg

SEQ ID NO: 5828961 - DNA, 14 bp, Homo sapiens
acagcggctgcctc

SEQ ID NO: 5828962 - DNA, 18 bp, Homo sapiens
acagcggctggacttgga

SEQ ID NO: 5828963 - DNA, 21 bp, Homo sapiens
acagcggctggacttggaggt

SEQ ID NO: 5828964 - DNA, 22 bp, Homo sapiens
acagcggctggacttggaggta

SEQ ID NO: 5828965 - DNA, 20 bp, Homo sapiens
acagcgggagacctgtgcta

SEQ ID NO: 5828966 - DNA, 16 bp, Homo sapiens
acagcggggccccagg

SEQ ID NO: 5828967 - DNA, 17 bp, Homo sapiens
acagcgggtaaaaagag

SEQ ID NO: 5828968 - DNA, 21 bp, Homo sapiens
acagcggttgtaaatacaatt

SEQ ID NO: 5828969 - DNA, 15 bp, Homo sapiens
acagcgtccctggcg

SEQ ID NO: 5828970 - DNA, 14 bp, Homo sapiens
acagcgtctgctca

SEQ ID NO: 5828971 - DNA, 19 bp, Homo sapiens
acagcgtgctaaaataaca

SEQ ID NO: 5828972 - DNA, 22 bp, Homo sapiens
acagcgttcctagagaagacag

SEQ ID NO: 5828973 - DNA, 17 bp, Homo sapiens
acagcgtttacatattt

SEQ ID NO: 5828974 - DNA, 19 bp, Homo sapiens
acagcgtttacatatttac

SEQ ID NO: 5828975 - DNA, 19 bp, Homo sapiens
acagctaaatcatttgaga

SEQ ID NO: 5828976 - DNA, 18 bp, Homo sapiens
acagctaaatttggagat

SEQ ID NO: 5828977 - DNA, 15 bp, Homo sapiens
acagctaacaataaa

SEQ ID NO: 5828978 - DNA, 19 bp, Homo sapiens
acagctaacacacagctcc

SEQ ID NO: 5828979 - DNA, 13 bp, Homo sapiens
acagctaacatgg

SEQ ID NO: 5828980 - DNA, 15 bp, Homo sapiens
acagctaacatggaa

SEQ ID NO: 5828981 - DNA, 20 bp, Homo sapiens
acagctaaggccttgccagc

SEQ ID NO: 5828982 - DNA, 19 bp, Homo sapiens
acagctaataaaagtcaga

SEQ ID NO: 5828983 - DNA, 20 bp, Homo sapiens
acagctaataaaagtcagag

SEQ ID NO: 5828984 - DNA, 24 bp, Homo sapiens
acagctaataaaagtcagagctca

SEQ ID NO: 5828985 - DNA, 22 bp, Homo sapiens
acagctaatcagcattctcact

SEQ ID NO: 5828986 - DNA, 21 bp, Homo sapiens
acagctaattctactcacagt

SEQ ID NO: 5828987 - DNA, 13 bp, Homo sapiens
acagctacaaact

SEQ ID NO: 5828988 - DNA, 17 bp, Homo sapiens
acagctacaaactttta

SEQ ID NO: 5828989 - DNA, 18 bp, Homo sapiens
acagctacaaacttttaa

SEQ ID NO: 5828990 - DNA, 14 bp, Homo sapiens
acagctacaacagc

SEQ ID NO: 5828991 - DNA, 19 bp, Homo sapiens
acagctacaaccctaccct

SEQ ID NO: 5828992 - DNA, 21 bp, Homo sapiens
acagctacaaccctaccctgg

SEQ ID NO: 5828993 - DNA, 22 bp, Homo sapiens
acagctacaaccctaccctggc

SEQ ID NO: 5828994 - DNA, 21 bp, Homo sapiens
acagctacgtgtgcccctctc

SEQ ID NO: 5828995 - DNA, 23 bp, Homo sapiens
acagctacgtgtgcccctctcat

SEQ ID NO: 5828996 - DNA, 23 bp, Homo sapiens
acagctactaacctggagacagt

SEQ ID NO: 5828997 - DNA, 19 bp, Homo sapiens
acagctactataaatatac

SEQ ID NO: 5828998 - DNA, 21 bp, Homo sapiens
acagctactataaatatacat

SEQ ID NO: 5828999 - DNA, 14 bp, Homo sapiens
acagctactctccc

SEQ ID NO: 5829000 - DNA, 13 bp, Homo sapiens
acagctactttaa

SEQ ID NO: 5829001 - DNA, 15 bp, Homo sapiens
acagctagacaccta

SEQ ID NO: 5829002 - DNA, 16 bp, Homo sapiens
acagctagcttgaaaa

SEQ ID NO: 5829003 - DNA, 16 bp, Homo sapiens
acagctaggcatgcct

SEQ ID NO: 5829004 - DNA, 20 bp, Homo sapiens
acagctaggcatgcctggga

SEQ ID NO: 5829005 - DNA, 14 bp, Homo sapiens
acagctaggctgag

SEQ ID NO: 5829006 - DNA, 23 bp, Homo sapiens
acagctaggttaataggaggaca

SEQ ID NO: 5829007 - DNA, 14 bp, Homo sapiens
acagctatctagat

SEQ ID NO: 5829008 - DNA, 14 bp, Homo sapiens
acagctatgcaaaa

SEQ ID NO: 5829009 - DNA, 13 bp, Homo sapiens
acagctatttaga

SEQ ID NO: 5829010 - DNA, 21 bp, Homo sapiens
acagctatttcccttttctgt

SEQ ID NO: 5829011 - DNA, 18 bp, Homo sapiens
acagctcaagcattctgt

SEQ ID NO: 5829012 - DNA, 21 bp, Homo sapiens
acagctcaagcattctgttta

SEQ ID NO: 5829013 - DNA, 15 bp, Homo sapiens
acagctcacctctga

SEQ ID NO: 5829014 - DNA, 20 bp, Homo sapiens
acagctcacctctgaaggca

SEQ ID NO: 5829015 - DNA, 15 bp, Homo sapiens
acagctcactgcagc

SEQ ID NO: 5829016 - DNA, 14 bp, Homo sapiens
acagctcagagatg

SEQ ID NO: 5829017 - DNA, 15 bp, Homo sapiens
acagctcagcagaca

SEQ ID NO: 5829018 - DNA, 16 bp, Homo sapiens
acagctcagccagtgg

SEQ ID NO: 5829019 - DNA, 17 bp, Homo sapiens
acagctcagccagtggg

SEQ ID NO: 5829020 - DNA, 14 bp, Homo sapiens
acagctcagctgcc

SEQ ID NO: 5829021 - DNA, 21 bp, Homo sapiens
acagctcagctttttgtcttt

SEQ ID NO: 5829022 - DNA, 19 bp, Homo sapiens
acagctcaggaggcgccct

SEQ ID NO: 5829023 - DNA, 17 bp, Homo sapiens
acagctcatgttttcta

SEQ ID NO: 5829024 - DNA, 21 bp, Homo sapiens
acagctcatgttttctatatg

SEQ ID NO: 5829025 - DNA, 14 bp, Homo sapiens
acagctcattaaac

SEQ ID NO: 5829026 - DNA, 19 bp, Homo sapiens
acagctcattaaacttttt

SEQ ID NO: 5829027 - DNA, 23 bp, Homo sapiens
acagctccagatgtttctcattt

SEQ ID NO: 5829028 - DNA, 18 bp, Homo sapiens
acagctcccaccccaccc

SEQ ID NO: 5829029 - DNA, 14 bp, Homo sapiens
acagctccccaagt

SEQ ID NO: 5829030 - DNA, 12 bp, Homo sapiens
acagctccccca

SEQ ID NO: 5829031 - DNA, 12 bp, Homo sapiens
acagctccctag

SEQ ID NO: 5829032 - DNA, 15 bp, Homo sapiens
acagctcccttccct

SEQ ID NO: 5829033 - DNA, 20 bp, Homo sapiens
acagctcctccatgcctgac

SEQ ID NO: 5829034 - DNA, 12 bp, Homo sapiens
acagctcctccc

SEQ ID NO: 5829035 - DNA, 18 bp, Homo sapiens
acagctcctcccctgccg

SEQ ID NO: 5829036 - DNA, 22 bp, Homo sapiens
acagctcctcccctgccgcctc

SEQ ID NO: 5829037 - DNA, 21 bp, Homo sapiens
acagctccttactctgaggaa

SEQ ID NO: 5829038 - DNA, 12 bp, Homo sapiens
acagctccttct

SEQ ID NO: 5829039 - DNA, 13 bp, Homo sapiens
acagctccttctg

SEQ ID NO: 5829040 - DNA, 18 bp, Homo sapiens
acagctccttctgtccta

SEQ ID NO: 5829041 - DNA, 15 bp, Homo sapiens
acagctccttgggag

SEQ ID NO: 5829042 - DNA, 15 bp, Homo sapiens
acagctccttgtgag

SEQ ID NO: 5829043 - DNA, 12 bp, Homo sapiens
acagctccttta

SEQ ID NO: 5829044 - DNA, 16 bp, Homo sapiens
acagggtctcactctg

SEQ ID NO: 5829045 - DNA, 17 bp, Homo sapiens
acagggtctcttccttc

SEQ ID NO: 5829046 - DNA, 15 bp, Homo sapiens
acagggtctgcctcc

SEQ ID NO: 5829047 - DNA, 17 bp, Homo sapiens
acagggtctgcctccag

SEQ ID NO: 5829048 - DNA, 14 bp, Homo sapiens
acagggtctgggac

SEQ ID NO: 5829049 - DNA, 14 bp, Homo sapiens
acagggtcttgcta

SEQ ID NO: 5829050 - DNA, 21 bp, Homo sapiens
acagggtgagcactctggggt

SEQ ID NO: 5829051 - DNA, 20 bp, Homo sapiens
acagggtgctccttgtcaat

SEQ ID NO: 5829052 - DNA, 22 bp, Homo sapiens
acagggtggcacccaccactct

SEQ ID NO: 5829053 - DNA, 21 bp, Homo sapiens
acagggtgggagggaggaggg

SEQ ID NO: 5829054 - DNA, 18 bp, Homo sapiens
acagggtgggatgagcct

SEQ ID NO: 5829055 - DNA, 19 bp, Homo sapiens
acagggtgggatgagcctc

SEQ ID NO: 5829056 - DNA, 15 bp, Homo sapiens
acagggtgggcctcg

SEQ ID NO: 5829057 - DNA, 17 bp, Homo sapiens
acagggtggggcttaga

SEQ ID NO: 5829058 - DNA, 21 bp, Homo sapiens
acagggtgtggtatgaggggg

SEQ ID NO: 5829059 - DNA, 22 bp, Homo sapiens
acagggtgtggtatgagggggt

SEQ ID NO: 5829060 - DNA, 16 bp, Homo sapiens
acagggtgttggaaga

SEQ ID NO: 5829061 - DNA, 16 bp, Homo sapiens
acagggttcaaaatgt

SEQ ID NO: 5829062 - DNA, 18 bp, Homo sapiens
acagggtttggcccaagt

SEQ ID NO: 5829063 - DNA, 14 bp, Homo sapiens
acagggtttttacc

SEQ ID NO: 5829064 - DNA, 14 bp, Homo sapiens
acaggtaaaacagg

SEQ ID NO: 5829065 - DNA, 19 bp, Homo sapiens
acaggtaaacagaaatcct

SEQ ID NO: 5829066 - DNA, 18 bp, Homo sapiens
acaggtaaactatcttgg

SEQ ID NO: 5829067 - DNA, 19 bp, Homo sapiens
acaggtaacgtctgtaagc

SEQ ID NO: 5829068 - DNA, 15 bp, Homo sapiens
acaggtaccagttct

SEQ ID NO: 5829069 - DNA, 22 bp, Homo sapiens
acaggtagcacagattttgaat

SEQ ID NO: 5829070 - DNA, 16 bp, Homo sapiens
acaggtatatactttg

SEQ ID NO: 5829071 - DNA, 14 bp, Homo sapiens
acaggtatcaggca

SEQ ID NO: 5829072 - DNA, 18 bp, Homo sapiens
acaggtatcaggcacagg

SEQ ID NO: 5829073 - DNA, 20 bp, Homo sapiens
acaggtatttttttaaatca

SEQ ID NO: 5829074 - DNA, 21 bp, Homo sapiens
acaggtcaccattatgctggt

SEQ ID NO: 5829075 - DNA, 19 bp, Homo sapiens
acaggtcacccatcaggac

SEQ ID NO: 5829076 - DNA, 14 bp, Homo sapiens
acaggtcagggctc

SEQ ID NO: 5829077 - DNA, 16 bp, Homo sapiens
acaggtcagggctcag

SEQ ID NO: 5829078 - DNA, 21 bp, Homo sapiens
acaggtcagtagtcacaaact

SEQ ID NO: 5829079 - DNA, 19 bp, Homo sapiens
acaggtcatattaatatat

SEQ ID NO: 5829080 - DNA, 19 bp, Homo sapiens
acaggtcatcagatgcctg

SEQ ID NO: 5829081 - DNA, 21 bp, Homo sapiens
acaggtcatcagatgcctgct

SEQ ID NO: 5829082 - DNA, 20 bp, Homo sapiens
acaggtccaaggctggtccc

SEQ ID NO: 5829083 - DNA, 13 bp, Homo sapiens
acaggtcccaaat

SEQ ID NO: 5829084 - DNA, 19 bp, Homo sapiens
acaggtcccacctccagcc

SEQ ID NO: 5829085 - DNA, 19 bp, Homo sapiens
acaggtcccacgccaggcc

SEQ ID NO: 5829086 - DNA, 14 bp, Homo sapiens
acaggtcctccatc

SEQ ID NO: 5829087 - DNA, 13 bp, Homo sapiens
acaggtcctgatt

SEQ ID NO: 5829088 - DNA, 15 bp, Homo sapiens
acaggtctagacttt

SEQ ID NO: 5829089 - DNA, 16 bp, Homo sapiens
acaggtctcagaatct

SEQ ID NO: 5829090 - DNA, 15 bp, Homo sapiens
acaggtctctgagac

SEQ ID NO: 5829091 - DNA, 15 bp, Homo sapiens
acaggtctctgttta

SEQ ID NO: 5829092 - DNA, 20 bp, Homo sapiens
acaggtcttcactgcccagg

SEQ ID NO: 5829093 - DNA, 21 bp, Homo sapiens
acaggtcttctttaaggaaga

SEQ ID NO: 5829094 - DNA, 21 bp, Homo sapiens
acaggtctttcctaaggctgc

SEQ ID NO: 5829095 - DNA, 14 bp, Homo sapiens
acaggtcttttcaa

SEQ ID NO: 5829096 - DNA, 18 bp, Homo sapiens
acaggtcttttcttggcg

SEQ ID NO: 5829097 - DNA, 14 bp, Homo sapiens
acaggtgacagtga

SEQ ID NO: 5829098 - DNA, 14 bp, Homo sapiens
acaggtgagtgcca

SEQ ID NO: 5829099 - DNA, 18 bp, Homo sapiens
acaggtgattaacttgga

SEQ ID NO: 5829100 - DNA, 14 bp, Homo sapiens
acaggtgcaagcca

SEQ ID NO: 5829101 - DNA, 22 bp, Homo sapiens
acaggtgcaagccactatgtcc

SEQ ID NO: 5829102 - DNA, 13 bp, Homo sapiens
acaggtgcccgcc

SEQ ID NO: 5829103 - DNA, 22 bp, Homo sapiens
acaggtgccgccagctgccgca

SEQ ID NO: 5829104 - DNA, 12 bp, Homo sapiens
acaggtgcctgg

SEQ ID NO: 5829105 - DNA, 12 bp, Homo sapiens
acaggtgcgccc

SEQ ID NO: 5829106 - DNA, 13 bp, Homo sapiens
acaggtgctggcc

SEQ ID NO: 5829107 - DNA, 18 bp, Homo sapiens
acaggtgctggcccagca

SEQ ID NO: 5829108 - DNA, 20 bp, Homo sapiens
acaggtgctggcccagcatg

SEQ ID NO: 5829109 - DNA, 15 bp, Homo sapiens
acaggtggcaggacc

SEQ ID NO: 5829110 - DNA, 12 bp, Homo sapiens
acaggtgggcct

SEQ ID NO: 5829111 - DNA, 15 bp, Homo sapiens
acaggtgggcctggc

SEQ ID NO: 5829112 - DNA, 16 bp, Homo sapiens
acaggtggggactggg

SEQ ID NO: 5829113 - DNA, 19 bp, Homo sapiens
acaggtggggcctcagcct

SEQ ID NO: 5829114 - DNA, 20 bp, Homo sapiens
acaggtggggcctcagcctg

SEQ ID NO: 5829115 - DNA, 17 bp, Homo sapiens
acaggtggtgtcactgt

SEQ ID NO: 5829116 - DNA, 18 bp, Homo sapiens
acaggtggtgtcactgtc

SEQ ID NO: 5829117 - DNA, 19 bp, Homo sapiens
acaggtggtgtcactgtcc

SEQ ID NO: 5829118 - DNA, 22 bp, Homo sapiens
acaggtggtgtcactgtccctc

SEQ ID NO: 5829119 - DNA, 16 bp, Homo sapiens
acaggtgtaaatatag

SEQ ID NO: 5829120 - DNA, 14 bp, Homo sapiens
acaggtgtgagcca

SEQ ID NO: 5829121 - DNA, 15 bp, Homo sapiens
acaggtgtgagccac

SEQ ID NO: 5829122 - DNA, 22 bp, Homo sapiens
acaggtgtgagccaccacgccc

SEQ ID NO: 5829123 - DNA, 23 bp, Homo sapiens
acaggtgtgagtcaccaagccca

SEQ ID NO: 5829124 - DNA, 20 bp, Homo sapiens
acaggtgtgggatggagagt

SEQ ID NO: 5829125 - DNA, 21 bp, Homo sapiens
acaggtgtggtgtaatttata

SEQ ID NO: 5829126 - DNA, 16 bp, Homo sapiens
acaggtgtgtatgtaa

SEQ ID NO: 5829127 - DNA, 16 bp, Homo sapiens
acaggtgtgtgtgaac

SEQ ID NO: 5829128 - DNA, 24 bp, Homo sapiens
acaggtgttccgtgggaccctcag

SEQ ID NO: 5829129 - DNA, 16 bp, Homo sapiens
acaggtgttcctcctc

SEQ ID NO: 5829130 - DNA, 22 bp, Homo sapiens
acaggtgttggaagccaggact

SEQ ID NO: 5829131 - DNA, 17 bp, Homo sapiens
acaggtgttggtgacaa

SEQ ID NO: 5829132 - DNA, 12 bp, Homo sapiens
acaggttacaac

SEQ ID NO: 5829133 - DNA, 17 bp, Homo sapiens
acaggttacaacagatt

SEQ ID NO: 5829134 - DNA, 20 bp, Homo sapiens
acaggttacaacagatttgt

SEQ ID NO: 5829135 - DNA, 22 bp, Homo sapiens
acaggttacaacagatttgtga

SEQ ID NO: 5829136 - DNA, 18 bp, Homo sapiens
acaggttataacagtgtt

SEQ ID NO: 5829137 - DNA, 23 bp, Homo sapiens
acaggttattttagtttctgttc

SEQ ID NO: 5829138 - DNA, 11 bp, Homo sapiens
acaggttcctt

SEQ ID NO: 5829139 - DNA, 18 bp, Homo sapiens
acaggttccttttgaagc

SEQ ID NO: 5829140 - DNA, 22 bp, Homo sapiens
acaggttgaggctaaaacaaat

SEQ ID NO: 5829141 - DNA, 13 bp, Homo sapiens
acaggttggccag

SEQ ID NO: 5829142 - DNA, 13 bp, Homo sapiens
acaggttggccgt

SEQ ID NO: 5829143 - DNA, 11 bp, Homo sapiens
acaggttggga

SEQ ID NO: 5829144 - DNA, 15 bp, Homo sapiens
acaggttgggatggg

SEQ ID NO: 5829145 - DNA, 22 bp, Homo sapiens
acaggttgtgaaataattttta

SEQ ID NO: 5829146 - DNA, 13 bp, Homo sapiens
acaggtttaaaaa

SEQ ID NO: 5829147 - DNA, 22 bp, Homo sapiens
acaggtttaaggctgaggctgc

SEQ ID NO: 5829148 - DNA, 23 bp, Homo sapiens
acaggtttaaggctgaggctgcc

SEQ ID NO: 5829149 - DNA, 18 bp, Homo sapiens
acaggtttgttttttcaa

SEQ ID NO: 5829150 - DNA, 17 bp, Homo sapiens
acagtaaaaacttgtac

SEQ ID NO: 5829151 - DNA, 20 bp, Homo sapiens
acagtaaaaacttgtactat

SEQ ID NO: 5829152 - DNA, 12 bp, Homo sapiens
acagtaaacatt

SEQ ID NO: 5829153 - DNA, 16 bp, Homo sapiens
acagtaaaccactgaa

SEQ ID NO: 5829154 - DNA, 18 bp, Homo sapiens
acagtaaaccactgaaaa

SEQ ID NO: 5829155 - DNA, 22 bp, Homo sapiens
acagtaaaccactgaaaaaata

SEQ ID NO: 5829156 - DNA, 19 bp, Homo sapiens
acagtaaagtttaaaaaat

SEQ ID NO: 5829157 - DNA, 21 bp, Homo sapiens
acagtaaagtttaaaaaatac

SEQ ID NO: 5829158 - DNA, 22 bp, Homo sapiens
acagtaaagtttaaaaaataca

SEQ ID NO: 5829159 - DNA, 23 bp, Homo sapiens
acagtaaagtttaaaaaatacac

SEQ ID NO: 5829160 - DNA, 17 bp, Homo sapiens
acagtaaataaattgtt

SEQ ID NO: 5829161 - DNA, 18 bp, Homo sapiens
acagtaaataaattgttt

SEQ ID NO: 5829162 - DNA, 23 bp, Homo sapiens
acagtaaataaattgtttgacca

SEQ ID NO: 5829163 - DNA, 18 bp, Homo sapiens
acagtaaatatacacttt

SEQ ID NO: 5829164 - DNA, 12 bp, Homo sapiens
acagtaaatgtt

SEQ ID NO: 5829165 - DNA, 14 bp, Homo sapiens
acagtaacacatct

SEQ ID NO: 5829166 - DNA, 19 bp, Homo sapiens
acagtaacccaaacctcaa

SEQ ID NO: 5829167 - DNA, 19 bp, Homo sapiens
acagtaacgcaggggaaac

SEQ ID NO: 5829168 - DNA, 14 bp, Homo sapiens
acagtaacttggtt

SEQ ID NO: 5829169 - DNA, 17 bp, Homo sapiens
acagtaacttggttata

SEQ ID NO: 5829170 - DNA, 16 bp, Homo sapiens
acagtaactttatgtg

SEQ ID NO: 5829171 - DNA, 18 bp, Homo sapiens
acagtaactttatgtgta

SEQ ID NO: 5829172 - DNA, 19 bp, Homo sapiens
acagtaactttatgtgtaa

SEQ ID NO: 5829173 - DNA, 20 bp, Homo sapiens
acagtaagaacatcataaaa

SEQ ID NO: 5829174 - DNA, 21 bp, Homo sapiens
acagtaagaacatcataaaat

SEQ ID NO: 5829175 - DNA, 16 bp, Homo sapiens
acagtaagagtttaca

SEQ ID NO: 5829176 - DNA, 17 bp, Homo sapiens
acagtaagagtttacaa

SEQ ID NO: 5829177 - DNA, 23 bp, Homo sapiens
acagtaagagtttacaagaaata

SEQ ID NO: 5829178 - DNA, 22 bp, Homo sapiens
acagtaagctggtttacagatg

SEQ ID NO: 5829179 - DNA, 13 bp, Homo sapiens
acagtaataaatg

SEQ ID NO: 5829180 - DNA, 18 bp, Homo sapiens
acagtaatacattccatt

SEQ ID NO: 5829181 - DNA, 21 bp, Homo sapiens
acagtaatacattccattgtt

SEQ ID NO: 5829182 - DNA, 19 bp, Homo sapiens
acagtaatatgaaagccac

SEQ ID NO: 5829183 - DNA, 21 bp, Homo sapiens
acagtaatctaggtgtggctg

SEQ ID NO: 5829184 - DNA, 16 bp, Homo sapiens
acagtaatctatgtgt

SEQ ID NO: 5829185 - DNA, 18 bp, Homo sapiens
acagtaatgaaatgttta

SEQ ID NO: 5829186 - DNA, 21 bp, Homo sapiens
acagtaattactttcagaatg

SEQ ID NO: 5829187 - DNA, 23 bp, Homo sapiens
acagtaattactttcagaatgtt

SEQ ID NO: 5829188 - DNA, 17 bp, Homo sapiens
acagtaattgtgtttac

SEQ ID NO: 5829189 - DNA, 13 bp, Homo sapiens
acagtacaataat

SEQ ID NO: 5829190 - DNA, 16 bp, Homo sapiens
acagtacaataatgta

SEQ ID NO: 5829191 - DNA, 20 bp, Homo sapiens
acagtacaataatgtactca

SEQ ID NO: 5829192 - DNA, 15 bp, Homo sapiens
acagtacagaaggca

SEQ ID NO: 5829193 - DNA, 17 bp, Homo sapiens
acagtacagcatgtgcc

SEQ ID NO: 5829194 - DNA, 18 bp, Homo sapiens
acagtacaggcagcacag

SEQ ID NO: 5829195 - DNA, 15 bp, Homo sapiens
acagtacatatgtaa

SEQ ID NO: 5829196 - DNA, 22 bp, Homo sapiens
acagtacccctctagctttgtt

SEQ ID NO: 5829197 - DNA, 19 bp, Homo sapiens
acagtaccctggttgtgtg

SEQ ID NO: 5829198 - DNA, 20 bp, Homo sapiens
acagtaccctggttgtgtgt

SEQ ID NO: 5829199 - DNA, 17 bp, Homo sapiens
acagtacctagctgtaa

SEQ ID NO: 5829200 - DNA, 16 bp, Homo sapiens
acagtacctatgactt

SEQ ID NO: 5829201 - DNA, 21 bp, Homo sapiens
acagtacctatgactttttta

SEQ ID NO: 5829202 - DNA, 17 bp, Homo sapiens
acagtacctgattgtat

SEQ ID NO: 5829203 - DNA, 13 bp, Homo sapiens
acagtacctgtgc

SEQ ID NO: 5829204 - DNA, 16 bp, Homo sapiens
acagtacggatttgtc

SEQ ID NO: 5829205 - DNA, 19 bp, Homo sapiens
acagtacggatttgtccaa

SEQ ID NO: 5829206 - DNA, 21 bp, Homo sapiens
acagtactatgtaaatttaaa

SEQ ID NO: 5829207 - DNA, 18 bp, Homo sapiens
acagtactcactttttcc

SEQ ID NO: 5829208 - DNA, 18 bp, Homo sapiens
acagtactggttactttc

SEQ ID NO: 5829209 - DNA, 20 bp, Homo sapiens
acagtactggttactttcaa

SEQ ID NO: 5829210 - DNA, 13 bp, Homo sapiens
acagtagaactgt

SEQ ID NO: 5829211 - DNA, 15 bp, Homo sapiens
acagtagagccagct

SEQ ID NO: 5829212 - DNA, 17 bp, Homo sapiens
acagtagaggcatgaac

SEQ ID NO: 5829213 - DNA, 18 bp, Homo sapiens
acagtagcatactgatga

SEQ ID NO: 5829214 - DNA, 19 bp, Homo sapiens
acagtagccaagttatatt

SEQ ID NO: 5829215 - DNA, 13 bp, Homo sapiens
acagtagctgcta

SEQ ID NO: 5829216 - DNA, 15 bp, Homo sapiens
acagtagcttaaata

SEQ ID NO: 5829217 - DNA, 20 bp, Homo sapiens
acagtagcttaaataaattc

SEQ ID NO: 5829218 - DNA, 21 bp, Homo sapiens
acagtagcttaaataaattca

SEQ ID NO: 5829219 - DNA, 13 bp, Homo sapiens
acagtaggagccc

SEQ ID NO: 5829220 - DNA, 22 bp, Homo sapiens
acagtaggagcccagctctgaa

SEQ ID NO: 5829221 - DNA, 21 bp, Homo sapiens
acagttactatagtggtgaga

SEQ ID NO: 5829222 - DNA, 16 bp, Homo sapiens
acagttactcttcagt

SEQ ID NO: 5829223 - DNA, 14 bp, Homo sapiens
acagttactgactt

SEQ ID NO: 5829224 - DNA, 22 bp, Homo sapiens
acagttacttaagattcagttt

SEQ ID NO: 5829225 - DNA, 19 bp, Homo sapiens
acagttacttaatgaccat

SEQ ID NO: 5829226 - DNA, 15 bp, Homo sapiens
acagttacttacaca

SEQ ID NO: 5829227 - DNA, 16 bp, Homo sapiens
acagttacttacacac

SEQ ID NO: 5829228 - DNA, 18 bp, Homo sapiens
acagttacttccttcctg

SEQ ID NO: 5829229 - DNA, 15 bp, Homo sapiens
acagttacttttcct

SEQ ID NO: 5829230 - DNA, 23 bp, Homo sapiens
acagttagcaaactttgtatgtc

SEQ ID NO: 5829231 - DNA, 18 bp, Homo sapiens
acagttagccactgctgg

SEQ ID NO: 5829232 - DNA, 19 bp, Homo sapiens
acagttagccactgctggt

SEQ ID NO: 5829233 - DNA, 21 bp, Homo sapiens
acagttagggttttgcaataa

SEQ ID NO: 5829234 - DNA, 17 bp, Homo sapiens
acagttataaaattaaa

SEQ ID NO: 5829235 - DNA, 12 bp, Homo sapiens
acagttataaag

SEQ ID NO: 5829236 - DNA, 17 bp, Homo sapiens
acagttataaagaaaga

SEQ ID NO: 5829237 - DNA, 16 bp, Homo sapiens
acagttatagaaagca

SEQ ID NO: 5829238 - DNA, 11 bp, Homo sapiens
acagttatatt

SEQ ID NO: 5829239 - DNA, 15 bp, Homo sapiens
acagttatctaagtt

SEQ ID NO: 5829240 - DNA, 16 bp, Homo sapiens
acagttatctaagtta

SEQ ID NO: 5829241 - DNA, 12 bp, Homo sapiens
acagttatctta

SEQ ID NO: 5829242 - DNA, 14 bp, Homo sapiens
acagttatgtgggt

SEQ ID NO: 5829243 - DNA, 20 bp, Homo sapiens
acagttattgggcttaaaaa

SEQ ID NO: 5829244 - DNA, 15 bp, Homo sapiens
acagttattttgata

SEQ ID NO: 5829245 - DNA, 13 bp, Homo sapiens
acagttattttgg

SEQ ID NO: 5829246 - DNA, 21 bp, Homo sapiens
acagttattttggatatatta

SEQ ID NO: 5829247 - DNA, 21 bp, Homo sapiens
acagttcaaaattctaaatgt

SEQ ID NO: 5829248 - DNA, 17 bp, Homo sapiens
acagttcaaagaagtca

SEQ ID NO: 5829249 - DNA, 21 bp, Homo sapiens
acagttcaataaacttaactt

SEQ ID NO: 5829250 - DNA, 18 bp, Homo sapiens
acagttcacaaacagtaa

SEQ ID NO: 5829251 - DNA, 15 bp, Homo sapiens
acagttcacaccctg

SEQ ID NO: 5829252 - DNA, 19 bp, Homo sapiens
acagttcacaccctgcaag

SEQ ID NO: 5829253 - DNA, 13 bp, Homo sapiens
acagttcagtggc

SEQ ID NO: 5829254 - DNA, 21 bp, Homo sapiens
acagttcagtggcagggctca

SEQ ID NO: 5829255 - DNA, 23 bp, Homo sapiens
acagttcagtggcagggctcagg

SEQ ID NO: 5829256 - DNA, 23 bp, Homo sapiens
acagttcataaatttgttgtcat

SEQ ID NO: 5829257 - DNA, 15 bp, Homo sapiens
acagttcataattca

SEQ ID NO: 5829258 - DNA, 15 bp, Homo sapiens
acagttcatatgtac

SEQ ID NO: 5829259 - DNA, 19 bp, Homo sapiens
acagttcattcagggccga

SEQ ID NO: 5829260 - DNA, 18 bp, Homo sapiens
acagttccacaattttgt

SEQ ID NO: 5829261 - DNA, 20 bp, Homo sapiens
acagttccacaattttgtct

SEQ ID NO: 5829262 - DNA, 23 bp, Homo sapiens
acagttccacaattttgtctcta

SEQ ID NO: 5829263 - DNA, 19 bp, Homo sapiens
acagttcccctatgtggaa

SEQ ID NO: 5829264 - DNA, 21 bp, Homo sapiens
acagttccctttatttcacat

SEQ ID NO: 5829265 - DNA, 15 bp, Homo sapiens
acagttcctcgccct

SEQ ID NO: 5829266 - DNA, 16 bp, Homo sapiens
acagttcctcgccctg

SEQ ID NO: 5829267 - DNA, 18 bp, Homo sapiens
acagttcctcgccctggg

SEQ ID NO: 5829268 - DNA, 22 bp, Homo sapiens
acagttcctctttgttggaaga

SEQ ID NO: 5829269 - DNA, 15 bp, Homo sapiens
acagttccttgcatg

SEQ ID NO: 5829270 - DNA, 23 bp, Homo sapiens
acagttcggtgagctacaaatgc

SEQ ID NO: 5829271 - DNA, 12 bp, Homo sapiens
acagttctaggt

SEQ ID NO: 5829272 - DNA, 16 bp, Homo sapiens
acagttctatttgcta

SEQ ID NO: 5829273 - DNA, 15 bp, Homo sapiens
acagttctcactggg

SEQ ID NO: 5829274 - DNA, 12 bp, Homo sapiens
acagttctctgt

SEQ ID NO: 5829275 - DNA, 13 bp, Homo sapiens
acagttctgaaga

SEQ ID NO: 5829276 - DNA, 13 bp, Homo sapiens
acagttctgagct

SEQ ID NO: 5829277 - DNA, 17 bp, Homo sapiens
acagttctggaggagga

SEQ ID NO: 5829278 - DNA, 18 bp, Homo sapiens
acagttctggaggaggag

SEQ ID NO: 5829279 - DNA, 12 bp, Homo sapiens
acagttctgtaa

SEQ ID NO: 5829280 - DNA, 12 bp, Homo sapiens
acagttctgtgg

SEQ ID NO: 5829281 - DNA, 22 bp, Homo sapiens
acagttctgtggtttcatgtta

SEQ ID NO: 5829282 - DNA, 20 bp, Homo sapiens
acagttcttcgggaagagag

SEQ ID NO: 5829283 - DNA, 21 bp, Homo sapiens
acagttcttcgggaagagagg

SEQ ID NO: 5829284 - DNA, 17 bp, Homo sapiens
acagttcttgtgtggtt

SEQ ID NO: 5829285 - DNA, 15 bp, Homo sapiens
acagttctttcctct

SEQ ID NO: 5829286 - DNA, 21 bp, Homo sapiens
acagttctttcctctttctgc

SEQ ID NO: 5829287 - DNA, 19 bp, Homo sapiens
acagttctttgggccagac

SEQ ID NO: 5829288 - DNA, 14 bp, Homo sapiens
acagttcttttcta

SEQ ID NO: 5829289 - DNA, 22 bp, Homo sapiens
acagttgaagggaggggctgtg

SEQ ID NO: 5829290 - DNA, 15 bp, Homo sapiens
acagttgaattttaa

SEQ ID NO: 5829291 - DNA, 18 bp, Homo sapiens
acagttgagagagaatct

SEQ ID NO: 5829292 - DNA, 15 bp, Homo sapiens
acagttgagctcagg

SEQ ID NO: 5829293 - DNA, 17 bp, Homo sapiens
acagttgagctcaggtt

SEQ ID NO: 5829294 - DNA, 22 bp, Homo sapiens
acagttgagtttcttctaaaga

SEQ ID NO: 5829295 - DNA, 16 bp, Homo sapiens
acagttgatatttaaa

SEQ ID NO: 5829296 - DNA, 20 bp, Homo sapiens
acagttgatatttaaaagat

SEQ ID NO: 5829297 - DNA, 17 bp, Homo sapiens
acagttgatggagcccc

SEQ ID NO: 5829298 - DNA, 18 bp, Homo sapiens
acagttgatggagcccca

SEQ ID NO: 5829299 - DNA, 21 bp, Homo sapiens
acagttgatggagccccaggg

SEQ ID NO: 5829300 - DNA, 22 bp, Homo sapiens
acagttgatggagccccagggt

SEQ ID NO: 5829301 - DNA, 15 bp, Homo sapiens
acagttgattcaaca

SEQ ID NO: 5829302 - DNA, 22 bp, Homo sapiens
acagttgattcaacaaagtatt

SEQ ID NO: 5829303 - DNA, 14 bp, Homo sapiens
acagttgcacagca

SEQ ID NO: 5829304 - DNA, 18 bp, Homo sapiens
acagttgcagcccttgtg

SEQ ID NO: 5829305 - DNA, 21 bp, Homo sapiens
acagttgcatttagcttcttt

SEQ ID NO: 5829306 - DNA, 21 bp, Homo sapiens
acagttgccacatcacacaga

SEQ ID NO: 5829307 - DNA, 21 bp, Homo sapiens
acagttgccaccacctctgtg

SEQ ID NO: 5829308 - DNA, 23 bp, Homo sapiens
acagttgccaccacctctgtggc

SEQ ID NO: 5829309 - DNA, 16 bp, Homo sapiens
acagttgctctatgct

SEQ ID NO: 5829310 - DNA, 19 bp, Homo sapiens
acagttgctctatgctttc

SEQ ID NO: 5829311 - DNA, 15 bp, Homo sapiens
acagttgctgtcata

SEQ ID NO: 5829312 - DNA, 18 bp, Homo sapiens
acagttggaaatccatcc

SEQ ID NO: 5829313 - DNA, 22 bp, Homo sapiens
acagttggagggaaagccagcc

SEQ ID NO: 5829314 - DNA, 17 bp, Homo sapiens
acagttggcacttctgc

SEQ ID NO: 5829315 - DNA, 13 bp, Homo sapiens
acagttggcagag

SEQ ID NO: 5829316 - DNA, 14 bp, Homo sapiens
acagttggcagaga

SEQ ID NO: 5829317 - DNA, 22 bp, Homo sapiens
acagttgggaagtctcagcctg

SEQ ID NO: 5829318 - DNA, 13 bp, Homo sapiens
acagttggggctg

SEQ ID NO: 5829319 - DNA, 16 bp, Homo sapiens
acagttgggtttttta

SEQ ID NO: 5829320 - DNA, 16 bp, Homo sapiens
acagttggtaactttt

SEQ ID NO: 5829321 - DNA, 24 bp, Homo sapiens
acagttggtaacttttgtgaatta

SEQ ID NO: 5829322 - DNA, 18 bp, Homo sapiens
acagttgtaccactgcta

SEQ ID NO: 5829323 - DNA, 20 bp, Homo sapiens
acagttgtaccattcaccgt

SEQ ID NO: 5829324 - DNA, 12 bp, Homo sapiens
acagttgtattt

SEQ ID NO: 5829325 - DNA, 13 bp, Homo sapiens
acagttgtcctga

SEQ ID NO: 5829326 - DNA, 17 bp, Homo sapiens
acagttgtctagagata

SEQ ID NO: 5829327 - DNA, 20 bp, Homo sapiens
acagttgtctattctgagcc

SEQ ID NO: 5829328 - DNA, 21 bp, Homo sapiens
acagttgtctattctgagcct

SEQ ID NO: 5829329 - DNA, 23 bp, Homo sapiens
acagttgtctattctgagccttg

SEQ ID NO: 5829330 - DNA, 12 bp, Homo sapiens
acagttgtgcag

SEQ ID NO: 5829331 - DNA, 13 bp, Homo sapiens
acagttgtgttca

SEQ ID NO: 5829332 - DNA, 23 bp, Homo sapiens
acagttgttgaatgactgaccca

SEQ ID NO: 5829333 - DNA, 11 bp, Homo sapiens
acagttgtttg

SEQ ID NO: 5829334 - DNA, 15 bp, Homo sapiens
acagttgtttgatgc

SEQ ID NO: 5829335 - DNA, 16 bp, Homo sapiens
acagtttaaagctttt

SEQ ID NO: 5829336 - DNA, 18 bp, Homo sapiens
acagtttaacagaaaaat

SEQ ID NO: 5829337 - DNA, 20 bp, Homo sapiens
acagtttaacagaaaaatga

SEQ ID NO: 5829338 - DNA, 21 bp, Homo sapiens
acagtttaacagaaaaatgaa

SEQ ID NO: 5829339 - DNA, 19 bp, Homo sapiens
acagtttacttggaaattg

SEQ ID NO: 5829340 - DNA, 19 bp, Homo sapiens
acagtttataaagccaaga

SEQ ID NO: 5829341 - DNA, 17 bp, Homo sapiens
acagtttataatagtaa

SEQ ID NO: 5829342 - DNA, 19 bp, Homo sapiens
acagtttatattgtggaat

SEQ ID NO: 5829343 - DNA, 21 bp, Homo sapiens
acagtttatgcagtgctgctt

SEQ ID NO: 5829344 - DNA, 15 bp, Homo sapiens
acagtttatttgttg

SEQ ID NO: 5829345 - DNA, 20 bp, Homo sapiens
acagtttcagagagtcaatg

SEQ ID NO: 5829346 - DNA, 20 bp, Homo sapiens
acagtttcaggcttttatga

SEQ ID NO: 5829347 - DNA, 23 bp, Homo sapiens
acagtttcattaactccttcccc

SEQ ID NO: 5829348 - DNA, 22 bp, Homo sapiens
acagtttccagtcatggccaaa

SEQ ID NO: 5829349 - DNA, 14 bp, Homo sapiens
acagtttcttagct

SEQ ID NO: 5829350 - DNA, 16 bp, Homo sapiens
acagtttcttagcttt

SEQ ID NO: 5829351 - DNA, 14 bp, Homo sapiens
acagtttcttgcaa

SEQ ID NO: 5829352 - DNA, 15 bp, Homo sapiens
acagtttgaaataag

SEQ ID NO: 5829353 - DNA, 18 bp, Homo sapiens
acagtttgaaataagcta

SEQ ID NO: 5829354 - DNA, 15 bp, Homo sapiens
acagtttgacttttt

SEQ ID NO: 5829355 - DNA, 19 bp, Homo sapiens
acagtttgactttttggaa

SEQ ID NO: 5829356 - DNA, 13 bp, Homo sapiens
acagtttgataca

SEQ ID NO: 5829357 - DNA, 20 bp, Homo sapiens
acagtttgatacaggaatta

SEQ ID NO: 5829358 - DNA, 16 bp, Homo sapiens
acagtttgatgtcatt

SEQ ID NO: 5829359 - DNA, 22 bp, Homo sapiens
acagtttgcaatcttatgttga

SEQ ID NO: 5829360 - DNA, 21 bp, Homo sapiens
acagtttgctatttgctttag

SEQ ID NO: 5829361 - DNA, 16 bp, Homo sapiens
acagtttggggactca

SEQ ID NO: 5829362 - DNA, 22 bp, Homo sapiens
acagtttgtaaatgttatttct

SEQ ID NO: 5829363 - DNA, 17 bp, Homo sapiens
acagtttgtaacttggg

SEQ ID NO: 5829364 - DNA, 19 bp, Homo sapiens
acagtttgtgctctactgt

SEQ ID NO: 5829365 - DNA, 12 bp, Homo sapiens
acagtttgtgtt

SEQ ID NO: 5829366 - DNA, 19 bp, Homo sapiens
acagtttgtgttttaaaaa

SEQ ID NO: 5829367 - DNA, 13 bp, Homo sapiens
acagtttgtttcc

SEQ ID NO: 5829368 - DNA, 13 bp, Homo sapiens
acagttttaaaga

SEQ ID NO: 5829369 - DNA, 19 bp, Homo sapiens
acagttttaaagaatcatt

SEQ ID NO: 5829370 - DNA, 17 bp, Homo sapiens
acagttttaactgtgga

SEQ ID NO: 5829371 - DNA, 19 bp, Homo sapiens
acagttttagttggtgctg

SEQ ID NO: 5829372 - DNA, 15 bp, Homo sapiens
acagttttataattt

SEQ ID NO: 5829373 - DNA, 12 bp, Homo sapiens
acagttttatgc

SEQ ID NO: 5829374 - DNA, 21 bp, Homo sapiens
acagttttcagaaaaagaaat

SEQ ID NO: 5829375 - DNA, 12 bp, Homo sapiens
acagttttcatt

SEQ ID NO: 5829376 - DNA, 19 bp, Homo sapiens
acagttttccatgaaaacg

SEQ ID NO: 5829377 - DNA, 20 bp, Homo sapiens
acagttttctagcaattttc

SEQ ID NO: 5829378 - DNA, 18 bp, Homo sapiens
acagttttctgagaaaga

SEQ ID NO: 5829379 - DNA, 21 bp, Homo sapiens
acagttttctgagaaagacta

SEQ ID NO: 5829380 - DNA, 13 bp, Homo sapiens
acagttttgagaa

SEQ ID NO: 5829381 - DNA, 20 bp, Homo sapiens
acagttttgagaacgtaaag

SEQ ID NO: 5829382 - DNA, 16 bp, Homo sapiens
acagttttgatacaaa

SEQ ID NO: 5829383 - DNA, 19 bp, Homo sapiens
acagttttggttgctttaa

SEQ ID NO: 5829384 - DNA, 14 bp, Homo sapiens
acagtttttaaact

SEQ ID NO: 5829385 - DNA, 19 bp, Homo sapiens
acagtttttaactctactg

SEQ ID NO: 5829386 - DNA, 20 bp, Homo sapiens
acagtttttgacatttatat

SEQ ID NO: 5829387 - DNA, 16 bp, Homo sapiens
acagtttttgtaacca

SEQ ID NO: 5829388 - DNA, 23 bp, Homo sapiens
acataaaaaagaagcactttgat

SEQ ID NO: 5829389 - DNA, 16 bp, Homo sapiens
acataaaaacaacttt

SEQ ID NO: 5829390 - DNA, 21 bp, Homo sapiens
acataaaaacaactttatacc

SEQ ID NO: 5829391 - DNA, 18 bp, Homo sapiens
acataaaaactactgaat

SEQ ID NO: 5829392 - DNA, 20 bp, Homo sapiens
acataaaaactactgaataa

SEQ ID NO: 5829393 - DNA, 19 bp, Homo sapiens
acataaaaagaaatgtgaa

SEQ ID NO: 5829394 - DNA, 14 bp, Homo sapiens
acataaaaaggaac

SEQ ID NO: 5829395 - DNA, 21 bp, Homo sapiens
acataaaaaggacatcagcaa

SEQ ID NO: 5829396 - DNA, 12 bp, Homo sapiens
acataaaaagtt

SEQ ID NO: 5829397 - DNA, 19 bp, Homo sapiens
acataaaaatgatctaaac

SEQ ID NO: 5829398 - DNA, 20 bp, Homo sapiens
acatatcatttgtgaagaat

SEQ ID NO: 5829399 - DNA, 18 bp, Homo sapiens
acatatccaaagggaata

SEQ ID NO: 5829400 - DNA, 20 bp, Homo sapiens
acatatcctttggtcctggt

SEQ ID NO: 5829401 - DNA, 22 bp, Homo sapiens
acatatctctgccgtctctcct

SEQ ID NO: 5829402 - DNA, 22 bp, Homo sapiens
acatatctgtttaggagtgtct

SEQ ID NO: 5829403 - DNA, 16 bp, Homo sapiens
acatatctttattaat

SEQ ID NO: 5829404 - DNA, 16 bp, Homo sapiens
acatatctttgagttc

SEQ ID NO: 5829405 - DNA, 15 bp, Homo sapiens
acatatgaaaataca

SEQ ID NO: 5829406 - DNA, 14 bp, Homo sapiens
acatatgaaatata

SEQ ID NO: 5829407 - DNA, 19 bp, Homo sapiens
acatatgaaatataaatta

SEQ ID NO: 5829408 - DNA, 12 bp, Homo sapiens
acatatgaacac

SEQ ID NO: 5829409 - DNA, 23 bp, Homo sapiens
acatatgaacgcacaacatgcac

SEQ ID NO: 5829410 - DNA, 14 bp, Homo sapiens
acatatgacttgat

SEQ ID NO: 5829411 - DNA, 19 bp, Homo sapiens
acatatgagaatatacctt

SEQ ID NO: 5829412 - DNA, 19 bp, Homo sapiens
acatatgattgtatttgtg

SEQ ID NO: 5829413 - DNA, 19 bp, Homo sapiens
acatatgcaccttgtgtct

SEQ ID NO: 5829414 - DNA, 20 bp, Homo sapiens
acatatgcaccttgtgtctg

SEQ ID NO: 5829415 - DNA, 22 bp, Homo sapiens
acatatgcagtgtgatccagtt

SEQ ID NO: 5829416 - DNA, 24 bp, Homo sapiens
acatatgctgatcttttaaaatca

SEQ ID NO: 5829417 - DNA, 20 bp, Homo sapiens
acatatgctttaagaatcga

SEQ ID NO: 5829418 - DNA, 18 bp, Homo sapiens
acatatggaaatcctgtt

SEQ ID NO: 5829419 - DNA, 17 bp, Homo sapiens
acatatgggtgctggca

SEQ ID NO: 5829420 - DNA, 19 bp, Homo sapiens
acatatggtctccatttta

SEQ ID NO: 5829421 - DNA, 23 bp, Homo sapiens
acatatgtaaaatattgttacta

SEQ ID NO: 5829422 - DNA, 12 bp, Homo sapiens
acatatgtaatt

SEQ ID NO: 5829423 - DNA, 20 bp, Homo sapiens
acatatgtagaaacatttag

SEQ ID NO: 5829424 - DNA, 13 bp, Homo sapiens
acatatgtagata

SEQ ID NO: 5829425 - DNA, 16 bp, Homo sapiens
acatatgtaggaaaat

SEQ ID NO: 5829426 - DNA, 22 bp, Homo sapiens
acatatgtaggaaaattttctt

SEQ ID NO: 5829427 - DNA, 16 bp, Homo sapiens
acatatgtatacatgt

SEQ ID NO: 5829428 - DNA, 18 bp, Homo sapiens
acatatgtatacatgtgc

SEQ ID NO: 5829429 - DNA, 13 bp, Homo sapiens
acatatgtatact

SEQ ID NO: 5829430 - DNA, 14 bp, Homo sapiens
acatatgtatgtgt

SEQ ID NO: 5829431 - DNA, 23 bp, Homo sapiens
acatatgtatgtgtgagtgtatg

SEQ ID NO: 5829432 - DNA, 15 bp, Homo sapiens
acatatgtctgtatc

SEQ ID NO: 5829433 - DNA, 17 bp, Homo sapiens
acatatgtctgtatcta

SEQ ID NO: 5829434 - DNA, 16 bp, Homo sapiens
acatatgtctgtcttt

SEQ ID NO: 5829435 - DNA, 23 bp, Homo sapiens
acatatgtctgtctttgcaaagg

SEQ ID NO: 5829436 - DNA, 13 bp, Homo sapiens
acatatgtgaata

SEQ ID NO: 5829437 - DNA, 21 bp, Homo sapiens
acatatgtgccaatgtgacaa

SEQ ID NO: 5829438 - DNA, 18 bp, Homo sapiens
acatatgtgcttctcagt

SEQ ID NO: 5829439 - DNA, 21 bp, Homo sapiens
acatatgttaataaactgcaa

SEQ ID NO: 5829440 - DNA, 16 bp, Homo sapiens
acatattacaagaaaa

SEQ ID NO: 5829441 - DNA, 18 bp, Homo sapiens
acatattaggaaaatatg

SEQ ID NO: 5829442 - DNA, 13 bp, Homo sapiens
acatattataaat

SEQ ID NO: 5829443 - DNA, 14 bp, Homo sapiens
acatattataaata

SEQ ID NO: 5829444 - DNA, 17 bp, Homo sapiens
acatattataaataaat

SEQ ID NO: 5829445 - DNA, 15 bp, Homo sapiens
acatattatcatcct

SEQ ID NO: 5829446 - DNA, 14 bp, Homo sapiens
acatattatttcat

SEQ ID NO: 5829447 - DNA, 11 bp, Homo sapiens
acatattcaag

SEQ ID NO: 5829448 - DNA, 17 bp, Homo sapiens
acatattcaatgcaagt

SEQ ID NO: 5829449 - DNA, 12 bp, Homo sapiens
acatattcattt

SEQ ID NO: 5829450 - DNA, 23 bp, Homo sapiens
acatattcttgctttcacaaata

SEQ ID NO: 5829451 - DNA, 21 bp, Homo sapiens
acatattcttttgatcacatt

SEQ ID NO: 5829452 - DNA, 18 bp, Homo sapiens
acatattgaaaaaatcaa

SEQ ID NO: 5829453 - DNA, 23 bp, Homo sapiens
acatattgatttccgttaaaata

SEQ ID NO: 5829454 - DNA, 19 bp, Homo sapiens
acatattgcaggagacatt

SEQ ID NO: 5829455 - DNA, 21 bp, Homo sapiens
acatattgcaggagacatttt

SEQ ID NO: 5829456 - DNA, 23 bp, Homo sapiens
acatattgcaggagacattttca

SEQ ID NO: 5829457 - DNA, 18 bp, Homo sapiens
acatattgtatatatatt

SEQ ID NO: 5829458 - DNA, 18 bp, Homo sapiens
acatattgtttcagtgtt

SEQ ID NO: 5829459 - DNA, 14 bp, Homo sapiens
acatatttaactgg

SEQ ID NO: 5829460 - DNA, 16 bp, Homo sapiens
acatatttacctgtat

SEQ ID NO: 5829461 - DNA, 22 bp, Homo sapiens
acatatttacctgtatttaaga

SEQ ID NO: 5829462 - DNA, 22 bp, Homo sapiens
acatatttatttttacctgctt

SEQ ID NO: 5829463 - DNA, 22 bp, Homo sapiens
acatatttcaaaaacatgcttt

SEQ ID NO: 5829464 - DNA, 20 bp, Homo sapiens
acatatttcataagcacatc

SEQ ID NO: 5829465 - DNA, 16 bp, Homo sapiens
acatatttcattttaa

SEQ ID NO: 5829466 - DNA, 23 bp, Homo sapiens
acatatttcattttaacatgatt

SEQ ID NO: 5829467 - DNA, 21 bp, Homo sapiens
acatatttcttgagtaattta

SEQ ID NO: 5829468 - DNA, 22 bp, Homo sapiens
acatatttgactctttcaaaga

SEQ ID NO: 5829469 - DNA, 21 bp, Homo sapiens
acatatttgatagatttttct

SEQ ID NO: 5829470 - DNA, 21 bp, Homo sapiens
acatatttgtagctagaatat

SEQ ID NO: 5829471 - DNA, 12 bp, Homo sapiens
acatatttgtct

SEQ ID NO: 5829472 - DNA, 14 bp, Homo sapiens
acatattttaaaat

SEQ ID NO: 5829473 - DNA, 18 bp, Homo sapiens
acatattttatagaactt

SEQ ID NO: 5829474 - DNA, 13 bp, Homo sapiens
acatattttctgt

SEQ ID NO: 5829475 - DNA, 15 bp, Homo sapiens
acatatttttatact

SEQ ID NO: 5829476 - DNA, 18 bp, Homo sapiens
acatatttttatacttta

SEQ ID NO: 5829477 - DNA, 19 bp, Homo sapiens
acatatttttatactttat

SEQ ID NO: 5829478 - DNA, 15 bp, Homo sapiens
acatattttttatat

SEQ ID NO: 5829479 - DNA, 23 bp, Homo sapiens
acatattttttgtatatttgttt

SEQ ID NO: 5829480 - DNA, 23 bp, Homo sapiens
acatcaaaaatgggtaattttct

SEQ ID NO: 5829481 - DNA, 16 bp, Homo sapiens
acatcaaaaccaccct

SEQ ID NO: 5829482 - DNA, 18 bp, Homo sapiens
acatcaaaacttaagatg

SEQ ID NO: 5829483 - DNA, 12 bp, Homo sapiens
acatcaaaatga

SEQ ID NO: 5829484 - DNA, 14 bp, Homo sapiens
acatcaaataaact

SEQ ID NO: 5829485 - DNA, 14 bp, Homo sapiens
acatcaaataaatt

SEQ ID NO: 5829486 - DNA, 20 bp, Homo sapiens
acatcaaatttgccaccact

SEQ ID NO: 5829487 - DNA, 18 bp, Homo sapiens
acatcaacaagaagaaac

SEQ ID NO: 5829488 - DNA, 19 bp, Homo sapiens
acatcaacaagaagaaact

SEQ ID NO: 5829489 - DNA, 13 bp, Homo sapiens
acatcaacagata

SEQ ID NO: 5829490 - DNA, 13 bp, Homo sapiens
acatcaacattcc

SEQ ID NO: 5829491 - DNA, 19 bp, Homo sapiens
acatcaacattccagggat

SEQ ID NO: 5829492 - DNA, 21 bp, Homo sapiens
acatcaacattccagggatga

SEQ ID NO: 5829493 - DNA, 22 bp, Homo sapiens
acatcaacattccagggatgag

SEQ ID NO: 5829494 - DNA, 16 bp, Homo sapiens
acatcaactttatgta

SEQ ID NO: 5829495 - DNA, 22 bp, Homo sapiens
acatcaactttatgtagcaaag

SEQ ID NO: 5829496 - DNA, 13 bp, Homo sapiens
acatcaagaaaac

SEQ ID NO: 5829497 - DNA, 14 bp, Homo sapiens
acatcaagaaaaca

SEQ ID NO: 5829498 - DNA, 21 bp, Homo sapiens
acatcaagactatctacaaaa

SEQ ID NO: 5829499 - DNA, 22 bp, Homo sapiens
acatcaagactatctacaaaaa

SEQ ID NO: 5829500 - DNA, 12 bp, Homo sapiens
acatcaagatac

SEQ ID NO: 5829501 - DNA, 18 bp, Homo sapiens
acatcaagcacagaagga

SEQ ID NO: 5829502 - DNA, 14 bp, Homo sapiens
acatcaatatgtat

SEQ ID NO: 5829503 - DNA, 14 bp, Homo sapiens
acatcaatctttaa

SEQ ID NO: 5829504 - DNA, 16 bp, Homo sapiens
acatcaatgttcattg

SEQ ID NO: 5829505 - DNA, 20 bp, Homo sapiens
acatcaattaattgattcct

SEQ ID NO: 5829506 - DNA, 19 bp, Homo sapiens
acatcaattgggttttgat

SEQ ID NO: 5829507 - DNA, 21 bp, Homo sapiens
acatcaattgggttttgatct

SEQ ID NO: 5829508 - DNA, 18 bp, Homo sapiens
acatcaatttaaaaagca

SEQ ID NO: 5829509 - DNA, 18 bp, Homo sapiens
acatcacaaaatgtaatt

SEQ ID NO: 5829510 - DNA, 13 bp, Homo sapiens
acatcacaggaca

SEQ ID NO: 5829511 - DNA, 16 bp, Homo sapiens
acatcacagggcctca

SEQ ID NO: 5829512 - DNA, 14 bp, Homo sapiens
acatcacagggtgg

SEQ ID NO: 5829513 - DNA, 13 bp, Homo sapiens
acatcacatctta

SEQ ID NO: 5829514 - DNA, 15 bp, Homo sapiens
acatcacatcttatt

SEQ ID NO: 5829515 - DNA, 18 bp, Homo sapiens
acatcacatcttatttat

SEQ ID NO: 5829516 - DNA, 16 bp, Homo sapiens
acatcacatggcatgt

SEQ ID NO: 5829517 - DNA, 21 bp, Homo sapiens
acatcaccaagtgtggaattg

SEQ ID NO: 5829518 - DNA, 16 bp, Homo sapiens
acatcaccacagttta

SEQ ID NO: 5829519 - DNA, 12 bp, Homo sapiens
acatcaccagtc

SEQ ID NO: 5829520 - DNA, 15 bp, Homo sapiens
acatcaccagtgcca

SEQ ID NO: 5829521 - DNA, 18 bp, Homo sapiens
acatcacctaacagaata

SEQ ID NO: 5829522 - DNA, 21 bp, Homo sapiens
acatcacctatttaatgtttt

SEQ ID NO: 5829523 - DNA, 16 bp, Homo sapiens
acatcacgaaggaaaa

SEQ ID NO: 5829524 - DNA, 19 bp, Homo sapiens
acatcactacaaaaagaag

SEQ ID NO: 5829525 - DNA, 20 bp, Homo sapiens
acatcactattgggccccca

SEQ ID NO: 5829526 - DNA, 22 bp, Homo sapiens
acatcactattgggcccccagg

SEQ ID NO: 5829527 - DNA, 21 bp, Homo sapiens
acatcactgcttgatgaagca

SEQ ID NO: 5829528 - DNA, 22 bp, Homo sapiens
acatcactgcttgatgaagcaa

SEQ ID NO: 5829529 - DNA, 12 bp, Homo sapiens
acatcactgggg

SEQ ID NO: 5829530 - DNA, 19 bp, Homo sapiens
acatcacttgtacaaaata

SEQ ID NO: 5829531 - DNA, 13 bp, Homo sapiens
acatcactttgtg

SEQ ID NO: 5829532 - DNA, 17 bp, Homo sapiens
acatcagaaaataaaat

SEQ ID NO: 5829533 - DNA, 20 bp, Homo sapiens
acatcagaaataataaaaaa

SEQ ID NO: 5829534 - DNA, 18 bp, Homo sapiens
acatcagaaggtattttt

SEQ ID NO: 5829535 - DNA, 19 bp, Homo sapiens
acatcagactctagaaaaa

SEQ ID NO: 5829536 - DNA, 22 bp, Homo sapiens
acatcagagtgtatttttgtaa

SEQ ID NO: 5829537 - DNA, 14 bp, Homo sapiens
acatcagattgtta

SEQ ID NO: 5829538 - DNA, 15 bp, Homo sapiens
acatcagattgttaa

SEQ ID NO: 5829539 - DNA, 16 bp, Homo sapiens
acatcagattgttaag

SEQ ID NO: 5829540 - DNA, 13 bp, Homo sapiens
acatcagatttct

SEQ ID NO: 5829541 - DNA, 19 bp, Homo sapiens
acatcagcaatttcagaac

SEQ ID NO: 5829542 - DNA, 21 bp, Homo sapiens
acatcagcacgatttctgttt

SEQ ID NO: 5829543 - DNA, 14 bp, Homo sapiens
acatcagcactgcc

SEQ ID NO: 5829544 - DNA, 13 bp, Homo sapiens
acatcagcatgtt

SEQ ID NO: 5829545 - DNA, 14 bp, Homo sapiens
acatcagccagctg

SEQ ID NO: 5829546 - DNA, 16 bp, Homo sapiens
acatcagccccacagg

SEQ ID NO: 5829547 - DNA, 14 bp, Homo sapiens
acatcagcctcctt

SEQ ID NO: 5829548 - DNA, 15 bp, Homo sapiens
acatcagccttctcc

SEQ ID NO: 5829549 - DNA, 15 bp, Homo sapiens
acatcaggagactgg

SEQ ID NO: 5829550 - DNA, 20 bp, Homo sapiens
acatcaggttaggcagtata

SEQ ID NO: 5829551 - DNA, 15 bp, Homo sapiens
acatcaggtttttcc

SEQ ID NO: 5829552 - DNA, 15 bp, Homo sapiens
acatcagtaatgtat

SEQ ID NO: 5829553 - DNA, 18 bp, Homo sapiens
acatcagtacttttctct

SEQ ID NO: 5829554 - DNA, 16 bp, Homo sapiens
acatcagtagcatttt

SEQ ID NO: 5829555 - DNA, 20 bp, Homo sapiens
acatcagtctccaacatgtt

SEQ ID NO: 5829556 - DNA, 16 bp, Homo sapiens
acatcagtgaggaggg

SEQ ID NO: 5829557 - DNA, 22 bp, Homo sapiens
acatcagtggcatggctccagt

SEQ ID NO: 5829558 - DNA, 12 bp, Homo sapiens
acatcagtgttt

SEQ ID NO: 5829559 - DNA, 15 bp, Homo sapiens
acatcagtgtttgtt

SEQ ID NO: 5829560 - DNA, 16 bp, Homo sapiens
acatcagtgtttgttg

SEQ ID NO: 5829561 - DNA, 15 bp, Homo sapiens
acatcagttactctg

SEQ ID NO: 5829562 - DNA, 18 bp, Homo sapiens
acatcagttactctgaag

SEQ ID NO: 5829563 - DNA, 14 bp, Homo sapiens
acatcagtttgttc

SEQ ID NO: 5829564 - DNA, 18 bp, Homo sapiens
acatcataaatagtaaat

SEQ ID NO: 5829565 - DNA, 14 bp, Homo sapiens
acatcataagatag

SEQ ID NO: 5829566 - DNA, 23 bp, Homo sapiens
acatcataagatagttacattta

SEQ ID NO: 5829567 - DNA, 17 bp, Homo sapiens
acatcataattacattc

SEQ ID NO: 5829568 - DNA, 20 bp, Homo sapiens
acatcataattacattccta

SEQ ID NO: 5829569 - DNA, 19 bp, Homo sapiens
acatcatatacctcttgaa

SEQ ID NO: 5829570 - DNA, 22 bp, Homo sapiens
acatcatattctattgtttact

SEQ ID NO: 5829571 - DNA, 23 bp, Homo sapiens
acatcatcctccttataagccca

SEQ ID NO: 5829572 - DNA, 13 bp, Homo sapiens
acatcatgagcct

SEQ ID NO: 5829573 - DNA, 22 bp, Homo sapiens
acatcatggactgagctggggg

SEQ ID NO: 5829574 - DNA, 13 bp, Homo sapiens
acatcatgtaaac

SEQ ID NO: 5829575 - DNA, 21 bp, Homo sapiens
acatgcagaaattgacctgat

SEQ ID NO: 5829576 - DNA, 23 bp, Homo sapiens
acatgcagctctgcagcaatatt

SEQ ID NO: 5829577 - DNA, 23 bp, Homo sapiens
acatgcagctgcaccctccctcc

SEQ ID NO: 5829578 - DNA, 21 bp, Homo sapiens
acatgcagtacttttgttgta

SEQ ID NO: 5829579 - DNA, 21 bp, Homo sapiens
acatgcagtagcactttggta

SEQ ID NO: 5829580 - DNA, 10 bp, Homo sapiens
acatgcagtt

SEQ ID NO: 5829581 - DNA, 22 bp, Homo sapiens
acatgcagttcattattttgtg

SEQ ID NO: 5829582 - DNA, 23 bp, Homo sapiens
acatgcagttcattattttgtgg

SEQ ID NO: 5829583 - DNA, 13 bp, Homo sapiens
acatgcagtttga

SEQ ID NO: 5829584 - DNA, 15 bp, Homo sapiens
acatgcagtttgaaa

SEQ ID NO: 5829585 - DNA, 17 bp, Homo sapiens
acatgcagtttgaaatt

SEQ ID NO: 5829586 - DNA, 18 bp, Homo sapiens
acatgcagtttgaaattc

SEQ ID NO: 5829587 - DNA, 22 bp, Homo sapiens
acatgcagtttgaaattctgaa

SEQ ID NO: 5829588 - DNA, 20 bp, Homo sapiens
acatgcataaaaattaaatg

SEQ ID NO: 5829589 - DNA, 14 bp, Homo sapiens
acatgcataaaagg

SEQ ID NO: 5829590 - DNA, 19 bp, Homo sapiens
acatgcataaaagggtcaa

SEQ ID NO: 5829591 - DNA, 15 bp, Homo sapiens
acatgcatacacaca

SEQ ID NO: 5829592 - DNA, 16 bp, Homo sapiens
acatgcatacacacac

SEQ ID NO: 5829593 - DNA, 16 bp, Homo sapiens
acatgcatacatacac

SEQ ID NO: 5829594 - DNA, 15 bp, Homo sapiens
acatgcatacttaca

SEQ ID NO: 5829595 - DNA, 16 bp, Homo sapiens
acatgcatataatgaa

SEQ ID NO: 5829596 - DNA, 23 bp, Homo sapiens
acatgcatataatgaataaatca

SEQ ID NO: 5829597 - DNA, 18 bp, Homo sapiens
acatgcatcatgctcatg

SEQ ID NO: 5829598 - DNA, 16 bp, Homo sapiens
acatgcatgagcacct

SEQ ID NO: 5829599 - DNA, 19 bp, Homo sapiens
acatgcatgtctgcctatg

SEQ ID NO: 5829600 - DNA, 15 bp, Homo sapiens
acatgcattgttggc

SEQ ID NO: 5829601 - DNA, 18 bp, Homo sapiens
acatgcattgttggctat

SEQ ID NO: 5829602 - DNA, 12 bp, Homo sapiens
acatgcatttga

SEQ ID NO: 5829603 - DNA, 17 bp, Homo sapiens
acatgcatttgaggtca

SEQ ID NO: 5829604 - DNA, 22 bp, Homo sapiens
acatgccacatcaaacctttga

SEQ ID NO: 5829605 - DNA, 19 bp, Homo sapiens
acatgccaccctctccatg

SEQ ID NO: 5829606 - DNA, 14 bp, Homo sapiens
acatgccagaagga

SEQ ID NO: 5829607 - DNA, 15 bp, Homo sapiens
acatgccaggggcct

SEQ ID NO: 5829608 - DNA, 23 bp, Homo sapiens
acatgccagtttttaaaatgctg

SEQ ID NO: 5829609 - DNA, 14 bp, Homo sapiens
acatgccatgccta

SEQ ID NO: 5829610 - DNA, 17 bp, Homo sapiens
acatgccatttgtactg

SEQ ID NO: 5829611 - DNA, 15 bp, Homo sapiens
acatgccccaggctc

SEQ ID NO: 5829612 - DNA, 15 bp, Homo sapiens
acatgccccctccct

SEQ ID NO: 5829613 - DNA, 14 bp, Homo sapiens
acatgcccctcccc

SEQ ID NO: 5829614 - DNA, 17 bp, Homo sapiens
acatgcccctcccccag

SEQ ID NO: 5829615 - DNA, 20 bp, Homo sapiens
acatgccccttggtcctggc

SEQ ID NO: 5829616 - DNA, 18 bp, Homo sapiens
acatgccctcaggcttgg

SEQ ID NO: 5829617 - DNA, 23 bp, Homo sapiens
acatgccctcccttctccctgga

SEQ ID NO: 5829618 - DNA, 15 bp, Homo sapiens
acatgccgcagggag

SEQ ID NO: 5829619 - DNA, 19 bp, Homo sapiens
acatgcctatattatcata

SEQ ID NO: 5829620 - DNA, 11 bp, Homo sapiens
acatgcctcct

SEQ ID NO: 5829621 - DNA, 19 bp, Homo sapiens
acatgcctcctcctgccct

SEQ ID NO: 5829622 - DNA, 23 bp, Homo sapiens
acatgcctcctcctgccctccgc

SEQ ID NO: 5829623 - DNA, 20 bp, Homo sapiens
acatgcctctctcaggccaa

SEQ ID NO: 5829624 - DNA, 12 bp, Homo sapiens
acatgcctgcca

SEQ ID NO: 5829625 - DNA, 15 bp, Homo sapiens
acatgcctgccaaag

SEQ ID NO: 5829626 - DNA, 15 bp, Homo sapiens
acatgcctgcgcctg

SEQ ID NO: 5829627 - DNA, 11 bp, Homo sapiens
acatgcctgtc

SEQ ID NO: 5829628 - DNA, 20 bp, Homo sapiens
acatgccttatatttgtcca

SEQ ID NO: 5829629 - DNA, 16 bp, Homo sapiens
acatgccttggtgccg

SEQ ID NO: 5829630 - DNA, 14 bp, Homo sapiens
acatgcctttccag

SEQ ID NO: 5829631 - DNA, 15 bp, Homo sapiens
acatgcgctcctggc

SEQ ID NO: 5829632 - DNA, 22 bp, Homo sapiens
acatgcgctcctggcttttaaa

SEQ ID NO: 5829633 - DNA, 23 bp, Homo sapiens
acatgcggcttccgagggcacta

SEQ ID NO: 5829634 - DNA, 13 bp, Homo sapiens
acatgcgggctcg

SEQ ID NO: 5829635 - DNA, 17 bp, Homo sapiens
acatgcgggctgggcag

SEQ ID NO: 5829636 - DNA, 21 bp, Homo sapiens
acatgcgggctgggcagctgt

SEQ ID NO: 5829637 - DNA, 20 bp, Homo sapiens
acatgcggtagccagcacac

SEQ ID NO: 5829638 - DNA, 16 bp, Homo sapiens
acatgcgtgtgtcagg

SEQ ID NO: 5829639 - DNA, 16 bp, Homo sapiens
acatgctaaataacta

SEQ ID NO: 5829640 - DNA, 18 bp, Homo sapiens
acatgctaagagaagtag

SEQ ID NO: 5829641 - DNA, 24 bp, Homo sapiens
acatgctaagagaagtagaaatca

SEQ ID NO: 5829642 - DNA, 21 bp, Homo sapiens
acatgctacctgatcccactc

SEQ ID NO: 5829643 - DNA, 18 bp, Homo sapiens
acatgctaggatgcggaa

SEQ ID NO: 5829644 - DNA, 22 bp, Homo sapiens
acatgctcagtacctgtgttga

SEQ ID NO: 5829645 - DNA, 18 bp, Homo sapiens
acatgctctcaatatata

SEQ ID NO: 5829646 - DNA, 19 bp, Homo sapiens
acatgctcttagaaaattc

SEQ ID NO: 5829647 - DNA, 12 bp, Homo sapiens
acatgctctttt

SEQ ID NO: 5829648 - DNA, 14 bp, Homo sapiens
acatgctgaacatc

SEQ ID NO: 5829649 - DNA, 14 bp, Homo sapiens
acatgctgaagcca

SEQ ID NO: 5829650 - DNA, 18 bp, Homo sapiens
acatgctgaggttttgaa

SEQ ID NO: 5829651 - DNA, 21 bp, Homo sapiens
acatgctgaggttttgaataa

SEQ ID NO: 5829652 - DNA, 14 bp, Homo sapiens
acatgctgcccacc

SEQ ID NO: 5829653 - DNA, 21 bp, Homo sapiens
acatgctgcccaccccctgct

SEQ ID NO: 5829654 - DNA, 22 bp, Homo sapiens
acatgctgcccaccccctgctg

SEQ ID NO: 5829655 - DNA, 22 bp, Homo sapiens
acatgctgcctggcacagacca

SEQ ID NO: 5829656 - DNA, 22 bp, Homo sapiens
acatgctgcgcatgttttcttc

SEQ ID NO: 5829657 - DNA, 23 bp, Homo sapiens
acatgctggaaataaaacagctg

SEQ ID NO: 5829658 - DNA, 13 bp, Homo sapiens
acatgctgtctta

SEQ ID NO: 5829659 - DNA, 21 bp, Homo sapiens
acatgctgtgctctttgaaga

SEQ ID NO: 5829660 - DNA, 23 bp, Homo sapiens
acatgctgtgctctttgaagaga

SEQ ID NO: 5829661 - DNA, 20 bp, Homo sapiens
acatgctgtgtaagctgtgt

SEQ ID NO: 5829662 - DNA, 13 bp, Homo sapiens
acatgctgttatt

SEQ ID NO: 5829663 - DNA, 22 bp, Homo sapiens
acatgctgttggcctcaagcaa

SEQ ID NO: 5829664 - DNA, 14 bp, Homo sapiens
acatgctgtttatg

SEQ ID NO: 5829665 - DNA, 21 bp, Homo sapiens
acatgcttactttttaatttt

SEQ ID NO: 5829666 - DNA, 18 bp, Homo sapiens
acatgcttagcttatctt

SEQ ID NO: 5829667 - DNA, 17 bp, Homo sapiens
acatgcttataacatta

SEQ ID NO: 5829668 - DNA, 20 bp, Homo sapiens
acatgcttcatgaaaatcct

SEQ ID NO: 5829669 - DNA, 16 bp, Homo sapiens
acatgcttccctttcc

SEQ ID NO: 5829670 - DNA, 18 bp, Homo sapiens
acatgcttccctttcctg

SEQ ID NO: 5829671 - DNA, 14 bp, Homo sapiens
acatgcttttactt

SEQ ID NO: 5829672 - DNA, 20 bp, Homo sapiens
acatgcttttctgccactcc

SEQ ID NO: 5829673 - DNA, 21 bp, Homo sapiens
acatgcttttctgccactcca

SEQ ID NO: 5829674 - DNA, 22 bp, Homo sapiens
acatggaaaacagagtatttct

SEQ ID NO: 5829675 - DNA, 15 bp, Homo sapiens
acatggaacagtgta

SEQ ID NO: 5829676 - DNA, 20 bp, Homo sapiens
acatggaacttaaaacatat

SEQ ID NO: 5829677 - DNA, 19 bp, Homo sapiens
acatggaagaagtatattt

SEQ ID NO: 5829678 - DNA, 17 bp, Homo sapiens
acatggaagattagagg

SEQ ID NO: 5829679 - DNA, 20 bp, Homo sapiens
acatggaataacatgtaatt

SEQ ID NO: 5829680 - DNA, 21 bp, Homo sapiens
acatggaatcgaagtgtttat

SEQ ID NO: 5829681 - DNA, 20 bp, Homo sapiens
acatggaatttaatttatgt

SEQ ID NO: 5829682 - DNA, 17 bp, Homo sapiens
acatggacaaggagctg

SEQ ID NO: 5829683 - DNA, 15 bp, Homo sapiens
acatggacagacttc

SEQ ID NO: 5829684 - DNA, 12 bp, Homo sapiens
acatggaccagc

SEQ ID NO: 5829685 - DNA, 23 bp, Homo sapiens
acatggacccactacccttctcc

SEQ ID NO: 5829686 - DNA, 13 bp, Homo sapiens
acatggacccgga

SEQ ID NO: 5829687 - DNA, 15 bp, Homo sapiens
acatggagaaatcta

SEQ ID NO: 5829688 - DNA, 22 bp, Homo sapiens
acatggagactcctgccctgtt

SEQ ID NO: 5829689 - DNA, 16 bp, Homo sapiens
acatggagagagactc

SEQ ID NO: 5829690 - DNA, 17 bp, Homo sapiens
acatggagatgtaaaat

SEQ ID NO: 5829691 - DNA, 21 bp, Homo sapiens
acatggagatgtaaaatgagt

SEQ ID NO: 5829692 - DNA, 19 bp, Homo sapiens
acatggagctcttgttgca

SEQ ID NO: 5829693 - DNA, 23 bp, Homo sapiens
acatggaggaattgggacctggt

SEQ ID NO: 5829694 - DNA, 16 bp, Homo sapiens
acatggaggttctaag

SEQ ID NO: 5829695 - DNA, 17 bp, Homo sapiens
acatggaggttctaagg

SEQ ID NO: 5829696 - DNA, 18 bp, Homo sapiens
acatggaggttctaaggc

SEQ ID NO: 5829697 - DNA, 15 bp, Homo sapiens
acatggagtatatgt

SEQ ID NO: 5829698 - DNA, 23 bp, Homo sapiens
acatggagtccaagtaatgaatt

SEQ ID NO: 5829699 - DNA, 17 bp, Homo sapiens
acatggatacatatttc

SEQ ID NO: 5829700 - DNA, 15 bp, Homo sapiens
acatggatacttcct

SEQ ID NO: 5829701 - DNA, 19 bp, Homo sapiens
acatggatgcgaggaccac

SEQ ID NO: 5829702 - DNA, 14 bp, Homo sapiens
acatggatgtgttg

SEQ ID NO: 5829703 - DNA, 18 bp, Homo sapiens
acatggcaattgcactca

SEQ ID NO: 5829704 - DNA, 20 bp, Homo sapiens
acatggcacttggaagaaaa

SEQ ID NO: 5829705 - DNA, 14 bp, Homo sapiens
acatggcagatgat

SEQ ID NO: 5829706 - DNA, 15 bp, Homo sapiens
acatggcagatgatt

SEQ ID NO: 5829707 - DNA, 16 bp, Homo sapiens
acatggcagtgtttta

SEQ ID NO: 5829708 - DNA, 18 bp, Homo sapiens
acatggcatgttttgtca

SEQ ID NO: 5829709 - DNA, 17 bp, Homo sapiens
acatggccatagaggcc

SEQ ID NO: 5829710 - DNA, 19 bp, Homo sapiens
acatggccatagaggccca

SEQ ID NO: 5829711 - DNA, 20 bp, Homo sapiens
acatggccatagaggcccag

SEQ ID NO: 5829712 - DNA, 22 bp, Homo sapiens
acatggccatagaggcccaggc

SEQ ID NO: 5829713 - DNA, 20 bp, Homo sapiens
acatggccatcttctttctt

SEQ ID NO: 5829714 - DNA, 14 bp, Homo sapiens
acatggcccattgg

SEQ ID NO: 5829715 - DNA, 22 bp, Homo sapiens
acatggcctgagcatccagacc

SEQ ID NO: 5829716 - DNA, 14 bp, Homo sapiens
acatggcctttgct

SEQ ID NO: 5829717 - DNA, 20 bp, Homo sapiens
acatggcgccctgcctcctg

SEQ ID NO: 5829718 - DNA, 19 bp, Homo sapiens
acatggctatcctagagag

SEQ ID NO: 5829719 - DNA, 22 bp, Homo sapiens
acatggctccggcctctgcctt

SEQ ID NO: 5829720 - DNA, 22 bp, Homo sapiens
acatggctctggactctaaaga

SEQ ID NO: 5829721 - DNA, 21 bp, Homo sapiens
acatggctgggggagggactg

SEQ ID NO: 5829722 - DNA, 19 bp, Homo sapiens
acatggcttaatcttattt

SEQ ID NO: 5829723 - DNA, 20 bp, Homo sapiens
acatggcttaatcttatttt

SEQ ID NO: 5829724 - DNA, 16 bp, Homo sapiens
acatggcttcctcctg

SEQ ID NO: 5829725 - DNA, 14 bp, Homo sapiens
acatggcttctcct

SEQ ID NO: 5829726 - DNA, 17 bp, Homo sapiens
acatggcttctcctttg

SEQ ID NO: 5829727 - DNA, 20 bp, Homo sapiens
acatggcttgccacagctct

SEQ ID NO: 5829728 - DNA, 18 bp, Homo sapiens
acatggctttcagaaaac

SEQ ID NO: 5829729 - DNA, 22 bp, Homo sapiens
acatgggaaacttccaagacct

SEQ ID NO: 5829730 - DNA, 15 bp, Homo sapiens
acatgggacatttgc

SEQ ID NO: 5829731 - DNA, 14 bp, Homo sapiens
acatgggacctggc

SEQ ID NO: 5829732 - DNA, 20 bp, Homo sapiens
acatgggaggaaggcccagg

SEQ ID NO: 5829733 - DNA, 19 bp, Homo sapiens
acatgggatccaattttaa

SEQ ID NO: 5829734 - DNA, 12 bp, Homo sapiens
acatgggcagcc

SEQ ID NO: 5829735 - DNA, 15 bp, Homo sapiens
acatgggcagcccaa

SEQ ID NO: 5829736 - DNA, 15 bp, Homo sapiens
acatgggccagccct

SEQ ID NO: 5829737 - DNA, 19 bp, Homo sapiens
acatgggccccagatacca

SEQ ID NO: 5829738 - DNA, 16 bp, Homo sapiens
acatgggccgcaccat

SEQ ID NO: 5829739 - DNA, 18 bp, Homo sapiens
acatgggctatcagggag

SEQ ID NO: 5829740 - DNA, 20 bp, Homo sapiens
acatgggctgtgattactgc

SEQ ID NO: 5829741 - DNA, 21 bp, Homo sapiens
acatgggctgtgattactgca

SEQ ID NO: 5829742 - DNA, 16 bp, Homo sapiens
acatggggaaggcaga

SEQ ID NO: 5829743 - DNA, 16 bp, Homo sapiens
acatggggcaagccag

SEQ ID NO: 5829744 - DNA, 17 bp, Homo sapiens
acatggggcaagccagg

SEQ ID NO: 5829745 - DNA, 19 bp, Homo sapiens
acatggggcaagccagggc

SEQ ID NO: 5829746 - DNA, 20 bp, Homo sapiens
acatggggcaagccagggcc

SEQ ID NO: 5829747 - DNA, 11 bp, Homo sapiens
acatggggcat

SEQ ID NO: 5829748 - DNA, 19 bp, Homo sapiens
acatggggcatagaaactg

SEQ ID NO: 5829749 - DNA, 18 bp, Homo sapiens
acatggggcccctctcat

SEQ ID NO: 5829750 - DNA, 23 bp, Homo sapiens
acatggggcccctctcatcactg

SEQ ID NO: 5829751 - DNA, 17 bp, Homo sapiens
acatggggttggctggg

SEQ ID NO: 5829752 - DNA, 22 bp, Homo sapiens
acatggggtttcagttgcgaaa

SEQ ID NO: 5829753 - DNA, 18 bp, Homo sapiens
acatggggttttcaattt

SEQ ID NO: 5829754 - DNA, 13 bp, Homo sapiens
acatgggttcaat

SEQ ID NO: 5829755 - DNA, 15 bp, Homo sapiens
acatggtagatgctt

SEQ ID NO: 5829756 - DNA, 14 bp, Homo sapiens
acatggtagcaggg

SEQ ID NO: 5829757 - DNA, 23 bp, Homo sapiens
acatggtccatttcatgtgatct

SEQ ID NO: 5829758 - DNA, 11 bp, Homo sapiens
acatggtgatg

SEQ ID NO: 5829759 - DNA, 19 bp, Homo sapiens
acatggtgcctgagaggca

SEQ ID NO: 5829760 - DNA, 19 bp, Homo sapiens
acatggtgctacgcctgca

SEQ ID NO: 5829761 - DNA, 23 bp, Homo sapiens
acatggtgctacgcctgcatgta

SEQ ID NO: 5829762 - DNA, 16 bp, Homo sapiens
acatggtgctgggaga

SEQ ID NO: 5829763 - DNA, 23 bp, Homo sapiens
acatggtggggtctcctcaggac

SEQ ID NO: 5829764 - DNA, 15 bp, Homo sapiens
acatggtgtctccca

SEQ ID NO: 5829765 - DNA, 20 bp, Homo sapiens
acatggtgtctcccaacatg

SEQ ID NO: 5829766 - DNA, 22 bp, Homo sapiens
acatggtgtctcccaacatggg

SEQ ID NO: 5829767 - DNA, 19 bp, Homo sapiens
acatggtgtggggggctgg

SEQ ID NO: 5829768 - DNA, 15 bp, Homo sapiens
acatggtgtgtgtct

SEQ ID NO: 5829769 - DNA, 22 bp, Homo sapiens
acatggtgttgtatacttcatt

SEQ ID NO: 5829770 - DNA, 18 bp, Homo sapiens
acatggttacaatcattg

SEQ ID NO: 5829771 - DNA, 19 bp, Homo sapiens
acatggttaccatgtcttt

SEQ ID NO: 5829772 - DNA, 18 bp, Homo sapiens
acatggttgtgacctgag

SEQ ID NO: 5829773 - DNA, 21 bp, Homo sapiens
acatggtttaaatatgaatga

SEQ ID NO: 5829774 - DNA, 14 bp, Homo sapiens
acatgtaaaatatg

SEQ ID NO: 5829775 - DNA, 15 bp, Homo sapiens
acatgtaaaatatgt

SEQ ID NO: 5829776 - DNA, 21 bp, Homo sapiens
acatgtaaaatatgtaaaact

SEQ ID NO: 5829777 - DNA, 13 bp, Homo sapiens
acatgtaaaatct

SEQ ID NO: 5829778 - DNA, 14 bp, Homo sapiens
acatgtaaacaaat

SEQ ID NO: 5829779 - DNA, 14 bp, Homo sapiens
acatgtaaagctgt

SEQ ID NO: 5829780 - DNA, 20 bp, Homo sapiens
acatgtaaatacaaattttg

SEQ ID NO: 5829781 - DNA, 16 bp, Homo sapiens
acatgtaaattaagtg

SEQ ID NO: 5829782 - DNA, 13 bp, Homo sapiens
acatgtaagaaaa

SEQ ID NO: 5829783 - DNA, 19 bp, Homo sapiens
acatgtaataaaaagtata

SEQ ID NO: 5829784 - DNA, 23 bp, Homo sapiens
acatgtaataaaaagtatatgtt

SEQ ID NO: 5829785 - DNA, 16 bp, Homo sapiens
acatgtaataaattca

SEQ ID NO: 5829786 - DNA, 18 bp, Homo sapiens
acatgtaatataaagatg

SEQ ID NO: 5829787 - DNA, 23 bp, Homo sapiens
acatgtaattaagtactatgtat

SEQ ID NO: 5829788 - DNA, 12 bp, Homo sapiens
acatgtacataa

SEQ ID NO: 5829789 - DNA, 18 bp, Homo sapiens
acatgtacatagtaaagt

SEQ ID NO: 5829790 - DNA, 18 bp, Homo sapiens
acatgtaccccctttccc

SEQ ID NO: 5829791 - DNA, 17 bp, Homo sapiens
acatgtacctatagaaa

SEQ ID NO: 5829792 - DNA, 14 bp, Homo sapiens
acatgtactacagc

SEQ ID NO: 5829793 - DNA, 17 bp, Homo sapiens
acatgtactacagctat

SEQ ID NO: 5829794 - DNA, 22 bp, Homo sapiens
acatgtactacagctatatttg

SEQ ID NO: 5829795 - DNA, 18 bp, Homo sapiens
acatgtactccagaggga

SEQ ID NO: 5829796 - DNA, 20 bp, Homo sapiens
acatgtactgttctcttctt

SEQ ID NO: 5829797 - DNA, 18 bp, Homo sapiens
acatgtagaaaacaaaat

SEQ ID NO: 5829798 - DNA, 19 bp, Homo sapiens
acatgtagagatttgagtg

SEQ ID NO: 5829799 - DNA, 15 bp, Homo sapiens
acatgtagcttcttc

SEQ ID NO: 5829800 - DNA, 21 bp, Homo sapiens
acatgtaggtaggaagcactg

SEQ ID NO: 5829801 - DNA, 23 bp, Homo sapiens
acatgtaggtgtttgttcatctg

SEQ ID NO: 5829802 - DNA, 20 bp, Homo sapiens
acatgtataaagtgattgac

SEQ ID NO: 5829803 - DNA, 23 bp, Homo sapiens
acatgtatactccatagaaacta

SEQ ID NO: 5829804 - DNA, 13 bp, Homo sapiens
acatgtatagtga

SEQ ID NO: 5829805 - DNA, 15 bp, Homo sapiens
acatgtatctgtcta

SEQ ID NO: 5829806 - DNA, 21 bp, Homo sapiens
acatgtatctgtctactttct

SEQ ID NO: 5829807 - DNA, 15 bp, Homo sapiens
acatgtatgaaattg

SEQ ID NO: 5829808 - DNA, 18 bp, Homo sapiens
acatgtatgatttctgtt

SEQ ID NO: 5829809 - DNA, 18 bp, Homo sapiens
acatgtatggttactaaa

SEQ ID NO: 5829810 - DNA, 14 bp, Homo sapiens
acatgtatgtggat

SEQ ID NO: 5829811 - DNA, 23 bp, Homo sapiens
acatgtatgttttggtatctgtt

SEQ ID NO: 5829812 - DNA, 14 bp, Homo sapiens
acatgtattaaatt

SEQ ID NO: 5829813 - DNA, 13 bp, Homo sapiens
acatgtattctgt

SEQ ID NO: 5829814 - DNA, 17 bp, Homo sapiens
acatgtattctgttggc

SEQ ID NO: 5829815 - DNA, 19 bp, Homo sapiens
acatgtattctgttggcca

SEQ ID NO: 5829816 - DNA, 14 bp, Homo sapiens
acatgtatttatgt

SEQ ID NO: 5829817 - DNA, 15 bp, Homo sapiens
acatgtatttatgta

SEQ ID NO: 5829818 - DNA, 21 bp, Homo sapiens
acatgtcaaagctgcatgtgt

SEQ ID NO: 5829819 - DNA, 19 bp, Homo sapiens
acatgtcacaatacagtaa

SEQ ID NO: 5829820 - DNA, 23 bp, Homo sapiens
acatgtcatgtaggttgtctaaa

SEQ ID NO: 5829821 - DNA, 19 bp, Homo sapiens
acatgtccaagaagcccag

SEQ ID NO: 5829822 - DNA, 21 bp, Homo sapiens
acatgtccagtgggaggtgag

SEQ ID NO: 5829823 - DNA, 14 bp, Homo sapiens
acatgtccccttcc

SEQ ID NO: 5829824 - DNA, 16 bp, Homo sapiens
acatgtccccttccct

SEQ ID NO: 5829825 - DNA, 22 bp, Homo sapiens
acatgtcctaattcttctgtcc

SEQ ID NO: 5829826 - DNA, 15 bp, Homo sapiens
acatgtctacttttt

SEQ ID NO: 5829827 - DNA, 16 bp, Homo sapiens
acatgtctacttttta

SEQ ID NO: 5829828 - DNA, 16 bp, Homo sapiens
acatgtctcctatcct

SEQ ID NO: 5829829 - DNA, 19 bp, Homo sapiens
acatgtctgtcctcagagc

SEQ ID NO: 5829830 - DNA, 21 bp, Homo sapiens
acatgtctgtcctcagagcag

SEQ ID NO: 5829831 - DNA, 18 bp, Homo sapiens
acatgtctgttctacata

SEQ ID NO: 5829832 - DNA, 20 bp, Homo sapiens
acatgtcttaatgaagtttg

SEQ ID NO: 5829833 - DNA, 16 bp, Homo sapiens
acatgtcttgtacatg

SEQ ID NO: 5829834 - DNA, 22 bp, Homo sapiens
acatgtcttgtacatgtgtagc

SEQ ID NO: 5829835 - DNA, 17 bp, Homo sapiens
acatgtgaaaagaatag

SEQ ID NO: 5829836 - DNA, 21 bp, Homo sapiens
acatgtgaaaagcttaataaa

SEQ ID NO: 5829837 - DNA, 15 bp, Homo sapiens
acatgtgaaaccttt

SEQ ID NO: 5829838 - DNA, 17 bp, Homo sapiens
acatgtgaagctatttg

SEQ ID NO: 5829839 - DNA, 16 bp, Homo sapiens
acatgtgacatttata

SEQ ID NO: 5829840 - DNA, 17 bp, Homo sapiens
acatgtgagatagtttt

SEQ ID NO: 5829841 - DNA, 18 bp, Homo sapiens
acatgtgaggaggaaaag

SEQ ID NO: 5829842 - DNA, 14 bp, Homo sapiens
acatgtgatacatt

SEQ ID NO: 5829843 - DNA, 11 bp, Homo sapiens
acatgtgcaac

SEQ ID NO: 5829844 - DNA, 15 bp, Homo sapiens
acatgtgcaactctt

SEQ ID NO: 5829845 - DNA, 21 bp, Homo sapiens
acatgtgcaattgtgagggac

SEQ ID NO: 5829846 - DNA, 15 bp, Homo sapiens
acatgtgcccctgcc

SEQ ID NO: 5829847 - DNA, 13 bp, Homo sapiens
acatgtgcctgta

SEQ ID NO: 5829848 - DNA, 17 bp, Homo sapiens
acatgtgccttttctga

SEQ ID NO: 5829849 - DNA, 11 bp, Homo sapiens
acatgtgctat

SEQ ID NO: 5829850 - DNA, 21 bp, Homo sapiens
acatgtgctcgctctgcatga

SEQ ID NO: 5829851 - DNA, 22 bp, Homo sapiens
acatgtgctcgctctgcatgat

SEQ ID NO: 5829852 - DNA, 16 bp, Homo sapiens
acatgtgctgatgttt

SEQ ID NO: 5829853 - DNA, 20 bp, Homo sapiens
acatgtggaaaactcacaga

SEQ ID NO: 5829854 - DNA, 18 bp, Homo sapiens
acatgtggaaagtgaatt

SEQ ID NO: 5829855 - DNA, 17 bp, Homo sapiens
acatgtggcagcaggca

SEQ ID NO: 5829856 - DNA, 18 bp, Homo sapiens
acatgtggcttgaattaa

SEQ ID NO: 5829857 - DNA, 20 bp, Homo sapiens
acatgtgggtggagaaggga

SEQ ID NO: 5829858 - DNA, 23 bp, Homo sapiens
acatgtggttacacagtgtgaat

SEQ ID NO: 5829859 - DNA, 16 bp, Homo sapiens
acatgtggtttataga

SEQ ID NO: 5829860 - DNA, 13 bp, Homo sapiens
acatgtgtacata

SEQ ID NO: 5829861 - DNA, 23 bp, Homo sapiens
acatgtgtcaacacccctgtgtg

SEQ ID NO: 5829862 - DNA, 20 bp, Homo sapiens
acatgtgtcaagctgcttgg

SEQ ID NO: 5829863 - DNA, 19 bp, Homo sapiens
acatgtgtctgtgtggtat

SEQ ID NO: 5829864 - DNA, 23 bp, Homo sapiens
acatgtgtctgtgtggtatattt

SEQ ID NO: 5829865 - DNA, 22 bp, Homo sapiens
acatgtgtgcagagcagacagg

SEQ ID NO: 5829866 - DNA, 16 bp, Homo sapiens
acatgtgtgcgtgtgc

SEQ ID NO: 5829867 - DNA, 12 bp, Homo sapiens
acatgtgtgtat

SEQ ID NO: 5829868 - DNA, 23 bp, Homo sapiens
acatgtgttagtgtatgtgaatt

SEQ ID NO: 5829869 - DNA, 17 bp, Homo sapiens
acatgtgttatctacct

SEQ ID NO: 5829870 - DNA, 22 bp, Homo sapiens
acatgtgtttattcatccagca

SEQ ID NO: 5829871 - DNA, 13 bp, Homo sapiens
acatgtgtttctg

SEQ ID NO: 5829872 - DNA, 12 bp, Homo sapiens
acatgtgtttta

SEQ ID NO: 5829873 - DNA, 22 bp, Homo sapiens
acatgtgttttcatcatttcag

SEQ ID NO: 5829874 - DNA, 14 bp, Homo sapiens
acatgttaaaccat

SEQ ID NO: 5829875 - DNA, 23 bp, Homo sapiens
acatgttaagataacttactgta

SEQ ID NO: 5829876 - DNA, 17 bp, Homo sapiens
acatgttaatgaacagt

SEQ ID NO: 5829877 - DNA, 20 bp, Homo sapiens
acatgttaatgacaatattc

SEQ ID NO: 5829878 - DNA, 13 bp, Homo sapiens
acatgttacaaca

SEQ ID NO: 5829879 - DNA, 19 bp, Homo sapiens
acatgttaccatgtctgac

SEQ ID NO: 5829880 - DNA, 19 bp, Homo sapiens
acatgttactgaccagcaa

SEQ ID NO: 5829881 - DNA, 17 bp, Homo sapiens
acatgttactgcttcat

SEQ ID NO: 5829882 - DNA, 18 bp, Homo sapiens
acatgttactgcttcatt

SEQ ID NO: 5829883 - DNA, 14 bp, Homo sapiens
acatgttatatatt

SEQ ID NO: 5829884 - DNA, 15 bp, Homo sapiens
acatgttatatattt

SEQ ID NO: 5829885 - DNA, 21 bp, Homo sapiens
acatgttatcaaatctgggta

SEQ ID NO: 5829886 - DNA, 17 bp, Homo sapiens
acatgttattgttttca

SEQ ID NO: 5829887 - DNA, 11 bp, Homo sapiens
acatgttcata

SEQ ID NO: 5829888 - DNA, 15 bp, Homo sapiens
acatgttcccttctc

SEQ ID NO: 5829889 - DNA, 23 bp, Homo sapiens
acatgttcttgtcataaaatgca

SEQ ID NO: 5829890 - DNA, 21 bp, Homo sapiens
acatgttgtaaattaggaggc

SEQ ID NO: 5829891 - DNA, 16 bp, Homo sapiens
acatgttgtatttatg

SEQ ID NO: 5829892 - DNA, 16 bp, Homo sapiens
acatgtttaaattgta

SEQ ID NO: 5829893 - DNA, 19 bp, Homo sapiens
acatgtttaaattgtaaat

SEQ ID NO: 5829894 - DNA, 20 bp, Homo sapiens
acatgtttagagttgcaatc

SEQ ID NO: 5829895 - DNA, 21 bp, Homo sapiens
acatgtttccatcatttctgt

SEQ ID NO: 5829896 - DNA, 11 bp, Homo sapiens
acatgtttcct

SEQ ID NO: 5829897 - DNA, 11 bp, Homo sapiens
acatgtttctc

SEQ ID NO: 5829898 - DNA, 16 bp, Homo sapiens
acatgtttctctataa

SEQ ID NO: 5829899 - DNA, 13 bp, Homo sapiens
acatgtttctgtt

SEQ ID NO: 5829900 - DNA, 15 bp, Homo sapiens
acatgttttactcac

SEQ ID NO: 5829901 - DNA, 23 bp, Homo sapiens
acatgttttatgtacacaaatcc

SEQ ID NO: 5829902 - DNA, 14 bp, Homo sapiens
acatgttttcaaat

SEQ ID NO: 5829903 - DNA, 17 bp, Homo sapiens
acatgttttcaaatgga

SEQ ID NO: 5829904 - DNA, 13 bp, Homo sapiens
acatgttttgata

SEQ ID NO: 5829905 - DNA, 17 bp, Homo sapiens
acatgttttgataaagt

SEQ ID NO: 5829906 - DNA, 17 bp, Homo sapiens
acatgtttttatacaaa

SEQ ID NO: 5829907 - DNA, 15 bp, Homo sapiens
acatgtttttatatg

SEQ ID NO: 5829908 - DNA, 18 bp, Homo sapiens
acatgtttttatatgtct

SEQ ID NO: 5829909 - DNA, 13 bp, Homo sapiens
acatgtttttcta

SEQ ID NO: 5829910 - DNA, 22 bp, Homo sapiens
acatgttttttcatttgtaaaa

SEQ ID NO: 5829911 - DNA, 23 bp, Homo sapiens
acattaaaaaaaatcatcattat

SEQ ID NO: 5829912 - DNA, 15 bp, Homo sapiens
acattaaaaagcctt

SEQ ID NO: 5829913 - DNA, 16 bp, Homo sapiens
acattaaaaatggaac

SEQ ID NO: 5829914 - DNA, 22 bp, Homo sapiens
acattaaaacaatattgtttct

SEQ ID NO: 5829915 - DNA, 13 bp, Homo sapiens
acattaaaactag

SEQ ID NO: 5829916 - DNA, 22 bp, Homo sapiens
acattaaaactaggtaatgttt

SEQ ID NO: 5829917 - DNA, 22 bp, Homo sapiens
acattaaaactcataattattt

SEQ ID NO: 5829918 - DNA, 18 bp, Homo sapiens
acattaaaagaagactgg

SEQ ID NO: 5829919 - DNA, 13 bp, Homo sapiens
acattaaaagaca

SEQ ID NO: 5829920 - DNA, 14 bp, Homo sapiens
acattaaaataact

SEQ ID NO: 5829921 - DNA, 20 bp, Homo sapiens
acattaaaatagcacatgat

SEQ ID NO: 5829922 - DNA, 16 bp, Homo sapiens
acattaaacactgtaa

SEQ ID NO: 5829923 - DNA, 20 bp, Homo sapiens
acattaaacaggattttaca

SEQ ID NO: 5829924 - DNA, 21 bp, Homo sapiens
acattaaactccctttcatgt

SEQ ID NO: 5829925 - DNA, 12 bp, Homo sapiens
acattaaagcag

SEQ ID NO: 5829926 - DNA, 12 bp, Homo sapiens
acattaaataat

SEQ ID NO: 5829927 - DNA, 17 bp, Homo sapiens
acattaaatctatgaag

SEQ ID NO: 5829928 - DNA, 15 bp, Homo sapiens
acatttaaaaaacat

SEQ ID NO: 5829929 - DNA, 15 bp, Homo sapiens
acatttaaaaataaa

SEQ ID NO: 5829930 - DNA, 22 bp, Homo sapiens
acatttaaaatagttttctaaa

SEQ ID NO: 5829931 - DNA, 12 bp, Homo sapiens
acatttaaaatt

SEQ ID NO: 5829932 - DNA, 16 bp, Homo sapiens
acatttaaaattaaat

SEQ ID NO: 5829933 - DNA, 17 bp, Homo sapiens
acatttaaactttttaa

SEQ ID NO: 5829934 - DNA, 20 bp, Homo sapiens
acatttaaactttttaaaat

SEQ ID NO: 5829935 - DNA, 19 bp, Homo sapiens
acatttaaataaaactttc

SEQ ID NO: 5829936 - DNA, 20 bp, Homo sapiens
acatttaaataaaactttcc

SEQ ID NO: 5829937 - DNA, 23 bp, Homo sapiens
acatttaaataaaactttccaaa

SEQ ID NO: 5829938 - DNA, 12 bp, Homo sapiens
acatttaaatcc

SEQ ID NO: 5829939 - DNA, 12 bp, Homo sapiens
acatttaaattc

SEQ ID NO: 5829940 - DNA, 17 bp, Homo sapiens
acatttaaattccacag

SEQ ID NO: 5829941 - DNA, 16 bp, Homo sapiens
acatttaacataatgg

SEQ ID NO: 5829942 - DNA, 22 bp, Homo sapiens
acatttaacttgtttccaatgt

SEQ ID NO: 5829943 - DNA, 16 bp, Homo sapiens
acatttaacttttcta

SEQ ID NO: 5829944 - DNA, 21 bp, Homo sapiens
acatttaagggaatgtgagca

SEQ ID NO: 5829945 - DNA, 14 bp, Homo sapiens
acatttaataaaac

SEQ ID NO: 5829946 - DNA, 16 bp, Homo sapiens
acatttaataaaactg

SEQ ID NO: 5829947 - DNA, 14 bp, Homo sapiens
acatttaataatca

SEQ ID NO: 5829948 - DNA, 19 bp, Homo sapiens
acatttaataatgtatgta

SEQ ID NO: 5829949 - DNA, 20 bp, Homo sapiens
acatttaatatcctgccttt

SEQ ID NO: 5829950 - DNA, 16 bp, Homo sapiens
acatttaatatcttca

SEQ ID NO: 5829951 - DNA, 22 bp, Homo sapiens
acatttaatattatataggata

SEQ ID NO: 5829952 - DNA, 11 bp, Homo sapiens
acatttaattg

SEQ ID NO: 5829953 - DNA, 17 bp, Homo sapiens
acatttacaaactgaag

SEQ ID NO: 5829954 - DNA, 17 bp, Homo sapiens
acatttacaataaatat

SEQ ID NO: 5829955 - DNA, 16 bp, Homo sapiens
acatttacacattctc

SEQ ID NO: 5829956 - DNA, 19 bp, Homo sapiens
acatttacacattctcaca

SEQ ID NO: 5829957 - DNA, 16 bp, Homo sapiens
acatttacaggagggc

SEQ ID NO: 5829958 - DNA, 17 bp, Homo sapiens
acatttacaggagggcc

SEQ ID NO: 5829959 - DNA, 19 bp, Homo sapiens
acatttacatgttcttcca

SEQ ID NO: 5829960 - DNA, 16 bp, Homo sapiens
acatttacctttttga

SEQ ID NO: 5829961 - DNA, 20 bp, Homo sapiens
acatttactagctgtgcaac

SEQ ID NO: 5829962 - DNA, 13 bp, Homo sapiens
acatttactgaaa

SEQ ID NO: 5829963 - DNA, 14 bp, Homo sapiens
acatttactgacca

SEQ ID NO: 5829964 - DNA, 20 bp, Homo sapiens
acatttagaaaagtgaattg

SEQ ID NO: 5829965 - DNA, 15 bp, Homo sapiens
acatttagaaatgtt

SEQ ID NO: 5829966 - DNA, 13 bp, Homo sapiens
acatttagaactt

SEQ ID NO: 5829967 - DNA, 15 bp, Homo sapiens
acatttagagtattt

SEQ ID NO: 5829968 - DNA, 13 bp, Homo sapiens
acatttagatcct

SEQ ID NO: 5829969 - DNA, 15 bp, Homo sapiens
acatttagcccctct

SEQ ID NO: 5829970 - DNA, 13 bp, Homo sapiens
acatttaggataa

SEQ ID NO: 5829971 - DNA, 16 bp, Homo sapiens
acatttaggattttgt

SEQ ID NO: 5829972 - DNA, 16 bp, Homo sapiens
acatttagtaccctgc

SEQ ID NO: 5829973 - DNA, 18 bp, Homo sapiens
acatttagtaccctgcag

SEQ ID NO: 5829974 - DNA, 21 bp, Homo sapiens
acatttagtaccctgcaggcc

SEQ ID NO: 5829975 - DNA, 22 bp, Homo sapiens
acatttagtaccctgcaggcca

SEQ ID NO: 5829976 - DNA, 16 bp, Homo sapiens
acatttagtccaatga

SEQ ID NO: 5829977 - DNA, 15 bp, Homo sapiens
acatttagtcctgta

SEQ ID NO: 5829978 - DNA, 17 bp, Homo sapiens
acatttagtctctttat

SEQ ID NO: 5829979 - DNA, 15 bp, Homo sapiens
acatttagttaacac

SEQ ID NO: 5829980 - DNA, 15 bp, Homo sapiens
acatttataatgttt

SEQ ID NO: 5829981 - DNA, 13 bp, Homo sapiens
acatttatacatc

SEQ ID NO: 5829982 - DNA, 15 bp, Homo sapiens
acatttatacatcac

SEQ ID NO: 5829983 - DNA, 22 bp, Homo sapiens
acatttatatattgtctgtaaa

SEQ ID NO: 5829984 - DNA, 20 bp, Homo sapiens
acatttatatgggtttattt

SEQ ID NO: 5829985 - DNA, 11 bp, Homo sapiens
acatttatatt

SEQ ID NO: 5829986 - DNA, 22 bp, Homo sapiens
acatttatcaatcagtataatt

SEQ ID NO: 5829987 - DNA, 21 bp, Homo sapiens
acatttatccaggaattgata

SEQ ID NO: 5829988 - DNA, 11 bp, Homo sapiens
acatttatctt

SEQ ID NO: 5829989 - DNA, 14 bp, Homo sapiens
acatttatcttctg

SEQ ID NO: 5829990 - DNA, 18 bp, Homo sapiens
acatttatcttctgtttt

SEQ ID NO: 5829991 - DNA, 21 bp, Homo sapiens
acatttatcttctgtttttct

SEQ ID NO: 5829992 - DNA, 23 bp, Homo sapiens
acatttatcttctgtttttctca

SEQ ID NO: 5829993 - DNA, 14 bp, Homo sapiens
acatttatctttgt

SEQ ID NO: 5829994 - DNA, 15 bp, Homo sapiens
acatttatctttgta

SEQ ID NO: 5829995 - DNA, 23 bp, Homo sapiens
acatttatctttgtattcttcat

SEQ ID NO: 5829996 - DNA, 20 bp, Homo sapiens
acatttatgacaagctgtat

SEQ ID NO: 5829997 - DNA, 13 bp, Homo sapiens
acatttatgacct

SEQ ID NO: 5829998 - DNA, 14 bp, Homo sapiens
acatttatgattta

SEQ ID NO: 5829999 - DNA, 17 bp, Homo sapiens
acatttatgatttaata

SEQ ID NO: 5830000 - DNA, 22 bp, Homo sapiens
acatttatgatttaataaaata

SEQ ID NO: 5830001 - DNA, 16 bp, Homo sapiens
acatttatgtacaaaa

SEQ ID NO: 5830002 - DNA, 19 bp, Homo sapiens
acatttatgtacaaaatga

SEQ ID NO: 5830003 - DNA, 19 bp, Homo sapiens
acatttatgtgaggtaatt

SEQ ID NO: 5830004 - DNA, 15 bp, Homo sapiens
acatttatgtgctgt

SEQ ID NO: 5830005 - DNA, 15 bp, Homo sapiens
acatttattccttcc

SEQ ID NO: 5830006 - DNA, 18 bp, Homo sapiens
acatttattgagatctaa

SEQ ID NO: 5830007 - DNA, 18 bp, Homo sapiens
acatttatttatccagaa

SEQ ID NO: 5830008 - DNA, 20 bp, Homo sapiens
acatttatttattactgtcc

SEQ ID NO: 5830009 - DNA, 16 bp, Homo sapiens
acatttattttatgag

SEQ ID NO: 5830010 - DNA, 15 bp, Homo sapiens
acatttatttttata

SEQ ID NO: 5830011 - DNA, 23 bp, Homo sapiens
acatttattttttttaaagaaaa

SEQ ID NO: 5830012 - DNA, 16 bp, Homo sapiens
acatttcaaaattaat

SEQ ID NO: 5830013 - DNA, 17 bp, Homo sapiens
acatttcaaatctgtag

SEQ ID NO: 5830014 - DNA, 21 bp, Homo sapiens
acatttcaaggtaaaatgtag

SEQ ID NO: 5830015 - DNA, 16 bp, Homo sapiens
acatttcaatcactga

SEQ ID NO: 5830016 - DNA, 19 bp, Homo sapiens
acatttcaatgtcagcctt

SEQ ID NO: 5830017 - DNA, 20 bp, Homo sapiens
acatttcaatgtcagccttt

SEQ ID NO: 5830018 - DNA, 21 bp, Homo sapiens
acatttcacaggctaatggga

SEQ ID NO: 5830019 - DNA, 14 bp, Homo sapiens
acatttcacctact

SEQ ID NO: 5830020 - DNA, 16 bp, Homo sapiens
acatttcactgtctgt

SEQ ID NO: 5830021 - DNA, 17 bp, Homo sapiens
acatttcacttctccaa

SEQ ID NO: 5830022 - DNA, 22 bp, Homo sapiens
acatttcagaaggtatcagtta

SEQ ID NO: 5830023 - DNA, 17 bp, Homo sapiens
acatttcagggagaaac

SEQ ID NO: 5830024 - DNA, 18 bp, Homo sapiens
acatttcataaggcctgc

SEQ ID NO: 5830025 - DNA, 22 bp, Homo sapiens
acatttcataaggcctgccctc

SEQ ID NO: 5830026 - DNA, 18 bp, Homo sapiens
acatttcatacaacagaa

SEQ ID NO: 5830027 - DNA, 17 bp, Homo sapiens
acatttcatctaattta

SEQ ID NO: 5830028 - DNA, 18 bp, Homo sapiens
acatttcatctaatttaa

SEQ ID NO: 5830029 - DNA, 12 bp, Homo sapiens
acatttcatctg

SEQ ID NO: 5830030 - DNA, 23 bp, Homo sapiens
acatttcatgtatttctttagaa

SEQ ID NO: 5830031 - DNA, 21 bp, Homo sapiens
acatttcattaaccaaagaaa

SEQ ID NO: 5830032 - DNA, 21 bp, Homo sapiens
acatttcattgtacaagtatt

SEQ ID NO: 5830033 - DNA, 16 bp, Homo sapiens
acatttccaaatgaac

SEQ ID NO: 5830034 - DNA, 21 bp, Homo sapiens
acatttccatttattgtttga

SEQ ID NO: 5830035 - DNA, 21 bp, Homo sapiens
acatttccccagacctgagct

SEQ ID NO: 5830036 - DNA, 13 bp, Homo sapiens
acatttccctgct

SEQ ID NO: 5830037 - DNA, 16 bp, Homo sapiens
acatttccgaataaag

SEQ ID NO: 5830038 - DNA, 13 bp, Homo sapiens
acatttcctctct

SEQ ID NO: 5830039 - DNA, 16 bp, Homo sapiens
acatttcctctgttct

SEQ ID NO: 5830040 - DNA, 21 bp, Homo sapiens
acatttcctttaccctccaca

SEQ ID NO: 5830041 - DNA, 16 bp, Homo sapiens
acatttcgttttttac

SEQ ID NO: 5830042 - DNA, 13 bp, Homo sapiens
acatttctaaaat

SEQ ID NO: 5830043 - DNA, 17 bp, Homo sapiens
acatttctaacatatgt

SEQ ID NO: 5830044 - DNA, 19 bp, Homo sapiens
acatttctaacatatgtat

SEQ ID NO: 5830045 - DNA, 20 bp, Homo sapiens
acatttctaactctgatgta

SEQ ID NO: 5830046 - DNA, 22 bp, Homo sapiens
acatttctaactctgatgtaaa

SEQ ID NO: 5830047 - DNA, 15 bp, Homo sapiens
acatttctataaata

SEQ ID NO: 5830048 - DNA, 19 bp, Homo sapiens
acatttctatcagtacttt

SEQ ID NO: 5830049 - DNA, 16 bp, Homo sapiens
acatttctcatgtgct

SEQ ID NO: 5830050 - DNA, 20 bp, Homo sapiens
acatttctctaactcctgcc

SEQ ID NO: 5830051 - DNA, 14 bp, Homo sapiens
acatttctctgagc

SEQ ID NO: 5830052 - DNA, 14 bp, Homo sapiens
acatttctgacacc

SEQ ID NO: 5830053 - DNA, 19 bp, Homo sapiens
acatttctgatcagaggtg

SEQ ID NO: 5830054 - DNA, 21 bp, Homo sapiens
acatttctgatcagaggtgta

SEQ ID NO: 5830055 - DNA, 16 bp, Homo sapiens
acatttctgctctcag

SEQ ID NO: 5830056 - DNA, 15 bp, Homo sapiens
acatttctggacagt

SEQ ID NO: 5830057 - DNA, 14 bp, Homo sapiens
acatttctggattg

SEQ ID NO: 5830058 - DNA, 24 bp, Homo sapiens
acatttctggccatttaactagca

SEQ ID NO: 5830059 - DNA, 15 bp, Homo sapiens
acatttctgtaaata

SEQ ID NO: 5830060 - DNA, 19 bp, Homo sapiens
acatttctgtaaataccat

SEQ ID NO: 5830061 - DNA, 13 bp, Homo sapiens
acatttctgtata

SEQ ID NO: 5830062 - DNA, 21 bp, Homo sapiens
acatttctgtatactgtaaaa

SEQ ID NO: 5830063 - DNA, 14 bp, Homo sapiens
acatttcttaaaac

SEQ ID NO: 5830064 - DNA, 15 bp, Homo sapiens
acatttcttaaaaca

SEQ ID NO: 5830065 - DNA, 20 bp, Homo sapiens
acatttcttaaaacacatga

SEQ ID NO: 5830066 - DNA, 17 bp, Homo sapiens
acatttcttaaattatt

SEQ ID NO: 5830067 - DNA, 22 bp, Homo sapiens
acatttcttaaattattttata

SEQ ID NO: 5830068 - DNA, 20 bp, Homo sapiens
acatttcttatgatttttaa

SEQ ID NO: 5830069 - DNA, 16 bp, Homo sapiens
acatttcttgttgata

SEQ ID NO: 5830070 - DNA, 21 bp, Homo sapiens
acatttctttcttgctggctc

SEQ ID NO: 5830071 - DNA, 17 bp, Homo sapiens
acatttcttttaaaata

SEQ ID NO: 5830072 - DNA, 18 bp, Homo sapiens
acatttcttttcttttta

SEQ ID NO: 5830073 - DNA, 21 bp, Homo sapiens
acatttcttttctttttacat

SEQ ID NO: 5830074 - DNA, 22 bp, Homo sapiens
acatttgaacagggcaaaatga

SEQ ID NO: 5830075 - DNA, 23 bp, Homo sapiens
acatttgaacagggcaaaatgaa

SEQ ID NO: 5830076 - DNA, 11 bp, Homo sapiens
acatttgaata

SEQ ID NO: 5830077 - DNA, 16 bp, Homo sapiens
acatttgaataatgtc

SEQ ID NO: 5830078 - DNA, 11 bp, Homo sapiens
acatttgaatt

SEQ ID NO: 5830079 - DNA, 14 bp, Homo sapiens
acatttgaattcat

SEQ ID NO: 5830080 - DNA, 16 bp, Homo sapiens
acatttgaattcattt

SEQ ID NO: 5830081 - DNA, 14 bp, Homo sapiens
acatttgaattctt

SEQ ID NO: 5830082 - DNA, 15 bp, Homo sapiens
acatttgaattcttg

SEQ ID NO: 5830083 - DNA, 15 bp, Homo sapiens
acatttgacacataa

SEQ ID NO: 5830084 - DNA, 21 bp, Homo sapiens
acatttgacacataaaagtaa

SEQ ID NO: 5830085 - DNA, 22 bp, Homo sapiens
acatttgacacataaaagtaat

SEQ ID NO: 5830086 - DNA, 21 bp, Homo sapiens
acatttgacatgagtctccag

SEQ ID NO: 5830087 - DNA, 19 bp, Homo sapiens
acatttgagccatgtcaca

SEQ ID NO: 5830088 - DNA, 11 bp, Homo sapiens
acatttgatat

SEQ ID NO: 5830089 - DNA, 22 bp, Homo sapiens
acatttgatgcatgtcttttaa

SEQ ID NO: 5830090 - DNA, 16 bp, Homo sapiens
acatttgatgtacatg

SEQ ID NO: 5830091 - DNA, 17 bp, Homo sapiens
acatttgatgtacatgt

SEQ ID NO: 5830092 - DNA, 21 bp, Homo sapiens
acatttgatttgatatacaga

SEQ ID NO: 5830093 - DNA, 16 bp, Homo sapiens
acatttgccttgcaga

SEQ ID NO: 5830094 - DNA, 23 bp, Homo sapiens
acatttgccttgcagaactgcca

SEQ ID NO: 5830095 - DNA, 14 bp, Homo sapiens
acatttgccttgct

SEQ ID NO: 5830096 - DNA, 15 bp, Homo sapiens
acatttgccttgctg

SEQ ID NO: 5830097 - DNA, 18 bp, Homo sapiens
acatttgctcatggaatt

SEQ ID NO: 5830098 - DNA, 21 bp, Homo sapiens
acatttgctttgttttctaaa

SEQ ID NO: 5830099 - DNA, 19 bp, Homo sapiens
acatttgctttttgcttgt

SEQ ID NO: 5830100 - DNA, 19 bp, Homo sapiens
acatttgctttttgtgata

SEQ ID NO: 5830101 - DNA, 16 bp, Homo sapiens
acatttggaacagtga

SEQ ID NO: 5830102 - DNA, 12 bp, Homo sapiens
acatttggaata

SEQ ID NO: 5830103 - DNA, 14 bp, Homo sapiens
acatttggagaggg

SEQ ID NO: 5830104 - DNA, 17 bp, Homo sapiens
acatttggattagaaat

SEQ ID NO: 5830105 - DNA, 20 bp, Homo sapiens
acatttggattagaaattta

SEQ ID NO: 5830106 - DNA, 21 bp, Homo sapiens
accaactgccctaagccccca

SEQ ID NO: 5830107 - DNA, 12 bp, Homo sapiens
accaactgcctt

SEQ ID NO: 5830108 - DNA, 20 bp, Homo sapiens
accaactggccctcttctta

SEQ ID NO: 5830109 - DNA, 22 bp, Homo sapiens
accaactgggcctctgatgttc

SEQ ID NO: 5830110 - DNA, 23 bp, Homo sapiens
accaactgtcactcattgctgag

SEQ ID NO: 5830111 - DNA, 20 bp, Homo sapiens
accaactgtgatgtcactga

SEQ ID NO: 5830112 - DNA, 13 bp, Homo sapiens
accaactgtgttg

SEQ ID NO: 5830113 - DNA, 15 bp, Homo sapiens
accaactgtgttgta

SEQ ID NO: 5830114 - DNA, 22 bp, Homo sapiens
accaactgtgttgtattaacaa

SEQ ID NO: 5830115 - DNA, 12 bp, Homo sapiens
accaacttacaa

SEQ ID NO: 5830116 - DNA, 19 bp, Homo sapiens
accaacttgttgtggctct

SEQ ID NO: 5830117 - DNA, 13 bp, Homo sapiens
accaactttcaag

SEQ ID NO: 5830118 - DNA, 14 bp, Homo sapiens
accaactttcaaga

SEQ ID NO: 5830119 - DNA, 14 bp, Homo sapiens
accaactttccccc

SEQ ID NO: 5830120 - DNA, 12 bp, Homo sapiens
accaactttctg

SEQ ID NO: 5830121 - DNA, 13 bp, Homo sapiens
accaactttctgt

SEQ ID NO: 5830122 - DNA, 22 bp, Homo sapiens
accaactttttccaagtccttt

SEQ ID NO: 5830123 - DNA, 16 bp, Homo sapiens
accaagaaaaagaaaa

SEQ ID NO: 5830124 - DNA, 15 bp, Homo sapiens
accaagaactgaagg

SEQ ID NO: 5830125 - DNA, 14 bp, Homo sapiens
accaagaactgcat

SEQ ID NO: 5830126 - DNA, 20 bp, Homo sapiens
accaagaagcctttcctgta

SEQ ID NO: 5830127 - DNA, 20 bp, Homo sapiens
accaagaattacaagtagaa

SEQ ID NO: 5830128 - DNA, 21 bp, Homo sapiens
accaagaattacaagtagaat

SEQ ID NO: 5830129 - DNA, 22 bp, Homo sapiens
accaagaattctccaaaacaat

SEQ ID NO: 5830130 - DNA, 14 bp, Homo sapiens
accaagacaaattc

SEQ ID NO: 5830131 - DNA, 15 bp, Homo sapiens
accaagacagtgctg

SEQ ID NO: 5830132 - DNA, 13 bp, Homo sapiens
accaagacataat

SEQ ID NO: 5830133 - DNA, 16 bp, Homo sapiens
accaagactctgaaat

SEQ ID NO: 5830134 - DNA, 13 bp, Homo sapiens
accaagagaaggg

SEQ ID NO: 5830135 - DNA, 13 bp, Homo sapiens
accaagagacaca

SEQ ID NO: 5830136 - DNA, 18 bp, Homo sapiens
accaagagattgctaatt

SEQ ID NO: 5830137 - DNA, 22 bp, Homo sapiens
accaagagattgctaattgctg

SEQ ID NO: 5830138 - DNA, 13 bp, Homo sapiens
accaagaggctgg

SEQ ID NO: 5830139 - DNA, 23 bp, Homo sapiens
accaagagtagcaccttcagaat

SEQ ID NO: 5830140 - DNA, 15 bp, Homo sapiens
accaagatacttaag

SEQ ID NO: 5830141 - DNA, 20 bp, Homo sapiens
accaagatacttaagtgctg

SEQ ID NO: 5830142 - DNA, 19 bp, Homo sapiens
accaagatgcaaatgtttt

SEQ ID NO: 5830143 - DNA, 16 bp, Homo sapiens
accaagatgccatctg

SEQ ID NO: 5830144 - DNA, 16 bp, Homo sapiens
accaagcacagcagcc

SEQ ID NO: 5830145 - DNA, 17 bp, Homo sapiens
accaagcacagcagcct

SEQ ID NO: 5830146 - DNA, 13 bp, Homo sapiens
accaagcaggaaa

SEQ ID NO: 5830147 - DNA, 14 bp, Homo sapiens
accaagcaggaagc

SEQ ID NO: 5830148 - DNA, 17 bp, Homo sapiens
accaagcaggaagctca

SEQ ID NO: 5830149 - DNA, 24 bp, Homo sapiens
accaagcaggaagctcagactggt

SEQ ID NO: 5830150 - DNA, 14 bp, Homo sapiens
accaagcatcttgg

SEQ ID NO: 5830151 - DNA, 20 bp, Homo sapiens
accaagccaagggaacctgt

SEQ ID NO: 5830152 - DNA, 19 bp, Homo sapiens
accaagccaccgcagctgc

SEQ ID NO: 5830153 - DNA, 12 bp, Homo sapiens
accaagcccagt

SEQ ID NO: 5830154 - DNA, 20 bp, Homo sapiens
accaagccggtgcccaccta

SEQ ID NO: 5830155 - DNA, 18 bp, Homo sapiens
accaagccgtggcttccc

SEQ ID NO: 5830156 - DNA, 13 bp, Homo sapiens
accaagcctctgg

SEQ ID NO: 5830157 - DNA, 19 bp, Homo sapiens
accaagctattcctttccc

SEQ ID NO: 5830158 - DNA, 14 bp, Homo sapiens
accaagctctctgc

SEQ ID NO: 5830159 - DNA, 23 bp, Homo sapiens
accaagctgagcaacctcttcag

SEQ ID NO: 5830160 - DNA, 18 bp, Homo sapiens
accaagctgagtttccta

SEQ ID NO: 5830161 - DNA, 14 bp, Homo sapiens
accaagctgctgtg

SEQ ID NO: 5830162 - DNA, 20 bp, Homo sapiens
accaagctgtacccttgaga

SEQ ID NO: 5830163 - DNA, 20 bp, Homo sapiens
accaagctgtgaccctcaat

SEQ ID NO: 5830164 - DNA, 19 bp, Homo sapiens
accaagcttaaggagagga

SEQ ID NO: 5830165 - DNA, 14 bp, Homo sapiens
accaagcttagaag

SEQ ID NO: 5830166 - DNA, 17 bp, Homo sapiens
accaagcttagtcctgg

SEQ ID NO: 5830167 - DNA, 19 bp, Homo sapiens
accaagcttagtcctggga

SEQ ID NO: 5830168 - DNA, 21 bp, Homo sapiens
accaagcttagtcctgggaga

SEQ ID NO: 5830169 - DNA, 19 bp, Homo sapiens
accaagcttcagagcctag

SEQ ID NO: 5830170 - DNA, 21 bp, Homo sapiens
accaagcttcagagcctagcc

SEQ ID NO: 5830171 - DNA, 24 bp, Homo sapiens
accaagcttcagagcctagccacc

SEQ ID NO: 5830172 - DNA, 17 bp, Homo sapiens
accaagcttgtctttaa

SEQ ID NO: 5830173 - DNA, 23 bp, Homo sapiens
accaagcttgtttccctgctggc

SEQ ID NO: 5830174 - DNA, 19 bp, Homo sapiens
accaaggaaagaacaaatg

SEQ ID NO: 5830175 - DNA, 21 bp, Homo sapiens
accaaggaacaagacccccag

SEQ ID NO: 5830176 - DNA, 19 bp, Homo sapiens
accaaggaaggagcccctg

SEQ ID NO: 5830177 - DNA, 13 bp, Homo sapiens
accaaggacccct

SEQ ID NO: 5830178 - DNA, 16 bp, Homo sapiens
accaaggacccctcac

SEQ ID NO: 5830179 - DNA, 18 bp, Homo sapiens
accaaggacccctcacct

SEQ ID NO: 5830180 - DNA, 20 bp, Homo sapiens
accaaggacggaaaatgctt

SEQ ID NO: 5830181 - DNA, 15 bp, Homo sapiens
accaaggactgagca

SEQ ID NO: 5830182 - DNA, 14 bp, Homo sapiens
accaaggaggggcc

SEQ ID NO: 5830183 - DNA, 20 bp, Homo sapiens
accaaggataattaaatata

SEQ ID NO: 5830184 - DNA, 16 bp, Homo sapiens
accaaggcaaggcagg

SEQ ID NO: 5830185 - DNA, 20 bp, Homo sapiens
accaaggcaaggcaggtgcc

SEQ ID NO: 5830186 - DNA, 21 bp, Homo sapiens
accaaggcagcctccagagcc

SEQ ID NO: 5830187 - DNA, 14 bp, Homo sapiens
accaaggcagggcc

SEQ ID NO: 5830188 - DNA, 14 bp, Homo sapiens
accaaggcagtgca

SEQ ID NO: 5830189 - DNA, 16 bp, Homo sapiens
accaaggcagtgcatg

SEQ ID NO: 5830190 - DNA, 17 bp, Homo sapiens
accaaggcagtgcatgc

SEQ ID NO: 5830191 - DNA, 23 bp, Homo sapiens
accaaggctgagacagtgaattt

SEQ ID NO: 5830192 - DNA, 14 bp, Homo sapiens
accaaggctgtgtt

SEQ ID NO: 5830193 - DNA, 16 bp, Homo sapiens
accaaggctgtgttta

SEQ ID NO: 5830194 - DNA, 20 bp, Homo sapiens
accaagggaagtgaccaagg

SEQ ID NO: 5830195 - DNA, 14 bp, Homo sapiens
accaagggcagagg

SEQ ID NO: 5830196 - DNA, 17 bp, Homo sapiens
accaagggccctcactc

SEQ ID NO: 5830197 - DNA, 13 bp, Homo sapiens
accaagggggcgg

SEQ ID NO: 5830198 - DNA, 20 bp, Homo sapiens
accaaggtctcacactcctc

SEQ ID NO: 5830199 - DNA, 22 bp, Homo sapiens
accaaggtctcacactcctcct

SEQ ID NO: 5830200 - DNA, 15 bp, Homo sapiens
accaaggtgcactga

SEQ ID NO: 5830201 - DNA, 16 bp, Homo sapiens
accaaggtgcactgag

SEQ ID NO: 5830202 - DNA, 24 bp, Homo sapiens
accaagtaaaacaaaaccactggg

SEQ ID NO: 5830203 - DNA, 23 bp, Homo sapiens
accaagtaaatctatctctatat

SEQ ID NO: 5830204 - DNA, 22 bp, Homo sapiens
accaagtaagacatctcaaata

SEQ ID NO: 5830205 - DNA, 16 bp, Homo sapiens
accaagtacagccttc

SEQ ID NO: 5830206 - DNA, 17 bp, Homo sapiens
accaagtcagacaccaa

SEQ ID NO: 5830207 - DNA, 19 bp, Homo sapiens
accaagtcaggccaggtgg

SEQ ID NO: 5830208 - DNA, 23 bp, Homo sapiens
accaagtcctggctacatcccag

SEQ ID NO: 5830209 - DNA, 12 bp, Homo sapiens
accaagtgaaat

SEQ ID NO: 5830210 - DNA, 13 bp, Homo sapiens
accaagtgcaata

SEQ ID NO: 5830211 - DNA, 23 bp, Homo sapiens
accaagtgccttgagctgcctgc

SEQ ID NO: 5830212 - DNA, 16 bp, Homo sapiens
accaagtggaccttga

SEQ ID NO: 5830213 - DNA, 14 bp, Homo sapiens
accaagtgggctgg

SEQ ID NO: 5830214 - DNA, 23 bp, Homo sapiens
accaagtgggctggtattctctc

SEQ ID NO: 5830215 - DNA, 18 bp, Homo sapiens
accaagttacttgaaaaa

SEQ ID NO: 5830216 - DNA, 23 bp, Homo sapiens
accaagttataaatcaatgtcac

SEQ ID NO: 5830217 - DNA, 21 bp, Homo sapiens
accaagttatataaagagaaa

SEQ ID NO: 5830218 - DNA, 13 bp, Homo sapiens
accaagttatctg

SEQ ID NO: 5830219 - DNA, 21 bp, Homo sapiens
accaagttatctgtttcctgt

SEQ ID NO: 5830220 - DNA, 20 bp, Homo sapiens
accaagttcattacctccct

SEQ ID NO: 5830221 - DNA, 18 bp, Homo sapiens
accaagttggtcttactt

SEQ ID NO: 5830222 - DNA, 18 bp, Homo sapiens
accaagttgtgcttttct

SEQ ID NO: 5830223 - DNA, 21 bp, Homo sapiens
accaagttgtgcttttctgtt

SEQ ID NO: 5830224 - DNA, 14 bp, Homo sapiens
accaagtttattca

SEQ ID NO: 5830225 - DNA, 15 bp, Homo sapiens
accaagtttattcag

SEQ ID NO: 5830226 - DNA, 21 bp, Homo sapiens
accaagtttattcagtaaaca

SEQ ID NO: 5830227 - DNA, 16 bp, Homo sapiens
accaataaaagccaga

SEQ ID NO: 5830228 - DNA, 13 bp, Homo sapiens
accaataaaggag

SEQ ID NO: 5830229 - DNA, 19 bp, Homo sapiens
accaataaaggaggaatca

SEQ ID NO: 5830230 - DNA, 20 bp, Homo sapiens
accaataaaggaggaatcag

SEQ ID NO: 5830231 - DNA, 11 bp, Homo sapiens
accaataaagt

SEQ ID NO: 5830232 - DNA, 17 bp, Homo sapiens
accaataaatttgtaac

SEQ ID NO: 5830233 - DNA, 12 bp, Homo sapiens
accaataacttc

SEQ ID NO: 5830234 - DNA, 20 bp, Homo sapiens
accaataacttcagagaagt

SEQ ID NO: 5830235 - DNA, 21 bp, Homo sapiens
accaataatggggcagacaca

SEQ ID NO: 5830236 - DNA, 20 bp, Homo sapiens
accaatacaaaatgtattac

SEQ ID NO: 5830237 - DNA, 14 bp, Homo sapiens
accaatacatttgt

SEQ ID NO: 5830238 - DNA, 16 bp, Homo sapiens
accaatactactgtaa

SEQ ID NO: 5830239 - DNA, 13 bp, Homo sapiens
accaatatcatgt

SEQ ID NO: 5830240 - DNA, 22 bp, Homo sapiens
accaatattaccatcttaatct

SEQ ID NO: 5830241 - DNA, 20 bp, Homo sapiens
accaatattatactaagaaa

SEQ ID NO: 5830242 - DNA, 14 bp, Homo sapiens
accaatattgtaca

SEQ ID NO: 5830243 - DNA, 15 bp, Homo sapiens
accaatattgtacag

SEQ ID NO: 5830244 - DNA, 17 bp, Homo sapiens
accaatattgtacagtt

SEQ ID NO: 5830245 - DNA, 19 bp, Homo sapiens
accaatattgtacagtttt

SEQ ID NO: 5830246 - DNA, 11 bp, Homo sapiens
accaatatttg

SEQ ID NO: 5830247 - DNA, 16 bp, Homo sapiens
accaatatttgtagaa

SEQ ID NO: 5830248 - DNA, 15 bp, Homo sapiens
accaatcaaatatat

SEQ ID NO: 5830249 - DNA, 21 bp, Homo sapiens
accaatcacaaggataataga

SEQ ID NO: 5830250 - DNA, 14 bp, Homo sapiens
accaatcatcttaa

SEQ ID NO: 5830251 - DNA, 14 bp, Homo sapiens
accaatccccagcc

SEQ ID NO: 5830252 - DNA, 18 bp, Homo sapiens
accaatcccgtgaaagaa

SEQ ID NO: 5830253 - DNA, 20 bp, Homo sapiens
accaatcctatgtcatttct

SEQ ID NO: 5830254 - DNA, 23 bp, Homo sapiens
accaatcgggagtagcaaggaag

SEQ ID NO: 5830255 - DNA, 17 bp, Homo sapiens
accaatctctgctctct

SEQ ID NO: 5830256 - DNA, 16 bp, Homo sapiens
accaatcttgtttata

SEQ ID NO: 5830257 - DNA, 23 bp, Homo sapiens
accaatgacttccatattttaaa

SEQ ID NO: 5830258 - DNA, 20 bp, Homo sapiens
accaatgactttttatttta

SEQ ID NO: 5830259 - DNA, 14 bp, Homo sapiens
accaatgagcctta

SEQ ID NO: 5830260 - DNA, 22 bp, Homo sapiens
accaatgattcataacaatgta

SEQ ID NO: 5830261 - DNA, 18 bp, Homo sapiens
accaatgcatctctttaa

SEQ ID NO: 5830262 - DNA, 22 bp, Homo sapiens
accaatgcatgcagccactgtg

SEQ ID NO: 5830263 - DNA, 22 bp, Homo sapiens
accaatgcattaccttctgttc

SEQ ID NO: 5830264 - DNA, 16 bp, Homo sapiens
accaatgccaagataa

SEQ ID NO: 5830265 - DNA, 14 bp, Homo sapiens
accaatgcccagca

SEQ ID NO: 5830266 - DNA, 15 bp, Homo sapiens
accaatgccttttta

SEQ ID NO: 5830267 - DNA, 17 bp, Homo sapiens
accaatgcctttttaga

SEQ ID NO: 5830268 - DNA, 22 bp, Homo sapiens
accaatggattcatggagtagc

SEQ ID NO: 5830269 - DNA, 19 bp, Homo sapiens
accaatgggaagcagggaa

SEQ ID NO: 5830270 - DNA, 17 bp, Homo sapiens
accaatgtaacactggc

SEQ ID NO: 5830271 - DNA, 15 bp, Homo sapiens
accaatgtcataaca

SEQ ID NO: 5830272 - DNA, 15 bp, Homo sapiens
accaattaaaaacct

SEQ ID NO: 5830273 - DNA, 14 bp, Homo sapiens
accaattaatgtag

SEQ ID NO: 5830274 - DNA, 20 bp, Homo sapiens
accaattacatggaactttt

SEQ ID NO: 5830275 - DNA, 13 bp, Homo sapiens
accaattacccat

SEQ ID NO: 5830276 - DNA, 19 bp, Homo sapiens
accaattacccataaacag

SEQ ID NO: 5830277 - DNA, 17 bp, Homo sapiens
accaattattgatatat

SEQ ID NO: 5830278 - DNA, 23 bp, Homo sapiens
accaattattgatatatattata

SEQ ID NO: 5830279 - DNA, 16 bp, Homo sapiens
accaattcaacccttt

SEQ ID NO: 5830280 - DNA, 12 bp, Homo sapiens
accaattcatga

SEQ ID NO: 5830281 - DNA, 17 bp, Homo sapiens
accaattccaccaagac

SEQ ID NO: 5830282 - DNA, 14 bp, Homo sapiens
accaattgaagcat

SEQ ID NO: 5830283 - DNA, 15 bp, Homo sapiens
accacccagcccttc

SEQ ID NO: 5830284 - DNA, 14 bp, Homo sapiens
accacccatatcat

SEQ ID NO: 5830285 - DNA, 15 bp, Homo sapiens
accacccatatcatg

SEQ ID NO: 5830286 - DNA, 18 bp, Homo sapiens
accaccccaacaaaccat

SEQ ID NO: 5830287 - DNA, 21 bp, Homo sapiens
accacccccaaacacaaaaca

SEQ ID NO: 5830288 - DNA, 15 bp, Homo sapiens
accaccccccactct

SEQ ID NO: 5830289 - DNA, 22 bp, Homo sapiens
accacccccccccatccccgct

SEQ ID NO: 5830290 - DNA, 22 bp, Homo sapiens
accacccccgagcttgcctcag

SEQ ID NO: 5830291 - DNA, 19 bp, Homo sapiens
accacccctccctctgctc

SEQ ID NO: 5830292 - DNA, 22 bp, Homo sapiens
accacccctccctctgctctca

SEQ ID NO: 5830293 - DNA, 13 bp, Homo sapiens
accacccctgcct

SEQ ID NO: 5830294 - DNA, 14 bp, Homo sapiens
accacccctgcctc

SEQ ID NO: 5830295 - DNA, 15 bp, Homo sapiens
accacccctgcctcc

SEQ ID NO: 5830296 - DNA, 18 bp, Homo sapiens
accaccccttacaattcc

SEQ ID NO: 5830297 - DNA, 16 bp, Homo sapiens
accacccgaaatgcca

SEQ ID NO: 5830298 - DNA, 16 bp, Homo sapiens
accacccggtccccac

SEQ ID NO: 5830299 - DNA, 20 bp, Homo sapiens
accaccctcactggctctcc

SEQ ID NO: 5830300 - DNA, 12 bp, Homo sapiens
accaccctcagg

SEQ ID NO: 5830301 - DNA, 16 bp, Homo sapiens
accaccctcaggtgcc

SEQ ID NO: 5830302 - DNA, 18 bp, Homo sapiens
accaccctcccctctctt

SEQ ID NO: 5830303 - DNA, 12 bp, Homo sapiens
accaccctcctt

SEQ ID NO: 5830304 - DNA, 16 bp, Homo sapiens
accaccctcgctgcca

SEQ ID NO: 5830305 - DNA, 17 bp, Homo sapiens
accaccctcgctgccac

SEQ ID NO: 5830306 - DNA, 16 bp, Homo sapiens
accaccctctggggac

SEQ ID NO: 5830307 - DNA, 13 bp, Homo sapiens
accaccctgagcc

SEQ ID NO: 5830308 - DNA, 21 bp, Homo sapiens
accaccctgccccccctaaga

SEQ ID NO: 5830309 - DNA, 14 bp, Homo sapiens
accaccctgcctgt

SEQ ID NO: 5830310 - DNA, 18 bp, Homo sapiens
accaccctgcctgtggag

SEQ ID NO: 5830311 - DNA, 14 bp, Homo sapiens
accaccctgtcttc

SEQ ID NO: 5830312 - DNA, 17 bp, Homo sapiens
accaccgaagaggaagc

SEQ ID NO: 5830313 - DNA, 17 bp, Homo sapiens
accaccgaccaactcca

SEQ ID NO: 5830314 - DNA, 16 bp, Homo sapiens
accaccgcatatgcat

SEQ ID NO: 5830315 - DNA, 21 bp, Homo sapiens
accaccgcatatgcatgccag

SEQ ID NO: 5830316 - DNA, 20 bp, Homo sapiens
accaccgcatcctcactggg

SEQ ID NO: 5830317 - DNA, 22 bp, Homo sapiens
accaccgccctcctcgctgtgc

SEQ ID NO: 5830318 - DNA, 23 bp, Homo sapiens
accaccgccctcctcgctgtgcc

SEQ ID NO: 5830319 - DNA, 21 bp, Homo sapiens
accaccgcgcccagccttttt

SEQ ID NO: 5830320 - DNA, 15 bp, Homo sapiens
accaccgcgcccctc

SEQ ID NO: 5830321 - DNA, 23 bp, Homo sapiens
accaccgcgcccctctgcgcccc

SEQ ID NO: 5830322 - DNA, 16 bp, Homo sapiens
accaccgcgcctacct

SEQ ID NO: 5830323 - DNA, 14 bp, Homo sapiens
accaccgctcccca

SEQ ID NO: 5830324 - DNA, 23 bp, Homo sapiens
accaccgctccccagcccagggt

SEQ ID NO: 5830325 - DNA, 23 bp, Homo sapiens
accaccggggcactggctgctct

SEQ ID NO: 5830326 - DNA, 17 bp, Homo sapiens
accaccgtctgtctcag

SEQ ID NO: 5830327 - DNA, 19 bp, Homo sapiens
accacctaccttacagtga

SEQ ID NO: 5830328 - DNA, 16 bp, Homo sapiens
accacctaggccactc

SEQ ID NO: 5830329 - DNA, 17 bp, Homo sapiens
accacctaggccactcc

SEQ ID NO: 5830330 - DNA, 14 bp, Homo sapiens
accacctccctcac

SEQ ID NO: 5830331 - DNA, 21 bp, Homo sapiens
accacctcctctgccagcagg

SEQ ID NO: 5830332 - DNA, 23 bp, Homo sapiens
accacctctcaatattcaataaa

SEQ ID NO: 5830333 - DNA, 14 bp, Homo sapiens
accacctctctgtc

SEQ ID NO: 5830334 - DNA, 15 bp, Homo sapiens
accacctctctgtct

SEQ ID NO: 5830335 - DNA, 16 bp, Homo sapiens
accacctctggccctg

SEQ ID NO: 5830336 - DNA, 14 bp, Homo sapiens
accacctctgtcac

SEQ ID NO: 5830337 - DNA, 15 bp, Homo sapiens
accacctctgtggca

SEQ ID NO: 5830338 - DNA, 20 bp, Homo sapiens
accacctgccagccatcaca

SEQ ID NO: 5830339 - DNA, 22 bp, Homo sapiens
accacctgcccggcccaggagc

SEQ ID NO: 5830340 - DNA, 15 bp, Homo sapiens
accacctgcttctga

SEQ ID NO: 5830341 - DNA, 12 bp, Homo sapiens
accacctgggtt

SEQ ID NO: 5830342 - DNA, 18 bp, Homo sapiens
accacctgggttcagcct

SEQ ID NO: 5830343 - DNA, 22 bp, Homo sapiens
accaccttatacatcacttcct

SEQ ID NO: 5830344 - DNA, 19 bp, Homo sapiens
accaccttcccagctctcc

SEQ ID NO: 5830345 - DNA, 21 bp, Homo sapiens
accaccttcccagctctccct

SEQ ID NO: 5830346 - DNA, 13 bp, Homo sapiens
accaccttccctc

SEQ ID NO: 5830347 - DNA, 14 bp, Homo sapiens
accaccttccctct

SEQ ID NO: 5830348 - DNA, 16 bp, Homo sapiens
accaccttcccttcct

SEQ ID NO: 5830349 - DNA, 20 bp, Homo sapiens
accaccttctgtccccagcc

SEQ ID NO: 5830350 - DNA, 21 bp, Homo sapiens
accaccttctgtccccagccc

SEQ ID NO: 5830351 - DNA, 12 bp, Homo sapiens
accaccttgcca

SEQ ID NO: 5830352 - DNA, 17 bp, Homo sapiens
accaccttggactcctc

SEQ ID NO: 5830353 - DNA, 20 bp, Homo sapiens
accacctttactgtgcttat

SEQ ID NO: 5830354 - DNA, 14 bp, Homo sapiens
accacctttcagat

SEQ ID NO: 5830355 - DNA, 17 bp, Homo sapiens
accacctttgtctctgc

SEQ ID NO: 5830356 - DNA, 21 bp, Homo sapiens
accacgaaagcacacacaaaa

SEQ ID NO: 5830357 - DNA, 16 bp, Homo sapiens
accacgacctcgtcca

SEQ ID NO: 5830358 - DNA, 14 bp, Homo sapiens
accacgaggctgcc

SEQ ID NO: 5830359 - DNA, 23 bp, Homo sapiens
accacgaggctgcccccatccag

SEQ ID NO: 5830360 - DNA, 16 bp, Homo sapiens
accacgatgtggccct

SEQ ID NO: 5830361 - DNA, 17 bp, Homo sapiens
accacgatgtggccctg

SEQ ID NO: 5830362 - DNA, 14 bp, Homo sapiens
accacgcaggaagc

SEQ ID NO: 5830363 - DNA, 13 bp, Homo sapiens
accacgcccagct

SEQ ID NO: 5830364 - DNA, 21 bp, Homo sapiens
accacgcccagctaatttttg

SEQ ID NO: 5830365 - DNA, 12 bp, Homo sapiens
accacgcccctg

SEQ ID NO: 5830366 - DNA, 21 bp, Homo sapiens
accacgcccggctaatgtttg

SEQ ID NO: 5830367 - DNA, 18 bp, Homo sapiens
accacgcccgtcctgcct

SEQ ID NO: 5830368 - DNA, 22 bp, Homo sapiens
accacgcctcttgaccaggctg

SEQ ID NO: 5830369 - DNA, 18 bp, Homo sapiens
accacgccttgaccttcc

SEQ ID NO: 5830370 - DNA, 14 bp, Homo sapiens
accacgctggacct

SEQ ID NO: 5830371 - DNA, 18 bp, Homo sapiens
accacgctggaccttgaa

SEQ ID NO: 5830372 - DNA, 16 bp, Homo sapiens
accacgctggagctgt

SEQ ID NO: 5830373 - DNA, 23 bp, Homo sapiens
accacgctggccaatttttgtac

SEQ ID NO: 5830374 - DNA, 21 bp, Homo sapiens
accacggacgtttccatcagg

SEQ ID NO: 5830375 - DNA, 13 bp, Homo sapiens
accacggccagaa

SEQ ID NO: 5830376 - DNA, 19 bp, Homo sapiens
accacggggtcgggggagg

SEQ ID NO: 5830377 - DNA, 23 bp, Homo sapiens
accacggggtcgggggaggagca

SEQ ID NO: 5830378 - DNA, 23 bp, Homo sapiens
accacgggtctgccatgctctgg

SEQ ID NO: 5830379 - DNA, 24 bp, Homo sapiens
accacggtcacacctcactgtcat

SEQ ID NO: 5830380 - DNA, 18 bp, Homo sapiens
accacggtgaaagtgctg

SEQ ID NO: 5830381 - DNA, 19 bp, Homo sapiens
accacggtgaaagtgctgc

SEQ ID NO: 5830382 - DNA, 20 bp, Homo sapiens
accacggtgaaagtgctgct

SEQ ID NO: 5830383 - DNA, 13 bp, Homo sapiens
accacgtctgcca

SEQ ID NO: 5830384 - DNA, 14 bp, Homo sapiens
accacgtctgccag

SEQ ID NO: 5830385 - DNA, 22 bp, Homo sapiens
accacgtctggctccctgcccc

SEQ ID NO: 5830386 - DNA, 23 bp, Homo sapiens
accacgtctggctccctgcccct

SEQ ID NO: 5830387 - DNA, 17 bp, Homo sapiens
accacgtggggctcact

SEQ ID NO: 5830388 - DNA, 20 bp, Homo sapiens
accacgttgggacagggagg

SEQ ID NO: 5830389 - DNA, 14 bp, Homo sapiens
accacgtttctaaa

SEQ ID NO: 5830390 - DNA, 15 bp, Homo sapiens
accacgtttctaaag

SEQ ID NO: 5830391 - DNA, 19 bp, Homo sapiens
accacgtttctaaaggcta

SEQ ID NO: 5830392 - DNA, 15 bp, Homo sapiens
accactaaccatccc

SEQ ID NO: 5830393 - DNA, 16 bp, Homo sapiens
accactaactcctgag

SEQ ID NO: 5830394 - DNA, 18 bp, Homo sapiens
accactaatttgtcactg

SEQ ID NO: 5830395 - DNA, 21 bp, Homo sapiens
accactaatttgtcactggaa

SEQ ID NO: 5830396 - DNA, 17 bp, Homo sapiens
accactacatgcagccc

SEQ ID NO: 5830397 - DNA, 17 bp, Homo sapiens
accactacattctgtta

SEQ ID NO: 5830398 - DNA, 23 bp, Homo sapiens
accactagactcaaggaagaata

SEQ ID NO: 5830399 - DNA, 15 bp, Homo sapiens
accactagcctcagg

SEQ ID NO: 5830400 - DNA, 20 bp, Homo sapiens
accactaggaatcccagagg

SEQ ID NO: 5830401 - DNA, 13 bp, Homo sapiens
accactaggcctg

SEQ ID NO: 5830402 - DNA, 14 bp, Homo sapiens
accactataaaatg

SEQ ID NO: 5830403 - DNA, 15 bp, Homo sapiens
accactatcttttgt

SEQ ID NO: 5830404 - DNA, 15 bp, Homo sapiens
accactatgaagcta

SEQ ID NO: 5830405 - DNA, 18 bp, Homo sapiens
accactatgcaaagaact

SEQ ID NO: 5830406 - DNA, 15 bp, Homo sapiens
accactcaaaggcca

SEQ ID NO: 5830407 - DNA, 12 bp, Homo sapiens
accactcagaga

SEQ ID NO: 5830408 - DNA, 20 bp, Homo sapiens
accactcagagacatgcaga

SEQ ID NO: 5830409 - DNA, 14 bp, Homo sapiens
accactcaggccac

SEQ ID NO: 5830410 - DNA, 13 bp, Homo sapiens
accactccccaac

SEQ ID NO: 5830411 - DNA, 22 bp, Homo sapiens
accactccccaacccctctcca

SEQ ID NO: 5830412 - DNA, 23 bp, Homo sapiens
accactccccaacccctctccag

SEQ ID NO: 5830413 - DNA, 16 bp, Homo sapiens
accactcctcaggaac

SEQ ID NO: 5830414 - DNA, 22 bp, Homo sapiens
accactcctcaggaacagaaca

SEQ ID NO: 5830415 - DNA, 12 bp, Homo sapiens
accactcctctc

SEQ ID NO: 5830416 - DNA, 15 bp, Homo sapiens
accactcctgcctgc

SEQ ID NO: 5830417 - DNA, 16 bp, Homo sapiens
accactcctgtccctg

SEQ ID NO: 5830418 - DNA, 17 bp, Homo sapiens
accactcctgtccctgt

SEQ ID NO: 5830419 - DNA, 21 bp, Homo sapiens
accactccttcatgtttggaa

SEQ ID NO: 5830420 - DNA, 19 bp, Homo sapiens
accactcgaggcctgcaaa

SEQ ID NO: 5830421 - DNA, 17 bp, Homo sapiens
accactcggggccccca

SEQ ID NO: 5830422 - DNA, 22 bp, Homo sapiens
accactcggggcccccatcttg

SEQ ID NO: 5830423 - DNA, 20 bp, Homo sapiens
accactctatcaagtattat

SEQ ID NO: 5830424 - DNA, 23 bp, Homo sapiens
accactctgggcacaagcagggc

SEQ ID NO: 5830425 - DNA, 13 bp, Homo sapiens
accactctgtggc

SEQ ID NO: 5830426 - DNA, 17 bp, Homo sapiens
accactctgtggccagc

SEQ ID NO: 5830427 - DNA, 23 bp, Homo sapiens
accactcttctctccaaggaaat

SEQ ID NO: 5830428 - DNA, 23 bp, Homo sapiens
accactcttctttaagccataga

SEQ ID NO: 5830429 - DNA, 14 bp, Homo sapiens
accactgaaaaaat

SEQ ID NO: 5830430 - DNA, 15 bp, Homo sapiens
accactgaaaaaata

SEQ ID NO: 5830431 - DNA, 19 bp, Homo sapiens
accactgaaaaaatatatg

SEQ ID NO: 5830432 - DNA, 17 bp, Homo sapiens
accactgaattcactcc

SEQ ID NO: 5830433 - DNA, 17 bp, Homo sapiens
accactgacagcctcca

SEQ ID NO: 5830434 - DNA, 14 bp, Homo sapiens
accactgagccctt

SEQ ID NO: 5830435 - DNA, 18 bp, Homo sapiens
accactgagcccttgcac

SEQ ID NO: 5830436 - DNA, 18 bp, Homo sapiens
accactgagctctgcctc

SEQ ID NO: 5830437 - DNA, 22 bp, Homo sapiens
accactgagctctgcctcaact

SEQ ID NO: 5830438 - DNA, 19 bp, Homo sapiens
accactgagtaccaggggc

SEQ ID NO: 5830439 - DNA, 20 bp, Homo sapiens
accactgagtaccaggggct

SEQ ID NO: 5830440 - DNA, 15 bp, Homo sapiens
accactgcaagtcct

SEQ ID NO: 5830441 - DNA, 19 bp, Homo sapiens
accactgcactccagcctg

SEQ ID NO: 5830442 - DNA, 18 bp, Homo sapiens
accactgcactctagcct

SEQ ID NO: 5830443 - DNA, 14 bp, Homo sapiens
accactgcagaaga

SEQ ID NO: 5830444 - DNA, 18 bp, Homo sapiens
accactgccattacccag

SEQ ID NO: 5830445 - DNA, 22 bp, Homo sapiens
accactgccctgcctgcccact

SEQ ID NO: 5830446 - DNA, 13 bp, Homo sapiens
accactgctaata

SEQ ID NO: 5830447 - DNA, 15 bp, Homo sapiens
accactgctaataaa

SEQ ID NO: 5830448 - DNA, 16 bp, Homo sapiens
accactgctaataaat

SEQ ID NO: 5830449 - DNA, 18 bp, Homo sapiens
accactgctatgccattt

SEQ ID NO: 5830450 - DNA, 14 bp, Homo sapiens
accactgctgagga

SEQ ID NO: 5830451 - DNA, 19 bp, Homo sapiens
accactgctgtgaacaagt

SEQ ID NO: 5830452 - DNA, 12 bp, Homo sapiens
accactgcttct

SEQ ID NO: 5830453 - DNA, 13 bp, Homo sapiens
accactggaagca

SEQ ID NO: 5830454 - DNA, 18 bp, Homo sapiens
accactggccaccaggct

SEQ ID NO: 5830455 - DNA, 19 bp, Homo sapiens
accactggccaccaggctg

SEQ ID NO: 5830456 - DNA, 12 bp, Homo sapiens
accactggccct

SEQ ID NO: 5830457 - DNA, 23 bp, Homo sapiens
accactgggccataatgttgctt

SEQ ID NO: 5830458 - DNA, 17 bp, Homo sapiens
accactgggcccctcag

SEQ ID NO: 5830459 - DNA, 19 bp, Homo sapiens
accactgggcccctcaggg

SEQ ID NO: 5830460 - DNA, 19 bp, Homo sapiens
accaggccgtcctcccggg

SEQ ID NO: 5830461 - DNA, 17 bp, Homo sapiens
accaggccgtgccttgt

SEQ ID NO: 5830462 - DNA, 18 bp, Homo sapiens
accaggccgtttgctttt

SEQ ID NO: 5830463 - DNA, 14 bp, Homo sapiens
accaggcctcactg

SEQ ID NO: 5830464 - DNA, 18 bp, Homo sapiens
accaggcctcactggctc

SEQ ID NO: 5830465 - DNA, 11 bp, Homo sapiens
accaggcctct

SEQ ID NO: 5830466 - DNA, 15 bp, Homo sapiens
accaggcctctgctg

SEQ ID NO: 5830467 - DNA, 16 bp, Homo sapiens
accaggcctggagggc

SEQ ID NO: 5830468 - DNA, 18 bp, Homo sapiens
accaggcctggagggcac

SEQ ID NO: 5830469 - DNA, 12 bp, Homo sapiens
accaggcctggc

SEQ ID NO: 5830470 - DNA, 17 bp, Homo sapiens
accaggcctggcctctg

SEQ ID NO: 5830471 - DNA, 12 bp, Homo sapiens
accaggccttca

SEQ ID NO: 5830472 - DNA, 18 bp, Homo sapiens
accaggctacagttgata

SEQ ID NO: 5830473 - DNA, 17 bp, Homo sapiens
accaggctgcagcctcc

SEQ ID NO: 5830474 - DNA, 18 bp, Homo sapiens
accaggctgcagcctcca

SEQ ID NO: 5830475 - DNA, 13 bp, Homo sapiens
accaggctgcagg

SEQ ID NO: 5830476 - DNA, 19 bp, Homo sapiens
accaggctgctcagggctg

SEQ ID NO: 5830477 - DNA, 18 bp, Homo sapiens
accaggcttcttcctaca

SEQ ID NO: 5830478 - DNA, 22 bp, Homo sapiens
accaggcttcttcctacatctt

SEQ ID NO: 5830479 - DNA, 18 bp, Homo sapiens
accaggcttgcctgggac

SEQ ID NO: 5830480 - DNA, 16 bp, Homo sapiens
accagggaagctgtcc

SEQ ID NO: 5830481 - DNA, 13 bp, Homo sapiens
accagggaccctg

SEQ ID NO: 5830482 - DNA, 14 bp, Homo sapiens
accagggactgagg

SEQ ID NO: 5830483 - DNA, 21 bp, Homo sapiens
accagggagaccgagcgcttt

SEQ ID NO: 5830484 - DNA, 14 bp, Homo sapiens
accagggagaggcc

SEQ ID NO: 5830485 - DNA, 17 bp, Homo sapiens
accagggagcttcctgg

SEQ ID NO: 5830486 - DNA, 20 bp, Homo sapiens
accagggatcacagaccaca

SEQ ID NO: 5830487 - DNA, 21 bp, Homo sapiens
accagggatcacagaccacag

SEQ ID NO: 5830488 - DNA, 22 bp, Homo sapiens
accagggatgctgggctgggcc

SEQ ID NO: 5830489 - DNA, 14 bp, Homo sapiens
accagggcaaggcc

SEQ ID NO: 5830490 - DNA, 20 bp, Homo sapiens
accagggcaaggccccttcc

SEQ ID NO: 5830491 - DNA, 22 bp, Homo sapiens
accagggcaaggccccttccac

SEQ ID NO: 5830492 - DNA, 19 bp, Homo sapiens
accagggcactgtctgcgt

SEQ ID NO: 5830493 - DNA, 20 bp, Homo sapiens
accagggcactgtctgcgtg

SEQ ID NO: 5830494 - DNA, 14 bp, Homo sapiens
accagggcagggcc

SEQ ID NO: 5830495 - DNA, 18 bp, Homo sapiens
accagggcagtgaaaatg

SEQ ID NO: 5830496 - DNA, 22 bp, Homo sapiens
accagggcatattaaaggcttt

SEQ ID NO: 5830497 - DNA, 19 bp, Homo sapiens
accagggcatctctgggct

SEQ ID NO: 5830498 - DNA, 20 bp, Homo sapiens
accagggcatctctgggctg

SEQ ID NO: 5830499 - DNA, 15 bp, Homo sapiens
accagggccagaagt

SEQ ID NO: 5830500 - DNA, 16 bp, Homo sapiens
accagggccagagcag

SEQ ID NO: 5830501 - DNA, 16 bp, Homo sapiens
accagggccgaggagg

SEQ ID NO: 5830502 - DNA, 13 bp, Homo sapiens
accagggcctttt

SEQ ID NO: 5830503 - DNA, 21 bp, Homo sapiens
accagggccttttctggcacc

SEQ ID NO: 5830504 - DNA, 17 bp, Homo sapiens
accagggctcagctcct

SEQ ID NO: 5830505 - DNA, 18 bp, Homo sapiens
accaggggaaggaaggag

SEQ ID NO: 5830506 - DNA, 23 bp, Homo sapiens
accaggggaaggaaggagggcac

SEQ ID NO: 5830507 - DNA, 15 bp, Homo sapiens
accaggggacacttt

SEQ ID NO: 5830508 - DNA, 16 bp, Homo sapiens
accaggggaggagcct

SEQ ID NO: 5830509 - DNA, 17 bp, Homo sapiens
accaggggaggagcctg

SEQ ID NO: 5830510 - DNA, 15 bp, Homo sapiens
accaggggcaggcac

SEQ ID NO: 5830511 - DNA, 17 bp, Homo sapiens
accaggggcaggcacag

SEQ ID NO: 5830512 - DNA, 19 bp, Homo sapiens
accaggggcaggcacagca

SEQ ID NO: 5830513 - DNA, 22 bp, Homo sapiens
accaggggccaacctcaggctc

SEQ ID NO: 5830514 - DNA, 18 bp, Homo sapiens
accaggggccctacctgg

SEQ ID NO: 5830515 - DNA, 19 bp, Homo sapiens
accagggggaagcaccagc

SEQ ID NO: 5830516 - DNA, 18 bp, Homo sapiens
accaggggtaccaggcac

SEQ ID NO: 5830517 - DNA, 20 bp, Homo sapiens
accaggggtgcacaataaag

SEQ ID NO: 5830518 - DNA, 21 bp, Homo sapiens
accaggggtgctcacctctgc

SEQ ID NO: 5830519 - DNA, 21 bp, Homo sapiens
accagggtccgcaccagctgc

SEQ ID NO: 5830520 - DNA, 22 bp, Homo sapiens
accagggtccgcaccagctgct

SEQ ID NO: 5830521 - DNA, 21 bp, Homo sapiens
accagggtcttacctctctgg

SEQ ID NO: 5830522 - DNA, 14 bp, Homo sapiens
accagggtggacca

SEQ ID NO: 5830523 - DNA, 20 bp, Homo sapiens
accagggtggaccaggcctg

SEQ ID NO: 5830524 - DNA, 23 bp, Homo sapiens
accagggtggaccaggcctggag

SEQ ID NO: 5830525 - DNA, 20 bp, Homo sapiens
accagggtggccacacaggc

SEQ ID NO: 5830526 - DNA, 21 bp, Homo sapiens
accagggttggcaccttcccc

SEQ ID NO: 5830527 - DNA, 17 bp, Homo sapiens
accaggtccagatgtgc

SEQ ID NO: 5830528 - DNA, 18 bp, Homo sapiens
accaggtccattttgcct

SEQ ID NO: 5830529 - DNA, 15 bp, Homo sapiens
accaggtcctgctcc

SEQ ID NO: 5830530 - DNA, 22 bp, Homo sapiens
accaggtcctgctccgctgcct

SEQ ID NO: 5830531 - DNA, 17 bp, Homo sapiens
accaggtgcatgcatgc

SEQ ID NO: 5830532 - DNA, 16 bp, Homo sapiens
accaggtgctcagccc

SEQ ID NO: 5830533 - DNA, 18 bp, Homo sapiens
accaggtgtgcctggaag

SEQ ID NO: 5830534 - DNA, 14 bp, Homo sapiens
accaggttgcagta

SEQ ID NO: 5830535 - DNA, 19 bp, Homo sapiens
accaggttgggaacatgct

SEQ ID NO: 5830536 - DNA, 19 bp, Homo sapiens
accaggttttgttccgccc

SEQ ID NO: 5830537 - DNA, 18 bp, Homo sapiens
accagtaaagtgtaacat

SEQ ID NO: 5830538 - DNA, 19 bp, Homo sapiens
accagtaaggaaatattaa

SEQ ID NO: 5830539 - DNA, 15 bp, Homo sapiens
accagtagccgctgg

SEQ ID NO: 5830540 - DNA, 15 bp, Homo sapiens
accagtagcttccca

SEQ ID NO: 5830541 - DNA, 23 bp, Homo sapiens
accagtagcttcccaaaaacagc

SEQ ID NO: 5830542 - DNA, 16 bp, Homo sapiens
accagtatggaaggga

SEQ ID NO: 5830543 - DNA, 19 bp, Homo sapiens
accagtatggaagggaggg

SEQ ID NO: 5830544 - DNA, 14 bp, Homo sapiens
accagtattgtaca

SEQ ID NO: 5830545 - DNA, 17 bp, Homo sapiens
accagtcacacattata

SEQ ID NO: 5830546 - DNA, 13 bp, Homo sapiens
accagtcacagcc

SEQ ID NO: 5830547 - DNA, 17 bp, Homo sapiens
accagtcacagccattt

SEQ ID NO: 5830548 - DNA, 20 bp, Homo sapiens
accagtcacagccatttcaa

SEQ ID NO: 5830549 - DNA, 14 bp, Homo sapiens
accagtcacatgac

SEQ ID NO: 5830550 - DNA, 21 bp, Homo sapiens
accagtcaggatgaggccccg

SEQ ID NO: 5830551 - DNA, 16 bp, Homo sapiens
accagtcatttttcag

SEQ ID NO: 5830552 - DNA, 15 bp, Homo sapiens
accagtcccagagca

SEQ ID NO: 5830553 - DNA, 14 bp, Homo sapiens
accagtcccatgct

SEQ ID NO: 5830554 - DNA, 15 bp, Homo sapiens
accagtcccatgctg

SEQ ID NO: 5830555 - DNA, 15 bp, Homo sapiens
accagtccccccacc

SEQ ID NO: 5830556 - DNA, 19 bp, Homo sapiens
accagtcccgtcgtgcagt

SEQ ID NO: 5830557 - DNA, 15 bp, Homo sapiens
accagtcctgctgcc

SEQ ID NO: 5830558 - DNA, 22 bp, Homo sapiens
accagtcctgctgcctggagtc

SEQ ID NO: 5830559 - DNA, 17 bp, Homo sapiens
accagtcgccctctgtg

SEQ ID NO: 5830560 - DNA, 19 bp, Homo sapiens
accagtcgccctctgtgcc

SEQ ID NO: 5830561 - DNA, 22 bp, Homo sapiens
accagtcgccctctgtgcctaa

SEQ ID NO: 5830562 - DNA, 23 bp, Homo sapiens
accagtctagtccgtcctggcac

SEQ ID NO: 5830563 - DNA, 20 bp, Homo sapiens
accagtctcctcactctgtc

SEQ ID NO: 5830564 - DNA, 23 bp, Homo sapiens
accagtctcctcactctgtccct

SEQ ID NO: 5830565 - DNA, 17 bp, Homo sapiens
accagtctctcaagtga

SEQ ID NO: 5830566 - DNA, 13 bp, Homo sapiens
accagtctgaagt

SEQ ID NO: 5830567 - DNA, 21 bp, Homo sapiens
accagtctgaagtttcattta

SEQ ID NO: 5830568 - DNA, 13 bp, Homo sapiens
accagtctgtgtt

SEQ ID NO: 5830569 - DNA, 21 bp, Homo sapiens
accagtctgtgtttacagaca

SEQ ID NO: 5830570 - DNA, 21 bp, Homo sapiens
accagtctttaaaggcccagc

SEQ ID NO: 5830571 - DNA, 23 bp, Homo sapiens
accagtctttaaaggcccagccc

SEQ ID NO: 5830572 - DNA, 20 bp, Homo sapiens
accagtctttcaactcattg

SEQ ID NO: 5830573 - DNA, 21 bp, Homo sapiens
accagtgaatttttgcaataa

SEQ ID NO: 5830574 - DNA, 14 bp, Homo sapiens
accagtgagtggcc

SEQ ID NO: 5830575 - DNA, 22 bp, Homo sapiens
accagtgagtggccccacctgt

SEQ ID NO: 5830576 - DNA, 18 bp, Homo sapiens
accagtgcaacagcactg

SEQ ID NO: 5830577 - DNA, 19 bp, Homo sapiens
accagtgcaggctggccag

SEQ ID NO: 5830578 - DNA, 19 bp, Homo sapiens
accagtgcatccttcatca

SEQ ID NO: 5830579 - DNA, 17 bp, Homo sapiens
accagtgccaaggacct

SEQ ID NO: 5830580 - DNA, 16 bp, Homo sapiens
accagtgccgcctgtg

SEQ ID NO: 5830581 - DNA, 18 bp, Homo sapiens
accagtgcctctccctgc

SEQ ID NO: 5830582 - DNA, 12 bp, Homo sapiens
accagtgcctta

SEQ ID NO: 5830583 - DNA, 18 bp, Homo sapiens
accagtgcgattctggat

SEQ ID NO: 5830584 - DNA, 18 bp, Homo sapiens
accagtggacctagcctg

SEQ ID NO: 5830585 - DNA, 19 bp, Homo sapiens
accagtggacctagcctgg

SEQ ID NO: 5830586 - DNA, 11 bp, Homo sapiens
accagtggccg

SEQ ID NO: 5830587 - DNA, 12 bp, Homo sapiens
accagtggcctt

SEQ ID NO: 5830588 - DNA, 21 bp, Homo sapiens
accagtggcgttgttgcatgt

SEQ ID NO: 5830589 - DNA, 16 bp, Homo sapiens
accagtggctggtctc

SEQ ID NO: 5830590 - DNA, 18 bp, Homo sapiens
accagtgggaattgctgg

SEQ ID NO: 5830591 - DNA, 22 bp, Homo sapiens
accagtgggatgggctctacct

SEQ ID NO: 5830592 - DNA, 13 bp, Homo sapiens
accagtgtacagg

SEQ ID NO: 5830593 - DNA, 19 bp, Homo sapiens
accagtgtacaggtcaccc

SEQ ID NO: 5830594 - DNA, 12 bp, Homo sapiens
accagtgtactg

SEQ ID NO: 5830595 - DNA, 14 bp, Homo sapiens
accagtgtactgct

SEQ ID NO: 5830596 - DNA, 15 bp, Homo sapiens
accagtgtactgctt

SEQ ID NO: 5830597 - DNA, 22 bp, Homo sapiens
accagtgtagcatcttcctctg

SEQ ID NO: 5830598 - DNA, 21 bp, Homo sapiens
accagtgtagccttgcccgga

SEQ ID NO: 5830599 - DNA, 18 bp, Homo sapiens
accagtgtatcaggtcag

SEQ ID NO: 5830600 - DNA, 20 bp, Homo sapiens
accagtgtcccctccactgt

SEQ ID NO: 5830601 - DNA, 19 bp, Homo sapiens
accagtgtcgtgtctgctg

SEQ ID NO: 5830602 - DNA, 22 bp, Homo sapiens
accagtgtcgtgtctgctgttg

SEQ ID NO: 5830603 - DNA, 11 bp, Homo sapiens
accagtgtgaa

SEQ ID NO: 5830604 - DNA, 12 bp, Homo sapiens
accagtgtgaac

SEQ ID NO: 5830605 - DNA, 16 bp, Homo sapiens
accagtgtgtggggga

SEQ ID NO: 5830606 - DNA, 21 bp, Homo sapiens
accagtgttaagtgacataga

SEQ ID NO: 5830607 - DNA, 18 bp, Homo sapiens
accagtgttaataaatgg

SEQ ID NO: 5830608 - DNA, 18 bp, Homo sapiens
accagtgttagtgggaag

SEQ ID NO: 5830609 - DNA, 22 bp, Homo sapiens
accagtgttagtgggaagagct

SEQ ID NO: 5830610 - DNA, 24 bp, Homo sapiens
accagtgttagtgggaagagctgg

SEQ ID NO: 5830611 - DNA, 21 bp, Homo sapiens
accagtgttcctgaagctgct

SEQ ID NO: 5830612 - DNA, 23 bp, Homo sapiens
accagtgttcctgaagctgctgt

SEQ ID NO: 5830613 - DNA, 19 bp, Homo sapiens
accagtgttgggttttttt

SEQ ID NO: 5830614 - DNA, 18 bp, Homo sapiens
accagtgttgtggattta

SEQ ID NO: 5830615 - DNA, 14 bp, Homo sapiens
accagttaagaatg

SEQ ID NO: 5830616 - DNA, 19 bp, Homo sapiens
accagttaagaatggaaga

SEQ ID NO: 5830617 - DNA, 13 bp, Homo sapiens
accagttaatttt

SEQ ID NO: 5830618 - DNA, 13 bp, Homo sapiens
accagttcagaca

SEQ ID NO: 5830619 - DNA, 15 bp, Homo sapiens
accagttcagacact

SEQ ID NO: 5830620 - DNA, 19 bp, Homo sapiens
accagttctctttgtaagg

SEQ ID NO: 5830621 - DNA, 21 bp, Homo sapiens
accagttctggccaggagctg

SEQ ID NO: 5830622 - DNA, 14 bp, Homo sapiens
accagttcttgcaa

SEQ ID NO: 5830623 - DNA, 22 bp, Homo sapiens
accagttgaactgcaggaagag

SEQ ID NO: 5830624 - DNA, 23 bp, Homo sapiens
accagttgaactgcaggaagaga

SEQ ID NO: 5830625 - DNA, 15 bp, Homo sapiens
accagttgcctttta

SEQ ID NO: 5830626 - DNA, 17 bp, Homo sapiens
accagttggcagacagc

SEQ ID NO: 5830627 - DNA, 21 bp, Homo sapiens
accagttggcagacagccgtt

SEQ ID NO: 5830628 - DNA, 16 bp, Homo sapiens
accagttggccatgat

SEQ ID NO: 5830629 - DNA, 20 bp, Homo sapiens
accagttgggagcactggag

SEQ ID NO: 5830630 - DNA, 19 bp, Homo sapiens
accagttgtatttaatttt

SEQ ID NO: 5830631 - DNA, 18 bp, Homo sapiens
accagttgttttgtcttg

SEQ ID NO: 5830632 - DNA, 13 bp, Homo sapiens
accagtttaaatt

SEQ ID NO: 5830633 - DNA, 19 bp, Homo sapiens
accagtttaacctgatgca

SEQ ID NO: 5830634 - DNA, 21 bp, Homo sapiens
accagtttagatttcaagaaa

SEQ ID NO: 5830635 - DNA, 23 bp, Homo sapiens
accagtttagctttttccttact

SEQ ID NO: 5830636 - DNA, 23 bp, Homo sapiens
accatgctgctggggaagacagt

SEQ ID NO: 5830637 - DNA, 14 bp, Homo sapiens
accatgctgggccg

SEQ ID NO: 5830638 - DNA, 18 bp, Homo sapiens
accatgctgtctggcaca

SEQ ID NO: 5830639 - DNA, 23 bp, Homo sapiens
accatgctgtctggcacagcctg

SEQ ID NO: 5830640 - DNA, 20 bp, Homo sapiens
accatggagatgaaatgcct

SEQ ID NO: 5830641 - DNA, 12 bp, Homo sapiens
accatggaggag

SEQ ID NO: 5830642 - DNA, 22 bp, Homo sapiens
accatggagtggcagcccagcc

SEQ ID NO: 5830643 - DNA, 21 bp, Homo sapiens
accatggcaagagagaaagaa

SEQ ID NO: 5830644 - DNA, 17 bp, Homo sapiens
accatggcacctttgag

SEQ ID NO: 5830645 - DNA, 22 bp, Homo sapiens
accatggccaattcagtttcac

SEQ ID NO: 5830646 - DNA, 15 bp, Homo sapiens
accatggccagccaa

SEQ ID NO: 5830647 - DNA, 15 bp, Homo sapiens
accatggctgaagga

SEQ ID NO: 5830648 - DNA, 17 bp, Homo sapiens
accatgggataaatgcc

SEQ ID NO: 5830649 - DNA, 18 bp, Homo sapiens
accatgggctcagggcca

SEQ ID NO: 5830650 - DNA, 19 bp, Homo sapiens
accatgggctcagggccag

SEQ ID NO: 5830651 - DNA, 20 bp, Homo sapiens
accatggggaagaaatctgg

SEQ ID NO: 5830652 - DNA, 16 bp, Homo sapiens
accatggtgaagtgct

SEQ ID NO: 5830653 - DNA, 19 bp, Homo sapiens
accatggttaagagtccaa

SEQ ID NO: 5830654 - DNA, 21 bp, Homo sapiens
accatggttaagagtccaaga

SEQ ID NO: 5830655 - DNA, 17 bp, Homo sapiens
accatgtaaataatctg

SEQ ID NO: 5830656 - DNA, 18 bp, Homo sapiens
accatgtaaataatctgt

SEQ ID NO: 5830657 - DNA, 17 bp, Homo sapiens
accatgtaacaaccaga

SEQ ID NO: 5830658 - DNA, 12 bp, Homo sapiens
accatgtaatgg

SEQ ID NO: 5830659 - DNA, 11 bp, Homo sapiens
accatgtacat

SEQ ID NO: 5830660 - DNA, 12 bp, Homo sapiens
accatgtagttt

SEQ ID NO: 5830661 - DNA, 17 bp, Homo sapiens
accatgtattcatccag

SEQ ID NO: 5830662 - DNA, 18 bp, Homo sapiens
accatgtattcatccaga

SEQ ID NO: 5830663 - DNA, 15 bp, Homo sapiens
accatgtattccctt

SEQ ID NO: 5830664 - DNA, 22 bp, Homo sapiens
accatgtcagcaaaaagcaaaa

SEQ ID NO: 5830665 - DNA, 15 bp, Homo sapiens
accatgtcatttcag

SEQ ID NO: 5830666 - DNA, 22 bp, Homo sapiens
accatgtgaaactctaccctga

SEQ ID NO: 5830667 - DNA, 15 bp, Homo sapiens
accatgtgactaaaa

SEQ ID NO: 5830668 - DNA, 21 bp, Homo sapiens
accatgtgccatctgtacata

SEQ ID NO: 5830669 - DNA, 19 bp, Homo sapiens
accatgtgcggagcagcct

SEQ ID NO: 5830670 - DNA, 20 bp, Homo sapiens
accatgtgcggagcagcctt

SEQ ID NO: 5830671 - DNA, 22 bp, Homo sapiens
accatgtggataactttacaga

SEQ ID NO: 5830672 - DNA, 21 bp, Homo sapiens
accatgtgtagattgcgtgga

SEQ ID NO: 5830673 - DNA, 16 bp, Homo sapiens
accatgtgtcacttgt

SEQ ID NO: 5830674 - DNA, 17 bp, Homo sapiens
accatgtgttatgtttt

SEQ ID NO: 5830675 - DNA, 15 bp, Homo sapiens
accatgttgcactgt

SEQ ID NO: 5830676 - DNA, 14 bp, Homo sapiens
accatgttgccaat

SEQ ID NO: 5830677 - DNA, 19 bp, Homo sapiens
accatgttggccaggatgg

SEQ ID NO: 5830678 - DNA, 19 bp, Homo sapiens
accatgttggccaggctgg

SEQ ID NO: 5830679 - DNA, 23 bp, Homo sapiens
accatgttggccaggcttgtctc

SEQ ID NO: 5830680 - DNA, 18 bp, Homo sapiens
accatgttggcctcttca

SEQ ID NO: 5830681 - DNA, 14 bp, Homo sapiens
accatgttggtcag

SEQ ID NO: 5830682 - DNA, 23 bp, Homo sapiens
accatgttggttgcactttgtag

SEQ ID NO: 5830683 - DNA, 12 bp, Homo sapiens
accatgtttgag

SEQ ID NO: 5830684 - DNA, 21 bp, Homo sapiens
accatgtttgagctcagaccc

SEQ ID NO: 5830685 - DNA, 20 bp, Homo sapiens
accatgtttgtggctattaa

SEQ ID NO: 5830686 - DNA, 13 bp, Homo sapiens
accattaaaccat

SEQ ID NO: 5830687 - DNA, 15 bp, Homo sapiens
accattaacattttt

SEQ ID NO: 5830688 - DNA, 20 bp, Homo sapiens
accattaagtcatgtgtgaa

SEQ ID NO: 5830689 - DNA, 14 bp, Homo sapiens
accattaatgaaaa

SEQ ID NO: 5830690 - DNA, 16 bp, Homo sapiens
accattacaaaatctt

SEQ ID NO: 5830691 - DNA, 14 bp, Homo sapiens
accattataaaatc

SEQ ID NO: 5830692 - DNA, 20 bp, Homo sapiens
accattataaaatctttcca

SEQ ID NO: 5830693 - DNA, 15 bp, Homo sapiens
accattataccagca

SEQ ID NO: 5830694 - DNA, 14 bp, Homo sapiens
accattatacttta

SEQ ID NO: 5830695 - DNA, 20 bp, Homo sapiens
accattatactttatatctg

SEQ ID NO: 5830696 - DNA, 21 bp, Homo sapiens
accattatggataaagatgag

SEQ ID NO: 5830697 - DNA, 15 bp, Homo sapiens
accattatggctttg

SEQ ID NO: 5830698 - DNA, 17 bp, Homo sapiens
accattatttaataaga

SEQ ID NO: 5830699 - DNA, 18 bp, Homo sapiens
accattatttaatttgta

SEQ ID NO: 5830700 - DNA, 12 bp, Homo sapiens
accattattttt

SEQ ID NO: 5830701 - DNA, 14 bp, Homo sapiens
accattcaattagt

SEQ ID NO: 5830702 - DNA, 13 bp, Homo sapiens
accattcacattt

SEQ ID NO: 5830703 - DNA, 14 bp, Homo sapiens
accattcacatttg

SEQ ID NO: 5830704 - DNA, 15 bp, Homo sapiens
accattcagtcaagt

SEQ ID NO: 5830705 - DNA, 17 bp, Homo sapiens
accattcatctctaaca

SEQ ID NO: 5830706 - DNA, 13 bp, Homo sapiens
accattccacatc

SEQ ID NO: 5830707 - DNA, 16 bp, Homo sapiens
accattccataatcat

SEQ ID NO: 5830708 - DNA, 12 bp, Homo sapiens
accattccccat

SEQ ID NO: 5830709 - DNA, 20 bp, Homo sapiens
accattcctatagtacttta

SEQ ID NO: 5830710 - DNA, 19 bp, Homo sapiens
accattcctgcctttaagc

SEQ ID NO: 5830711 - DNA, 20 bp, Homo sapiens
accattcctgtccctttgtt

SEQ ID NO: 5830712 - DNA, 15 bp, Homo sapiens
accattccttcaaat

SEQ ID NO: 5830713 - DNA, 21 bp, Homo sapiens
accattcctttaaattctcca

SEQ ID NO: 5830714 - DNA, 21 bp, Homo sapiens
accattctattctccagacat

SEQ ID NO: 5830715 - DNA, 22 bp, Homo sapiens
accattctattctccagacatg

SEQ ID NO: 5830716 - DNA, 20 bp, Homo sapiens
accattctcaccctgtgaaa

SEQ ID NO: 5830717 - DNA, 21 bp, Homo sapiens
accattctcaccctgtgaaac

SEQ ID NO: 5830718 - DNA, 18 bp, Homo sapiens
accattctccacctgcca

SEQ ID NO: 5830719 - DNA, 20 bp, Homo sapiens
accattctccacctgccagg

SEQ ID NO: 5830720 - DNA, 21 bp, Homo sapiens
accattctccacctgccaggg

SEQ ID NO: 5830721 - DNA, 13 bp, Homo sapiens
accattctccttc

SEQ ID NO: 5830722 - DNA, 14 bp, Homo sapiens
accattctccttcc

SEQ ID NO: 5830723 - DNA, 14 bp, Homo sapiens
accattctgcattt

SEQ ID NO: 5830724 - DNA, 19 bp, Homo sapiens
accattctttcttggtgca

SEQ ID NO: 5830725 - DNA, 20 bp, Homo sapiens
accattgaaaaaggaaaaat

SEQ ID NO: 5830726 - DNA, 22 bp, Homo sapiens
accattgaaaaaggaaaaatgt

SEQ ID NO: 5830727 - DNA, 18 bp, Homo sapiens
accattgaattcttggtt

SEQ ID NO: 5830728 - DNA, 13 bp, Homo sapiens
accattgacacat

SEQ ID NO: 5830729 - DNA, 18 bp, Homo sapiens
accattgacctcagctgc

SEQ ID NO: 5830730 - DNA, 24 bp, Homo sapiens
accattgacctcagctgcacattc

SEQ ID NO: 5830731 - DNA, 18 bp, Homo sapiens
accattgatttaatgtaa

SEQ ID NO: 5830732 - DNA, 15 bp, Homo sapiens
accattgcaacaaaa

SEQ ID NO: 5830733 - DNA, 16 bp, Homo sapiens
accattgcaacaaaat

SEQ ID NO: 5830734 - DNA, 23 bp, Homo sapiens
accattgctgctccttagctgcc

SEQ ID NO: 5830735 - DNA, 15 bp, Homo sapiens
accattgctggaaaa

SEQ ID NO: 5830736 - DNA, 15 bp, Homo sapiens
accattgcttcacta

SEQ ID NO: 5830737 - DNA, 21 bp, Homo sapiens
accattggacagtctccctga

SEQ ID NO: 5830738 - DNA, 17 bp, Homo sapiens
accattggggctcccag

SEQ ID NO: 5830739 - DNA, 16 bp, Homo sapiens
accattgtaactatta

SEQ ID NO: 5830740 - DNA, 15 bp, Homo sapiens
accattgtcttccaa

SEQ ID NO: 5830741 - DNA, 20 bp, Homo sapiens
accattgtcttccaacccca

SEQ ID NO: 5830742 - DNA, 21 bp, Homo sapiens
accattgtcttccaaccccag

SEQ ID NO: 5830743 - DNA, 23 bp, Homo sapiens
accattgtcttccaaccccagct

SEQ ID NO: 5830744 - DNA, 16 bp, Homo sapiens
accattgttcagaaga

SEQ ID NO: 5830745 - DNA, 17 bp, Homo sapiens
accattgttccttacct

SEQ ID NO: 5830746 - DNA, 22 bp, Homo sapiens
accattgttctgaatgctgctt

SEQ ID NO: 5830747 - DNA, 14 bp, Homo sapiens
accatttaacatgc

SEQ ID NO: 5830748 - DNA, 15 bp, Homo sapiens
accatttaatcattt

SEQ ID NO: 5830749 - DNA, 17 bp, Homo sapiens
accatttaattcataat

SEQ ID NO: 5830750 - DNA, 21 bp, Homo sapiens
accatttaatttcatgtatat

SEQ ID NO: 5830751 - DNA, 15 bp, Homo sapiens
accatttacatgcac

SEQ ID NO: 5830752 - DNA, 11 bp, Homo sapiens
accatttataa

SEQ ID NO: 5830753 - DNA, 16 bp, Homo sapiens
accatttatcttgaag

SEQ ID NO: 5830754 - DNA, 20 bp, Homo sapiens
accatttcagagaggccttt

SEQ ID NO: 5830755 - DNA, 21 bp, Homo sapiens
accatttcatccatatttctt

SEQ ID NO: 5830756 - DNA, 16 bp, Homo sapiens
accatttccaacagca

SEQ ID NO: 5830757 - DNA, 13 bp, Homo sapiens
accatttcctcag

SEQ ID NO: 5830758 - DNA, 18 bp, Homo sapiens
accatttctcactagtgt

SEQ ID NO: 5830759 - DNA, 17 bp, Homo sapiens
accatttcttatggaaa

SEQ ID NO: 5830760 - DNA, 16 bp, Homo sapiens
accatttcttggcatt

SEQ ID NO: 5830761 - DNA, 23 bp, Homo sapiens
accatttgaagtgtacctgtgta

SEQ ID NO: 5830762 - DNA, 22 bp, Homo sapiens
accatttgcatggctccagaaa

SEQ ID NO: 5830763 - DNA, 19 bp, Homo sapiens
accatttgctactgtacat

SEQ ID NO: 5830764 - DNA, 19 bp, Homo sapiens
accatttggcatccctggg

SEQ ID NO: 5830765 - DNA, 20 bp, Homo sapiens
accatttggcatccctgggc

SEQ ID NO: 5830766 - DNA, 19 bp, Homo sapiens
accatttgtaataaagtat

SEQ ID NO: 5830767 - DNA, 21 bp, Homo sapiens
accatttgtaataaagtatat

SEQ ID NO: 5830768 - DNA, 20 bp, Homo sapiens
accatttgtattaccattac

SEQ ID NO: 5830769 - DNA, 20 bp, Homo sapiens
accatttgtgtctctttatt

SEQ ID NO: 5830770 - DNA, 15 bp, Homo sapiens
accattttaaagtta

SEQ ID NO: 5830771 - DNA, 11 bp, Homo sapiens
accattttaca

SEQ ID NO: 5830772 - DNA, 17 bp, Homo sapiens
accattttacatttcta

SEQ ID NO: 5830773 - DNA, 17 bp, Homo sapiens
accattttataaagtgc

SEQ ID NO: 5830774 - DNA, 17 bp, Homo sapiens
accattttcccatcatc

SEQ ID NO: 5830775 - DNA, 19 bp, Homo sapiens
accattttgcgatgtgttt

SEQ ID NO: 5830776 - DNA, 21 bp, Homo sapiens
accattttggggtacccactg

SEQ ID NO: 5830777 - DNA, 22 bp, Homo sapiens
accattttggggtacccactgc

SEQ ID NO: 5830778 - DNA, 22 bp, Homo sapiens
accatttttaaagtagaagagg

SEQ ID NO: 5830779 - DNA, 15 bp, Homo sapiens
accatttttaatgag

SEQ ID NO: 5830780 - DNA, 11 bp, Homo sapiens
accatttttca

SEQ ID NO: 5830781 - DNA, 17 bp, Homo sapiens
accatttttgctgaatt

SEQ ID NO: 5830782 - DNA, 15 bp, Homo sapiens
accatttttgttact

SEQ ID NO: 5830783 - DNA, 15 bp, Homo sapiens
accattttttttaag

SEQ ID NO: 5830784 - DNA, 14 bp, Homo sapiens
accattttttttgt

SEQ ID NO: 5830785 - DNA, 18 bp, Homo sapiens
acccaaaaatatctcctc

SEQ ID NO: 5830786 - DNA, 22 bp, Homo sapiens
acccaaaaatatctcctccaat

SEQ ID NO: 5830787 - DNA, 23 bp, Homo sapiens
acccaaaaatatctcctccaatg

SEQ ID NO: 5830788 - DNA, 15 bp, Homo sapiens
acccaaaacaagcct

SEQ ID NO: 5830789 - DNA, 21 bp, Homo sapiens
acccaaaacaagcctggtagg

SEQ ID NO: 5830790 - DNA, 12 bp, Homo sapiens
acccaaaacacg

SEQ ID NO: 5830791 - DNA, 23 bp, Homo sapiens
acccaaaacacgcacaccctgcc

SEQ ID NO: 5830792 - DNA, 19 bp, Homo sapiens
acccaaaaccctgaagcca

SEQ ID NO: 5830793 - DNA, 14 bp, Homo sapiens
acccaaaagagaaa

SEQ ID NO: 5830794 - DNA, 16 bp, Homo sapiens
acccaaaagagaaaaa

SEQ ID NO: 5830795 - DNA, 17 bp, Homo sapiens
acccaaaagcacaaaat

SEQ ID NO: 5830796 - DNA, 22 bp, Homo sapiens
acccaaaagctcagccagcccc

SEQ ID NO: 5830797 - DNA, 13 bp, Homo sapiens
acccaaaaggcag

SEQ ID NO: 5830798 - DNA, 17 bp, Homo sapiens
acccaaaagtcacccag

SEQ ID NO: 5830799 - DNA, 17 bp, Homo sapiens
acccaaaatgtgaatga

SEQ ID NO: 5830800 - DNA, 17 bp, Homo sapiens
acccaaaccccctgcag

SEQ ID NO: 5830801 - DNA, 16 bp, Homo sapiens
acccaaaccccttccc

SEQ ID NO: 5830802 - DNA, 15 bp, Homo sapiens
acccaaacctggaga

SEQ ID NO: 5830803 - DNA, 18 bp, Homo sapiens
acccaaagaccaatattc

SEQ ID NO: 5830804 - DNA, 11 bp, Homo sapiens
acccaaagcag

SEQ ID NO: 5830805 - DNA, 21 bp, Homo sapiens
acccaaagcccacttcacaca

SEQ ID NO: 5830806 - DNA, 16 bp, Homo sapiens
acccaaagccctggta

SEQ ID NO: 5830807 - DNA, 21 bp, Homo sapiens
acccaaagcctgtcccaggac

SEQ ID NO: 5830808 - DNA, 17 bp, Homo sapiens
acccaaagcggtccctg

SEQ ID NO: 5830809 - DNA, 20 bp, Homo sapiens
acccaaagcggtccctgtcc

SEQ ID NO: 5830810 - DNA, 22 bp, Homo sapiens
acccaaagcggtccctgtccct

SEQ ID NO: 5830811 - DNA, 11 bp, Homo sapiens
acccaaagctg

SEQ ID NO: 5830812 - DNA, 16 bp, Homo sapiens
acccaaagctgagcct

SEQ ID NO: 5830813 - DNA, 18 bp, Homo sapiens
acccaggctggagtgcag

SEQ ID NO: 5830814 - DNA, 19 bp, Homo sapiens
acccaggctggagtgcagt

SEQ ID NO: 5830815 - DNA, 20 bp, Homo sapiens
acccaggctggagtggagtg

SEQ ID NO: 5830816 - DNA, 13 bp, Homo sapiens
acccaggctgggc

SEQ ID NO: 5830817 - DNA, 14 bp, Homo sapiens
acccaggctgggca

SEQ ID NO: 5830818 - DNA, 17 bp, Homo sapiens
acccaggctggttcttg

SEQ ID NO: 5830819 - DNA, 17 bp, Homo sapiens
acccagggacactccaa

SEQ ID NO: 5830820 - DNA, 21 bp, Homo sapiens
acccagggagaggctgtgtcc

SEQ ID NO: 5830821 - DNA, 23 bp, Homo sapiens
acccagggcccccaaagagcaag

SEQ ID NO: 5830822 - DNA, 18 bp, Homo sapiens
acccagggcccggcacag

SEQ ID NO: 5830823 - DNA, 21 bp, Homo sapiens
acccagggcctgacttgagcc

SEQ ID NO: 5830824 - DNA, 13 bp, Homo sapiens
acccagggcctgc

SEQ ID NO: 5830825 - DNA, 14 bp, Homo sapiens
acccagggcctgca

SEQ ID NO: 5830826 - DNA, 17 bp, Homo sapiens
acccagggcctgcagga

SEQ ID NO: 5830827 - DNA, 22 bp, Homo sapiens
acccagggctagtataaacatg

SEQ ID NO: 5830828 - DNA, 19 bp, Homo sapiens
acccagggctccctcctgg

SEQ ID NO: 5830829 - DNA, 12 bp, Homo sapiens
acccagggctct

SEQ ID NO: 5830830 - DNA, 13 bp, Homo sapiens
acccagggctctg

SEQ ID NO: 5830831 - DNA, 16 bp, Homo sapiens
acccagggctctgcag

SEQ ID NO: 5830832 - DNA, 18 bp, Homo sapiens
acccagggctctgcccca

SEQ ID NO: 5830833 - DNA, 20 bp, Homo sapiens
acccagggctctgccccagt

SEQ ID NO: 5830834 - DNA, 15 bp, Homo sapiens
acccagggctctgta

SEQ ID NO: 5830835 - DNA, 22 bp, Homo sapiens
acccaggggaaggccctgaggc

SEQ ID NO: 5830836 - DNA, 21 bp, Homo sapiens
acccaggggcagccccaggcc

SEQ ID NO: 5830837 - DNA, 14 bp, Homo sapiens
acccaggggtccag

SEQ ID NO: 5830838 - DNA, 19 bp, Homo sapiens
acccaggggtccaggcccc

SEQ ID NO: 5830839 - DNA, 15 bp, Homo sapiens
acccagggtcccctc

SEQ ID NO: 5830840 - DNA, 19 bp, Homo sapiens
acccagggtcccctcccca

SEQ ID NO: 5830841 - DNA, 22 bp, Homo sapiens
acccagggtctagccgctgccc

SEQ ID NO: 5830842 - DNA, 23 bp, Homo sapiens
acccagggtctagccgctgccct

SEQ ID NO: 5830843 - DNA, 20 bp, Homo sapiens
acccagggtggagtgcagtg

SEQ ID NO: 5830844 - DNA, 20 bp, Homo sapiens
acccaggtctgatgccaaag

SEQ ID NO: 5830845 - DNA, 14 bp, Homo sapiens
acccaggtctgggt

SEQ ID NO: 5830846 - DNA, 15 bp, Homo sapiens
acccaggtcttccag

SEQ ID NO: 5830847 - DNA, 16 bp, Homo sapiens
acccaggtcttccaga

SEQ ID NO: 5830848 - DNA, 21 bp, Homo sapiens
acccaggtcttccagacctgc

SEQ ID NO: 5830849 - DNA, 17 bp, Homo sapiens
acccaggtgatttcctc

SEQ ID NO: 5830850 - DNA, 23 bp, Homo sapiens
acccaggtgctaggaacactcct

SEQ ID NO: 5830851 - DNA, 15 bp, Homo sapiens
acccaggtggagggc

SEQ ID NO: 5830852 - DNA, 16 bp, Homo sapiens
acccaggtgggtcccg

SEQ ID NO: 5830853 - DNA, 14 bp, Homo sapiens
acccaggtgtgcct

SEQ ID NO: 5830854 - DNA, 16 bp, Homo sapiens
acccaggtgtgcctgt

SEQ ID NO: 5830855 - DNA, 17 bp, Homo sapiens
acccaggtgtgcctgtg

SEQ ID NO: 5830856 - DNA, 19 bp, Homo sapiens
acccaggtgtgcctgtgct

SEQ ID NO: 5830857 - DNA, 17 bp, Homo sapiens
acccaggttaagaaaat

SEQ ID NO: 5830858 - DNA, 23 bp, Homo sapiens
acccaggttcatgaatatggtgt

SEQ ID NO: 5830859 - DNA, 18 bp, Homo sapiens
acccagtattactgctgc

SEQ ID NO: 5830860 - DNA, 23 bp, Homo sapiens
acccagtattactgctgctgtgc

SEQ ID NO: 5830861 - DNA, 13 bp, Homo sapiens
acccagtcccaca

SEQ ID NO: 5830862 - DNA, 16 bp, Homo sapiens
acccagtcccacactg

SEQ ID NO: 5830863 - DNA, 13 bp, Homo sapiens
acccagtccccac

SEQ ID NO: 5830864 - DNA, 18 bp, Homo sapiens
acccagtccccacccgcc

SEQ ID NO: 5830865 - DNA, 20 bp, Homo sapiens
acccagtccccacccgcctg

SEQ ID NO: 5830866 - DNA, 17 bp, Homo sapiens
acccagtccccgtgccc

SEQ ID NO: 5830867 - DNA, 14 bp, Homo sapiens
acccagtccctggg

SEQ ID NO: 5830868 - DNA, 17 bp, Homo sapiens
acccagtcctctgcctc

SEQ ID NO: 5830869 - DNA, 19 bp, Homo sapiens
acccagtcctctgcctcca

SEQ ID NO: 5830870 - DNA, 14 bp, Homo sapiens
acccagtcgccctt

SEQ ID NO: 5830871 - DNA, 15 bp, Homo sapiens
acccagtctcctctc

SEQ ID NO: 5830872 - DNA, 19 bp, Homo sapiens
acccagtgagacagaccgc

SEQ ID NO: 5830873 - DNA, 12 bp, Homo sapiens
acccagtgcaga

SEQ ID NO: 5830874 - DNA, 15 bp, Homo sapiens
acccagtgccctctc

SEQ ID NO: 5830875 - DNA, 16 bp, Homo sapiens
acccagtgctgccatg

SEQ ID NO: 5830876 - DNA, 17 bp, Homo sapiens
acccagtgctgccatgc

SEQ ID NO: 5830877 - DNA, 22 bp, Homo sapiens
acccagtgctgccatgccactg

SEQ ID NO: 5830878 - DNA, 15 bp, Homo sapiens
acccagtggaaccaa

SEQ ID NO: 5830879 - DNA, 21 bp, Homo sapiens
acccagtggaattccaacttg

SEQ ID NO: 5830880 - DNA, 14 bp, Homo sapiens
acccagtggcaggg

SEQ ID NO: 5830881 - DNA, 19 bp, Homo sapiens
acccagtggcagggcacag

SEQ ID NO: 5830882 - DNA, 14 bp, Homo sapiens
acccagtgtaaaga

SEQ ID NO: 5830883 - DNA, 15 bp, Homo sapiens
acccagtgtaaagaa

SEQ ID NO: 5830884 - DNA, 20 bp, Homo sapiens
acccagtgtaaagaataaat

SEQ ID NO: 5830885 - DNA, 21 bp, Homo sapiens
acccagtgtaaagaataaatg

SEQ ID NO: 5830886 - DNA, 15 bp, Homo sapiens
acccagtgtccttcc

SEQ ID NO: 5830887 - DNA, 18 bp, Homo sapiens
acccagtgtctaccttca

SEQ ID NO: 5830888 - DNA, 14 bp, Homo sapiens
acccagtgtgtgct

SEQ ID NO: 5830889 - DNA, 18 bp, Homo sapiens
acccagtgtgtgctcagc

SEQ ID NO: 5830890 - DNA, 22 bp, Homo sapiens
acccagtgtgtgctcagcagcc

SEQ ID NO: 5830891 - DNA, 22 bp, Homo sapiens
acccagtgttttaggagcatga

SEQ ID NO: 5830892 - DNA, 13 bp, Homo sapiens
acccagttacttt

SEQ ID NO: 5830893 - DNA, 15 bp, Homo sapiens
acccagttctgaata

SEQ ID NO: 5830894 - DNA, 16 bp, Homo sapiens
acccagttcttcattt

SEQ ID NO: 5830895 - DNA, 18 bp, Homo sapiens
acccagttgccatctgcg

SEQ ID NO: 5830896 - DNA, 21 bp, Homo sapiens
acccagtttctaaactggaga

SEQ ID NO: 5830897 - DNA, 12 bp, Homo sapiens
acccataaacag

SEQ ID NO: 5830898 - DNA, 13 bp, Homo sapiens
acccataaacagc

SEQ ID NO: 5830899 - DNA, 15 bp, Homo sapiens
acccataaacagcac

SEQ ID NO: 5830900 - DNA, 13 bp, Homo sapiens
acccatacaatgt

SEQ ID NO: 5830901 - DNA, 18 bp, Homo sapiens
acccatacaatgtatgta

SEQ ID NO: 5830902 - DNA, 23 bp, Homo sapiens
acccatacaatgtatgtacaata

SEQ ID NO: 5830903 - DNA, 14 bp, Homo sapiens
acccatagaaaact

SEQ ID NO: 5830904 - DNA, 17 bp, Homo sapiens
acccatagatcttctga

SEQ ID NO: 5830905 - DNA, 16 bp, Homo sapiens
acccatagcttccatg

SEQ ID NO: 5830906 - DNA, 14 bp, Homo sapiens
acccatatgttaaa

SEQ ID NO: 5830907 - DNA, 22 bp, Homo sapiens
acccatattttccccctgtttt

SEQ ID NO: 5830908 - DNA, 15 bp, Homo sapiens
acccatcaacaaaaa

SEQ ID NO: 5830909 - DNA, 18 bp, Homo sapiens
acccatcacgcctgtgca

SEQ ID NO: 5830910 - DNA, 17 bp, Homo sapiens
acccatcagaaaaagca

SEQ ID NO: 5830911 - DNA, 17 bp, Homo sapiens
acccatcagtgctctgt

SEQ ID NO: 5830912 - DNA, 19 bp, Homo sapiens
acccatcagttccagcctt

SEQ ID NO: 5830913 - DNA, 20 bp, Homo sapiens
acccatccaccgtcccctcc

SEQ ID NO: 5830914 - DNA, 14 bp, Homo sapiens
acccatccagtgga

SEQ ID NO: 5830915 - DNA, 20 bp, Homo sapiens
acccatccctgcctggaggc

SEQ ID NO: 5830916 - DNA, 21 bp, Homo sapiens
acccatccctgcctggaggct

SEQ ID NO: 5830917 - DNA, 20 bp, Homo sapiens
acccatcctaccaatgcatg

SEQ ID NO: 5830918 - DNA, 15 bp, Homo sapiens
acccatcctaggaac

SEQ ID NO: 5830919 - DNA, 17 bp, Homo sapiens
acccatcctaggaacca

SEQ ID NO: 5830920 - DNA, 21 bp, Homo sapiens
acccatcggtgtccatttata

SEQ ID NO: 5830921 - DNA, 16 bp, Homo sapiens
acccatcgtccacccc

SEQ ID NO: 5830922 - DNA, 22 bp, Homo sapiens
acccatctaaaccagaaggaag

SEQ ID NO: 5830923 - DNA, 12 bp, Homo sapiens
acccatctccag

SEQ ID NO: 5830924 - DNA, 13 bp, Homo sapiens
acccatctctccc

SEQ ID NO: 5830925 - DNA, 15 bp, Homo sapiens
acccatctctccctt

SEQ ID NO: 5830926 - DNA, 13 bp, Homo sapiens
acccatctgggct

SEQ ID NO: 5830927 - DNA, 14 bp, Homo sapiens
acccatcttaaaaa

SEQ ID NO: 5830928 - DNA, 15 bp, Homo sapiens
acccatcttccccgg

SEQ ID NO: 5830929 - DNA, 16 bp, Homo sapiens
acccatcttcctgctg

SEQ ID NO: 5830930 - DNA, 14 bp, Homo sapiens
acccatcttgcttc

SEQ ID NO: 5830931 - DNA, 20 bp, Homo sapiens
acccatgaaattgaccccca

SEQ ID NO: 5830932 - DNA, 16 bp, Homo sapiens
acccatgaagctggcc

SEQ ID NO: 5830933 - DNA, 18 bp, Homo sapiens
acccatgaagctggccct

SEQ ID NO: 5830934 - DNA, 23 bp, Homo sapiens
acccatgactgccccttgcttct

SEQ ID NO: 5830935 - DNA, 15 bp, Homo sapiens
acccatgagcctgcc

SEQ ID NO: 5830936 - DNA, 16 bp, Homo sapiens
acccatgagcctgccc

SEQ ID NO: 5830937 - DNA, 13 bp, Homo sapiens
acccatgaggcaa

SEQ ID NO: 5830938 - DNA, 22 bp, Homo sapiens
acccatgagtgctaagagcctc

SEQ ID NO: 5830939 - DNA, 18 bp, Homo sapiens
acccatgatgagctcctc

SEQ ID NO: 5830940 - DNA, 20 bp, Homo sapiens
acccatgatgagctcctctt

SEQ ID NO: 5830941 - DNA, 18 bp, Homo sapiens
acccatgcaagcagagga

SEQ ID NO: 5830942 - DNA, 22 bp, Homo sapiens
acccatgcaagcagaggaccag

SEQ ID NO: 5830943 - DNA, 18 bp, Homo sapiens
acccatgcagctgctccc

SEQ ID NO: 5830944 - DNA, 18 bp, Homo sapiens
acccatgcatcttccact

SEQ ID NO: 5830945 - DNA, 16 bp, Homo sapiens
acccatgcatggcctc

SEQ ID NO: 5830946 - DNA, 13 bp, Homo sapiens
acccatgccatag

SEQ ID NO: 5830947 - DNA, 12 bp, Homo sapiens
acccatgccctg

SEQ ID NO: 5830948 - DNA, 23 bp, Homo sapiens
acccatgccctggaccagccgcc

SEQ ID NO: 5830949 - DNA, 23 bp, Homo sapiens
acccatgcgccttcgtgcctgag

SEQ ID NO: 5830950 - DNA, 14 bp, Homo sapiens
acccatggcctcag

SEQ ID NO: 5830951 - DNA, 16 bp, Homo sapiens
acccatggcctcagat

SEQ ID NO: 5830952 - DNA, 16 bp, Homo sapiens
acccatggcctcagcc

SEQ ID NO: 5830953 - DNA, 17 bp, Homo sapiens
acccatggctctatttc

SEQ ID NO: 5830954 - DNA, 19 bp, Homo sapiens
acccatggctctatttctt

SEQ ID NO: 5830955 - DNA, 13 bp, Homo sapiens
acccatggggagg

SEQ ID NO: 5830956 - DNA, 22 bp, Homo sapiens
acccatggggaggagacctttg

SEQ ID NO: 5830957 - DNA, 19 bp, Homo sapiens
acccatggtcatctctgtt

SEQ ID NO: 5830958 - DNA, 23 bp, Homo sapiens
acccatgtaaatgtccaaaatgt

SEQ ID NO: 5830959 - DNA, 14 bp, Homo sapiens
acccatgtgccaag

SEQ ID NO: 5830960 - DNA, 17 bp, Homo sapiens
acccatgtgctgggaaa

SEQ ID NO: 5830961 - DNA, 23 bp, Homo sapiens
acccatgtgggcgcccaccctgg

SEQ ID NO: 5830962 - DNA, 24 bp, Homo sapiens
acccatgtgggcgcccaccctggg

SEQ ID NO: 5830963 - DNA, 18 bp, Homo sapiens
acccatgttacttctctg

SEQ ID NO: 5830964 - DNA, 22 bp, Homo sapiens
acccatgttgagacctcagctt

SEQ ID NO: 5830965 - DNA, 22 bp, Homo sapiens
acccatgtttctgggtgggtga

SEQ ID NO: 5830966 - DNA, 22 bp, Homo sapiens
acccattaaggggaagaatgaa

SEQ ID NO: 5830967 - DNA, 19 bp, Homo sapiens
acccattaggcatgcctaa

SEQ ID NO: 5830968 - DNA, 13 bp, Homo sapiens
acccattattcct

SEQ ID NO: 5830969 - DNA, 16 bp, Homo sapiens
acccattcactacagg

SEQ ID NO: 5830970 - DNA, 21 bp, Homo sapiens
acccattcagagactgtccct

SEQ ID NO: 5830971 - DNA, 18 bp, Homo sapiens
acccattcatactaaata

SEQ ID NO: 5830972 - DNA, 20 bp, Homo sapiens
acccattcccccatgtggct

SEQ ID NO: 5830973 - DNA, 23 bp, Homo sapiens
acccattcccccatgtggctgaa

SEQ ID NO: 5830974 - DNA, 16 bp, Homo sapiens
acccattccttcccag

SEQ ID NO: 5830975 - DNA, 16 bp, Homo sapiens
acccattgcagaccct

SEQ ID NO: 5830976 - DNA, 21 bp, Homo sapiens
acccattgtctcattgccagt

SEQ ID NO: 5830977 - DNA, 23 bp, Homo sapiens
acccattgttgtcaaggaagaag

SEQ ID NO: 5830978 - DNA, 15 bp, Homo sapiens
acccatttacaaata

SEQ ID NO: 5830979 - DNA, 19 bp, Homo sapiens
acccatttacaaataagag

SEQ ID NO: 5830980 - DNA, 14 bp, Homo sapiens
acccatttgttcat

SEQ ID NO: 5830981 - DNA, 20 bp, Homo sapiens
acccattttgagtgactcga

SEQ ID NO: 5830982 - DNA, 15 bp, Homo sapiens
acccattttggtgca

SEQ ID NO: 5830983 - DNA, 18 bp, Homo sapiens
acccatttttgagccaag

SEQ ID NO: 5830984 - DNA, 22 bp, Homo sapiens
acccatttttgagccaagcttc

SEQ ID NO: 5830985 - DNA, 23 bp, Homo sapiens
accccaaaattagccagtaatcc

SEQ ID NO: 5830986 - DNA, 20 bp, Homo sapiens
accccaaacaaatggaagag

SEQ ID NO: 5830987 - DNA, 18 bp, Homo sapiens
accccaaaccccagcccc

SEQ ID NO: 5830988 - DNA, 15 bp, Homo sapiens
accccaaacttccag

SEQ ID NO: 5830989 - DNA, 17 bp, Homo sapiens
accccaaagagaaagag

SEQ ID NO: 5830990 - DNA, 20 bp, Homo sapiens
acccctcccctccatccctg

SEQ ID NO: 5830991 - DNA, 16 bp, Homo sapiens
acccctcccctgggac

SEQ ID NO: 5830992 - DNA, 17 bp, Homo sapiens
acccctcccctgggact

SEQ ID NO: 5830993 - DNA, 20 bp, Homo sapiens
acccctcccggccctgcctg

SEQ ID NO: 5830994 - DNA, 15 bp, Homo sapiens
acccctccctctgct

SEQ ID NO: 5830995 - DNA, 17 bp, Homo sapiens
acccctccctctgtcca

SEQ ID NO: 5830996 - DNA, 21 bp, Homo sapiens
acccctccctgcttgcacact

SEQ ID NO: 5830997 - DNA, 13 bp, Homo sapiens
acccctccctttc

SEQ ID NO: 5830998 - DNA, 14 bp, Homo sapiens
acccctccctttct

SEQ ID NO: 5830999 - DNA, 13 bp, Homo sapiens
acccctcctcact

SEQ ID NO: 5831000 - DNA, 19 bp, Homo sapiens
acccctcctcactggccat

SEQ ID NO: 5831001 - DNA, 17 bp, Homo sapiens
acccctcctccctcaga

SEQ ID NO: 5831002 - DNA, 18 bp, Homo sapiens
acccctcctccctcagac

SEQ ID NO: 5831003 - DNA, 22 bp, Homo sapiens
acccctcctccctcagactcag

SEQ ID NO: 5831004 - DNA, 12 bp, Homo sapiens
acccctcctcta

SEQ ID NO: 5831005 - DNA, 24 bp, Homo sapiens
acccctcctctagctctggtggga

SEQ ID NO: 5831006 - DNA, 14 bp, Homo sapiens
acccctcctgaact

SEQ ID NO: 5831007 - DNA, 21 bp, Homo sapiens
acccctcctgaactggccact

SEQ ID NO: 5831008 - DNA, 16 bp, Homo sapiens
acccctcctgggccca

SEQ ID NO: 5831009 - DNA, 19 bp, Homo sapiens
acccctcctgggcccaggc

SEQ ID NO: 5831010 - DNA, 20 bp, Homo sapiens
acccctcctggggccaggcc

SEQ ID NO: 5831011 - DNA, 21 bp, Homo sapiens
acccctcctggggccaggccg

SEQ ID NO: 5831012 - DNA, 13 bp, Homo sapiens
acccctccttccc

SEQ ID NO: 5831013 - DNA, 23 bp, Homo sapiens
acccctccttccccagacccaga

SEQ ID NO: 5831014 - DNA, 22 bp, Homo sapiens
acccctccttccctggtccaga

SEQ ID NO: 5831015 - DNA, 16 bp, Homo sapiens
acccctccttccttga

SEQ ID NO: 5831016 - DNA, 17 bp, Homo sapiens
acccctccttccttgac

SEQ ID NO: 5831017 - DNA, 16 bp, Homo sapiens
acccctcgactcagca

SEQ ID NO: 5831018 - DNA, 22 bp, Homo sapiens
acccctcgcaaccctgcctgtc

SEQ ID NO: 5831019 - DNA, 24 bp, Homo sapiens
acccctcgcccagtcccagcagcc

SEQ ID NO: 5831020 - DNA, 16 bp, Homo sapiens
acccctctaccaagct

SEQ ID NO: 5831021 - DNA, 18 bp, Homo sapiens
acccctctatttctagag

SEQ ID NO: 5831022 - DNA, 15 bp, Homo sapiens
acccctctcagcccc

SEQ ID NO: 5831023 - DNA, 17 bp, Homo sapiens
acccctctccaggcctg

SEQ ID NO: 5831024 - DNA, 19 bp, Homo sapiens
acccctctccaggcctgtc

SEQ ID NO: 5831025 - DNA, 16 bp, Homo sapiens
acccctctgcccctgc

SEQ ID NO: 5831026 - DNA, 11 bp, Homo sapiens
acccctctggt

SEQ ID NO: 5831027 - DNA, 13 bp, Homo sapiens
acccctctgtagc

SEQ ID NO: 5831028 - DNA, 23 bp, Homo sapiens
acccctctgtccagccagctcct

SEQ ID NO: 5831029 - DNA, 17 bp, Homo sapiens
acccctctgtcttcaag

SEQ ID NO: 5831030 - DNA, 18 bp, Homo sapiens
acccctcttccagcttct

SEQ ID NO: 5831031 - DNA, 15 bp, Homo sapiens
acccctcttcccacc

SEQ ID NO: 5831032 - DNA, 18 bp, Homo sapiens
acccctcttcccccttcc

SEQ ID NO: 5831033 - DNA, 17 bp, Homo sapiens
acccctcttctgctcct

SEQ ID NO: 5831034 - DNA, 23 bp, Homo sapiens
acccctgaactggccccagctcc

SEQ ID NO: 5831035 - DNA, 18 bp, Homo sapiens
acccctgagccagcaggg

SEQ ID NO: 5831036 - DNA, 15 bp, Homo sapiens
acccctgagcttgca

SEQ ID NO: 5831037 - DNA, 15 bp, Homo sapiens
acccctgatctgaca

SEQ ID NO: 5831038 - DNA, 23 bp, Homo sapiens
acccctgcacacacctgcacacc

SEQ ID NO: 5831039 - DNA, 12 bp, Homo sapiens
acccctgcactt

SEQ ID NO: 5831040 - DNA, 22 bp, Homo sapiens
acccctgcattggaactggagg

SEQ ID NO: 5831041 - DNA, 23 bp, Homo sapiens
acccctgcattggaactggaggc

SEQ ID NO: 5831042 - DNA, 12 bp, Homo sapiens
acccctgccact

SEQ ID NO: 5831043 - DNA, 17 bp, Homo sapiens
acccctgccactcaccc

SEQ ID NO: 5831044 - DNA, 14 bp, Homo sapiens
acccctgcccaggc

SEQ ID NO: 5831045 - DNA, 13 bp, Homo sapiens
acccctgcccctg

SEQ ID NO: 5831046 - DNA, 17 bp, Homo sapiens
acccctgccctcggcca

SEQ ID NO: 5831047 - DNA, 14 bp, Homo sapiens
acccctgccctggg

SEQ ID NO: 5831048 - DNA, 18 bp, Homo sapiens
acccctgccggccttggc

SEQ ID NO: 5831049 - DNA, 10 bp, Homo sapiens
acccctgcct

SEQ ID NO: 5831050 - DNA, 13 bp, Homo sapiens
acccctgcctcca

SEQ ID NO: 5831051 - DNA, 17 bp, Homo sapiens
acccctgcctccaccct

SEQ ID NO: 5831052 - DNA, 18 bp, Homo sapiens
acccctgcctccaccctc

SEQ ID NO: 5831053 - DNA, 22 bp, Homo sapiens
acccctgcctccaccctctgag

SEQ ID NO: 5831054 - DNA, 15 bp, Homo sapiens
acccctgcctcccat

SEQ ID NO: 5831055 - DNA, 21 bp, Homo sapiens
acccctgcctcccatgcctgg

SEQ ID NO: 5831056 - DNA, 13 bp, Homo sapiens
acccctgcctcct

SEQ ID NO: 5831057 - DNA, 13 bp, Homo sapiens
acccctgcctcga

SEQ ID NO: 5831058 - DNA, 14 bp, Homo sapiens
acccctgcctcgag

SEQ ID NO: 5831059 - DNA, 23 bp, Homo sapiens
acccctgcctggatttcttccta

SEQ ID NO: 5831060 - DNA, 15 bp, Homo sapiens
acccctgcctgggtt

SEQ ID NO: 5831061 - DNA, 18 bp, Homo sapiens
acccctgcctgttggcag

SEQ ID NO: 5831062 - DNA, 15 bp, Homo sapiens
acccctgccttcctc

SEQ ID NO: 5831063 - DNA, 14 bp, Homo sapiens
acccctgcctttgt

SEQ ID NO: 5831064 - DNA, 15 bp, Homo sapiens
acccctgcctttgtt

SEQ ID NO: 5831065 - DNA, 19 bp, Homo sapiens
acccctgctcccattcctc

SEQ ID NO: 5831066 - DNA, 14 bp, Homo sapiens
acccctgcttctga

SEQ ID NO: 5831067 - DNA, 22 bp, Homo sapiens
acccctgctttgggcttgggcc

SEQ ID NO: 5831068 - DNA, 23 bp, Homo sapiens
acccctggaagagcccagtctgt

SEQ ID NO: 5831069 - DNA, 19 bp, Homo sapiens
acccctggaccaccagccc

SEQ ID NO: 5831070 - DNA, 17 bp, Homo sapiens
acccctggaccccagcc

SEQ ID NO: 5831071 - DNA, 17 bp, Homo sapiens
acccctggccacagcct

SEQ ID NO: 5831072 - DNA, 13 bp, Homo sapiens
acccctggcctcc

SEQ ID NO: 5831073 - DNA, 14 bp, Homo sapiens
acccctggcctccg

SEQ ID NO: 5831074 - DNA, 16 bp, Homo sapiens
acccctggctaccttg

SEQ ID NO: 5831075 - DNA, 19 bp, Homo sapiens
acccctggctccttcacca

SEQ ID NO: 5831076 - DNA, 17 bp, Homo sapiens
acccctggcttttcact

SEQ ID NO: 5831077 - DNA, 22 bp, Homo sapiens
acccctggggctgagtctccag

SEQ ID NO: 5831078 - DNA, 17 bp, Homo sapiens
acccctgggggaggctt

SEQ ID NO: 5831079 - DNA, 15 bp, Homo sapiens
acccctgggggctct

SEQ ID NO: 5831080 - DNA, 14 bp, Homo sapiens
acccctggggtggc

SEQ ID NO: 5831081 - DNA, 17 bp, Homo sapiens
acccctggggtggccag

SEQ ID NO: 5831082 - DNA, 21 bp, Homo sapiens
acccctggggtggccagggct

SEQ ID NO: 5831083 - DNA, 18 bp, Homo sapiens
acccctgggtgggccctg

SEQ ID NO: 5831084 - DNA, 17 bp, Homo sapiens
acccctggtggctgcag

SEQ ID NO: 5831085 - DNA, 22 bp, Homo sapiens
acccctggtgtccctgcctggc

SEQ ID NO: 5831086 - DNA, 15 bp, Homo sapiens
acccctggttctcat

SEQ ID NO: 5831087 - DNA, 21 bp, Homo sapiens
acccctgtaatcaggcaagga

SEQ ID NO: 5831088 - DNA, 15 bp, Homo sapiens
acccctgtacccagc

SEQ ID NO: 5831089 - DNA, 19 bp, Homo sapiens
acccctgtacccagccacc

SEQ ID NO: 5831090 - DNA, 19 bp, Homo sapiens
acccctgtacccagctcct

SEQ ID NO: 5831091 - DNA, 15 bp, Homo sapiens
acccctgtaggcctc

SEQ ID NO: 5831092 - DNA, 15 bp, Homo sapiens
acccctgtagggaaa

SEQ ID NO: 5831093 - DNA, 23 bp, Homo sapiens
acccctgtagggaaaccttggag

SEQ ID NO: 5831094 - DNA, 21 bp, Homo sapiens
acccctgtcccatgcaggccc

SEQ ID NO: 5831095 - DNA, 15 bp, Homo sapiens
acccctgtcctcact

SEQ ID NO: 5831096 - DNA, 17 bp, Homo sapiens
acccctgtctctagcca

SEQ ID NO: 5831097 - DNA, 21 bp, Homo sapiens
acccctgtctgcgccgctgtg

SEQ ID NO: 5831098 - DNA, 17 bp, Homo sapiens
acccctgtgctcccctg

SEQ ID NO: 5831099 - DNA, 21 bp, Homo sapiens
acccctgtgctccgtgcctcc

SEQ ID NO: 5831100 - DNA, 13 bp, Homo sapiens
acccctgtggagc

SEQ ID NO: 5831101 - DNA, 10 bp, Homo sapiens
acccctgtgt

SEQ ID NO: 5831102 - DNA, 17 bp, Homo sapiens
acccctgtgtgacatca

SEQ ID NO: 5831103 - DNA, 19 bp, Homo sapiens
accccttaagccctggccc

SEQ ID NO: 5831104 - DNA, 14 bp, Homo sapiens
accccttagcctcc

SEQ ID NO: 5831105 - DNA, 11 bp, Homo sapiens
accccttaggc

SEQ ID NO: 5831106 - DNA, 14 bp, Homo sapiens
accccttaggcccc

SEQ ID NO: 5831107 - DNA, 18 bp, Homo sapiens
accccttaggccccgtgg

SEQ ID NO: 5831108 - DNA, 15 bp, Homo sapiens
accccttatccagga

SEQ ID NO: 5831109 - DNA, 17 bp, Homo sapiens
accccttatccaggact

SEQ ID NO: 5831110 - DNA, 18 bp, Homo sapiens
accccttatccaggactc

SEQ ID NO: 5831111 - DNA, 20 bp, Homo sapiens
accccttattaaggccccag

SEQ ID NO: 5831112 - DNA, 17 bp, Homo sapiens
accccttattgctgcca

SEQ ID NO: 5831113 - DNA, 19 bp, Homo sapiens
accccttattgctgccaaa

SEQ ID NO: 5831114 - DNA, 22 bp, Homo sapiens
accccttattgctgccaaaacc

SEQ ID NO: 5831115 - DNA, 18 bp, Homo sapiens
accccttcagccgagccc

SEQ ID NO: 5831116 - DNA, 22 bp, Homo sapiens
accccttcagccgagcccagac

SEQ ID NO: 5831117 - DNA, 21 bp, Homo sapiens
accccttccagatcactgcca

SEQ ID NO: 5831118 - DNA, 18 bp, Homo sapiens
accccttccccactgcct

SEQ ID NO: 5831119 - DNA, 22 bp, Homo sapiens
accccttccccactgcctgccc

SEQ ID NO: 5831120 - DNA, 23 bp, Homo sapiens
accccttccccaggcccaccatc

SEQ ID NO: 5831121 - DNA, 13 bp, Homo sapiens
accccttccccat

SEQ ID NO: 5831122 - DNA, 22 bp, Homo sapiens
accccttccccatttcctcttc

SEQ ID NO: 5831123 - DNA, 22 bp, Homo sapiens
accccttccctataggaacagc

SEQ ID NO: 5831124 - DNA, 18 bp, Homo sapiens
accccttcctcagcctgg

SEQ ID NO: 5831125 - DNA, 21 bp, Homo sapiens
accccttcctcagcctggggt

SEQ ID NO: 5831126 - DNA, 22 bp, Homo sapiens
accccttcctgggcacacgctg

SEQ ID NO: 5831127 - DNA, 23 bp, Homo sapiens
accccttcctgggcacacgctgc

SEQ ID NO: 5831128 - DNA, 15 bp, Homo sapiens
accccttcctgtcct

SEQ ID NO: 5831129 - DNA, 17 bp, Homo sapiens
accccttcctgtctggc

SEQ ID NO: 5831130 - DNA, 18 bp, Homo sapiens
accccttcctgtctggcc

SEQ ID NO: 5831131 - DNA, 22 bp, Homo sapiens
accccttcctttcctctgcagc

SEQ ID NO: 5831132 - DNA, 23 bp, Homo sapiens
accccttccttttttctttcttt

SEQ ID NO: 5831133 - DNA, 19 bp, Homo sapiens
accccttcgacatgctgcc

SEQ ID NO: 5831134 - DNA, 16 bp, Homo sapiens
accccttcgctcctgt

SEQ ID NO: 5831135 - DNA, 23 bp, Homo sapiens
accccttctctcctccccaaatc

SEQ ID NO: 5831136 - DNA, 16 bp, Homo sapiens
accccttctctctcca

SEQ ID NO: 5831137 - DNA, 13 bp, Homo sapiens
accccttctctgt

SEQ ID NO: 5831138 - DNA, 20 bp, Homo sapiens
accccttctctgtagctgct

SEQ ID NO: 5831139 - DNA, 16 bp, Homo sapiens
accccttctctgtgac

SEQ ID NO: 5831140 - DNA, 17 bp, Homo sapiens
accccttctttgcaggg

SEQ ID NO: 5831141 - DNA, 19 bp, Homo sapiens
accccttctttgcagggct

SEQ ID NO: 5831142 - DNA, 14 bp, Homo sapiens
accccttgattttc

SEQ ID NO: 5831143 - DNA, 22 bp, Homo sapiens
accccttggaaatgtctgctgg

SEQ ID NO: 5831144 - DNA, 19 bp, Homo sapiens
accccttggcccctcacat

SEQ ID NO: 5831145 - DNA, 18 bp, Homo sapiens
accccttgttgcactgcc

SEQ ID NO: 5831146 - DNA, 16 bp, Homo sapiens
acccctttaaactgtc

SEQ ID NO: 5831147 - DNA, 18 bp, Homo sapiens
acccctttccccagcctc

SEQ ID NO: 5831148 - DNA, 18 bp, Homo sapiens
acccctttcctccccata

SEQ ID NO: 5831149 - DNA, 12 bp, Homo sapiens
acccctttctag

SEQ ID NO: 5831150 - DNA, 21 bp, Homo sapiens
acccctttctagaccaataaa

SEQ ID NO: 5831151 - DNA, 11 bp, Homo sapiens
acccctttctt

SEQ ID NO: 5831152 - DNA, 13 bp, Homo sapiens
acccctttcttct

SEQ ID NO: 5831153 - DNA, 14 bp, Homo sapiens
acccctttcttctc

SEQ ID NO: 5831154 - DNA, 18 bp, Homo sapiens
acccctttggcacaccct

SEQ ID NO: 5831155 - DNA, 19 bp, Homo sapiens
accccttttcagcttctgc

SEQ ID NO: 5831156 - DNA, 20 bp, Homo sapiens
accccttttccagttgctgt

SEQ ID NO: 5831157 - DNA, 23 bp, Homo sapiens
acccgaaatgccacgtggtcact

SEQ ID NO: 5831158 - DNA, 14 bp, Homo sapiens
acccgaagcccagg

SEQ ID NO: 5831159 - DNA, 23 bp, Homo sapiens
acccgaagcccaggctgaagagt

SEQ ID NO: 5831160 - DNA, 17 bp, Homo sapiens
acccgacaacatttctg

SEQ ID NO: 5831161 - DNA, 20 bp, Homo sapiens
acccgacctggctgcccctc

SEQ ID NO: 5831162 - DNA, 15 bp, Homo sapiens
acccgactccagtcc

SEQ ID NO: 5831163 - DNA, 15 bp, Homo sapiens
acccgacttcttttg

SEQ ID NO: 5831164 - DNA, 14 bp, Homo sapiens
acccgagcccagct

SEQ ID NO: 5831165 - DNA, 15 bp, Homo sapiens
acccgagggttgatt

SEQ ID NO: 5831166 - DNA, 23 bp, Homo sapiens
acccgagttcctctgggtttcta

SEQ ID NO: 5831167 - DNA, 23 bp, Homo sapiens
accctgaaatattttctacttta

SEQ ID NO: 5831168 - DNA, 12 bp, Homo sapiens
accctgaaatgt

SEQ ID NO: 5831169 - DNA, 16 bp, Homo sapiens
accctgaacccacacc

SEQ ID NO: 5831170 - DNA, 20 bp, Homo sapiens
accctgaacccacacctggg

SEQ ID NO: 5831171 - DNA, 18 bp, Homo sapiens
accctgaaggggccatga

SEQ ID NO: 5831172 - DNA, 22 bp, Homo sapiens
accctgaatccgtacttgggtc

SEQ ID NO: 5831173 - DNA, 18 bp, Homo sapiens
accctgaattcattgtct

SEQ ID NO: 5831174 - DNA, 15 bp, Homo sapiens
accctgaatttgaga

SEQ ID NO: 5831175 - DNA, 17 bp, Homo sapiens
accctgacctgctgtgc

SEQ ID NO: 5831176 - DNA, 16 bp, Homo sapiens
accctgacctggcccc

SEQ ID NO: 5831177 - DNA, 14 bp, Homo sapiens
accctgactgtggg

SEQ ID NO: 5831178 - DNA, 21 bp, Homo sapiens
accctgagcagggtccacagc

SEQ ID NO: 5831179 - DNA, 23 bp, Homo sapiens
accctgagcagggtccacagctg

SEQ ID NO: 5831180 - DNA, 11 bp, Homo sapiens
accctgagccc

SEQ ID NO: 5831181 - DNA, 17 bp, Homo sapiens
accctgagccccttcct

SEQ ID NO: 5831182 - DNA, 22 bp, Homo sapiens
accctgagctgaccagccgtga

SEQ ID NO: 5831183 - DNA, 23 bp, Homo sapiens
accctgaggagtctgaggtcctg

SEQ ID NO: 5831184 - DNA, 17 bp, Homo sapiens
accctgaggagtgatgg

SEQ ID NO: 5831185 - DNA, 16 bp, Homo sapiens
accctgaggcccagag

SEQ ID NO: 5831186 - DNA, 17 bp, Homo sapiens
accctgaggcccagagg

SEQ ID NO: 5831187 - DNA, 15 bp, Homo sapiens
accctgaggccctgg

SEQ ID NO: 5831188 - DNA, 17 bp, Homo sapiens
accctgaggccctgggc

SEQ ID NO: 5831189 - DNA, 16 bp, Homo sapiens
accctgagggctcctc

SEQ ID NO: 5831190 - DNA, 22 bp, Homo sapiens
accctgagggtttccaccttgg

SEQ ID NO: 5831191 - DNA, 20 bp, Homo sapiens
accctgaggtatctgtgtta

SEQ ID NO: 5831192 - DNA, 18 bp, Homo sapiens
accctgaggtcactgcta

SEQ ID NO: 5831193 - DNA, 17 bp, Homo sapiens
accctgagtgaacaccc

SEQ ID NO: 5831194 - DNA, 19 bp, Homo sapiens
accctgagttgcttttcag

SEQ ID NO: 5831195 - DNA, 19 bp, Homo sapiens
accctgataggaagagggg

SEQ ID NO: 5831196 - DNA, 15 bp, Homo sapiens
accctgatccttttc

SEQ ID NO: 5831197 - DNA, 14 bp, Homo sapiens
accctgatgaaaac

SEQ ID NO: 5831198 - DNA, 14 bp, Homo sapiens
accctgatgaaacc

SEQ ID NO: 5831199 - DNA, 23 bp, Homo sapiens
accctgattcttgattcctggct

SEQ ID NO: 5831200 - DNA, 23 bp, Homo sapiens
accctgatttaggagaagccagg

SEQ ID NO: 5831201 - DNA, 19 bp, Homo sapiens
accctgcacctcattccaa

SEQ ID NO: 5831202 - DNA, 15 bp, Homo sapiens
accctgcacctgctg

SEQ ID NO: 5831203 - DNA, 23 bp, Homo sapiens
accctgcacctgctgcgtcccca

SEQ ID NO: 5831204 - DNA, 13 bp, Homo sapiens
accctgcagagct

SEQ ID NO: 5831205 - DNA, 10 bp, Homo sapiens
accctgcagg

SEQ ID NO: 5831206 - DNA, 12 bp, Homo sapiens
accctgcaggac

SEQ ID NO: 5831207 - DNA, 12 bp, Homo sapiens
accctgcaggca

SEQ ID NO: 5831208 - DNA, 18 bp, Homo sapiens
accctgcaggccaggcca

SEQ ID NO: 5831209 - DNA, 20 bp, Homo sapiens
accctgcaggccaggccagc

SEQ ID NO: 5831210 - DNA, 13 bp, Homo sapiens
accctgcaggttg

SEQ ID NO: 5831211 - DNA, 18 bp, Homo sapiens
accctgcattacatgtgt

SEQ ID NO: 5831212 - DNA, 20 bp, Homo sapiens
accctgcattacatgtgttt

SEQ ID NO: 5831213 - DNA, 20 bp, Homo sapiens
accctgccaactttccagac

SEQ ID NO: 5831214 - DNA, 20 bp, Homo sapiens
accctgccaagactcctcag

SEQ ID NO: 5831215 - DNA, 17 bp, Homo sapiens
accctgccacagccaga

SEQ ID NO: 5831216 - DNA, 19 bp, Homo sapiens
accctgccaggcacaggca

SEQ ID NO: 5831217 - DNA, 21 bp, Homo sapiens
accctgccaggcacaggcagg

SEQ ID NO: 5831218 - DNA, 23 bp, Homo sapiens
accctgccaggcacaggcagggc

SEQ ID NO: 5831219 - DNA, 12 bp, Homo sapiens
accctgccaggg

SEQ ID NO: 5831220 - DNA, 20 bp, Homo sapiens
accctgccagtgccagggtg

SEQ ID NO: 5831221 - DNA, 13 bp, Homo sapiens
accctgccatgga

SEQ ID NO: 5831222 - DNA, 22 bp, Homo sapiens
accctgccatggaactgtttcc

SEQ ID NO: 5831223 - DNA, 16 bp, Homo sapiens
accctgccatggaggc

SEQ ID NO: 5831224 - DNA, 13 bp, Homo sapiens
accctgcccaccc

SEQ ID NO: 5831225 - DNA, 21 bp, Homo sapiens
accctgcccaccccatccctg

SEQ ID NO: 5831226 - DNA, 23 bp, Homo sapiens
accctgcccaccccatccctggc

SEQ ID NO: 5831227 - DNA, 12 bp, Homo sapiens
accctgcccact

SEQ ID NO: 5831228 - DNA, 13 bp, Homo sapiens
accctgcccactc

SEQ ID NO: 5831229 - DNA, 20 bp, Homo sapiens
accctgcccagtctggaaga

SEQ ID NO: 5831230 - DNA, 23 bp, Homo sapiens
accctgcccagtctggaagaaga

SEQ ID NO: 5831231 - DNA, 20 bp, Homo sapiens
accctgcccatacccctgcc

SEQ ID NO: 5831232 - DNA, 23 bp, Homo sapiens
accctgcccatacccctgcctgg

SEQ ID NO: 5831233 - DNA, 22 bp, Homo sapiens
accctgccccaccccacctcca

SEQ ID NO: 5831234 - DNA, 20 bp, Homo sapiens
accctgccccactcctgtca

SEQ ID NO: 5831235 - DNA, 17 bp, Homo sapiens
accctgccccagctggg

SEQ ID NO: 5831236 - DNA, 11 bp, Homo sapiens
accctgcccct

SEQ ID NO: 5831237 - DNA, 17 bp, Homo sapiens
accctgcccctcagaga

SEQ ID NO: 5831238 - DNA, 22 bp, Homo sapiens
accctgcccctccccaaaagaa

SEQ ID NO: 5831239 - DNA, 14 bp, Homo sapiens
accctgcccctgca

SEQ ID NO: 5831240 - DNA, 15 bp, Homo sapiens
accctgcccctgccc

SEQ ID NO: 5831241 - DNA, 20 bp, Homo sapiens
accctgcccctttcttcccc

SEQ ID NO: 5831242 - DNA, 13 bp, Homo sapiens
accctgccctggc

SEQ ID NO: 5831243 - DNA, 14 bp, Homo sapiens
accctgccctggcc

SEQ ID NO: 5831244 - DNA, 16 bp, Homo sapiens
accctgccctggccta

SEQ ID NO: 5831245 - DNA, 15 bp, Homo sapiens
accctgccctgtggg

SEQ ID NO: 5831246 - DNA, 21 bp, Homo sapiens
accctgcccttgtttggggca

SEQ ID NO: 5831247 - DNA, 20 bp, Homo sapiens
accctgcctacgccaggaga

SEQ ID NO: 5831248 - DNA, 11 bp, Homo sapiens
accctgcctcc

SEQ ID NO: 5831249 - DNA, 14 bp, Homo sapiens
accctgcctccctt

SEQ ID NO: 5831250 - DNA, 20 bp, Homo sapiens
accctgcctcccttgacttt

SEQ ID NO: 5831251 - DNA, 15 bp, Homo sapiens
accctgcctcctccc

SEQ ID NO: 5831252 - DNA, 15 bp, Homo sapiens
accctgcctctcaga

SEQ ID NO: 5831253 - DNA, 21 bp, Homo sapiens
accctgcctctcagagggttt

SEQ ID NO: 5831254 - DNA, 16 bp, Homo sapiens
accctgcctctcccag

SEQ ID NO: 5831255 - DNA, 23 bp, Homo sapiens
accctgcctctcccaggcagggg

SEQ ID NO: 5831256 - DNA, 14 bp, Homo sapiens
accctgcctgagcc

SEQ ID NO: 5831257 - DNA, 19 bp, Homo sapiens
accctgcctgagcccagga

SEQ ID NO: 5831258 - DNA, 16 bp, Homo sapiens
accctgcctgcacctc

SEQ ID NO: 5831259 - DNA, 15 bp, Homo sapiens
accctgcctgccgct

SEQ ID NO: 5831260 - DNA, 16 bp, Homo sapiens
accctgcctgctgtgg

SEQ ID NO: 5831261 - DNA, 19 bp, Homo sapiens
accctgcctgtcacctggg

SEQ ID NO: 5831262 - DNA, 14 bp, Homo sapiens
accctgcgcccctg

SEQ ID NO: 5831263 - DNA, 14 bp, Homo sapiens
accctgcgcctcca

SEQ ID NO: 5831264 - DNA, 22 bp, Homo sapiens
accctgcgcctccagaggtcct

SEQ ID NO: 5831265 - DNA, 14 bp, Homo sapiens
accctgcgggccag

SEQ ID NO: 5831266 - DNA, 16 bp, Homo sapiens
accctgcgggccaggg

SEQ ID NO: 5831267 - DNA, 21 bp, Homo sapiens
accctgcgggccagggtcctg

SEQ ID NO: 5831268 - DNA, 14 bp, Homo sapiens
accctgctcacagg

SEQ ID NO: 5831269 - DNA, 18 bp, Homo sapiens
accctgctcatccactct

SEQ ID NO: 5831270 - DNA, 11 bp, Homo sapiens
accctgctccc

SEQ ID NO: 5831271 - DNA, 16 bp, Homo sapiens
accctgctcctagcac

SEQ ID NO: 5831272 - DNA, 21 bp, Homo sapiens
accctgctcctagcaccctgg

SEQ ID NO: 5831273 - DNA, 15 bp, Homo sapiens
accctgctcctcctg

SEQ ID NO: 5831274 - DNA, 21 bp, Homo sapiens
accctgctgaacacagtgtct

SEQ ID NO: 5831275 - DNA, 22 bp, Homo sapiens
accctgctgaacacagtgtctg

SEQ ID NO: 5831276 - DNA, 23 bp, Homo sapiens
accctgctgaacacagtgtctgt

SEQ ID NO: 5831277 - DNA, 14 bp, Homo sapiens
accctgctgctgct

SEQ ID NO: 5831278 - DNA, 16 bp, Homo sapiens
accctgctgctggtgc

SEQ ID NO: 5831279 - DNA, 19 bp, Homo sapiens
accctgctgctggtgcaca

SEQ ID NO: 5831280 - DNA, 14 bp, Homo sapiens
accctgcttaggat

SEQ ID NO: 5831281 - DNA, 23 bp, Homo sapiens
accctgcttcattgacctctact

SEQ ID NO: 5831282 - DNA, 23 bp, Homo sapiens
accctgcttcccaaactcccagg

SEQ ID NO: 5831283 - DNA, 12 bp, Homo sapiens
accctgcttctc

SEQ ID NO: 5831284 - DNA, 17 bp, Homo sapiens
accctgcttctcccggg

SEQ ID NO: 5831285 - DNA, 19 bp, Homo sapiens
accctgcttctcccgggga

SEQ ID NO: 5831286 - DNA, 20 bp, Homo sapiens
accctgcttctcccggggac

SEQ ID NO: 5831287 - DNA, 23 bp, Homo sapiens
accctgcttctcccggggacgct

SEQ ID NO: 5831288 - DNA, 15 bp, Homo sapiens
accctgcttctgctg

SEQ ID NO: 5831289 - DNA, 20 bp, Homo sapiens
accctgcttctgctgccctg

SEQ ID NO: 5831290 - DNA, 21 bp, Homo sapiens
accctgcttctgctgccctga

SEQ ID NO: 5831291 - DNA, 20 bp, Homo sapiens
accctgcttctgctgcctgt

SEQ ID NO: 5831292 - DNA, 15 bp, Homo sapiens
accctgcttggccca

SEQ ID NO: 5831293 - DNA, 18 bp, Homo sapiens
accctgcttggcccaggg

SEQ ID NO: 5831294 - DNA, 20 bp, Homo sapiens
accctgcttggggcctggcg

SEQ ID NO: 5831295 - DNA, 19 bp, Homo sapiens
accctgctttagagctagg

SEQ ID NO: 5831296 - DNA, 14 bp, Homo sapiens
accctggaaaagga

SEQ ID NO: 5831297 - DNA, 24 bp, Homo sapiens
accctggaaactaccagtgggcat

SEQ ID NO: 5831298 - DNA, 14 bp, Homo sapiens
accctggaaatgga

SEQ ID NO: 5831299 - DNA, 23 bp, Homo sapiens
accctggaaatggactggtttga

SEQ ID NO: 5831300 - DNA, 19 bp, Homo sapiens
accctggaattcagcaccc

SEQ ID NO: 5831301 - DNA, 21 bp, Homo sapiens
accctggaattcagcaccctg

SEQ ID NO: 5831302 - DNA, 17 bp, Homo sapiens
accctggaccagtggtc

SEQ ID NO: 5831303 - DNA, 20 bp, Homo sapiens
accctggaccagtggtctca

SEQ ID NO: 5831304 - DNA, 14 bp, Homo sapiens
accctggagacaga

SEQ ID NO: 5831305 - DNA, 19 bp, Homo sapiens
accctggagacagaagtca

SEQ ID NO: 5831306 - DNA, 13 bp, Homo sapiens
accctggagccat

SEQ ID NO: 5831307 - DNA, 19 bp, Homo sapiens
accctggagtatttggaag

SEQ ID NO: 5831308 - DNA, 12 bp, Homo sapiens
accctggagtgg

SEQ ID NO: 5831309 - DNA, 15 bp, Homo sapiens
accctggagttcttg

SEQ ID NO: 5831310 - DNA, 15 bp, Homo sapiens
accctggcagagaag

SEQ ID NO: 5831311 - DNA, 17 bp, Homo sapiens
accctggcagagaagag

SEQ ID NO: 5831312 - DNA, 23 bp, Homo sapiens
accctggcagggacctgagagca

SEQ ID NO: 5831313 - DNA, 22 bp, Homo sapiens
accctggccaccacccaacctg

SEQ ID NO: 5831314 - DNA, 16 bp, Homo sapiens
accctggcccctctcc

SEQ ID NO: 5831315 - DNA, 22 bp, Homo sapiens
accctggcccgcccctcgctgc

SEQ ID NO: 5831316 - DNA, 18 bp, Homo sapiens
accctggccgagtccaag

SEQ ID NO: 5831317 - DNA, 16 bp, Homo sapiens
accctggccgccccct

SEQ ID NO: 5831318 - DNA, 22 bp, Homo sapiens
accctggccgccccctgccccc

SEQ ID NO: 5831319 - DNA, 11 bp, Homo sapiens
accctggcctg

SEQ ID NO: 5831320 - DNA, 16 bp, Homo sapiens
accctggcctgagaag

SEQ ID NO: 5831321 - DNA, 20 bp, Homo sapiens
accctggcctggtccctggt

SEQ ID NO: 5831322 - DNA, 11 bp, Homo sapiens
accctggctct

SEQ ID NO: 5831323 - DNA, 13 bp, Homo sapiens
accctggctcttc

SEQ ID NO: 5831324 - DNA, 12 bp, Homo sapiens
accctggctgga

SEQ ID NO: 5831325 - DNA, 21 bp, Homo sapiens
accctggcttgcttgccgagc

SEQ ID NO: 5831326 - DNA, 12 bp, Homo sapiens
accctgggacct

SEQ ID NO: 5831327 - DNA, 23 bp, Homo sapiens
accctgggacctatacagaacag

SEQ ID NO: 5831328 - DNA, 14 bp, Homo sapiens
accctgggagacag

SEQ ID NO: 5831329 - DNA, 16 bp, Homo sapiens
accctgggagacagac

SEQ ID NO: 5831330 - DNA, 14 bp, Homo sapiens
accctgggagagaa

SEQ ID NO: 5831331 - DNA, 11 bp, Homo sapiens
accctgggcaa

SEQ ID NO: 5831332 - DNA, 19 bp, Homo sapiens
accctgggcaaacagagct

SEQ ID NO: 5831333 - DNA, 22 bp, Homo sapiens
accctgggcaatgcagtgcagc

SEQ ID NO: 5831334 - DNA, 17 bp, Homo sapiens
accctgggcagtgagtg

SEQ ID NO: 5831335 - DNA, 15 bp, Homo sapiens
accctgggccacgcc

SEQ ID NO: 5831336 - DNA, 14 bp, Homo sapiens
accctgggccctgg

SEQ ID NO: 5831337 - DNA, 15 bp, Homo sapiens
accctgggcctggca

SEQ ID NO: 5831338 - DNA, 17 bp, Homo sapiens
accctgggctccctgga

SEQ ID NO: 5831339 - DNA, 13 bp, Homo sapiens
accctgggctctg

SEQ ID NO: 5831340 - DNA, 19 bp, Homo sapiens
accctgggctctgggagca

SEQ ID NO: 5831341 - DNA, 20 bp, Homo sapiens
accctgggctctgtgggctg

SEQ ID NO: 5831342 - DNA, 18 bp, Homo sapiens
accctgggctggagagtt

SEQ ID NO: 5831343 - DNA, 15 bp, Homo sapiens
accctgggctgtcca

SEQ ID NO: 5831344 - DNA, 22 bp, Homo sapiens
accctgggctgtccagccttaa

SEQ ID NO: 5831345 - DNA, 17 bp, Homo sapiens
accgctcacctagagcc

SEQ ID NO: 5831346 - DNA, 16 bp, Homo sapiens
accgctcagtgtcagc

SEQ ID NO: 5831347 - DNA, 13 bp, Homo sapiens
accgctccccagc

SEQ ID NO: 5831348 - DNA, 18 bp, Homo sapiens
accgctccccagcccagg

SEQ ID NO: 5831349 - DNA, 16 bp, Homo sapiens
accgctctcttttctg

SEQ ID NO: 5831350 - DNA, 19 bp, Homo sapiens
accgctgccagcacagagc

SEQ ID NO: 5831351 - DNA, 16 bp, Homo sapiens
accgctgcccaggtgg

SEQ ID NO: 5831352 - DNA, 21 bp, Homo sapiens
accgctgcctaagtggctgct

SEQ ID NO: 5831353 - DNA, 22 bp, Homo sapiens
accgctgccttttgctgctgct

SEQ ID NO: 5831354 - DNA, 13 bp, Homo sapiens
accgctggctccg

SEQ ID NO: 5831355 - DNA, 14 bp, Homo sapiens
accgctggctccgc

SEQ ID NO: 5831356 - DNA, 16 bp, Homo sapiens
accgctggggaacaga

SEQ ID NO: 5831357 - DNA, 15 bp, Homo sapiens
accgctggtccctgc

SEQ ID NO: 5831358 - DNA, 19 bp, Homo sapiens
accgcttcacccctgcact

SEQ ID NO: 5831359 - DNA, 15 bp, Homo sapiens
accgcttccctcctg

SEQ ID NO: 5831360 - DNA, 15 bp, Homo sapiens
accgcttctgccttt

SEQ ID NO: 5831361 - DNA, 17 bp, Homo sapiens
accgcttctgccttttc

SEQ ID NO: 5831362 - DNA, 21 bp, Homo sapiens
accgcttgtggggacccaggc

SEQ ID NO: 5831363 - DNA, 20 bp, Homo sapiens
accggaactgggctggcgct

SEQ ID NO: 5831364 - DNA, 14 bp, Homo sapiens
accggaagctcctg

SEQ ID NO: 5831365 - DNA, 22 bp, Homo sapiens
accggaaggaggccaaccagcc

SEQ ID NO: 5831366 - DNA, 20 bp, Homo sapiens
accggaatggtcaaatctct

SEQ ID NO: 5831367 - DNA, 18 bp, Homo sapiens
accggaccagcctggccc

SEQ ID NO: 5831368 - DNA, 19 bp, Homo sapiens
accggacgctggagaccct

SEQ ID NO: 5831369 - DNA, 15 bp, Homo sapiens
accggacttttctgc

SEQ ID NO: 5831370 - DNA, 16 bp, Homo sapiens
accggacttttctgca

SEQ ID NO: 5831371 - DNA, 18 bp, Homo sapiens
accggagctccagtttct

SEQ ID NO: 5831372 - DNA, 17 bp, Homo sapiens
accggagtatgtgcagt

SEQ ID NO: 5831373 - DNA, 13 bp, Homo sapiens
accggatcctggg

SEQ ID NO: 5831374 - DNA, 14 bp, Homo sapiens
accggatggcggac

SEQ ID NO: 5831375 - DNA, 18 bp, Homo sapiens
accggcaatttccggcca

SEQ ID NO: 5831376 - DNA, 11 bp, Homo sapiens
accggcacctg

SEQ ID NO: 5831377 - DNA, 14 bp, Homo sapiens
accggcactcatga

SEQ ID NO: 5831378 - DNA, 13 bp, Homo sapiens
accggcactgtgc

SEQ ID NO: 5831379 - DNA, 17 bp, Homo sapiens
accggcatgctggcctg

SEQ ID NO: 5831380 - DNA, 22 bp, Homo sapiens
accggcatgctggcctgtggca

SEQ ID NO: 5831381 - DNA, 12 bp, Homo sapiens
accggccactgc

SEQ ID NO: 5831382 - DNA, 13 bp, Homo sapiens
accggccactgca

SEQ ID NO: 5831383 - DNA, 15 bp, Homo sapiens
accggcccctggcag

SEQ ID NO: 5831384 - DNA, 14 bp, Homo sapiens
accggccgcagccc

SEQ ID NO: 5831385 - DNA, 15 bp, Homo sapiens
accggccgcagcccc

SEQ ID NO: 5831386 - DNA, 18 bp, Homo sapiens
accggccgcagcccccac

SEQ ID NO: 5831387 - DNA, 18 bp, Homo sapiens
accggccgcatgtctgca

SEQ ID NO: 5831388 - DNA, 21 bp, Homo sapiens
accggccgcggctccccctgg

SEQ ID NO: 5831389 - DNA, 17 bp, Homo sapiens
accggcctgccaggagg

SEQ ID NO: 5831390 - DNA, 12 bp, Homo sapiens
accggcctggac

SEQ ID NO: 5831391 - DNA, 16 bp, Homo sapiens
accggcctggctgcag

SEQ ID NO: 5831392 - DNA, 23 bp, Homo sapiens
accggcctggctgcagctgggca

SEQ ID NO: 5831393 - DNA, 22 bp, Homo sapiens
accggcctgtgggtctctgaag

SEQ ID NO: 5831394 - DNA, 21 bp, Homo sapiens
accggccttgtgacattcact

SEQ ID NO: 5831395 - DNA, 23 bp, Homo sapiens
accggcggaccccagccatccag

SEQ ID NO: 5831396 - DNA, 19 bp, Homo sapiens
accggctcaggagagggcc

SEQ ID NO: 5831397 - DNA, 21 bp, Homo sapiens
accggctcaggagagggcctt

SEQ ID NO: 5831398 - DNA, 21 bp, Homo sapiens
accggctctcacctggccctg

SEQ ID NO: 5831399 - DNA, 15 bp, Homo sapiens
accggctggcctggc

SEQ ID NO: 5831400 - DNA, 17 bp, Homo sapiens
accggctggcctggccc

SEQ ID NO: 5831401 - DNA, 19 bp, Homo sapiens
accggctttaccaaaccgc

SEQ ID NO: 5831402 - DNA, 23 bp, Homo sapiens
accgggaagggtggcctgttccc

SEQ ID NO: 5831403 - DNA, 16 bp, Homo sapiens
accgggacagacctgg

SEQ ID NO: 5831404 - DNA, 14 bp, Homo sapiens
accgggaccccctc

SEQ ID NO: 5831405 - DNA, 19 bp, Homo sapiens
accgggagaaggcatgaga

SEQ ID NO: 5831406 - DNA, 19 bp, Homo sapiens
accgggagcctccccctca

SEQ ID NO: 5831407 - DNA, 19 bp, Homo sapiens
accgggatgaacctatcct

SEQ ID NO: 5831408 - DNA, 16 bp, Homo sapiens
accgggcactcagaag

SEQ ID NO: 5831409 - DNA, 22 bp, Homo sapiens
accgggcatgtctgcctggagt

SEQ ID NO: 5831410 - DNA, 15 bp, Homo sapiens
accgggccacagaga

SEQ ID NO: 5831411 - DNA, 12 bp, Homo sapiens
accgggccactc

SEQ ID NO: 5831412 - DNA, 22 bp, Homo sapiens
accgggccagtatctatatatg

SEQ ID NO: 5831413 - DNA, 15 bp, Homo sapiens
accgggccctgggtt

SEQ ID NO: 5831414 - DNA, 21 bp, Homo sapiens
accgggcgcatgcctcccagg

SEQ ID NO: 5831415 - DNA, 14 bp, Homo sapiens
accgggctgcaggt

SEQ ID NO: 5831416 - DNA, 13 bp, Homo sapiens
accgggcttcctc

SEQ ID NO: 5831417 - DNA, 14 bp, Homo sapiens
accggggcaagagg

SEQ ID NO: 5831418 - DNA, 18 bp, Homo sapiens
accggggcactggctgct

SEQ ID NO: 5831419 - DNA, 19 bp, Homo sapiens
accggggcctgggcaggag

SEQ ID NO: 5831420 - DNA, 13 bp, Homo sapiens
accgggggccaga

SEQ ID NO: 5831421 - DNA, 14 bp, Homo sapiens
accgggggctgctg

SEQ ID NO: 5831422 - DNA, 20 bp, Homo sapiens
accgggtgggcctggcctga

SEQ ID NO: 5831423 - DNA, 22 bp, Homo sapiens
accgggtgggcctggcctgagc

SEQ ID NO: 5831424 - DNA, 16 bp, Homo sapiens
accggtcagtgccttt

SEQ ID NO: 5831425 - DNA, 17 bp, Homo sapiens
accggtccagctggcct

SEQ ID NO: 5831426 - DNA, 15 bp, Homo sapiens
accggtcccagcctg

SEQ ID NO: 5831427 - DNA, 14 bp, Homo sapiens
accggtcccttcca

SEQ ID NO: 5831428 - DNA, 13 bp, Homo sapiens
accggtgccaaac

SEQ ID NO: 5831429 - DNA, 12 bp, Homo sapiens
accggtgcctcc

SEQ ID NO: 5831430 - DNA, 13 bp, Homo sapiens
accggtgcctcct

SEQ ID NO: 5831431 - DNA, 13 bp, Homo sapiens
accggtgggcagt

SEQ ID NO: 5831432 - DNA, 20 bp, Homo sapiens
accggttatcagttggacag

SEQ ID NO: 5831433 - DNA, 15 bp, Homo sapiens
accggttcccacaag

SEQ ID NO: 5831434 - DNA, 15 bp, Homo sapiens
accggttgcttctgg

SEQ ID NO: 5831435 - DNA, 16 bp, Homo sapiens
accggttgcttctggg

SEQ ID NO: 5831436 - DNA, 18 bp, Homo sapiens
accggttgcttctgggaa

SEQ ID NO: 5831437 - DNA, 21 bp, Homo sapiens
accgtaattgctttgtgcctt

SEQ ID NO: 5831438 - DNA, 14 bp, Homo sapiens
accgtaattttatt

SEQ ID NO: 5831439 - DNA, 16 bp, Homo sapiens
accgtacaaccccctc

SEQ ID NO: 5831440 - DNA, 19 bp, Homo sapiens
accgtactccctgcaccgt

SEQ ID NO: 5831441 - DNA, 13 bp, Homo sapiens
accgtactctcac

SEQ ID NO: 5831442 - DNA, 13 bp, Homo sapiens
accgtagcctccg

SEQ ID NO: 5831443 - DNA, 19 bp, Homo sapiens
accgtagcgtatacatttg

SEQ ID NO: 5831444 - DNA, 16 bp, Homo sapiens
accgtattagccagga

SEQ ID NO: 5831445 - DNA, 14 bp, Homo sapiens
accgtcaatgtgaa

SEQ ID NO: 5831446 - DNA, 17 bp, Homo sapiens
accgtcaatgtgaaata

SEQ ID NO: 5831447 - DNA, 12 bp, Homo sapiens
accgtccagggg

SEQ ID NO: 5831448 - DNA, 22 bp, Homo sapiens
accgtccaggggagatggggag

SEQ ID NO: 5831449 - DNA, 18 bp, Homo sapiens
accgtccccggcccctgc

SEQ ID NO: 5831450 - DNA, 21 bp, Homo sapiens
accgtccccggcccctgcccc

SEQ ID NO: 5831451 - DNA, 17 bp, Homo sapiens
accgtcccctccttccc

SEQ ID NO: 5831452 - DNA, 21 bp, Homo sapiens
accgtcccctccttccctcac

SEQ ID NO: 5831453 - DNA, 13 bp, Homo sapiens
accgtccctctcc

SEQ ID NO: 5831454 - DNA, 17 bp, Homo sapiens
accgtccctctccccgg

SEQ ID NO: 5831455 - DNA, 14 bp, Homo sapiens
accgtccgccctgc

SEQ ID NO: 5831456 - DNA, 17 bp, Homo sapiens
accgtcctcacccctgt

SEQ ID NO: 5831457 - DNA, 18 bp, Homo sapiens
accgtcctcacccctgtc

SEQ ID NO: 5831458 - DNA, 14 bp, Homo sapiens
accgtcctgctgtc

SEQ ID NO: 5831459 - DNA, 21 bp, Homo sapiens
accgtcctgctgtccctgtca

SEQ ID NO: 5831460 - DNA, 18 bp, Homo sapiens
accgtcgacaagaatgtc

SEQ ID NO: 5831461 - DNA, 14 bp, Homo sapiens
accgtctacagatg

SEQ ID NO: 5831462 - DNA, 16 bp, Homo sapiens
accgtctcactgtgtg

SEQ ID NO: 5831463 - DNA, 16 bp, Homo sapiens
accgtgaaccagaggg

SEQ ID NO: 5831464 - DNA, 18 bp, Homo sapiens
accgtgaagatactttgt

SEQ ID NO: 5831465 - DNA, 19 bp, Homo sapiens
accgtgaagatactttgta

SEQ ID NO: 5831466 - DNA, 21 bp, Homo sapiens
accgtgaagatactttgtatt

SEQ ID NO: 5831467 - DNA, 20 bp, Homo sapiens
accgtgagcaggaaggcctg

SEQ ID NO: 5831468 - DNA, 22 bp, Homo sapiens
accgtgagcgccccgcccccac

SEQ ID NO: 5831469 - DNA, 14 bp, Homo sapiens
accgtgaggagggg

SEQ ID NO: 5831470 - DNA, 19 bp, Homo sapiens
accgtgaggaggggtgtgg

SEQ ID NO: 5831471 - DNA, 13 bp, Homo sapiens
accgtgaggccaa

SEQ ID NO: 5831472 - DNA, 18 bp, Homo sapiens
accgtgaggccagagaca

SEQ ID NO: 5831473 - DNA, 19 bp, Homo sapiens
accgtgagtgacatagcct

SEQ ID NO: 5831474 - DNA, 23 bp, Homo sapiens
accgtgatttggaagagaggcac

SEQ ID NO: 5831475 - DNA, 16 bp, Homo sapiens
accgtgcagagctgca

SEQ ID NO: 5831476 - DNA, 17 bp, Homo sapiens
accgtgccaaccccacc

SEQ ID NO: 5831477 - DNA, 14 bp, Homo sapiens
accgtgccagcagc

SEQ ID NO: 5831478 - DNA, 13 bp, Homo sapiens
accgtgccattgt

SEQ ID NO: 5831479 - DNA, 21 bp, Homo sapiens
accgtgccattgtactccagc

SEQ ID NO: 5831480 - DNA, 15 bp, Homo sapiens
accgtgcccacgagg

SEQ ID NO: 5831481 - DNA, 12 bp, Homo sapiens
accgtgccccac

SEQ ID NO: 5831482 - DNA, 17 bp, Homo sapiens
accgtgccccacctccc

SEQ ID NO: 5831483 - DNA, 12 bp, Homo sapiens
accgtgcctggc

SEQ ID NO: 5831484 - DNA, 15 bp, Homo sapiens
accgtgcctggccag

SEQ ID NO: 5831485 - DNA, 16 bp, Homo sapiens
accgtgcgagctgccg

SEQ ID NO: 5831486 - DNA, 18 bp, Homo sapiens
accgtgctggccccagtg

SEQ ID NO: 5831487 - DNA, 13 bp, Homo sapiens
accgtgctgggct

SEQ ID NO: 5831488 - DNA, 13 bp, Homo sapiens
accgtggacaggc

SEQ ID NO: 5831489 - DNA, 16 bp, Homo sapiens
accgtggacaggccca

SEQ ID NO: 5831490 - DNA, 17 bp, Homo sapiens
accgtggacaggcccag

SEQ ID NO: 5831491 - DNA, 18 bp, Homo sapiens
accgtggaccttcctgcc

SEQ ID NO: 5831492 - DNA, 19 bp, Homo sapiens
accgtggatctccttccct

SEQ ID NO: 5831493 - DNA, 20 bp, Homo sapiens
accgtggccctgccctctcc

SEQ ID NO: 5831494 - DNA, 16 bp, Homo sapiens
accgtggcccttcctg

SEQ ID NO: 5831495 - DNA, 17 bp, Homo sapiens
accgtggcccttcctgg

SEQ ID NO: 5831496 - DNA, 18 bp, Homo sapiens
accgtggcccttcctgga

SEQ ID NO: 5831497 - DNA, 19 bp, Homo sapiens
accgtggcccttcctggac

SEQ ID NO: 5831498 - DNA, 20 bp, Homo sapiens
accgtggcccttcctggaca

SEQ ID NO: 5831499 - DNA, 15 bp, Homo sapiens
accgtggcctgggct

SEQ ID NO: 5831500 - DNA, 17 bp, Homo sapiens
accgtggcctgggcttg

SEQ ID NO: 5831501 - DNA, 19 bp, Homo sapiens
accgtggcctgggcttggc

SEQ ID NO: 5831502 - DNA, 15 bp, Homo sapiens
accgtggggaagggg

SEQ ID NO: 5831503 - DNA, 20 bp, Homo sapiens
accgtggtatgtctgccatg

SEQ ID NO: 5831504 - DNA, 22 bp, Homo sapiens
accgtggtgagcatacagagtg

SEQ ID NO: 5831505 - DNA, 19 bp, Homo sapiens
accgtggtgtcctctgtcc

SEQ ID NO: 5831506 - DNA, 12 bp, Homo sapiens
accgtgtacaat

SEQ ID NO: 5831507 - DNA, 19 bp, Homo sapiens
accgtgtacatagccctgg

SEQ ID NO: 5831508 - DNA, 14 bp, Homo sapiens
accgtgtccagcac

SEQ ID NO: 5831509 - DNA, 22 bp, Homo sapiens
accgtgtgctccagtgttttct

SEQ ID NO: 5831510 - DNA, 17 bp, Homo sapiens
accgtgtgctcctcggc

SEQ ID NO: 5831511 - DNA, 20 bp, Homo sapiens
accgtgttagccaggatggt

SEQ ID NO: 5831512 - DNA, 22 bp, Homo sapiens
accgtgttggtctgtactgatt

SEQ ID NO: 5831513 - DNA, 13 bp, Homo sapiens
accgttaggaaaa

SEQ ID NO: 5831514 - DNA, 21 bp, Homo sapiens
accgttcagtgtcccaggcag

SEQ ID NO: 5831515 - DNA, 18 bp, Homo sapiens
accgttggggattgggga

SEQ ID NO: 5831516 - DNA, 17 bp, Homo sapiens
accgtttagaaaaaaca

SEQ ID NO: 5831517 - DNA, 19 bp, Homo sapiens
accgtttagaaaaaacaat

SEQ ID NO: 5831518 - DNA, 13 bp, Homo sapiens
accgtttggtgtc

SEQ ID NO: 5831519 - DNA, 19 bp, Homo sapiens
accgtttttatattacttt

SEQ ID NO: 5831520 - DNA, 21 bp, Homo sapiens
accgtttttatattacttttg

SEQ ID NO: 5831521 - DNA, 23 bp, Homo sapiens
accgtttttcaagaaaactggaa

SEQ ID NO: 5831522 - DNA, 13 bp, Homo sapiens
acctaaaacttaa

SEQ ID NO: 5831523 - DNA, 21 bp, Homo sapiens
acctaaaagttgaaaagccaa

SEQ ID NO: 5831524 - DNA, 21 bp, Homo sapiens
acctctcagctgctggatgac

SEQ ID NO: 5831525 - DNA, 20 bp, Homo sapiens
acctctcaggattgctagga

SEQ ID NO: 5831526 - DNA, 12 bp, Homo sapiens
acctctcagggc

SEQ ID NO: 5831527 - DNA, 16 bp, Homo sapiens
acctctcagggcctgg

SEQ ID NO: 5831528 - DNA, 10 bp, Homo sapiens
acctctccaa

SEQ ID NO: 5831529 - DNA, 11 bp, Homo sapiens
acctctccaag

SEQ ID NO: 5831530 - DNA, 13 bp, Homo sapiens
acctctccaaggg

SEQ ID NO: 5831531 - DNA, 18 bp, Homo sapiens
acctctccacacaggtgt

SEQ ID NO: 5831532 - DNA, 20 bp, Homo sapiens
acctctccagcatcccagcc

SEQ ID NO: 5831533 - DNA, 20 bp, Homo sapiens
acctctccagcctcagctct

SEQ ID NO: 5831534 - DNA, 15 bp, Homo sapiens
acctctccaggtgct

SEQ ID NO: 5831535 - DNA, 23 bp, Homo sapiens
acctctccatcttcagcttcttc

SEQ ID NO: 5831536 - DNA, 13 bp, Homo sapiens
acctctcccaccc

SEQ ID NO: 5831537 - DNA, 22 bp, Homo sapiens
acctctcccccaaggccactgc

SEQ ID NO: 5831538 - DNA, 17 bp, Homo sapiens
acctctcccctggaact

SEQ ID NO: 5831539 - DNA, 17 bp, Homo sapiens
acctctccctgaccctg

SEQ ID NO: 5831540 - DNA, 23 bp, Homo sapiens
acctctccctgaccctgtatata

SEQ ID NO: 5831541 - DNA, 18 bp, Homo sapiens
acctctccctgcatcctg

SEQ ID NO: 5831542 - DNA, 13 bp, Homo sapiens
acctctcccttgg

SEQ ID NO: 5831543 - DNA, 23 bp, Homo sapiens
acctctcccttggattgtccccg

SEQ ID NO: 5831544 - DNA, 14 bp, Homo sapiens
acctctcctgaccc

SEQ ID NO: 5831545 - DNA, 21 bp, Homo sapiens
acctctcctgacccctgcctg

SEQ ID NO: 5831546 - DNA, 14 bp, Homo sapiens
acctctccttggaa

SEQ ID NO: 5831547 - DNA, 15 bp, Homo sapiens
acctctccttggaaa

SEQ ID NO: 5831548 - DNA, 16 bp, Homo sapiens
acctctcctttctgtg

SEQ ID NO: 5831549 - DNA, 20 bp, Homo sapiens
acctctcggccccatcgccc

SEQ ID NO: 5831550 - DNA, 18 bp, Homo sapiens
acctctcgtttctgccca

SEQ ID NO: 5831551 - DNA, 19 bp, Homo sapiens
acctctcgtttctgcccag

SEQ ID NO: 5831552 - DNA, 21 bp, Homo sapiens
acctctcgtttctgcccagcc

SEQ ID NO: 5831553 - DNA, 16 bp, Homo sapiens
acctctctatttttaa

SEQ ID NO: 5831554 - DNA, 19 bp, Homo sapiens
acctctctcactccttgaa

SEQ ID NO: 5831555 - DNA, 15 bp, Homo sapiens
acctctctcagagca

SEQ ID NO: 5831556 - DNA, 17 bp, Homo sapiens
acctctctctatatata

SEQ ID NO: 5831557 - DNA, 14 bp, Homo sapiens
acctctctctctgg

SEQ ID NO: 5831558 - DNA, 13 bp, Homo sapiens
acctctctctgag

SEQ ID NO: 5831559 - DNA, 18 bp, Homo sapiens
acctctctctgctcctca

SEQ ID NO: 5831560 - DNA, 14 bp, Homo sapiens
acctctctctggga

SEQ ID NO: 5831561 - DNA, 15 bp, Homo sapiens
acctctctgcctctc

SEQ ID NO: 5831562 - DNA, 16 bp, Homo sapiens
acctctctgcctctct

SEQ ID NO: 5831563 - DNA, 17 bp, Homo sapiens
acctctctgcctctctt

SEQ ID NO: 5831564 - DNA, 19 bp, Homo sapiens
acctctctgcctctcttct

SEQ ID NO: 5831565 - DNA, 20 bp, Homo sapiens
acctctctgcctctcttctt

SEQ ID NO: 5831566 - DNA, 17 bp, Homo sapiens
acctctctgcctgttcc

SEQ ID NO: 5831567 - DNA, 21 bp, Homo sapiens
acctctctgcctgttcctccc

SEQ ID NO: 5831568 - DNA, 14 bp, Homo sapiens
acctctctgggacc

SEQ ID NO: 5831569 - DNA, 22 bp, Homo sapiens
acctctctgggacctaggggga

SEQ ID NO: 5831570 - DNA, 16 bp, Homo sapiens
acctctctgtcatgtg

SEQ ID NO: 5831571 - DNA, 19 bp, Homo sapiens
acctctctgtcccttgctg

SEQ ID NO: 5831572 - DNA, 14 bp, Homo sapiens
acctctctgtcttt

SEQ ID NO: 5831573 - DNA, 13 bp, Homo sapiens
acctctcttccct

SEQ ID NO: 5831574 - DNA, 20 bp, Homo sapiens
acctctcttgaaccccaaat

SEQ ID NO: 5831575 - DNA, 21 bp, Homo sapiens
acctctcttggaaagacacaa

SEQ ID NO: 5831576 - DNA, 19 bp, Homo sapiens
acctctcttgtgagccata

SEQ ID NO: 5831577 - DNA, 15 bp, Homo sapiens
acctctcttttcctc

SEQ ID NO: 5831578 - DNA, 14 bp, Homo sapiens
acctctctttttca

SEQ ID NO: 5831579 - DNA, 20 bp, Homo sapiens
acctctgaaaccctggacca

SEQ ID NO: 5831580 - DNA, 21 bp, Homo sapiens
acctctgaatgtcccagaggc

SEQ ID NO: 5831581 - DNA, 24 bp, Homo sapiens
acctctgaatgtcccagaggctag

SEQ ID NO: 5831582 - DNA, 22 bp, Homo sapiens
acctctgaatttacttccttgc

SEQ ID NO: 5831583 - DNA, 13 bp, Homo sapiens
acctctgacagca

SEQ ID NO: 5831584 - DNA, 19 bp, Homo sapiens
acctctgacagcagcatct

SEQ ID NO: 5831585 - DNA, 21 bp, Homo sapiens
acctctgacgcaccactgcca

SEQ ID NO: 5831586 - DNA, 12 bp, Homo sapiens
acctctgagaag

SEQ ID NO: 5831587 - DNA, 14 bp, Homo sapiens
acctctgagaagac

SEQ ID NO: 5831588 - DNA, 10 bp, Homo sapiens
acctctgagg

SEQ ID NO: 5831589 - DNA, 18 bp, Homo sapiens
acctctgatagactttgt

SEQ ID NO: 5831590 - DNA, 15 bp, Homo sapiens
acctctgatcaaagc

SEQ ID NO: 5831591 - DNA, 14 bp, Homo sapiens
acctctgatccctc

SEQ ID NO: 5831592 - DNA, 18 bp, Homo sapiens
acctctgcaagagggggc

SEQ ID NO: 5831593 - DNA, 15 bp, Homo sapiens
acctctgcagcaata

SEQ ID NO: 5831594 - DNA, 18 bp, Homo sapiens
acctctgcagcaataaag

SEQ ID NO: 5831595 - DNA, 18 bp, Homo sapiens
acctctgccccttgggcc

SEQ ID NO: 5831596 - DNA, 22 bp, Homo sapiens
acctctgccccttgggcctccc

SEQ ID NO: 5831597 - DNA, 18 bp, Homo sapiens
acctctgcctcagaaaac

SEQ ID NO: 5831598 - DNA, 17 bp, Homo sapiens
acctctgcctcccgggt

SEQ ID NO: 5831599 - DNA, 13 bp, Homo sapiens
acctctgcctcct

SEQ ID NO: 5831600 - DNA, 15 bp, Homo sapiens
acctctgcctcctgg

SEQ ID NO: 5831601 - DNA, 19 bp, Homo sapiens
acctctgcggaccccagct

SEQ ID NO: 5831602 - DNA, 20 bp, Homo sapiens
acctctgcggaccccagctg

SEQ ID NO: 5831603 - DNA, 14 bp, Homo sapiens
acctctgctgccca

SEQ ID NO: 5831604 - DNA, 20 bp, Homo sapiens
acctctgctgcccacggcca

SEQ ID NO: 5831605 - DNA, 21 bp, Homo sapiens
acctctgctgcccacggccac

SEQ ID NO: 5831606 - DNA, 23 bp, Homo sapiens
acctctgctgcccacggccaccc

SEQ ID NO: 5831607 - DNA, 15 bp, Homo sapiens
acctctgcttcccag

SEQ ID NO: 5831608 - DNA, 17 bp, Homo sapiens
acctctgcttcccaggt

SEQ ID NO: 5831609 - DNA, 13 bp, Homo sapiens
acctctgcttgga

SEQ ID NO: 5831610 - DNA, 15 bp, Homo sapiens
acctctgcttttatc

SEQ ID NO: 5831611 - DNA, 14 bp, Homo sapiens
acctctggactggc

SEQ ID NO: 5831612 - DNA, 15 bp, Homo sapiens
acctctggactggct

SEQ ID NO: 5831613 - DNA, 9 bp, Homo sapiens
acctctggc

SEQ ID NO: 5831614 - DNA, 14 bp, Homo sapiens
acctctggccctgt

SEQ ID NO: 5831615 - DNA, 16 bp, Homo sapiens
acctctggccctgtgt

SEQ ID NO: 5831616 - DNA, 13 bp, Homo sapiens
acctctgggagct

SEQ ID NO: 5831617 - DNA, 14 bp, Homo sapiens
acctctgggagctg

SEQ ID NO: 5831618 - DNA, 18 bp, Homo sapiens
acctctgggtccttggct

SEQ ID NO: 5831619 - DNA, 23 bp, Homo sapiens
acctctgggtccttggctcccgg

SEQ ID NO: 5831620 - DNA, 13 bp, Homo sapiens
acctctgtaattt

SEQ ID NO: 5831621 - DNA, 23 bp, Homo sapiens
acctctgtaatttttcagctctc

SEQ ID NO: 5831622 - DNA, 19 bp, Homo sapiens
acctctgtatagaaatcta

SEQ ID NO: 5831623 - DNA, 22 bp, Homo sapiens
acctctgtatagaaatctaaaa

SEQ ID NO: 5831624 - DNA, 20 bp, Homo sapiens
acctctgtcacgttctggaa

SEQ ID NO: 5831625 - DNA, 20 bp, Homo sapiens
acctctgtccctcaaaattg

SEQ ID NO: 5831626 - DNA, 19 bp, Homo sapiens
acctctgtgacctcaggca

SEQ ID NO: 5831627 - DNA, 11 bp, Homo sapiens
acctctgtgcc

SEQ ID NO: 5831628 - DNA, 16 bp, Homo sapiens
acctctgtgcctctgt

SEQ ID NO: 5831629 - DNA, 15 bp, Homo sapiens
acctctgtgccttgc

SEQ ID NO: 5831630 - DNA, 11 bp, Homo sapiens
acctctgtgtg

SEQ ID NO: 5831631 - DNA, 12 bp, Homo sapiens
acctctgtgtgc

SEQ ID NO: 5831632 - DNA, 15 bp, Homo sapiens
acctctgttaaggtt

SEQ ID NO: 5831633 - DNA, 19 bp, Homo sapiens
acctctgttcagtgtaaat

SEQ ID NO: 5831634 - DNA, 17 bp, Homo sapiens
acctctgttgtcctccc

SEQ ID NO: 5831635 - DNA, 16 bp, Homo sapiens
acctcttaatattctg

SEQ ID NO: 5831636 - DNA, 14 bp, Homo sapiens
acctcttagaaaat

SEQ ID NO: 5831637 - DNA, 14 bp, Homo sapiens
acctcttagctgag

SEQ ID NO: 5831638 - DNA, 15 bp, Homo sapiens
acctcttcacccccc

SEQ ID NO: 5831639 - DNA, 22 bp, Homo sapiens
acctcttccaggaagcacaggc

SEQ ID NO: 5831640 - DNA, 16 bp, Homo sapiens
acctcttcccatgact

SEQ ID NO: 5831641 - DNA, 13 bp, Homo sapiens
acctcttccccag

SEQ ID NO: 5831642 - DNA, 22 bp, Homo sapiens
acctcttccccagaaaggagac

SEQ ID NO: 5831643 - DNA, 13 bp, Homo sapiens
acctcttccctct

SEQ ID NO: 5831644 - DNA, 19 bp, Homo sapiens
acctcttccctctgggcct

SEQ ID NO: 5831645 - DNA, 12 bp, Homo sapiens
acctcttccgac

SEQ ID NO: 5831646 - DNA, 18 bp, Homo sapiens
acctcttcctaggccacg

SEQ ID NO: 5831647 - DNA, 16 bp, Homo sapiens
acctcttcctctggtt

SEQ ID NO: 5831648 - DNA, 17 bp, Homo sapiens
acctcttcctggccggt

SEQ ID NO: 5831649 - DNA, 13 bp, Homo sapiens
acctcttccttcc

SEQ ID NO: 5831650 - DNA, 21 bp, Homo sapiens
acctcttcggttgtcttgaaa

SEQ ID NO: 5831651 - DNA, 19 bp, Homo sapiens
acctcttctaccctcatca

SEQ ID NO: 5831652 - DNA, 22 bp, Homo sapiens
acctcttctatgcaagccttgc

SEQ ID NO: 5831653 - DNA, 13 bp, Homo sapiens
acctcttctctcc

SEQ ID NO: 5831654 - DNA, 20 bp, Homo sapiens
acctcttctctcctccccta

SEQ ID NO: 5831655 - DNA, 11 bp, Homo sapiens
acctcttctgg

SEQ ID NO: 5831656 - DNA, 13 bp, Homo sapiens
acctcttctggag

SEQ ID NO: 5831657 - DNA, 22 bp, Homo sapiens
acctcttctggagatggaagct

SEQ ID NO: 5831658 - DNA, 15 bp, Homo sapiens
acctcttgctgccag

SEQ ID NO: 5831659 - DNA, 12 bp, Homo sapiens
acctcttgctgt

SEQ ID NO: 5831660 - DNA, 24 bp, Homo sapiens
acctcttgctgtctctgctcgccc

SEQ ID NO: 5831661 - DNA, 22 bp, Homo sapiens
acctcttgggcatgctcagccc

SEQ ID NO: 5831662 - DNA, 23 bp, Homo sapiens
acctcttgttactccctgttatt

SEQ ID NO: 5831663 - DNA, 23 bp, Homo sapiens
acctcttgtttctgggtccctgc

SEQ ID NO: 5831664 - DNA, 17 bp, Homo sapiens
acctctttaagtattga

SEQ ID NO: 5831665 - DNA, 17 bp, Homo sapiens
acctctttactctctcc

SEQ ID NO: 5831666 - DNA, 21 bp, Homo sapiens
acctctttgctcaacagaaca

SEQ ID NO: 5831667 - DNA, 14 bp, Homo sapiens
acctctttggggca

SEQ ID NO: 5831668 - DNA, 21 bp, Homo sapiens
acctcttttagtcattttgct

SEQ ID NO: 5831669 - DNA, 18 bp, Homo sapiens
acctcttttctgcatcat

SEQ ID NO: 5831670 - DNA, 22 bp, Homo sapiens
acctcttttgcttgccaaagta

SEQ ID NO: 5831671 - DNA, 19 bp, Homo sapiens
acctcttttgttgtccttg

SEQ ID NO: 5831672 - DNA, 14 bp, Homo sapiens
acctctttttcctc

SEQ ID NO: 5831673 - DNA, 21 bp, Homo sapiens
acctctttttcctcctggaca

SEQ ID NO: 5831674 - DNA, 22 bp, Homo sapiens
acctctttttcctcctggacac

SEQ ID NO: 5831675 - DNA, 17 bp, Homo sapiens
acctctttttcttacca

SEQ ID NO: 5831676 - DNA, 14 bp, Homo sapiens
acctcttttttcta

SEQ ID NO: 5831677 - DNA, 15 bp, Homo sapiens
acctgaaaaaaagtt

SEQ ID NO: 5831678 - DNA, 19 bp, Homo sapiens
acctgaaaaaaagtttaca

SEQ ID NO: 5831679 - DNA, 11 bp, Homo sapiens
acctgaaaaca

SEQ ID NO: 5831680 - DNA, 21 bp, Homo sapiens
acctgaaaacactgtgcacat

SEQ ID NO: 5831681 - DNA, 12 bp, Homo sapiens
acctgaaaagat

SEQ ID NO: 5831682 - DNA, 22 bp, Homo sapiens
acctgaaaagatgttgtgtctt

SEQ ID NO: 5831683 - DNA, 15 bp, Homo sapiens
acctgaaaatgttag

SEQ ID NO: 5831684 - DNA, 22 bp, Homo sapiens
acctgaaagacagtatgagaaa

SEQ ID NO: 5831685 - DNA, 14 bp, Homo sapiens
acctgaaagagagg

SEQ ID NO: 5831686 - DNA, 13 bp, Homo sapiens
acctgaaagccct

SEQ ID NO: 5831687 - DNA, 16 bp, Homo sapiens
acctgaaagcccttct

SEQ ID NO: 5831688 - DNA, 14 bp, Homo sapiens
acctgaaagcctgt

SEQ ID NO: 5831689 - DNA, 13 bp, Homo sapiens
acctgaaagttcc

SEQ ID NO: 5831690 - DNA, 17 bp, Homo sapiens
acctgaaatatatttta

SEQ ID NO: 5831691 - DNA, 20 bp, Homo sapiens
acctgaaatattttcttcct

SEQ ID NO: 5831692 - DNA, 21 bp, Homo sapiens
acctgaaattaatttgtgaat

SEQ ID NO: 5831693 - DNA, 22 bp, Homo sapiens
acctgaaattaatttgtgaatt

SEQ ID NO: 5831694 - DNA, 16 bp, Homo sapiens
acctgaaattccaaag

SEQ ID NO: 5831695 - DNA, 17 bp, Homo sapiens
acctgaaatttaaactg

SEQ ID NO: 5831696 - DNA, 12 bp, Homo sapiens
acctgaacagga

SEQ ID NO: 5831697 - DNA, 13 bp, Homo sapiens
acctgaacaggaa

SEQ ID NO: 5831698 - DNA, 14 bp, Homo sapiens
acctgaacaggaat

SEQ ID NO: 5831699 - DNA, 15 bp, Homo sapiens
acctgaaccccagag

SEQ ID NO: 5831700 - DNA, 18 bp, Homo sapiens
acctgaaccccagaggca

SEQ ID NO: 5831701 - DNA, 13 bp, Homo sapiens
acctgaacctggg

SEQ ID NO: 5831702 - DNA, 16 bp, Homo sapiens
acctgaactctgcaac

SEQ ID NO: 5831703 - DNA, 16 bp, Homo sapiens
acctgccaggaagcca

SEQ ID NO: 5831704 - DNA, 21 bp, Homo sapiens
acctgccaggaagccagcagg

SEQ ID NO: 5831705 - DNA, 11 bp, Homo sapiens
acctgccaggc

SEQ ID NO: 5831706 - DNA, 14 bp, Homo sapiens
acctgccaggcctc

SEQ ID NO: 5831707 - DNA, 18 bp, Homo sapiens
acctgccagggagacaga

SEQ ID NO: 5831708 - DNA, 15 bp, Homo sapiens
acctgccagtcccag

SEQ ID NO: 5831709 - DNA, 16 bp, Homo sapiens
acctgccatgccagga

SEQ ID NO: 5831710 - DNA, 19 bp, Homo sapiens
acctgccatgccaggaacc

SEQ ID NO: 5831711 - DNA, 22 bp, Homo sapiens
acctgcccacaactcccttgca

SEQ ID NO: 5831712 - DNA, 10 bp, Homo sapiens
acctgcccag

SEQ ID NO: 5831713 - DNA, 19 bp, Homo sapiens
acctgcccagctccccaac

SEQ ID NO: 5831714 - DNA, 20 bp, Homo sapiens
acctgcccagttagcccggc

SEQ ID NO: 5831715 - DNA, 16 bp, Homo sapiens
acctgcccatgtccag

SEQ ID NO: 5831716 - DNA, 17 bp, Homo sapiens
acctgccccaactctcc

SEQ ID NO: 5831717 - DNA, 13 bp, Homo sapiens
acctgccccaagt

SEQ ID NO: 5831718 - DNA, 22 bp, Homo sapiens
acctgccccaagtggtgagcaa

SEQ ID NO: 5831719 - DNA, 12 bp, Homo sapiens
acctgccccagc

SEQ ID NO: 5831720 - DNA, 15 bp, Homo sapiens
acctgccccagcact

SEQ ID NO: 5831721 - DNA, 15 bp, Homo sapiens
acctgccccaggctc

SEQ ID NO: 5831722 - DNA, 16 bp, Homo sapiens
acctgcccccaatcca

SEQ ID NO: 5831723 - DNA, 18 bp, Homo sapiens
acctgcccccacagctcc

SEQ ID NO: 5831724 - DNA, 18 bp, Homo sapiens
acctgcccccgcatcccc

SEQ ID NO: 5831725 - DNA, 16 bp, Homo sapiens
acctgcccccttctcc

SEQ ID NO: 5831726 - DNA, 17 bp, Homo sapiens
acctgccccgcccagct

SEQ ID NO: 5831727 - DNA, 19 bp, Homo sapiens
acctgccccggacctacct

SEQ ID NO: 5831728 - DNA, 21 bp, Homo sapiens
acctgccccggacctacctcc

SEQ ID NO: 5831729 - DNA, 17 bp, Homo sapiens
acctgccccgtagagaa

SEQ ID NO: 5831730 - DNA, 23 bp, Homo sapiens
acctgcccctcctctctgcccta

SEQ ID NO: 5831731 - DNA, 22 bp, Homo sapiens
acctgcccctgccgcctgtgcc

SEQ ID NO: 5831732 - DNA, 22 bp, Homo sapiens
acctgcccctgcctgacagcct

SEQ ID NO: 5831733 - DNA, 21 bp, Homo sapiens
acctgcccgcctaagaccctg

SEQ ID NO: 5831734 - DNA, 18 bp, Homo sapiens
acctgcccggcccaggag

SEQ ID NO: 5831735 - DNA, 22 bp, Homo sapiens
acctgcccggcccaggagcgca

SEQ ID NO: 5831736 - DNA, 12 bp, Homo sapiens
acctgccctcta

SEQ ID NO: 5831737 - DNA, 14 bp, Homo sapiens
acctgccctctctc

SEQ ID NO: 5831738 - DNA, 21 bp, Homo sapiens
acctgccctgccctgccacct

SEQ ID NO: 5831739 - DNA, 17 bp, Homo sapiens
acctgccctgcctgagg

SEQ ID NO: 5831740 - DNA, 18 bp, Homo sapiens
acctgccctgcctgaggg

SEQ ID NO: 5831741 - DNA, 16 bp, Homo sapiens
acctgccctggcccca

SEQ ID NO: 5831742 - DNA, 20 bp, Homo sapiens
acctgcccttttttctgcct

SEQ ID NO: 5831743 - DNA, 13 bp, Homo sapiens
acctgccgacctc

SEQ ID NO: 5831744 - DNA, 18 bp, Homo sapiens
acctgccgacctcgtcct

SEQ ID NO: 5831745 - DNA, 16 bp, Homo sapiens
acctgccgagagtcca

SEQ ID NO: 5831746 - DNA, 21 bp, Homo sapiens
acctgccgctgcttgagtgga

SEQ ID NO: 5831747 - DNA, 17 bp, Homo sapiens
acctgcctagcatgggg

SEQ ID NO: 5831748 - DNA, 20 bp, Homo sapiens
acctgcctagctcttgggcc

SEQ ID NO: 5831749 - DNA, 19 bp, Homo sapiens
acctgcctaggtttttcct

SEQ ID NO: 5831750 - DNA, 19 bp, Homo sapiens
acctgcctatccatcctgc

SEQ ID NO: 5831751 - DNA, 16 bp, Homo sapiens
acctgcctcagctacc

SEQ ID NO: 5831752 - DNA, 14 bp, Homo sapiens
acctgcctccacca

SEQ ID NO: 5831753 - DNA, 13 bp, Homo sapiens
acctgcctcctgc

SEQ ID NO: 5831754 - DNA, 18 bp, Homo sapiens
acctgcctcctgcctgcc

SEQ ID NO: 5831755 - DNA, 17 bp, Homo sapiens
acctgcctcggcctccc

SEQ ID NO: 5831756 - DNA, 23 bp, Homo sapiens
acctgcctcggcctcccaaagtg

SEQ ID NO: 5831757 - DNA, 15 bp, Homo sapiens
acctgcctctcacac

SEQ ID NO: 5831758 - DNA, 23 bp, Homo sapiens
acctgcctctgaactgctgctgg

SEQ ID NO: 5831759 - DNA, 13 bp, Homo sapiens
acctgcctgccct

SEQ ID NO: 5831760 - DNA, 13 bp, Homo sapiens
acctgcctgcgtc

SEQ ID NO: 5831761 - DNA, 21 bp, Homo sapiens
acctgcctggccggccagcca

SEQ ID NO: 5831762 - DNA, 21 bp, Homo sapiens
acctgcctgggacagccactg

SEQ ID NO: 5831763 - DNA, 14 bp, Homo sapiens
acctgcctggtgca

SEQ ID NO: 5831764 - DNA, 11 bp, Homo sapiens
acctgcctgta

SEQ ID NO: 5831765 - DNA, 23 bp, Homo sapiens
acctgcctgttgggccaggagcc

SEQ ID NO: 5831766 - DNA, 16 bp, Homo sapiens
acctgccttctaccct

SEQ ID NO: 5831767 - DNA, 23 bp, Homo sapiens
acctgccttctcactagctgtct

SEQ ID NO: 5831768 - DNA, 14 bp, Homo sapiens
acctgcctttgtat

SEQ ID NO: 5831769 - DNA, 18 bp, Homo sapiens
acctgccttttaagtttg

SEQ ID NO: 5831770 - DNA, 19 bp, Homo sapiens
acctgcgaacttgtgttta

SEQ ID NO: 5831771 - DNA, 14 bp, Homo sapiens
acctgcgaaggatg

SEQ ID NO: 5831772 - DNA, 16 bp, Homo sapiens
acctgcgacagcttgt

SEQ ID NO: 5831773 - DNA, 23 bp, Homo sapiens
acctgcgagaggtccctgcttac

SEQ ID NO: 5831774 - DNA, 20 bp, Homo sapiens
acctgcgcaagtgcctggga

SEQ ID NO: 5831775 - DNA, 15 bp, Homo sapiens
acctgcggaaggagg

SEQ ID NO: 5831776 - DNA, 16 bp, Homo sapiens
acctgcggcccaatcc

SEQ ID NO: 5831777 - DNA, 16 bp, Homo sapiens
acctgcggccttgggt

SEQ ID NO: 5831778 - DNA, 23 bp, Homo sapiens
acctgcggtgctatctcccccag

SEQ ID NO: 5831779 - DNA, 15 bp, Homo sapiens
acctgctcacaggga

SEQ ID NO: 5831780 - DNA, 18 bp, Homo sapiens
acctgctcacagggatgc

SEQ ID NO: 5831781 - DNA, 15 bp, Homo sapiens
acctgctcaggcgtc

SEQ ID NO: 5831782 - DNA, 13 bp, Homo sapiens
acctgctccaatt

SEQ ID NO: 5831783 - DNA, 12 bp, Homo sapiens
acctgctccaga

SEQ ID NO: 5831784 - DNA, 14 bp, Homo sapiens
acctgctccagaag

SEQ ID NO: 5831785 - DNA, 13 bp, Homo sapiens
acctgctccagat

SEQ ID NO: 5831786 - DNA, 15 bp, Homo sapiens
acctgctccagatcc

SEQ ID NO: 5831787 - DNA, 14 bp, Homo sapiens
acctgctcccacag

SEQ ID NO: 5831788 - DNA, 12 bp, Homo sapiens
acctgctcccag

SEQ ID NO: 5831789 - DNA, 16 bp, Homo sapiens
acctgctcccaggccc

SEQ ID NO: 5831790 - DNA, 13 bp, Homo sapiens
acctgctcccagt

SEQ ID NO: 5831791 - DNA, 22 bp, Homo sapiens
acctgctcccagtcctgcctga

SEQ ID NO: 5831792 - DNA, 14 bp, Homo sapiens
acctgctcccctca

SEQ ID NO: 5831793 - DNA, 13 bp, Homo sapiens
acctgctcccttc

SEQ ID NO: 5831794 - DNA, 15 bp, Homo sapiens
acctgctccgctgct

SEQ ID NO: 5831795 - DNA, 17 bp, Homo sapiens
acctgctccgctgctcc

SEQ ID NO: 5831796 - DNA, 22 bp, Homo sapiens
acctgctccttggcctagtcag

SEQ ID NO: 5831797 - DNA, 14 bp, Homo sapiens
acctgctctccggc

SEQ ID NO: 5831798 - DNA, 12 bp, Homo sapiens
acctgctctcct

SEQ ID NO: 5831799 - DNA, 13 bp, Homo sapiens
acctgctctcctc

SEQ ID NO: 5831800 - DNA, 17 bp, Homo sapiens
acctgctctcctcttgc

SEQ ID NO: 5831801 - DNA, 16 bp, Homo sapiens
acctgctctgtcccca

SEQ ID NO: 5831802 - DNA, 17 bp, Homo sapiens
acctgctctgtccccaa

SEQ ID NO: 5831803 - DNA, 13 bp, Homo sapiens
acctgctcttccc

SEQ ID NO: 5831804 - DNA, 11 bp, Homo sapiens
acctgctgagc

SEQ ID NO: 5831805 - DNA, 13 bp, Homo sapiens
acctgctgagctc

SEQ ID NO: 5831806 - DNA, 15 bp, Homo sapiens
acctgctgagctctg

SEQ ID NO: 5831807 - DNA, 20 bp, Homo sapiens
acctgctgagctctgagagg

SEQ ID NO: 5831808 - DNA, 21 bp, Homo sapiens
acctgctgagctctgagaggc

SEQ ID NO: 5831809 - DNA, 17 bp, Homo sapiens
acctgctgaggcacaga

SEQ ID NO: 5831810 - DNA, 18 bp, Homo sapiens
acctgctgccccagctga

SEQ ID NO: 5831811 - DNA, 23 bp, Homo sapiens
acctgctgcccgtgaggaggggg

SEQ ID NO: 5831812 - DNA, 15 bp, Homo sapiens
acctgctgctgctat

SEQ ID NO: 5831813 - DNA, 12 bp, Homo sapiens
acctgctgctgt

SEQ ID NO: 5831814 - DNA, 13 bp, Homo sapiens
acctgctgcttct

SEQ ID NO: 5831815 - DNA, 14 bp, Homo sapiens
acctgctgcttctc

SEQ ID NO: 5831816 - DNA, 13 bp, Homo sapiens
acctgctggacag

SEQ ID NO: 5831817 - DNA, 15 bp, Homo sapiens
acctgctggacagcc

SEQ ID NO: 5831818 - DNA, 18 bp, Homo sapiens
acctgctggatgggactc

SEQ ID NO: 5831819 - DNA, 14 bp, Homo sapiens
acctgctggcccct

SEQ ID NO: 5831820 - DNA, 21 bp, Homo sapiens
acctgctggcccctcacctgg

SEQ ID NO: 5831821 - DNA, 13 bp, Homo sapiens
acctgctggtggg

SEQ ID NO: 5831822 - DNA, 18 bp, Homo sapiens
acctgctggtggggcaga

SEQ ID NO: 5831823 - DNA, 22 bp, Homo sapiens
acctgctggttgttgccaggtt

SEQ ID NO: 5831824 - DNA, 17 bp, Homo sapiens
acctgctgtggatgtcc

SEQ ID NO: 5831825 - DNA, 21 bp, Homo sapiens
acctgcttagctgccttgagc

SEQ ID NO: 5831826 - DNA, 19 bp, Homo sapiens
acctgcttcatgctcagcc

SEQ ID NO: 5831827 - DNA, 23 bp, Homo sapiens
acctgcttcatgctcagccctga

SEQ ID NO: 5831828 - DNA, 15 bp, Homo sapiens
acctgcttcattcaa

SEQ ID NO: 5831829 - DNA, 15 bp, Homo sapiens
acctgcttcccccac

SEQ ID NO: 5831830 - DNA, 20 bp, Homo sapiens
acctgcttcccccacttcac

SEQ ID NO: 5831831 - DNA, 12 bp, Homo sapiens
acctgcttcctg

SEQ ID NO: 5831832 - DNA, 16 bp, Homo sapiens
acctgcttcctgaaat

SEQ ID NO: 5831833 - DNA, 21 bp, Homo sapiens
acctgcttcctgaaataaaca

SEQ ID NO: 5831834 - DNA, 23 bp, Homo sapiens
acctgcttcctgaaataaacact

SEQ ID NO: 5831835 - DNA, 22 bp, Homo sapiens
acctgcttctcagcgcaacagc

SEQ ID NO: 5831836 - DNA, 14 bp, Homo sapiens
acctgcttctctgc

SEQ ID NO: 5831837 - DNA, 16 bp, Homo sapiens
acctgcttctgaactc

SEQ ID NO: 5831838 - DNA, 13 bp, Homo sapiens
acctgcttgagct

SEQ ID NO: 5831839 - DNA, 20 bp, Homo sapiens
acctgcttgggtggagaagc

SEQ ID NO: 5831840 - DNA, 23 bp, Homo sapiens
acctgcttgggtggagaagccat

SEQ ID NO: 5831841 - DNA, 20 bp, Homo sapiens
acctgcttgtgttgggcccc

SEQ ID NO: 5831842 - DNA, 15 bp, Homo sapiens
acctgctttctcctg

SEQ ID NO: 5831843 - DNA, 13 bp, Homo sapiens
acctgctttttga

SEQ ID NO: 5831844 - DNA, 19 bp, Homo sapiens
acctggaaaaattccagaa

SEQ ID NO: 5831845 - DNA, 20 bp, Homo sapiens
acctggaaactgctcagacg

SEQ ID NO: 5831846 - DNA, 15 bp, Homo sapiens
acctggaaatgaatg

SEQ ID NO: 5831847 - DNA, 17 bp, Homo sapiens
acctggaaccagagcca

SEQ ID NO: 5831848 - DNA, 20 bp, Homo sapiens
acctggaagaacaggcctct

SEQ ID NO: 5831849 - DNA, 17 bp, Homo sapiens
acctggaagagctgggt

SEQ ID NO: 5831850 - DNA, 20 bp, Homo sapiens
acctggaatatataaccagt

SEQ ID NO: 5831851 - DNA, 20 bp, Homo sapiens
acctggaatcagattattaa

SEQ ID NO: 5831852 - DNA, 14 bp, Homo sapiens
acctggaatgttag

SEQ ID NO: 5831853 - DNA, 14 bp, Homo sapiens
acctggaccccagc

SEQ ID NO: 5831854 - DNA, 19 bp, Homo sapiens
acctggaccccctgcccgc

SEQ ID NO: 5831855 - DNA, 14 bp, Homo sapiens
acctggacctggaa

SEQ ID NO: 5831856 - DNA, 18 bp, Homo sapiens
acctggaccttttctgga

SEQ ID NO: 5831857 - DNA, 15 bp, Homo sapiens
acctggactagggcc

SEQ ID NO: 5831858 - DNA, 16 bp, Homo sapiens
acctggactgaccctg

SEQ ID NO: 5831859 - DNA, 14 bp, Homo sapiens
acctggactgagcc

SEQ ID NO: 5831860 - DNA, 15 bp, Homo sapiens
acctggacttcctgt

SEQ ID NO: 5831861 - DNA, 17 bp, Homo sapiens
acctggacttcctgtca

SEQ ID NO: 5831862 - DNA, 18 bp, Homo sapiens
acctggacttcctgtcat

SEQ ID NO: 5831863 - DNA, 23 bp, Homo sapiens
acctggagagctagaacctggag

SEQ ID NO: 5831864 - DNA, 13 bp, Homo sapiens
acctggagatgat

SEQ ID NO: 5831865 - DNA, 17 bp, Homo sapiens
acctggagatgatgatg

SEQ ID NO: 5831866 - DNA, 17 bp, Homo sapiens
acctggagatgcagcta

SEQ ID NO: 5831867 - DNA, 15 bp, Homo sapiens
acctggagcccctgg

SEQ ID NO: 5831868 - DNA, 15 bp, Homo sapiens
acctggagctgccag

SEQ ID NO: 5831869 - DNA, 19 bp, Homo sapiens
acctggagctgccagcacc

SEQ ID NO: 5831870 - DNA, 18 bp, Homo sapiens
acctggagcttcagccag

SEQ ID NO: 5831871 - DNA, 19 bp, Homo sapiens
acctggagcttcagccagg

SEQ ID NO: 5831872 - DNA, 14 bp, Homo sapiens
acctggaggctgga

SEQ ID NO: 5831873 - DNA, 18 bp, Homo sapiens
acctggaggctggaccaa

SEQ ID NO: 5831874 - DNA, 21 bp, Homo sapiens
acctggaggctggaccaactg

SEQ ID NO: 5831875 - DNA, 15 bp, Homo sapiens
acctggagggctgga

SEQ ID NO: 5831876 - DNA, 16 bp, Homo sapiens
acctggaggggagagg

SEQ ID NO: 5831877 - DNA, 18 bp, Homo sapiens
acctggaggggcaccagg

SEQ ID NO: 5831878 - DNA, 15 bp, Homo sapiens
acctggagtttaata

SEQ ID NO: 5831879 - DNA, 19 bp, Homo sapiens
acctggatagttaagggct

SEQ ID NO: 5831880 - DNA, 21 bp, Homo sapiens
acctggattttttaaatcata

SEQ ID NO: 5831881 - DNA, 13 bp, Homo sapiens
acctggcacacca

SEQ ID NO: 5831882 - DNA, 23 bp, Homo sapiens
acctggcacaccagaagtgccat

SEQ ID NO: 5831883 - DNA, 21 bp, Homo sapiens
accttagtgtttctgtgcatg

SEQ ID NO: 5831884 - DNA, 14 bp, Homo sapiens
accttatacatcac

SEQ ID NO: 5831885 - DNA, 15 bp, Homo sapiens
accttatacatcact

SEQ ID NO: 5831886 - DNA, 19 bp, Homo sapiens
accttatagagcacaatat

SEQ ID NO: 5831887 - DNA, 12 bp, Homo sapiens
accttatagtta

SEQ ID NO: 5831888 - DNA, 19 bp, Homo sapiens
accttatagttactgtgta

SEQ ID NO: 5831889 - DNA, 20 bp, Homo sapiens
accttatagttactgtgtaa

SEQ ID NO: 5831890 - DNA, 16 bp, Homo sapiens
accttatatttacaat

SEQ ID NO: 5831891 - DNA, 19 bp, Homo sapiens
accttatcactgcattatt

SEQ ID NO: 5831892 - DNA, 16 bp, Homo sapiens
accttatcctgcattg

SEQ ID NO: 5831893 - DNA, 18 bp, Homo sapiens
accttatcctgcattgtt

SEQ ID NO: 5831894 - DNA, 13 bp, Homo sapiens
accttatctgtgc

SEQ ID NO: 5831895 - DNA, 18 bp, Homo sapiens
accttatgagaaactgca

SEQ ID NO: 5831896 - DNA, 12 bp, Homo sapiens
accttatgtatt

SEQ ID NO: 5831897 - DNA, 16 bp, Homo sapiens
accttattactgtctt

SEQ ID NO: 5831898 - DNA, 17 bp, Homo sapiens
accttattcagaaaata

SEQ ID NO: 5831899 - DNA, 19 bp, Homo sapiens
accttattcagaaaataga

SEQ ID NO: 5831900 - DNA, 19 bp, Homo sapiens
accttattggatatttgat

SEQ ID NO: 5831901 - DNA, 20 bp, Homo sapiens
accttattgtacctctctta

SEQ ID NO: 5831902 - DNA, 11 bp, Homo sapiens
accttatttaa

SEQ ID NO: 5831903 - DNA, 17 bp, Homo sapiens
accttatttaagtaact

SEQ ID NO: 5831904 - DNA, 17 bp, Homo sapiens
accttatttatttttgt

SEQ ID NO: 5831905 - DNA, 16 bp, Homo sapiens
accttattttttccca

SEQ ID NO: 5831906 - DNA, 21 bp, Homo sapiens
accttcaaaatgttctattta

SEQ ID NO: 5831907 - DNA, 14 bp, Homo sapiens
accttcaaagctga

SEQ ID NO: 5831908 - DNA, 17 bp, Homo sapiens
accttcaaagcttttgt

SEQ ID NO: 5831909 - DNA, 23 bp, Homo sapiens
accttcaaagcttttgtaaaata

SEQ ID NO: 5831910 - DNA, 13 bp, Homo sapiens
accttcaaataat

SEQ ID NO: 5831911 - DNA, 16 bp, Homo sapiens
accttcaagcgctcca

SEQ ID NO: 5831912 - DNA, 12 bp, Homo sapiens
accttcaagctg

SEQ ID NO: 5831913 - DNA, 12 bp, Homo sapiens
accttcaataaa

SEQ ID NO: 5831914 - DNA, 13 bp, Homo sapiens
accttcaataaag

SEQ ID NO: 5831915 - DNA, 22 bp, Homo sapiens
accttcaatgaattaattcaga

SEQ ID NO: 5831916 - DNA, 23 bp, Homo sapiens
accttcacacacagactgttgtc

SEQ ID NO: 5831917 - DNA, 20 bp, Homo sapiens
accttcaccaagcttagaag

SEQ ID NO: 5831918 - DNA, 13 bp, Homo sapiens
accttcaccacct

SEQ ID NO: 5831919 - DNA, 14 bp, Homo sapiens
accttcacccagca

SEQ ID NO: 5831920 - DNA, 18 bp, Homo sapiens
accttcacctcggaggga

SEQ ID NO: 5831921 - DNA, 23 bp, Homo sapiens
accttcacgattaactgtgaaat

SEQ ID NO: 5831922 - DNA, 14 bp, Homo sapiens
accttcactccaga

SEQ ID NO: 5831923 - DNA, 19 bp, Homo sapiens
accttcactctaagatgtt

SEQ ID NO: 5831924 - DNA, 22 bp, Homo sapiens
accttcactctaagatgttata

SEQ ID NO: 5831925 - DNA, 18 bp, Homo sapiens
accttcactctccagggt

SEQ ID NO: 5831926 - DNA, 18 bp, Homo sapiens
accttcagattccccatc

SEQ ID NO: 5831927 - DNA, 12 bp, Homo sapiens
accttcagccct

SEQ ID NO: 5831928 - DNA, 14 bp, Homo sapiens
accttcagccctgg

SEQ ID NO: 5831929 - DNA, 15 bp, Homo sapiens
accttcagccctggc

SEQ ID NO: 5831930 - DNA, 16 bp, Homo sapiens
accttcagccctggcc

SEQ ID NO: 5831931 - DNA, 17 bp, Homo sapiens
accttcagccctggcca

SEQ ID NO: 5831932 - DNA, 20 bp, Homo sapiens
accttcagccctggccaagc

SEQ ID NO: 5831933 - DNA, 21 bp, Homo sapiens
accttcagccctggccaagct

SEQ ID NO: 5831934 - DNA, 16 bp, Homo sapiens
accttcagctttattt

SEQ ID NO: 5831935 - DNA, 19 bp, Homo sapiens
accttcagtaaacaccatg

SEQ ID NO: 5831936 - DNA, 22 bp, Homo sapiens
accttcagtaacccccactgga

SEQ ID NO: 5831937 - DNA, 23 bp, Homo sapiens
accttcatctgaaacccacagat

SEQ ID NO: 5831938 - DNA, 19 bp, Homo sapiens
accttcatgcttactattt

SEQ ID NO: 5831939 - DNA, 15 bp, Homo sapiens
accttcatttcatgt

SEQ ID NO: 5831940 - DNA, 14 bp, Homo sapiens
accttccaaagagt

SEQ ID NO: 5831941 - DNA, 16 bp, Homo sapiens
accttccaacactcca

SEQ ID NO: 5831942 - DNA, 16 bp, Homo sapiens
accttccaagactgaa

SEQ ID NO: 5831943 - DNA, 19 bp, Homo sapiens
accttccaagactgaagac

SEQ ID NO: 5831944 - DNA, 15 bp, Homo sapiens
accttccaagagcct

SEQ ID NO: 5831945 - DNA, 15 bp, Homo sapiens
accttccagaaatac

SEQ ID NO: 5831946 - DNA, 14 bp, Homo sapiens
accttccagctcct

SEQ ID NO: 5831947 - DNA, 15 bp, Homo sapiens
accttccaggacccc

SEQ ID NO: 5831948 - DNA, 13 bp, Homo sapiens
accttccagggcc

SEQ ID NO: 5831949 - DNA, 15 bp, Homo sapiens
accttccagggccct

SEQ ID NO: 5831950 - DNA, 14 bp, Homo sapiens
accttcccaaacgc

SEQ ID NO: 5831951 - DNA, 19 bp, Homo sapiens
accttcccaaacgcctccc

SEQ ID NO: 5831952 - DNA, 13 bp, Homo sapiens
accttcccagctc

SEQ ID NO: 5831953 - DNA, 19 bp, Homo sapiens
accttcccagctctccctc

SEQ ID NO: 5831954 - DNA, 17 bp, Homo sapiens
accttcccagctgctcc

SEQ ID NO: 5831955 - DNA, 21 bp, Homo sapiens
accttcccagctgctcctaga

SEQ ID NO: 5831956 - DNA, 11 bp, Homo sapiens
accttcccagg

SEQ ID NO: 5831957 - DNA, 12 bp, Homo sapiens
accttcccaggg

SEQ ID NO: 5831958 - DNA, 17 bp, Homo sapiens
accttcccatgccctgg

SEQ ID NO: 5831959 - DNA, 21 bp, Homo sapiens
accttccccacccttgagaag

SEQ ID NO: 5831960 - DNA, 14 bp, Homo sapiens
accttccccagact

SEQ ID NO: 5831961 - DNA, 15 bp, Homo sapiens
accttccccagactt

SEQ ID NO: 5831962 - DNA, 17 bp, Homo sapiens
accttcccccagctttc

SEQ ID NO: 5831963 - DNA, 23 bp, Homo sapiens
accttcccctaaaccccaagctt

SEQ ID NO: 5831964 - DNA, 9 bp, Homo sapiens
accttccct

SEQ ID NO: 5831965 - DNA, 20 bp, Homo sapiens
accttccctccacctgcttg

SEQ ID NO: 5831966 - DNA, 11 bp, Homo sapiens
accttccctcg

SEQ ID NO: 5831967 - DNA, 19 bp, Homo sapiens
accttccctctcaccatcc

SEQ ID NO: 5831968 - DNA, 12 bp, Homo sapiens
accttcccttcc

SEQ ID NO: 5831969 - DNA, 22 bp, Homo sapiens
accttcccttcctcagcaggcc

SEQ ID NO: 5831970 - DNA, 16 bp, Homo sapiens
accttcctcagctcag

SEQ ID NO: 5831971 - DNA, 18 bp, Homo sapiens
accttcctcctccccgct

SEQ ID NO: 5831972 - DNA, 20 bp, Homo sapiens
accttcctcctccccgctcc

SEQ ID NO: 5831973 - DNA, 17 bp, Homo sapiens
accttcctcctgcagac

SEQ ID NO: 5831974 - DNA, 18 bp, Homo sapiens
accttcctcctgcagaca

SEQ ID NO: 5831975 - DNA, 13 bp, Homo sapiens
accttcctcgcag

SEQ ID NO: 5831976 - DNA, 16 bp, Homo sapiens
accttcctcgcagaga

SEQ ID NO: 5831977 - DNA, 18 bp, Homo sapiens
accttcctctgcctttgt

SEQ ID NO: 5831978 - DNA, 12 bp, Homo sapiens
accttcctgact

SEQ ID NO: 5831979 - DNA, 18 bp, Homo sapiens
accttcctgactgggaag

SEQ ID NO: 5831980 - DNA, 12 bp, Homo sapiens
accttcctgctg

SEQ ID NO: 5831981 - DNA, 20 bp, Homo sapiens
accttcctgggaggacaggc

SEQ ID NO: 5831982 - DNA, 12 bp, Homo sapiens
accttcctgggc

SEQ ID NO: 5831983 - DNA, 19 bp, Homo sapiens
accttcctgggcagcccag

SEQ ID NO: 5831984 - DNA, 23 bp, Homo sapiens
accttcctgggcagcccagagag

SEQ ID NO: 5831985 - DNA, 15 bp, Homo sapiens
accttcctgtccctg

SEQ ID NO: 5831986 - DNA, 24 bp, Homo sapiens
accttcctgtgggtgttctttcct

SEQ ID NO: 5831987 - DNA, 24 bp, Homo sapiens
accttccttccctgggctgtgcta

SEQ ID NO: 5831988 - DNA, 12 bp, Homo sapiens
accttccttcct

SEQ ID NO: 5831989 - DNA, 16 bp, Homo sapiens
accttccttcctgctt

SEQ ID NO: 5831990 - DNA, 20 bp, Homo sapiens
accttccttgaaatttctca

SEQ ID NO: 5831991 - DNA, 15 bp, Homo sapiens
accttcctttgtctt

SEQ ID NO: 5831992 - DNA, 13 bp, Homo sapiens
accttcctttttt

SEQ ID NO: 5831993 - DNA, 17 bp, Homo sapiens
accttcgccacctgggt

SEQ ID NO: 5831994 - DNA, 18 bp, Homo sapiens
accttcggcagtggctgg

SEQ ID NO: 5831995 - DNA, 15 bp, Homo sapiens
accttcgggctgtgc

SEQ ID NO: 5831996 - DNA, 18 bp, Homo sapiens
accttcgggctgtgcccg

SEQ ID NO: 5831997 - DNA, 19 bp, Homo sapiens
accttcggggcctgtctga

SEQ ID NO: 5831998 - DNA, 20 bp, Homo sapiens
accttctaatccatgtgctg

SEQ ID NO: 5831999 - DNA, 16 bp, Homo sapiens
accttctaccctgggt

SEQ ID NO: 5832000 - DNA, 22 bp, Homo sapiens
accttctaccctgggtcctcgg

SEQ ID NO: 5832001 - DNA, 17 bp, Homo sapiens
accttctagaacctggg

SEQ ID NO: 5832002 - DNA, 22 bp, Homo sapiens
accttctaggacgccacccagc

SEQ ID NO: 5832003 - DNA, 13 bp, Homo sapiens
accttctatcctc

SEQ ID NO: 5832004 - DNA, 14 bp, Homo sapiens
accttctatgtatt

SEQ ID NO: 5832005 - DNA, 23 bp, Homo sapiens
accttctcacatggaatgagggt

SEQ ID NO: 5832006 - DNA, 13 bp, Homo sapiens
accttctcccagg

SEQ ID NO: 5832007 - DNA, 15 bp, Homo sapiens
accttctcccaggcc

SEQ ID NO: 5832008 - DNA, 21 bp, Homo sapiens
accttctccccagctcccagg

SEQ ID NO: 5832009 - DNA, 22 bp, Homo sapiens
accttctccccagctcccagga

SEQ ID NO: 5832010 - DNA, 19 bp, Homo sapiens
accttctccctagcccttc

SEQ ID NO: 5832011 - DNA, 15 bp, Homo sapiens
accttctcccttctt

SEQ ID NO: 5832012 - DNA, 12 bp, Homo sapiens
accttctccttc

SEQ ID NO: 5832013 - DNA, 13 bp, Homo sapiens
accttctccttca

SEQ ID NO: 5832014 - DNA, 19 bp, Homo sapiens
accttctctacccatctcc

SEQ ID NO: 5832015 - DNA, 20 bp, Homo sapiens
accttctctacccatctccc

SEQ ID NO: 5832016 - DNA, 22 bp, Homo sapiens
accttctctggagccaagtcca

SEQ ID NO: 5832017 - DNA, 15 bp, Homo sapiens
accttctcttagatt

SEQ ID NO: 5832018 - DNA, 19 bp, Homo sapiens
accttctgacgcagcctga

SEQ ID NO: 5832019 - DNA, 13 bp, Homo sapiens
accttctgacttt

SEQ ID NO: 5832020 - DNA, 15 bp, Homo sapiens
accttctgagtacag

SEQ ID NO: 5832021 - DNA, 13 bp, Homo sapiens
accttctgccaag

SEQ ID NO: 5832022 - DNA, 19 bp, Homo sapiens
accttctgccaaggccagc

SEQ ID NO: 5832023 - DNA, 15 bp, Homo sapiens
accttctgccagaag

SEQ ID NO: 5832024 - DNA, 18 bp, Homo sapiens
accttctggcctcccaca

SEQ ID NO: 5832025 - DNA, 22 bp, Homo sapiens
accttctggcctcccacagact

SEQ ID NO: 5832026 - DNA, 17 bp, Homo sapiens
accttctgtaatactaa

SEQ ID NO: 5832027 - DNA, 21 bp, Homo sapiens
accttctgtccccagccctgt

SEQ ID NO: 5832028 - DNA, 17 bp, Homo sapiens
accttctgtcgtcccca

SEQ ID NO: 5832029 - DNA, 23 bp, Homo sapiens
accttctgtgcatctggcctggg

SEQ ID NO: 5832030 - DNA, 13 bp, Homo sapiens
accttctgtgctc

SEQ ID NO: 5832031 - DNA, 13 bp, Homo sapiens
accttctgtggct

SEQ ID NO: 5832032 - DNA, 19 bp, Homo sapiens
accttcttattatatatat

SEQ ID NO: 5832033 - DNA, 19 bp, Homo sapiens
accttcttcagccacctct

SEQ ID NO: 5832034 - DNA, 17 bp, Homo sapiens
accttcttggcgctgga

SEQ ID NO: 5832035 - DNA, 19 bp, Homo sapiens
accttcttgggactgctgt

SEQ ID NO: 5832036 - DNA, 22 bp, Homo sapiens
accttcttgggactgctgtgaa

SEQ ID NO: 5832037 - DNA, 17 bp, Homo sapiens
accttctttctggactg

SEQ ID NO: 5832038 - DNA, 20 bp, Homo sapiens
accttctttctggactggcg

SEQ ID NO: 5832039 - DNA, 20 bp, Homo sapiens
accttctttggccccttgct

SEQ ID NO: 5832040 - DNA, 14 bp, Homo sapiens
accttctttgtaat

SEQ ID NO: 5832041 - DNA, 14 bp, Homo sapiens
accttcttttcaat

SEQ ID NO: 5832042 - DNA, 20 bp, Homo sapiens
accttgaaaataagaataga

SEQ ID NO: 5832043 - DNA, 11 bp, Homo sapiens
accttgaaggt

SEQ ID NO: 5832044 - DNA, 15 bp, Homo sapiens
accttgaatgctgcc

SEQ ID NO: 5832045 - DNA, 16 bp, Homo sapiens
accttgacagagcagc

SEQ ID NO: 5832046 - DNA, 14 bp, Homo sapiens
accttgacagggca

SEQ ID NO: 5832047 - DNA, 22 bp, Homo sapiens
accttgacttgaaatgctcttt

SEQ ID NO: 5832048 - DNA, 15 bp, Homo sapiens
accttgagacagctt

SEQ ID NO: 5832049 - DNA, 13 bp, Homo sapiens
accttgagcacta

SEQ ID NO: 5832050 - DNA, 20 bp, Homo sapiens
accttgagcactattctaag

SEQ ID NO: 5832051 - DNA, 23 bp, Homo sapiens
accttgagcagaatacaatggga

SEQ ID NO: 5832052 - DNA, 13 bp, Homo sapiens
accttgaggagaa

SEQ ID NO: 5832053 - DNA, 14 bp, Homo sapiens
accttgaggagaag

SEQ ID NO: 5832054 - DNA, 14 bp, Homo sapiens
accttgagggtggg

SEQ ID NO: 5832055 - DNA, 20 bp, Homo sapiens
accttgagggtgggccagca

SEQ ID NO: 5832056 - DNA, 22 bp, Homo sapiens
accttgagtcagaaaacagaga

SEQ ID NO: 5832057 - DNA, 22 bp, Homo sapiens
accttgatcccaatccttatcc

SEQ ID NO: 5832058 - DNA, 16 bp, Homo sapiens
accttgatgtcttgag

SEQ ID NO: 5832059 - DNA, 14 bp, Homo sapiens
accttgatttaaaa

SEQ ID NO: 5832060 - DNA, 19 bp, Homo sapiens
accttgcaaactctataaa

SEQ ID NO: 5832061 - DNA, 14 bp, Homo sapiens
accttgcacacatc

SEQ ID NO: 5832062 - DNA, 18 bp, Homo sapiens
acgaggctctagaaatgc

SEQ ID NO: 5832063 - DNA, 17 bp, Homo sapiens
acgaggctgggccaagc

SEQ ID NO: 5832064 - DNA, 20 bp, Homo sapiens
acgagggaggaacacctgat

SEQ ID NO: 5832065 - DNA, 22 bp, Homo sapiens
acgagggatgggatttcatgta

SEQ ID NO: 5832066 - DNA, 11 bp, Homo sapiens
acgagggctgg

SEQ ID NO: 5832067 - DNA, 14 bp, Homo sapiens
acgagggctggctg

SEQ ID NO: 5832068 - DNA, 19 bp, Homo sapiens
acgaggggcagggaaggac

SEQ ID NO: 5832069 - DNA, 20 bp, Homo sapiens
acgaggggcagggaaggaca

SEQ ID NO: 5832070 - DNA, 14 bp, Homo sapiens
acgaggggggccag

SEQ ID NO: 5832071 - DNA, 20 bp, Homo sapiens
acgagggtctcccctcctgc

SEQ ID NO: 5832072 - DNA, 14 bp, Homo sapiens
acgagggtgccgtg

SEQ ID NO: 5832073 - DNA, 20 bp, Homo sapiens
acgaggtcaagagatcgaga

SEQ ID NO: 5832074 - DNA, 20 bp, Homo sapiens
acgaggtcaggagatcgaga

SEQ ID NO: 5832075 - DNA, 20 bp, Homo sapiens
acgaggtggtagctctgagc

SEQ ID NO: 5832076 - DNA, 23 bp, Homo sapiens
acgagtaagatattatttaaatg

SEQ ID NO: 5832077 - DNA, 16 bp, Homo sapiens
acgagtaatttattgt

SEQ ID NO: 5832078 - DNA, 14 bp, Homo sapiens
acgagtcacctgca

SEQ ID NO: 5832079 - DNA, 18 bp, Homo sapiens
acgagtcacctgcaagcc

SEQ ID NO: 5832080 - DNA, 20 bp, Homo sapiens
acgagtcacctgcaagcccc

SEQ ID NO: 5832081 - DNA, 21 bp, Homo sapiens
acgagtgaccgattatgcttt

SEQ ID NO: 5832082 - DNA, 18 bp, Homo sapiens
acgagtgagctaccagga

SEQ ID NO: 5832083 - DNA, 13 bp, Homo sapiens
acgagtgctaagt

SEQ ID NO: 5832084 - DNA, 22 bp, Homo sapiens
acgagtgtagtcccggaggcct

SEQ ID NO: 5832085 - DNA, 19 bp, Homo sapiens
acgagttaatgatggcaga

SEQ ID NO: 5832086 - DNA, 23 bp, Homo sapiens
acgagtttggatgttgtaaataa

SEQ ID NO: 5832087 - DNA, 23 bp, Homo sapiens
acgataaggaagaaacagaagag

SEQ ID NO: 5832088 - DNA, 23 bp, Homo sapiens
acgatacgctactataaagagaa

SEQ ID NO: 5832089 - DNA, 17 bp, Homo sapiens
acgatagcctagctttc

SEQ ID NO: 5832090 - DNA, 11 bp, Homo sapiens
acgatatatgt

SEQ ID NO: 5832091 - DNA, 22 bp, Homo sapiens
acgatatttaattcacctcagc

SEQ ID NO: 5832092 - DNA, 23 bp, Homo sapiens
acgatatttcgtttggtcttagg

SEQ ID NO: 5832093 - DNA, 17 bp, Homo sapiens
acgatcacaaatgactt

SEQ ID NO: 5832094 - DNA, 14 bp, Homo sapiens
acgatcacctgcat

SEQ ID NO: 5832095 - DNA, 18 bp, Homo sapiens
acgatcaggaggaagtga

SEQ ID NO: 5832096 - DNA, 14 bp, Homo sapiens
acgatcaggcacag

SEQ ID NO: 5832097 - DNA, 18 bp, Homo sapiens
acgatcaggcacaggtca

SEQ ID NO: 5832098 - DNA, 13 bp, Homo sapiens
acgatcccctccc

SEQ ID NO: 5832099 - DNA, 22 bp, Homo sapiens
acgatccgcaacccatgccctg

SEQ ID NO: 5832100 - DNA, 24 bp, Homo sapiens
acgatccgcaacccatgccctgga

SEQ ID NO: 5832101 - DNA, 14 bp, Homo sapiens
acgatccttcaaag

SEQ ID NO: 5832102 - DNA, 15 bp, Homo sapiens
acgatccttcaaagt

SEQ ID NO: 5832103 - DNA, 16 bp, Homo sapiens
acgatccttcaaagtc

SEQ ID NO: 5832104 - DNA, 15 bp, Homo sapiens
acgatcggtttcata

SEQ ID NO: 5832105 - DNA, 13 bp, Homo sapiens
acgatctcagctc

SEQ ID NO: 5832106 - DNA, 17 bp, Homo sapiens
acgatcttcccccttcc

SEQ ID NO: 5832107 - DNA, 18 bp, Homo sapiens
acgatgatatctatatat

SEQ ID NO: 5832108 - DNA, 14 bp, Homo sapiens
acgatgcatttaat

SEQ ID NO: 5832109 - DNA, 20 bp, Homo sapiens
acgatgcatttaataaagat

SEQ ID NO: 5832110 - DNA, 14 bp, Homo sapiens
acgatgcctgcagg

SEQ ID NO: 5832111 - DNA, 19 bp, Homo sapiens
acgatgcctgcaggcatgg

SEQ ID NO: 5832112 - DNA, 17 bp, Homo sapiens
acgatggcaattggcat

SEQ ID NO: 5832113 - DNA, 23 bp, Homo sapiens
acgatgggctttcccaacagctc

SEQ ID NO: 5832114 - DNA, 18 bp, Homo sapiens
acgatgggtgttgctgtt

SEQ ID NO: 5832115 - DNA, 22 bp, Homo sapiens
acgatgtcaaccttgtgtgagt

SEQ ID NO: 5832116 - DNA, 19 bp, Homo sapiens
acgatgtgcaatacatttt

SEQ ID NO: 5832117 - DNA, 21 bp, Homo sapiens
acgatgtggaaaaatgagaga

SEQ ID NO: 5832118 - DNA, 16 bp, Homo sapiens
acgatgtggccctggc

SEQ ID NO: 5832119 - DNA, 16 bp, Homo sapiens
acgatgtttatgttct

SEQ ID NO: 5832120 - DNA, 15 bp, Homo sapiens
acgattaagtccaaa

SEQ ID NO: 5832121 - DNA, 13 bp, Homo sapiens
acgattagcttta

SEQ ID NO: 5832122 - DNA, 17 bp, Homo sapiens
acgattagctttattat

SEQ ID NO: 5832123 - DNA, 16 bp, Homo sapiens
acgattatacttgaga

SEQ ID NO: 5832124 - DNA, 11 bp, Homo sapiens
acgattcacag

SEQ ID NO: 5832125 - DNA, 14 bp, Homo sapiens
acgattcacagcct

SEQ ID NO: 5832126 - DNA, 16 bp, Homo sapiens
acgattcacagcctcc

SEQ ID NO: 5832127 - DNA, 12 bp, Homo sapiens
acgattccagtg

SEQ ID NO: 5832128 - DNA, 13 bp, Homo sapiens
acgattccagtgc

SEQ ID NO: 5832129 - DNA, 13 bp, Homo sapiens
acgattccttctc

SEQ ID NO: 5832130 - DNA, 11 bp, Homo sapiens
acgattctccc

SEQ ID NO: 5832131 - DNA, 19 bp, Homo sapiens
acgattgacaccaaaatga

SEQ ID NO: 5832132 - DNA, 17 bp, Homo sapiens
acgattgacctgtcctc

SEQ ID NO: 5832133 - DNA, 15 bp, Homo sapiens
acgattgagaactga

SEQ ID NO: 5832134 - DNA, 12 bp, Homo sapiens
acgatttaaggt

SEQ ID NO: 5832135 - DNA, 19 bp, Homo sapiens
acgatttaattctcttgaa

SEQ ID NO: 5832136 - DNA, 17 bp, Homo sapiens
acgatttcactgacact

SEQ ID NO: 5832137 - DNA, 12 bp, Homo sapiens
acgatttctcca

SEQ ID NO: 5832138 - DNA, 20 bp, Homo sapiens
acgatttctgtttagataat

SEQ ID NO: 5832139 - DNA, 11 bp, Homo sapiens
acgatttgtct

SEQ ID NO: 5832140 - DNA, 15 bp, Homo sapiens
acgattttaaaatga

SEQ ID NO: 5832141 - DNA, 14 bp, Homo sapiens
acgattttgcacaa

SEQ ID NO: 5832142 - DNA, 14 bp, Homo sapiens
acgattttggaaat

SEQ ID NO: 5832143 - DNA, 18 bp, Homo sapiens
acgatttttaaaatgtac

SEQ ID NO: 5832144 - DNA, 23 bp, Homo sapiens
acgcaaaccaacctttctgacat

SEQ ID NO: 5832145 - DNA, 18 bp, Homo sapiens
acgcaaacctctccttcc

SEQ ID NO: 5832146 - DNA, 18 bp, Homo sapiens
acgcaaactttgagcctt

SEQ ID NO: 5832147 - DNA, 17 bp, Homo sapiens
acgcaaatacactccag

SEQ ID NO: 5832148 - DNA, 14 bp, Homo sapiens
acgcaagaggcatc

SEQ ID NO: 5832149 - DNA, 19 bp, Homo sapiens
acgcaagaggtttcagcat

SEQ ID NO: 5832150 - DNA, 14 bp, Homo sapiens
acgcaagcctcagc

SEQ ID NO: 5832151 - DNA, 16 bp, Homo sapiens
acgcaagcctcagcca

SEQ ID NO: 5832152 - DNA, 12 bp, Homo sapiens
acgcaaggaagg

SEQ ID NO: 5832153 - DNA, 17 bp, Homo sapiens
acgcaaggctgtgctct

SEQ ID NO: 5832154 - DNA, 19 bp, Homo sapiens
acgcaaggctgtgctcttc

SEQ ID NO: 5832155 - DNA, 23 bp, Homo sapiens
acgcaagggagaagaaatccata

SEQ ID NO: 5832156 - DNA, 20 bp, Homo sapiens
acgcaagggcatcaggcact

SEQ ID NO: 5832157 - DNA, 21 bp, Homo sapiens
acgcaagggcatcaggcactg

SEQ ID NO: 5832158 - DNA, 13 bp, Homo sapiens
acgcaagtgccag

SEQ ID NO: 5832159 - DNA, 14 bp, Homo sapiens
acgcaagtgtgtga

SEQ ID NO: 5832160 - DNA, 21 bp, Homo sapiens
acgcaataaatttatatactt

SEQ ID NO: 5832161 - DNA, 23 bp, Homo sapiens
acgcaatgaaaagtcgttttcca

SEQ ID NO: 5832162 - DNA, 15 bp, Homo sapiens
acgcacaaacacaca

SEQ ID NO: 5832163 - DNA, 16 bp, Homo sapiens
acgcacaaacacacac

SEQ ID NO: 5832164 - DNA, 17 bp, Homo sapiens
acgcacaaacacacaca

SEQ ID NO: 5832165 - DNA, 16 bp, Homo sapiens
acgcacaacatgcaca

SEQ ID NO: 5832166 - DNA, 18 bp, Homo sapiens
acgcacaacatgcacatt

SEQ ID NO: 5832167 - DNA, 21 bp, Homo sapiens
acgcacacacacacacaggag

SEQ ID NO: 5832168 - DNA, 19 bp, Homo sapiens
acgcacacacacatacaga

SEQ ID NO: 5832169 - DNA, 13 bp, Homo sapiens
acgcacaccctgc

SEQ ID NO: 5832170 - DNA, 22 bp, Homo sapiens
acgcacacgtacttaaatgaaa

SEQ ID NO: 5832171 - DNA, 20 bp, Homo sapiens
acgcacagcactgcctgcca

SEQ ID NO: 5832172 - DNA, 21 bp, Homo sapiens
acgcacagcactgcctgccaa

SEQ ID NO: 5832173 - DNA, 14 bp, Homo sapiens
acgcaccactgcca

SEQ ID NO: 5832174 - DNA, 15 bp, Homo sapiens
acgcaccactgccaa

SEQ ID NO: 5832175 - DNA, 14 bp, Homo sapiens
acgcaccactgctt

SEQ ID NO: 5832176 - DNA, 19 bp, Homo sapiens
acgcaccactgcttcccac

SEQ ID NO: 5832177 - DNA, 15 bp, Homo sapiens
acgcaccagcccaga

SEQ ID NO: 5832178 - DNA, 22 bp, Homo sapiens
acgcacccacaccctacagcag

SEQ ID NO: 5832179 - DNA, 20 bp, Homo sapiens
acgcaccccgcccctgcatg

SEQ ID NO: 5832180 - DNA, 19 bp, Homo sapiens
acgcaccgccgccaccagc

SEQ ID NO: 5832181 - DNA, 14 bp, Homo sapiens
acgcaccggcctgg

SEQ ID NO: 5832182 - DNA, 15 bp, Homo sapiens
acgcacctcccatcc

SEQ ID NO: 5832183 - DNA, 15 bp, Homo sapiens
acgcacctgcctcag

SEQ ID NO: 5832184 - DNA, 16 bp, Homo sapiens
acgcacctgcctcagg

SEQ ID NO: 5832185 - DNA, 19 bp, Homo sapiens
acgcacctgtagtcccagc

SEQ ID NO: 5832186 - DNA, 19 bp, Homo sapiens
acgcacgacgtcagcctct

SEQ ID NO: 5832187 - DNA, 20 bp, Homo sapiens
acgcacgcaacccttgctgc

SEQ ID NO: 5832188 - DNA, 14 bp, Homo sapiens
acgcacgcacacac

SEQ ID NO: 5832189 - DNA, 15 bp, Homo sapiens
acgcacgcacacaca

SEQ ID NO: 5832190 - DNA, 16 bp, Homo sapiens
acgcacgcacacacac

SEQ ID NO: 5832191 - DNA, 20 bp, Homo sapiens
acgcacgtgggtcttcaggg

SEQ ID NO: 5832192 - DNA, 16 bp, Homo sapiens
acgcactccatgagca

SEQ ID NO: 5832193 - DNA, 16 bp, Homo sapiens
acgcactggacagcat

SEQ ID NO: 5832194 - DNA, 20 bp, Homo sapiens
acgcactgggccacggagga

SEQ ID NO: 5832195 - DNA, 15 bp, Homo sapiens
acgcactggtgccaa

SEQ ID NO: 5832196 - DNA, 15 bp, Homo sapiens
acgcacttacaagtg

SEQ ID NO: 5832197 - DNA, 20 bp, Homo sapiens
acgcacttctggggccagcc

SEQ ID NO: 5832198 - DNA, 23 bp, Homo sapiens
acgcacttctggggccagcccct

SEQ ID NO: 5832199 - DNA, 14 bp, Homo sapiens
acgcacttgcctgt

SEQ ID NO: 5832200 - DNA, 16 bp, Homo sapiens
acgcagaagagaaagt

SEQ ID NO: 5832201 - DNA, 11 bp, Homo sapiens
acgcagacaca

SEQ ID NO: 5832202 - DNA, 12 bp, Homo sapiens
acgcagacacac

SEQ ID NO: 5832203 - DNA, 14 bp, Homo sapiens
acgcagacacacac

SEQ ID NO: 5832204 - DNA, 14 bp, Homo sapiens
acgcagagattttc

SEQ ID NO: 5832205 - DNA, 20 bp, Homo sapiens
acgcagagattttcatctat

SEQ ID NO: 5832206 - DNA, 12 bp, Homo sapiens
acgcagagcccc

SEQ ID NO: 5832207 - DNA, 16 bp, Homo sapiens
acgcagagccccggag

SEQ ID NO: 5832208 - DNA, 17 bp, Homo sapiens
acgcagagccccggagc

SEQ ID NO: 5832209 - DNA, 20 bp, Homo sapiens
acgcagaggcggaaaccttg

SEQ ID NO: 5832210 - DNA, 23 bp, Homo sapiens
acgcagaggcggaaaccttgcag

SEQ ID NO: 5832211 - DNA, 17 bp, Homo sapiens
acgcagatgatccatga

SEQ ID NO: 5832212 - DNA, 18 bp, Homo sapiens
acgcagattgggctggct

SEQ ID NO: 5832213 - DNA, 21 bp, Homo sapiens
acgcagattgggctggctctg

SEQ ID NO: 5832214 - DNA, 13 bp, Homo sapiens
acgcagcaccctt

SEQ ID NO: 5832215 - DNA, 12 bp, Homo sapiens
acgcagcagctg

SEQ ID NO: 5832216 - DNA, 14 bp, Homo sapiens
acgcagcaggaggc

SEQ ID NO: 5832217 - DNA, 14 bp, Homo sapiens
acgcagccaggaca

SEQ ID NO: 5832218 - DNA, 15 bp, Homo sapiens
acgcagccaggacac

SEQ ID NO: 5832219 - DNA, 14 bp, Homo sapiens
acgcagccctagag

SEQ ID NO: 5832220 - DNA, 18 bp, Homo sapiens
acgcagccctagagcctg

SEQ ID NO: 5832221 - DNA, 21 bp, Homo sapiens
acgcagccctagagcctgcct

SEQ ID NO: 5832222 - DNA, 22 bp, Homo sapiens
acgcagccctagagcctgcctg

SEQ ID NO: 5832223 - DNA, 23 bp, Homo sapiens
acgcagccctagagcctgcctgg

SEQ ID NO: 5832224 - DNA, 22 bp, Homo sapiens
acgcagccctgggggccagctg

SEQ ID NO: 5832225 - DNA, 12 bp, Homo sapiens
acgcagcctgag

SEQ ID NO: 5832226 - DNA, 13 bp, Homo sapiens
acgcagcctgaga

SEQ ID NO: 5832227 - DNA, 14 bp, Homo sapiens
acgcagcctgagaa

SEQ ID NO: 5832228 - DNA, 16 bp, Homo sapiens
acgcagcctgagaatg

SEQ ID NO: 5832229 - DNA, 13 bp, Homo sapiens
acgcagcctgctc

SEQ ID NO: 5832230 - DNA, 15 bp, Homo sapiens
acgcagctggcagag

SEQ ID NO: 5832231 - DNA, 21 bp, Homo sapiens
acgcagctgggtgcagaagct

SEQ ID NO: 5832232 - DNA, 16 bp, Homo sapiens
acgcaggagagagaga

SEQ ID NO: 5832233 - DNA, 19 bp, Homo sapiens
acgcaggcccccaggtgcc

SEQ ID NO: 5832234 - DNA, 17 bp, Homo sapiens
acgcaggcccctctcct

SEQ ID NO: 5832235 - DNA, 19 bp, Homo sapiens
acgcaggcccctctcctcc

SEQ ID NO: 5832236 - DNA, 20 bp, Homo sapiens
acgcaggcccctctcctccg

SEQ ID NO: 5832237 - DNA, 23 bp, Homo sapiens
acgcaggcccctctcctccgtgg

SEQ ID NO: 5832238 - DNA, 14 bp, Homo sapiens
acgcaggcctccct

SEQ ID NO: 5832239 - DNA, 16 bp, Homo sapiens
acgcaggcggccaggg

SEQ ID NO: 5832240 - DNA, 18 bp, Homo sapiens
acgcaggctgagtccaga

SEQ ID NO: 5832241 - DNA, 11 bp, Homo sapiens
acggcagcccc

SEQ ID NO: 5832242 - DNA, 13 bp, Homo sapiens
acggcagcccccc

SEQ ID NO: 5832243 - DNA, 16 bp, Homo sapiens
acggcagcccccccct

SEQ ID NO: 5832244 - DNA, 21 bp, Homo sapiens
acggcagcccccccctcaagg

SEQ ID NO: 5832245 - DNA, 22 bp, Homo sapiens
acggcagcccccccctcaaggg

SEQ ID NO: 5832246 - DNA, 18 bp, Homo sapiens
acggcagcttgagcctgt

SEQ ID NO: 5832247 - DNA, 20 bp, Homo sapiens
acggcaggagtgtcctggct

SEQ ID NO: 5832248 - DNA, 13 bp, Homo sapiens
acggcaggcgtgt

SEQ ID NO: 5832249 - DNA, 17 bp, Homo sapiens
acggcaggctcactgcc

SEQ ID NO: 5832250 - DNA, 20 bp, Homo sapiens
acggcaggctcactgccagg

SEQ ID NO: 5832251 - DNA, 23 bp, Homo sapiens
acggcagtaaatccacagtgagt

SEQ ID NO: 5832252 - DNA, 22 bp, Homo sapiens
acggcagtcacactgctgggaa

SEQ ID NO: 5832253 - DNA, 22 bp, Homo sapiens
acggcatgtgaattctgtgaag

SEQ ID NO: 5832254 - DNA, 15 bp, Homo sapiens
acggccacacagctg

SEQ ID NO: 5832255 - DNA, 16 bp, Homo sapiens
acggccacacagctgc

SEQ ID NO: 5832256 - DNA, 17 bp, Homo sapiens
acggccacacagctgcc

SEQ ID NO: 5832257 - DNA, 18 bp, Homo sapiens
acggccacacagctgccg

SEQ ID NO: 5832258 - DNA, 19 bp, Homo sapiens
acggccacacagctgccgg

SEQ ID NO: 5832259 - DNA, 18 bp, Homo sapiens
acggccacatcaaagagg

SEQ ID NO: 5832260 - DNA, 16 bp, Homo sapiens
acggccacccaccctt

SEQ ID NO: 5832261 - DNA, 14 bp, Homo sapiens
acggccacccgccc

SEQ ID NO: 5832262 - DNA, 14 bp, Homo sapiens
acggccaggcagat

SEQ ID NO: 5832263 - DNA, 19 bp, Homo sapiens
acggccaggctccctgacc

SEQ ID NO: 5832264 - DNA, 18 bp, Homo sapiens
acggccagggagaagctc

SEQ ID NO: 5832265 - DNA, 15 bp, Homo sapiens
acggccatgagactg

SEQ ID NO: 5832266 - DNA, 17 bp, Homo sapiens
acggccatgagggctgg

SEQ ID NO: 5832267 - DNA, 16 bp, Homo sapiens
acggcccaggccaggt

SEQ ID NO: 5832268 - DNA, 15 bp, Homo sapiens
acggcccagggaggg

SEQ ID NO: 5832269 - DNA, 13 bp, Homo sapiens
acggccccagctt

SEQ ID NO: 5832270 - DNA, 20 bp, Homo sapiens
acggccccagcttctcagct

SEQ ID NO: 5832271 - DNA, 17 bp, Homo sapiens
acggccccgggtccagg

SEQ ID NO: 5832272 - DNA, 19 bp, Homo sapiens
acggcccggcccctcaccc

SEQ ID NO: 5832273 - DNA, 13 bp, Homo sapiens
acggccctcctgg

SEQ ID NO: 5832274 - DNA, 14 bp, Homo sapiens
acggccctcctggg

SEQ ID NO: 5832275 - DNA, 12 bp, Homo sapiens
acggccctgcaa

SEQ ID NO: 5832276 - DNA, 13 bp, Homo sapiens
acggccctgcaat

SEQ ID NO: 5832277 - DNA, 18 bp, Homo sapiens
acggccctgcagccagct

SEQ ID NO: 5832278 - DNA, 11 bp, Homo sapiens
acggccctgcc

SEQ ID NO: 5832279 - DNA, 19 bp, Homo sapiens
acggccctgccccatcctg

SEQ ID NO: 5832280 - DNA, 20 bp, Homo sapiens
acggccctgccccatcctgg

SEQ ID NO: 5832281 - DNA, 12 bp, Homo sapiens
acggccctgcct

SEQ ID NO: 5832282 - DNA, 20 bp, Homo sapiens
acggccctgcctgcctcttg

SEQ ID NO: 5832283 - DNA, 21 bp, Homo sapiens
acggccctgcctgcctcttgg

SEQ ID NO: 5832284 - DNA, 12 bp, Homo sapiens
acggccctggcc

SEQ ID NO: 5832285 - DNA, 23 bp, Homo sapiens
acggccctggccttgggccctct

SEQ ID NO: 5832286 - DNA, 11 bp, Homo sapiens
acggccctgtt

SEQ ID NO: 5832287 - DNA, 23 bp, Homo sapiens
acggcctatgccccacctgccct

SEQ ID NO: 5832288 - DNA, 10 bp, Homo sapiens
acggcctcca

SEQ ID NO: 5832289 - DNA, 15 bp, Homo sapiens
acggcctgatgctcc

SEQ ID NO: 5832290 - DNA, 22 bp, Homo sapiens
acggcctgatgctccctcccct

SEQ ID NO: 5832291 - DNA, 20 bp, Homo sapiens
acggcctgcccagtcgaccc

SEQ ID NO: 5832292 - DNA, 14 bp, Homo sapiens
acggcctgcctgca

SEQ ID NO: 5832293 - DNA, 15 bp, Homo sapiens
acggcctggcatgca

SEQ ID NO: 5832294 - DNA, 20 bp, Homo sapiens
acggcctggcatgcagcttg

SEQ ID NO: 5832295 - DNA, 14 bp, Homo sapiens
acggccttcttggt

SEQ ID NO: 5832296 - DNA, 16 bp, Homo sapiens
acggcgcccccagtgt

SEQ ID NO: 5832297 - DNA, 22 bp, Homo sapiens
acggcgcctttttggcctgtga

SEQ ID NO: 5832298 - DNA, 23 bp, Homo sapiens
acggcgtggtgtgtccctggaca

SEQ ID NO: 5832299 - DNA, 16 bp, Homo sapiens
acggctcactgcagcc

SEQ ID NO: 5832300 - DNA, 23 bp, Homo sapiens
acggctcccacggagcatctcag

SEQ ID NO: 5832301 - DNA, 14 bp, Homo sapiens
acggctcccccagg

SEQ ID NO: 5832302 - DNA, 15 bp, Homo sapiens
acggctccgagggcg

SEQ ID NO: 5832303 - DNA, 12 bp, Homo sapiens
acggctcctcag

SEQ ID NO: 5832304 - DNA, 13 bp, Homo sapiens
acggctcctcaga

SEQ ID NO: 5832305 - DNA, 14 bp, Homo sapiens
acggctcctcagag

SEQ ID NO: 5832306 - DNA, 16 bp, Homo sapiens
acggctcctccccgat

SEQ ID NO: 5832307 - DNA, 17 bp, Homo sapiens
acggctctaggtggggc

SEQ ID NO: 5832308 - DNA, 21 bp, Homo sapiens
acggctctccagacctgagct

SEQ ID NO: 5832309 - DNA, 21 bp, Homo sapiens
acggctctcgtccctctgctc

SEQ ID NO: 5832310 - DNA, 19 bp, Homo sapiens
acggctctgtccccagcct

SEQ ID NO: 5832311 - DNA, 24 bp, Homo sapiens
acggctctgtgcccggtgccatct

SEQ ID NO: 5832312 - DNA, 12 bp, Homo sapiens
acggctgcacct

SEQ ID NO: 5832313 - DNA, 20 bp, Homo sapiens
acggctgcacctgcagggag

SEQ ID NO: 5832314 - DNA, 23 bp, Homo sapiens
acggctgccattggtccaccctt

SEQ ID NO: 5832315 - DNA, 22 bp, Homo sapiens
acggctgcctgacactgagccc

SEQ ID NO: 5832316 - DNA, 13 bp, Homo sapiens
acggctggacctg

SEQ ID NO: 5832317 - DNA, 22 bp, Homo sapiens
acggctggcatggtggctcccg

SEQ ID NO: 5832318 - DNA, 11 bp, Homo sapiens
acggctgggca

SEQ ID NO: 5832319 - DNA, 19 bp, Homo sapiens
acggctggtcactctgccc

SEQ ID NO: 5832320 - DNA, 20 bp, Homo sapiens
acggctggtcactctgccct

SEQ ID NO: 5832321 - DNA, 23 bp, Homo sapiens
acggctggtcactctgccctctg

SEQ ID NO: 5832322 - DNA, 12 bp, Homo sapiens
acggctgtgacg

SEQ ID NO: 5832323 - DNA, 20 bp, Homo sapiens
acggctgtggaccgtggaca

SEQ ID NO: 5832324 - DNA, 22 bp, Homo sapiens
acggctgttcccctcacccaaa

SEQ ID NO: 5832325 - DNA, 23 bp, Homo sapiens
acggcttagacttcgactcagga

SEQ ID NO: 5832326 - DNA, 16 bp, Homo sapiens
acggcttcactgacca

SEQ ID NO: 5832327 - DNA, 22 bp, Homo sapiens
acggcttcactgaccagcggct

SEQ ID NO: 5832328 - DNA, 22 bp, Homo sapiens
acggcttcctataacttcttcc

SEQ ID NO: 5832329 - DNA, 18 bp, Homo sapiens
acggcttttacttaaacc

SEQ ID NO: 5832330 - DNA, 21 bp, Homo sapiens
acgggaagcctccgtcaggag

SEQ ID NO: 5832331 - DNA, 23 bp, Homo sapiens
acgggacatcacagggtgggcct

SEQ ID NO: 5832332 - DNA, 20 bp, Homo sapiens
acgggaccctgcccagagct

SEQ ID NO: 5832333 - DNA, 16 bp, Homo sapiens
acgggactgacgcaac

SEQ ID NO: 5832334 - DNA, 13 bp, Homo sapiens
acgggagagcgcc

SEQ ID NO: 5832335 - DNA, 19 bp, Homo sapiens
acgggagcattggcccctg

SEQ ID NO: 5832336 - DNA, 23 bp, Homo sapiens
acgggagctggggagaggaaaga

SEQ ID NO: 5832337 - DNA, 13 bp, Homo sapiens
acgggaggcccca

SEQ ID NO: 5832338 - DNA, 17 bp, Homo sapiens
acgggaggccccagctc

SEQ ID NO: 5832339 - DNA, 12 bp, Homo sapiens
acgggaggggag

SEQ ID NO: 5832340 - DNA, 16 bp, Homo sapiens
acgggaggggaggcat

SEQ ID NO: 5832341 - DNA, 19 bp, Homo sapiens
acgggaggggaggcattga

SEQ ID NO: 5832342 - DNA, 20 bp, Homo sapiens
acgggagggtaaggctgtgg

SEQ ID NO: 5832343 - DNA, 17 bp, Homo sapiens
acgggagtgacccagct

SEQ ID NO: 5832344 - DNA, 16 bp, Homo sapiens
acgggagtggccatct

SEQ ID NO: 5832345 - DNA, 15 bp, Homo sapiens
acgggatgacctcca

SEQ ID NO: 5832346 - DNA, 16 bp, Homo sapiens
acgggatgacctccag

SEQ ID NO: 5832347 - DNA, 16 bp, Homo sapiens
acgggatgcgtgggag

SEQ ID NO: 5832348 - DNA, 13 bp, Homo sapiens
acgggatgctctt

SEQ ID NO: 5832349 - DNA, 18 bp, Homo sapiens
acgggcaacactcactgc

SEQ ID NO: 5832350 - DNA, 17 bp, Homo sapiens
acgggcaagaagctgct

SEQ ID NO: 5832351 - DNA, 20 bp, Homo sapiens
acgggcaagtgagaggggag

SEQ ID NO: 5832352 - DNA, 21 bp, Homo sapiens
acgggcaagtgagaggggagg

SEQ ID NO: 5832353 - DNA, 23 bp, Homo sapiens
acgggcacaagacccctgctcct

SEQ ID NO: 5832354 - DNA, 11 bp, Homo sapiens
acgggcagcca

SEQ ID NO: 5832355 - DNA, 21 bp, Homo sapiens
acgggcagccacaggactgag

SEQ ID NO: 5832356 - DNA, 16 bp, Homo sapiens
acgggcagtctgctct

SEQ ID NO: 5832357 - DNA, 20 bp, Homo sapiens
acgggcagtctgctctgctg

SEQ ID NO: 5832358 - DNA, 18 bp, Homo sapiens
acgggcatgggcactccc

SEQ ID NO: 5832359 - DNA, 22 bp, Homo sapiens
acgggccaggccctggagggca

SEQ ID NO: 5832360 - DNA, 15 bp, Homo sapiens
acgggcccatggcct

SEQ ID NO: 5832361 - DNA, 20 bp, Homo sapiens
acgggcccgggttgggtcac

SEQ ID NO: 5832362 - DNA, 12 bp, Homo sapiens
acgggccctccc

SEQ ID NO: 5832363 - DNA, 21 bp, Homo sapiens
acgggccctccttccctcctg

SEQ ID NO: 5832364 - DNA, 22 bp, Homo sapiens
acgggccctccttccctcctgt

SEQ ID NO: 5832365 - DNA, 13 bp, Homo sapiens
acgggccctgccc

SEQ ID NO: 5832366 - DNA, 16 bp, Homo sapiens
acgggccctgccccag

SEQ ID NO: 5832367 - DNA, 18 bp, Homo sapiens
acgggccgcaggagggag

SEQ ID NO: 5832368 - DNA, 13 bp, Homo sapiens
acgggccggccag

SEQ ID NO: 5832369 - DNA, 15 bp, Homo sapiens
acgggcctcagtttc

SEQ ID NO: 5832370 - DNA, 16 bp, Homo sapiens
acgggcctcagtttcc

SEQ ID NO: 5832371 - DNA, 19 bp, Homo sapiens
acgggcctcagtttcccca

SEQ ID NO: 5832372 - DNA, 19 bp, Homo sapiens
acgggcctctgcttgccag

SEQ ID NO: 5832373 - DNA, 21 bp, Homo sapiens
acgggcctctgcttgccagcc

SEQ ID NO: 5832374 - DNA, 22 bp, Homo sapiens
acgggcctctgcttgccagcca

SEQ ID NO: 5832375 - DNA, 16 bp, Homo sapiens
acgggcgagctttctc

SEQ ID NO: 5832376 - DNA, 15 bp, Homo sapiens
acgggcgctgcagcc

SEQ ID NO: 5832377 - DNA, 19 bp, Homo sapiens
acgggcgctgcagcctccc

SEQ ID NO: 5832378 - DNA, 13 bp, Homo sapiens
acgggcggtcctg

SEQ ID NO: 5832379 - DNA, 18 bp, Homo sapiens
acgggcggtcctgcacag

SEQ ID NO: 5832380 - DNA, 20 bp, Homo sapiens
acgggctctatgcctgcact

SEQ ID NO: 5832381 - DNA, 14 bp, Homo sapiens
acgggctgccctgc

SEQ ID NO: 5832382 - DNA, 19 bp, Homo sapiens
acgggctgtccgtgtgcct

SEQ ID NO: 5832383 - DNA, 16 bp, Homo sapiens
acggggaccactgggc

SEQ ID NO: 5832384 - DNA, 13 bp, Homo sapiens
acggggacctgga

SEQ ID NO: 5832385 - DNA, 12 bp, Homo sapiens
acggggagaaaa

SEQ ID NO: 5832386 - DNA, 19 bp, Homo sapiens
acggggagtgagactcctg

SEQ ID NO: 5832387 - DNA, 20 bp, Homo sapiens
acggggatggttccccagga

SEQ ID NO: 5832388 - DNA, 19 bp, Homo sapiens
acggggcacccagcccaac

SEQ ID NO: 5832389 - DNA, 22 bp, Homo sapiens
acggggcagtactcctccctgg

SEQ ID NO: 5832390 - DNA, 23 bp, Homo sapiens
acggggcagtactcctccctggg

SEQ ID NO: 5832391 - DNA, 15 bp, Homo sapiens
acggggccagcatcc

SEQ ID NO: 5832392 - DNA, 18 bp, Homo sapiens
acggggcctccaacccat

SEQ ID NO: 5832393 - DNA, 15 bp, Homo sapiens
acggggcgggccctg

SEQ ID NO: 5832394 - DNA, 19 bp, Homo sapiens
acggggctcccctggacag

SEQ ID NO: 5832395 - DNA, 15 bp, Homo sapiens
acgggggctgtgact

SEQ ID NO: 5832396 - DNA, 20 bp, Homo sapiens
acgggggctgtggctctggg

SEQ ID NO: 5832397 - DNA, 22 bp, Homo sapiens
acggggggccccagtcagcctc

SEQ ID NO: 5832398 - DNA, 23 bp, Homo sapiens
acggggggccccagtcagcctct

SEQ ID NO: 5832399 - DNA, 14 bp, Homo sapiens
acggggggctcctg

SEQ ID NO: 5832400 - DNA, 21 bp, Homo sapiens
acggggggctcctgcccaggc

SEQ ID NO: 5832401 - DNA, 21 bp, Homo sapiens
acgggggtgcggcaggagcag

SEQ ID NO: 5832402 - DNA, 19 bp, Homo sapiens
acggggtctccctgtgtta

SEQ ID NO: 5832403 - DNA, 15 bp, Homo sapiens
acggggtggacgagg

SEQ ID NO: 5832404 - DNA, 14 bp, Homo sapiens
acggggtggggagg

SEQ ID NO: 5832405 - DNA, 20 bp, Homo sapiens
acggggttggctgttccaga

SEQ ID NO: 5832406 - DNA, 16 bp, Homo sapiens
acggggtttcaccatg

SEQ ID NO: 5832407 - DNA, 20 bp, Homo sapiens
acggggtttcatcatgttga

SEQ ID NO: 5832408 - DNA, 21 bp, Homo sapiens
acgggtaacagtgaggctggg

SEQ ID NO: 5832409 - DNA, 20 bp, Homo sapiens
acgggtcagtattaaggttt

SEQ ID NO: 5832410 - DNA, 15 bp, Homo sapiens
acgggtgccagaagc

SEQ ID NO: 5832411 - DNA, 23 bp, Homo sapiens
acgggtgcccgtaatcccagcta

SEQ ID NO: 5832412 - DNA, 15 bp, Homo sapiens
acgggtgcctggtca

SEQ ID NO: 5832413 - DNA, 19 bp, Homo sapiens
acgggtgtcacggccaggc

SEQ ID NO: 5832414 - DNA, 14 bp, Homo sapiens
acgggtgtggctcg

SEQ ID NO: 5832415 - DNA, 18 bp, Homo sapiens
acgggttcaccatgttgc

SEQ ID NO: 5832416 - DNA, 15 bp, Homo sapiens
acgggttgaaagaca

SEQ ID NO: 5832417 - DNA, 18 bp, Homo sapiens
acgggttgaaagacatca

SEQ ID NO: 5832418 - DNA, 21 bp, Homo sapiens
acgttgaaccacgtgaaactg

SEQ ID NO: 5832419 - DNA, 18 bp, Homo sapiens
acgttgacaccaagaaac

SEQ ID NO: 5832420 - DNA, 17 bp, Homo sapiens
acgttgacccctttccc

SEQ ID NO: 5832421 - DNA, 19 bp, Homo sapiens
acgttgacccctttccccc

SEQ ID NO: 5832422 - DNA, 16 bp, Homo sapiens
acgttgagcccctgga

SEQ ID NO: 5832423 - DNA, 16 bp, Homo sapiens
acgttgatctcctggt

SEQ ID NO: 5832424 - DNA, 20 bp, Homo sapiens
acgttgatctcctggtagca

SEQ ID NO: 5832425 - DNA, 16 bp, Homo sapiens
acgttgatgtctgaac

SEQ ID NO: 5832426 - DNA, 21 bp, Homo sapiens
acgttgcagaaaaagagcttc

SEQ ID NO: 5832427 - DNA, 22 bp, Homo sapiens
acgttgccacaccaatcagaga

SEQ ID NO: 5832428 - DNA, 23 bp, Homo sapiens
acgttgcccaaggttgcacagca

SEQ ID NO: 5832429 - DNA, 15 bp, Homo sapiens
acgttgctgtgggaa

SEQ ID NO: 5832430 - DNA, 23 bp, Homo sapiens
acgttggacttttcgttaacatt

SEQ ID NO: 5832431 - DNA, 12 bp, Homo sapiens
acgttggcctca

SEQ ID NO: 5832432 - DNA, 15 bp, Homo sapiens
acgttggtcccaagt

SEQ ID NO: 5832433 - DNA, 15 bp, Homo sapiens
acgttgttgtcattg

SEQ ID NO: 5832434 - DNA, 20 bp, Homo sapiens
acgttgtttcttatagattt

SEQ ID NO: 5832435 - DNA, 15 bp, Homo sapiens
acgtttaaagttctg

SEQ ID NO: 5832436 - DNA, 20 bp, Homo sapiens
acgtttaatcccagcacttt

SEQ ID NO: 5832437 - DNA, 11 bp, Homo sapiens
acgtttataaa

SEQ ID NO: 5832438 - DNA, 16 bp, Homo sapiens
acgtttataaacagaa

SEQ ID NO: 5832439 - DNA, 19 bp, Homo sapiens
acgtttataaacagaaatg

SEQ ID NO: 5832440 - DNA, 21 bp, Homo sapiens
acgtttattaggaaaagatat

SEQ ID NO: 5832441 - DNA, 13 bp, Homo sapiens
acgtttcactgca

SEQ ID NO: 5832442 - DNA, 17 bp, Homo sapiens
acgtttcagtaataaaa

SEQ ID NO: 5832443 - DNA, 12 bp, Homo sapiens
acgtttccatca

SEQ ID NO: 5832444 - DNA, 21 bp, Homo sapiens
acgtttccccaataaagcctt

SEQ ID NO: 5832445 - DNA, 22 bp, Homo sapiens
acgtttccccaataaagccttt

SEQ ID NO: 5832446 - DNA, 15 bp, Homo sapiens
acgtttcctgagaag

SEQ ID NO: 5832447 - DNA, 12 bp, Homo sapiens
acgtttctggaa

SEQ ID NO: 5832448 - DNA, 16 bp, Homo sapiens
acgtttgacaaacaca

SEQ ID NO: 5832449 - DNA, 18 bp, Homo sapiens
acgtttgacaaacacaat

SEQ ID NO: 5832450 - DNA, 18 bp, Homo sapiens
acgtttgcaccgcctgcc

SEQ ID NO: 5832451 - DNA, 19 bp, Homo sapiens
acgtttgcagtcacacaca

SEQ ID NO: 5832452 - DNA, 17 bp, Homo sapiens
acgtttgcatagagaga

SEQ ID NO: 5832453 - DNA, 22 bp, Homo sapiens
acgtttgcggcagtgttccttg

SEQ ID NO: 5832454 - DNA, 18 bp, Homo sapiens
acgtttgtaatcccagtt

SEQ ID NO: 5832455 - DNA, 14 bp, Homo sapiens
acgtttgtgagaag

SEQ ID NO: 5832456 - DNA, 14 bp, Homo sapiens
acgtttgttcccca

SEQ ID NO: 5832457 - DNA, 17 bp, Homo sapiens
acgtttgttcgcttcct

SEQ ID NO: 5832458 - DNA, 12 bp, Homo sapiens
acgttttaagga

SEQ ID NO: 5832459 - DNA, 11 bp, Homo sapiens
acgttttatga

SEQ ID NO: 5832460 - DNA, 14 bp, Homo sapiens
acgttttatgtgaa

SEQ ID NO: 5832461 - DNA, 12 bp, Homo sapiens
acgttttattgg

SEQ ID NO: 5832462 - DNA, 15 bp, Homo sapiens
acgttttattgtgtt

SEQ ID NO: 5832463 - DNA, 16 bp, Homo sapiens
acgttttattgtgttt

SEQ ID NO: 5832464 - DNA, 18 bp, Homo sapiens
acgttttattgtgttttt

SEQ ID NO: 5832465 - DNA, 17 bp, Homo sapiens
acgttttctactttgaa

SEQ ID NO: 5832466 - DNA, 18 bp, Homo sapiens
acgttttctactttgaaa

SEQ ID NO: 5832467 - DNA, 21 bp, Homo sapiens
acgttttctcttccttgtgat

SEQ ID NO: 5832468 - DNA, 20 bp, Homo sapiens
acgttttcttctttccctgg

SEQ ID NO: 5832469 - DNA, 21 bp, Homo sapiens
acgttttcttctttccctgga

SEQ ID NO: 5832470 - DNA, 23 bp, Homo sapiens
acgttttcttctttccctggaca

SEQ ID NO: 5832471 - DNA, 16 bp, Homo sapiens
acgttttctttacaca

SEQ ID NO: 5832472 - DNA, 17 bp, Homo sapiens
acgttttgcacattttg

SEQ ID NO: 5832473 - DNA, 12 bp, Homo sapiens
acgtttttacat

SEQ ID NO: 5832474 - DNA, 21 bp, Homo sapiens
acgtttttcttcttgggcccg

SEQ ID NO: 5832475 - DNA, 19 bp, Homo sapiens
acgtttttggaaaatgtat

SEQ ID NO: 5832476 - DNA, 17 bp, Homo sapiens
acgttttttctgcacaa

SEQ ID NO: 5832477 - DNA, 15 bp, Homo sapiens
actaaaaaaaagatg

SEQ ID NO: 5832478 - DNA, 20 bp, Homo sapiens
actaaaaaatataaaaatta

SEQ ID NO: 5832479 - DNA, 15 bp, Homo sapiens
actaaaaacaaaccc

SEQ ID NO: 5832480 - DNA, 17 bp, Homo sapiens
actaaaaagaaggaaaa

SEQ ID NO: 5832481 - DNA, 14 bp, Homo sapiens
actaaaaagtggct

SEQ ID NO: 5832482 - DNA, 21 bp, Homo sapiens
actaaaaagtggctaattcaa

SEQ ID NO: 5832483 - DNA, 16 bp, Homo sapiens
actaaaaataaattaa

SEQ ID NO: 5832484 - DNA, 13 bp, Homo sapiens
actaaaaatacaa

SEQ ID NO: 5832485 - DNA, 14 bp, Homo sapiens
actaaaaatacacc

SEQ ID NO: 5832486 - DNA, 12 bp, Homo sapiens
actaaaaataga

SEQ ID NO: 5832487 - DNA, 16 bp, Homo sapiens
actaaaaatatgaaat

SEQ ID NO: 5832488 - DNA, 15 bp, Homo sapiens
actaaaaatattgtt

SEQ ID NO: 5832489 - DNA, 20 bp, Homo sapiens
actaaaaatttacaagagaa

SEQ ID NO: 5832490 - DNA, 14 bp, Homo sapiens
actaaaaattttta

SEQ ID NO: 5832491 - DNA, 18 bp, Homo sapiens
actaaaacttgaggcaga

SEQ ID NO: 5832492 - DNA, 13 bp, Homo sapiens
actaaaagaaact

SEQ ID NO: 5832493 - DNA, 11 bp, Homo sapiens
actaaaagaat

SEQ ID NO: 5832494 - DNA, 16 bp, Homo sapiens
actaaaagatataagt

SEQ ID NO: 5832495 - DNA, 16 bp, Homo sapiens
actaaaagtctccaaa

SEQ ID NO: 5832496 - DNA, 13 bp, Homo sapiens
actaaaagtgatg

SEQ ID NO: 5832497 - DNA, 12 bp, Homo sapiens
actaaaagtgtg

SEQ ID NO: 5832498 - DNA, 20 bp, Homo sapiens
actaaaagttcttctccaat

SEQ ID NO: 5832499 - DNA, 14 bp, Homo sapiens
actaaaataatttt

SEQ ID NO: 5832500 - DNA, 15 bp, Homo sapiens
actaaaataattttg

SEQ ID NO: 5832501 - DNA, 16 bp, Homo sapiens
actaaaatcgtattct

SEQ ID NO: 5832502 - DNA, 14 bp, Homo sapiens
actaaaatgttcta

SEQ ID NO: 5832503 - DNA, 15 bp, Homo sapiens
actaaaatgttctaa

SEQ ID NO: 5832504 - DNA, 22 bp, Homo sapiens
actaaaatgtttaattcattaa

SEQ ID NO: 5832505 - DNA, 14 bp, Homo sapiens
actaaaattcaaca

SEQ ID NO: 5832506 - DNA, 18 bp, Homo sapiens
actaaaattcaacaaatg

SEQ ID NO: 5832507 - DNA, 19 bp, Homo sapiens
actaaaattcaacaaatga

SEQ ID NO: 5832508 - DNA, 20 bp, Homo sapiens
actaaaattcaacaaatgat

SEQ ID NO: 5832509 - DNA, 13 bp, Homo sapiens
actaaaatttaaa

SEQ ID NO: 5832510 - DNA, 13 bp, Homo sapiens
actaaaatttaca

SEQ ID NO: 5832511 - DNA, 16 bp, Homo sapiens
actaaaatttacacat

SEQ ID NO: 5832512 - DNA, 15 bp, Homo sapiens
actaaacagaaaact

SEQ ID NO: 5832513 - DNA, 13 bp, Homo sapiens
actaaacatgtat

SEQ ID NO: 5832514 - DNA, 13 bp, Homo sapiens
actaaacattttg

SEQ ID NO: 5832515 - DNA, 14 bp, Homo sapiens
actaaacattttgt

SEQ ID NO: 5832516 - DNA, 17 bp, Homo sapiens
actaaaccaactctaat

SEQ ID NO: 5832517 - DNA, 18 bp, Homo sapiens
actaaaccaactctaata

SEQ ID NO: 5832518 - DNA, 16 bp, Homo sapiens
actaaaccacttaaaa

SEQ ID NO: 5832519 - DNA, 13 bp, Homo sapiens
actaaaccacttc

SEQ ID NO: 5832520 - DNA, 18 bp, Homo sapiens
actaaaccacttctctgc

SEQ ID NO: 5832521 - DNA, 21 bp, Homo sapiens
actaaaccacttctctgctgc

SEQ ID NO: 5832522 - DNA, 20 bp, Homo sapiens
actaaaccccatacctggaa

SEQ ID NO: 5832523 - DNA, 23 bp, Homo sapiens
actaaacgggcgccaagactcag

SEQ ID NO: 5832524 - DNA, 15 bp, Homo sapiens
actaaactacagaaa

SEQ ID NO: 5832525 - DNA, 20 bp, Homo sapiens
actaaactacattgttctta

SEQ ID NO: 5832526 - DNA, 20 bp, Homo sapiens
actaaactatctgtatttat

SEQ ID NO: 5832527 - DNA, 16 bp, Homo sapiens
actaaactccatgata

SEQ ID NO: 5832528 - DNA, 21 bp, Homo sapiens
actaaactctgaataagcact

SEQ ID NO: 5832529 - DNA, 13 bp, Homo sapiens
actaaactctggg

SEQ ID NO: 5832530 - DNA, 18 bp, Homo sapiens
actaaactctggggcttg

SEQ ID NO: 5832531 - DNA, 17 bp, Homo sapiens
actaaactcttaccata

SEQ ID NO: 5832532 - DNA, 23 bp, Homo sapiens
actaaactggtttgttgcagcca

SEQ ID NO: 5832533 - DNA, 18 bp, Homo sapiens
actaaacttggtgcttat

SEQ ID NO: 5832534 - DNA, 17 bp, Homo sapiens
actaaactttttttctg

SEQ ID NO: 5832535 - DNA, 18 bp, Homo sapiens
actaaactttttttctgt

SEQ ID NO: 5832536 - DNA, 22 bp, Homo sapiens
actaaactttttttctgtacca

SEQ ID NO: 5832537 - DNA, 17 bp, Homo sapiens
actaaagaaagattact

SEQ ID NO: 5832538 - DNA, 18 bp, Homo sapiens
actaaagaagatctgtaa

SEQ ID NO: 5832539 - DNA, 21 bp, Homo sapiens
actaaagaatagtgcctcagc

SEQ ID NO: 5832540 - DNA, 12 bp, Homo sapiens
actaaagagaga

SEQ ID NO: 5832541 - DNA, 18 bp, Homo sapiens
actaaagagtgaatgcca

SEQ ID NO: 5832542 - DNA, 21 bp, Homo sapiens
actaaagatatcagagctctt

SEQ ID NO: 5832543 - DNA, 16 bp, Homo sapiens
actaaagcaaattgtt

SEQ ID NO: 5832544 - DNA, 17 bp, Homo sapiens
actaaagcaggcctttt

SEQ ID NO: 5832545 - DNA, 17 bp, Homo sapiens
actaaagcagtttttaa

SEQ ID NO: 5832546 - DNA, 15 bp, Homo sapiens
actaaagcatgaaat

SEQ ID NO: 5832547 - DNA, 17 bp, Homo sapiens
actaaagccaaacatat

SEQ ID NO: 5832548 - DNA, 13 bp, Homo sapiens
actaaagccaagg

SEQ ID NO: 5832549 - DNA, 22 bp, Homo sapiens
actaaagccaggaacagggacc

SEQ ID NO: 5832550 - DNA, 17 bp, Homo sapiens
actaaagccatttgtct

SEQ ID NO: 5832551 - DNA, 21 bp, Homo sapiens
actaaaggtggttttattttc

SEQ ID NO: 5832552 - DNA, 16 bp, Homo sapiens
actaaagtagagccct

SEQ ID NO: 5832553 - DNA, 14 bp, Homo sapiens
actaaagtgtctat

SEQ ID NO: 5832554 - DNA, 19 bp, Homo sapiens
actaaagtgtgctttataa

SEQ ID NO: 5832555 - DNA, 23 bp, Homo sapiens
actaaagtgtgctttataaaaaa

SEQ ID NO: 5832556 - DNA, 22 bp, Homo sapiens
actaaagttgtactttaaaaat

SEQ ID NO: 5832557 - DNA, 13 bp, Homo sapiens
actaaataaaaaa

SEQ ID NO: 5832558 - DNA, 16 bp, Homo sapiens
actaaataaactactt

SEQ ID NO: 5832559 - DNA, 21 bp, Homo sapiens
actaaataacacagatattgt

SEQ ID NO: 5832560 - DNA, 21 bp, Homo sapiens
actaaataatgaataaactga

SEQ ID NO: 5832561 - DNA, 19 bp, Homo sapiens
actaaatagatttttagat

SEQ ID NO: 5832562 - DNA, 19 bp, Homo sapiens
actaaatagcatgtattgt

SEQ ID NO: 5832563 - DNA, 23 bp, Homo sapiens
actaaatatataaagtatatgtt

SEQ ID NO: 5832564 - DNA, 16 bp, Homo sapiens
actaaatatatgtctg

SEQ ID NO: 5832565 - DNA, 18 bp, Homo sapiens
actaaatatatgtctgtg

SEQ ID NO: 5832566 - DNA, 14 bp, Homo sapiens
actaaatatctagt

SEQ ID NO: 5832567 - DNA, 17 bp, Homo sapiens
actaaatatgaaatttt

SEQ ID NO: 5832568 - DNA, 20 bp, Homo sapiens
actaaatatttaagtgcagt

SEQ ID NO: 5832569 - DNA, 14 bp, Homo sapiens
actaaatattttat

SEQ ID NO: 5832570 - DNA, 21 bp, Homo sapiens
actaaatcagagacaaaatat

SEQ ID NO: 5832571 - DNA, 14 bp, Homo sapiens
actaaatcccctca

SEQ ID NO: 5832572 - DNA, 14 bp, Homo sapiens
actaaatctgtaag

SEQ ID NO: 5832573 - DNA, 18 bp, Homo sapiens
actaaatctgtaagctct

SEQ ID NO: 5832574 - DNA, 19 bp, Homo sapiens
actaaatctgtaagctctt

SEQ ID NO: 5832575 - DNA, 14 bp, Homo sapiens
actaaatgagctcc

SEQ ID NO: 5832576 - DNA, 16 bp, Homo sapiens
actaaatgagctcctg

SEQ ID NO: 5832577 - DNA, 12 bp, Homo sapiens
actaaatgataa

SEQ ID NO: 5832578 - DNA, 17 bp, Homo sapiens
actaaatggcagtgaga

SEQ ID NO: 5832579 - DNA, 22 bp, Homo sapiens
actaaatggcagtgagatgtca

SEQ ID NO: 5832580 - DNA, 16 bp, Homo sapiens
actaaatggcctctct

SEQ ID NO: 5832581 - DNA, 22 bp, Homo sapiens
actaaatggcctctctccacta

SEQ ID NO: 5832582 - DNA, 18 bp, Homo sapiens
actaaatggtgttacatt

SEQ ID NO: 5832583 - DNA, 19 bp, Homo sapiens
actaaatggtgttacatta

SEQ ID NO: 5832584 - DNA, 20 bp, Homo sapiens
actaaatggtgttacattaa

SEQ ID NO: 5832585 - DNA, 13 bp, Homo sapiens
actaaatggttgt

SEQ ID NO: 5832586 - DNA, 22 bp, Homo sapiens
actaaatgtagttgtcacacta

SEQ ID NO: 5832587 - DNA, 15 bp, Homo sapiens
actaaatgtgtacac

SEQ ID NO: 5832588 - DNA, 13 bp, Homo sapiens
actaaatgttaaa

SEQ ID NO: 5832589 - DNA, 18 bp, Homo sapiens
actaaatgttaaagatgt

SEQ ID NO: 5832590 - DNA, 13 bp, Homo sapiens
actaaattactgt

SEQ ID NO: 5832591 - DNA, 20 bp, Homo sapiens
actaaattcgtgattttcaa

SEQ ID NO: 5832592 - DNA, 22 bp, Homo sapiens
actaaattgcagtttacagtat

SEQ ID NO: 5832593 - DNA, 18 bp, Homo sapiens
actaaattgtaaactcct

SEQ ID NO: 5832594 - DNA, 21 bp, Homo sapiens
actaaattgtatacattttgt

SEQ ID NO: 5832595 - DNA, 12 bp, Homo sapiens
actaaatttaaa

SEQ ID NO: 5832596 - DNA, 17 bp, Homo sapiens
actaaatttgatactta

SEQ ID NO: 5832597 - DNA, 20 bp, Homo sapiens
actacgggggggagaaggaa

SEQ ID NO: 5832598 - DNA, 14 bp, Homo sapiens
actacgtgttcaca

SEQ ID NO: 5832599 - DNA, 18 bp, Homo sapiens
actactaacaaatgtaaa

SEQ ID NO: 5832600 - DNA, 13 bp, Homo sapiens
actactacatctg

SEQ ID NO: 5832601 - DNA, 22 bp, Homo sapiens
actactacctcttaagtcccag

SEQ ID NO: 5832602 - DNA, 17 bp, Homo sapiens
actactagatcacttgt

SEQ ID NO: 5832603 - DNA, 19 bp, Homo sapiens
actactagatcacttgtcc

SEQ ID NO: 5832604 - DNA, 14 bp, Homo sapiens
actactagattgac

SEQ ID NO: 5832605 - DNA, 16 bp, Homo sapiens
actactaggtaataat

SEQ ID NO: 5832606 - DNA, 14 bp, Homo sapiens
actactatggctgt

SEQ ID NO: 5832607 - DNA, 13 bp, Homo sapiens
actactattcaaa

SEQ ID NO: 5832608 - DNA, 14 bp, Homo sapiens
actactattctgtt

SEQ ID NO: 5832609 - DNA, 14 bp, Homo sapiens
actactatttttct

SEQ ID NO: 5832610 - DNA, 20 bp, Homo sapiens
actactatttttctttccaa

SEQ ID NO: 5832611 - DNA, 19 bp, Homo sapiens
actactcaatactacctct

SEQ ID NO: 5832612 - DNA, 12 bp, Homo sapiens
actactcagcat

SEQ ID NO: 5832613 - DNA, 17 bp, Homo sapiens
actactcagggaatgaa

SEQ ID NO: 5832614 - DNA, 15 bp, Homo sapiens
actactcagttatta

SEQ ID NO: 5832615 - DNA, 20 bp, Homo sapiens
actactccggagacagggtt

SEQ ID NO: 5832616 - DNA, 12 bp, Homo sapiens
actactctgcca

SEQ ID NO: 5832617 - DNA, 13 bp, Homo sapiens
actactctgcctg

SEQ ID NO: 5832618 - DNA, 14 bp, Homo sapiens
actactcttacatg

SEQ ID NO: 5832619 - DNA, 14 bp, Homo sapiens
actactctttgatt

SEQ ID NO: 5832620 - DNA, 14 bp, Homo sapiens
actactgaactgtt

SEQ ID NO: 5832621 - DNA, 16 bp, Homo sapiens
actactgaataatgct

SEQ ID NO: 5832622 - DNA, 21 bp, Homo sapiens
actactgaataatgctaccag

SEQ ID NO: 5832623 - DNA, 16 bp, Homo sapiens
actactgacgaaagag

SEQ ID NO: 5832624 - DNA, 17 bp, Homo sapiens
actactgacgaaagagt

SEQ ID NO: 5832625 - DNA, 20 bp, Homo sapiens
actactgattttaaaatgaa

SEQ ID NO: 5832626 - DNA, 16 bp, Homo sapiens
actactgcaaaaagta

SEQ ID NO: 5832627 - DNA, 18 bp, Homo sapiens
actactgcaaaaagtaca

SEQ ID NO: 5832628 - DNA, 17 bp, Homo sapiens
actactgcagtctttat

SEQ ID NO: 5832629 - DNA, 15 bp, Homo sapiens
actactgcctttcaa

SEQ ID NO: 5832630 - DNA, 16 bp, Homo sapiens
actactgctatttttt

SEQ ID NO: 5832631 - DNA, 20 bp, Homo sapiens
actactgctattttttttaa

SEQ ID NO: 5832632 - DNA, 17 bp, Homo sapiens
actactgctcctgtggc

SEQ ID NO: 5832633 - DNA, 17 bp, Homo sapiens
actactgctgcaaagtg

SEQ ID NO: 5832634 - DNA, 12 bp, Homo sapiens
actactgggtgt

SEQ ID NO: 5832635 - DNA, 14 bp, Homo sapiens
actactgggtgtca

SEQ ID NO: 5832636 - DNA, 16 bp, Homo sapiens
actactgggtgtcatt

SEQ ID NO: 5832637 - DNA, 19 bp, Homo sapiens
actactgggtgtcatttca

SEQ ID NO: 5832638 - DNA, 23 bp, Homo sapiens
actactgggtgtcatttcattcc

SEQ ID NO: 5832639 - DNA, 14 bp, Homo sapiens
actactggtgatgc

SEQ ID NO: 5832640 - DNA, 18 bp, Homo sapiens
actactggtgatgcctaa

SEQ ID NO: 5832641 - DNA, 13 bp, Homo sapiens
actactgtacatt

SEQ ID NO: 5832642 - DNA, 15 bp, Homo sapiens
actactgtacatttt

SEQ ID NO: 5832643 - DNA, 22 bp, Homo sapiens
actactgtagaactgattttac

SEQ ID NO: 5832644 - DNA, 18 bp, Homo sapiens
actactgtatttcattat

SEQ ID NO: 5832645 - DNA, 18 bp, Homo sapiens
actactgtgttcctggca

SEQ ID NO: 5832646 - DNA, 23 bp, Homo sapiens
actactgttaggaacagcagtgt

SEQ ID NO: 5832647 - DNA, 14 bp, Homo sapiens
actacttagcactg

SEQ ID NO: 5832648 - DNA, 17 bp, Homo sapiens
actacttagcatcctaa

SEQ ID NO: 5832649 - DNA, 21 bp, Homo sapiens
actacttagcatcctaagaaa

SEQ ID NO: 5832650 - DNA, 13 bp, Homo sapiens
actacttcatttt

SEQ ID NO: 5832651 - DNA, 19 bp, Homo sapiens
actacttccatccctgctt

SEQ ID NO: 5832652 - DNA, 16 bp, Homo sapiens
actacttctctctgta

SEQ ID NO: 5832653 - DNA, 17 bp, Homo sapiens
actacttcttggaaaaa

SEQ ID NO: 5832654 - DNA, 16 bp, Homo sapiens
actacttgttaccttt

SEQ ID NO: 5832655 - DNA, 17 bp, Homo sapiens
actacttgttacctttc

SEQ ID NO: 5832656 - DNA, 13 bp, Homo sapiens
actactttaaatc

SEQ ID NO: 5832657 - DNA, 13 bp, Homo sapiens
actactttgctac

SEQ ID NO: 5832658 - DNA, 19 bp, Homo sapiens
actactttgttaggatttt

SEQ ID NO: 5832659 - DNA, 22 bp, Homo sapiens
actactttgttaggattttcac

SEQ ID NO: 5832660 - DNA, 17 bp, Homo sapiens
actacttttctaaaatc

SEQ ID NO: 5832661 - DNA, 23 bp, Homo sapiens
actacttttgcttttttatttac

SEQ ID NO: 5832662 - DNA, 20 bp, Homo sapiens
actacttttgtaccagtgtg

SEQ ID NO: 5832663 - DNA, 14 bp, Homo sapiens
actactttttatac

SEQ ID NO: 5832664 - DNA, 16 bp, Homo sapiens
actactttttatactc

SEQ ID NO: 5832665 - DNA, 17 bp, Homo sapiens
actactttttatactcc

SEQ ID NO: 5832666 - DNA, 13 bp, Homo sapiens
actagaaaatctg

SEQ ID NO: 5832667 - DNA, 18 bp, Homo sapiens
actagaaagaaggaccca

SEQ ID NO: 5832668 - DNA, 15 bp, Homo sapiens
actagaaataaataa

SEQ ID NO: 5832669 - DNA, 18 bp, Homo sapiens
actagaaatatattcata

SEQ ID NO: 5832670 - DNA, 19 bp, Homo sapiens
actagaaatgggaatcatg

SEQ ID NO: 5832671 - DNA, 15 bp, Homo sapiens
actagaaattcttaa

SEQ ID NO: 5832672 - DNA, 16 bp, Homo sapiens
actagaaattgggcag

SEQ ID NO: 5832673 - DNA, 23 bp, Homo sapiens
actagaactgaattttgtcttta

SEQ ID NO: 5832674 - DNA, 15 bp, Homo sapiens
actagaagaaaagcc

SEQ ID NO: 5832675 - DNA, 23 bp, Homo sapiens
actagaagaaagggcaagaagga

SEQ ID NO: 5832676 - DNA, 18 bp, Homo sapiens
actagaagatgaatacaa

SEQ ID NO: 5832677 - DNA, 19 bp, Homo sapiens
actagaagctgatctgatt

SEQ ID NO: 5832678 - DNA, 21 bp, Homo sapiens
actagaaggcttctctccaca

SEQ ID NO: 5832679 - DNA, 14 bp, Homo sapiens
actagaagggccag

SEQ ID NO: 5832680 - DNA, 23 bp, Homo sapiens
actagaagggccagtcctgcctg

SEQ ID NO: 5832681 - DNA, 16 bp, Homo sapiens
actagaatattcctta

SEQ ID NO: 5832682 - DNA, 14 bp, Homo sapiens
actagaatgagaaa

SEQ ID NO: 5832683 - DNA, 23 bp, Homo sapiens
actagaattcaggtgctttgcta

SEQ ID NO: 5832684 - DNA, 16 bp, Homo sapiens
actagaattcatgtga

SEQ ID NO: 5832685 - DNA, 19 bp, Homo sapiens
actagaattctagtgctgc

SEQ ID NO: 5832686 - DNA, 22 bp, Homo sapiens
actagaattctagtgctgctga

SEQ ID NO: 5832687 - DNA, 23 bp, Homo sapiens
actagaattctagtgctgctgaa

SEQ ID NO: 5832688 - DNA, 14 bp, Homo sapiens
actagaatttagtt

SEQ ID NO: 5832689 - DNA, 15 bp, Homo sapiens
actagaatttattca

SEQ ID NO: 5832690 - DNA, 22 bp, Homo sapiens
actagaatttcatttattttgt

SEQ ID NO: 5832691 - DNA, 17 bp, Homo sapiens
actagaatttgtatttt

SEQ ID NO: 5832692 - DNA, 13 bp, Homo sapiens
actagacaaataa

SEQ ID NO: 5832693 - DNA, 15 bp, Homo sapiens
actagacaaataact

SEQ ID NO: 5832694 - DNA, 17 bp, Homo sapiens
actagacaccaaagttc

SEQ ID NO: 5832695 - DNA, 13 bp, Homo sapiens
actagacatgtca

SEQ ID NO: 5832696 - DNA, 16 bp, Homo sapiens
actagacattctgtcg

SEQ ID NO: 5832697 - DNA, 17 bp, Homo sapiens
actagaccatataactg

SEQ ID NO: 5832698 - DNA, 16 bp, Homo sapiens
actagacctccagctg

SEQ ID NO: 5832699 - DNA, 15 bp, Homo sapiens
actagactactcaat

SEQ ID NO: 5832700 - DNA, 15 bp, Homo sapiens
actagactcaaggaa

SEQ ID NO: 5832701 - DNA, 11 bp, Homo sapiens
actagactctt

SEQ ID NO: 5832702 - DNA, 12 bp, Homo sapiens
actagactttga

SEQ ID NO: 5832703 - DNA, 15 bp, Homo sapiens
actagagaaagacaa

SEQ ID NO: 5832704 - DNA, 16 bp, Homo sapiens
actagagaaagacaaa

SEQ ID NO: 5832705 - DNA, 22 bp, Homo sapiens
actagagaaagacaaaatgtga

SEQ ID NO: 5832706 - DNA, 20 bp, Homo sapiens
actagagaatgcacagatat

SEQ ID NO: 5832707 - DNA, 21 bp, Homo sapiens
actagagacaaatctttaaga

SEQ ID NO: 5832708 - DNA, 19 bp, Homo sapiens
actagagacctctcaacag

SEQ ID NO: 5832709 - DNA, 16 bp, Homo sapiens
actagagactctgtga

SEQ ID NO: 5832710 - DNA, 14 bp, Homo sapiens
actagagatattct

SEQ ID NO: 5832711 - DNA, 16 bp, Homo sapiens
actagagatgtgcaat

SEQ ID NO: 5832712 - DNA, 22 bp, Homo sapiens
actagagcacgggcgttatgta

SEQ ID NO: 5832713 - DNA, 19 bp, Homo sapiens
actagagcagccctggagt

SEQ ID NO: 5832714 - DNA, 21 bp, Homo sapiens
actagagcctgtgctaaagaa

SEQ ID NO: 5832715 - DNA, 17 bp, Homo sapiens
actagagctgggaaaca

SEQ ID NO: 5832716 - DNA, 19 bp, Homo sapiens
actagagctgggaaacagg

SEQ ID NO: 5832717 - DNA, 14 bp, Homo sapiens
actagaggcaggga

SEQ ID NO: 5832718 - DNA, 14 bp, Homo sapiens
actagaggccaggg

SEQ ID NO: 5832719 - DNA, 19 bp, Homo sapiens
actagagggacctctccca

SEQ ID NO: 5832720 - DNA, 11 bp, Homo sapiens
actagagggcc

SEQ ID NO: 5832721 - DNA, 21 bp, Homo sapiens
actagagggcccatcaggcag

SEQ ID NO: 5832722 - DNA, 22 bp, Homo sapiens
actagagtcacccccccaggcc

SEQ ID NO: 5832723 - DNA, 14 bp, Homo sapiens
actagataaaatgt

SEQ ID NO: 5832724 - DNA, 11 bp, Homo sapiens
actagatctcc

SEQ ID NO: 5832725 - DNA, 13 bp, Homo sapiens
actagatctcctg

SEQ ID NO: 5832726 - DNA, 20 bp, Homo sapiens
actagatctctggattctaa

SEQ ID NO: 5832727 - DNA, 18 bp, Homo sapiens
actagatggacctgcctg

SEQ ID NO: 5832728 - DNA, 12 bp, Homo sapiens
actagatgtagt

SEQ ID NO: 5832729 - DNA, 13 bp, Homo sapiens
actagatgtagta

SEQ ID NO: 5832730 - DNA, 16 bp, Homo sapiens
actagatgtagtattt

SEQ ID NO: 5832731 - DNA, 17 bp, Homo sapiens
actagatgtagtatttt

SEQ ID NO: 5832732 - DNA, 13 bp, Homo sapiens
actagattacatt

SEQ ID NO: 5832733 - DNA, 17 bp, Homo sapiens
actagattctcacctgc

SEQ ID NO: 5832734 - DNA, 20 bp, Homo sapiens
actagattctcacctgcctt

SEQ ID NO: 5832735 - DNA, 18 bp, Homo sapiens
actagatttgtcctttta

SEQ ID NO: 5832736 - DNA, 19 bp, Homo sapiens
actagatttgtccttttat

SEQ ID NO: 5832737 - DNA, 20 bp, Homo sapiens
actagattttcacttatgaa

SEQ ID NO: 5832738 - DNA, 14 bp, Homo sapiens
actagcaaaataaa

SEQ ID NO: 5832739 - DNA, 15 bp, Homo sapiens
actagcaaacaaaaa

SEQ ID NO: 5832740 - DNA, 18 bp, Homo sapiens
actagcaaacaaaaatag

SEQ ID NO: 5832741 - DNA, 15 bp, Homo sapiens
actagcaataagttg

SEQ ID NO: 5832742 - DNA, 23 bp, Homo sapiens
actagcaatctcttcattattct

SEQ ID NO: 5832743 - DNA, 13 bp, Homo sapiens
actagcagctgca

SEQ ID NO: 5832744 - DNA, 23 bp, Homo sapiens
actagcaggcaatgctgtacttt

SEQ ID NO: 5832745 - DNA, 15 bp, Homo sapiens
actagcatatctgcc

SEQ ID NO: 5832746 - DNA, 19 bp, Homo sapiens
actagcatatctgccttta

SEQ ID NO: 5832747 - DNA, 17 bp, Homo sapiens
actagcattacattatt

SEQ ID NO: 5832748 - DNA, 23 bp, Homo sapiens
actagcattcagggttatacaca

SEQ ID NO: 5832749 - DNA, 18 bp, Homo sapiens
actagccaaaccaggacc

SEQ ID NO: 5832750 - DNA, 16 bp, Homo sapiens
actagccaaacctcac

SEQ ID NO: 5832751 - DNA, 19 bp, Homo sapiens
actagccaaacctcaccaa

SEQ ID NO: 5832752 - DNA, 23 bp, Homo sapiens
actagccaacggccccagcttct

SEQ ID NO: 5832753 - DNA, 12 bp, Homo sapiens
actagccaaggc

SEQ ID NO: 5832754 - DNA, 16 bp, Homo sapiens
actagccaaggctagt

SEQ ID NO: 5832755 - DNA, 16 bp, Homo sapiens
actagccaccaactct

SEQ ID NO: 5832756 - DNA, 23 bp, Homo sapiens
actagccaccaactcttgcaggt

SEQ ID NO: 5832757 - DNA, 15 bp, Homo sapiens
actagccagaattct

SEQ ID NO: 5832758 - DNA, 21 bp, Homo sapiens
actagccagaattctaccctg

SEQ ID NO: 5832759 - DNA, 18 bp, Homo sapiens
actagccatgactagggt

SEQ ID NO: 5832760 - DNA, 11 bp, Homo sapiens
actagcccccc

SEQ ID NO: 5832761 - DNA, 21 bp, Homo sapiens
actagcccctgtggagactgg

SEQ ID NO: 5832762 - DNA, 16 bp, Homo sapiens
actagccccttttctg

SEQ ID NO: 5832763 - DNA, 12 bp, Homo sapiens
actagccctctt

SEQ ID NO: 5832764 - DNA, 21 bp, Homo sapiens
actagccctctttctctctgt

SEQ ID NO: 5832765 - DNA, 23 bp, Homo sapiens
actagccctctttctctctgtgt

SEQ ID NO: 5832766 - DNA, 15 bp, Homo sapiens
actagccgaatggta

SEQ ID NO: 5832767 - DNA, 13 bp, Homo sapiens
actagcctggcca

SEQ ID NO: 5832768 - DNA, 22 bp, Homo sapiens
actagcctttggctctggagac

SEQ ID NO: 5832769 - DNA, 14 bp, Homo sapiens
actagcgcctggcc

SEQ ID NO: 5832770 - DNA, 16 bp, Homo sapiens
actagctaagcaagcc

SEQ ID NO: 5832771 - DNA, 18 bp, Homo sapiens
actagctaagcaagccag

SEQ ID NO: 5832772 - DNA, 19 bp, Homo sapiens
actagctaaggaagggaaa

SEQ ID NO: 5832773 - DNA, 23 bp, Homo sapiens
actagctagaagtgggccaggac

SEQ ID NO: 5832774 - DNA, 18 bp, Homo sapiens
actagctccccaatccct

SEQ ID NO: 5832775 - DNA, 20 bp, Homo sapiens
actagctccccaatccctga

SEQ ID NO: 5832776 - DNA, 16 bp, Homo sapiens
actatttaaaataaag

SEQ ID NO: 5832777 - DNA, 17 bp, Homo sapiens
actatttaaaattggca

SEQ ID NO: 5832778 - DNA, 12 bp, Homo sapiens
actatttaactg

SEQ ID NO: 5832779 - DNA, 14 bp, Homo sapiens
actatttaactgac

SEQ ID NO: 5832780 - DNA, 16 bp, Homo sapiens
actatttaactgacta

SEQ ID NO: 5832781 - DNA, 17 bp, Homo sapiens
actatttaagatgtgaa

SEQ ID NO: 5832782 - DNA, 19 bp, Homo sapiens
actatttaagttatcaact

SEQ ID NO: 5832783 - DNA, 21 bp, Homo sapiens
actatttacaagatggactta

SEQ ID NO: 5832784 - DNA, 18 bp, Homo sapiens
actatttagtgttagtta

SEQ ID NO: 5832785 - DNA, 20 bp, Homo sapiens
actatttagtttttgtaatt

SEQ ID NO: 5832786 - DNA, 23 bp, Homo sapiens
actatttagtttttgtaatttat

SEQ ID NO: 5832787 - DNA, 21 bp, Homo sapiens
actatttatataacattagat

SEQ ID NO: 5832788 - DNA, 20 bp, Homo sapiens
actatttatatcacacaata

SEQ ID NO: 5832789 - DNA, 21 bp, Homo sapiens
actatttatatcacacaatat

SEQ ID NO: 5832790 - DNA, 15 bp, Homo sapiens
actatttatctgtgt

SEQ ID NO: 5832791 - DNA, 22 bp, Homo sapiens
actatttattaaaaacatgacc

SEQ ID NO: 5832792 - DNA, 20 bp, Homo sapiens
actatttattgtgctgggtc

SEQ ID NO: 5832793 - DNA, 18 bp, Homo sapiens
actatttcaataagtgtt

SEQ ID NO: 5832794 - DNA, 23 bp, Homo sapiens
actatttcacatgagtcaaaaca

SEQ ID NO: 5832795 - DNA, 15 bp, Homo sapiens
actatttcagaatat

SEQ ID NO: 5832796 - DNA, 20 bp, Homo sapiens
actatttcagaatattttgt

SEQ ID NO: 5832797 - DNA, 21 bp, Homo sapiens
actatttcagaatattttgta

SEQ ID NO: 5832798 - DNA, 16 bp, Homo sapiens
actatttcagtgataa

SEQ ID NO: 5832799 - DNA, 17 bp, Homo sapiens
actatttccaaaagcac

SEQ ID NO: 5832800 - DNA, 22 bp, Homo sapiens
actatttcccttgaaattttaa

SEQ ID NO: 5832801 - DNA, 16 bp, Homo sapiens
actatttcctttataa

SEQ ID NO: 5832802 - DNA, 23 bp, Homo sapiens
actatttctgggtcttttgctac

SEQ ID NO: 5832803 - DNA, 13 bp, Homo sapiens
actatttcttaat

SEQ ID NO: 5832804 - DNA, 15 bp, Homo sapiens
actatttcttcagag

SEQ ID NO: 5832805 - DNA, 16 bp, Homo sapiens
actatttctttcatca

SEQ ID NO: 5832806 - DNA, 15 bp, Homo sapiens
actatttgcagaggc

SEQ ID NO: 5832807 - DNA, 16 bp, Homo sapiens
actatttgtctttcag

SEQ ID NO: 5832808 - DNA, 15 bp, Homo sapiens
actattttaaatatc

SEQ ID NO: 5832809 - DNA, 15 bp, Homo sapiens
actattttaatttgt

SEQ ID NO: 5832810 - DNA, 13 bp, Homo sapiens
actattttatatg

SEQ ID NO: 5832811 - DNA, 20 bp, Homo sapiens
actattttatatttaaaaat

SEQ ID NO: 5832812 - DNA, 14 bp, Homo sapiens
actattttatgcaa

SEQ ID NO: 5832813 - DNA, 15 bp, Homo sapiens
actattttcaaagaa

SEQ ID NO: 5832814 - DNA, 22 bp, Homo sapiens
actattttcagatgtgaaccat

SEQ ID NO: 5832815 - DNA, 14 bp, Homo sapiens
actattttcttttt

SEQ ID NO: 5832816 - DNA, 18 bp, Homo sapiens
actatttttactgccact

SEQ ID NO: 5832817 - DNA, 18 bp, Homo sapiens
actatttttatattaaag

SEQ ID NO: 5832818 - DNA, 15 bp, Homo sapiens
actatttttatattc

SEQ ID NO: 5832819 - DNA, 18 bp, Homo sapiens
actatttttatttatatt

SEQ ID NO: 5832820 - DNA, 16 bp, Homo sapiens
actatttttattttta

SEQ ID NO: 5832821 - DNA, 21 bp, Homo sapiens
actatttttatttttaaatta

SEQ ID NO: 5832822 - DNA, 14 bp, Homo sapiens
actatttttcagaa

SEQ ID NO: 5832823 - DNA, 14 bp, Homo sapiens
actatttttcctca

SEQ ID NO: 5832824 - DNA, 11 bp, Homo sapiens
actatttttgt

SEQ ID NO: 5832825 - DNA, 13 bp, Homo sapiens
actattttttaat

SEQ ID NO: 5832826 - DNA, 14 bp, Homo sapiens
actattttttaata

SEQ ID NO: 5832827 - DNA, 16 bp, Homo sapiens
actattttttaataaa

SEQ ID NO: 5832828 - DNA, 17 bp, Homo sapiens
actatttttttgttgct

SEQ ID NO: 5832829 - DNA, 15 bp, Homo sapiens
actcaaaaaggtgtg

SEQ ID NO: 5832830 - DNA, 19 bp, Homo sapiens
actcaaaagacaaacatgc

SEQ ID NO: 5832831 - DNA, 21 bp, Homo sapiens
actcaaaaggagaactgtgct

SEQ ID NO: 5832832 - DNA, 21 bp, Homo sapiens
actcaaaatatgtcaacttaa

SEQ ID NO: 5832833 - DNA, 17 bp, Homo sapiens
actcaaaatatttgtac

SEQ ID NO: 5832834 - DNA, 13 bp, Homo sapiens
actcaaaatctgt

SEQ ID NO: 5832835 - DNA, 17 bp, Homo sapiens
actcaaacacttattgt

SEQ ID NO: 5832836 - DNA, 16 bp, Homo sapiens
actcaaaccatatttt

SEQ ID NO: 5832837 - DNA, 17 bp, Homo sapiens
actcaaacgatgtgcaa

SEQ ID NO: 5832838 - DNA, 17 bp, Homo sapiens
actcaaactcttaaaac

SEQ ID NO: 5832839 - DNA, 14 bp, Homo sapiens
actcaaactgagga

SEQ ID NO: 5832840 - DNA, 21 bp, Homo sapiens
actcaaactgaggaatttcac

SEQ ID NO: 5832841 - DNA, 23 bp, Homo sapiens
actcaaacttttcccctgtcctg

SEQ ID NO: 5832842 - DNA, 13 bp, Homo sapiens
actcaaagaatgt

SEQ ID NO: 5832843 - DNA, 19 bp, Homo sapiens
actcaaagaggccagtact

SEQ ID NO: 5832844 - DNA, 21 bp, Homo sapiens
actcaaagaggccagtacttt

SEQ ID NO: 5832845 - DNA, 15 bp, Homo sapiens
actcaaagagggtga

SEQ ID NO: 5832846 - DNA, 15 bp, Homo sapiens
actcaaagatgatgg

SEQ ID NO: 5832847 - DNA, 22 bp, Homo sapiens
actcaaaggaactttctggtcc

SEQ ID NO: 5832848 - DNA, 13 bp, Homo sapiens
actcaaaggactg

SEQ ID NO: 5832849 - DNA, 18 bp, Homo sapiens
actcaaagtctaacatat

SEQ ID NO: 5832850 - DNA, 20 bp, Homo sapiens
actcaaagtttcagagacca

SEQ ID NO: 5832851 - DNA, 15 bp, Homo sapiens
actcaaatacacatt

SEQ ID NO: 5832852 - DNA, 19 bp, Homo sapiens
actcaaatacacatttgct

SEQ ID NO: 5832853 - DNA, 18 bp, Homo sapiens
actcaaatcttaagaaat

SEQ ID NO: 5832854 - DNA, 16 bp, Homo sapiens
actcaaatgagtaaca

SEQ ID NO: 5832855 - DNA, 17 bp, Homo sapiens
actcaaatgagtaacat

SEQ ID NO: 5832856 - DNA, 23 bp, Homo sapiens
actcaaatgctcagaccagctct

SEQ ID NO: 5832857 - DNA, 19 bp, Homo sapiens
actcaaatgcttggcttct

SEQ ID NO: 5832858 - DNA, 23 bp, Homo sapiens
actcaaatggggccagatccagc

SEQ ID NO: 5832859 - DNA, 16 bp, Homo sapiens
actcaaatgttctaag

SEQ ID NO: 5832860 - DNA, 17 bp, Homo sapiens
actcaaatgttctaagt

SEQ ID NO: 5832861 - DNA, 22 bp, Homo sapiens
actcaaatgttctaagtttcta

SEQ ID NO: 5832862 - DNA, 14 bp, Homo sapiens
actcaaattttggc

SEQ ID NO: 5832863 - DNA, 23 bp, Homo sapiens
actcaaattttggcgaatctcaa

SEQ ID NO: 5832864 - DNA, 22 bp, Homo sapiens
actcaacaaaaaaccgaggccc

SEQ ID NO: 5832865 - DNA, 16 bp, Homo sapiens
actcaacatgagtcaa

SEQ ID NO: 5832866 - DNA, 19 bp, Homo sapiens
actcaacatgagtcaagag

SEQ ID NO: 5832867 - DNA, 21 bp, Homo sapiens
actcaacatgttactgaccag

SEQ ID NO: 5832868 - DNA, 16 bp, Homo sapiens
actcaacattactgtt

SEQ ID NO: 5832869 - DNA, 12 bp, Homo sapiens
actcaaccaaat

SEQ ID NO: 5832870 - DNA, 17 bp, Homo sapiens
actcaaccataacactt

SEQ ID NO: 5832871 - DNA, 20 bp, Homo sapiens
actcaaccatcaatggaaac

SEQ ID NO: 5832872 - DNA, 13 bp, Homo sapiens
actcaaccctctc

SEQ ID NO: 5832873 - DNA, 17 bp, Homo sapiens
actcaactaatttttgt

SEQ ID NO: 5832874 - DNA, 13 bp, Homo sapiens
actcaactaggct

SEQ ID NO: 5832875 - DNA, 15 bp, Homo sapiens
actcaactctgagcc

SEQ ID NO: 5832876 - DNA, 16 bp, Homo sapiens
actcaactctgagccc

SEQ ID NO: 5832877 - DNA, 15 bp, Homo sapiens
actcaagaagcacac

SEQ ID NO: 5832878 - DNA, 18 bp, Homo sapiens
actcaagactatgttctc

SEQ ID NO: 5832879 - DNA, 21 bp, Homo sapiens
actcaagagcccttccaggag

SEQ ID NO: 5832880 - DNA, 17 bp, Homo sapiens
actcaagaggaatctgt

SEQ ID NO: 5832881 - DNA, 18 bp, Homo sapiens
actcaagaggctgaggca

SEQ ID NO: 5832882 - DNA, 14 bp, Homo sapiens
actcaagatactgg

SEQ ID NO: 5832883 - DNA, 18 bp, Homo sapiens
actcaagatactggacta

SEQ ID NO: 5832884 - DNA, 19 bp, Homo sapiens
actcaagcaggtttcttgc

SEQ ID NO: 5832885 - DNA, 19 bp, Homo sapiens
actcaaggaagaataattt

SEQ ID NO: 5832886 - DNA, 12 bp, Homo sapiens
actcaaggaatg

SEQ ID NO: 5832887 - DNA, 14 bp, Homo sapiens
actcaaggagttgg

SEQ ID NO: 5832888 - DNA, 20 bp, Homo sapiens
actcaagggaaaggcaagct

SEQ ID NO: 5832889 - DNA, 22 bp, Homo sapiens
actcaagggttttccaggtgta

SEQ ID NO: 5832890 - DNA, 16 bp, Homo sapiens
actcaagtagcattta

SEQ ID NO: 5832891 - DNA, 18 bp, Homo sapiens
actcaagtgccattcatc

SEQ ID NO: 5832892 - DNA, 19 bp, Homo sapiens
actcaagtgtcacctcctt

SEQ ID NO: 5832893 - DNA, 23 bp, Homo sapiens
actcaagtgtctcagtccacctg

SEQ ID NO: 5832894 - DNA, 15 bp, Homo sapiens
actcaataaaatcat

SEQ ID NO: 5832895 - DNA, 14 bp, Homo sapiens
actcaataaacagt

SEQ ID NO: 5832896 - DNA, 15 bp, Homo sapiens
actcaataaacagtc

SEQ ID NO: 5832897 - DNA, 14 bp, Homo sapiens
actcaatactacct

SEQ ID NO: 5832898 - DNA, 15 bp, Homo sapiens
actcaatattttcca

SEQ ID NO: 5832899 - DNA, 21 bp, Homo sapiens
actcaatattttccatgaaaa

SEQ ID NO: 5832900 - DNA, 14 bp, Homo sapiens
actcaatctccagg

SEQ ID NO: 5832901 - DNA, 17 bp, Homo sapiens
actcaatctccagggct

SEQ ID NO: 5832902 - DNA, 14 bp, Homo sapiens
actcaatgagctct

SEQ ID NO: 5832903 - DNA, 12 bp, Homo sapiens
actcaatgcatg

SEQ ID NO: 5832904 - DNA, 13 bp, Homo sapiens
actcaatgcatga

SEQ ID NO: 5832905 - DNA, 19 bp, Homo sapiens
actcaatgctttatttgta

SEQ ID NO: 5832906 - DNA, 20 bp, Homo sapiens
actcaatgctttatttgtaa

SEQ ID NO: 5832907 - DNA, 21 bp, Homo sapiens
actcaatgctttatttgtaaa

SEQ ID NO: 5832908 - DNA, 13 bp, Homo sapiens
actcaatgggaga

SEQ ID NO: 5832909 - DNA, 17 bp, Homo sapiens
actcaatggtatcatta

SEQ ID NO: 5832910 - DNA, 21 bp, Homo sapiens
actcaatgttactatctgctt

SEQ ID NO: 5832911 - DNA, 17 bp, Homo sapiens
actcaattatttgcata

SEQ ID NO: 5832912 - DNA, 14 bp, Homo sapiens
actcaatttctccc

SEQ ID NO: 5832913 - DNA, 13 bp, Homo sapiens
actcacaaatgat

SEQ ID NO: 5832914 - DNA, 17 bp, Homo sapiens
actcacaacagctgcct

SEQ ID NO: 5832915 - DNA, 21 bp, Homo sapiens
actcacaacctgaacctagga

SEQ ID NO: 5832916 - DNA, 14 bp, Homo sapiens
actcacaagaagac

SEQ ID NO: 5832917 - DNA, 22 bp, Homo sapiens
actcacaagtgctcatctgttg

SEQ ID NO: 5832918 - DNA, 19 bp, Homo sapiens
actcacaatcatcttctcc

SEQ ID NO: 5832919 - DNA, 13 bp, Homo sapiens
actcacacaggca

SEQ ID NO: 5832920 - DNA, 14 bp, Homo sapiens
actcacacaggcat

SEQ ID NO: 5832921 - DNA, 20 bp, Homo sapiens
actcacacaggcatttcctg

SEQ ID NO: 5832922 - DNA, 15 bp, Homo sapiens
actcacacattaacc

SEQ ID NO: 5832923 - DNA, 18 bp, Homo sapiens
actcacaccactagcctc

SEQ ID NO: 5832924 - DNA, 21 bp, Homo sapiens
actcacacctccttttcttct

SEQ ID NO: 5832925 - DNA, 16 bp, Homo sapiens
actcacactctctgca

SEQ ID NO: 5832926 - DNA, 21 bp, Homo sapiens
actcacactctctgcagccca

SEQ ID NO: 5832927 - DNA, 13 bp, Homo sapiens
actcacactggcc

SEQ ID NO: 5832928 - DNA, 18 bp, Homo sapiens
actcacagacctggagcc

SEQ ID NO: 5832929 - DNA, 12 bp, Homo sapiens
actcacagagct

SEQ ID NO: 5832930 - DNA, 17 bp, Homo sapiens
actcacagagtcaaggc

SEQ ID NO: 5832931 - DNA, 22 bp, Homo sapiens
actcacagagtcaaggcctgct

SEQ ID NO: 5832932 - DNA, 21 bp, Homo sapiens
actcacagcacttgttttcag

SEQ ID NO: 5832933 - DNA, 13 bp, Homo sapiens
actcacagcttct

SEQ ID NO: 5832934 - DNA, 16 bp, Homo sapiens
actcacagcttctcca

SEQ ID NO: 5832935 - DNA, 15 bp, Homo sapiens
actcacaggaaggag

SEQ ID NO: 5832936 - DNA, 13 bp, Homo sapiens
actcacatagcca

SEQ ID NO: 5832937 - DNA, 18 bp, Homo sapiens
actcacatagccaactct

SEQ ID NO: 5832938 - DNA, 17 bp, Homo sapiens
actcacatataacatgc

SEQ ID NO: 5832939 - DNA, 22 bp, Homo sapiens
actcacatgctggacaggtctg

SEQ ID NO: 5832940 - DNA, 17 bp, Homo sapiens
actcacattagagaaca

SEQ ID NO: 5832941 - DNA, 15 bp, Homo sapiens
actcacattttctca

SEQ ID NO: 5832942 - DNA, 23 bp, Homo sapiens
actcaccaaaaagctttaaaaaa

SEQ ID NO: 5832943 - DNA, 11 bp, Homo sapiens
actcaccagcc

SEQ ID NO: 5832944 - DNA, 16 bp, Homo sapiens
actcaccagccctagc

SEQ ID NO: 5832945 - DNA, 17 bp, Homo sapiens
actcaccagcctctgct

SEQ ID NO: 5832946 - DNA, 19 bp, Homo sapiens
actcaccagggtccgcacc

SEQ ID NO: 5832947 - DNA, 15 bp, Homo sapiens
actcaccagtggcct

SEQ ID NO: 5832948 - DNA, 17 bp, Homo sapiens
actcaccagtggccttt

SEQ ID NO: 5832949 - DNA, 23 bp, Homo sapiens
actcaccagtgtcccctccactg

SEQ ID NO: 5832950 - DNA, 14 bp, Homo sapiens
actcaccatctgtg

SEQ ID NO: 5832951 - DNA, 15 bp, Homo sapiens
actcaccatctgtgc

SEQ ID NO: 5832952 - DNA, 18 bp, Homo sapiens
actcaccatgaagcgaaa

SEQ ID NO: 5832953 - DNA, 11 bp, Homo sapiens
actcaccattt

SEQ ID NO: 5832954 - DNA, 17 bp, Homo sapiens
actcacccatgtgccaa

SEQ ID NO: 5832955 - DNA, 19 bp, Homo sapiens
actcccacccagtctctgc

SEQ ID NO: 5832956 - DNA, 18 bp, Homo sapiens
actcccaccctaccccct

SEQ ID NO: 5832957 - DNA, 17 bp, Homo sapiens
actcccacctcacccgg

SEQ ID NO: 5832958 - DNA, 14 bp, Homo sapiens
actcccacctgaca

SEQ ID NO: 5832959 - DNA, 16 bp, Homo sapiens
actcccacctgacaca

SEQ ID NO: 5832960 - DNA, 16 bp, Homo sapiens
actcccactcctaatc

SEQ ID NO: 5832961 - DNA, 15 bp, Homo sapiens
actcccactctttga

SEQ ID NO: 5832962 - DNA, 14 bp, Homo sapiens
actcccacttccct

SEQ ID NO: 5832963 - DNA, 17 bp, Homo sapiens
actcccagacacccacc

SEQ ID NO: 5832964 - DNA, 20 bp, Homo sapiens
actcccagaccacctccctg

SEQ ID NO: 5832965 - DNA, 13 bp, Homo sapiens
actcccagcactc

SEQ ID NO: 5832966 - DNA, 17 bp, Homo sapiens
actcccagcagagccca

SEQ ID NO: 5832967 - DNA, 20 bp, Homo sapiens
actcccagcatcgcactctg

SEQ ID NO: 5832968 - DNA, 20 bp, Homo sapiens
actcccagccaccaccactg

SEQ ID NO: 5832969 - DNA, 23 bp, Homo sapiens
actcccagccaccaccactgtcc

SEQ ID NO: 5832970 - DNA, 13 bp, Homo sapiens
actcccaggcccc

SEQ ID NO: 5832971 - DNA, 12 bp, Homo sapiens
actcccagggac

SEQ ID NO: 5832972 - DNA, 12 bp, Homo sapiens
actcccagggcc

SEQ ID NO: 5832973 - DNA, 14 bp, Homo sapiens
actcccaggggcct

SEQ ID NO: 5832974 - DNA, 19 bp, Homo sapiens
actcccaggtgagaattca

SEQ ID NO: 5832975 - DNA, 16 bp, Homo sapiens
actcccatgaagcctt

SEQ ID NO: 5832976 - DNA, 17 bp, Homo sapiens
actcccatgaagccttt

SEQ ID NO: 5832977 - DNA, 20 bp, Homo sapiens
actcccatgaagccttttga

SEQ ID NO: 5832978 - DNA, 17 bp, Homo sapiens
actcccatgagggagat

SEQ ID NO: 5832979 - DNA, 22 bp, Homo sapiens
actcccatgagggagatgccat

SEQ ID NO: 5832980 - DNA, 12 bp, Homo sapiens
actcccatggct

SEQ ID NO: 5832981 - DNA, 14 bp, Homo sapiens
actcccatggctct

SEQ ID NO: 5832982 - DNA, 20 bp, Homo sapiens
actcccattcctgaagaacc

SEQ ID NO: 5832983 - DNA, 21 bp, Homo sapiens
actcccattttgcagatgaag

SEQ ID NO: 5832984 - DNA, 16 bp, Homo sapiens
actcccatttttactt

SEQ ID NO: 5832985 - DNA, 20 bp, Homo sapiens
actccccaacccctctccag

SEQ ID NO: 5832986 - DNA, 23 bp, Homo sapiens
actccccaacccctctccaggcc

SEQ ID NO: 5832987 - DNA, 19 bp, Homo sapiens
actccccaaggaagagcca

SEQ ID NO: 5832988 - DNA, 12 bp, Homo sapiens
actccccactcc

SEQ ID NO: 5832989 - DNA, 16 bp, Homo sapiens
actccccactccccca

SEQ ID NO: 5832990 - DNA, 21 bp, Homo sapiens
actccccacttcactttcttc

SEQ ID NO: 5832991 - DNA, 18 bp, Homo sapiens
actccccagagctgtgcc

SEQ ID NO: 5832992 - DNA, 15 bp, Homo sapiens
actccccagcccagc

SEQ ID NO: 5832993 - DNA, 12 bp, Homo sapiens
actccccaggga

SEQ ID NO: 5832994 - DNA, 14 bp, Homo sapiens
actccccagggagc

SEQ ID NO: 5832995 - DNA, 16 bp, Homo sapiens
actccccagggagctc

SEQ ID NO: 5832996 - DNA, 20 bp, Homo sapiens
actccccagggagctctggg

SEQ ID NO: 5832997 - DNA, 21 bp, Homo sapiens
actccccattggagcaagctt

SEQ ID NO: 5832998 - DNA, 18 bp, Homo sapiens
actcccccaccactcagg

SEQ ID NO: 5832999 - DNA, 20 bp, Homo sapiens
actcccccaccactcaggcc

SEQ ID NO: 5833000 - DNA, 14 bp, Homo sapiens
actcccccacccat

SEQ ID NO: 5833001 - DNA, 21 bp, Homo sapiens
actcccccacccatggggagg

SEQ ID NO: 5833002 - DNA, 14 bp, Homo sapiens
actcccccaccgcc

SEQ ID NO: 5833003 - DNA, 20 bp, Homo sapiens
actcccccaccgcccactct

SEQ ID NO: 5833004 - DNA, 14 bp, Homo sapiens
actcccccacctga

SEQ ID NO: 5833005 - DNA, 12 bp, Homo sapiens
actcccccagag

SEQ ID NO: 5833006 - DNA, 16 bp, Homo sapiens
actcccccagccctca

SEQ ID NO: 5833007 - DNA, 18 bp, Homo sapiens
actcccccagccctcagt

SEQ ID NO: 5833008 - DNA, 14 bp, Homo sapiens
actcccccaggagc

SEQ ID NO: 5833009 - DNA, 18 bp, Homo sapiens
actcccccaggagcagct

SEQ ID NO: 5833010 - DNA, 13 bp, Homo sapiens
actcccccaggat

SEQ ID NO: 5833011 - DNA, 14 bp, Homo sapiens
actccccgaagtct

SEQ ID NO: 5833012 - DNA, 16 bp, Homo sapiens
actccccgaagtcttt

SEQ ID NO: 5833013 - DNA, 17 bp, Homo sapiens
actccccgaagtctttt

SEQ ID NO: 5833014 - DNA, 20 bp, Homo sapiens
actccccgcccgccctcctc

SEQ ID NO: 5833015 - DNA, 22 bp, Homo sapiens
actcccctcacacacacccccc

SEQ ID NO: 5833016 - DNA, 11 bp, Homo sapiens
actcccctcca

SEQ ID NO: 5833017 - DNA, 17 bp, Homo sapiens
actcccctctcctcccc

SEQ ID NO: 5833018 - DNA, 21 bp, Homo sapiens
actcccctctcctccccttcc

SEQ ID NO: 5833019 - DNA, 22 bp, Homo sapiens
actcccctctcctccccttcct

SEQ ID NO: 5833020 - DNA, 14 bp, Homo sapiens
actcccctggctgg

SEQ ID NO: 5833021 - DNA, 12 bp, Homo sapiens
actccccttccc

SEQ ID NO: 5833022 - DNA, 17 bp, Homo sapiens
actccccttccctgggg

SEQ ID NO: 5833023 - DNA, 18 bp, Homo sapiens
actccccttccctgggga

SEQ ID NO: 5833024 - DNA, 15 bp, Homo sapiens
actccccttgagctg

SEQ ID NO: 5833025 - DNA, 20 bp, Homo sapiens
actccccttgagctgagatg

SEQ ID NO: 5833026 - DNA, 13 bp, Homo sapiens
actccccttgcct

SEQ ID NO: 5833027 - DNA, 20 bp, Homo sapiens
actcccgaaagcctttcctc

SEQ ID NO: 5833028 - DNA, 20 bp, Homo sapiens
actcccgcctcagggccagg

SEQ ID NO: 5833029 - DNA, 17 bp, Homo sapiens
actcccgctgcacacag

SEQ ID NO: 5833030 - DNA, 18 bp, Homo sapiens
actcccgctgcacacaga

SEQ ID NO: 5833031 - DNA, 14 bp, Homo sapiens
actcccggagcctg

SEQ ID NO: 5833032 - DNA, 19 bp, Homo sapiens
actcccggagcctgtgcag

SEQ ID NO: 5833033 - DNA, 19 bp, Homo sapiens
actcccggcactccatgct

SEQ ID NO: 5833034 - DNA, 15 bp, Homo sapiens
actcccgggccaaga

SEQ ID NO: 5833035 - DNA, 21 bp, Homo sapiens
actcccgggccaagacagatg

SEQ ID NO: 5833036 - DNA, 19 bp, Homo sapiens
actcccgggccacgcccca

SEQ ID NO: 5833037 - DNA, 23 bp, Homo sapiens
actcccgggccacgccccagccc

SEQ ID NO: 5833038 - DNA, 22 bp, Homo sapiens
actcccggggtccccgccctct

SEQ ID NO: 5833039 - DNA, 18 bp, Homo sapiens
actccctaaagccctctt

SEQ ID NO: 5833040 - DNA, 16 bp, Homo sapiens
actccctaagaaaccc

SEQ ID NO: 5833041 - DNA, 21 bp, Homo sapiens
actccctaatttatgtgctat

SEQ ID NO: 5833042 - DNA, 16 bp, Homo sapiens
actccctacactgatg

SEQ ID NO: 5833043 - DNA, 23 bp, Homo sapiens
actccctacactgatgcaaggat

SEQ ID NO: 5833044 - DNA, 22 bp, Homo sapiens
actccctacccaatgtctccca

SEQ ID NO: 5833045 - DNA, 16 bp, Homo sapiens
actccctaggcccaag

SEQ ID NO: 5833046 - DNA, 14 bp, Homo sapiens
actccctaggcctg

SEQ ID NO: 5833047 - DNA, 15 bp, Homo sapiens
actccctaggcctga

SEQ ID NO: 5833048 - DNA, 20 bp, Homo sapiens
actccctatctccttcccac

SEQ ID NO: 5833049 - DNA, 15 bp, Homo sapiens
actccctcacaagtg

SEQ ID NO: 5833050 - DNA, 22 bp, Homo sapiens
actccctcagatcccagttcct

SEQ ID NO: 5833051 - DNA, 13 bp, Homo sapiens
actccctccacca

SEQ ID NO: 5833052 - DNA, 14 bp, Homo sapiens
actccctccagcac

SEQ ID NO: 5833053 - DNA, 16 bp, Homo sapiens
actccctccagcacaa

SEQ ID NO: 5833054 - DNA, 13 bp, Homo sapiens
actccctcccaga

SEQ ID NO: 5833055 - DNA, 13 bp, Homo sapiens
actccctccccac

SEQ ID NO: 5833056 - DNA, 15 bp, Homo sapiens
actccctccccagat

SEQ ID NO: 5833057 - DNA, 18 bp, Homo sapiens
actccctcctaacctaga

SEQ ID NO: 5833058 - DNA, 21 bp, Homo sapiens
actccctctcaggatccaagc

SEQ ID NO: 5833059 - DNA, 23 bp, Homo sapiens
actccctctccctccctaacagt

SEQ ID NO: 5833060 - DNA, 12 bp, Homo sapiens
actccctctgca

SEQ ID NO: 5833061 - DNA, 23 bp, Homo sapiens
actccctcttcactgtggccaca

SEQ ID NO: 5833062 - DNA, 13 bp, Homo sapiens
actccctcttcca

SEQ ID NO: 5833063 - DNA, 19 bp, Homo sapiens
actccctgaacctcagttt

SEQ ID NO: 5833064 - DNA, 17 bp, Homo sapiens
actccctgcagatgcca

SEQ ID NO: 5833065 - DNA, 11 bp, Homo sapiens
actccctgcca

SEQ ID NO: 5833066 - DNA, 13 bp, Homo sapiens
actccctgccaac

SEQ ID NO: 5833067 - DNA, 22 bp, Homo sapiens
actccctgccaactccatgacc

SEQ ID NO: 5833068 - DNA, 19 bp, Homo sapiens
actccctgccaccgtcaca

SEQ ID NO: 5833069 - DNA, 23 bp, Homo sapiens
actccctgccaccgtcacacagt

SEQ ID NO: 5833070 - DNA, 16 bp, Homo sapiens
actccctgctccacga

SEQ ID NO: 5833071 - DNA, 17 bp, Homo sapiens
actccctggctctcaga

SEQ ID NO: 5833072 - DNA, 20 bp, Homo sapiens
actccctgtccatccccagt

SEQ ID NO: 5833073 - DNA, 16 bp, Homo sapiens
actcccttcctggcct

SEQ ID NO: 5833074 - DNA, 21 bp, Homo sapiens
actcccttccttatgcatact

SEQ ID NO: 5833075 - DNA, 18 bp, Homo sapiens
actcccttctacctgcca

SEQ ID NO: 5833076 - DNA, 18 bp, Homo sapiens
actcccttctcccctcag

SEQ ID NO: 5833077 - DNA, 22 bp, Homo sapiens
actcccttctcggggtgggaca

SEQ ID NO: 5833078 - DNA, 22 bp, Homo sapiens
actcccttgaggatggagagca

SEQ ID NO: 5833079 - DNA, 16 bp, Homo sapiens
actcccttgctggccc

SEQ ID NO: 5833080 - DNA, 18 bp, Homo sapiens
actcccttgctggcccca

SEQ ID NO: 5833081 - DNA, 22 bp, Homo sapiens
actcccttgctggccccagccc

SEQ ID NO: 5833082 - DNA, 17 bp, Homo sapiens
actcccttgtgttcctt

SEQ ID NO: 5833083 - DNA, 19 bp, Homo sapiens
actcccttgtgttccttct

SEQ ID NO: 5833084 - DNA, 16 bp, Homo sapiens
actccctttaaagaga

SEQ ID NO: 5833085 - DNA, 13 bp, Homo sapiens
actccctttcaac

SEQ ID NO: 5833086 - DNA, 15 bp, Homo sapiens
actccctttttacac

SEQ ID NO: 5833087 - DNA, 16 bp, Homo sapiens
actccctttttacact

SEQ ID NO: 5833088 - DNA, 15 bp, Homo sapiens
actccgaagaaaaga

SEQ ID NO: 5833089 - DNA, 21 bp, Homo sapiens
actccgagagcagtgggcagg

SEQ ID NO: 5833090 - DNA, 23 bp, Homo sapiens
actccgagaggtgggccagtctg

SEQ ID NO: 5833091 - DNA, 14 bp, Homo sapiens
actccgcaaatatc

SEQ ID NO: 5833092 - DNA, 17 bp, Homo sapiens
actccgcatcacctcac

SEQ ID NO: 5833093 - DNA, 15 bp, Homo sapiens
actccgccagccaca

SEQ ID NO: 5833094 - DNA, 19 bp, Homo sapiens
actccgccagccacaggac

SEQ ID NO: 5833095 - DNA, 22 bp, Homo sapiens
actccgccagccacaggaccac

SEQ ID NO: 5833096 - DNA, 22 bp, Homo sapiens
actccgcccagcctctccccgc

SEQ ID NO: 5833097 - DNA, 13 bp, Homo sapiens
actccgcccccag

SEQ ID NO: 5833098 - DNA, 16 bp, Homo sapiens
actccgcgccgatgcc

SEQ ID NO: 5833099 - DNA, 18 bp, Homo sapiens
actccgcgccgatgccac

SEQ ID NO: 5833100 - DNA, 22 bp, Homo sapiens
actccgcgccgatgccaccggc

SEQ ID NO: 5833101 - DNA, 23 bp, Homo sapiens
actccgcggagtgatcatggaaa

SEQ ID NO: 5833102 - DNA, 17 bp, Homo sapiens
actccgctcactgaact

SEQ ID NO: 5833103 - DNA, 14 bp, Homo sapiens
actccgctggaggt

SEQ ID NO: 5833104 - DNA, 22 bp, Homo sapiens
actccgctggaggtggggcctg

SEQ ID NO: 5833105 - DNA, 23 bp, Homo sapiens
actccgctggatggggagtctca

SEQ ID NO: 5833106 - DNA, 12 bp, Homo sapiens
actccggaggac

SEQ ID NO: 5833107 - DNA, 23 bp, Homo sapiens
actccggaggactgagcccccac

SEQ ID NO: 5833108 - DNA, 23 bp, Homo sapiens
actccggagtgagaagctttgcc

SEQ ID NO: 5833109 - DNA, 23 bp, Homo sapiens
actccggattccggccctggctg

SEQ ID NO: 5833110 - DNA, 19 bp, Homo sapiens
actccggcctgatgacaga

SEQ ID NO: 5833111 - DNA, 23 bp, Homo sapiens
actccggcctgatgacagagcga

SEQ ID NO: 5833112 - DNA, 13 bp, Homo sapiens
actccggctgtgc

SEQ ID NO: 5833113 - DNA, 14 bp, Homo sapiens
actccggctgtgct

SEQ ID NO: 5833114 - DNA, 19 bp, Homo sapiens
actccgtaacagattttgt

SEQ ID NO: 5833115 - DNA, 15 bp, Homo sapiens
actccgtctcaagga

SEQ ID NO: 5833116 - DNA, 16 bp, Homo sapiens
actccgtgaggctgct

SEQ ID NO: 5833117 - DNA, 18 bp, Homo sapiens
actccgtgaggctgctgc

SEQ ID NO: 5833118 - DNA, 23 bp, Homo sapiens
actccgtgaggctgctgccatcc

SEQ ID NO: 5833119 - DNA, 14 bp, Homo sapiens
actccgttcctggc

SEQ ID NO: 5833120 - DNA, 22 bp, Homo sapiens
actcctaatcaagagtctctcc

SEQ ID NO: 5833121 - DNA, 16 bp, Homo sapiens
actcctacacctaact

SEQ ID NO: 5833122 - DNA, 17 bp, Homo sapiens
actcctacacctaactc

SEQ ID NO: 5833123 - DNA, 21 bp, Homo sapiens
actcctacatgatgttatgta

SEQ ID NO: 5833124 - DNA, 14 bp, Homo sapiens
actcctacctcagc

SEQ ID NO: 5833125 - DNA, 12 bp, Homo sapiens
actcctacctga

SEQ ID NO: 5833126 - DNA, 21 bp, Homo sapiens
actcctacctgaaggcagggc

SEQ ID NO: 5833127 - DNA, 22 bp, Homo sapiens
actcctactgcttcctctgaat

SEQ ID NO: 5833128 - DNA, 14 bp, Homo sapiens
actcctagaagaac

SEQ ID NO: 5833129 - DNA, 21 bp, Homo sapiens
actcctagagaacgcagccct

SEQ ID NO: 5833130 - DNA, 22 bp, Homo sapiens
actcctagagaacgcagcccta

SEQ ID NO: 5833131 - DNA, 23 bp, Homo sapiens
actcctagagaacgcagccctag

SEQ ID NO: 5833132 - DNA, 18 bp, Homo sapiens
actctcatcaccccagag

SEQ ID NO: 5833133 - DNA, 16 bp, Homo sapiens
actctcatcactacag

SEQ ID NO: 5833134 - DNA, 15 bp, Homo sapiens
actctcatgtcccct

SEQ ID NO: 5833135 - DNA, 16 bp, Homo sapiens
actctcatgtcccctt

SEQ ID NO: 5833136 - DNA, 18 bp, Homo sapiens
actctcatgtccccttcc

SEQ ID NO: 5833137 - DNA, 17 bp, Homo sapiens
actctcattccccaggt

SEQ ID NO: 5833138 - DNA, 13 bp, Homo sapiens
actctcattcttt

SEQ ID NO: 5833139 - DNA, 15 bp, Homo sapiens
actctcattctttga

SEQ ID NO: 5833140 - DNA, 19 bp, Homo sapiens
actctcattctttgaacat

SEQ ID NO: 5833141 - DNA, 14 bp, Homo sapiens
actctccaacctgg

SEQ ID NO: 5833142 - DNA, 18 bp, Homo sapiens
actctccaccctggctgg

SEQ ID NO: 5833143 - DNA, 21 bp, Homo sapiens
actctccaccctggctgggat

SEQ ID NO: 5833144 - DNA, 16 bp, Homo sapiens
actctccacctcacta

SEQ ID NO: 5833145 - DNA, 16 bp, Homo sapiens
actctccactgacctg

SEQ ID NO: 5833146 - DNA, 22 bp, Homo sapiens
actctccagccgaagctgcagg

SEQ ID NO: 5833147 - DNA, 18 bp, Homo sapiens
actctccaggcaccgcct

SEQ ID NO: 5833148 - DNA, 19 bp, Homo sapiens
actctccaggcaccgcctg

SEQ ID NO: 5833149 - DNA, 11 bp, Homo sapiens
actctccaggg

SEQ ID NO: 5833150 - DNA, 15 bp, Homo sapiens
actctccaggggtcc

SEQ ID NO: 5833151 - DNA, 17 bp, Homo sapiens
actctccatcagatgtg

SEQ ID NO: 5833152 - DNA, 20 bp, Homo sapiens
actctccattagaaaatttt

SEQ ID NO: 5833153 - DNA, 23 bp, Homo sapiens
actctcccagaggctcctggagc

SEQ ID NO: 5833154 - DNA, 14 bp, Homo sapiens
actctcccaggcct

SEQ ID NO: 5833155 - DNA, 15 bp, Homo sapiens
actctcccatggctt

SEQ ID NO: 5833156 - DNA, 20 bp, Homo sapiens
actctcccattatatttatt

SEQ ID NO: 5833157 - DNA, 21 bp, Homo sapiens
actctcccattatatttattg

SEQ ID NO: 5833158 - DNA, 10 bp, Homo sapiens
actctcccca

SEQ ID NO: 5833159 - DNA, 19 bp, Homo sapiens
actctccccacgagggctg

SEQ ID NO: 5833160 - DNA, 22 bp, Homo sapiens
actctccccacgagggctggct

SEQ ID NO: 5833161 - DNA, 14 bp, Homo sapiens
actctccccagtgc

SEQ ID NO: 5833162 - DNA, 15 bp, Homo sapiens
actctccccgctcag

SEQ ID NO: 5833163 - DNA, 11 bp, Homo sapiens
actctcccctc

SEQ ID NO: 5833164 - DNA, 18 bp, Homo sapiens
actctcccctccccatct

SEQ ID NO: 5833165 - DNA, 21 bp, Homo sapiens
actctcccctccccatctgtg

SEQ ID NO: 5833166 - DNA, 14 bp, Homo sapiens
actctcccctccct

SEQ ID NO: 5833167 - DNA, 16 bp, Homo sapiens
actctcccctccctct

SEQ ID NO: 5833168 - DNA, 20 bp, Homo sapiens
actctcccctccctcttcct

SEQ ID NO: 5833169 - DNA, 13 bp, Homo sapiens
actctcctagaga

SEQ ID NO: 5833170 - DNA, 21 bp, Homo sapiens
actctcctagagacagaagca

SEQ ID NO: 5833171 - DNA, 16 bp, Homo sapiens
actctcctatgccttt

SEQ ID NO: 5833172 - DNA, 14 bp, Homo sapiens
actctcctcatctc

SEQ ID NO: 5833173 - DNA, 15 bp, Homo sapiens
actctcctcatctct

SEQ ID NO: 5833174 - DNA, 14 bp, Homo sapiens
actctcctccagag

SEQ ID NO: 5833175 - DNA, 17 bp, Homo sapiens
actctcctccagagtca

SEQ ID NO: 5833176 - DNA, 22 bp, Homo sapiens
actctcctcccctccctcagag

SEQ ID NO: 5833177 - DNA, 19 bp, Homo sapiens
actctcctcctcccctcct

SEQ ID NO: 5833178 - DNA, 22 bp, Homo sapiens
actctcctcggccccctccatc

SEQ ID NO: 5833179 - DNA, 12 bp, Homo sapiens
actctcctctgc

SEQ ID NO: 5833180 - DNA, 16 bp, Homo sapiens
actctcctctgctgct

SEQ ID NO: 5833181 - DNA, 19 bp, Homo sapiens
actctcctctttttttaaa

SEQ ID NO: 5833182 - DNA, 14 bp, Homo sapiens
actctcctgaggag

SEQ ID NO: 5833183 - DNA, 17 bp, Homo sapiens
actctcctgaggagcag

SEQ ID NO: 5833184 - DNA, 19 bp, Homo sapiens
actctcctgcctcagcctc

SEQ ID NO: 5833185 - DNA, 23 bp, Homo sapiens
actctcctgcctcagcctcccca

SEQ ID NO: 5833186 - DNA, 18 bp, Homo sapiens
actctcctggaaatatta

SEQ ID NO: 5833187 - DNA, 14 bp, Homo sapiens
actctcctggcctt

SEQ ID NO: 5833188 - DNA, 13 bp, Homo sapiens
actctcctgggcc

SEQ ID NO: 5833189 - DNA, 16 bp, Homo sapiens
actctcctgggcccct

SEQ ID NO: 5833190 - DNA, 19 bp, Homo sapiens
actctcgagacttctctgt

SEQ ID NO: 5833191 - DNA, 17 bp, Homo sapiens
actctcgcatcttccca

SEQ ID NO: 5833192 - DNA, 20 bp, Homo sapiens
actctcgtgatatgctgctt

SEQ ID NO: 5833193 - DNA, 18 bp, Homo sapiens
actctcgtgcatttcaac

SEQ ID NO: 5833194 - DNA, 19 bp, Homo sapiens
actctctaaactggtacaa

SEQ ID NO: 5833195 - DNA, 19 bp, Homo sapiens
actctctaaatcttccttg

SEQ ID NO: 5833196 - DNA, 21 bp, Homo sapiens
actctctataagtgttcagtg

SEQ ID NO: 5833197 - DNA, 21 bp, Homo sapiens
actctctccaggagggctcgg

SEQ ID NO: 5833198 - DNA, 18 bp, Homo sapiens
actctctccatcagaagg

SEQ ID NO: 5833199 - DNA, 21 bp, Homo sapiens
actctctccctggtctctgcc

SEQ ID NO: 5833200 - DNA, 22 bp, Homo sapiens
actctctcctctctctccctcc

SEQ ID NO: 5833201 - DNA, 23 bp, Homo sapiens
actctctcctctctctccctcca

SEQ ID NO: 5833202 - DNA, 10 bp, Homo sapiens
actctctctc

SEQ ID NO: 5833203 - DNA, 22 bp, Homo sapiens
actctctctcttttccctcctt

SEQ ID NO: 5833204 - DNA, 13 bp, Homo sapiens
actctctctgccc

SEQ ID NO: 5833205 - DNA, 14 bp, Homo sapiens
actctctctgtgtc

SEQ ID NO: 5833206 - DNA, 21 bp, Homo sapiens
actctctgaacccctccctcc

SEQ ID NO: 5833207 - DNA, 14 bp, Homo sapiens
actctctgacaaag

SEQ ID NO: 5833208 - DNA, 15 bp, Homo sapiens
actctctgagtacat

SEQ ID NO: 5833209 - DNA, 18 bp, Homo sapiens
actctctgcagcccagcc

SEQ ID NO: 5833210 - DNA, 17 bp, Homo sapiens
actctctgcagtcctcc

SEQ ID NO: 5833211 - DNA, 21 bp, Homo sapiens
actctctgccagctccacagg

SEQ ID NO: 5833212 - DNA, 20 bp, Homo sapiens
actctctgccattctgtgca

SEQ ID NO: 5833213 - DNA, 13 bp, Homo sapiens
actctctgcctgc

SEQ ID NO: 5833214 - DNA, 16 bp, Homo sapiens
actctctgctctagcc

SEQ ID NO: 5833215 - DNA, 20 bp, Homo sapiens
actctctgctctagccagga

SEQ ID NO: 5833216 - DNA, 21 bp, Homo sapiens
actctctgcttggattcacta

SEQ ID NO: 5833217 - DNA, 18 bp, Homo sapiens
actctctgggactctcct

SEQ ID NO: 5833218 - DNA, 16 bp, Homo sapiens
actctctgtacaaaaa

SEQ ID NO: 5833219 - DNA, 21 bp, Homo sapiens
actctctgtacaaaaacaaaa

SEQ ID NO: 5833220 - DNA, 22 bp, Homo sapiens
actctctgtacaaaaacaaaac

SEQ ID NO: 5833221 - DNA, 15 bp, Homo sapiens
actctctgtcttctc

SEQ ID NO: 5833222 - DNA, 17 bp, Homo sapiens
actctctgtcttctctc

SEQ ID NO: 5833223 - DNA, 16 bp, Homo sapiens
actctctgtggtccct

SEQ ID NO: 5833224 - DNA, 23 bp, Homo sapiens
actctctgttttagtgtttatgt

SEQ ID NO: 5833225 - DNA, 13 bp, Homo sapiens
actctcttatgca

SEQ ID NO: 5833226 - DNA, 13 bp, Homo sapiens
actctcttccctt

SEQ ID NO: 5833227 - DNA, 16 bp, Homo sapiens
actctcttccctttcc

SEQ ID NO: 5833228 - DNA, 11 bp, Homo sapiens
actctcttcct

SEQ ID NO: 5833229 - DNA, 13 bp, Homo sapiens
actctcttccttt

SEQ ID NO: 5833230 - DNA, 16 bp, Homo sapiens
actctcttcctttcat

SEQ ID NO: 5833231 - DNA, 20 bp, Homo sapiens
actctcttctctttctctct

SEQ ID NO: 5833232 - DNA, 20 bp, Homo sapiens
actctcttcttactgtattt

SEQ ID NO: 5833233 - DNA, 15 bp, Homo sapiens
actctgaaaaacatt

SEQ ID NO: 5833234 - DNA, 23 bp, Homo sapiens
actctgaaaagcaattgccctgt

SEQ ID NO: 5833235 - DNA, 15 bp, Homo sapiens
actctgaactggagc

SEQ ID NO: 5833236 - DNA, 17 bp, Homo sapiens
actctgaagcctctggg

SEQ ID NO: 5833237 - DNA, 18 bp, Homo sapiens
actctgaagcctctggga

SEQ ID NO: 5833238 - DNA, 19 bp, Homo sapiens
actctgaagcctctgggaa

SEQ ID NO: 5833239 - DNA, 22 bp, Homo sapiens
actctgaagctaattgtactaa

SEQ ID NO: 5833240 - DNA, 23 bp, Homo sapiens
actctgaagctgacgaacttcca

SEQ ID NO: 5833241 - DNA, 17 bp, Homo sapiens
actctgaaggagaggag

SEQ ID NO: 5833242 - DNA, 20 bp, Homo sapiens
actctgaagggcatcatgca

SEQ ID NO: 5833243 - DNA, 20 bp, Homo sapiens
actctgaataagcacttttt

SEQ ID NO: 5833244 - DNA, 19 bp, Homo sapiens
actctgaatcaaaagctga

SEQ ID NO: 5833245 - DNA, 15 bp, Homo sapiens
actctgaatttatct

SEQ ID NO: 5833246 - DNA, 17 bp, Homo sapiens
actctgaatttatcttt

SEQ ID NO: 5833247 - DNA, 19 bp, Homo sapiens
actctgaatttatctttga

SEQ ID NO: 5833248 - DNA, 14 bp, Homo sapiens
actctgacaagctg

SEQ ID NO: 5833249 - DNA, 15 bp, Homo sapiens
actctgaccttcaca

SEQ ID NO: 5833250 - DNA, 19 bp, Homo sapiens
actctgacgcaaaaccact

SEQ ID NO: 5833251 - DNA, 19 bp, Homo sapiens
actctgagatgtggagact

SEQ ID NO: 5833252 - DNA, 14 bp, Homo sapiens
actctgagcccagg

SEQ ID NO: 5833253 - DNA, 18 bp, Homo sapiens
actctgagcgggaggcag

SEQ ID NO: 5833254 - DNA, 16 bp, Homo sapiens
actctgagctgctcac

SEQ ID NO: 5833255 - DNA, 15 bp, Homo sapiens
actctgaggaagttg

SEQ ID NO: 5833256 - DNA, 23 bp, Homo sapiens
actctgaggctctttctgggcca

SEQ ID NO: 5833257 - DNA, 22 bp, Homo sapiens
actctgagtaactggttgctgt

SEQ ID NO: 5833258 - DNA, 22 bp, Homo sapiens
actctgagtcacaggtgtggga

SEQ ID NO: 5833259 - DNA, 13 bp, Homo sapiens
actctgagtcctc

SEQ ID NO: 5833260 - DNA, 14 bp, Homo sapiens
actctgagtcctca

SEQ ID NO: 5833261 - DNA, 22 bp, Homo sapiens
actctgagtgcaaacttcagag

SEQ ID NO: 5833262 - DNA, 20 bp, Homo sapiens
actctgagtgttttatgaga

SEQ ID NO: 5833263 - DNA, 22 bp, Homo sapiens
actctgagtttaccatttgtaa

SEQ ID NO: 5833264 - DNA, 14 bp, Homo sapiens
actctgatagaatt

SEQ ID NO: 5833265 - DNA, 18 bp, Homo sapiens
actctgatccctctgggg

SEQ ID NO: 5833266 - DNA, 22 bp, Homo sapiens
actctgatggaatgtgccacct

SEQ ID NO: 5833267 - DNA, 23 bp, Homo sapiens
actctgatggaatgtgccacctg

SEQ ID NO: 5833268 - DNA, 23 bp, Homo sapiens
actctgatggttcttcacctcct

SEQ ID NO: 5833269 - DNA, 19 bp, Homo sapiens
actctgatgtaaatgaagt

SEQ ID NO: 5833270 - DNA, 17 bp, Homo sapiens
actctgattcacctctt

SEQ ID NO: 5833271 - DNA, 23 bp, Homo sapiens
actctgattcacctcttcctctg

SEQ ID NO: 5833272 - DNA, 14 bp, Homo sapiens
actctgcaaaggcc

SEQ ID NO: 5833273 - DNA, 17 bp, Homo sapiens
actctgcaaaggcctgg

SEQ ID NO: 5833274 - DNA, 21 bp, Homo sapiens
actctgcaactgaatacttga

SEQ ID NO: 5833275 - DNA, 14 bp, Homo sapiens
actctgcaagaaga

SEQ ID NO: 5833276 - DNA, 15 bp, Homo sapiens
actctgcaagaagaa

SEQ ID NO: 5833277 - DNA, 21 bp, Homo sapiens
actctgcaagtgtctggagcg

SEQ ID NO: 5833278 - DNA, 14 bp, Homo sapiens
actctgcacatacg

SEQ ID NO: 5833279 - DNA, 18 bp, Homo sapiens
actctgcacatgtcttgt

SEQ ID NO: 5833280 - DNA, 19 bp, Homo sapiens
actctgcactatagccatt

SEQ ID NO: 5833281 - DNA, 13 bp, Homo sapiens
actctgcactcca

SEQ ID NO: 5833282 - DNA, 22 bp, Homo sapiens
actctgcactccatggccaccc

SEQ ID NO: 5833283 - DNA, 13 bp, Homo sapiens
actctgcagactg

SEQ ID NO: 5833284 - DNA, 20 bp, Homo sapiens
actctgcagatagtgcctct

SEQ ID NO: 5833285 - DNA, 15 bp, Homo sapiens
actctgcagcctcag

SEQ ID NO: 5833286 - DNA, 12 bp, Homo sapiens
actctgcaggaa

SEQ ID NO: 5833287 - DNA, 13 bp, Homo sapiens
actctgcaggcag

SEQ ID NO: 5833288 - DNA, 22 bp, Homo sapiens
actctgccagaaaaaaataact

SEQ ID NO: 5833289 - DNA, 16 bp, Homo sapiens
actctgccagcaaaga

SEQ ID NO: 5833290 - DNA, 14 bp, Homo sapiens
actctgccagggtg

SEQ ID NO: 5833291 - DNA, 17 bp, Homo sapiens
actctgccagggtgggg

SEQ ID NO: 5833292 - DNA, 20 bp, Homo sapiens
actctgcccaccccagcatc

SEQ ID NO: 5833293 - DNA, 23 bp, Homo sapiens
actctgccccaatcgggtccaga

SEQ ID NO: 5833294 - DNA, 13 bp, Homo sapiens
actctgccccccc

SEQ ID NO: 5833295 - DNA, 21 bp, Homo sapiens
actctgccccctgctggctct

SEQ ID NO: 5833296 - DNA, 21 bp, Homo sapiens
actctgccccttctgtttcca

SEQ ID NO: 5833297 - DNA, 17 bp, Homo sapiens
actctgccctctagagc

SEQ ID NO: 5833298 - DNA, 15 bp, Homo sapiens
actctgccctctgct

SEQ ID NO: 5833299 - DNA, 19 bp, Homo sapiens
actctgccctctgctgctg

SEQ ID NO: 5833300 - DNA, 19 bp, Homo sapiens
actctgcctaaccatgggc

SEQ ID NO: 5833301 - DNA, 23 bp, Homo sapiens
actctgcctaaccatgggctcag

SEQ ID NO: 5833302 - DNA, 19 bp, Homo sapiens
actctgcctacagaacttc

SEQ ID NO: 5833303 - DNA, 12 bp, Homo sapiens
actctgcctaga

SEQ ID NO: 5833304 - DNA, 12 bp, Homo sapiens
actctgcctcct

SEQ ID NO: 5833305 - DNA, 11 bp, Homo sapiens
actctgcctct

SEQ ID NO: 5833306 - DNA, 14 bp, Homo sapiens
actctgcctgcctg

SEQ ID NO: 5833307 - DNA, 16 bp, Homo sapiens
actctgcctgcttaca

SEQ ID NO: 5833308 - DNA, 21 bp, Homo sapiens
actctgcctttatgatgctaa

SEQ ID NO: 5833309 - DNA, 21 bp, Homo sapiens
actctgcggcccgggccgacc

SEQ ID NO: 5833310 - DNA, 21 bp, Homo sapiens
actctgcgggaggctggggcc

SEQ ID NO: 5833311 - DNA, 20 bp, Homo sapiens
actctgcggtggtgccagag

SEQ ID NO: 5833312 - DNA, 21 bp, Homo sapiens
actctgctagactcctcagga

SEQ ID NO: 5833313 - DNA, 16 bp, Homo sapiens
actctgctatttctct

SEQ ID NO: 5833314 - DNA, 11 bp, Homo sapiens
actctgctctc

SEQ ID NO: 5833315 - DNA, 12 bp, Homo sapiens
actctgctctga

SEQ ID NO: 5833316 - DNA, 15 bp, Homo sapiens
actctgctctgatgc

SEQ ID NO: 5833317 - DNA, 16 bp, Homo sapiens
actctgctctgatgca

SEQ ID NO: 5833318 - DNA, 13 bp, Homo sapiens
actctgctgaggg

SEQ ID NO: 5833319 - DNA, 14 bp, Homo sapiens
actctgctgagggt

SEQ ID NO: 5833320 - DNA, 11 bp, Homo sapiens
actctgctgcc

SEQ ID NO: 5833321 - DNA, 12 bp, Homo sapiens
actctgctgcct

SEQ ID NO: 5833322 - DNA, 13 bp, Homo sapiens
actctgctgcctg

SEQ ID NO: 5833323 - DNA, 23 bp, Homo sapiens
actctgctgtctaacctgtgacc

SEQ ID NO: 5833324 - DNA, 12 bp, Homo sapiens
actctgcttaaa

SEQ ID NO: 5833325 - DNA, 21 bp, Homo sapiens
actctgcttaaacaaagcagt

SEQ ID NO: 5833326 - DNA, 17 bp, Homo sapiens
actctgcttctctgact

SEQ ID NO: 5833327 - DNA, 20 bp, Homo sapiens
actctgcttctctgacttct

SEQ ID NO: 5833328 - DNA, 15 bp, Homo sapiens
actctgcttcttgct

SEQ ID NO: 5833329 - DNA, 20 bp, Homo sapiens
actctgctttgactgagcag

SEQ ID NO: 5833330 - DNA, 15 bp, Homo sapiens
actctgctttgcatc

SEQ ID NO: 5833331 - DNA, 16 bp, Homo sapiens
actctggaaccatcct

SEQ ID NO: 5833332 - DNA, 19 bp, Homo sapiens
actctggaaccatcctctg

SEQ ID NO: 5833333 - DNA, 20 bp, Homo sapiens
actctggaaccatcctctgt

SEQ ID NO: 5833334 - DNA, 22 bp, Homo sapiens
actctggaaccttattccagca

SEQ ID NO: 5833335 - DNA, 18 bp, Homo sapiens
actctggaagattttcat

SEQ ID NO: 5833336 - DNA, 19 bp, Homo sapiens
actctggaagattttcatt

SEQ ID NO: 5833337 - DNA, 14 bp, Homo sapiens
actctggaccatgc

SEQ ID NO: 5833338 - DNA, 20 bp, Homo sapiens
actctggaccatgctgagac

SEQ ID NO: 5833339 - DNA, 18 bp, Homo sapiens
actctggaccccaggcca

SEQ ID NO: 5833340 - DNA, 22 bp, Homo sapiens
actctggactccacgatgcctt

SEQ ID NO: 5833341 - DNA, 15 bp, Homo sapiens
actctggactgggaa

SEQ ID NO: 5833342 - DNA, 17 bp, Homo sapiens
actctggactttctcta

SEQ ID NO: 5833343 - DNA, 14 bp, Homo sapiens
actctggagagcct

SEQ ID NO: 5833344 - DNA, 19 bp, Homo sapiens
actctggaggtcatctggc

SEQ ID NO: 5833345 - DNA, 15 bp, Homo sapiens
actctggatatttgc

SEQ ID NO: 5833346 - DNA, 17 bp, Homo sapiens
actctggattcagcctt

SEQ ID NO: 5833347 - DNA, 21 bp, Homo sapiens
actctggattcagccttcttt

SEQ ID NO: 5833348 - DNA, 14 bp, Homo sapiens
actctggattttga

SEQ ID NO: 5833349 - DNA, 15 bp, Homo sapiens
actctggattttgaa

SEQ ID NO: 5833350 - DNA, 16 bp, Homo sapiens
actctggcaaagcttt

SEQ ID NO: 5833351 - DNA, 11 bp, Homo sapiens
actctggcaca

SEQ ID NO: 5833352 - DNA, 19 bp, Homo sapiens
actctggcacagtgatgcc

SEQ ID NO: 5833353 - DNA, 14 bp, Homo sapiens
actctggcacccag

SEQ ID NO: 5833354 - DNA, 22 bp, Homo sapiens
actctggcagcaccgcctcttc

SEQ ID NO: 5833355 - DNA, 17 bp, Homo sapiens
actctggcagccacact

SEQ ID NO: 5833356 - DNA, 15 bp, Homo sapiens
actctggcagctcag

SEQ ID NO: 5833357 - DNA, 17 bp, Homo sapiens
actctggcagctcagag

SEQ ID NO: 5833358 - DNA, 20 bp, Homo sapiens
actctggcagctcagagagg

SEQ ID NO: 5833359 - DNA, 12 bp, Homo sapiens
actctggccctg

SEQ ID NO: 5833360 - DNA, 13 bp, Homo sapiens
actctggcctctc

SEQ ID NO: 5833361 - DNA, 14 bp, Homo sapiens
actctggcctctgt

SEQ ID NO: 5833362 - DNA, 21 bp, Homo sapiens
actctggccttggttcctcca

SEQ ID NO: 5833363 - DNA, 20 bp, Homo sapiens
actctggcggtggccacagc

SEQ ID NO: 5833364 - DNA, 14 bp, Homo sapiens
actctggctcagcc

SEQ ID NO: 5833365 - DNA, 19 bp, Homo sapiens
actctggctcagcctgtct

SEQ ID NO: 5833366 - DNA, 21 bp, Homo sapiens
actctggctcagcctgtctcg

SEQ ID NO: 5833367 - DNA, 15 bp, Homo sapiens
actctggctccaggc

SEQ ID NO: 5833368 - DNA, 14 bp, Homo sapiens
actctggctgccaa

SEQ ID NO: 5833369 - DNA, 15 bp, Homo sapiens
actctggctgccaag

SEQ ID NO: 5833370 - DNA, 22 bp, Homo sapiens
actctggctggtttggaatgct

SEQ ID NO: 5833371 - DNA, 23 bp, Homo sapiens
actctggctggtttggaatgctt

SEQ ID NO: 5833372 - DNA, 23 bp, Homo sapiens
actctggcttcaaaaagccacag

SEQ ID NO: 5833373 - DNA, 14 bp, Homo sapiens
actctggcttccag

SEQ ID NO: 5833374 - DNA, 17 bp, Homo sapiens
actctggcttccaggta

SEQ ID NO: 5833375 - DNA, 15 bp, Homo sapiens
actctggcttggcct

SEQ ID NO: 5833376 - DNA, 21 bp, Homo sapiens
actctgggcaaagcccctcac

SEQ ID NO: 5833377 - DNA, 21 bp, Homo sapiens
actctgggcacttttgaactc

SEQ ID NO: 5833378 - DNA, 11 bp, Homo sapiens
actctgggcag

SEQ ID NO: 5833379 - DNA, 18 bp, Homo sapiens
actctgggctatggacac

SEQ ID NO: 5833380 - DNA, 22 bp, Homo sapiens
actctgggctatggacacaggg

SEQ ID NO: 5833381 - DNA, 23 bp, Homo sapiens
actctgggctcaagcaatcctct

SEQ ID NO: 5833382 - DNA, 14 bp, Homo sapiens
actctgggctccag

SEQ ID NO: 5833383 - DNA, 16 bp, Homo sapiens
actctgggctccagag

SEQ ID NO: 5833384 - DNA, 12 bp, Homo sapiens
actctgggctgt

SEQ ID NO: 5833385 - DNA, 17 bp, Homo sapiens
actctgggctgtgcctg

SEQ ID NO: 5833386 - DNA, 23 bp, Homo sapiens
actctggggctggcaccagcagg

SEQ ID NO: 5833387 - DNA, 21 bp, Homo sapiens
actctggggcttgtcctgtgc

SEQ ID NO: 5833388 - DNA, 15 bp, Homo sapiens
actctgggtccttcc

SEQ ID NO: 5833389 - DNA, 18 bp, Homo sapiens
actctgggtccttcctga

SEQ ID NO: 5833390 - DNA, 19 bp, Homo sapiens
actctgggtccttcctgaa

SEQ ID NO: 5833391 - DNA, 16 bp, Homo sapiens
actctgggtctggcca

SEQ ID NO: 5833392 - DNA, 20 bp, Homo sapiens
actctgggtcttggccatga

SEQ ID NO: 5833393 - DNA, 22 bp, Homo sapiens
actctgggtggaagtgcccagc

SEQ ID NO: 5833394 - DNA, 20 bp, Homo sapiens
actctgggttcgttggggac

SEQ ID NO: 5833395 - DNA, 17 bp, Homo sapiens
actctggtcttggaatt

SEQ ID NO: 5833396 - DNA, 21 bp, Homo sapiens
actctggtgataaaaataaag

SEQ ID NO: 5833397 - DNA, 17 bp, Homo sapiens
actctggtgcctccaga

SEQ ID NO: 5833398 - DNA, 13 bp, Homo sapiens
actctggtggcca

SEQ ID NO: 5833399 - DNA, 13 bp, Homo sapiens
actctgtaaaatg

SEQ ID NO: 5833400 - DNA, 17 bp, Homo sapiens
actctgtaaccacctct

SEQ ID NO: 5833401 - DNA, 12 bp, Homo sapiens
actctgtaattg

SEQ ID NO: 5833402 - DNA, 16 bp, Homo sapiens
actctgtagcaaattt

SEQ ID NO: 5833403 - DNA, 19 bp, Homo sapiens
actctgtagcaaatttgtt

SEQ ID NO: 5833404 - DNA, 18 bp, Homo sapiens
actctgtagtctcagttc

SEQ ID NO: 5833405 - DNA, 21 bp, Homo sapiens
actctgtatctatgcaaagca

SEQ ID NO: 5833406 - DNA, 20 bp, Homo sapiens
actctgtatttaggccattt

SEQ ID NO: 5833407 - DNA, 16 bp, Homo sapiens
actctgtcacactaaa

SEQ ID NO: 5833408 - DNA, 14 bp, Homo sapiens
actctgtcagatgg

SEQ ID NO: 5833409 - DNA, 15 bp, Homo sapiens
actctgtcagccagc

SEQ ID NO: 5833410 - DNA, 14 bp, Homo sapiens
actctgtccaactc

SEQ ID NO: 5833411 - DNA, 17 bp, Homo sapiens
actctgtccaactctgt

SEQ ID NO: 5833412 - DNA, 21 bp, Homo sapiens
actctgtccaactctgtattt

SEQ ID NO: 5833413 - DNA, 23 bp, Homo sapiens
actctgtccaggccactgtggcc

SEQ ID NO: 5833414 - DNA, 21 bp, Homo sapiens
actctgtccctgtccttccct

SEQ ID NO: 5833415 - DNA, 19 bp, Homo sapiens
actctgtctcaaaaaaaca

SEQ ID NO: 5833416 - DNA, 22 bp, Homo sapiens
actctgtctcaataatataata

SEQ ID NO: 5833417 - DNA, 15 bp, Homo sapiens
actctgtctcagtcc

SEQ ID NO: 5833418 - DNA, 20 bp, Homo sapiens
actctgtctcagtccatgaa

SEQ ID NO: 5833419 - DNA, 15 bp, Homo sapiens
actctgtctggccag

SEQ ID NO: 5833420 - DNA, 16 bp, Homo sapiens
actctgtcttaaatga

SEQ ID NO: 5833421 - DNA, 17 bp, Homo sapiens
actctgtcttcacctga

SEQ ID NO: 5833422 - DNA, 15 bp, Homo sapiens
actctgtcttgtgtt

SEQ ID NO: 5833423 - DNA, 16 bp, Homo sapiens
actctgtgatctaagc

SEQ ID NO: 5833424 - DNA, 12 bp, Homo sapiens
actctgtgcagg

SEQ ID NO: 5833425 - DNA, 21 bp, Homo sapiens
actctgtgcaggtgctgcctt

SEQ ID NO: 5833426 - DNA, 11 bp, Homo sapiens
actctgtgcca

SEQ ID NO: 5833427 - DNA, 12 bp, Homo sapiens
actctgtgctca

SEQ ID NO: 5833428 - DNA, 11 bp, Homo sapiens
actctgtgctg

SEQ ID NO: 5833429 - DNA, 17 bp, Homo sapiens
actctgtgctggccagc

SEQ ID NO: 5833430 - DNA, 12 bp, Homo sapiens
actctgtggcca

SEQ ID NO: 5833431 - DNA, 13 bp, Homo sapiens
actctgtggccag

SEQ ID NO: 5833432 - DNA, 16 bp, Homo sapiens
actctgtggccagcct

SEQ ID NO: 5833433 - DNA, 17 bp, Homo sapiens
actctgtggccagcctg

SEQ ID NO: 5833434 - DNA, 23 bp, Homo sapiens
actctgtggccagcctggcatca

SEQ ID NO: 5833435 - DNA, 12 bp, Homo sapiens
actctgtgtaaa

SEQ ID NO: 5833436 - DNA, 13 bp, Homo sapiens
actctgtgtaaat

SEQ ID NO: 5833437 - DNA, 22 bp, Homo sapiens
actctgtgtaaatatttttccc

SEQ ID NO: 5833438 - DNA, 19 bp, Homo sapiens
actctgtgtaatagaataa

SEQ ID NO: 5833439 - DNA, 22 bp, Homo sapiens
actctgtgtcagcatctttgcc

SEQ ID NO: 5833440 - DNA, 16 bp, Homo sapiens
actctgtgtcaggtgg

SEQ ID NO: 5833441 - DNA, 19 bp, Homo sapiens
actctgtgtcaggtggggc

SEQ ID NO: 5833442 - DNA, 15 bp, Homo sapiens
actctgtgtctgagt

SEQ ID NO: 5833443 - DNA, 16 bp, Homo sapiens
actctgtgtctgagtg

SEQ ID NO: 5833444 - DNA, 13 bp, Homo sapiens
actctgtgtgaga

SEQ ID NO: 5833445 - DNA, 14 bp, Homo sapiens
actctgtgtttaaa

SEQ ID NO: 5833446 - DNA, 15 bp, Homo sapiens
actctgttatttaga

SEQ ID NO: 5833447 - DNA, 15 bp, Homo sapiens
actctgttcattcct

SEQ ID NO: 5833448 - DNA, 16 bp, Homo sapiens
actctgttcattcctc

SEQ ID NO: 5833449 - DNA, 19 bp, Homo sapiens
actctgttcccccaccctc

SEQ ID NO: 5833450 - DNA, 22 bp, Homo sapiens
actctgttcccccaccctccat

SEQ ID NO: 5833451 - DNA, 23 bp, Homo sapiens
actctgttcccccaccctccatg

SEQ ID NO: 5833452 - DNA, 14 bp, Homo sapiens
actctgttccttca

SEQ ID NO: 5833453 - DNA, 22 bp, Homo sapiens
actctgttccttcacatcctgt

SEQ ID NO: 5833454 - DNA, 17 bp, Homo sapiens
actctgttgatctaccc

SEQ ID NO: 5833455 - DNA, 13 bp, Homo sapiens
actctgttgcctc

SEQ ID NO: 5833456 - DNA, 17 bp, Homo sapiens
actctgttgcctcctct

SEQ ID NO: 5833457 - DNA, 23 bp, Homo sapiens
actctgttgcctcctctctccct

SEQ ID NO: 5833458 - DNA, 16 bp, Homo sapiens
actctgtttgctcacc

SEQ ID NO: 5833459 - DNA, 21 bp, Homo sapiens
actcttaaaaatgttttttca

SEQ ID NO: 5833460 - DNA, 18 bp, Homo sapiens
actcttaaaacccaagtg

SEQ ID NO: 5833461 - DNA, 20 bp, Homo sapiens
actcttaaagcaaaaaatga

SEQ ID NO: 5833462 - DNA, 16 bp, Homo sapiens
actcttaaatatacaa

SEQ ID NO: 5833463 - DNA, 19 bp, Homo sapiens
actcttaaatatacaactt

SEQ ID NO: 5833464 - DNA, 15 bp, Homo sapiens
actcttaagcaatgg

SEQ ID NO: 5833465 - DNA, 18 bp, Homo sapiens
actcttaagtttctcagc

SEQ ID NO: 5833466 - DNA, 19 bp, Homo sapiens
actcttaatctcacttcat

SEQ ID NO: 5833467 - DNA, 18 bp, Homo sapiens
actcttaatctgtgtgta

SEQ ID NO: 5833468 - DNA, 15 bp, Homo sapiens
actcttaattttaaa

SEQ ID NO: 5833469 - DNA, 18 bp, Homo sapiens
actcttacctaaactgag

SEQ ID NO: 5833470 - DNA, 18 bp, Homo sapiens
actcttagactgagtaaa

SEQ ID NO: 5833471 - DNA, 19 bp, Homo sapiens
actcttaggaagagaaacc

SEQ ID NO: 5833472 - DNA, 22 bp, Homo sapiens
actcttaggcacatcaattaat

SEQ ID NO: 5833473 - DNA, 23 bp, Homo sapiens
actcttaggctaagagatgtgac

SEQ ID NO: 5833474 - DNA, 15 bp, Homo sapiens
actcttagttactca

SEQ ID NO: 5833475 - DNA, 23 bp, Homo sapiens
actcttagttttttttttttaca

SEQ ID NO: 5833476 - DNA, 16 bp, Homo sapiens
actcttatatctatat

SEQ ID NO: 5833477 - DNA, 19 bp, Homo sapiens
actcttatatctatatttt

SEQ ID NO: 5833478 - DNA, 22 bp, Homo sapiens
actcttatctcagtcatgcata

SEQ ID NO: 5833479 - DNA, 21 bp, Homo sapiens
actcttattgcccacgctgga

SEQ ID NO: 5833480 - DNA, 14 bp, Homo sapiens
actcttatttcttt

SEQ ID NO: 5833481 - DNA, 15 bp, Homo sapiens
actcttcaaatgcct

SEQ ID NO: 5833482 - DNA, 16 bp, Homo sapiens
actcttcaaggccaag

SEQ ID NO: 5833483 - DNA, 17 bp, Homo sapiens
actcttcacaaaatctg

SEQ ID NO: 5833484 - DNA, 12 bp, Homo sapiens
actcttcactgt

SEQ ID NO: 5833485 - DNA, 13 bp, Homo sapiens
actcttcactgtt

SEQ ID NO: 5833486 - DNA, 13 bp, Homo sapiens
actcttcagaaca

SEQ ID NO: 5833487 - DNA, 19 bp, Homo sapiens
actcttcagcctcattcac

SEQ ID NO: 5833488 - DNA, 23 bp, Homo sapiens
actgagtaccaggggctgggctc

SEQ ID NO: 5833489 - DNA, 19 bp, Homo sapiens
actgagtacgttgtgcatt

SEQ ID NO: 5833490 - DNA, 23 bp, Homo sapiens
actgagtacgttgtgcatttggt

SEQ ID NO: 5833491 - DNA, 20 bp, Homo sapiens
actgagtactctttctctcc

SEQ ID NO: 5833492 - DNA, 19 bp, Homo sapiens
actgagtattaatatctga

SEQ ID NO: 5833493 - DNA, 23 bp, Homo sapiens
actgagtcacgctggggctctct

SEQ ID NO: 5833494 - DNA, 22 bp, Homo sapiens
actgagtcatcttgtgagtgga

SEQ ID NO: 5833495 - DNA, 15 bp, Homo sapiens
actgagtccatgaaa

SEQ ID NO: 5833496 - DNA, 16 bp, Homo sapiens
actgagtccatgaaaa

SEQ ID NO: 5833497 - DNA, 21 bp, Homo sapiens
actgagtctggcaaacatgtg

SEQ ID NO: 5833498 - DNA, 11 bp, Homo sapiens
actgagtgcct

SEQ ID NO: 5833499 - DNA, 13 bp, Homo sapiens
actgagtgcctgc

SEQ ID NO: 5833500 - DNA, 16 bp, Homo sapiens
actgagtgccttttgg

SEQ ID NO: 5833501 - DNA, 13 bp, Homo sapiens
actgagtggcttg

SEQ ID NO: 5833502 - DNA, 14 bp, Homo sapiens
actgagtgggaagc

SEQ ID NO: 5833503 - DNA, 15 bp, Homo sapiens
actgagtgggaagcc

SEQ ID NO: 5833504 - DNA, 16 bp, Homo sapiens
actgagtggggagtgt

SEQ ID NO: 5833505 - DNA, 15 bp, Homo sapiens
actgagttacattgt

SEQ ID NO: 5833506 - DNA, 13 bp, Homo sapiens
actgagtttgtgg

SEQ ID NO: 5833507 - DNA, 20 bp, Homo sapiens
actgagttttgtttcacttt

SEQ ID NO: 5833508 - DNA, 14 bp, Homo sapiens
actgataaacctaa

SEQ ID NO: 5833509 - DNA, 12 bp, Homo sapiens
actgataacaac

SEQ ID NO: 5833510 - DNA, 21 bp, Homo sapiens
actgataacttggggaggcaa

SEQ ID NO: 5833511 - DNA, 19 bp, Homo sapiens
actgataattttacaattt

SEQ ID NO: 5833512 - DNA, 20 bp, Homo sapiens
actgataatttttgttttta

SEQ ID NO: 5833513 - DNA, 15 bp, Homo sapiens
actgatacataaaaa

SEQ ID NO: 5833514 - DNA, 14 bp, Homo sapiens
actgatactattca

SEQ ID NO: 5833515 - DNA, 15 bp, Homo sapiens
actgatactattcaa

SEQ ID NO: 5833516 - DNA, 16 bp, Homo sapiens
actgatactattcaat

SEQ ID NO: 5833517 - DNA, 22 bp, Homo sapiens
actgatactattcaatgcaatg

SEQ ID NO: 5833518 - DNA, 23 bp, Homo sapiens
actgatactattcaatgcaatgc

SEQ ID NO: 5833519 - DNA, 17 bp, Homo sapiens
actgatagttactgttg

SEQ ID NO: 5833520 - DNA, 18 bp, Homo sapiens
actgatagttactgttgt

SEQ ID NO: 5833521 - DNA, 23 bp, Homo sapiens
actgatagttgccttttcttccc

SEQ ID NO: 5833522 - DNA, 17 bp, Homo sapiens
actgatatattttacaa

SEQ ID NO: 5833523 - DNA, 18 bp, Homo sapiens
actgatatcacgggcccg

SEQ ID NO: 5833524 - DNA, 20 bp, Homo sapiens
actgatatcacgggcccgct

SEQ ID NO: 5833525 - DNA, 19 bp, Homo sapiens
actgatatgggtcttgata

SEQ ID NO: 5833526 - DNA, 17 bp, Homo sapiens
actgatcaaaaataaac

SEQ ID NO: 5833527 - DNA, 18 bp, Homo sapiens
actgatcaaaaataaact

SEQ ID NO: 5833528 - DNA, 19 bp, Homo sapiens
actgatcaaaaataaacta

SEQ ID NO: 5833529 - DNA, 21 bp, Homo sapiens
actgatcaaaaataaactagt

SEQ ID NO: 5833530 - DNA, 18 bp, Homo sapiens
actgatcaggacctccaa

SEQ ID NO: 5833531 - DNA, 19 bp, Homo sapiens
actgatcatccaggcctca

SEQ ID NO: 5833532 - DNA, 16 bp, Homo sapiens
actgatcatctgctgt

SEQ ID NO: 5833533 - DNA, 18 bp, Homo sapiens
actgatcatgcattgttg

SEQ ID NO: 5833534 - DNA, 21 bp, Homo sapiens
actgatcatgtttatgagaaa

SEQ ID NO: 5833535 - DNA, 19 bp, Homo sapiens
actgatcatttgcagctgc

SEQ ID NO: 5833536 - DNA, 17 bp, Homo sapiens
actgatccagccctgag

SEQ ID NO: 5833537 - DNA, 18 bp, Homo sapiens
actgatccatcctgtttt

SEQ ID NO: 5833538 - DNA, 21 bp, Homo sapiens
actgatcctgaacaagaaaga

SEQ ID NO: 5833539 - DNA, 16 bp, Homo sapiens
actgatctcgatgcag

SEQ ID NO: 5833540 - DNA, 22 bp, Homo sapiens
actgatctctactaccacaagg

SEQ ID NO: 5833541 - DNA, 13 bp, Homo sapiens
actgatctctcgt

SEQ ID NO: 5833542 - DNA, 20 bp, Homo sapiens
actgatcttacctttatgag

SEQ ID NO: 5833543 - DNA, 21 bp, Homo sapiens
actgatgaactagtgatgtag

SEQ ID NO: 5833544 - DNA, 20 bp, Homo sapiens
actgatgaagaaatttatga

SEQ ID NO: 5833545 - DNA, 17 bp, Homo sapiens
actgatgacaaacccag

SEQ ID NO: 5833546 - DNA, 20 bp, Homo sapiens
actgatgagacaacacacac

SEQ ID NO: 5833547 - DNA, 12 bp, Homo sapiens
actgatgagcac

SEQ ID NO: 5833548 - DNA, 16 bp, Homo sapiens
actgatgagtcttgat

SEQ ID NO: 5833549 - DNA, 22 bp, Homo sapiens
actgatgagtttcactgtactg

SEQ ID NO: 5833550 - DNA, 23 bp, Homo sapiens
actgatgataggttaataaagat

SEQ ID NO: 5833551 - DNA, 24 bp, Homo sapiens
actgatgataggttaataaagatg

SEQ ID NO: 5833552 - DNA, 23 bp, Homo sapiens
actgatgatgacaggtcagcagt

SEQ ID NO: 5833553 - DNA, 13 bp, Homo sapiens
actgatgatgtgt

SEQ ID NO: 5833554 - DNA, 16 bp, Homo sapiens
actgatgattttcctt

SEQ ID NO: 5833555 - DNA, 17 bp, Homo sapiens
actgatgattttccttt

SEQ ID NO: 5833556 - DNA, 17 bp, Homo sapiens
actgatgcaaggattac

SEQ ID NO: 5833557 - DNA, 23 bp, Homo sapiens
actgatgcaaggattacagaaac

SEQ ID NO: 5833558 - DNA, 13 bp, Homo sapiens
actgatgctgagg

SEQ ID NO: 5833559 - DNA, 15 bp, Homo sapiens
actgatgctgcccct

SEQ ID NO: 5833560 - DNA, 12 bp, Homo sapiens
actgatgctttt

SEQ ID NO: 5833561 - DNA, 17 bp, Homo sapiens
actgatggaagcacaca

SEQ ID NO: 5833562 - DNA, 18 bp, Homo sapiens
actgatggaagcacacaa

SEQ ID NO: 5833563 - DNA, 12 bp, Homo sapiens
actgatggaatt

SEQ ID NO: 5833564 - DNA, 23 bp, Homo sapiens
actgatggaccgggtgggcctgg

SEQ ID NO: 5833565 - DNA, 17 bp, Homo sapiens
actgatggaggctgcag

SEQ ID NO: 5833566 - DNA, 15 bp, Homo sapiens
actgatggattccaa

SEQ ID NO: 5833567 - DNA, 17 bp, Homo sapiens
actgatggccaggcaag

SEQ ID NO: 5833568 - DNA, 21 bp, Homo sapiens
actgatgggaataaaagtatt

SEQ ID NO: 5833569 - DNA, 22 bp, Homo sapiens
actgatgggaataaaagtatta

SEQ ID NO: 5833570 - DNA, 22 bp, Homo sapiens
actgatgggcaacccccagcct

SEQ ID NO: 5833571 - DNA, 12 bp, Homo sapiens
actgatgggctg

SEQ ID NO: 5833572 - DNA, 16 bp, Homo sapiens
actgatgggctggggc

SEQ ID NO: 5833573 - DNA, 17 bp, Homo sapiens
actgatgggctggggca

SEQ ID NO: 5833574 - DNA, 22 bp, Homo sapiens
actgatgggtatcatgcttcta

SEQ ID NO: 5833575 - DNA, 20 bp, Homo sapiens
actgatggtttggaaaataa

SEQ ID NO: 5833576 - DNA, 20 bp, Homo sapiens
actgatgtatagctttaaca

SEQ ID NO: 5833577 - DNA, 21 bp, Homo sapiens
actgatgtatagctttaacat

SEQ ID NO: 5833578 - DNA, 20 bp, Homo sapiens
actgatgtatgaggaatttc

SEQ ID NO: 5833579 - DNA, 19 bp, Homo sapiens
actgatgtcatcttgagct

SEQ ID NO: 5833580 - DNA, 13 bp, Homo sapiens
actgatgtctcct

SEQ ID NO: 5833581 - DNA, 14 bp, Homo sapiens
actgatgtctccta

SEQ ID NO: 5833582 - DNA, 17 bp, Homo sapiens
actgatgtctcctaagc

SEQ ID NO: 5833583 - DNA, 19 bp, Homo sapiens
actgatgtgttgtgcctta

SEQ ID NO: 5833584 - DNA, 21 bp, Homo sapiens
actgatgttacatcacagtgt

SEQ ID NO: 5833585 - DNA, 17 bp, Homo sapiens
actgatgttactagcct

SEQ ID NO: 5833586 - DNA, 23 bp, Homo sapiens
actgatgttaggctgggcccaga

SEQ ID NO: 5833587 - DNA, 17 bp, Homo sapiens
actgatgttgtgttttt

SEQ ID NO: 5833588 - DNA, 18 bp, Homo sapiens
actgatgtttgtgcagta

SEQ ID NO: 5833589 - DNA, 13 bp, Homo sapiens
actgatgttttag

SEQ ID NO: 5833590 - DNA, 15 bp, Homo sapiens
actgattaacaaata

SEQ ID NO: 5833591 - DNA, 16 bp, Homo sapiens
actgattacctgccaa

SEQ ID NO: 5833592 - DNA, 17 bp, Homo sapiens
actgattagtattcagg

SEQ ID NO: 5833593 - DNA, 18 bp, Homo sapiens
actgattattacttctgt

SEQ ID NO: 5833594 - DNA, 15 bp, Homo sapiens
actgattattttctt

SEQ ID NO: 5833595 - DNA, 18 bp, Homo sapiens
actgattattttcttcat

SEQ ID NO: 5833596 - DNA, 16 bp, Homo sapiens
actgattcaagaacaa

SEQ ID NO: 5833597 - DNA, 19 bp, Homo sapiens
actgattcacatctcattt

SEQ ID NO: 5833598 - DNA, 22 bp, Homo sapiens
actgattccagcaagaccaaat

SEQ ID NO: 5833599 - DNA, 17 bp, Homo sapiens
actgattccctctccca

SEQ ID NO: 5833600 - DNA, 20 bp, Homo sapiens
actgattctgggatgctcct

SEQ ID NO: 5833601 - DNA, 14 bp, Homo sapiens
actgattctgtgta

SEQ ID NO: 5833602 - DNA, 15 bp, Homo sapiens
actgattcttcagca

SEQ ID NO: 5833603 - DNA, 15 bp, Homo sapiens
actgattgagaagtt

SEQ ID NO: 5833604 - DNA, 20 bp, Homo sapiens
actgattgttttagagacta

SEQ ID NO: 5833605 - DNA, 20 bp, Homo sapiens
actgatttagaagcaaagat

SEQ ID NO: 5833606 - DNA, 14 bp, Homo sapiens
actgatttagccat

SEQ ID NO: 5833607 - DNA, 14 bp, Homo sapiens
actgatttcagtaa

SEQ ID NO: 5833608 - DNA, 15 bp, Homo sapiens
actgatttcagtaag

SEQ ID NO: 5833609 - DNA, 17 bp, Homo sapiens
actgatttccccttttg

SEQ ID NO: 5833610 - DNA, 16 bp, Homo sapiens
actgatttctatggct

SEQ ID NO: 5833611 - DNA, 21 bp, Homo sapiens
actgatttgatgcctctcccc

SEQ ID NO: 5833612 - DNA, 12 bp, Homo sapiens
actgatttgctc

SEQ ID NO: 5833613 - DNA, 12 bp, Homo sapiens
actgatttgtgg

SEQ ID NO: 5833614 - DNA, 16 bp, Homo sapiens
actgattttaaaatga

SEQ ID NO: 5833615 - DNA, 19 bp, Homo sapiens
actgattttcaaaaaaatg

SEQ ID NO: 5833616 - DNA, 15 bp, Homo sapiens
actgattttgaaaag

SEQ ID NO: 5833617 - DNA, 17 bp, Homo sapiens
actgattttgtatgtaa

SEQ ID NO: 5833618 - DNA, 16 bp, Homo sapiens
actgatttttaagtca

SEQ ID NO: 5833619 - DNA, 23 bp, Homo sapiens
actgatttttattaactgctttt

SEQ ID NO: 5833620 - DNA, 15 bp, Homo sapiens
actgatttttgtaag

SEQ ID NO: 5833621 - DNA, 18 bp, Homo sapiens
actgatttttgtaagaca

SEQ ID NO: 5833622 - DNA, 13 bp, Homo sapiens
actgattttttaa

SEQ ID NO: 5833623 - DNA, 18 bp, Homo sapiens
actgatttttttttcctt

SEQ ID NO: 5833624 - DNA, 19 bp, Homo sapiens
actgatttttttttccttc

SEQ ID NO: 5833625 - DNA, 20 bp, Homo sapiens
actgatttttttttccttca

SEQ ID NO: 5833626 - DNA, 17 bp, Homo sapiens
actgcaaaaaaagcctc

SEQ ID NO: 5833627 - DNA, 15 bp, Homo sapiens
actgcaaaaagtaca

SEQ ID NO: 5833628 - DNA, 23 bp, Homo sapiens
actgcaaaatgtcttaatgcaaa

SEQ ID NO: 5833629 - DNA, 13 bp, Homo sapiens
actgcaaactttt

SEQ ID NO: 5833630 - DNA, 18 bp, Homo sapiens
actgcaaacttttttata

SEQ ID NO: 5833631 - DNA, 13 bp, Homo sapiens
actgcaaaggctt

SEQ ID NO: 5833632 - DNA, 16 bp, Homo sapiens
actgcaaataaagcct

SEQ ID NO: 5833633 - DNA, 12 bp, Homo sapiens
actgcaaatact

SEQ ID NO: 5833634 - DNA, 20 bp, Homo sapiens
actgcaaatggcagttttaa

SEQ ID NO: 5833635 - DNA, 19 bp, Homo sapiens
actgcaaattgtagcccag

SEQ ID NO: 5833636 - DNA, 21 bp, Homo sapiens
actgcaaattgtagcccagtt

SEQ ID NO: 5833637 - DNA, 11 bp, Homo sapiens
actgcaacagg

SEQ ID NO: 5833638 - DNA, 18 bp, Homo sapiens
actgcaacaggcttgtgc

SEQ ID NO: 5833639 - DNA, 13 bp, Homo sapiens
actgcaacctcca

SEQ ID NO: 5833640 - DNA, 16 bp, Homo sapiens
actgcaacctccacct

SEQ ID NO: 5833641 - DNA, 17 bp, Homo sapiens
actgcaacctccacctc

SEQ ID NO: 5833642 - DNA, 20 bp, Homo sapiens
actgcaacctccacctcgca

SEQ ID NO: 5833643 - DNA, 17 bp, Homo sapiens
actgcaacctccgcctc

SEQ ID NO: 5833644 - DNA, 18 bp, Homo sapiens
actgcaacctctgcctcc

SEQ ID NO: 5833645 - DNA, 22 bp, Homo sapiens
actgcaacttaacttaaaattg

SEQ ID NO: 5833646 - DNA, 21 bp, Homo sapiens
actgcaacttccgcctcctgt

SEQ ID NO: 5833647 - DNA, 14 bp, Homo sapiens
actgcaacttctgc

SEQ ID NO: 5833648 - DNA, 16 bp, Homo sapiens
actgcaacttctgcct

SEQ ID NO: 5833649 - DNA, 15 bp, Homo sapiens
actgcaacttgtgaa

SEQ ID NO: 5833650 - DNA, 16 bp, Homo sapiens
actgcaagaaaatgat

SEQ ID NO: 5833651 - DNA, 12 bp, Homo sapiens
actgcaagaact

SEQ ID NO: 5833652 - DNA, 14 bp, Homo sapiens
actgcaagagatgg

SEQ ID NO: 5833653 - DNA, 17 bp, Homo sapiens
actgcaagagccttggt

SEQ ID NO: 5833654 - DNA, 18 bp, Homo sapiens
actgcaagaggctcctgt

SEQ ID NO: 5833655 - DNA, 22 bp, Homo sapiens
actgcaagcatttttccatctg

SEQ ID NO: 5833656 - DNA, 14 bp, Homo sapiens
actgcaagctctgc

SEQ ID NO: 5833657 - DNA, 19 bp, Homo sapiens
actgcaagctctgcctccc

SEQ ID NO: 5833658 - DNA, 15 bp, Homo sapiens
actgcaagctgcttg

SEQ ID NO: 5833659 - DNA, 18 bp, Homo sapiens
actgcaagtcacaaagga

SEQ ID NO: 5833660 - DNA, 20 bp, Homo sapiens
actgcaagtcacaaaggaat

SEQ ID NO: 5833661 - DNA, 21 bp, Homo sapiens
actgcaagtcacaaaggaatg

SEQ ID NO: 5833662 - DNA, 23 bp, Homo sapiens
actgcaagttcattttaaatgaa

SEQ ID NO: 5833663 - DNA, 17 bp, Homo sapiens
actgcaataacttctga

SEQ ID NO: 5833664 - DNA, 20 bp, Homo sapiens
actgcaataacttctgacct

SEQ ID NO: 5833665 - DNA, 15 bp, Homo sapiens
actgcggctgtctcc

SEQ ID NO: 5833666 - DNA, 16 bp, Homo sapiens
actgcgggagccagac

SEQ ID NO: 5833667 - DNA, 17 bp, Homo sapiens
actgcgggagctctgta

SEQ ID NO: 5833668 - DNA, 23 bp, Homo sapiens
actgcgggagctctgtatggtca

SEQ ID NO: 5833669 - DNA, 16 bp, Homo sapiens
actgcggggcttggct

SEQ ID NO: 5833670 - DNA, 13 bp, Homo sapiens
actgctaaataaa

SEQ ID NO: 5833671 - DNA, 14 bp, Homo sapiens
actgctaaataaaa

SEQ ID NO: 5833672 - DNA, 16 bp, Homo sapiens
actgctaaataaaatt

SEQ ID NO: 5833673 - DNA, 20 bp, Homo sapiens
actgctaaataaaatttgtt

SEQ ID NO: 5833674 - DNA, 18 bp, Homo sapiens
actgctaagaatatttga

SEQ ID NO: 5833675 - DNA, 18 bp, Homo sapiens
actgctaaggctgctggc

SEQ ID NO: 5833676 - DNA, 15 bp, Homo sapiens
actgctaataaatga

SEQ ID NO: 5833677 - DNA, 16 bp, Homo sapiens
actgctaataaatgac

SEQ ID NO: 5833678 - DNA, 18 bp, Homo sapiens
actgctaataaatgacca

SEQ ID NO: 5833679 - DNA, 20 bp, Homo sapiens
actgctaataaatgaccagt

SEQ ID NO: 5833680 - DNA, 14 bp, Homo sapiens
actgctaatgttga

SEQ ID NO: 5833681 - DNA, 14 bp, Homo sapiens
actgctaattacac

SEQ ID NO: 5833682 - DNA, 17 bp, Homo sapiens
actgctacacttctgat

SEQ ID NO: 5833683 - DNA, 14 bp, Homo sapiens
actgctacagcaat

SEQ ID NO: 5833684 - DNA, 21 bp, Homo sapiens
actgctacatgtgctggaagg

SEQ ID NO: 5833685 - DNA, 16 bp, Homo sapiens
actgctaccatgaagt

SEQ ID NO: 5833686 - DNA, 19 bp, Homo sapiens
actgctactgacccagagg

SEQ ID NO: 5833687 - DNA, 22 bp, Homo sapiens
actgctactgtaattttatatg

SEQ ID NO: 5833688 - DNA, 20 bp, Homo sapiens
actgctacttgtggacctca

SEQ ID NO: 5833689 - DNA, 19 bp, Homo sapiens
actgctaggcgagtgccag

SEQ ID NO: 5833690 - DNA, 22 bp, Homo sapiens
actgctaggcgagtgccaggac

SEQ ID NO: 5833691 - DNA, 16 bp, Homo sapiens
actgctaggtgggcca

SEQ ID NO: 5833692 - DNA, 17 bp, Homo sapiens
actgctaggtgggccag

SEQ ID NO: 5833693 - DNA, 21 bp, Homo sapiens
actgctaggtgggccagcccc

SEQ ID NO: 5833694 - DNA, 15 bp, Homo sapiens
actgctagtacctgt

SEQ ID NO: 5833695 - DNA, 13 bp, Homo sapiens
actgctagtgttc

SEQ ID NO: 5833696 - DNA, 17 bp, Homo sapiens
actgctagtgttctgtc

SEQ ID NO: 5833697 - DNA, 16 bp, Homo sapiens
actgctatagcctaag

SEQ ID NO: 5833698 - DNA, 17 bp, Homo sapiens
actgctattctagagct

SEQ ID NO: 5833699 - DNA, 21 bp, Homo sapiens
actgctatttttcatcctaaa

SEQ ID NO: 5833700 - DNA, 18 bp, Homo sapiens
actgctcaagaagacatg

SEQ ID NO: 5833701 - DNA, 16 bp, Homo sapiens
actgctcaattctgtt

SEQ ID NO: 5833702 - DNA, 18 bp, Homo sapiens
actgctcacgtctctgcc

SEQ ID NO: 5833703 - DNA, 19 bp, Homo sapiens
actgctcacgtctctgccg

SEQ ID NO: 5833704 - DNA, 13 bp, Homo sapiens
actgctcagagct

SEQ ID NO: 5833705 - DNA, 16 bp, Homo sapiens
actgctcagagcttta

SEQ ID NO: 5833706 - DNA, 12 bp, Homo sapiens
actgctcaggcc

SEQ ID NO: 5833707 - DNA, 13 bp, Homo sapiens
actgctcaggcct

SEQ ID NO: 5833708 - DNA, 14 bp, Homo sapiens
actgctcaggcctc

SEQ ID NO: 5833709 - DNA, 18 bp, Homo sapiens
actgctcaggcctcacct

SEQ ID NO: 5833710 - DNA, 18 bp, Homo sapiens
actgctcaggctccccaa

SEQ ID NO: 5833711 - DNA, 15 bp, Homo sapiens
actgctcaggctgca

SEQ ID NO: 5833712 - DNA, 21 bp, Homo sapiens
actgctcaggctgcagctgga

SEQ ID NO: 5833713 - DNA, 19 bp, Homo sapiens
actgctcatcattccttga

SEQ ID NO: 5833714 - DNA, 12 bp, Homo sapiens
actgctcatttg

SEQ ID NO: 5833715 - DNA, 23 bp, Homo sapiens
actgctccaagggacaggtgggc

SEQ ID NO: 5833716 - DNA, 14 bp, Homo sapiens
actgctccagcctc

SEQ ID NO: 5833717 - DNA, 17 bp, Homo sapiens
actgctccagcctctgc

SEQ ID NO: 5833718 - DNA, 18 bp, Homo sapiens
actgctccagcctctgcc

SEQ ID NO: 5833719 - DNA, 13 bp, Homo sapiens
actgctccaggcc

SEQ ID NO: 5833720 - DNA, 14 bp, Homo sapiens
actgctccaggcct

SEQ ID NO: 5833721 - DNA, 20 bp, Homo sapiens
actgctccatttataacccc

SEQ ID NO: 5833722 - DNA, 19 bp, Homo sapiens
actgctcccatcattcctt

SEQ ID NO: 5833723 - DNA, 19 bp, Homo sapiens
actgctccccagccctggc

SEQ ID NO: 5833724 - DNA, 21 bp, Homo sapiens
actgctccctaagccagcctg

SEQ ID NO: 5833725 - DNA, 24 bp, Homo sapiens
actgctccctaccccagggccctg

SEQ ID NO: 5833726 - DNA, 20 bp, Homo sapiens
actgctccctgaagccagcc

SEQ ID NO: 5833727 - DNA, 13 bp, Homo sapiens
actgctccgtgga

SEQ ID NO: 5833728 - DNA, 15 bp, Homo sapiens
actgctcctgagccc

SEQ ID NO: 5833729 - DNA, 16 bp, Homo sapiens
actgctcctgagcccc

SEQ ID NO: 5833730 - DNA, 22 bp, Homo sapiens
actgctcctgagcccccagctt

SEQ ID NO: 5833731 - DNA, 15 bp, Homo sapiens
actgctcctgggcat

SEQ ID NO: 5833732 - DNA, 16 bp, Homo sapiens
actgctcctgtggcag

SEQ ID NO: 5833733 - DNA, 19 bp, Homo sapiens
actgctccttccatctgcc

SEQ ID NO: 5833734 - DNA, 19 bp, Homo sapiens
actgctcgtggactgtgct

SEQ ID NO: 5833735 - DNA, 18 bp, Homo sapiens
actgctctataaatagta

SEQ ID NO: 5833736 - DNA, 21 bp, Homo sapiens
actgctctcaaaatgtgaact

SEQ ID NO: 5833737 - DNA, 16 bp, Homo sapiens
actgctcttgaacatt

SEQ ID NO: 5833738 - DNA, 18 bp, Homo sapiens
actgctcttgtttctttt

SEQ ID NO: 5833739 - DNA, 22 bp, Homo sapiens
actgctctttattgcagaatgt

SEQ ID NO: 5833740 - DNA, 15 bp, Homo sapiens
actgctcttttacta

SEQ ID NO: 5833741 - DNA, 12 bp, Homo sapiens
actgctgaagat

SEQ ID NO: 5833742 - DNA, 15 bp, Homo sapiens
actgctgacccacca

SEQ ID NO: 5833743 - DNA, 18 bp, Homo sapiens
actgctgacccaccaagg

SEQ ID NO: 5833744 - DNA, 18 bp, Homo sapiens
actgctgagatacataca

SEQ ID NO: 5833745 - DNA, 16 bp, Homo sapiens
actgctgagccactcg

SEQ ID NO: 5833746 - DNA, 14 bp, Homo sapiens
actgctgagctggc

SEQ ID NO: 5833747 - DNA, 13 bp, Homo sapiens
actgctgaggaat

SEQ ID NO: 5833748 - DNA, 20 bp, Homo sapiens
actgctgaggagtctgagga

SEQ ID NO: 5833749 - DNA, 18 bp, Homo sapiens
actgctgaggtcccgggc

SEQ ID NO: 5833750 - DNA, 15 bp, Homo sapiens
actgctgatgctgaa

SEQ ID NO: 5833751 - DNA, 18 bp, Homo sapiens
actgctgatgctgaaata

SEQ ID NO: 5833752 - DNA, 16 bp, Homo sapiens
actgctgattcttgta

SEQ ID NO: 5833753 - DNA, 17 bp, Homo sapiens
actgctgattcttgtaa

SEQ ID NO: 5833754 - DNA, 19 bp, Homo sapiens
actgctgattcttgtaaat

SEQ ID NO: 5833755 - DNA, 20 bp, Homo sapiens
actgctgattcttgtaaatc

SEQ ID NO: 5833756 - DNA, 12 bp, Homo sapiens
actgctgcaaag

SEQ ID NO: 5833757 - DNA, 15 bp, Homo sapiens
actgctgcaaagtgc

SEQ ID NO: 5833758 - DNA, 21 bp, Homo sapiens
actgctgcaaagtgcaaatac

SEQ ID NO: 5833759 - DNA, 15 bp, Homo sapiens
actgctgcaaggcct

SEQ ID NO: 5833760 - DNA, 17 bp, Homo sapiens
actgctgcaaggtggcc

SEQ ID NO: 5833761 - DNA, 15 bp, Homo sapiens
actgctgcaccagag

SEQ ID NO: 5833762 - DNA, 19 bp, Homo sapiens
actgctgcatactttgaca

SEQ ID NO: 5833763 - DNA, 12 bp, Homo sapiens
actgctgccact

SEQ ID NO: 5833764 - DNA, 13 bp, Homo sapiens
actgctgccactg

SEQ ID NO: 5833765 - DNA, 14 bp, Homo sapiens
actgctgccactga

SEQ ID NO: 5833766 - DNA, 18 bp, Homo sapiens
actgctgcccagcctcca

SEQ ID NO: 5833767 - DNA, 21 bp, Homo sapiens
actgctgcccagcctccaagc

SEQ ID NO: 5833768 - DNA, 22 bp, Homo sapiens
actgctgccccaaaggaagctt

SEQ ID NO: 5833769 - DNA, 14 bp, Homo sapiens
actgctgcctcagc

SEQ ID NO: 5833770 - DNA, 15 bp, Homo sapiens
actgctgcctcagct

SEQ ID NO: 5833771 - DNA, 16 bp, Homo sapiens
actgctgcgctgtgct

SEQ ID NO: 5833772 - DNA, 17 bp, Homo sapiens
actgctgctagagccag

SEQ ID NO: 5833773 - DNA, 10 bp, Homo sapiens
actgctgctc

SEQ ID NO: 5833774 - DNA, 15 bp, Homo sapiens
actgctgctccccac

SEQ ID NO: 5833775 - DNA, 17 bp, Homo sapiens
actgctgctccccaccc

SEQ ID NO: 5833776 - DNA, 13 bp, Homo sapiens
actgctgctcctc

SEQ ID NO: 5833777 - DNA, 12 bp, Homo sapiens
actgctgctctc

SEQ ID NO: 5833778 - DNA, 14 bp, Homo sapiens
actgctgctctccc

SEQ ID NO: 5833779 - DNA, 21 bp, Homo sapiens
actgctgctgacccctgtgtg

SEQ ID NO: 5833780 - DNA, 14 bp, Homo sapiens
actgctgctgcctg

SEQ ID NO: 5833781 - DNA, 15 bp, Homo sapiens
actgctgctgcctgg

SEQ ID NO: 5833782 - DNA, 19 bp, Homo sapiens
actgctgctgcctggccac

SEQ ID NO: 5833783 - DNA, 14 bp, Homo sapiens
actgctgctgctgc

SEQ ID NO: 5833784 - DNA, 18 bp, Homo sapiens
actgctgctgctgctgcc

SEQ ID NO: 5833785 - DNA, 13 bp, Homo sapiens
actgctgctggga

SEQ ID NO: 5833786 - DNA, 12 bp, Homo sapiens
actgctgctgtg

SEQ ID NO: 5833787 - DNA, 14 bp, Homo sapiens
actgctgctgtgct

SEQ ID NO: 5833788 - DNA, 20 bp, Homo sapiens
actgctgcttaaaatgcaag

SEQ ID NO: 5833789 - DNA, 23 bp, Homo sapiens
actgctgcttcaccagacttttc

SEQ ID NO: 5833790 - DNA, 14 bp, Homo sapiens
actgctgcttctcc

SEQ ID NO: 5833791 - DNA, 12 bp, Homo sapiens
actgctggacat

SEQ ID NO: 5833792 - DNA, 19 bp, Homo sapiens
actgctggagtctggcttt

SEQ ID NO: 5833793 - DNA, 12 bp, Homo sapiens
actgctggctca

SEQ ID NO: 5833794 - DNA, 15 bp, Homo sapiens
actgctggctgcagc

SEQ ID NO: 5833795 - DNA, 17 bp, Homo sapiens
actgctgggaagtggct

SEQ ID NO: 5833796 - DNA, 13 bp, Homo sapiens
actgctgggactg

SEQ ID NO: 5833797 - DNA, 19 bp, Homo sapiens
actgctgggactggccagg

SEQ ID NO: 5833798 - DNA, 22 bp, Homo sapiens
actgctggggaggagaggactg

SEQ ID NO: 5833799 - DNA, 17 bp, Homo sapiens
actgctggggctggtga

SEQ ID NO: 5833800 - DNA, 20 bp, Homo sapiens
actgctgggggtgagctgta

SEQ ID NO: 5833801 - DNA, 18 bp, Homo sapiens
actgctgggtggcccatc

SEQ ID NO: 5833802 - DNA, 19 bp, Homo sapiens
actgctgggtggcccatcc

SEQ ID NO: 5833803 - DNA, 19 bp, Homo sapiens
actgctggtaaaataatgt

SEQ ID NO: 5833804 - DNA, 22 bp, Homo sapiens
actgctgtaaaattataaactt

SEQ ID NO: 5833805 - DNA, 13 bp, Homo sapiens
actgctgtaaagc

SEQ ID NO: 5833806 - DNA, 17 bp, Homo sapiens
actgctgtaaagcaaaa

SEQ ID NO: 5833807 - DNA, 22 bp, Homo sapiens
actgctgtaaagcaaaatattt

SEQ ID NO: 5833808 - DNA, 18 bp, Homo sapiens
actgctgtacccagatgc

SEQ ID NO: 5833809 - DNA, 12 bp, Homo sapiens
actgctgtcaat

SEQ ID NO: 5833810 - DNA, 19 bp, Homo sapiens
actgctgtcaataaatgac

SEQ ID NO: 5833811 - DNA, 16 bp, Homo sapiens
actgctgtcattgtcc

SEQ ID NO: 5833812 - DNA, 18 bp, Homo sapiens
actgctgtcattgtccat

SEQ ID NO: 5833813 - DNA, 17 bp, Homo sapiens
actgctgtcctctcccc

SEQ ID NO: 5833814 - DNA, 16 bp, Homo sapiens
actgctgtcttccaag

SEQ ID NO: 5833815 - DNA, 21 bp, Homo sapiens
actgctgtgaacatgcctcct

SEQ ID NO: 5833816 - DNA, 22 bp, Homo sapiens
actgctgtgaaccctggggcct

SEQ ID NO: 5833817 - DNA, 23 bp, Homo sapiens
actgctgtgaaccctggggcctg

SEQ ID NO: 5833818 - DNA, 16 bp, Homo sapiens
actgctgtggccagga

SEQ ID NO: 5833819 - DNA, 19 bp, Homo sapiens
actgctgtggccccctgtc

SEQ ID NO: 5833820 - DNA, 12 bp, Homo sapiens
actgctgttaaa

SEQ ID NO: 5833821 - DNA, 22 bp, Homo sapiens
actgctgttaattgattaaaat

SEQ ID NO: 5833822 - DNA, 12 bp, Homo sapiens
actgctgtttta

SEQ ID NO: 5833823 - DNA, 14 bp, Homo sapiens
actgctgttttcta

SEQ ID NO: 5833824 - DNA, 18 bp, Homo sapiens
actgcttaacttcacata

SEQ ID NO: 5833825 - DNA, 21 bp, Homo sapiens
actgcttaaggaaaagagaaa

SEQ ID NO: 5833826 - DNA, 13 bp, Homo sapiens
actgcttaattca

SEQ ID NO: 5833827 - DNA, 16 bp, Homo sapiens
actgcttaattcaaat

SEQ ID NO: 5833828 - DNA, 21 bp, Homo sapiens
actgcttacctactttcttca

SEQ ID NO: 5833829 - DNA, 23 bp, Homo sapiens
actgcttcacggactctttgctg

SEQ ID NO: 5833830 - DNA, 15 bp, Homo sapiens
actgcttcatttttg

SEQ ID NO: 5833831 - DNA, 17 bp, Homo sapiens
actgcttccagtgaggc

SEQ ID NO: 5833832 - DNA, 18 bp, Homo sapiens
actgcttccagtgaggct

SEQ ID NO: 5833833 - DNA, 21 bp, Homo sapiens
actgcttccagtgaggctctg

SEQ ID NO: 5833834 - DNA, 22 bp, Homo sapiens
actgcttccagtgaggctctgc

SEQ ID NO: 5833835 - DNA, 23 bp, Homo sapiens
actgcttccagtgaggctctgcc

SEQ ID NO: 5833836 - DNA, 15 bp, Homo sapiens
actgcttcccactgg

SEQ ID NO: 5833837 - DNA, 17 bp, Homo sapiens
actgcttcctataattt

SEQ ID NO: 5833838 - DNA, 18 bp, Homo sapiens
actgcttcctataatttt

SEQ ID NO: 5833839 - DNA, 17 bp, Homo sapiens
actgcttcctttcttga

SEQ ID NO: 5833840 - DNA, 18 bp, Homo sapiens
actgcttcctttcttgat

SEQ ID NO: 5833841 - DNA, 16 bp, Homo sapiens
actgcttctaccaact

SEQ ID NO: 5833842 - DNA, 20 bp, Homo sapiens
actgcttctaccaactggaa

SEQ ID NO: 5833843 - DNA, 22 bp, Homo sapiens
actgcttctcggaggccaggcc

SEQ ID NO: 5833844 - DNA, 17 bp, Homo sapiens
actggttctgaggccag

SEQ ID NO: 5833845 - DNA, 14 bp, Homo sapiens
actggttcttgcct

SEQ ID NO: 5833846 - DNA, 20 bp, Homo sapiens
actggttcttgccttcccct

SEQ ID NO: 5833847 - DNA, 19 bp, Homo sapiens
actggttgcatggaaatca

SEQ ID NO: 5833848 - DNA, 13 bp, Homo sapiens
actggttgtcaga

SEQ ID NO: 5833849 - DNA, 16 bp, Homo sapiens
actggttgtcagaatg

SEQ ID NO: 5833850 - DNA, 21 bp, Homo sapiens
actggttgtcagaatggaatc

SEQ ID NO: 5833851 - DNA, 14 bp, Homo sapiens
actggtttacaaat

SEQ ID NO: 5833852 - DNA, 17 bp, Homo sapiens
actggtttacaaatata

SEQ ID NO: 5833853 - DNA, 18 bp, Homo sapiens
actggtttataataaact

SEQ ID NO: 5833854 - DNA, 22 bp, Homo sapiens
actggtttatccacccacaaca

SEQ ID NO: 5833855 - DNA, 13 bp, Homo sapiens
actggtttcaaga

SEQ ID NO: 5833856 - DNA, 17 bp, Homo sapiens
actggtttctcctggta

SEQ ID NO: 5833857 - DNA, 19 bp, Homo sapiens
actggtttgaaatttttga

SEQ ID NO: 5833858 - DNA, 17 bp, Homo sapiens
actggtttgaagaatgt

SEQ ID NO: 5833859 - DNA, 22 bp, Homo sapiens
actggtttgtatgatgtattag

SEQ ID NO: 5833860 - DNA, 22 bp, Homo sapiens
actggtttgttgcagccaaaga

SEQ ID NO: 5833861 - DNA, 12 bp, Homo sapiens
actggtttgttt

SEQ ID NO: 5833862 - DNA, 14 bp, Homo sapiens
actggtttgtttct

SEQ ID NO: 5833863 - DNA, 17 bp, Homo sapiens
actggttttaagtgctt

SEQ ID NO: 5833864 - DNA, 19 bp, Homo sapiens
actggttttacacagagaa

SEQ ID NO: 5833865 - DNA, 20 bp, Homo sapiens
actggttttacacagagaaa

SEQ ID NO: 5833866 - DNA, 15 bp, Homo sapiens
actggttttacttac

SEQ ID NO: 5833867 - DNA, 21 bp, Homo sapiens
actggttttacttacaaaaat

SEQ ID NO: 5833868 - DNA, 14 bp, Homo sapiens
actggttttcacat

SEQ ID NO: 5833869 - DNA, 14 bp, Homo sapiens
actggttttctgcc

SEQ ID NO: 5833870 - DNA, 19 bp, Homo sapiens
actggttttctgccaatga

SEQ ID NO: 5833871 - DNA, 22 bp, Homo sapiens
actggtttttctgttccctgct

SEQ ID NO: 5833872 - DNA, 18 bp, Homo sapiens
actgtaaaagtgtacaga

SEQ ID NO: 5833873 - DNA, 22 bp, Homo sapiens
actgtaaaagtgtacagactct

SEQ ID NO: 5833874 - DNA, 13 bp, Homo sapiens
actgtaaaagtta

SEQ ID NO: 5833875 - DNA, 17 bp, Homo sapiens
actgtaaaatagttttg

SEQ ID NO: 5833876 - DNA, 23 bp, Homo sapiens
actgtaaaatagttttgctttgt

SEQ ID NO: 5833877 - DNA, 12 bp, Homo sapiens
actgtaaaatgc

SEQ ID NO: 5833878 - DNA, 19 bp, Homo sapiens
actgtaaaatgcaaaaaat

SEQ ID NO: 5833879 - DNA, 24 bp, Homo sapiens
actgtaaaatgcaaaaaatcttaa

SEQ ID NO: 5833880 - DNA, 16 bp, Homo sapiens
actgtaaaatgtggga

SEQ ID NO: 5833881 - DNA, 13 bp, Homo sapiens
actgtaaacacag

SEQ ID NO: 5833882 - DNA, 14 bp, Homo sapiens
actgtaaacacaga

SEQ ID NO: 5833883 - DNA, 16 bp, Homo sapiens
actgtaaagaaagaga

SEQ ID NO: 5833884 - DNA, 21 bp, Homo sapiens
actgtaaagaaagagagaaaa

SEQ ID NO: 5833885 - DNA, 22 bp, Homo sapiens
actgtaaagaaagagagaaaat

SEQ ID NO: 5833886 - DNA, 18 bp, Homo sapiens
actgtaaagacaaataaa

SEQ ID NO: 5833887 - DNA, 13 bp, Homo sapiens
actgtaaagatgt

SEQ ID NO: 5833888 - DNA, 14 bp, Homo sapiens
actgtaaagcaaat

SEQ ID NO: 5833889 - DNA, 23 bp, Homo sapiens
actgtaaaggcaagccagcatgt

SEQ ID NO: 5833890 - DNA, 23 bp, Homo sapiens
actgtaaataaaatgtgtacagt

SEQ ID NO: 5833891 - DNA, 17 bp, Homo sapiens
actgtaaatacaaaata

SEQ ID NO: 5833892 - DNA, 13 bp, Homo sapiens
actgtaaatatcc

SEQ ID NO: 5833893 - DNA, 19 bp, Homo sapiens
actgtaaatatccacagac

SEQ ID NO: 5833894 - DNA, 12 bp, Homo sapiens
actgtaaatcac

SEQ ID NO: 5833895 - DNA, 14 bp, Homo sapiens
actgtaaatcactt

SEQ ID NO: 5833896 - DNA, 15 bp, Homo sapiens
actgtaaatcacttg

SEQ ID NO: 5833897 - DNA, 17 bp, Homo sapiens
actgtaaatcacttgta

SEQ ID NO: 5833898 - DNA, 19 bp, Homo sapiens
actgtaaatcacttgtaaa

SEQ ID NO: 5833899 - DNA, 21 bp, Homo sapiens
actgtaaatcacttgtaaata

SEQ ID NO: 5833900 - DNA, 22 bp, Homo sapiens
actgtaaatcacttgtaaataa

SEQ ID NO: 5833901 - DNA, 16 bp, Homo sapiens
actgtaaatgccttgc

SEQ ID NO: 5833902 - DNA, 14 bp, Homo sapiens
actgtaacatttac

SEQ ID NO: 5833903 - DNA, 13 bp, Homo sapiens
actgtaacctgat

SEQ ID NO: 5833904 - DNA, 13 bp, Homo sapiens
actgtaactgcat

SEQ ID NO: 5833905 - DNA, 14 bp, Homo sapiens
actgtaactgctca

SEQ ID NO: 5833906 - DNA, 22 bp, Homo sapiens
actgtaactgctcagagcttta

SEQ ID NO: 5833907 - DNA, 17 bp, Homo sapiens
actgtaacttttttaaa

SEQ ID NO: 5833908 - DNA, 18 bp, Homo sapiens
actgtaagaaatgtatat

SEQ ID NO: 5833909 - DNA, 15 bp, Homo sapiens
actgtaagaataatt

SEQ ID NO: 5833910 - DNA, 19 bp, Homo sapiens
actgtaagaataatttata

SEQ ID NO: 5833911 - DNA, 23 bp, Homo sapiens
actgtaagaataatttatagtaa

SEQ ID NO: 5833912 - DNA, 13 bp, Homo sapiens
actgtaagacatt

SEQ ID NO: 5833913 - DNA, 17 bp, Homo sapiens
actgtaagagacatgaa

SEQ ID NO: 5833914 - DNA, 12 bp, Homo sapiens
actgtaagatgt

SEQ ID NO: 5833915 - DNA, 23 bp, Homo sapiens
actgtaagcagattacaataaat

SEQ ID NO: 5833916 - DNA, 12 bp, Homo sapiens
actgtaagcttt

SEQ ID NO: 5833917 - DNA, 18 bp, Homo sapiens
actgtaaggaagagggac

SEQ ID NO: 5833918 - DNA, 19 bp, Homo sapiens
actgtaaggtgcttgctcc

SEQ ID NO: 5833919 - DNA, 16 bp, Homo sapiens
actgtaagttgggctt

SEQ ID NO: 5833920 - DNA, 14 bp, Homo sapiens
actgtaagtttatt

SEQ ID NO: 5833921 - DNA, 13 bp, Homo sapiens
actgtaataatac

SEQ ID NO: 5833922 - DNA, 17 bp, Homo sapiens
actgtaataatacctca

SEQ ID NO: 5833923 - DNA, 18 bp, Homo sapiens
actgtaataatacctcaa

SEQ ID NO: 5833924 - DNA, 21 bp, Homo sapiens
actgtaatacgtagctctctt

SEQ ID NO: 5833925 - DNA, 18 bp, Homo sapiens
actgtaatacttctttgt

SEQ ID NO: 5833926 - DNA, 20 bp, Homo sapiens
actgtaatacttctttgtta

SEQ ID NO: 5833927 - DNA, 17 bp, Homo sapiens
actgtaatcaaaaggag

SEQ ID NO: 5833928 - DNA, 18 bp, Homo sapiens
actgtaatcttaaaagtg

SEQ ID NO: 5833929 - DNA, 15 bp, Homo sapiens
actgtaatgctgcct

SEQ ID NO: 5833930 - DNA, 15 bp, Homo sapiens
actgtaatgtgtact

SEQ ID NO: 5833931 - DNA, 16 bp, Homo sapiens
actgtaattaaaacta

SEQ ID NO: 5833932 - DNA, 19 bp, Homo sapiens
actgtaattaagtgcaatt

SEQ ID NO: 5833933 - DNA, 18 bp, Homo sapiens
actgtaattatttgaatg

SEQ ID NO: 5833934 - DNA, 20 bp, Homo sapiens
actgtaattatttgaatgac

SEQ ID NO: 5833935 - DNA, 15 bp, Homo sapiens
actgtaattggtgac

SEQ ID NO: 5833936 - DNA, 12 bp, Homo sapiens
actgtaatttag

SEQ ID NO: 5833937 - DNA, 17 bp, Homo sapiens
actgtaatttctttgag

SEQ ID NO: 5833938 - DNA, 13 bp, Homo sapiens
actgtaattttgt

SEQ ID NO: 5833939 - DNA, 18 bp, Homo sapiens
actgtaattttgtttgta

SEQ ID NO: 5833940 - DNA, 22 bp, Homo sapiens
actgtaattttgtttgtaatcc

SEQ ID NO: 5833941 - DNA, 22 bp, Homo sapiens
actgtacaaaaaaatcttccaa

SEQ ID NO: 5833942 - DNA, 14 bp, Homo sapiens
actgtacaaagtag

SEQ ID NO: 5833943 - DNA, 15 bp, Homo sapiens
actgtacaaagtaga

SEQ ID NO: 5833944 - DNA, 15 bp, Homo sapiens
actgtacaaatgaaa

SEQ ID NO: 5833945 - DNA, 13 bp, Homo sapiens
actgtacaataag

SEQ ID NO: 5833946 - DNA, 23 bp, Homo sapiens
actgtacacactttatttacttc

SEQ ID NO: 5833947 - DNA, 12 bp, Homo sapiens
actgtacagggg

SEQ ID NO: 5833948 - DNA, 11 bp, Homo sapiens
actgtacagtg

SEQ ID NO: 5833949 - DNA, 12 bp, Homo sapiens
actgtacagtgt

SEQ ID NO: 5833950 - DNA, 16 bp, Homo sapiens
actgtacagtgtcttt

SEQ ID NO: 5833951 - DNA, 17 bp, Homo sapiens
actgtacagtgtctttt

SEQ ID NO: 5833952 - DNA, 12 bp, Homo sapiens
actgtacagttt

SEQ ID NO: 5833953 - DNA, 18 bp, Homo sapiens
actgtacataaattccag

SEQ ID NO: 5833954 - DNA, 16 bp, Homo sapiens
actgtacatactgcag

SEQ ID NO: 5833955 - DNA, 17 bp, Homo sapiens
actgtacatagatgtat

SEQ ID NO: 5833956 - DNA, 14 bp, Homo sapiens
actgtacatgaaaa

SEQ ID NO: 5833957 - DNA, 21 bp, Homo sapiens
actgtacatgaaaacacattt

SEQ ID NO: 5833958 - DNA, 23 bp, Homo sapiens
actgtacatgaaaacacattttt

SEQ ID NO: 5833959 - DNA, 14 bp, Homo sapiens
actgtacattatga

SEQ ID NO: 5833960 - DNA, 17 bp, Homo sapiens
actgtacattatgaaga

SEQ ID NO: 5833961 - DNA, 14 bp, Homo sapiens
actgtacattgtga

SEQ ID NO: 5833962 - DNA, 15 bp, Homo sapiens
actgtacattgtgag

SEQ ID NO: 5833963 - DNA, 19 bp, Homo sapiens
actgtacattgtgagctct

SEQ ID NO: 5833964 - DNA, 22 bp, Homo sapiens
actgtacatttaaaattgctat

SEQ ID NO: 5833965 - DNA, 19 bp, Homo sapiens
actgtaccatatagcaaaa

SEQ ID NO: 5833966 - DNA, 19 bp, Homo sapiens
actgtaccatggtttgata

SEQ ID NO: 5833967 - DNA, 20 bp, Homo sapiens
actgtacctgtaggaaacag

SEQ ID NO: 5833968 - DNA, 22 bp, Homo sapiens
actgtacctgtaggaaacagaa

SEQ ID NO: 5833969 - DNA, 13 bp, Homo sapiens
actgtactcctcc

SEQ ID NO: 5833970 - DNA, 17 bp, Homo sapiens
actgtactgatactatt

SEQ ID NO: 5833971 - DNA, 23 bp, Homo sapiens
actgtactgatactattcaatgc

SEQ ID NO: 5833972 - DNA, 16 bp, Homo sapiens
actgtactgcatgtga

SEQ ID NO: 5833973 - DNA, 12 bp, Homo sapiens
actgtactggcc

SEQ ID NO: 5833974 - DNA, 18 bp, Homo sapiens
actgtactggccagtgtc

SEQ ID NO: 5833975 - DNA, 17 bp, Homo sapiens
actgtacttaataaatt

SEQ ID NO: 5833976 - DNA, 14 bp, Homo sapiens
actgtacttcccaa

SEQ ID NO: 5833977 - DNA, 23 bp, Homo sapiens
actgtacttgctcttgatgcctg

SEQ ID NO: 5833978 - DNA, 16 bp, Homo sapiens
actgtactttgattca

SEQ ID NO: 5833979 - DNA, 23 bp, Homo sapiens
actgtactttgattcacatgttt

SEQ ID NO: 5833980 - DNA, 16 bp, Homo sapiens
actgtactttgccatt

SEQ ID NO: 5833981 - DNA, 23 bp, Homo sapiens
actgtagaaaagggaactgaaca

SEQ ID NO: 5833982 - DNA, 17 bp, Homo sapiens
actgtagaaaggaaata

SEQ ID NO: 5833983 - DNA, 15 bp, Homo sapiens
actgtagaaatgatg

SEQ ID NO: 5833984 - DNA, 18 bp, Homo sapiens
actgtagaactgatttta

SEQ ID NO: 5833985 - DNA, 21 bp, Homo sapiens
actgtagaaggtgagaggcga

SEQ ID NO: 5833986 - DNA, 18 bp, Homo sapiens
actgtagaatgatttcat

SEQ ID NO: 5833987 - DNA, 14 bp, Homo sapiens
actgtagacactct

SEQ ID NO: 5833988 - DNA, 18 bp, Homo sapiens
actgtagacactctgaca

SEQ ID NO: 5833989 - DNA, 18 bp, Homo sapiens
actgtagattgcttctgt

SEQ ID NO: 5833990 - DNA, 17 bp, Homo sapiens
actgtagcaatatattt

SEQ ID NO: 5833991 - DNA, 19 bp, Homo sapiens
actgtagcaatatatttgt

SEQ ID NO: 5833992 - DNA, 22 bp, Homo sapiens
actgtagcacggagtgttgggg

SEQ ID NO: 5833993 - DNA, 21 bp, Homo sapiens
actgtagcctgcgtcatggct

SEQ ID NO: 5833994 - DNA, 17 bp, Homo sapiens
actgtagcctggatatt

SEQ ID NO: 5833995 - DNA, 16 bp, Homo sapiens
actgtagcgaccccag

SEQ ID NO: 5833996 - DNA, 21 bp, Homo sapiens
actgtagctattagcggctcc

SEQ ID NO: 5833997 - DNA, 18 bp, Homo sapiens
actgtaggactatataaa

SEQ ID NO: 5833998 - DNA, 19 bp, Homo sapiens
actgtaggactatataaag

SEQ ID NO: 5833999 - DNA, 20 bp, Homo sapiens
actgtaggactatataaagt

SEQ ID NO: 5834000 - DNA, 15 bp, Homo sapiens
actgtaggattcaag

SEQ ID NO: 5834001 - DNA, 21 bp, Homo sapiens
actgtaggcagggaaccttaa

SEQ ID NO: 5834002 - DNA, 18 bp, Homo sapiens
actgtaggttatttaaaa

SEQ ID NO: 5834003 - DNA, 16 bp, Homo sapiens
actgtagtaaataatg

SEQ ID NO: 5834004 - DNA, 20 bp, Homo sapiens
actgtagtaaataatgcttt

SEQ ID NO: 5834005 - DNA, 20 bp, Homo sapiens
actgtagtgtagtcaggtgc

SEQ ID NO: 5834006 - DNA, 13 bp, Homo sapiens
actgtagtttaat

SEQ ID NO: 5834007 - DNA, 20 bp, Homo sapiens
actgtagtttaatacttttt

SEQ ID NO: 5834008 - DNA, 21 bp, Homo sapiens
actgtagtttagttctgttga

SEQ ID NO: 5834009 - DNA, 22 bp, Homo sapiens
actgtagtttttgaaaattatg

SEQ ID NO: 5834010 - DNA, 22 bp, Homo sapiens
actgtagtttttgttcaccttc

SEQ ID NO: 5834011 - DNA, 12 bp, Homo sapiens
actgtataaata

SEQ ID NO: 5834012 - DNA, 13 bp, Homo sapiens
actgtataaatag

SEQ ID NO: 5834013 - DNA, 14 bp, Homo sapiens
actgtataaatagg

SEQ ID NO: 5834014 - DNA, 17 bp, Homo sapiens
actgtataaataggaga

SEQ ID NO: 5834015 - DNA, 23 bp, Homo sapiens
actgtataaataggagaggatga

SEQ ID NO: 5834016 - DNA, 19 bp, Homo sapiens
actgtataacattaagaaa

SEQ ID NO: 5834017 - DNA, 22 bp, Homo sapiens
actgtataagtactagatgcat

SEQ ID NO: 5834018 - DNA, 19 bp, Homo sapiens
actgtataccgatcaggaa

SEQ ID NO: 5834019 - DNA, 18 bp, Homo sapiens
actgtataccgtgtgctc

SEQ ID NO: 5834020 - DNA, 20 bp, Homo sapiens
actgtatagctcttttccta

SEQ ID NO: 5834021 - DNA, 12 bp, Homo sapiens
actgtatagtaa

SEQ ID NO: 5834022 - DNA, 17 bp, Homo sapiens
actgtgtacacctcaaa

SEQ ID NO: 5834023 - DNA, 18 bp, Homo sapiens
actgtgtacataactgaa

SEQ ID NO: 5834024 - DNA, 14 bp, Homo sapiens
actgtgtacataat

SEQ ID NO: 5834025 - DNA, 19 bp, Homo sapiens
actgtgtactggagcctgc

SEQ ID NO: 5834026 - DNA, 12 bp, Homo sapiens
actgtgtataga

SEQ ID NO: 5834027 - DNA, 19 bp, Homo sapiens
actgtgtataggaatttgt

SEQ ID NO: 5834028 - DNA, 20 bp, Homo sapiens
actgtgtatcattaaaatat

SEQ ID NO: 5834029 - DNA, 20 bp, Homo sapiens
actgtgtatgttttatatca

SEQ ID NO: 5834030 - DNA, 15 bp, Homo sapiens
actgtgtattccaag

SEQ ID NO: 5834031 - DNA, 16 bp, Homo sapiens
actgtgtattccaaga

SEQ ID NO: 5834032 - DNA, 23 bp, Homo sapiens
actgtgtatttatttaaaactct

SEQ ID NO: 5834033 - DNA, 21 bp, Homo sapiens
actgtgtccaggtggtacttt

SEQ ID NO: 5834034 - DNA, 22 bp, Homo sapiens
actgtgtcccagtgtctggccc

SEQ ID NO: 5834035 - DNA, 16 bp, Homo sapiens
actgtgtcctggtgct

SEQ ID NO: 5834036 - DNA, 21 bp, Homo sapiens
actgtgtcctggtgctctctg

SEQ ID NO: 5834037 - DNA, 12 bp, Homo sapiens
actgtgtctcta

SEQ ID NO: 5834038 - DNA, 13 bp, Homo sapiens
actgtgtctctat

SEQ ID NO: 5834039 - DNA, 17 bp, Homo sapiens
actgtgtctctatgtga

SEQ ID NO: 5834040 - DNA, 18 bp, Homo sapiens
actgtgtctctatgtgaa

SEQ ID NO: 5834041 - DNA, 13 bp, Homo sapiens
actgtgtctctgt

SEQ ID NO: 5834042 - DNA, 19 bp, Homo sapiens
actgtgtctggcgttctca

SEQ ID NO: 5834043 - DNA, 23 bp, Homo sapiens
actgtgtctggcgttctcaagaa

SEQ ID NO: 5834044 - DNA, 14 bp, Homo sapiens
actgtgtgagaggg

SEQ ID NO: 5834045 - DNA, 21 bp, Homo sapiens
actgtgtgaggctgtgtctct

SEQ ID NO: 5834046 - DNA, 22 bp, Homo sapiens
actgtgtgaggctgtgtctctg

SEQ ID NO: 5834047 - DNA, 20 bp, Homo sapiens
actgtgtgctcaggagccct

SEQ ID NO: 5834048 - DNA, 21 bp, Homo sapiens
actgtgtggccctggacaagc

SEQ ID NO: 5834049 - DNA, 18 bp, Homo sapiens
actgtgtgtgccctctgg

SEQ ID NO: 5834050 - DNA, 20 bp, Homo sapiens
actgtgtgtgtcctacacaa

SEQ ID NO: 5834051 - DNA, 22 bp, Homo sapiens
actgtgtgtgtcctacacaatg

SEQ ID NO: 5834052 - DNA, 22 bp, Homo sapiens
actgtgtgtgtgaatgaacact

SEQ ID NO: 5834053 - DNA, 18 bp, Homo sapiens
actgtgtgttgacactgt

SEQ ID NO: 5834054 - DNA, 21 bp, Homo sapiens
actgtgtgttgacactgtttt

SEQ ID NO: 5834055 - DNA, 22 bp, Homo sapiens
actgtgtgttgccacaggacac

SEQ ID NO: 5834056 - DNA, 18 bp, Homo sapiens
actgtgtgttgtgaaata

SEQ ID NO: 5834057 - DNA, 19 bp, Homo sapiens
actgtgtgttgtgaaataa

SEQ ID NO: 5834058 - DNA, 22 bp, Homo sapiens
actgtgtgtttgggaaggtggg

SEQ ID NO: 5834059 - DNA, 15 bp, Homo sapiens
actgtgttacatgtt

SEQ ID NO: 5834060 - DNA, 19 bp, Homo sapiens
actgtgttacatgttgtat

SEQ ID NO: 5834061 - DNA, 16 bp, Homo sapiens
actgtgttatgcaaaa

SEQ ID NO: 5834062 - DNA, 15 bp, Homo sapiens
actgtgttcagtgcc

SEQ ID NO: 5834063 - DNA, 14 bp, Homo sapiens
actgtgttcattag

SEQ ID NO: 5834064 - DNA, 15 bp, Homo sapiens
actgtgttcctggca

SEQ ID NO: 5834065 - DNA, 12 bp, Homo sapiens
actgtgttcctt

SEQ ID NO: 5834066 - DNA, 14 bp, Homo sapiens
actgtgttccttcc

SEQ ID NO: 5834067 - DNA, 21 bp, Homo sapiens
actgtgttgggcaagacctct

SEQ ID NO: 5834068 - DNA, 20 bp, Homo sapiens
actgtgttgtattaacaaaa

SEQ ID NO: 5834069 - DNA, 19 bp, Homo sapiens
actgtgtttaatagtatat

SEQ ID NO: 5834070 - DNA, 21 bp, Homo sapiens
actgtgtttaatagtatatct

SEQ ID NO: 5834071 - DNA, 18 bp, Homo sapiens
actgtgtttcaaatggac

SEQ ID NO: 5834072 - DNA, 15 bp, Homo sapiens
actgtgtttcaagtt

SEQ ID NO: 5834073 - DNA, 18 bp, Homo sapiens
actgtgtttcaagttcaa

SEQ ID NO: 5834074 - DNA, 20 bp, Homo sapiens
actgtgtttccaaaggttcc

SEQ ID NO: 5834075 - DNA, 17 bp, Homo sapiens
actgtgtttcgtgaact

SEQ ID NO: 5834076 - DNA, 19 bp, Homo sapiens
actgtgtttcgtgaactgc

SEQ ID NO: 5834077 - DNA, 12 bp, Homo sapiens
actgtgtttcta

SEQ ID NO: 5834078 - DNA, 17 bp, Homo sapiens
actgtgtttctgtgctc

SEQ ID NO: 5834079 - DNA, 14 bp, Homo sapiens
actgtgtttttgcc

SEQ ID NO: 5834080 - DNA, 15 bp, Homo sapiens
actgttaaaactgta

SEQ ID NO: 5834081 - DNA, 21 bp, Homo sapiens
actgttaaaactgtacctttt

SEQ ID NO: 5834082 - DNA, 16 bp, Homo sapiens
actgttaaaggaaaaa

SEQ ID NO: 5834083 - DNA, 21 bp, Homo sapiens
actgttaaccaaattttgagc

SEQ ID NO: 5834084 - DNA, 19 bp, Homo sapiens
actgttaacccagtgttca

SEQ ID NO: 5834085 - DNA, 14 bp, Homo sapiens
actgttaagaagca

SEQ ID NO: 5834086 - DNA, 15 bp, Homo sapiens
actgttaagaataat

SEQ ID NO: 5834087 - DNA, 22 bp, Homo sapiens
actgttaatagtactattaaca

SEQ ID NO: 5834088 - DNA, 12 bp, Homo sapiens
actgttacagac

SEQ ID NO: 5834089 - DNA, 14 bp, Homo sapiens
actgttacagactg

SEQ ID NO: 5834090 - DNA, 12 bp, Homo sapiens
actgttacagta

SEQ ID NO: 5834091 - DNA, 19 bp, Homo sapiens
actgttaccattggaaatt

SEQ ID NO: 5834092 - DNA, 16 bp, Homo sapiens
actgttactccacagc

SEQ ID NO: 5834093 - DNA, 18 bp, Homo sapiens
actgttactctaaataga

SEQ ID NO: 5834094 - DNA, 13 bp, Homo sapiens
actgttactttgg

SEQ ID NO: 5834095 - DNA, 17 bp, Homo sapiens
actgttactttttagtc

SEQ ID NO: 5834096 - DNA, 20 bp, Homo sapiens
actgttactttttagtcttt

SEQ ID NO: 5834097 - DNA, 22 bp, Homo sapiens
actgttactttttagtctttta

SEQ ID NO: 5834098 - DNA, 20 bp, Homo sapiens
actgttagaaaatggacact

SEQ ID NO: 5834099 - DNA, 23 bp, Homo sapiens
actgttagaacactattttcaga

SEQ ID NO: 5834100 - DNA, 15 bp, Homo sapiens
actgttagaatgtaa

SEQ ID NO: 5834101 - DNA, 18 bp, Homo sapiens
actgttagaattctttta

SEQ ID NO: 5834102 - DNA, 13 bp, Homo sapiens
actgttagcactg

SEQ ID NO: 5834103 - DNA, 14 bp, Homo sapiens
actgttagcactgt

SEQ ID NO: 5834104 - DNA, 15 bp, Homo sapiens
actgttagcactgtt

SEQ ID NO: 5834105 - DNA, 20 bp, Homo sapiens
actgttagcttttaccttaa

SEQ ID NO: 5834106 - DNA, 21 bp, Homo sapiens
actgttatcagtaatgctaaa

SEQ ID NO: 5834107 - DNA, 13 bp, Homo sapiens
actgttatcattt

SEQ ID NO: 5834108 - DNA, 17 bp, Homo sapiens
actgttatgtgagaaca

SEQ ID NO: 5834109 - DNA, 16 bp, Homo sapiens
actgttattctttgca

SEQ ID NO: 5834110 - DNA, 18 bp, Homo sapiens
actgttattctttgcact

SEQ ID NO: 5834111 - DNA, 19 bp, Homo sapiens
actgttattctttgcactt

SEQ ID NO: 5834112 - DNA, 15 bp, Homo sapiens
actgttatttaattg

SEQ ID NO: 5834113 - DNA, 14 bp, Homo sapiens
actgttatttataa

SEQ ID NO: 5834114 - DNA, 17 bp, Homo sapiens
actgttatttataatca

SEQ ID NO: 5834115 - DNA, 19 bp, Homo sapiens
actgttattttcagcatga

SEQ ID NO: 5834116 - DNA, 14 bp, Homo sapiens
actgttcaagcaaa

SEQ ID NO: 5834117 - DNA, 15 bp, Homo sapiens
actgttcaagcaaaa

SEQ ID NO: 5834118 - DNA, 12 bp, Homo sapiens
actgttcaagtg

SEQ ID NO: 5834119 - DNA, 16 bp, Homo sapiens
actgttcaagtgtccc

SEQ ID NO: 5834120 - DNA, 19 bp, Homo sapiens
actgttcaagtgtccccag

SEQ ID NO: 5834121 - DNA, 22 bp, Homo sapiens
actgttcaatgattatttgtat

SEQ ID NO: 5834122 - DNA, 23 bp, Homo sapiens
actgttcaatggttctgaaataa

SEQ ID NO: 5834123 - DNA, 12 bp, Homo sapiens
actgttcaattt

SEQ ID NO: 5834124 - DNA, 18 bp, Homo sapiens
actgttcacgttgggtgg

SEQ ID NO: 5834125 - DNA, 16 bp, Homo sapiens
actgttcagcggagct

SEQ ID NO: 5834126 - DNA, 17 bp, Homo sapiens
actgttcagcttttatt

SEQ ID NO: 5834127 - DNA, 14 bp, Homo sapiens
actgttcagtattg

SEQ ID NO: 5834128 - DNA, 15 bp, Homo sapiens
actgttcatttccac

SEQ ID NO: 5834129 - DNA, 14 bp, Homo sapiens
actgttccaaagcc

SEQ ID NO: 5834130 - DNA, 20 bp, Homo sapiens
actgttccaaagccagtgaa

SEQ ID NO: 5834131 - DNA, 17 bp, Homo sapiens
actgttccagattccta

SEQ ID NO: 5834132 - DNA, 18 bp, Homo sapiens
actgttccagattcctat

SEQ ID NO: 5834133 - DNA, 19 bp, Homo sapiens
actgttccaggccctccag

SEQ ID NO: 5834134 - DNA, 15 bp, Homo sapiens
actgttccccctgtg

SEQ ID NO: 5834135 - DNA, 15 bp, Homo sapiens
actgttccctctgct

SEQ ID NO: 5834136 - DNA, 16 bp, Homo sapiens
actgttccctctggct

SEQ ID NO: 5834137 - DNA, 16 bp, Homo sapiens
actgttcctttcagat

SEQ ID NO: 5834138 - DNA, 13 bp, Homo sapiens
actgttctaaagc

SEQ ID NO: 5834139 - DNA, 12 bp, Homo sapiens
actgttctaact

SEQ ID NO: 5834140 - DNA, 22 bp, Homo sapiens
actgttctaactagtaatcttg

SEQ ID NO: 5834141 - DNA, 18 bp, Homo sapiens
actgttctcccttcggtg

SEQ ID NO: 5834142 - DNA, 14 bp, Homo sapiens
actgttctctgccc

SEQ ID NO: 5834143 - DNA, 17 bp, Homo sapiens
actgttctctgccctcc

SEQ ID NO: 5834144 - DNA, 18 bp, Homo sapiens
actgttctctgccctcca

SEQ ID NO: 5834145 - DNA, 19 bp, Homo sapiens
actgttctctgccctccaa

SEQ ID NO: 5834146 - DNA, 21 bp, Homo sapiens
actgttctctgccctccaaga

SEQ ID NO: 5834147 - DNA, 14 bp, Homo sapiens
actgttctgaaatt

SEQ ID NO: 5834148 - DNA, 12 bp, Homo sapiens
actgttctgcaa

SEQ ID NO: 5834149 - DNA, 20 bp, Homo sapiens
actgttctggcctcagacca

SEQ ID NO: 5834150 - DNA, 20 bp, Homo sapiens
actgttctgggactccaggt

SEQ ID NO: 5834151 - DNA, 23 bp, Homo sapiens
actgttctgtgtgggtctgggga

SEQ ID NO: 5834152 - DNA, 20 bp, Homo sapiens
actgttcttagctcaatgag

SEQ ID NO: 5834153 - DNA, 23 bp, Homo sapiens
actgttcttagctcaatgagcat

SEQ ID NO: 5834154 - DNA, 13 bp, Homo sapiens
actgttcttgaat

SEQ ID NO: 5834155 - DNA, 11 bp, Homo sapiens
actgttcttgc

SEQ ID NO: 5834156 - DNA, 12 bp, Homo sapiens
actgttcttgct

SEQ ID NO: 5834157 - DNA, 15 bp, Homo sapiens
actgttctttccagg

SEQ ID NO: 5834158 - DNA, 14 bp, Homo sapiens
actgttctttgctg

SEQ ID NO: 5834159 - DNA, 13 bp, Homo sapiens
actgttcttttgc

SEQ ID NO: 5834160 - DNA, 9 bp, Homo sapiens
actgttgaa

SEQ ID NO: 5834161 - DNA, 14 bp, Homo sapiens
actgttgaaaaaga

SEQ ID NO: 5834162 - DNA, 21 bp, Homo sapiens
actgttgaaaaagataaagag

SEQ ID NO: 5834163 - DNA, 13 bp, Homo sapiens
actgttgaaaatt

SEQ ID NO: 5834164 - DNA, 16 bp, Homo sapiens
actgttgacatacaaa

SEQ ID NO: 5834165 - DNA, 20 bp, Homo sapiens
actgttgagccccagtgctg

SEQ ID NO: 5834166 - DNA, 12 bp, Homo sapiens
actgttgagtta

SEQ ID NO: 5834167 - DNA, 14 bp, Homo sapiens
actgttgagttctg

SEQ ID NO: 5834168 - DNA, 14 bp, Homo sapiens
actgttgatacaaa

SEQ ID NO: 5834169 - DNA, 19 bp, Homo sapiens
actgttgatccatctcagt

SEQ ID NO: 5834170 - DNA, 15 bp, Homo sapiens
actgttgatgtactg

SEQ ID NO: 5834171 - DNA, 15 bp, Homo sapiens
actgttgcacagcca

SEQ ID NO: 5834172 - DNA, 22 bp, Homo sapiens
actgttgcacagccagaagggg

SEQ ID NO: 5834173 - DNA, 13 bp, Homo sapiens
actgttgcacgtg

SEQ ID NO: 5834174 - DNA, 18 bp, Homo sapiens
actgttgcacgtgtgttt

SEQ ID NO: 5834175 - DNA, 17 bp, Homo sapiens
actgttgcacttttgaa

SEQ ID NO: 5834176 - DNA, 15 bp, Homo sapiens
actgttgcatagaat

SEQ ID NO: 5834177 - DNA, 18 bp, Homo sapiens
actgttgcatttactttt

SEQ ID NO: 5834178 - DNA, 17 bp, Homo sapiens
actgttgcccaggctgg

SEQ ID NO: 5834179 - DNA, 18 bp, Homo sapiens
actgttgcccaggctggc

SEQ ID NO: 5834180 - DNA, 16 bp, Homo sapiens
actgttgccccccagg

SEQ ID NO: 5834181 - DNA, 21 bp, Homo sapiens
actgttgccccccagggtcct

SEQ ID NO: 5834182 - DNA, 21 bp, Homo sapiens
actgttgcctttgctcttata

SEQ ID NO: 5834183 - DNA, 16 bp, Homo sapiens
actgttgccttttaaa

SEQ ID NO: 5834184 - DNA, 15 bp, Homo sapiens
actgttgctttgaaa

SEQ ID NO: 5834185 - DNA, 15 bp, Homo sapiens
actgttggaagttca

SEQ ID NO: 5834186 - DNA, 12 bp, Homo sapiens
actgttggaatg

SEQ ID NO: 5834187 - DNA, 13 bp, Homo sapiens
actgttggagccc

SEQ ID NO: 5834188 - DNA, 21 bp, Homo sapiens
actgttggggtgggtataaaa

SEQ ID NO: 5834189 - DNA, 23 bp, Homo sapiens
actgttggttcatccagaagtgt

SEQ ID NO: 5834190 - DNA, 20 bp, Homo sapiens
actgttgtaactaggctcag

SEQ ID NO: 5834191 - DNA, 20 bp, Homo sapiens
actgttgtagaaattcttaa

SEQ ID NO: 5834192 - DNA, 21 bp, Homo sapiens
actgttgtagcattttcctgt

SEQ ID NO: 5834193 - DNA, 23 bp, Homo sapiens
actgttgtagcattttcctgttt

SEQ ID NO: 5834194 - DNA, 24 bp, Homo sapiens
actgttgtagcattttcctgttta

SEQ ID NO: 5834195 - DNA, 15 bp, Homo sapiens
actgttgtatctatg

SEQ ID NO: 5834196 - DNA, 19 bp, Homo sapiens
actgttgtgacctgaagtt

SEQ ID NO: 5834197 - DNA, 15 bp, Homo sapiens
actgttgtgggcgct

SEQ ID NO: 5834198 - DNA, 21 bp, Homo sapiens
actgttgtttgatgtgtatgt

SEQ ID NO: 5834199 - DNA, 18 bp, Homo sapiens
actgttgttttgtatgag

SEQ ID NO: 5834200 - DNA, 11 bp, Homo sapiens
acttatgtaga

SEQ ID NO: 5834201 - DNA, 16 bp, Homo sapiens
acttatgtagacaaaa

SEQ ID NO: 5834202 - DNA, 13 bp, Homo sapiens
acttatgtagata

SEQ ID NO: 5834203 - DNA, 15 bp, Homo sapiens
acttatgtagatatt

SEQ ID NO: 5834204 - DNA, 15 bp, Homo sapiens
acttatgtctcttgt

SEQ ID NO: 5834205 - DNA, 18 bp, Homo sapiens
acttattaaaaaatttgt

SEQ ID NO: 5834206 - DNA, 22 bp, Homo sapiens
acttattaatctgtatgaagat

SEQ ID NO: 5834207 - DNA, 16 bp, Homo sapiens
acttattacctcaggt

SEQ ID NO: 5834208 - DNA, 19 bp, Homo sapiens
acttattactgctaagtat

SEQ ID NO: 5834209 - DNA, 13 bp, Homo sapiens
acttattagaaac

SEQ ID NO: 5834210 - DNA, 15 bp, Homo sapiens
acttattatatcaga

SEQ ID NO: 5834211 - DNA, 17 bp, Homo sapiens
acttattatatcagagt

SEQ ID NO: 5834212 - DNA, 12 bp, Homo sapiens
acttattattaa

SEQ ID NO: 5834213 - DNA, 19 bp, Homo sapiens
acttattcaaaaaaatcct

SEQ ID NO: 5834214 - DNA, 17 bp, Homo sapiens
acttattcatagtttta

SEQ ID NO: 5834215 - DNA, 13 bp, Homo sapiens
acttattcattcc

SEQ ID NO: 5834216 - DNA, 18 bp, Homo sapiens
acttattcattcctcaca

SEQ ID NO: 5834217 - DNA, 19 bp, Homo sapiens
acttattcattcctcacaa

SEQ ID NO: 5834218 - DNA, 22 bp, Homo sapiens
acttattccgagaatgccgagg

SEQ ID NO: 5834219 - DNA, 14 bp, Homo sapiens
acttattcttttat

SEQ ID NO: 5834220 - DNA, 15 bp, Homo sapiens
acttattgaccattt

SEQ ID NO: 5834221 - DNA, 21 bp, Homo sapiens
acttattgcctgggcagtgcc

SEQ ID NO: 5834222 - DNA, 19 bp, Homo sapiens
acttattgctgattttaat

SEQ ID NO: 5834223 - DNA, 21 bp, Homo sapiens
acttattggaactctgcttga

SEQ ID NO: 5834224 - DNA, 23 bp, Homo sapiens
acttattgttgctgaaaactcta

SEQ ID NO: 5834225 - DNA, 18 bp, Homo sapiens
acttattgtttgaaagac

SEQ ID NO: 5834226 - DNA, 12 bp, Homo sapiens
acttatttaaaa

SEQ ID NO: 5834227 - DNA, 16 bp, Homo sapiens
acttatttataaaaag

SEQ ID NO: 5834228 - DNA, 17 bp, Homo sapiens
acttatttataacattg

SEQ ID NO: 5834229 - DNA, 20 bp, Homo sapiens
acttatttatatgaagcaag

SEQ ID NO: 5834230 - DNA, 13 bp, Homo sapiens
acttatttatgaa

SEQ ID NO: 5834231 - DNA, 15 bp, Homo sapiens
acttatttatgaatt

SEQ ID NO: 5834232 - DNA, 11 bp, Homo sapiens
acttatttcac

SEQ ID NO: 5834233 - DNA, 14 bp, Homo sapiens
acttatttcactat

SEQ ID NO: 5834234 - DNA, 12 bp, Homo sapiens
acttatttcata

SEQ ID NO: 5834235 - DNA, 22 bp, Homo sapiens
acttatttcataattgcctaca

SEQ ID NO: 5834236 - DNA, 11 bp, Homo sapiens
acttatttctg

SEQ ID NO: 5834237 - DNA, 12 bp, Homo sapiens
acttatttctgc

SEQ ID NO: 5834238 - DNA, 16 bp, Homo sapiens
acttatttcttcaaat

SEQ ID NO: 5834239 - DNA, 11 bp, Homo sapiens
acttatttgag

SEQ ID NO: 5834240 - DNA, 23 bp, Homo sapiens
acttatttgccctaagaactttg

SEQ ID NO: 5834241 - DNA, 14 bp, Homo sapiens
acttatttgtcaaa

SEQ ID NO: 5834242 - DNA, 15 bp, Homo sapiens
acttattttacacag

SEQ ID NO: 5834243 - DNA, 21 bp, Homo sapiens
acttattttcagtgcatcatt

SEQ ID NO: 5834244 - DNA, 20 bp, Homo sapiens
acttattttccacttatctt

SEQ ID NO: 5834245 - DNA, 21 bp, Homo sapiens
acttattttctggatctatct

SEQ ID NO: 5834246 - DNA, 20 bp, Homo sapiens
acttattttgtcttattctt

SEQ ID NO: 5834247 - DNA, 13 bp, Homo sapiens
acttatttttctg

SEQ ID NO: 5834248 - DNA, 14 bp, Homo sapiens
acttatttttgaca

SEQ ID NO: 5834249 - DNA, 22 bp, Homo sapiens
acttatttttgacagtgttgaa

SEQ ID NO: 5834250 - DNA, 18 bp, Homo sapiens
acttattttttaatgtga

SEQ ID NO: 5834251 - DNA, 20 bp, Homo sapiens
acttcaaaaacatttcatgc

SEQ ID NO: 5834252 - DNA, 15 bp, Homo sapiens
acttcaaaaactaaa

SEQ ID NO: 5834253 - DNA, 23 bp, Homo sapiens
acttcaaaaataaaaaatctgaa

SEQ ID NO: 5834254 - DNA, 15 bp, Homo sapiens
acttcaaaagccata

SEQ ID NO: 5834255 - DNA, 17 bp, Homo sapiens
acttcaaaagtattttc

SEQ ID NO: 5834256 - DNA, 18 bp, Homo sapiens
acttcaaaagtattttcc

SEQ ID NO: 5834257 - DNA, 15 bp, Homo sapiens
acttcaaaagtttgt

SEQ ID NO: 5834258 - DNA, 15 bp, Homo sapiens
acttcaaaatattga

SEQ ID NO: 5834259 - DNA, 16 bp, Homo sapiens
acttcaaaatcagtga

SEQ ID NO: 5834260 - DNA, 21 bp, Homo sapiens
acttcaaactactttgctgct

SEQ ID NO: 5834261 - DNA, 16 bp, Homo sapiens
acttcaaactgagatc

SEQ ID NO: 5834262 - DNA, 23 bp, Homo sapiens
acttcaaagaagctgtcttggaa

SEQ ID NO: 5834263 - DNA, 15 bp, Homo sapiens
acttcaaagcaagct

SEQ ID NO: 5834264 - DNA, 16 bp, Homo sapiens
acttcaaagctgaata

SEQ ID NO: 5834265 - DNA, 18 bp, Homo sapiens
acttcaaagctgaatatt

SEQ ID NO: 5834266 - DNA, 13 bp, Homo sapiens
acttcaaagtgcc

SEQ ID NO: 5834267 - DNA, 19 bp, Homo sapiens
acttcaaagtgcctgggct

SEQ ID NO: 5834268 - DNA, 20 bp, Homo sapiens
acttcaaataattaaatctc

SEQ ID NO: 5834269 - DNA, 17 bp, Homo sapiens
acttcaaatcagagcag

SEQ ID NO: 5834270 - DNA, 17 bp, Homo sapiens
acttcaaatccttgaag

SEQ ID NO: 5834271 - DNA, 12 bp, Homo sapiens
acttcaaatgtc

SEQ ID NO: 5834272 - DNA, 24 bp, Homo sapiens
acttcaaatgtcatttcatacaaa

SEQ ID NO: 5834273 - DNA, 14 bp, Homo sapiens
acttcaaatgtgta

SEQ ID NO: 5834274 - DNA, 22 bp, Homo sapiens
acttcaaatgtgtaactttatt

SEQ ID NO: 5834275 - DNA, 14 bp, Homo sapiens
acttcaacccccag

SEQ ID NO: 5834276 - DNA, 16 bp, Homo sapiens
acttcaacccccagct

SEQ ID NO: 5834277 - DNA, 15 bp, Homo sapiens
acttcaactgcccag

SEQ ID NO: 5834278 - DNA, 16 bp, Homo sapiens
acttcaactgcccagc

SEQ ID NO: 5834279 - DNA, 17 bp, Homo sapiens
acttcaactgcccagca

SEQ ID NO: 5834280 - DNA, 22 bp, Homo sapiens
acttcaagatcctcttgccaca

SEQ ID NO: 5834281 - DNA, 17 bp, Homo sapiens
acttcaagatgagcctg

SEQ ID NO: 5834282 - DNA, 23 bp, Homo sapiens
acttcaagatgagcctgggctca

SEQ ID NO: 5834283 - DNA, 20 bp, Homo sapiens
acttcaagatgcctcttcta

SEQ ID NO: 5834284 - DNA, 22 bp, Homo sapiens
acttcaagcaaagacagtttct

SEQ ID NO: 5834285 - DNA, 23 bp, Homo sapiens
acttcaagcaaagacagtttctt

SEQ ID NO: 5834286 - DNA, 22 bp, Homo sapiens
acttcaagcagaatcctcagtt

SEQ ID NO: 5834287 - DNA, 16 bp, Homo sapiens
acttcaaggaaaataa

SEQ ID NO: 5834288 - DNA, 20 bp, Homo sapiens
acttcaaggaaaataagtga

SEQ ID NO: 5834289 - DNA, 13 bp, Homo sapiens
acttcaaggccca

SEQ ID NO: 5834290 - DNA, 16 bp, Homo sapiens
acttcaaggtgacaga

SEQ ID NO: 5834291 - DNA, 22 bp, Homo sapiens
acttcaagtgcatgctctctgc

SEQ ID NO: 5834292 - DNA, 15 bp, Homo sapiens
acttcaatgaacaaa

SEQ ID NO: 5834293 - DNA, 19 bp, Homo sapiens
acttcaatgggctcttcca

SEQ ID NO: 5834294 - DNA, 19 bp, Homo sapiens
acttcaatgtgtcatttcc

SEQ ID NO: 5834295 - DNA, 22 bp, Homo sapiens
acttcacaatgttggcctgtca

SEQ ID NO: 5834296 - DNA, 21 bp, Homo sapiens
acttcacacagcacctcctct

SEQ ID NO: 5834297 - DNA, 17 bp, Homo sapiens
acttcacacatttataa

SEQ ID NO: 5834298 - DNA, 13 bp, Homo sapiens
acttcacactgca

SEQ ID NO: 5834299 - DNA, 15 bp, Homo sapiens
acttcacactgcaag

SEQ ID NO: 5834300 - DNA, 18 bp, Homo sapiens
acttcacagagtgtgctg

SEQ ID NO: 5834301 - DNA, 20 bp, Homo sapiens
acttcacagagtgtgctgga

SEQ ID NO: 5834302 - DNA, 22 bp, Homo sapiens
acttcacagagtgtgctggagg

SEQ ID NO: 5834303 - DNA, 16 bp, Homo sapiens
acttcacagcgtctgc

SEQ ID NO: 5834304 - DNA, 23 bp, Homo sapiens
acttcacatattgatttccgtta

SEQ ID NO: 5834305 - DNA, 14 bp, Homo sapiens
acttcaccaccccc

SEQ ID NO: 5834306 - DNA, 15 bp, Homo sapiens
acttcaccaccccct

SEQ ID NO: 5834307 - DNA, 14 bp, Homo sapiens
acttcacccccaac

SEQ ID NO: 5834308 - DNA, 18 bp, Homo sapiens
acttcacccggctgggct

SEQ ID NO: 5834309 - DNA, 19 bp, Homo sapiens
acttcacccggctgggctc

SEQ ID NO: 5834310 - DNA, 24 bp, Homo sapiens
acttcacccggctgggctcctcat

SEQ ID NO: 5834311 - DNA, 19 bp, Homo sapiens
acttcacctccatatcaga

SEQ ID NO: 5834312 - DNA, 16 bp, Homo sapiens
acttcacctccttctg

SEQ ID NO: 5834313 - DNA, 13 bp, Homo sapiens
acttcacctttcc

SEQ ID NO: 5834314 - DNA, 23 bp, Homo sapiens
acttcacctttcctctccctcag

SEQ ID NO: 5834315 - DNA, 16 bp, Homo sapiens
acttcactaccaaatg

SEQ ID NO: 5834316 - DNA, 14 bp, Homo sapiens
acttcactgcagcc

SEQ ID NO: 5834317 - DNA, 23 bp, Homo sapiens
acttcactgtcaggaagaaatca

SEQ ID NO: 5834318 - DNA, 13 bp, Homo sapiens
acttcactgtgag

SEQ ID NO: 5834319 - DNA, 17 bp, Homo sapiens
acttcactgtgctgttg

SEQ ID NO: 5834320 - DNA, 19 bp, Homo sapiens
acttcactgtgctgttgtt

SEQ ID NO: 5834321 - DNA, 17 bp, Homo sapiens
acttcactttaattctc

SEQ ID NO: 5834322 - DNA, 15 bp, Homo sapiens
acttcactttcttca

SEQ ID NO: 5834323 - DNA, 21 bp, Homo sapiens
acttcactttcttcaaagcca

SEQ ID NO: 5834324 - DNA, 20 bp, Homo sapiens
acttcagaaactttttctaa

SEQ ID NO: 5834325 - DNA, 17 bp, Homo sapiens
acttcagaacatgctgg

SEQ ID NO: 5834326 - DNA, 19 bp, Homo sapiens
acttcagaacatgctggat

SEQ ID NO: 5834327 - DNA, 17 bp, Homo sapiens
acttcagaagcaaacaa

SEQ ID NO: 5834328 - DNA, 18 bp, Homo sapiens
acttcagaagcaaacaat

SEQ ID NO: 5834329 - DNA, 15 bp, Homo sapiens
acttcagaattccat

SEQ ID NO: 5834330 - DNA, 21 bp, Homo sapiens
acttcagacatagaattaaca

SEQ ID NO: 5834331 - DNA, 15 bp, Homo sapiens
acttcagagaagtca

SEQ ID NO: 5834332 - DNA, 13 bp, Homo sapiens
acttcagagagaa

SEQ ID NO: 5834333 - DNA, 22 bp, Homo sapiens
acttcagagagaatgagcagag

SEQ ID NO: 5834334 - DNA, 15 bp, Homo sapiens
acttcagagagctgg

SEQ ID NO: 5834335 - DNA, 20 bp, Homo sapiens
acttcagagagctggtagtt

SEQ ID NO: 5834336 - DNA, 14 bp, Homo sapiens
acttcagatgtttc

SEQ ID NO: 5834337 - DNA, 16 bp, Homo sapiens
acttcagatgtttcca

SEQ ID NO: 5834338 - DNA, 12 bp, Homo sapiens
acttcagatttc

SEQ ID NO: 5834339 - DNA, 17 bp, Homo sapiens
acttcagatttcaaatt

SEQ ID NO: 5834340 - DNA, 19 bp, Homo sapiens
acttcagatttcaaattaa

SEQ ID NO: 5834341 - DNA, 12 bp, Homo sapiens
acttcagcaaga

SEQ ID NO: 5834342 - DNA, 14 bp, Homo sapiens
acttcagcaagaga

SEQ ID NO: 5834343 - DNA, 16 bp, Homo sapiens
acttcagcaagagaga

SEQ ID NO: 5834344 - DNA, 17 bp, Homo sapiens
acttcagcaagagagaa

SEQ ID NO: 5834345 - DNA, 18 bp, Homo sapiens
acttcagcaagagagaac

SEQ ID NO: 5834346 - DNA, 19 bp, Homo sapiens
acttcagcaagagagaacc

SEQ ID NO: 5834347 - DNA, 10 bp, Homo sapiens
acttcagcac

SEQ ID NO: 5834348 - DNA, 15 bp, Homo sapiens
acttcagcaggggat

SEQ ID NO: 5834349 - DNA, 21 bp, Homo sapiens
acttcagcaggggatggcgct

SEQ ID NO: 5834350 - DNA, 15 bp, Homo sapiens
acttcagcctgtgca

SEQ ID NO: 5834351 - DNA, 18 bp, Homo sapiens
acttcagcggtttatata

SEQ ID NO: 5834352 - DNA, 14 bp, Homo sapiens
acttcagctctgtt

SEQ ID NO: 5834353 - DNA, 16 bp, Homo sapiens
acttcagctgactttt

SEQ ID NO: 5834354 - DNA, 16 bp, Homo sapiens
acttcagggcagattt

SEQ ID NO: 5834355 - DNA, 18 bp, Homo sapiens
acttcagggcagatttta

SEQ ID NO: 5834356 - DNA, 18 bp, Homo sapiens
acttcaggggatgggtgt

SEQ ID NO: 5834357 - DNA, 15 bp, Homo sapiens
acttcaggggctgcc

SEQ ID NO: 5834358 - DNA, 16 bp, Homo sapiens
acttcaggggctgccc

SEQ ID NO: 5834359 - DNA, 17 bp, Homo sapiens
acttcaggggctgcccg

SEQ ID NO: 5834360 - DNA, 22 bp, Homo sapiens
acttcaggggctgcccgctccc

SEQ ID NO: 5834361 - DNA, 19 bp, Homo sapiens
acttcaggtaaaaacttca

SEQ ID NO: 5834362 - DNA, 21 bp, Homo sapiens
acttcaggtaaaaacttcatt

SEQ ID NO: 5834363 - DNA, 18 bp, Homo sapiens
acttcaggtatacctcac

SEQ ID NO: 5834364 - DNA, 21 bp, Homo sapiens
acttcaggtcaggtggctgtg

SEQ ID NO: 5834365 - DNA, 16 bp, Homo sapiens
acttcaggtccgtggg

SEQ ID NO: 5834366 - DNA, 22 bp, Homo sapiens
acttcaggtggagagcactaga

SEQ ID NO: 5834367 - DNA, 21 bp, Homo sapiens
acttcaggtgtgactctagca

SEQ ID NO: 5834368 - DNA, 19 bp, Homo sapiens
acttcagtactcaaattca

SEQ ID NO: 5834369 - DNA, 15 bp, Homo sapiens
acttcagtcctgctc

SEQ ID NO: 5834370 - DNA, 19 bp, Homo sapiens
acttcagtcctgctccaga

SEQ ID NO: 5834371 - DNA, 17 bp, Homo sapiens
acttcagtcctggtctg

SEQ ID NO: 5834372 - DNA, 18 bp, Homo sapiens
acttcagtcttgcctagg

SEQ ID NO: 5834373 - DNA, 18 bp, Homo sapiens
acttcagttctcatcttg

SEQ ID NO: 5834374 - DNA, 20 bp, Homo sapiens
acttcagtttaatgtctcct

SEQ ID NO: 5834375 - DNA, 18 bp, Homo sapiens
acttcagttttactgcat

SEQ ID NO: 5834376 - DNA, 21 bp, Homo sapiens
acttcagttttactgcatttt

SEQ ID NO: 5834377 - DNA, 22 bp, Homo sapiens
acttcagttttactgcattttc

SEQ ID NO: 5834378 - DNA, 18 bp, Homo sapiens
acttcttaaatatctttt

SEQ ID NO: 5834379 - DNA, 21 bp, Homo sapiens
acttcttacccaaagcacatg

SEQ ID NO: 5834380 - DNA, 17 bp, Homo sapiens
acttcttacgcaatgct

SEQ ID NO: 5834381 - DNA, 17 bp, Homo sapiens
acttcttatacatttga

SEQ ID NO: 5834382 - DNA, 18 bp, Homo sapiens
acttcttatacatttgat

SEQ ID NO: 5834383 - DNA, 21 bp, Homo sapiens
acttcttatggaattgatttg

SEQ ID NO: 5834384 - DNA, 15 bp, Homo sapiens
acttcttattgaagt

SEQ ID NO: 5834385 - DNA, 12 bp, Homo sapiens
acttcttatttt

SEQ ID NO: 5834386 - DNA, 15 bp, Homo sapiens
acttcttatttttct

SEQ ID NO: 5834387 - DNA, 18 bp, Homo sapiens
acttcttcacctcttcca

SEQ ID NO: 5834388 - DNA, 19 bp, Homo sapiens
acttcttcacctcttccac

SEQ ID NO: 5834389 - DNA, 20 bp, Homo sapiens
acttcttcacctcttccact

SEQ ID NO: 5834390 - DNA, 12 bp, Homo sapiens
acttcttcatcc

SEQ ID NO: 5834391 - DNA, 21 bp, Homo sapiens
acttcttccctaaaatgtaga

SEQ ID NO: 5834392 - DNA, 11 bp, Homo sapiens
acttcttcctg

SEQ ID NO: 5834393 - DNA, 15 bp, Homo sapiens
acttcttcctgctgg

SEQ ID NO: 5834394 - DNA, 17 bp, Homo sapiens
acttcttcggaggtggc

SEQ ID NO: 5834395 - DNA, 22 bp, Homo sapiens
acttcttctcatactatttaag

SEQ ID NO: 5834396 - DNA, 20 bp, Homo sapiens
acttcttctgtccaagcaga

SEQ ID NO: 5834397 - DNA, 12 bp, Homo sapiens
acttcttgaaaa

SEQ ID NO: 5834398 - DNA, 15 bp, Homo sapiens
acttcttgaaaaaga

SEQ ID NO: 5834399 - DNA, 12 bp, Homo sapiens
acttcttgaagg

SEQ ID NO: 5834400 - DNA, 16 bp, Homo sapiens
acttcttgaaggtgct

SEQ ID NO: 5834401 - DNA, 13 bp, Homo sapiens
acttcttgaatat

SEQ ID NO: 5834402 - DNA, 21 bp, Homo sapiens
acttcttgaatataaaaaatc

SEQ ID NO: 5834403 - DNA, 23 bp, Homo sapiens
acttcttggaaaaaaattacaaa

SEQ ID NO: 5834404 - DNA, 22 bp, Homo sapiens
acttcttggcttggtgaggaaa

SEQ ID NO: 5834405 - DNA, 15 bp, Homo sapiens
acttcttggttcctg

SEQ ID NO: 5834406 - DNA, 16 bp, Homo sapiens
acttcttggttcctgg

SEQ ID NO: 5834407 - DNA, 17 bp, Homo sapiens
acttcttggttcctggg

SEQ ID NO: 5834408 - DNA, 23 bp, Homo sapiens
acttcttggtttggggagaaata

SEQ ID NO: 5834409 - DNA, 21 bp, Homo sapiens
acttcttggttttctctctgg

SEQ ID NO: 5834410 - DNA, 24 bp, Homo sapiens
acttcttgtcagacataaagccat

SEQ ID NO: 5834411 - DNA, 19 bp, Homo sapiens
acttcttgtgtgtatgcac

SEQ ID NO: 5834412 - DNA, 19 bp, Homo sapiens
acttcttgtgttaaactaa

SEQ ID NO: 5834413 - DNA, 18 bp, Homo sapiens
acttctttaattttggaa

SEQ ID NO: 5834414 - DNA, 21 bp, Homo sapiens
acttctttagtattatattaa

SEQ ID NO: 5834415 - DNA, 20 bp, Homo sapiens
acttctttatactctcttcc

SEQ ID NO: 5834416 - DNA, 21 bp, Homo sapiens
acttctttatactctcttccc

SEQ ID NO: 5834417 - DNA, 22 bp, Homo sapiens
acttctttatactctcttccct

SEQ ID NO: 5834418 - DNA, 19 bp, Homo sapiens
acttctttcccttcctcca

SEQ ID NO: 5834419 - DNA, 14 bp, Homo sapiens
acttctttctattt

SEQ ID NO: 5834420 - DNA, 17 bp, Homo sapiens
acttctttgcagagcct

SEQ ID NO: 5834421 - DNA, 20 bp, Homo sapiens
acttctttgctttgcccagc

SEQ ID NO: 5834422 - DNA, 20 bp, Homo sapiens
acttctttgtggtttcaaat

SEQ ID NO: 5834423 - DNA, 14 bp, Homo sapiens
acttcttttcacat

SEQ ID NO: 5834424 - DNA, 18 bp, Homo sapiens
acttcttttccaaaaata

SEQ ID NO: 5834425 - DNA, 15 bp, Homo sapiens
acttcttttgaacat

SEQ ID NO: 5834426 - DNA, 15 bp, Homo sapiens
acttctttttaatct

SEQ ID NO: 5834427 - DNA, 17 bp, Homo sapiens
acttctttttaatctta

SEQ ID NO: 5834428 - DNA, 22 bp, Homo sapiens
acttcttttttcaaaagaaagt

SEQ ID NO: 5834429 - DNA, 19 bp, Homo sapiens
acttgaaaaaaaaaaacac

SEQ ID NO: 5834430 - DNA, 13 bp, Homo sapiens
acttgaaaaatat

SEQ ID NO: 5834431 - DNA, 18 bp, Homo sapiens
acttgaaaacttctcatt

SEQ ID NO: 5834432 - DNA, 15 bp, Homo sapiens
acttgaaaagaaaac

SEQ ID NO: 5834433 - DNA, 21 bp, Homo sapiens
acttgaaaagagacaggcagg

SEQ ID NO: 5834434 - DNA, 18 bp, Homo sapiens
acttgaaaagattgcaaa

SEQ ID NO: 5834435 - DNA, 18 bp, Homo sapiens
acttgaaaattaacatga

SEQ ID NO: 5834436 - DNA, 15 bp, Homo sapiens
acttgaaaccagaag

SEQ ID NO: 5834437 - DNA, 17 bp, Homo sapiens
acttgaaaccagtattt

SEQ ID NO: 5834438 - DNA, 22 bp, Homo sapiens
acttgaaacttggttcccagaa

SEQ ID NO: 5834439 - DNA, 12 bp, Homo sapiens
acttgaaagaaa

SEQ ID NO: 5834440 - DNA, 16 bp, Homo sapiens
acttgaaagttttcca

SEQ ID NO: 5834441 - DNA, 23 bp, Homo sapiens
acttgaaagttttccagtattga

SEQ ID NO: 5834442 - DNA, 16 bp, Homo sapiens
acttgaaagttttcta

SEQ ID NO: 5834443 - DNA, 14 bp, Homo sapiens
acttgaaataagtt

SEQ ID NO: 5834444 - DNA, 11 bp, Homo sapiens
acttgaaatat

SEQ ID NO: 5834445 - DNA, 22 bp, Homo sapiens
acttgaaatatataatattcag

SEQ ID NO: 5834446 - DNA, 23 bp, Homo sapiens
acttgaaattatatctgtggtct

SEQ ID NO: 5834447 - DNA, 19 bp, Homo sapiens
acttgaacaaaatctgttg

SEQ ID NO: 5834448 - DNA, 14 bp, Homo sapiens
acttgaacaaagac

SEQ ID NO: 5834449 - DNA, 17 bp, Homo sapiens
acttgaacaaagacatt

SEQ ID NO: 5834450 - DNA, 22 bp, Homo sapiens
acttgaacaaagacatttatat

SEQ ID NO: 5834451 - DNA, 15 bp, Homo sapiens
acttgaacaagaaat

SEQ ID NO: 5834452 - DNA, 15 bp, Homo sapiens
acttgaaccataaaa

SEQ ID NO: 5834453 - DNA, 16 bp, Homo sapiens
acttgaaccataaaat

SEQ ID NO: 5834454 - DNA, 21 bp, Homo sapiens
acttgaacccatatttgtaca

SEQ ID NO: 5834455 - DNA, 21 bp, Homo sapiens
acttgaacccgggaggcagag

SEQ ID NO: 5834456 - DNA, 23 bp, Homo sapiens
acttgaacccgggaggcagaggt

SEQ ID NO: 5834457 - DNA, 20 bp, Homo sapiens
acttgaacctatgaagcaat

SEQ ID NO: 5834458 - DNA, 19 bp, Homo sapiens
acttgaacgttttctaatt

SEQ ID NO: 5834459 - DNA, 12 bp, Homo sapiens
acttgaactcca

SEQ ID NO: 5834460 - DNA, 20 bp, Homo sapiens
acttgaactgttgcccttct

SEQ ID NO: 5834461 - DNA, 16 bp, Homo sapiens
acttgaacttgcctct

SEQ ID NO: 5834462 - DNA, 12 bp, Homo sapiens
acttgaacttgt

SEQ ID NO: 5834463 - DNA, 16 bp, Homo sapiens
acttgaactttcctgg

SEQ ID NO: 5834464 - DNA, 20 bp, Homo sapiens
acttgaagccatctaaagta

SEQ ID NO: 5834465 - DNA, 14 bp, Homo sapiens
acttgaagcctgct

SEQ ID NO: 5834466 - DNA, 16 bp, Homo sapiens
acttgaagcctgctcc

SEQ ID NO: 5834467 - DNA, 22 bp, Homo sapiens
acttgaaggatggatgagtcag

SEQ ID NO: 5834468 - DNA, 13 bp, Homo sapiens
acttgaaggattg

SEQ ID NO: 5834469 - DNA, 16 bp, Homo sapiens
acttgaaggattgcat

SEQ ID NO: 5834470 - DNA, 19 bp, Homo sapiens
acttgaaggattgcatcct

SEQ ID NO: 5834471 - DNA, 21 bp, Homo sapiens
acttgaaggattgcatcctgc

SEQ ID NO: 5834472 - DNA, 17 bp, Homo sapiens
acttgaagggccagagc

SEQ ID NO: 5834473 - DNA, 22 bp, Homo sapiens
acttgaagggccagagccaggg

SEQ ID NO: 5834474 - DNA, 23 bp, Homo sapiens
acttgaataactctttttcagag

SEQ ID NO: 5834475 - DNA, 19 bp, Homo sapiens
acttgaataatagtatgag

SEQ ID NO: 5834476 - DNA, 16 bp, Homo sapiens
acttgaatagtattgt

SEQ ID NO: 5834477 - DNA, 18 bp, Homo sapiens
acttgaatagtattgtgt

SEQ ID NO: 5834478 - DNA, 17 bp, Homo sapiens
acttgaatatggaacat

SEQ ID NO: 5834479 - DNA, 19 bp, Homo sapiens
acttgaatccattgaaagt

SEQ ID NO: 5834480 - DNA, 16 bp, Homo sapiens
acttgaatctgttact

SEQ ID NO: 5834481 - DNA, 23 bp, Homo sapiens
acttgaatctgttactgaaatga

SEQ ID NO: 5834482 - DNA, 20 bp, Homo sapiens
acttgaatgaaaatgtccat

SEQ ID NO: 5834483 - DNA, 24 bp, Homo sapiens
acttgaatgctagttatacttatt

SEQ ID NO: 5834484 - DNA, 14 bp, Homo sapiens
acttgaatgctgcc

SEQ ID NO: 5834485 - DNA, 15 bp, Homo sapiens
acttgaatgtacaaa

SEQ ID NO: 5834486 - DNA, 18 bp, Homo sapiens
acttgaatgtacaaagat

SEQ ID NO: 5834487 - DNA, 14 bp, Homo sapiens
acttgaattacaac

SEQ ID NO: 5834488 - DNA, 16 bp, Homo sapiens
acttgaatttagtttt

SEQ ID NO: 5834489 - DNA, 18 bp, Homo sapiens
acttgaattttcccactg

SEQ ID NO: 5834490 - DNA, 19 bp, Homo sapiens
acttgaattttcccactgc

SEQ ID NO: 5834491 - DNA, 16 bp, Homo sapiens
acttgaattttttgaa

SEQ ID NO: 5834492 - DNA, 19 bp, Homo sapiens
acttgaattttttgaaatg

SEQ ID NO: 5834493 - DNA, 22 bp, Homo sapiens
acttgacaacatcccacagtgg

SEQ ID NO: 5834494 - DNA, 13 bp, Homo sapiens
acttgacaccact

SEQ ID NO: 5834495 - DNA, 13 bp, Homo sapiens
acttgacagtgga

SEQ ID NO: 5834496 - DNA, 16 bp, Homo sapiens
acttgacatgtagctt

SEQ ID NO: 5834497 - DNA, 14 bp, Homo sapiens
acttgaccattctc

SEQ ID NO: 5834498 - DNA, 20 bp, Homo sapiens
acttgaccctttcctccccc

SEQ ID NO: 5834499 - DNA, 17 bp, Homo sapiens
acttgactaataccttg

SEQ ID NO: 5834500 - DNA, 22 bp, Homo sapiens
acttgactataaaaactgcccc

SEQ ID NO: 5834501 - DNA, 13 bp, Homo sapiens
acttgactctaat

SEQ ID NO: 5834502 - DNA, 18 bp, Homo sapiens
acttgactctaatatgat

SEQ ID NO: 5834503 - DNA, 19 bp, Homo sapiens
acttgactctaatatgatt

SEQ ID NO: 5834504 - DNA, 15 bp, Homo sapiens
acttgactcttgaat

SEQ ID NO: 5834505 - DNA, 17 bp, Homo sapiens
acttgactcttgaataa

SEQ ID NO: 5834506 - DNA, 17 bp, Homo sapiens
acttgacttttaaggct

SEQ ID NO: 5834507 - DNA, 15 bp, Homo sapiens
acttgagaaaatgca

SEQ ID NO: 5834508 - DNA, 15 bp, Homo sapiens
acttgagaaatttga

SEQ ID NO: 5834509 - DNA, 22 bp, Homo sapiens
acttgagaaccagtctcctcac

SEQ ID NO: 5834510 - DNA, 14 bp, Homo sapiens
acttgagacctaat

SEQ ID NO: 5834511 - DNA, 16 bp, Homo sapiens
acttgagaggatgaat

SEQ ID NO: 5834512 - DNA, 20 bp, Homo sapiens
acttgagatctgtataaata

SEQ ID NO: 5834513 - DNA, 22 bp, Homo sapiens
acttgagatctgtataaataag

SEQ ID NO: 5834514 - DNA, 19 bp, Homo sapiens
acttgagatgtatgaaggc

SEQ ID NO: 5834515 - DNA, 16 bp, Homo sapiens
acttgagattcaagac

SEQ ID NO: 5834516 - DNA, 10 bp, Homo sapiens
acttgagcca

SEQ ID NO: 5834517 - DNA, 14 bp, Homo sapiens
acttgagccactcc

SEQ ID NO: 5834518 - DNA, 23 bp, Homo sapiens
acttgagccctgccactcaatgg

SEQ ID NO: 5834519 - DNA, 21 bp, Homo sapiens
acttgagcctatatcagtcgt

SEQ ID NO: 5834520 - DNA, 11 bp, Homo sapiens
acttgagcctg

SEQ ID NO: 5834521 - DNA, 15 bp, Homo sapiens
acttgagctgtatat

SEQ ID NO: 5834522 - DNA, 23 bp, Homo sapiens
acttgagctttaaaaatcattgt

SEQ ID NO: 5834523 - DNA, 12 bp, Homo sapiens
acttgaggacac

SEQ ID NO: 5834524 - DNA, 20 bp, Homo sapiens
acttgaggaggagctggcct

SEQ ID NO: 5834525 - DNA, 19 bp, Homo sapiens
acttgaggatcatatgaat

SEQ ID NO: 5834526 - DNA, 18 bp, Homo sapiens
acttgaggattttgagta

SEQ ID NO: 5834527 - DNA, 18 bp, Homo sapiens
acttgaggcacaaatcac

SEQ ID NO: 5834528 - DNA, 18 bp, Homo sapiens
acttgaggccaggacttt

SEQ ID NO: 5834529 - DNA, 18 bp, Homo sapiens
acttgaggctggcactcc

SEQ ID NO: 5834530 - DNA, 23 bp, Homo sapiens
acttgaggctttcagtgatatct

SEQ ID NO: 5834531 - DNA, 16 bp, Homo sapiens
acttgagggcccagag

SEQ ID NO: 5834532 - DNA, 17 bp, Homo sapiens
acttgagggcccagagc

SEQ ID NO: 5834533 - DNA, 20 bp, Homo sapiens
acttgagggcccagagcagg

SEQ ID NO: 5834534 - DNA, 18 bp, Homo sapiens
acttgagggtaataaact

SEQ ID NO: 5834535 - DNA, 21 bp, Homo sapiens
acttgaggtggcctccttgct

SEQ ID NO: 5834536 - DNA, 18 bp, Homo sapiens
acttgagtaaaatactct

SEQ ID NO: 5834537 - DNA, 15 bp, Homo sapiens
acttgagtataagat

SEQ ID NO: 5834538 - DNA, 19 bp, Homo sapiens
acttgagtataagataaaa

SEQ ID NO: 5834539 - DNA, 15 bp, Homo sapiens
acttgagtatcataa

SEQ ID NO: 5834540 - DNA, 16 bp, Homo sapiens
acttgagttaactttt

SEQ ID NO: 5834541 - DNA, 21 bp, Homo sapiens
acttgagttacaccagacctg

SEQ ID NO: 5834542 - DNA, 22 bp, Homo sapiens
acttgagttggagtactatatt

SEQ ID NO: 5834543 - DNA, 16 bp, Homo sapiens
acttgagttggctgtg

SEQ ID NO: 5834544 - DNA, 22 bp, Homo sapiens
acttgataatattagtgattct

SEQ ID NO: 5834545 - DNA, 13 bp, Homo sapiens
acttgatatttat

SEQ ID NO: 5834546 - DNA, 17 bp, Homo sapiens
acttgatcacatgcttg

SEQ ID NO: 5834547 - DNA, 20 bp, Homo sapiens
acttgatccatttctaatta

SEQ ID NO: 5834548 - DNA, 20 bp, Homo sapiens
acttgatgaataaacacttt

SEQ ID NO: 5834549 - DNA, 13 bp, Homo sapiens
acttgatgatttt

SEQ ID NO: 5834550 - DNA, 20 bp, Homo sapiens
acttgatggaaggatctctc

SEQ ID NO: 5834551 - DNA, 21 bp, Homo sapiens
acttgatggggcctgggtttg

SEQ ID NO: 5834552 - DNA, 16 bp, Homo sapiens
acttgatgtgccattt

SEQ ID NO: 5834553 - DNA, 18 bp, Homo sapiens
acttgatgtgccatttta

SEQ ID NO: 5834554 - DNA, 15 bp, Homo sapiens
actttattataaaat

SEQ ID NO: 5834555 - DNA, 16 bp, Homo sapiens
actttattattttgct

SEQ ID NO: 5834556 - DNA, 17 bp, Homo sapiens
actttattctcctccga

SEQ ID NO: 5834557 - DNA, 12 bp, Homo sapiens
actttattcttg

SEQ ID NO: 5834558 - DNA, 15 bp, Homo sapiens
actttattcttgctg

SEQ ID NO: 5834559 - DNA, 19 bp, Homo sapiens
actttattctttgttcttt

SEQ ID NO: 5834560 - DNA, 17 bp, Homo sapiens
actttattgacaagtga

SEQ ID NO: 5834561 - DNA, 20 bp, Homo sapiens
actttattgattttctttct

SEQ ID NO: 5834562 - DNA, 22 bp, Homo sapiens
actttattgcaactcttttaag

SEQ ID NO: 5834563 - DNA, 15 bp, Homo sapiens
actttattgcaatgc

SEQ ID NO: 5834564 - DNA, 15 bp, Homo sapiens
actttattgcatata

SEQ ID NO: 5834565 - DNA, 15 bp, Homo sapiens
actttattgcttaat

SEQ ID NO: 5834566 - DNA, 21 bp, Homo sapiens
actttattgcttaatttctgc

SEQ ID NO: 5834567 - DNA, 14 bp, Homo sapiens
actttattgtacag

SEQ ID NO: 5834568 - DNA, 15 bp, Homo sapiens
actttatttaaatgc

SEQ ID NO: 5834569 - DNA, 13 bp, Homo sapiens
actttatttaatt

SEQ ID NO: 5834570 - DNA, 20 bp, Homo sapiens
actttatttaatttcataaa

SEQ ID NO: 5834571 - DNA, 23 bp, Homo sapiens
actttatttaatttcataaattg

SEQ ID NO: 5834572 - DNA, 21 bp, Homo sapiens
actttatttattgcttagtga

SEQ ID NO: 5834573 - DNA, 12 bp, Homo sapiens
actttatttctg

SEQ ID NO: 5834574 - DNA, 21 bp, Homo sapiens
actttatttctgagcaaagca

SEQ ID NO: 5834575 - DNA, 14 bp, Homo sapiens
actttatttgtaaa

SEQ ID NO: 5834576 - DNA, 19 bp, Homo sapiens
actttatttgtaaaccatt

SEQ ID NO: 5834577 - DNA, 23 bp, Homo sapiens
actttatttgtaaaccattgtaa

SEQ ID NO: 5834578 - DNA, 14 bp, Homo sapiens
actttattttgctt

SEQ ID NO: 5834579 - DNA, 15 bp, Homo sapiens
actttattttgtgtt

SEQ ID NO: 5834580 - DNA, 19 bp, Homo sapiens
actttatttttctaagtgt

SEQ ID NO: 5834581 - DNA, 20 bp, Homo sapiens
actttcaaaagagtagaaag

SEQ ID NO: 5834582 - DNA, 19 bp, Homo sapiens
actttcaaaatatattttg

SEQ ID NO: 5834583 - DNA, 20 bp, Homo sapiens
actttcaaaatgaattttta

SEQ ID NO: 5834584 - DNA, 19 bp, Homo sapiens
actttcaagaatcagacag

SEQ ID NO: 5834585 - DNA, 18 bp, Homo sapiens
actttcaagtattatatt

SEQ ID NO: 5834586 - DNA, 18 bp, Homo sapiens
actttcacgtggcctccg

SEQ ID NO: 5834587 - DNA, 15 bp, Homo sapiens
actttcacttcttcc

SEQ ID NO: 5834588 - DNA, 16 bp, Homo sapiens
actttcacttcttcct

SEQ ID NO: 5834589 - DNA, 14 bp, Homo sapiens
actttcactttgaa

SEQ ID NO: 5834590 - DNA, 19 bp, Homo sapiens
actttcagaagtgccactt

SEQ ID NO: 5834591 - DNA, 19 bp, Homo sapiens
actttcagagaattactat

SEQ ID NO: 5834592 - DNA, 13 bp, Homo sapiens
actttcagagccc

SEQ ID NO: 5834593 - DNA, 20 bp, Homo sapiens
actttcagagcccccagccc

SEQ ID NO: 5834594 - DNA, 23 bp, Homo sapiens
actttcagagcccccagccctgg

SEQ ID NO: 5834595 - DNA, 22 bp, Homo sapiens
actttcagattgtatctgaact

SEQ ID NO: 5834596 - DNA, 22 bp, Homo sapiens
actttcagctgtcttttggagg

SEQ ID NO: 5834597 - DNA, 22 bp, Homo sapiens
actttcaggccacatggctaaa

SEQ ID NO: 5834598 - DNA, 19 bp, Homo sapiens
actttcaggctactgttct

SEQ ID NO: 5834599 - DNA, 20 bp, Homo sapiens
actttcaggctactgttctt

SEQ ID NO: 5834600 - DNA, 13 bp, Homo sapiens
actttcaggggct

SEQ ID NO: 5834601 - DNA, 17 bp, Homo sapiens
actttcagtaaacataa

SEQ ID NO: 5834602 - DNA, 22 bp, Homo sapiens
actttcatattttaaacagagg

SEQ ID NO: 5834603 - DNA, 14 bp, Homo sapiens
actttcatcttaaa

SEQ ID NO: 5834604 - DNA, 17 bp, Homo sapiens
actttcatcttaaacta

SEQ ID NO: 5834605 - DNA, 24 bp, Homo sapiens
actttcatcttaaactaatacgtg

SEQ ID NO: 5834606 - DNA, 18 bp, Homo sapiens
actttcattgccagtgtc

SEQ ID NO: 5834607 - DNA, 17 bp, Homo sapiens
actttcatttttttcca

SEQ ID NO: 5834608 - DNA, 20 bp, Homo sapiens
actttcatttttttccaggc

SEQ ID NO: 5834609 - DNA, 21 bp, Homo sapiens
actttcatttttttccaggct

SEQ ID NO: 5834610 - DNA, 23 bp, Homo sapiens
actttcatttttttccaggctgg

SEQ ID NO: 5834611 - DNA, 13 bp, Homo sapiens
actttccaacttt

SEQ ID NO: 5834612 - DNA, 18 bp, Homo sapiens
actttccaatgccacaga

SEQ ID NO: 5834613 - DNA, 22 bp, Homo sapiens
actttccacttcttcctttctc

SEQ ID NO: 5834614 - DNA, 12 bp, Homo sapiens
actttccagaat

SEQ ID NO: 5834615 - DNA, 16 bp, Homo sapiens
actttccatctctgcc

SEQ ID NO: 5834616 - DNA, 13 bp, Homo sapiens
actttccatgaca

SEQ ID NO: 5834617 - DNA, 21 bp, Homo sapiens
actttccattacaagtatttt

SEQ ID NO: 5834618 - DNA, 12 bp, Homo sapiens
actttcccacac

SEQ ID NO: 5834619 - DNA, 16 bp, Homo sapiens
actttcccacccagga

SEQ ID NO: 5834620 - DNA, 20 bp, Homo sapiens
actttccccaccagatgctg

SEQ ID NO: 5834621 - DNA, 21 bp, Homo sapiens
actttccccaccagatgctga

SEQ ID NO: 5834622 - DNA, 22 bp, Homo sapiens
actttccccatactctgtctcc

SEQ ID NO: 5834623 - DNA, 15 bp, Homo sapiens
actttcccccttccc

SEQ ID NO: 5834624 - DNA, 18 bp, Homo sapiens
actttcccccttcccgcc

SEQ ID NO: 5834625 - DNA, 13 bp, Homo sapiens
actttccctaccc

SEQ ID NO: 5834626 - DNA, 21 bp, Homo sapiens
actttccctaccctctagaga

SEQ ID NO: 5834627 - DNA, 15 bp, Homo sapiens
actttccctagaaag

SEQ ID NO: 5834628 - DNA, 21 bp, Homo sapiens
actttcccttgccctgggctg

SEQ ID NO: 5834629 - DNA, 22 bp, Homo sapiens
actttcccttgcttttccctct

SEQ ID NO: 5834630 - DNA, 23 bp, Homo sapiens
actttcccttgcttttccctctt

SEQ ID NO: 5834631 - DNA, 16 bp, Homo sapiens
actttcctacaaaatg

SEQ ID NO: 5834632 - DNA, 14 bp, Homo sapiens
actttcctcccatt

SEQ ID NO: 5834633 - DNA, 14 bp, Homo sapiens
actttcctgagctg

SEQ ID NO: 5834634 - DNA, 14 bp, Homo sapiens
actttcctgcaact

SEQ ID NO: 5834635 - DNA, 20 bp, Homo sapiens
actttcctggataaaaaaga

SEQ ID NO: 5834636 - DNA, 17 bp, Homo sapiens
actttcctggatgtctg

SEQ ID NO: 5834637 - DNA, 15 bp, Homo sapiens
actttcctgtggttt

SEQ ID NO: 5834638 - DNA, 23 bp, Homo sapiens
actttccttcattcaacccacct

SEQ ID NO: 5834639 - DNA, 15 bp, Homo sapiens
actttccttcctcat

SEQ ID NO: 5834640 - DNA, 15 bp, Homo sapiens
actttcctttaactc

SEQ ID NO: 5834641 - DNA, 22 bp, Homo sapiens
actttcctttaactcccttttt

SEQ ID NO: 5834642 - DNA, 23 bp, Homo sapiens
actttcctttaactcccttttta

SEQ ID NO: 5834643 - DNA, 14 bp, Homo sapiens
actttcctttcaat

SEQ ID NO: 5834644 - DNA, 15 bp, Homo sapiens
actttcctttcaata

SEQ ID NO: 5834645 - DNA, 17 bp, Homo sapiens
actttcctttcaataaa

SEQ ID NO: 5834646 - DNA, 18 bp, Homo sapiens
actttcctttcaataaag

SEQ ID NO: 5834647 - DNA, 23 bp, Homo sapiens
actttccttttcttgtctctgag

SEQ ID NO: 5834648 - DNA, 17 bp, Homo sapiens
actttcgaaatttcatt

SEQ ID NO: 5834649 - DNA, 17 bp, Homo sapiens
actttcgcctcctccag

SEQ ID NO: 5834650 - DNA, 17 bp, Homo sapiens
actttcgttaatcttgc

SEQ ID NO: 5834651 - DNA, 20 bp, Homo sapiens
actttcgttaatcttgctgc

SEQ ID NO: 5834652 - DNA, 17 bp, Homo sapiens
actttctacaatgtgaa

SEQ ID NO: 5834653 - DNA, 14 bp, Homo sapiens
actttctacatgca

SEQ ID NO: 5834654 - DNA, 16 bp, Homo sapiens
actttctacatgcaaa

SEQ ID NO: 5834655 - DNA, 19 bp, Homo sapiens
actttctactcattttaat

SEQ ID NO: 5834656 - DNA, 15 bp, Homo sapiens
actttctagattaag

SEQ ID NO: 5834657 - DNA, 17 bp, Homo sapiens
actttctatcctctgta

SEQ ID NO: 5834658 - DNA, 22 bp, Homo sapiens
actttctatgtgacatttctct

SEQ ID NO: 5834659 - DNA, 14 bp, Homo sapiens
actttctattaata

SEQ ID NO: 5834660 - DNA, 19 bp, Homo sapiens
actttctattaatatttat

SEQ ID NO: 5834661 - DNA, 20 bp, Homo sapiens
actttctattaatatttatg

SEQ ID NO: 5834662 - DNA, 20 bp, Homo sapiens
actttctcagcatatatata

SEQ ID NO: 5834663 - DNA, 15 bp, Homo sapiens
actttctcaggcttc

SEQ ID NO: 5834664 - DNA, 16 bp, Homo sapiens
actttctcaggcttct

SEQ ID NO: 5834665 - DNA, 18 bp, Homo sapiens
actttctcaggcttctca

SEQ ID NO: 5834666 - DNA, 18 bp, Homo sapiens
actttctcagttttcata

SEQ ID NO: 5834667 - DNA, 22 bp, Homo sapiens
actttctcctggtgtttttctc

SEQ ID NO: 5834668 - DNA, 19 bp, Homo sapiens
actttctctaataataaat

SEQ ID NO: 5834669 - DNA, 13 bp, Homo sapiens
actttctctgtag

SEQ ID NO: 5834670 - DNA, 14 bp, Homo sapiens
actttctctgtagt

SEQ ID NO: 5834671 - DNA, 18 bp, Homo sapiens
actttctctgtagttcct

SEQ ID NO: 5834672 - DNA, 15 bp, Homo sapiens
actttctctgtgaaa

SEQ ID NO: 5834673 - DNA, 19 bp, Homo sapiens
actttctctgtgaaagctt

SEQ ID NO: 5834674 - DNA, 12 bp, Homo sapiens
actttctcttca

SEQ ID NO: 5834675 - DNA, 19 bp, Homo sapiens
actttctcttcatactttt

SEQ ID NO: 5834676 - DNA, 15 bp, Homo sapiens
actttctcttgttta

SEQ ID NO: 5834677 - DNA, 15 bp, Homo sapiens
actttctctttgcca

SEQ ID NO: 5834678 - DNA, 20 bp, Homo sapiens
actttctctttgccatttct

SEQ ID NO: 5834679 - DNA, 20 bp, Homo sapiens
actttctgaaaacacttgat

SEQ ID NO: 5834680 - DNA, 18 bp, Homo sapiens
actttctgaaaatttata

SEQ ID NO: 5834681 - DNA, 22 bp, Homo sapiens
actttctgaaaatttatataac

SEQ ID NO: 5834682 - DNA, 13 bp, Homo sapiens
actttctgccgct

SEQ ID NO: 5834683 - DNA, 21 bp, Homo sapiens
actttctggactcccactctt

SEQ ID NO: 5834684 - DNA, 15 bp, Homo sapiens
actttctggcaaacg

SEQ ID NO: 5834685 - DNA, 17 bp, Homo sapiens
actttctggtgctgtct

SEQ ID NO: 5834686 - DNA, 17 bp, Homo sapiens
actttctgtactaaaca

SEQ ID NO: 5834687 - DNA, 17 bp, Homo sapiens
actttctgtgacgcaga

SEQ ID NO: 5834688 - DNA, 23 bp, Homo sapiens
actttctgttaaaatgcatgatt

SEQ ID NO: 5834689 - DNA, 13 bp, Homo sapiens
actttctgttcct

SEQ ID NO: 5834690 - DNA, 17 bp, Homo sapiens
actttctgttccttcct

SEQ ID NO: 5834691 - DNA, 22 bp, Homo sapiens
actttctgttggattccatgct

SEQ ID NO: 5834692 - DNA, 23 bp, Homo sapiens
actttctgttggattccatgcta

SEQ ID NO: 5834693 - DNA, 23 bp, Homo sapiens
actttctgttttctgtttgtaaa

SEQ ID NO: 5834694 - DNA, 17 bp, Homo sapiens
actttcttattctgtat

SEQ ID NO: 5834695 - DNA, 20 bp, Homo sapiens
actttcttcaccaagtgcaa

SEQ ID NO: 5834696 - DNA, 10 bp, Homo sapiens
actttcttct

SEQ ID NO: 5834697 - DNA, 14 bp, Homo sapiens
actttcttctaaat

SEQ ID NO: 5834698 - DNA, 18 bp, Homo sapiens
actttcttctgaatattt

SEQ ID NO: 5834699 - DNA, 16 bp, Homo sapiens
actttcttcttcccat

SEQ ID NO: 5834700 - DNA, 16 bp, Homo sapiens
actttcttgagcacca

SEQ ID NO: 5834701 - DNA, 17 bp, Homo sapiens
actttcttgagcaccag

SEQ ID NO: 5834702 - DNA, 18 bp, Homo sapiens
actttctttaaattatgt

SEQ ID NO: 5834703 - DNA, 15 bp, Homo sapiens
actttctttaacata

SEQ ID NO: 5834704 - DNA, 16 bp, Homo sapiens
actttctttagtcttt

SEQ ID NO: 5834705 - DNA, 18 bp, Homo sapiens
actttctttcagatgttt

SEQ ID NO: 5834706 - DNA, 13 bp, Homo sapiens
actttctttctca

SEQ ID NO: 5834707 - DNA, 23 bp, Homo sapiens
actttctttttgtagctggggct

SEQ ID NO: 5834708 - DNA, 17 bp, Homo sapiens
actttcttttttgatat

SEQ ID NO: 5834709 - DNA, 23 bp, Homo sapiens
actttcttttttgatatagaagt

SEQ ID NO: 5834710 - DNA, 22 bp, Homo sapiens
actttcttttttttctatttca

SEQ ID NO: 5834711 - DNA, 23 bp, Homo sapiens
actttcttttttttctatttcac

SEQ ID NO: 5834712 - DNA, 16 bp, Homo sapiens
actttgaaaaagatat

SEQ ID NO: 5834713 - DNA, 17 bp, Homo sapiens
actttgaaaaagatatt

SEQ ID NO: 5834714 - DNA, 18 bp, Homo sapiens
actttgaaaacaattcag

SEQ ID NO: 5834715 - DNA, 14 bp, Homo sapiens
actttgaaaatatt

SEQ ID NO: 5834716 - DNA, 20 bp, Homo sapiens
actttgaaaatatttctatg

SEQ ID NO: 5834717 - DNA, 18 bp, Homo sapiens
actttgaaaggagatgtc

SEQ ID NO: 5834718 - DNA, 16 bp, Homo sapiens
actttgaaatacctca

SEQ ID NO: 5834719 - DNA, 17 bp, Homo sapiens
actttgaaatacctcat

SEQ ID NO: 5834720 - DNA, 21 bp, Homo sapiens
actttgaaatacctcatgttt

SEQ ID NO: 5834721 - DNA, 13 bp, Homo sapiens
actttgaaatatt

SEQ ID NO: 5834722 - DNA, 19 bp, Homo sapiens
actttgaaatgtgtttctg

SEQ ID NO: 5834723 - DNA, 23 bp, Homo sapiens
actttgaaatgtgtttctgtata

SEQ ID NO: 5834724 - DNA, 22 bp, Homo sapiens
actttgaacattaatgttgaaa

SEQ ID NO: 5834725 - DNA, 13 bp, Homo sapiens
actttgaactgaa

SEQ ID NO: 5834726 - DNA, 23 bp, Homo sapiens
actttgaagcaaatacaattcac

SEQ ID NO: 5834727 - DNA, 17 bp, Homo sapiens
actttgaaggtaataaa

SEQ ID NO: 5834728 - DNA, 16 bp, Homo sapiens
actttgaagtgcagct

SEQ ID NO: 5834729 - DNA, 12 bp, Homo sapiens
actttgaataaa

SEQ ID NO: 5834730 - DNA, 17 bp, Homo sapiens
actttttggtggatgta

SEQ ID NO: 5834731 - DNA, 21 bp, Homo sapiens
actttttggtggatgtaaata

SEQ ID NO: 5834732 - DNA, 18 bp, Homo sapiens
actttttggtttgcagat

SEQ ID NO: 5834733 - DNA, 13 bp, Homo sapiens
actttttgtaaat

SEQ ID NO: 5834734 - DNA, 19 bp, Homo sapiens
actttttgtaggatacttg

SEQ ID NO: 5834735 - DNA, 22 bp, Homo sapiens
actttttgtattttttccttaa

SEQ ID NO: 5834736 - DNA, 23 bp, Homo sapiens
actttttgtgaagacggcacggt

SEQ ID NO: 5834737 - DNA, 13 bp, Homo sapiens
actttttgttcat

SEQ ID NO: 5834738 - DNA, 18 bp, Homo sapiens
actttttgttctggtcct

SEQ ID NO: 5834739 - DNA, 23 bp, Homo sapiens
actttttgttttgtttcttcctt

SEQ ID NO: 5834740 - DNA, 19 bp, Homo sapiens
acttttttaaataaacttt

SEQ ID NO: 5834741 - DNA, 21 bp, Homo sapiens
acttttttaaataaacttttt

SEQ ID NO: 5834742 - DNA, 17 bp, Homo sapiens
acttttttaaatataaa

SEQ ID NO: 5834743 - DNA, 16 bp, Homo sapiens
acttttttaaatattt

SEQ ID NO: 5834744 - DNA, 23 bp, Homo sapiens
acttttttataaattataatgca

SEQ ID NO: 5834745 - DNA, 18 bp, Homo sapiens
acttttttatccacctcc

SEQ ID NO: 5834746 - DNA, 22 bp, Homo sapiens
acttttttatccacctccctac

SEQ ID NO: 5834747 - DNA, 18 bp, Homo sapiens
acttttttatgaagaaaa

SEQ ID NO: 5834748 - DNA, 14 bp, Homo sapiens
acttttttcaaaat

SEQ ID NO: 5834749 - DNA, 19 bp, Homo sapiens
acttttttcaaatattgaa

SEQ ID NO: 5834750 - DNA, 22 bp, Homo sapiens
acttttttctttgaaatgctaa

SEQ ID NO: 5834751 - DNA, 23 bp, Homo sapiens
acttttttctttgaaatgctaaa

SEQ ID NO: 5834752 - DNA, 21 bp, Homo sapiens
acttttttgaaataataaatc

SEQ ID NO: 5834753 - DNA, 21 bp, Homo sapiens
acttttttgagacatgggatc

SEQ ID NO: 5834754 - DNA, 14 bp, Homo sapiens
acttttttgattaa

SEQ ID NO: 5834755 - DNA, 23 bp, Homo sapiens
acttttttgctatccagctattt

SEQ ID NO: 5834756 - DNA, 12 bp, Homo sapiens
acttttttggaa

SEQ ID NO: 5834757 - DNA, 22 bp, Homo sapiens
acttttttggtactataaaagc

SEQ ID NO: 5834758 - DNA, 17 bp, Homo sapiens
acttttttgtgtatgta

SEQ ID NO: 5834759 - DNA, 19 bp, Homo sapiens
acttttttgtgtatgtact

SEQ ID NO: 5834760 - DNA, 12 bp, Homo sapiens
actttttttagt

SEQ ID NO: 5834761 - DNA, 13 bp, Homo sapiens
actttttttcaat

SEQ ID NO: 5834762 - DNA, 20 bp, Homo sapiens
actttttttctgtaccagtt

SEQ ID NO: 5834763 - DNA, 18 bp, Homo sapiens
actttttttctgtgacat

SEQ ID NO: 5834764 - DNA, 19 bp, Homo sapiens
actttttttctgtgacatt

SEQ ID NO: 5834765 - DNA, 14 bp, Homo sapiens
actttttttgtatg

SEQ ID NO: 5834766 - DNA, 15 bp, Homo sapiens
acttttttttaagtt

SEQ ID NO: 5834767 - DNA, 20 bp, Homo sapiens
actttttttttatactgcac

SEQ ID NO: 5834768 - DNA, 22 bp, Homo sapiens
actttttttttccaaaaaaata

SEQ ID NO: 5834769 - DNA, 22 bp, Homo sapiens
actttttttttttaagagtaaa

SEQ ID NO: 5834770 - DNA, 22 bp, Homo sapiens
actttttttttttctgcctgag

SEQ ID NO: 5834771 - DNA, 20 bp, Homo sapiens
acttttttttttttaacatc

SEQ ID NO: 5834772 - DNA, 21 bp, Homo sapiens
acttttttttttttaacatct

SEQ ID NO: 5834773 - DNA, 21 bp, Homo sapiens
actttttttttttttgagatg

SEQ ID NO: 5834774 - DNA, 15 bp, Homo sapiens
agaaaaaaaaaagaa

SEQ ID NO: 5834775 - DNA, 16 bp, Homo sapiens
agaaaaaaaaaagaag

SEQ ID NO: 5834776 - DNA, 17 bp, Homo sapiens
agaaaaaaaaaagaaga

SEQ ID NO: 5834777 - DNA, 20 bp, Homo sapiens
agaaaaaaaaaagaagaaga

SEQ ID NO: 5834778 - DNA, 18 bp, Homo sapiens
agaaaaaaaaaatgattg

SEQ ID NO: 5834779 - DNA, 14 bp, Homo sapiens
agaaaaaaaaagaa

SEQ ID NO: 5834780 - DNA, 15 bp, Homo sapiens
agaaaaaaaaagaaa

SEQ ID NO: 5834781 - DNA, 20 bp, Homo sapiens
agaaaaaaaaagcaaatcag

SEQ ID NO: 5834782 - DNA, 21 bp, Homo sapiens
agaaaaaaaaagcaaatcaga

SEQ ID NO: 5834783 - DNA, 20 bp, Homo sapiens
agaaaaaaaaagtgaaaaaa

SEQ ID NO: 5834784 - DNA, 22 bp, Homo sapiens
agaaaaaaaaagtgaaaaaaag

SEQ ID NO: 5834785 - DNA, 23 bp, Homo sapiens
agaaaaaaaaagtgaaaaaaaga

SEQ ID NO: 5834786 - DNA, 15 bp, Homo sapiens
agaaaaaaaaatact

SEQ ID NO: 5834787 - DNA, 14 bp, Homo sapiens
agaaaaaaaaatat

SEQ ID NO: 5834788 - DNA, 16 bp, Homo sapiens
agaaaaaaaaatatgt

SEQ ID NO: 5834789 - DNA, 20 bp, Homo sapiens
agaaaaaaaaatatgtgtac

SEQ ID NO: 5834790 - DNA, 16 bp, Homo sapiens
agaaaaaaaaatgcca

SEQ ID NO: 5834791 - DNA, 22 bp, Homo sapiens
agaaaaaaaaatgccataatac

SEQ ID NO: 5834792 - DNA, 23 bp, Homo sapiens
agaaaaaaaaatgccataataca

SEQ ID NO: 5834793 - DNA, 13 bp, Homo sapiens
agaaaaaaaacac

SEQ ID NO: 5834794 - DNA, 14 bp, Homo sapiens
agaaaaaaaagaaa

SEQ ID NO: 5834795 - DNA, 16 bp, Homo sapiens
agaaaaaaaagtgtct

SEQ ID NO: 5834796 - DNA, 19 bp, Homo sapiens
agaaaaaaaataacacaga

SEQ ID NO: 5834797 - DNA, 12 bp, Homo sapiens
agaaaaaaacaa

SEQ ID NO: 5834798 - DNA, 22 bp, Homo sapiens
agaaaaaaacattctatctact

SEQ ID NO: 5834799 - DNA, 14 bp, Homo sapiens
agaaaaaaaccaaa

SEQ ID NO: 5834800 - DNA, 18 bp, Homo sapiens
agaaaaaaaccacacaaa

SEQ ID NO: 5834801 - DNA, 15 bp, Homo sapiens
agaaaaaaagaaaaa

SEQ ID NO: 5834802 - DNA, 21 bp, Homo sapiens
agaaaaaaagaaaaaaaaaga

SEQ ID NO: 5834803 - DNA, 16 bp, Homo sapiens
agaaaaaaagaaatta

SEQ ID NO: 5834804 - DNA, 17 bp, Homo sapiens
agaaaaaaagatttatt

SEQ ID NO: 5834805 - DNA, 21 bp, Homo sapiens
agaaaaaaagtttgccagaag

SEQ ID NO: 5834806 - DNA, 15 bp, Homo sapiens
agaaaaaaataacta

SEQ ID NO: 5834807 - DNA, 22 bp, Homo sapiens
agaaaaaaataactattttgtt

SEQ ID NO: 5834808 - DNA, 22 bp, Homo sapiens
agaaaaaaataattttatgaac

SEQ ID NO: 5834809 - DNA, 12 bp, Homo sapiens
agaaaaaaatat

SEQ ID NO: 5834810 - DNA, 19 bp, Homo sapiens
agaaaaaaatatattttat

SEQ ID NO: 5834811 - DNA, 23 bp, Homo sapiens
agaaaaaaatatattttatgatt

SEQ ID NO: 5834812 - DNA, 16 bp, Homo sapiens
agaaaaaaatcttctc

SEQ ID NO: 5834813 - DNA, 16 bp, Homo sapiens
agaaaaaaatgtattt

SEQ ID NO: 5834814 - DNA, 20 bp, Homo sapiens
agaaaaaaatgtcaaaagta

SEQ ID NO: 5834815 - DNA, 13 bp, Homo sapiens
agaaaaaaattca

SEQ ID NO: 5834816 - DNA, 16 bp, Homo sapiens
agaaaaaaattgaaat

SEQ ID NO: 5834817 - DNA, 17 bp, Homo sapiens
agaaaaaaattgaaatg

SEQ ID NO: 5834818 - DNA, 12 bp, Homo sapiens
agaaaaaacaat

SEQ ID NO: 5834819 - DNA, 10 bp, Homo sapiens
agaaaaaaga

SEQ ID NO: 5834820 - DNA, 16 bp, Homo sapiens
agaaaaaagaatgtca

SEQ ID NO: 5834821 - DNA, 17 bp, Homo sapiens
agaaaaaaggactgtat

SEQ ID NO: 5834822 - DNA, 13 bp, Homo sapiens
agaaaaaagggtt

SEQ ID NO: 5834823 - DNA, 20 bp, Homo sapiens
agaaaaaagggtttatgctt

SEQ ID NO: 5834824 - DNA, 22 bp, Homo sapiens
agaaaaaaggttctttgtgtat

SEQ ID NO: 5834825 - DNA, 19 bp, Homo sapiens
agaaaaaagtcaccattct

SEQ ID NO: 5834826 - DNA, 12 bp, Homo sapiens
agaaaaaagttg

SEQ ID NO: 5834827 - DNA, 18 bp, Homo sapiens
agaaaaaataacacacat

SEQ ID NO: 5834828 - DNA, 18 bp, Homo sapiens
agaaaaaatacattttat

SEQ ID NO: 5834829 - DNA, 14 bp, Homo sapiens
agaaaaaatattgt

SEQ ID NO: 5834830 - DNA, 17 bp, Homo sapiens
agaaaaaatattttccc

SEQ ID NO: 5834831 - DNA, 13 bp, Homo sapiens
agaaaaaatggca

SEQ ID NO: 5834832 - DNA, 22 bp, Homo sapiens
agaaaaaatggcaagagatcat

SEQ ID NO: 5834833 - DNA, 21 bp, Homo sapiens
agaaaaaattaagagatacat

SEQ ID NO: 5834834 - DNA, 21 bp, Homo sapiens
agaaaaaattttaaaaatcta

SEQ ID NO: 5834835 - DNA, 11 bp, Homo sapiens
agaaaaacaaa

SEQ ID NO: 5834836 - DNA, 13 bp, Homo sapiens
agaaaaacaaatc

SEQ ID NO: 5834837 - DNA, 18 bp, Homo sapiens
agaaaaacaataaagata

SEQ ID NO: 5834838 - DNA, 15 bp, Homo sapiens
agaaaaacagacaaa

SEQ ID NO: 5834839 - DNA, 14 bp, Homo sapiens
agaaaaacaggcac

SEQ ID NO: 5834840 - DNA, 15 bp, Homo sapiens
agaaaaacaggcact

SEQ ID NO: 5834841 - DNA, 12 bp, Homo sapiens
agaaaaacatgt

SEQ ID NO: 5834842 - DNA, 14 bp, Homo sapiens
agaaaaacatgtca

SEQ ID NO: 5834843 - DNA, 16 bp, Homo sapiens
agaaaaacatgtcatg

SEQ ID NO: 5834844 - DNA, 13 bp, Homo sapiens
agaaaaacattta

SEQ ID NO: 5834845 - DNA, 14 bp, Homo sapiens
agaaaaaccaatga

SEQ ID NO: 5834846 - DNA, 16 bp, Homo sapiens
agaaaaaccaatgatt

SEQ ID NO: 5834847 - DNA, 19 bp, Homo sapiens
agaaaaaccagaggcagct

SEQ ID NO: 5834848 - DNA, 10 bp, Homo sapiens
agaaaaagaa

SEQ ID NO: 5834849 - DNA, 12 bp, Homo sapiens
agaaaaagaaca

SEQ ID NO: 5834850 - DNA, 20 bp, Homo sapiens
agaaaaagcaataacctcaa

SEQ ID NO: 5834851 - DNA, 16 bp, Homo sapiens
agaaaaagcacagctc

SEQ ID NO: 5834852 - DNA, 14 bp, Homo sapiens
agaaaaaggaaaag

SEQ ID NO: 5834853 - DNA, 13 bp, Homo sapiens
agaaaaaggaaat

SEQ ID NO: 5834854 - DNA, 17 bp, Homo sapiens
agaaaaaggatgcacag

SEQ ID NO: 5834855 - DNA, 13 bp, Homo sapiens
agaaaaaggatgg

SEQ ID NO: 5834856 - DNA, 21 bp, Homo sapiens
agaaaaaggctgaaaagaagg

SEQ ID NO: 5834857 - DNA, 15 bp, Homo sapiens
agaaaaagggctgcc

SEQ ID NO: 5834858 - DNA, 14 bp, Homo sapiens
agaaaaagtacaat

SEQ ID NO: 5834859 - DNA, 13 bp, Homo sapiens
agaaaaagtagaa

SEQ ID NO: 5834860 - DNA, 14 bp, Homo sapiens
agaaaaagtcctgt

SEQ ID NO: 5834861 - DNA, 15 bp, Homo sapiens
agaaaaataaaatgt

SEQ ID NO: 5834862 - DNA, 16 bp, Homo sapiens
agaaaaataaaatgtt

SEQ ID NO: 5834863 - DNA, 18 bp, Homo sapiens
agaaaaataaaatttcct

SEQ ID NO: 5834864 - DNA, 13 bp, Homo sapiens
agaaaaataaaga

SEQ ID NO: 5834865 - DNA, 20 bp, Homo sapiens
agaaaaataaagaaaagatg

SEQ ID NO: 5834866 - DNA, 14 bp, Homo sapiens
agaaaaatactttg

SEQ ID NO: 5834867 - DNA, 15 bp, Homo sapiens
agaaaaatatctgta

SEQ ID NO: 5834868 - DNA, 18 bp, Homo sapiens
agaaaaatatctgtaaga

SEQ ID NO: 5834869 - DNA, 11 bp, Homo sapiens
agaaaaatatt

SEQ ID NO: 5834870 - DNA, 20 bp, Homo sapiens
agaaaaatattaataagaca

SEQ ID NO: 5834871 - DNA, 13 bp, Homo sapiens
agaaaaatcaaag

SEQ ID NO: 5834872 - DNA, 12 bp, Homo sapiens
agaaaaatcagt

SEQ ID NO: 5834873 - DNA, 14 bp, Homo sapiens
agaaaaatcatgtt

SEQ ID NO: 5834874 - DNA, 22 bp, Homo sapiens
agaaaaatctcattatttcaaa

SEQ ID NO: 5834875 - DNA, 13 bp, Homo sapiens
agaaaaatgaaaa

SEQ ID NO: 5834876 - DNA, 17 bp, Homo sapiens
agaaaaatgaaaagcaa

SEQ ID NO: 5834877 - DNA, 17 bp, Homo sapiens
agaaaaatgagcctggc

SEQ ID NO: 5834878 - DNA, 17 bp, Homo sapiens
agaaaaatgcctgtctc

SEQ ID NO: 5834879 - DNA, 23 bp, Homo sapiens
agaaaaatgctgttcagaaatat

SEQ ID NO: 5834880 - DNA, 23 bp, Homo sapiens
agaaaaatgcttgaccctgaaat

SEQ ID NO: 5834881 - DNA, 15 bp, Homo sapiens
agaaaaattaattag

SEQ ID NO: 5834882 - DNA, 19 bp, Homo sapiens
agaaaaattaattctcttg

SEQ ID NO: 5834883 - DNA, 15 bp, Homo sapiens
agaaaaattacagat

SEQ ID NO: 5834884 - DNA, 13 bp, Homo sapiens
agaaaaattcaca

SEQ ID NO: 5834885 - DNA, 20 bp, Homo sapiens
agaaaaattcagcaaaccat

SEQ ID NO: 5834886 - DNA, 19 bp, Homo sapiens
agaaaaatttctggcaaat

SEQ ID NO: 5834887 - DNA, 22 bp, Homo sapiens
agaaaaatttctggcaaatatt

SEQ ID NO: 5834888 - DNA, 21 bp, Homo sapiens
agaaaacaaaaaacgaatgaa

SEQ ID NO: 5834889 - DNA, 21 bp, Homo sapiens
agaaaacaaaaccaaaagtta

SEQ ID NO: 5834890 - DNA, 17 bp, Homo sapiens
agaaaacaaatcttcaa

SEQ ID NO: 5834891 - DNA, 18 bp, Homo sapiens
agaaaacaacaaaagaat

SEQ ID NO: 5834892 - DNA, 18 bp, Homo sapiens
agaaaacaacttggcatt

SEQ ID NO: 5834893 - DNA, 16 bp, Homo sapiens
agaaaacaagcaagtt

SEQ ID NO: 5834894 - DNA, 21 bp, Homo sapiens
agaaaacaagcaagttctgag

SEQ ID NO: 5834895 - DNA, 16 bp, Homo sapiens
agaaaacaaggatgaa

SEQ ID NO: 5834896 - DNA, 14 bp, Homo sapiens
agaaaacaatggaa

SEQ ID NO: 5834897 - DNA, 16 bp, Homo sapiens
agaaaacacatttctg

SEQ ID NO: 5834898 - DNA, 14 bp, Homo sapiens
agaaaacactgtta

SEQ ID NO: 5834899 - DNA, 21 bp, Homo sapiens
agaaaacactgttatcatttt

SEQ ID NO: 5834900 - DNA, 12 bp, Homo sapiens
agaaaacacttt

SEQ ID NO: 5834901 - DNA, 13 bp, Homo sapiens
agaaaacactttc

SEQ ID NO: 5834902 - DNA, 13 bp, Homo sapiens
agaaaacagaaaa

SEQ ID NO: 5834903 - DNA, 16 bp, Homo sapiens
agaaaacagaaaacaa

SEQ ID NO: 5834904 - DNA, 13 bp, Homo sapiens
agaaaacagagcc

SEQ ID NO: 5834905 - DNA, 18 bp, Homo sapiens
agaaaacagagcctgcct

SEQ ID NO: 5834906 - DNA, 14 bp, Homo sapiens
agaaaacagccact

SEQ ID NO: 5834907 - DNA, 22 bp, Homo sapiens
agaaaacaggaaaaaaactttt

SEQ ID NO: 5834908 - DNA, 16 bp, Homo sapiens
agaaaacatagcacta

SEQ ID NO: 5834909 - DNA, 22 bp, Homo sapiens
agaaagccacgccctccctgct

SEQ ID NO: 5834910 - DNA, 17 bp, Homo sapiens
agaaagccagacaactt

SEQ ID NO: 5834911 - DNA, 16 bp, Homo sapiens
agaaagccatattcca

SEQ ID NO: 5834912 - DNA, 18 bp, Homo sapiens
agaaagccatattccagc

SEQ ID NO: 5834913 - DNA, 13 bp, Homo sapiens
agaaagcccacct

SEQ ID NO: 5834914 - DNA, 15 bp, Homo sapiens
agaaagcccacctgg

SEQ ID NO: 5834915 - DNA, 19 bp, Homo sapiens
agaaagccctaaaatacta

SEQ ID NO: 5834916 - DNA, 20 bp, Homo sapiens
agaaagcccttaggaagaat

SEQ ID NO: 5834917 - DNA, 18 bp, Homo sapiens
agaaagcctaaaattgag

SEQ ID NO: 5834918 - DNA, 20 bp, Homo sapiens
agaaagcctccgctgggctt

SEQ ID NO: 5834919 - DNA, 21 bp, Homo sapiens
agaaagcctcctctggagaat

SEQ ID NO: 5834920 - DNA, 18 bp, Homo sapiens
agaaagcctgggtgacat

SEQ ID NO: 5834921 - DNA, 21 bp, Homo sapiens
agaaagcctgggtgacatttg

SEQ ID NO: 5834922 - DNA, 20 bp, Homo sapiens
agaaagcctgttcccctcac

SEQ ID NO: 5834923 - DNA, 15 bp, Homo sapiens
agaaagccttctttt

SEQ ID NO: 5834924 - DNA, 20 bp, Homo sapiens
agaaagcctttcattttgct

SEQ ID NO: 5834925 - DNA, 15 bp, Homo sapiens
agaaagctaaagtga

SEQ ID NO: 5834926 - DNA, 11 bp, Homo sapiens
agaaagctaat

SEQ ID NO: 5834927 - DNA, 15 bp, Homo sapiens
agaaagctaatacaa

SEQ ID NO: 5834928 - DNA, 20 bp, Homo sapiens
agaaagctgacttggctggt

SEQ ID NO: 5834929 - DNA, 22 bp, Homo sapiens
agaaagctgacttggctggtgt

SEQ ID NO: 5834930 - DNA, 23 bp, Homo sapiens
agaaagctgacttggctggtgtg

SEQ ID NO: 5834931 - DNA, 13 bp, Homo sapiens
agaaagctgcctg

SEQ ID NO: 5834932 - DNA, 13 bp, Homo sapiens
agaaagctgcgga

SEQ ID NO: 5834933 - DNA, 14 bp, Homo sapiens
agaaagctggactg

SEQ ID NO: 5834934 - DNA, 16 bp, Homo sapiens
agaaagctggtaaact

SEQ ID NO: 5834935 - DNA, 20 bp, Homo sapiens
agaaagctggtaaactattt

SEQ ID NO: 5834936 - DNA, 18 bp, Homo sapiens
agaaagctgtgaaattga

SEQ ID NO: 5834937 - DNA, 22 bp, Homo sapiens
agaaagctgtgaacaggctggg

SEQ ID NO: 5834938 - DNA, 17 bp, Homo sapiens
agaaagcttaatatatt

SEQ ID NO: 5834939 - DNA, 21 bp, Homo sapiens
agaaagcttaatatattccca

SEQ ID NO: 5834940 - DNA, 13 bp, Homo sapiens
agaaagcttcctt

SEQ ID NO: 5834941 - DNA, 12 bp, Homo sapiens
agaaagcttctt

SEQ ID NO: 5834942 - DNA, 18 bp, Homo sapiens
agaaagctttatatgtaa

SEQ ID NO: 5834943 - DNA, 14 bp, Homo sapiens
agaaaggaaaagaa

SEQ ID NO: 5834944 - DNA, 15 bp, Homo sapiens
agaaaggaaaccttt

SEQ ID NO: 5834945 - DNA, 13 bp, Homo sapiens
agaaaggaaagaa

SEQ ID NO: 5834946 - DNA, 16 bp, Homo sapiens
agaaaggaaagaagga

SEQ ID NO: 5834947 - DNA, 23 bp, Homo sapiens
agaaaggaaatgagatgacagta

SEQ ID NO: 5834948 - DNA, 17 bp, Homo sapiens
agaaaggaacctgggat

SEQ ID NO: 5834949 - DNA, 13 bp, Homo sapiens
agaaaggaagcaa

SEQ ID NO: 5834950 - DNA, 14 bp, Homo sapiens
agaaaggactctgg

SEQ ID NO: 5834951 - DNA, 11 bp, Homo sapiens
agaaaggactg

SEQ ID NO: 5834952 - DNA, 19 bp, Homo sapiens
agaaaggagaaattttggt

SEQ ID NO: 5834953 - DNA, 13 bp, Homo sapiens
agaaaggagagaa

SEQ ID NO: 5834954 - DNA, 19 bp, Homo sapiens
agaaaggagctctgaatct

SEQ ID NO: 5834955 - DNA, 18 bp, Homo sapiens
agaaaggagctgagatga

SEQ ID NO: 5834956 - DNA, 17 bp, Homo sapiens
agaaaggagtagttttc

SEQ ID NO: 5834957 - DNA, 16 bp, Homo sapiens
agaaaggataaagttg

SEQ ID NO: 5834958 - DNA, 14 bp, Homo sapiens
agaaaggatattta

SEQ ID NO: 5834959 - DNA, 20 bp, Homo sapiens
agaaaggatggcagcctcag

SEQ ID NO: 5834960 - DNA, 23 bp, Homo sapiens
agaaaggattaagatacactcct

SEQ ID NO: 5834961 - DNA, 17 bp, Homo sapiens
agaaaggcaaatctgac

SEQ ID NO: 5834962 - DNA, 18 bp, Homo sapiens
agaaaggcaaatctgact

SEQ ID NO: 5834963 - DNA, 17 bp, Homo sapiens
agaaaggcagagattgg

SEQ ID NO: 5834964 - DNA, 21 bp, Homo sapiens
agaaaggcagccctcacctct

SEQ ID NO: 5834965 - DNA, 16 bp, Homo sapiens
agaaaggcaggtttca

SEQ ID NO: 5834966 - DNA, 14 bp, Homo sapiens
agaaaggcctttaa

SEQ ID NO: 5834967 - DNA, 15 bp, Homo sapiens
agaaaggcctttaaa

SEQ ID NO: 5834968 - DNA, 16 bp, Homo sapiens
agaaaggcctttaaaa

SEQ ID NO: 5834969 - DNA, 19 bp, Homo sapiens
agaaaggcctttaaaattt

SEQ ID NO: 5834970 - DNA, 12 bp, Homo sapiens
agaaaggctgca

SEQ ID NO: 5834971 - DNA, 16 bp, Homo sapiens
agaaagggaaagctgt

SEQ ID NO: 5834972 - DNA, 14 bp, Homo sapiens
agaaagggacccac

SEQ ID NO: 5834973 - DNA, 22 bp, Homo sapiens
agaaagggagaaggattctttt

SEQ ID NO: 5834974 - DNA, 17 bp, Homo sapiens
agaaagggagaggaaga

SEQ ID NO: 5834975 - DNA, 14 bp, Homo sapiens
agaaagggagggct

SEQ ID NO: 5834976 - DNA, 15 bp, Homo sapiens
agaaagggagggctc

SEQ ID NO: 5834977 - DNA, 20 bp, Homo sapiens
agaaagggagggctctgagg

SEQ ID NO: 5834978 - DNA, 14 bp, Homo sapiens
agaaagggcaaatt

SEQ ID NO: 5834979 - DNA, 19 bp, Homo sapiens
agaaagggcagcccctccc

SEQ ID NO: 5834980 - DNA, 16 bp, Homo sapiens
agaaaggggagcccac

SEQ ID NO: 5834981 - DNA, 21 bp, Homo sapiens
agaaaggggcaagaaattcat

SEQ ID NO: 5834982 - DNA, 17 bp, Homo sapiens
agaaaggggcaggagct

SEQ ID NO: 5834983 - DNA, 22 bp, Homo sapiens
agaaaggggcaggagctcagat

SEQ ID NO: 5834984 - DNA, 22 bp, Homo sapiens
agaaaggggcccattcagcctc

SEQ ID NO: 5834985 - DNA, 20 bp, Homo sapiens
agaaaggggctagcactgga

SEQ ID NO: 5834986 - DNA, 21 bp, Homo sapiens
agaaaggggtgattgaaagaa

SEQ ID NO: 5834987 - DNA, 22 bp, Homo sapiens
agaaaggggtgattgaaagaaa

SEQ ID NO: 5834988 - DNA, 14 bp, Homo sapiens
agaaagggtgtttt

SEQ ID NO: 5834989 - DNA, 14 bp, Homo sapiens
agaaaggtctctgg

SEQ ID NO: 5834990 - DNA, 22 bp, Homo sapiens
agaaaggtgagtttgagctgcc

SEQ ID NO: 5834991 - DNA, 21 bp, Homo sapiens
agaaaggtgtgaggagagagg

SEQ ID NO: 5834992 - DNA, 21 bp, Homo sapiens
agaaaggttttgagcatgggt

SEQ ID NO: 5834993 - DNA, 14 bp, Homo sapiens
agaaagtaaaacca

SEQ ID NO: 5834994 - DNA, 18 bp, Homo sapiens
agaaagtaagaaaacaat

SEQ ID NO: 5834995 - DNA, 16 bp, Homo sapiens
agaaagtaagcatttc

SEQ ID NO: 5834996 - DNA, 17 bp, Homo sapiens
agaaagtaagtcttttt

SEQ ID NO: 5834997 - DNA, 21 bp, Homo sapiens
agaaagtaatttaatttgtaa

SEQ ID NO: 5834998 - DNA, 15 bp, Homo sapiens
agaaagtaatttctt

SEQ ID NO: 5834999 - DNA, 14 bp, Homo sapiens
agaaagtacccagc

SEQ ID NO: 5835000 - DNA, 16 bp, Homo sapiens
agaaagtacccagcaa

SEQ ID NO: 5835001 - DNA, 22 bp, Homo sapiens
agaaagtaccctcttttaccaa

SEQ ID NO: 5835002 - DNA, 22 bp, Homo sapiens
agaaagtacttctccaccctgc

SEQ ID NO: 5835003 - DNA, 23 bp, Homo sapiens
agaaagtacttctccaccctgct

SEQ ID NO: 5835004 - DNA, 14 bp, Homo sapiens
agaaagtaggagtg

SEQ ID NO: 5835005 - DNA, 14 bp, Homo sapiens
agaaagtcccccct

SEQ ID NO: 5835006 - DNA, 22 bp, Homo sapiens
agaaagtcttatttattcatat

SEQ ID NO: 5835007 - DNA, 14 bp, Homo sapiens
agaaagtgaaagca

SEQ ID NO: 5835008 - DNA, 23 bp, Homo sapiens
agaaagtgaagcaaatcagaaac

SEQ ID NO: 5835009 - DNA, 15 bp, Homo sapiens
agaaagtgaataaaa

SEQ ID NO: 5835010 - DNA, 14 bp, Homo sapiens
agaaagtgagcagt

SEQ ID NO: 5835011 - DNA, 17 bp, Homo sapiens
agaaagtgcagcatgga

SEQ ID NO: 5835012 - DNA, 23 bp, Homo sapiens
agaaagtgcctttatctcagcca

SEQ ID NO: 5835013 - DNA, 14 bp, Homo sapiens
agaaagtgcctttc

SEQ ID NO: 5835014 - DNA, 20 bp, Homo sapiens
agaaagtggaaaacaaggaa

SEQ ID NO: 5835015 - DNA, 18 bp, Homo sapiens
agaaagtggcagagccag

SEQ ID NO: 5835016 - DNA, 19 bp, Homo sapiens
agaaagtgggaggtcagga

SEQ ID NO: 5835017 - DNA, 22 bp, Homo sapiens
agaaagtgggaggtcaggaaac

SEQ ID NO: 5835018 - DNA, 13 bp, Homo sapiens
agaaagtgggggt

SEQ ID NO: 5835019 - DNA, 14 bp, Homo sapiens
agaaagtggtgctc

SEQ ID NO: 5835020 - DNA, 21 bp, Homo sapiens
agaaagtggtgctcagttgta

SEQ ID NO: 5835021 - DNA, 11 bp, Homo sapiens
agaaagtgtat

SEQ ID NO: 5835022 - DNA, 16 bp, Homo sapiens
agaaagtgtgctttat

SEQ ID NO: 5835023 - DNA, 22 bp, Homo sapiens
agaaagtgtgctttatgctgaa

SEQ ID NO: 5835024 - DNA, 16 bp, Homo sapiens
agaaagtgttctgtta

SEQ ID NO: 5835025 - DNA, 20 bp, Homo sapiens
agaaagtgttttattttcaa

SEQ ID NO: 5835026 - DNA, 12 bp, Homo sapiens
agaaagttattg

SEQ ID NO: 5835027 - DNA, 14 bp, Homo sapiens
agaaagttcatgct

SEQ ID NO: 5835028 - DNA, 22 bp, Homo sapiens
agaaagttctgtgtaaacagaa

SEQ ID NO: 5835029 - DNA, 17 bp, Homo sapiens
agaaagttgcacggctg

SEQ ID NO: 5835030 - DNA, 21 bp, Homo sapiens
agaaagttgcacggctgctga

SEQ ID NO: 5835031 - DNA, 20 bp, Homo sapiens
agaaagttggaaaggaaaaa

SEQ ID NO: 5835032 - DNA, 15 bp, Homo sapiens
agaaagtttgaagca

SEQ ID NO: 5835033 - DNA, 19 bp, Homo sapiens
agaaataaaacaactctga

SEQ ID NO: 5835034 - DNA, 14 bp, Homo sapiens
agaaataaaagatg

SEQ ID NO: 5835035 - DNA, 19 bp, Homo sapiens
agaaataaaaggaagccaa

SEQ ID NO: 5835036 - DNA, 20 bp, Homo sapiens
agaaataaaaggaagccaaa

SEQ ID NO: 5835037 - DNA, 18 bp, Homo sapiens
agaaataaaatcaccctg

SEQ ID NO: 5835038 - DNA, 23 bp, Homo sapiens
agaaataaaccttaatatttctt

SEQ ID NO: 5835039 - DNA, 21 bp, Homo sapiens
agaaataaagttggtgacaga

SEQ ID NO: 5835040 - DNA, 18 bp, Homo sapiens
agaaataaagtttctgtt

SEQ ID NO: 5835041 - DNA, 19 bp, Homo sapiens
agaaataaatagctatatc

SEQ ID NO: 5835042 - DNA, 20 bp, Homo sapiens
agaaataaatcagagagcaa

SEQ ID NO: 5835043 - DNA, 12 bp, Homo sapiens
agaaataaatga

SEQ ID NO: 5835044 - DNA, 14 bp, Homo sapiens
agaaataaatgaaa

SEQ ID NO: 5835045 - DNA, 14 bp, Homo sapiens
agaaataaattact

SEQ ID NO: 5835046 - DNA, 23 bp, Homo sapiens
agaaataaattcctaaactccct

SEQ ID NO: 5835047 - DNA, 15 bp, Homo sapiens
agaaataaattttgt

SEQ ID NO: 5835048 - DNA, 13 bp, Homo sapiens
agaaataacagaa

SEQ ID NO: 5835049 - DNA, 21 bp, Homo sapiens
agaaataacagaagaaaatag

SEQ ID NO: 5835050 - DNA, 17 bp, Homo sapiens
agaaataagaataaagt

SEQ ID NO: 5835051 - DNA, 21 bp, Homo sapiens
agaaataagtggttatttctc

SEQ ID NO: 5835052 - DNA, 13 bp, Homo sapiens
agaaataagtttt

SEQ ID NO: 5835053 - DNA, 17 bp, Homo sapiens
agaaataataaaaagaa

SEQ ID NO: 5835054 - DNA, 13 bp, Homo sapiens
agaaataataata

SEQ ID NO: 5835055 - DNA, 14 bp, Homo sapiens
agaaataatatgca

SEQ ID NO: 5835056 - DNA, 16 bp, Homo sapiens
agaaataatatgcatt

SEQ ID NO: 5835057 - DNA, 22 bp, Homo sapiens
agaaataatgctacaattttaa

SEQ ID NO: 5835058 - DNA, 16 bp, Homo sapiens
agaaataattgttgat

SEQ ID NO: 5835059 - DNA, 12 bp, Homo sapiens
agaaatacaaaa

SEQ ID NO: 5835060 - DNA, 20 bp, Homo sapiens
agaaatacaaaaaattagct

SEQ ID NO: 5835061 - DNA, 14 bp, Homo sapiens
agaaatacaaaata

SEQ ID NO: 5835062 - DNA, 22 bp, Homo sapiens
agaaatacacagggaggggatg

SEQ ID NO: 5835063 - DNA, 15 bp, Homo sapiens
agaaatacagctggc

SEQ ID NO: 5835064 - DNA, 17 bp, Homo sapiens
agaaatacagtactgtt

SEQ ID NO: 5835065 - DNA, 13 bp, Homo sapiens
agaaatacagtgc

SEQ ID NO: 5835066 - DNA, 16 bp, Homo sapiens
agaaatacagtgcttt

SEQ ID NO: 5835067 - DNA, 15 bp, Homo sapiens
agaaatacataaaaa

SEQ ID NO: 5835068 - DNA, 18 bp, Homo sapiens
agaaataccaaaattatt

SEQ ID NO: 5835069 - DNA, 23 bp, Homo sapiens
agaaataccaaaattatttcaga

SEQ ID NO: 5835070 - DNA, 23 bp, Homo sapiens
agaaatactagagtaaaggccat

SEQ ID NO: 5835071 - DNA, 14 bp, Homo sapiens
agaaatactcatgt

SEQ ID NO: 5835072 - DNA, 16 bp, Homo sapiens
agaaatactcatgtgc

SEQ ID NO: 5835073 - DNA, 13 bp, Homo sapiens
agaaatacttttc

SEQ ID NO: 5835074 - DNA, 14 bp, Homo sapiens
agaaatagaacact

SEQ ID NO: 5835075 - DNA, 16 bp, Homo sapiens
agaaatagaataggca

SEQ ID NO: 5835076 - DNA, 18 bp, Homo sapiens
agaaatagacagtatatt

SEQ ID NO: 5835077 - DNA, 13 bp, Homo sapiens
agaaatagacttt

SEQ ID NO: 5835078 - DNA, 13 bp, Homo sapiens
agaaatagagcca

SEQ ID NO: 5835079 - DNA, 14 bp, Homo sapiens
agaaatagagccaa

SEQ ID NO: 5835080 - DNA, 13 bp, Homo sapiens
agaaataggaaga

SEQ ID NO: 5835081 - DNA, 16 bp, Homo sapiens
agaaatagggcatggc

SEQ ID NO: 5835082 - DNA, 15 bp, Homo sapiens
agaaatagtcggtga

SEQ ID NO: 5835083 - DNA, 15 bp, Homo sapiens
agaaatagttctgtg

SEQ ID NO: 5835084 - DNA, 19 bp, Homo sapiens
agaaatagttggttcctaa

SEQ ID NO: 5835085 - DNA, 16 bp, Homo sapiens
agaaatatacagtttg

SEQ ID NO: 5835086 - DNA, 19 bp, Homo sapiens
agaaatatacagtttgact

SEQ ID NO: 5835087 - DNA, 20 bp, Homo sapiens
agaacattctctcatagaac

SEQ ID NO: 5835088 - DNA, 19 bp, Homo sapiens
agaacattgatctgtttta

SEQ ID NO: 5835089 - DNA, 16 bp, Homo sapiens
agaacatttaaaatta

SEQ ID NO: 5835090 - DNA, 16 bp, Homo sapiens
agaacatttacacatt

SEQ ID NO: 5835091 - DNA, 14 bp, Homo sapiens
agaacattttactg

SEQ ID NO: 5835092 - DNA, 23 bp, Homo sapiens
agaacattttactgttgtacaat

SEQ ID NO: 5835093 - DNA, 15 bp, Homo sapiens
agaaccaaaagatgc

SEQ ID NO: 5835094 - DNA, 17 bp, Homo sapiens
agaaccaaaagatgcct

SEQ ID NO: 5835095 - DNA, 22 bp, Homo sapiens
agaaccaaagcaaccacaaatg

SEQ ID NO: 5835096 - DNA, 15 bp, Homo sapiens
agaaccaaatacctc

SEQ ID NO: 5835097 - DNA, 16 bp, Homo sapiens
agaaccaaatctggaa

SEQ ID NO: 5835098 - DNA, 18 bp, Homo sapiens
agaaccaaatctggaagc

SEQ ID NO: 5835099 - DNA, 13 bp, Homo sapiens
agaaccaaattaa

SEQ ID NO: 5835100 - DNA, 20 bp, Homo sapiens
agaaccaagcttcagagcct

SEQ ID NO: 5835101 - DNA, 16 bp, Homo sapiens
agaaccaattcacttt

SEQ ID NO: 5835102 - DNA, 13 bp, Homo sapiens
agaaccacactgt

SEQ ID NO: 5835103 - DNA, 19 bp, Homo sapiens
agaaccacacttgaaacct

SEQ ID NO: 5835104 - DNA, 23 bp, Homo sapiens
agaaccaccccggccccctgccc

SEQ ID NO: 5835105 - DNA, 21 bp, Homo sapiens
agaaccacggtgaaagtgctg

SEQ ID NO: 5835106 - DNA, 13 bp, Homo sapiens
agaaccactatga

SEQ ID NO: 5835107 - DNA, 23 bp, Homo sapiens
agaaccactgtctagagcaactt

SEQ ID NO: 5835108 - DNA, 14 bp, Homo sapiens
agaaccacttcctg

SEQ ID NO: 5835109 - DNA, 15 bp, Homo sapiens
agaaccacttcctgc

SEQ ID NO: 5835110 - DNA, 12 bp, Homo sapiens
agaaccagaggg

SEQ ID NO: 5835111 - DNA, 19 bp, Homo sapiens
agaaccagagggcatgctg

SEQ ID NO: 5835112 - DNA, 19 bp, Homo sapiens
agaaccagagggttgtact

SEQ ID NO: 5835113 - DNA, 20 bp, Homo sapiens
agaaccagcactaaggtgga

SEQ ID NO: 5835114 - DNA, 14 bp, Homo sapiens
agaaccagcactcc

SEQ ID NO: 5835115 - DNA, 16 bp, Homo sapiens
agaaccagcactccca

SEQ ID NO: 5835116 - DNA, 18 bp, Homo sapiens
agaaccagcactcccagg

SEQ ID NO: 5835117 - DNA, 20 bp, Homo sapiens
agaaccagcactcccagggc

SEQ ID NO: 5835118 - DNA, 19 bp, Homo sapiens
agaaccagcagaagccaga

SEQ ID NO: 5835119 - DNA, 14 bp, Homo sapiens
agaaccagccatat

SEQ ID NO: 5835120 - DNA, 13 bp, Homo sapiens
agaaccagcccag

SEQ ID NO: 5835121 - DNA, 14 bp, Homo sapiens
agaaccagcccagc

SEQ ID NO: 5835122 - DNA, 19 bp, Homo sapiens
agaaccagcccagcctgcc

SEQ ID NO: 5835123 - DNA, 18 bp, Homo sapiens
agaaccaggaggcctggg

SEQ ID NO: 5835124 - DNA, 18 bp, Homo sapiens
agaaccaggcatggaaag

SEQ ID NO: 5835125 - DNA, 19 bp, Homo sapiens
agaaccagtctttcaactc

SEQ ID NO: 5835126 - DNA, 14 bp, Homo sapiens
agaaccatgcagga

SEQ ID NO: 5835127 - DNA, 18 bp, Homo sapiens
agaaccatgcaggaagga

SEQ ID NO: 5835128 - DNA, 15 bp, Homo sapiens
agaacccaagtgcct

SEQ ID NO: 5835129 - DNA, 17 bp, Homo sapiens
agaacccacagtgagag

SEQ ID NO: 5835130 - DNA, 23 bp, Homo sapiens
agaacccacagtgagaggggagg

SEQ ID NO: 5835131 - DNA, 17 bp, Homo sapiens
agaacccagcccacccc

SEQ ID NO: 5835132 - DNA, 19 bp, Homo sapiens
agaacccagcccacccccg

SEQ ID NO: 5835133 - DNA, 22 bp, Homo sapiens
agaacccagggctctgccccag

SEQ ID NO: 5835134 - DNA, 14 bp, Homo sapiens
agaacccaggtctg

SEQ ID NO: 5835135 - DNA, 21 bp, Homo sapiens
agaacccagtgtttccacact

SEQ ID NO: 5835136 - DNA, 21 bp, Homo sapiens
agaaccccaactcccagccta

SEQ ID NO: 5835137 - DNA, 23 bp, Homo sapiens
agaaccccagggtcctgtagccc

SEQ ID NO: 5835138 - DNA, 14 bp, Homo sapiens
agaaccccaggtga

SEQ ID NO: 5835139 - DNA, 18 bp, Homo sapiens
agaaccccccgcaatgtg

SEQ ID NO: 5835140 - DNA, 16 bp, Homo sapiens
agaacccccctcccca

SEQ ID NO: 5835141 - DNA, 17 bp, Homo sapiens
agaacccctctgtcttc

SEQ ID NO: 5835142 - DNA, 12 bp, Homo sapiens
agaaccctctgt

SEQ ID NO: 5835143 - DNA, 19 bp, Homo sapiens
agaaccctgagcagggtcc

SEQ ID NO: 5835144 - DNA, 13 bp, Homo sapiens
agaaccctgcagg

SEQ ID NO: 5835145 - DNA, 16 bp, Homo sapiens
agaaccctgccatgga

SEQ ID NO: 5835146 - DNA, 23 bp, Homo sapiens
agaaccctgccatggaactgttt

SEQ ID NO: 5835147 - DNA, 14 bp, Homo sapiens
agaacccttcctgc

SEQ ID NO: 5835148 - DNA, 18 bp, Homo sapiens
agaaccgagcaaagatca

SEQ ID NO: 5835149 - DNA, 15 bp, Homo sapiens
agaaccgcattttga

SEQ ID NO: 5835150 - DNA, 16 bp, Homo sapiens
agaacctaactgtatc

SEQ ID NO: 5835151 - DNA, 21 bp, Homo sapiens
agaacctaactgtatcttgag

SEQ ID NO: 5835152 - DNA, 14 bp, Homo sapiens
agaacctaactttt

SEQ ID NO: 5835153 - DNA, 20 bp, Homo sapiens
agaacctaatagcaccaata

SEQ ID NO: 5835154 - DNA, 17 bp, Homo sapiens
agaacctacaaaagctt

SEQ ID NO: 5835155 - DNA, 22 bp, Homo sapiens
agaacctacagactccatctct

SEQ ID NO: 5835156 - DNA, 19 bp, Homo sapiens
agaacctactgttcctttc

SEQ ID NO: 5835157 - DNA, 22 bp, Homo sapiens
agaacctagtcttgttgttcat

SEQ ID NO: 5835158 - DNA, 22 bp, Homo sapiens
agaacctatagcatcttctcat

SEQ ID NO: 5835159 - DNA, 16 bp, Homo sapiens
agaacctatctttaaa

SEQ ID NO: 5835160 - DNA, 18 bp, Homo sapiens
agaacctatctttaaagc

SEQ ID NO: 5835161 - DNA, 18 bp, Homo sapiens
agaacctcacgcacctcc

SEQ ID NO: 5835162 - DNA, 21 bp, Homo sapiens
agaacctcacgcacctcccat

SEQ ID NO: 5835163 - DNA, 14 bp, Homo sapiens
agaacctccctcct

SEQ ID NO: 5835164 - DNA, 14 bp, Homo sapiens
agaacctcctattt

SEQ ID NO: 5835165 - DNA, 23 bp, Homo sapiens
agaacctctaagtgctgctgtgg

SEQ ID NO: 5835166 - DNA, 14 bp, Homo sapiens
agaacctcttcccc

SEQ ID NO: 5835167 - DNA, 21 bp, Homo sapiens
agaacctgagctattttcctc

SEQ ID NO: 5835168 - DNA, 19 bp, Homo sapiens
agaacctgaggtctcattc

SEQ ID NO: 5835169 - DNA, 13 bp, Homo sapiens
agaacctgcattt

SEQ ID NO: 5835170 - DNA, 16 bp, Homo sapiens
agaacctgcatttaag

SEQ ID NO: 5835171 - DNA, 20 bp, Homo sapiens
agaacctgcatttaagaaca

SEQ ID NO: 5835172 - DNA, 21 bp, Homo sapiens
agaacctggaacttggggagt

SEQ ID NO: 5835173 - DNA, 12 bp, Homo sapiens
agaacctggcct

SEQ ID NO: 5835174 - DNA, 14 bp, Homo sapiens
agaacctggccttc

SEQ ID NO: 5835175 - DNA, 11 bp, Homo sapiens
agaacctgggc

SEQ ID NO: 5835176 - DNA, 16 bp, Homo sapiens
agaacctgggctgtgc

SEQ ID NO: 5835177 - DNA, 23 bp, Homo sapiens
agaacctgggctgtgctgctttt

SEQ ID NO: 5835178 - DNA, 18 bp, Homo sapiens
agaacctggtggctggag

SEQ ID NO: 5835179 - DNA, 22 bp, Homo sapiens
agaacctgtcttattaagactg

SEQ ID NO: 5835180 - DNA, 15 bp, Homo sapiens
agaaccttaatgaca

SEQ ID NO: 5835181 - DNA, 19 bp, Homo sapiens
agaaccttactggcactgt

SEQ ID NO: 5835182 - DNA, 13 bp, Homo sapiens
agaaccttctttg

SEQ ID NO: 5835183 - DNA, 22 bp, Homo sapiens
agaaccttgcctgaacatcctt

SEQ ID NO: 5835184 - DNA, 20 bp, Homo sapiens
agaaccttggaccactcctg

SEQ ID NO: 5835185 - DNA, 23 bp, Homo sapiens
agaaccttgtcccagccagtgag

SEQ ID NO: 5835186 - DNA, 23 bp, Homo sapiens
agaaccttgtgcctggctcagag

SEQ ID NO: 5835187 - DNA, 18 bp, Homo sapiens
agaacctttagaatatct

SEQ ID NO: 5835188 - DNA, 23 bp, Homo sapiens
agaaccttttgagtgccttacac

SEQ ID NO: 5835189 - DNA, 17 bp, Homo sapiens
agaacgagcctggaagc

SEQ ID NO: 5835190 - DNA, 18 bp, Homo sapiens
agaacgaggattttaatt

SEQ ID NO: 5835191 - DNA, 17 bp, Homo sapiens
agaacgaggtttatatt

SEQ ID NO: 5835192 - DNA, 21 bp, Homo sapiens
agaacgaggtttatattttca

SEQ ID NO: 5835193 - DNA, 14 bp, Homo sapiens
agaacgcatgcagg

SEQ ID NO: 5835194 - DNA, 20 bp, Homo sapiens
agaacgccagtctcccaggc

SEQ ID NO: 5835195 - DNA, 13 bp, Homo sapiens
agaacgccctgtg

SEQ ID NO: 5835196 - DNA, 15 bp, Homo sapiens
agaacgccctgtgtc

SEQ ID NO: 5835197 - DNA, 20 bp, Homo sapiens
agaacgccctgtgtccacag

SEQ ID NO: 5835198 - DNA, 19 bp, Homo sapiens
agaacgcgacttccacaaa

SEQ ID NO: 5835199 - DNA, 16 bp, Homo sapiens
agaacgcggtgtgtaa

SEQ ID NO: 5835200 - DNA, 22 bp, Homo sapiens
agaacggacgagataatgtgaa

SEQ ID NO: 5835201 - DNA, 15 bp, Homo sapiens
agaacgggcctcccc

SEQ ID NO: 5835202 - DNA, 23 bp, Homo sapiens
agaacggtttttggatctggcat

SEQ ID NO: 5835203 - DNA, 16 bp, Homo sapiens
agaacgtctctcacct

SEQ ID NO: 5835204 - DNA, 15 bp, Homo sapiens
agaacgtgcccagcc

SEQ ID NO: 5835205 - DNA, 18 bp, Homo sapiens
agaacgtgcttgtggaag

SEQ ID NO: 5835206 - DNA, 19 bp, Homo sapiens
agaacgtggctctgctggc

SEQ ID NO: 5835207 - DNA, 20 bp, Homo sapiens
agaacgttttttcctcagtg

SEQ ID NO: 5835208 - DNA, 18 bp, Homo sapiens
agaactaaactcatttat

SEQ ID NO: 5835209 - DNA, 20 bp, Homo sapiens
agaactaaaggtggccacaa

SEQ ID NO: 5835210 - DNA, 21 bp, Homo sapiens
agaactaaatataaattttca

SEQ ID NO: 5835211 - DNA, 13 bp, Homo sapiens
agaactaaatgtt

SEQ ID NO: 5835212 - DNA, 21 bp, Homo sapiens
agaactaaatttttcatagaa

SEQ ID NO: 5835213 - DNA, 16 bp, Homo sapiens
agaactaagaggccca

SEQ ID NO: 5835214 - DNA, 16 bp, Homo sapiens
agaactaagtaagaaa

SEQ ID NO: 5835215 - DNA, 22 bp, Homo sapiens
agaactacaaacaaaatttcta

SEQ ID NO: 5835216 - DNA, 14 bp, Homo sapiens
agaactaccccctt

SEQ ID NO: 5835217 - DNA, 18 bp, Homo sapiens
agaactacgcacagctgc

SEQ ID NO: 5835218 - DNA, 16 bp, Homo sapiens
agaactactaaagtgc

SEQ ID NO: 5835219 - DNA, 22 bp, Homo sapiens
agaactactcagggaatgaagg

SEQ ID NO: 5835220 - DNA, 17 bp, Homo sapiens
agaactagaatttgatt

SEQ ID NO: 5835221 - DNA, 15 bp, Homo sapiens
agaactagcatatag

SEQ ID NO: 5835222 - DNA, 17 bp, Homo sapiens
agaactagccaaaccag

SEQ ID NO: 5835223 - DNA, 14 bp, Homo sapiens
agaactagtagaag

SEQ ID NO: 5835224 - DNA, 22 bp, Homo sapiens
agaactagtggtggctctgaga

SEQ ID NO: 5835225 - DNA, 16 bp, Homo sapiens
agaactataacattca

SEQ ID NO: 5835226 - DNA, 15 bp, Homo sapiens
agaactatattttcc

SEQ ID NO: 5835227 - DNA, 15 bp, Homo sapiens
agaactatcattttt

SEQ ID NO: 5835228 - DNA, 14 bp, Homo sapiens
agaactatcttcat

SEQ ID NO: 5835229 - DNA, 17 bp, Homo sapiens
agaactatcttcatctg

SEQ ID NO: 5835230 - DNA, 17 bp, Homo sapiens
agaactatgtaaacaaa

SEQ ID NO: 5835231 - DNA, 22 bp, Homo sapiens
agaactattctgggggcccgac

SEQ ID NO: 5835232 - DNA, 21 bp, Homo sapiens
agaactattgtgctcagagac

SEQ ID NO: 5835233 - DNA, 23 bp, Homo sapiens
agaactattgtgctcagagacac

SEQ ID NO: 5835234 - DNA, 19 bp, Homo sapiens
agaactcactctgggctgt

SEQ ID NO: 5835235 - DNA, 20 bp, Homo sapiens
agaactcactctgggctgta

SEQ ID NO: 5835236 - DNA, 16 bp, Homo sapiens
agaactcactggggcc

SEQ ID NO: 5835237 - DNA, 19 bp, Homo sapiens
agaactcagtgccacacct

SEQ ID NO: 5835238 - DNA, 17 bp, Homo sapiens
agaactcagttttaact

SEQ ID NO: 5835239 - DNA, 15 bp, Homo sapiens
agaactcatcactgt

SEQ ID NO: 5835240 - DNA, 21 bp, Homo sapiens
agaactcatgacggaagagtt

SEQ ID NO: 5835241 - DNA, 22 bp, Homo sapiens
agaactcatgttattttttaac

SEQ ID NO: 5835242 - DNA, 12 bp, Homo sapiens
agaactcatttc

SEQ ID NO: 5835243 - DNA, 19 bp, Homo sapiens
agaactccacccccagagg

SEQ ID NO: 5835244 - DNA, 22 bp, Homo sapiens
agaactccagtaaaagttgtgc

SEQ ID NO: 5835245 - DNA, 22 bp, Homo sapiens
agaactccatcagaaaaccaaa

SEQ ID NO: 5835246 - DNA, 13 bp, Homo sapiens
agaactcccacaa

SEQ ID NO: 5835247 - DNA, 16 bp, Homo sapiens
agaactccctttcaac

SEQ ID NO: 5835248 - DNA, 14 bp, Homo sapiens
agaactccgctgga

SEQ ID NO: 5835249 - DNA, 15 bp, Homo sapiens
agaactcctacctga

SEQ ID NO: 5835250 - DNA, 20 bp, Homo sapiens
agaactcctccaaagcatgt

SEQ ID NO: 5835251 - DNA, 11 bp, Homo sapiens
agaactcctga

SEQ ID NO: 5835252 - DNA, 14 bp, Homo sapiens
agaactcctgaaat

SEQ ID NO: 5835253 - DNA, 15 bp, Homo sapiens
agaactcctgaaatc

SEQ ID NO: 5835254 - DNA, 13 bp, Homo sapiens
agaactcctttct

SEQ ID NO: 5835255 - DNA, 16 bp, Homo sapiens
agaactcgatgcactg

SEQ ID NO: 5835256 - DNA, 18 bp, Homo sapiens
agaactcgatgcactgac

SEQ ID NO: 5835257 - DNA, 18 bp, Homo sapiens
agaactcgcgctcagtaa

SEQ ID NO: 5835258 - DNA, 20 bp, Homo sapiens
agaactcgcgctcagtaaac

SEQ ID NO: 5835259 - DNA, 20 bp, Homo sapiens
agaactcggtgtccccacca

SEQ ID NO: 5835260 - DNA, 21 bp, Homo sapiens
agaactctcagactctaaaca

SEQ ID NO: 5835261 - DNA, 15 bp, Homo sapiens
agaactctctagttc

SEQ ID NO: 5835262 - DNA, 21 bp, Homo sapiens
agaactctctggaagcccctg

SEQ ID NO: 5835263 - DNA, 13 bp, Homo sapiens
agaactctgcctg

SEQ ID NO: 5835264 - DNA, 21 bp, Homo sapiens
agaaggccagaaaaggcagcc

SEQ ID NO: 5835265 - DNA, 22 bp, Homo sapiens
agaaggccagaaaaggcagcca

SEQ ID NO: 5835266 - DNA, 13 bp, Homo sapiens
agaaggccagccc

SEQ ID NO: 5835267 - DNA, 15 bp, Homo sapiens
agaaggccaggcctc

SEQ ID NO: 5835268 - DNA, 20 bp, Homo sapiens
agaaggcccataccttctgg

SEQ ID NO: 5835269 - DNA, 16 bp, Homo sapiens
agaaggccccagggca

SEQ ID NO: 5835270 - DNA, 17 bp, Homo sapiens
agaaggcccgaggaggc

SEQ ID NO: 5835271 - DNA, 23 bp, Homo sapiens
agaaggcccgggaggaggatccg

SEQ ID NO: 5835272 - DNA, 14 bp, Homo sapiens
agaaggccgctgcc

SEQ ID NO: 5835273 - DNA, 20 bp, Homo sapiens
agaaggcctcccctgaggat

SEQ ID NO: 5835274 - DNA, 16 bp, Homo sapiens
agaaggcctgcccccc

SEQ ID NO: 5835275 - DNA, 21 bp, Homo sapiens
agaaggcctgccccccttccc

SEQ ID NO: 5835276 - DNA, 16 bp, Homo sapiens
agaaggcctggtcagc

SEQ ID NO: 5835277 - DNA, 17 bp, Homo sapiens
agaaggcctggtcagca

SEQ ID NO: 5835278 - DNA, 23 bp, Homo sapiens
agaaggccttcatggccccagca

SEQ ID NO: 5835279 - DNA, 16 bp, Homo sapiens
agaaggccttgccttg

SEQ ID NO: 5835280 - DNA, 15 bp, Homo sapiens
agaaggcgtccatgt

SEQ ID NO: 5835281 - DNA, 22 bp, Homo sapiens
agaaggctatgtaaacaaacca

SEQ ID NO: 5835282 - DNA, 13 bp, Homo sapiens
agaaggctggggc

SEQ ID NO: 5835283 - DNA, 15 bp, Homo sapiens
agaaggctggggcca

SEQ ID NO: 5835284 - DNA, 16 bp, Homo sapiens
agaaggctggggctat

SEQ ID NO: 5835285 - DNA, 14 bp, Homo sapiens
agaaggcttctctc

SEQ ID NO: 5835286 - DNA, 16 bp, Homo sapiens
agaaggcttctctcca

SEQ ID NO: 5835287 - DNA, 15 bp, Homo sapiens
agaagggaaagccca

SEQ ID NO: 5835288 - DNA, 20 bp, Homo sapiens
agaagggaaattcacactgt

SEQ ID NO: 5835289 - DNA, 18 bp, Homo sapiens
agaagggaaatttcaata

SEQ ID NO: 5835290 - DNA, 16 bp, Homo sapiens
agaagggaatcctcct

SEQ ID NO: 5835291 - DNA, 22 bp, Homo sapiens
agaagggaattaggctttagat

SEQ ID NO: 5835292 - DNA, 14 bp, Homo sapiens
agaagggacatggg

SEQ ID NO: 5835293 - DNA, 23 bp, Homo sapiens
agaagggagactctatttaagat

SEQ ID NO: 5835294 - DNA, 18 bp, Homo sapiens
agaagggagctagccaga

SEQ ID NO: 5835295 - DNA, 11 bp, Homo sapiens
agaagggaggc

SEQ ID NO: 5835296 - DNA, 11 bp, Homo sapiens
agaagggaggg

SEQ ID NO: 5835297 - DNA, 19 bp, Homo sapiens
agaagggagggcagagctg

SEQ ID NO: 5835298 - DNA, 23 bp, Homo sapiens
agaagggagggcagagctggtgc

SEQ ID NO: 5835299 - DNA, 13 bp, Homo sapiens
agaagggagtgaa

SEQ ID NO: 5835300 - DNA, 16 bp, Homo sapiens
agaagggagttgctca

SEQ ID NO: 5835301 - DNA, 20 bp, Homo sapiens
agaagggagttgctcactca

SEQ ID NO: 5835302 - DNA, 22 bp, Homo sapiens
agaagggagttgctcactcagg

SEQ ID NO: 5835303 - DNA, 21 bp, Homo sapiens
agaagggataaccctacaccc

SEQ ID NO: 5835304 - DNA, 14 bp, Homo sapiens
agaagggccagccc

SEQ ID NO: 5835305 - DNA, 17 bp, Homo sapiens
agaagggccagccctac

SEQ ID NO: 5835306 - DNA, 20 bp, Homo sapiens
agaagggccagtcctgcctg

SEQ ID NO: 5835307 - DNA, 15 bp, Homo sapiens
agaagggcctgctct

SEQ ID NO: 5835308 - DNA, 13 bp, Homo sapiens
agaagggctagaa

SEQ ID NO: 5835309 - DNA, 23 bp, Homo sapiens
agaagggctagaacctggagagc

SEQ ID NO: 5835310 - DNA, 23 bp, Homo sapiens
agaagggctcagagaggacaaaa

SEQ ID NO: 5835311 - DNA, 20 bp, Homo sapiens
agaagggctgcatgatgttt

SEQ ID NO: 5835312 - DNA, 21 bp, Homo sapiens
agaagggctgcttccctgaag

SEQ ID NO: 5835313 - DNA, 22 bp, Homo sapiens
agaagggcttacaggcatggac

SEQ ID NO: 5835314 - DNA, 12 bp, Homo sapiens
agaagggcttca

SEQ ID NO: 5835315 - DNA, 16 bp, Homo sapiens
agaaggggaagcactc

SEQ ID NO: 5835316 - DNA, 20 bp, Homo sapiens
agaaggggactgccacctcc

SEQ ID NO: 5835317 - DNA, 17 bp, Homo sapiens
agaaggggaggacactg

SEQ ID NO: 5835318 - DNA, 16 bp, Homo sapiens
agaaggggatgggaaa

SEQ ID NO: 5835319 - DNA, 18 bp, Homo sapiens
agaaggggcgtcataaat

SEQ ID NO: 5835320 - DNA, 21 bp, Homo sapiens
agaaggggctcgagtgcccct

SEQ ID NO: 5835321 - DNA, 22 bp, Homo sapiens
agaaggggctcgagtgcccctg

SEQ ID NO: 5835322 - DNA, 22 bp, Homo sapiens
agaagggggagtgaaacagaga

SEQ ID NO: 5835323 - DNA, 20 bp, Homo sapiens
agaagggggctctgccccag

SEQ ID NO: 5835324 - DNA, 21 bp, Homo sapiens
agaagggggctctgccccagg

SEQ ID NO: 5835325 - DNA, 20 bp, Homo sapiens
agaagggggtcaaagcaagg

SEQ ID NO: 5835326 - DNA, 13 bp, Homo sapiens
agaagggggtggt

SEQ ID NO: 5835327 - DNA, 18 bp, Homo sapiens
agaagggtccttccctct

SEQ ID NO: 5835328 - DNA, 17 bp, Homo sapiens
agaagggtggagtcaga

SEQ ID NO: 5835329 - DNA, 20 bp, Homo sapiens
agaagggtgggagtggggcc

SEQ ID NO: 5835330 - DNA, 23 bp, Homo sapiens
agaagggttacttgctgctcaca

SEQ ID NO: 5835331 - DNA, 23 bp, Homo sapiens
agaagggttctgccctgcctgag

SEQ ID NO: 5835332 - DNA, 20 bp, Homo sapiens
agaagggttttccaccctgg

SEQ ID NO: 5835333 - DNA, 21 bp, Homo sapiens
agaaggtatacctgggaagat

SEQ ID NO: 5835334 - DNA, 21 bp, Homo sapiens
agaaggtattccttttgtgta

SEQ ID NO: 5835335 - DNA, 14 bp, Homo sapiens
agaaggtatttttc

SEQ ID NO: 5835336 - DNA, 18 bp, Homo sapiens
agaaggtatttttccaat

SEQ ID NO: 5835337 - DNA, 15 bp, Homo sapiens
agaaggtatttttga

SEQ ID NO: 5835338 - DNA, 18 bp, Homo sapiens
agaaggtatttttgaagt

SEQ ID NO: 5835339 - DNA, 19 bp, Homo sapiens
agaaggtattttttaactc

SEQ ID NO: 5835340 - DNA, 21 bp, Homo sapiens
agaaggtccttaatgatccgt

SEQ ID NO: 5835341 - DNA, 20 bp, Homo sapiens
agaaggtcggaggcttggga

SEQ ID NO: 5835342 - DNA, 14 bp, Homo sapiens
agaaggtctgtggt

SEQ ID NO: 5835343 - DNA, 16 bp, Homo sapiens
agaaggtgagaggcga

SEQ ID NO: 5835344 - DNA, 20 bp, Homo sapiens
agaaggtgccgtgagcaggc

SEQ ID NO: 5835345 - DNA, 15 bp, Homo sapiens
agaaggtgcctgcca

SEQ ID NO: 5835346 - DNA, 15 bp, Homo sapiens
agaaggtgcttagct

SEQ ID NO: 5835347 - DNA, 21 bp, Homo sapiens
agaaggtgcttgggcttctgc

SEQ ID NO: 5835348 - DNA, 14 bp, Homo sapiens
agaaggtgggagga

SEQ ID NO: 5835349 - DNA, 13 bp, Homo sapiens
agaaggtggggac

SEQ ID NO: 5835350 - DNA, 23 bp, Homo sapiens
agaaggtggtggcatttttgctt

SEQ ID NO: 5835351 - DNA, 18 bp, Homo sapiens
agaaggttaagtcaggga

SEQ ID NO: 5835352 - DNA, 20 bp, Homo sapiens
agaaggttaccaagaagcct

SEQ ID NO: 5835353 - DNA, 21 bp, Homo sapiens
agaaggttctgagctgtccca

SEQ ID NO: 5835354 - DNA, 15 bp, Homo sapiens
agaaggttgagggca

SEQ ID NO: 5835355 - DNA, 16 bp, Homo sapiens
agaaggttgctctaga

SEQ ID NO: 5835356 - DNA, 20 bp, Homo sapiens
agaaggttgctctagattga

SEQ ID NO: 5835357 - DNA, 18 bp, Homo sapiens
agaaggtttattgttaat

SEQ ID NO: 5835358 - DNA, 18 bp, Homo sapiens
agaaggtttctggagcag

SEQ ID NO: 5835359 - DNA, 19 bp, Homo sapiens
agaaggtttgtgtttttct

SEQ ID NO: 5835360 - DNA, 20 bp, Homo sapiens
agaaggtttgtgtttttctg

SEQ ID NO: 5835361 - DNA, 13 bp, Homo sapiens
agaagtaaaagct

SEQ ID NO: 5835362 - DNA, 20 bp, Homo sapiens
agaagtaaactggatactgt

SEQ ID NO: 5835363 - DNA, 15 bp, Homo sapiens
agaagtaaatttgtc

SEQ ID NO: 5835364 - DNA, 16 bp, Homo sapiens
agaagtaaatttgtcc

SEQ ID NO: 5835365 - DNA, 17 bp, Homo sapiens
agaagtaaatttgtcca

SEQ ID NO: 5835366 - DNA, 19 bp, Homo sapiens
agaagtaaatttgtccaat

SEQ ID NO: 5835367 - DNA, 13 bp, Homo sapiens
agaagtaacaaga

SEQ ID NO: 5835368 - DNA, 23 bp, Homo sapiens
agaagtaaccaactgaacgacaa

SEQ ID NO: 5835369 - DNA, 19 bp, Homo sapiens
agaagtaactcccactcct

SEQ ID NO: 5835370 - DNA, 14 bp, Homo sapiens
agaagtaagcagag

SEQ ID NO: 5835371 - DNA, 23 bp, Homo sapiens
agaagtaagtttatccaaatctt

SEQ ID NO: 5835372 - DNA, 14 bp, Homo sapiens
agaagtacagaatg

SEQ ID NO: 5835373 - DNA, 16 bp, Homo sapiens
agaagtacgtgttact

SEQ ID NO: 5835374 - DNA, 18 bp, Homo sapiens
agaagtacgtttttgcat

SEQ ID NO: 5835375 - DNA, 24 bp, Homo sapiens
agaagtacgtttttgcattattca

SEQ ID NO: 5835376 - DNA, 14 bp, Homo sapiens
agaagtactttgtg

SEQ ID NO: 5835377 - DNA, 18 bp, Homo sapiens
agaagtactttgtgctga

SEQ ID NO: 5835378 - DNA, 13 bp, Homo sapiens
agaagtaggaagg

SEQ ID NO: 5835379 - DNA, 14 bp, Homo sapiens
agaagtaggaagga

SEQ ID NO: 5835380 - DNA, 19 bp, Homo sapiens
agaagtaggaggaaacagt

SEQ ID NO: 5835381 - DNA, 17 bp, Homo sapiens
agaagtaggcatgaggg

SEQ ID NO: 5835382 - DNA, 19 bp, Homo sapiens
agaagtaggggtggcccga

SEQ ID NO: 5835383 - DNA, 16 bp, Homo sapiens
agaagtagtggtttgc

SEQ ID NO: 5835384 - DNA, 15 bp, Homo sapiens
agaagtataaagaat

SEQ ID NO: 5835385 - DNA, 15 bp, Homo sapiens
agaagtataaggtgc

SEQ ID NO: 5835386 - DNA, 20 bp, Homo sapiens
agaagtatacgtttttcagt

SEQ ID NO: 5835387 - DNA, 21 bp, Homo sapiens
agaagtatccaattatgtgac

SEQ ID NO: 5835388 - DNA, 22 bp, Homo sapiens
agaagtatccaattatgtgaca

SEQ ID NO: 5835389 - DNA, 19 bp, Homo sapiens
agaagtattcctgttgctg

SEQ ID NO: 5835390 - DNA, 17 bp, Homo sapiens
agaagtatttatcagga

SEQ ID NO: 5835391 - DNA, 21 bp, Homo sapiens
agaagtatttttagaataaga

SEQ ID NO: 5835392 - DNA, 17 bp, Homo sapiens
agaagtcaaatgaatga

SEQ ID NO: 5835393 - DNA, 16 bp, Homo sapiens
agaagtcaaggcttag

SEQ ID NO: 5835394 - DNA, 14 bp, Homo sapiens
agaagtcacacagt

SEQ ID NO: 5835395 - DNA, 14 bp, Homo sapiens
agaagtcacagggc

SEQ ID NO: 5835396 - DNA, 21 bp, Homo sapiens
agaagtcacagggcagtacct

SEQ ID NO: 5835397 - DNA, 23 bp, Homo sapiens
agaagtcacagggcagtacctga

SEQ ID NO: 5835398 - DNA, 18 bp, Homo sapiens
agaagtcacattcctgaa

SEQ ID NO: 5835399 - DNA, 21 bp, Homo sapiens
agaagtcacattcctgaacag

SEQ ID NO: 5835400 - DNA, 21 bp, Homo sapiens
agaagtcactcacactggcca

SEQ ID NO: 5835401 - DNA, 22 bp, Homo sapiens
agaagtcactcacactggccac

SEQ ID NO: 5835402 - DNA, 17 bp, Homo sapiens
agaagtcactgaacaaa

SEQ ID NO: 5835403 - DNA, 19 bp, Homo sapiens
agaagtcactgaacaaaac

SEQ ID NO: 5835404 - DNA, 20 bp, Homo sapiens
agaagtcagagaaaacactt

SEQ ID NO: 5835405 - DNA, 22 bp, Homo sapiens
agaagtcagcccgaatgcctgt

SEQ ID NO: 5835406 - DNA, 21 bp, Homo sapiens
agaagtcataaacagcattta

SEQ ID NO: 5835407 - DNA, 22 bp, Homo sapiens
agaagtcataaacagcatttat

SEQ ID NO: 5835408 - DNA, 15 bp, Homo sapiens
agaagtccacagaca

SEQ ID NO: 5835409 - DNA, 17 bp, Homo sapiens
agaagtccatgagttga

SEQ ID NO: 5835410 - DNA, 13 bp, Homo sapiens
agaagtccctccc

SEQ ID NO: 5835411 - DNA, 22 bp, Homo sapiens
agaagtccctcccatctctacc

SEQ ID NO: 5835412 - DNA, 13 bp, Homo sapiens
agaagtcccttca

SEQ ID NO: 5835413 - DNA, 20 bp, Homo sapiens
agaagtcctatcgactttat

SEQ ID NO: 5835414 - DNA, 22 bp, Homo sapiens
agaagtcctgctggatcttgcc

SEQ ID NO: 5835415 - DNA, 19 bp, Homo sapiens
agaagtcctgtatgtctgt

SEQ ID NO: 5835416 - DNA, 22 bp, Homo sapiens
agaagtcctgtatgtctgtcat

SEQ ID NO: 5835417 - DNA, 18 bp, Homo sapiens
agaagtcggaatgtcata

SEQ ID NO: 5835418 - DNA, 22 bp, Homo sapiens
agaagtctcagctaagctcacg

SEQ ID NO: 5835419 - DNA, 14 bp, Homo sapiens
agaagtctcattcg

SEQ ID NO: 5835420 - DNA, 17 bp, Homo sapiens
agaagtctccctgcaca

SEQ ID NO: 5835421 - DNA, 15 bp, Homo sapiens
agaagtctcttccag

SEQ ID NO: 5835422 - DNA, 17 bp, Homo sapiens
agaagtctggccatttt

SEQ ID NO: 5835423 - DNA, 18 bp, Homo sapiens
agaagtctggtcagagcc

SEQ ID NO: 5835424 - DNA, 20 bp, Homo sapiens
agaagtctggtcagagccac

SEQ ID NO: 5835425 - DNA, 19 bp, Homo sapiens
agaagtcttagatgtatat

SEQ ID NO: 5835426 - DNA, 13 bp, Homo sapiens
agaagtcttcatg

SEQ ID NO: 5835427 - DNA, 16 bp, Homo sapiens
agaagtcttcatgaaa

SEQ ID NO: 5835428 - DNA, 18 bp, Homo sapiens
agaagtcttcatgaaatg

SEQ ID NO: 5835429 - DNA, 19 bp, Homo sapiens
agaagtcttcatgaaatgc

SEQ ID NO: 5835430 - DNA, 22 bp, Homo sapiens
agaagtcttcatggtctcttcc

SEQ ID NO: 5835431 - DNA, 16 bp, Homo sapiens
agaagtcttctattta

SEQ ID NO: 5835432 - DNA, 14 bp, Homo sapiens
agaagtctttcaga

SEQ ID NO: 5835433 - DNA, 18 bp, Homo sapiens
agaagtgaataactgcaa

SEQ ID NO: 5835434 - DNA, 17 bp, Homo sapiens
agaagtgaatgctggga

SEQ ID NO: 5835435 - DNA, 19 bp, Homo sapiens
agaagtgaatgctgggact

SEQ ID NO: 5835436 - DNA, 21 bp, Homo sapiens
agaagtgaatgctgggactca

SEQ ID NO: 5835437 - DNA, 17 bp, Homo sapiens
agaagtgaatgggaaag

SEQ ID NO: 5835438 - DNA, 19 bp, Homo sapiens
agaagtgaatgggaaaggg

SEQ ID NO: 5835439 - DNA, 15 bp, Homo sapiens
agaatcctgcctctc

SEQ ID NO: 5835440 - DNA, 21 bp, Homo sapiens
agaatcctgcctctccccaaa

SEQ ID NO: 5835441 - DNA, 13 bp, Homo sapiens
agaatcctgggcc

SEQ ID NO: 5835442 - DNA, 17 bp, Homo sapiens
agaatccttttgtagaa

SEQ ID NO: 5835443 - DNA, 17 bp, Homo sapiens
agaatcgaggtgctgtt

SEQ ID NO: 5835444 - DNA, 23 bp, Homo sapiens
agaatcgatgggggatgcttcat

SEQ ID NO: 5835445 - DNA, 22 bp, Homo sapiens
agaatcggcagtattttctgtt

SEQ ID NO: 5835446 - DNA, 20 bp, Homo sapiens
agaatctaaacctctctagg

SEQ ID NO: 5835447 - DNA, 14 bp, Homo sapiens
agaatctaaacctt

SEQ ID NO: 5835448 - DNA, 15 bp, Homo sapiens
agaatctaatgaatg

SEQ ID NO: 5835449 - DNA, 18 bp, Homo sapiens
agaatctagaaaatcaga

SEQ ID NO: 5835450 - DNA, 17 bp, Homo sapiens
agaatctagaagatgtg

SEQ ID NO: 5835451 - DNA, 21 bp, Homo sapiens
agaatctagaagatgtgtaaa

SEQ ID NO: 5835452 - DNA, 21 bp, Homo sapiens
agaatctagataggtgctttt

SEQ ID NO: 5835453 - DNA, 16 bp, Homo sapiens
agaatctaggaaatta

SEQ ID NO: 5835454 - DNA, 14 bp, Homo sapiens
agaatctatagtga

SEQ ID NO: 5835455 - DNA, 13 bp, Homo sapiens
agaatctattttc

SEQ ID NO: 5835456 - DNA, 15 bp, Homo sapiens
agaatctattttcta

SEQ ID NO: 5835457 - DNA, 17 bp, Homo sapiens
agaatctcaaataacta

SEQ ID NO: 5835458 - DNA, 18 bp, Homo sapiens
agaatctcaacatgtctc

SEQ ID NO: 5835459 - DNA, 18 bp, Homo sapiens
agaatctcagacacacat

SEQ ID NO: 5835460 - DNA, 17 bp, Homo sapiens
agaatctcattactgct

SEQ ID NO: 5835461 - DNA, 21 bp, Homo sapiens
agaatctcattactgcttcat

SEQ ID NO: 5835462 - DNA, 23 bp, Homo sapiens
agaatctcattactgcttcattt

SEQ ID NO: 5835463 - DNA, 16 bp, Homo sapiens
agaatctcttcatgct

SEQ ID NO: 5835464 - DNA, 13 bp, Homo sapiens
agaatctgagggc

SEQ ID NO: 5835465 - DNA, 20 bp, Homo sapiens
agaatctgctgttgccatag

SEQ ID NO: 5835466 - DNA, 16 bp, Homo sapiens
agaatctggctcctgt

SEQ ID NO: 5835467 - DNA, 20 bp, Homo sapiens
agaatctgtgcagtcatcaa

SEQ ID NO: 5835468 - DNA, 13 bp, Homo sapiens
agaatctgtgtga

SEQ ID NO: 5835469 - DNA, 19 bp, Homo sapiens
agaatctgtttcccagcag

SEQ ID NO: 5835470 - DNA, 20 bp, Homo sapiens
agaatcttaaggtctaactg

SEQ ID NO: 5835471 - DNA, 18 bp, Homo sapiens
agaatcttaatgcttgta

SEQ ID NO: 5835472 - DNA, 22 bp, Homo sapiens
agaatcttgactttctgattgg

SEQ ID NO: 5835473 - DNA, 20 bp, Homo sapiens
agaatcttggtttgccttcc

SEQ ID NO: 5835474 - DNA, 19 bp, Homo sapiens
agaatcttgttttgaaaat

SEQ ID NO: 5835475 - DNA, 22 bp, Homo sapiens
agaatcttgttttgaaaataac

SEQ ID NO: 5835476 - DNA, 11 bp, Homo sapiens
agaatctttat

SEQ ID NO: 5835477 - DNA, 17 bp, Homo sapiens
agaatctttattgagaa

SEQ ID NO: 5835478 - DNA, 18 bp, Homo sapiens
agaatctttattgagaaa

SEQ ID NO: 5835479 - DNA, 19 bp, Homo sapiens
agaatctttattgagaaag

SEQ ID NO: 5835480 - DNA, 15 bp, Homo sapiens
agaatgaaaagttta

SEQ ID NO: 5835481 - DNA, 20 bp, Homo sapiens
agaatgaaaatcagcaactt

SEQ ID NO: 5835482 - DNA, 19 bp, Homo sapiens
agaatgaaagagtaaagga

SEQ ID NO: 5835483 - DNA, 16 bp, Homo sapiens
agaatgaaagctgttc

SEQ ID NO: 5835484 - DNA, 14 bp, Homo sapiens
agaatgaaagtagc

SEQ ID NO: 5835485 - DNA, 20 bp, Homo sapiens
agaatgaaatactgtttgag

SEQ ID NO: 5835486 - DNA, 16 bp, Homo sapiens
agaatgaaatgaatga

SEQ ID NO: 5835487 - DNA, 15 bp, Homo sapiens
agaatgaaatgtatg

SEQ ID NO: 5835488 - DNA, 17 bp, Homo sapiens
agaatgaaatgtatgtg

SEQ ID NO: 5835489 - DNA, 20 bp, Homo sapiens
agaatgaaattgctgaaaga

SEQ ID NO: 5835490 - DNA, 12 bp, Homo sapiens
agaatgaacaaa

SEQ ID NO: 5835491 - DNA, 13 bp, Homo sapiens
agaatgaacaaag

SEQ ID NO: 5835492 - DNA, 21 bp, Homo sapiens
agaatgaacccaagagcaagg

SEQ ID NO: 5835493 - DNA, 20 bp, Homo sapiens
agaatgaaccctcctccttt

SEQ ID NO: 5835494 - DNA, 21 bp, Homo sapiens
agaatgaaccctcctcctttt

SEQ ID NO: 5835495 - DNA, 19 bp, Homo sapiens
agaatgaactgtctagatg

SEQ ID NO: 5835496 - DNA, 15 bp, Homo sapiens
agaatgaactgtgga

SEQ ID NO: 5835497 - DNA, 20 bp, Homo sapiens
agaatgaactgtggaattta

SEQ ID NO: 5835498 - DNA, 12 bp, Homo sapiens
agaatgaagacc

SEQ ID NO: 5835499 - DNA, 22 bp, Homo sapiens
agaatgaagataagtaatttac

SEQ ID NO: 5835500 - DNA, 12 bp, Homo sapiens
agaatgaagggc

SEQ ID NO: 5835501 - DNA, 20 bp, Homo sapiens
agaatgaaggtttttgtaaa

SEQ ID NO: 5835502 - DNA, 13 bp, Homo sapiens
agaatgaatatag

SEQ ID NO: 5835503 - DNA, 15 bp, Homo sapiens
agaatgaatttatct

SEQ ID NO: 5835504 - DNA, 20 bp, Homo sapiens
agaatgaatttatctttacc

SEQ ID NO: 5835505 - DNA, 13 bp, Homo sapiens
agaatgacctgcc

SEQ ID NO: 5835506 - DNA, 23 bp, Homo sapiens
agaatgaccttgtaatgtaactg

SEQ ID NO: 5835507 - DNA, 22 bp, Homo sapiens
agaatgacggaataagagacct

SEQ ID NO: 5835508 - DNA, 14 bp, Homo sapiens
agaatgactctgga

SEQ ID NO: 5835509 - DNA, 19 bp, Homo sapiens
agaatgagaaagaaaagga

SEQ ID NO: 5835510 - DNA, 15 bp, Homo sapiens
agaatgagaaatcat

SEQ ID NO: 5835511 - DNA, 22 bp, Homo sapiens
agaatgagagacacactgaaga

SEQ ID NO: 5835512 - DNA, 23 bp, Homo sapiens
agaatgagagagagactgtgtgt

SEQ ID NO: 5835513 - DNA, 14 bp, Homo sapiens
agaatgagagagtg

SEQ ID NO: 5835514 - DNA, 15 bp, Homo sapiens
agaatgagagagtgt

SEQ ID NO: 5835515 - DNA, 17 bp, Homo sapiens
agaatgagagagtgtgg

SEQ ID NO: 5835516 - DNA, 19 bp, Homo sapiens
agaatgagagcgacacaga

SEQ ID NO: 5835517 - DNA, 20 bp, Homo sapiens
agaatgagagcgacacagac

SEQ ID NO: 5835518 - DNA, 15 bp, Homo sapiens
agaatgagatgattt

SEQ ID NO: 5835519 - DNA, 17 bp, Homo sapiens
agaatgagatgatttaa

SEQ ID NO: 5835520 - DNA, 20 bp, Homo sapiens
agaatgagatgatttaattc

SEQ ID NO: 5835521 - DNA, 16 bp, Homo sapiens
agaatgagcacccatt

SEQ ID NO: 5835522 - DNA, 19 bp, Homo sapiens
agaatgagcagagagcaaa

SEQ ID NO: 5835523 - DNA, 21 bp, Homo sapiens
agaatgagcctacgctgaaga

SEQ ID NO: 5835524 - DNA, 12 bp, Homo sapiens
agaatgagcctc

SEQ ID NO: 5835525 - DNA, 15 bp, Homo sapiens
agaatgagctggttt

SEQ ID NO: 5835526 - DNA, 16 bp, Homo sapiens
agaatgaggaggaagg

SEQ ID NO: 5835527 - DNA, 20 bp, Homo sapiens
agaatgaggctgctttccaa

SEQ ID NO: 5835528 - DNA, 20 bp, Homo sapiens
agaatgagggcgtgaaacac

SEQ ID NO: 5835529 - DNA, 23 bp, Homo sapiens
agaatgagggcgtgaaacacaat

SEQ ID NO: 5835530 - DNA, 22 bp, Homo sapiens
agaatgagtccttgatttcaaa

SEQ ID NO: 5835531 - DNA, 14 bp, Homo sapiens
agaatgagtttctt

SEQ ID NO: 5835532 - DNA, 19 bp, Homo sapiens
agaatgatcaaggatctgg

SEQ ID NO: 5835533 - DNA, 23 bp, Homo sapiens
agaatgatcaccctgaattcatt

SEQ ID NO: 5835534 - DNA, 14 bp, Homo sapiens
agaatgatctgatt

SEQ ID NO: 5835535 - DNA, 20 bp, Homo sapiens
agaatgatgataacagaact

SEQ ID NO: 5835536 - DNA, 13 bp, Homo sapiens
agaatgatttcat

SEQ ID NO: 5835537 - DNA, 18 bp, Homo sapiens
agaatgattttgctgact

SEQ ID NO: 5835538 - DNA, 20 bp, Homo sapiens
agaatgcaaccaagtcacac

SEQ ID NO: 5835539 - DNA, 22 bp, Homo sapiens
agaatgcacaaacagaggccgc

SEQ ID NO: 5835540 - DNA, 23 bp, Homo sapiens
agaatgcacaaacagaggccgcc

SEQ ID NO: 5835541 - DNA, 17 bp, Homo sapiens
agaatgcacaagaatgg

SEQ ID NO: 5835542 - DNA, 18 bp, Homo sapiens
agaatgcacagatatact

SEQ ID NO: 5835543 - DNA, 22 bp, Homo sapiens
agaatgcacattggaagctccc

SEQ ID NO: 5835544 - DNA, 23 bp, Homo sapiens
agaatgcacgcgtgcatatgcta

SEQ ID NO: 5835545 - DNA, 23 bp, Homo sapiens
agaatgcacttgattcaggaggt

SEQ ID NO: 5835546 - DNA, 14 bp, Homo sapiens
agaatgcagagatg

SEQ ID NO: 5835547 - DNA, 15 bp, Homo sapiens
agaatgcagagatgt

SEQ ID NO: 5835548 - DNA, 21 bp, Homo sapiens
agaatgcagattcctgggcct

SEQ ID NO: 5835549 - DNA, 19 bp, Homo sapiens
agaatgcagcccaccagga

SEQ ID NO: 5835550 - DNA, 21 bp, Homo sapiens
agaatgcagcccaccaggagc

SEQ ID NO: 5835551 - DNA, 21 bp, Homo sapiens
agaatgcattccagaacaaat

SEQ ID NO: 5835552 - DNA, 16 bp, Homo sapiens
agaatgcattccctga

SEQ ID NO: 5835553 - DNA, 20 bp, Homo sapiens
agaatgcattccctgaatct

SEQ ID NO: 5835554 - DNA, 12 bp, Homo sapiens
agaatgcattga

SEQ ID NO: 5835555 - DNA, 13 bp, Homo sapiens
agaatgcattgat

SEQ ID NO: 5835556 - DNA, 21 bp, Homo sapiens
agaatgcattgatattgtgaa

SEQ ID NO: 5835557 - DNA, 22 bp, Homo sapiens
agaatgcattgatattgtgaac

SEQ ID NO: 5835558 - DNA, 14 bp, Homo sapiens
agaatgccagccca

SEQ ID NO: 5835559 - DNA, 18 bp, Homo sapiens
agaatgccagcccaaagc

SEQ ID NO: 5835560 - DNA, 22 bp, Homo sapiens
agaatgccataaaattgcagtt

SEQ ID NO: 5835561 - DNA, 22 bp, Homo sapiens
agaatgccatatttttgagggc

SEQ ID NO: 5835562 - DNA, 16 bp, Homo sapiens
agaatgccattctctt

SEQ ID NO: 5835563 - DNA, 16 bp, Homo sapiens
agaatgccatttctca

SEQ ID NO: 5835564 - DNA, 15 bp, Homo sapiens
agaatgcccaactct

SEQ ID NO: 5835565 - DNA, 17 bp, Homo sapiens
agaatgcccaactcttc

SEQ ID NO: 5835566 - DNA, 18 bp, Homo sapiens
agaatgcccaactcttca

SEQ ID NO: 5835567 - DNA, 15 bp, Homo sapiens
agaatgccctcagct

SEQ ID NO: 5835568 - DNA, 16 bp, Homo sapiens
agaatgccggttaaat

SEQ ID NO: 5835569 - DNA, 18 bp, Homo sapiens
agaatgctctttacttca

SEQ ID NO: 5835570 - DNA, 15 bp, Homo sapiens
agaatgctgtagaat

SEQ ID NO: 5835571 - DNA, 14 bp, Homo sapiens
agaatgctttgaaa

SEQ ID NO: 5835572 - DNA, 15 bp, Homo sapiens
agaatgctttgccat

SEQ ID NO: 5835573 - DNA, 13 bp, Homo sapiens
agaatggaaaaga

SEQ ID NO: 5835574 - DNA, 23 bp, Homo sapiens
agaatggaaaccacaacttttaa

SEQ ID NO: 5835575 - DNA, 16 bp, Homo sapiens
agaatggaaatttata

SEQ ID NO: 5835576 - DNA, 18 bp, Homo sapiens
agaatggaactcaagctg

SEQ ID NO: 5835577 - DNA, 17 bp, Homo sapiens
agaatggaagcctccac

SEQ ID NO: 5835578 - DNA, 16 bp, Homo sapiens
agaatggaagcctgaa

SEQ ID NO: 5835579 - DNA, 22 bp, Homo sapiens
agaatggagaaagtaagtcttt

SEQ ID NO: 5835580 - DNA, 14 bp, Homo sapiens
agaatggagacaga

SEQ ID NO: 5835581 - DNA, 14 bp, Homo sapiens
agaatggagggcct

SEQ ID NO: 5835582 - DNA, 22 bp, Homo sapiens
agaatggataagatgatgttaa

SEQ ID NO: 5835583 - DNA, 19 bp, Homo sapiens
agaatggatcacaagatgg

SEQ ID NO: 5835584 - DNA, 14 bp, Homo sapiens
agaatggatttttc

SEQ ID NO: 5835585 - DNA, 16 bp, Homo sapiens
agaatggcagaaaagt

SEQ ID NO: 5835586 - DNA, 16 bp, Homo sapiens
agaatggcctggagca

SEQ ID NO: 5835587 - DNA, 18 bp, Homo sapiens
agaatggcctggagcagg

SEQ ID NO: 5835588 - DNA, 13 bp, Homo sapiens
agaatggctctgg

SEQ ID NO: 5835589 - DNA, 14 bp, Homo sapiens
agaatggctctggc

SEQ ID NO: 5835590 - DNA, 22 bp, Homo sapiens
agaatggctgactgttgccttt

SEQ ID NO: 5835591 - DNA, 22 bp, Homo sapiens
agaatggctttcaatacccttt

SEQ ID NO: 5835592 - DNA, 18 bp, Homo sapiens
agaatggctttggtctct

SEQ ID NO: 5835593 - DNA, 23 bp, Homo sapiens
agaatggctttggtctcttgctt

SEQ ID NO: 5835594 - DNA, 18 bp, Homo sapiens
agaatgggacgaggacat

SEQ ID NO: 5835595 - DNA, 22 bp, Homo sapiens
agaatgggacgaggacatttgt

SEQ ID NO: 5835596 - DNA, 17 bp, Homo sapiens
agaatggggctgggccc

SEQ ID NO: 5835597 - DNA, 22 bp, Homo sapiens
agaatgggggctttcggggagg

SEQ ID NO: 5835598 - DNA, 21 bp, Homo sapiens
agaatgggggtatcctgtgca

SEQ ID NO: 5835599 - DNA, 17 bp, Homo sapiens
agaatggggttcctgct

SEQ ID NO: 5835600 - DNA, 18 bp, Homo sapiens
agaatggggttcctgctg

SEQ ID NO: 5835601 - DNA, 20 bp, Homo sapiens
agaatggggttcctgctgtg

SEQ ID NO: 5835602 - DNA, 23 bp, Homo sapiens
agaatggtccgtgctaaggactt

SEQ ID NO: 5835603 - DNA, 15 bp, Homo sapiens
agaatggtggagtgt

SEQ ID NO: 5835604 - DNA, 13 bp, Homo sapiens
agaatggtggctt

SEQ ID NO: 5835605 - DNA, 19 bp, Homo sapiens
agaatggtgggctccagag

SEQ ID NO: 5835606 - DNA, 23 bp, Homo sapiens
agaatggtgggctccagagtagg

SEQ ID NO: 5835607 - DNA, 12 bp, Homo sapiens
agaatgtaaagc

SEQ ID NO: 5835608 - DNA, 19 bp, Homo sapiens
agaatgtaaatgtctcact

SEQ ID NO: 5835609 - DNA, 19 bp, Homo sapiens
agaatgtaagaaaacaaaa

SEQ ID NO: 5835610 - DNA, 15 bp, Homo sapiens
agaatgtaagaacta

SEQ ID NO: 5835611 - DNA, 15 bp, Homo sapiens
agaatgtaatatact

SEQ ID NO: 5835612 - DNA, 12 bp, Homo sapiens
agaatgtacaga

SEQ ID NO: 5835613 - DNA, 17 bp, Homo sapiens
agaatgtacagaaaata

SEQ ID NO: 5835614 - DNA, 17 bp, Homo sapiens
agaatgtagaagtggca

SEQ ID NO: 5835615 - DNA, 15 bp, Homo sapiens
agactgttgctcaaa

SEQ ID NO: 5835616 - DNA, 17 bp, Homo sapiens
agactgttgtccctgca

SEQ ID NO: 5835617 - DNA, 16 bp, Homo sapiens
agactgtttgaatgtt

SEQ ID NO: 5835618 - DNA, 19 bp, Homo sapiens
agactgtttttaagtaact

SEQ ID NO: 5835619 - DNA, 19 bp, Homo sapiens
agacttaactggcccagaa

SEQ ID NO: 5835620 - DNA, 20 bp, Homo sapiens
agacttaactggcccagaag

SEQ ID NO: 5835621 - DNA, 23 bp, Homo sapiens
agacttaactggcccagaagctg

SEQ ID NO: 5835622 - DNA, 18 bp, Homo sapiens
agacttaatcttgaatga

SEQ ID NO: 5835623 - DNA, 20 bp, Homo sapiens
agacttaatgagactttaaa

SEQ ID NO: 5835624 - DNA, 16 bp, Homo sapiens
agacttaatttcaaat

SEQ ID NO: 5835625 - DNA, 20 bp, Homo sapiens
agacttaatttcaaatctgt

SEQ ID NO: 5835626 - DNA, 14 bp, Homo sapiens
agacttaattttgt

SEQ ID NO: 5835627 - DNA, 19 bp, Homo sapiens
agacttacgccctgttccc

SEQ ID NO: 5835628 - DNA, 20 bp, Homo sapiens
agacttactaataaaatgtg

SEQ ID NO: 5835629 - DNA, 23 bp, Homo sapiens
agacttactaataaaatgtgaag

SEQ ID NO: 5835630 - DNA, 15 bp, Homo sapiens
agacttactattaca

SEQ ID NO: 5835631 - DNA, 16 bp, Homo sapiens
agacttactctaagat

SEQ ID NO: 5835632 - DNA, 18 bp, Homo sapiens
agacttactctaagatct

SEQ ID NO: 5835633 - DNA, 19 bp, Homo sapiens
agacttacttgcattgctg

SEQ ID NO: 5835634 - DNA, 17 bp, Homo sapiens
agacttagatctgagcc

SEQ ID NO: 5835635 - DNA, 17 bp, Homo sapiens
agacttagggcaccagg

SEQ ID NO: 5835636 - DNA, 14 bp, Homo sapiens
agacttatcaacat

SEQ ID NO: 5835637 - DNA, 21 bp, Homo sapiens
agacttcaaaaggaatgaact

SEQ ID NO: 5835638 - DNA, 17 bp, Homo sapiens
agacttcaaaatattga

SEQ ID NO: 5835639 - DNA, 19 bp, Homo sapiens
agacttcaagcatggctat

SEQ ID NO: 5835640 - DNA, 14 bp, Homo sapiens
agacttcaccaaat

SEQ ID NO: 5835641 - DNA, 15 bp, Homo sapiens
agacttcactgcagc

SEQ ID NO: 5835642 - DNA, 16 bp, Homo sapiens
agacttcactgcagcc

SEQ ID NO: 5835643 - DNA, 14 bp, Homo sapiens
agacttcagattcc

SEQ ID NO: 5835644 - DNA, 16 bp, Homo sapiens
agacttcagattcccc

SEQ ID NO: 5835645 - DNA, 14 bp, Homo sapiens
agacttcagggagt

SEQ ID NO: 5835646 - DNA, 14 bp, Homo sapiens
agacttcaggttgt

SEQ ID NO: 5835647 - DNA, 24 bp, Homo sapiens
agacttcaggttgttctgtataaa

SEQ ID NO: 5835648 - DNA, 19 bp, Homo sapiens
agacttcagtatgttgtca

SEQ ID NO: 5835649 - DNA, 21 bp, Homo sapiens
agacttcagtatgttgtcaaa

SEQ ID NO: 5835650 - DNA, 19 bp, Homo sapiens
agacttcagtcctggtctg

SEQ ID NO: 5835651 - DNA, 14 bp, Homo sapiens
agacttcatccctc

SEQ ID NO: 5835652 - DNA, 17 bp, Homo sapiens
agacttcatccctctgg

SEQ ID NO: 5835653 - DNA, 21 bp, Homo sapiens
agacttccaaacctgacagat

SEQ ID NO: 5835654 - DNA, 17 bp, Homo sapiens
agacttccaaagaatgt

SEQ ID NO: 5835655 - DNA, 17 bp, Homo sapiens
agacttccaaatcctgg

SEQ ID NO: 5835656 - DNA, 15 bp, Homo sapiens
agacttccagagcct

SEQ ID NO: 5835657 - DNA, 17 bp, Homo sapiens
agacttcccaacagcct

SEQ ID NO: 5835658 - DNA, 18 bp, Homo sapiens
agacttcccaacagcctt

SEQ ID NO: 5835659 - DNA, 18 bp, Homo sapiens
agacttcccactgttctg

SEQ ID NO: 5835660 - DNA, 23 bp, Homo sapiens
agacttccccaagcctggcaggg

SEQ ID NO: 5835661 - DNA, 15 bp, Homo sapiens
agacttccccatccc

SEQ ID NO: 5835662 - DNA, 17 bp, Homo sapiens
agacttccccatcccga

SEQ ID NO: 5835663 - DNA, 15 bp, Homo sapiens
agacttccctgaatg

SEQ ID NO: 5835664 - DNA, 19 bp, Homo sapiens
agacttcctattaatttat

SEQ ID NO: 5835665 - DNA, 15 bp, Homo sapiens
agacttcctctctac

SEQ ID NO: 5835666 - DNA, 21 bp, Homo sapiens
agacttcctctggctccccaa

SEQ ID NO: 5835667 - DNA, 16 bp, Homo sapiens
agacttcgactcagga

SEQ ID NO: 5835668 - DNA, 20 bp, Homo sapiens
agacttcgactcaggatcca

SEQ ID NO: 5835669 - DNA, 19 bp, Homo sapiens
agacttcgctattcccagg

SEQ ID NO: 5835670 - DNA, 21 bp, Homo sapiens
agacttcgctattcccaggca

SEQ ID NO: 5835671 - DNA, 23 bp, Homo sapiens
agacttcgctattcccaggcagg

SEQ ID NO: 5835672 - DNA, 18 bp, Homo sapiens
agacttctaaaataaatg

SEQ ID NO: 5835673 - DNA, 15 bp, Homo sapiens
agacttctagcagaa

SEQ ID NO: 5835674 - DNA, 19 bp, Homo sapiens
agacttctcggaattcata

SEQ ID NO: 5835675 - DNA, 17 bp, Homo sapiens
agacttctctttcttat

SEQ ID NO: 5835676 - DNA, 18 bp, Homo sapiens
agacttctgcttttcaac

SEQ ID NO: 5835677 - DNA, 22 bp, Homo sapiens
agacttctggaaggctggctga

SEQ ID NO: 5835678 - DNA, 19 bp, Homo sapiens
agacttctggtgctgctgg

SEQ ID NO: 5835679 - DNA, 18 bp, Homo sapiens
agacttctggttgtattt

SEQ ID NO: 5835680 - DNA, 15 bp, Homo sapiens
agacttctgttttca

SEQ ID NO: 5835681 - DNA, 17 bp, Homo sapiens
agacttctgttttcaat

SEQ ID NO: 5835682 - DNA, 18 bp, Homo sapiens
agacttgaaaagagacag

SEQ ID NO: 5835683 - DNA, 19 bp, Homo sapiens
agacttgaaaagagacagg

SEQ ID NO: 5835684 - DNA, 12 bp, Homo sapiens
agacttgaaagt

SEQ ID NO: 5835685 - DNA, 15 bp, Homo sapiens
agacttgaaagtttt

SEQ ID NO: 5835686 - DNA, 22 bp, Homo sapiens
agacttgaaatacgtttgtgtt

SEQ ID NO: 5835687 - DNA, 22 bp, Homo sapiens
agacttgaatttagttttttac

SEQ ID NO: 5835688 - DNA, 22 bp, Homo sapiens
agacttgacaacatcccacagt

SEQ ID NO: 5835689 - DNA, 15 bp, Homo sapiens
agacttgacagtgga

SEQ ID NO: 5835690 - DNA, 20 bp, Homo sapiens
agacttgacgcagcccccca

SEQ ID NO: 5835691 - DNA, 18 bp, Homo sapiens
agacttgagacaatgttt

SEQ ID NO: 5835692 - DNA, 22 bp, Homo sapiens
agacttgagcttgacctaagga

SEQ ID NO: 5835693 - DNA, 18 bp, Homo sapiens
agacttgatgaataaaca

SEQ ID NO: 5835694 - DNA, 21 bp, Homo sapiens
agacttgcagttagactcaaa

SEQ ID NO: 5835695 - DNA, 11 bp, Homo sapiens
agacttgcctt

SEQ ID NO: 5835696 - DNA, 23 bp, Homo sapiens
agacttgcggccacagcactaga

SEQ ID NO: 5835697 - DNA, 12 bp, Homo sapiens
agacttgctccc

SEQ ID NO: 5835698 - DNA, 20 bp, Homo sapiens
agacttgctgaatcggaatc

SEQ ID NO: 5835699 - DNA, 14 bp, Homo sapiens
agacttggagctgt

SEQ ID NO: 5835700 - DNA, 12 bp, Homo sapiens
agacttggatta

SEQ ID NO: 5835701 - DNA, 21 bp, Homo sapiens
agacttggattctttccattt

SEQ ID NO: 5835702 - DNA, 19 bp, Homo sapiens
agacttggcaacagaagca

SEQ ID NO: 5835703 - DNA, 14 bp, Homo sapiens
agacttggcctcca

SEQ ID NO: 5835704 - DNA, 22 bp, Homo sapiens
agacttggcctccagctgttct

SEQ ID NO: 5835705 - DNA, 14 bp, Homo sapiens
agacttggggccag

SEQ ID NO: 5835706 - DNA, 21 bp, Homo sapiens
agacttggttggtagggtggg

SEQ ID NO: 5835707 - DNA, 22 bp, Homo sapiens
agacttggttggtagggtggga

SEQ ID NO: 5835708 - DNA, 11 bp, Homo sapiens
agacttgtaca

SEQ ID NO: 5835709 - DNA, 23 bp, Homo sapiens
agacttgtacagttgactggctt

SEQ ID NO: 5835710 - DNA, 16 bp, Homo sapiens
agacttgtatattcta

SEQ ID NO: 5835711 - DNA, 17 bp, Homo sapiens
agacttgtgctcaagga

SEQ ID NO: 5835712 - DNA, 17 bp, Homo sapiens
agacttgtgtgcatgga

SEQ ID NO: 5835713 - DNA, 15 bp, Homo sapiens
agacttgttaaatgt

SEQ ID NO: 5835714 - DNA, 15 bp, Homo sapiens
agacttgttcttggt

SEQ ID NO: 5835715 - DNA, 12 bp, Homo sapiens
agacttgtttcc

SEQ ID NO: 5835716 - DNA, 16 bp, Homo sapiens
agacttgtttcctgtg

SEQ ID NO: 5835717 - DNA, 10 bp, Homo sapiens
agactttaaa

SEQ ID NO: 5835718 - DNA, 21 bp, Homo sapiens
agactttaacataagctattt

SEQ ID NO: 5835719 - DNA, 22 bp, Homo sapiens
agactttaatcactgctgaaga

SEQ ID NO: 5835720 - DNA, 20 bp, Homo sapiens
agactttaattcttctcttt

SEQ ID NO: 5835721 - DNA, 19 bp, Homo sapiens
agactttacatgacacagc

SEQ ID NO: 5835722 - DNA, 16 bp, Homo sapiens
agactttagaaataaa

SEQ ID NO: 5835723 - DNA, 16 bp, Homo sapiens
agactttagtgccctg

SEQ ID NO: 5835724 - DNA, 17 bp, Homo sapiens
agactttagtgccctgc

SEQ ID NO: 5835725 - DNA, 18 bp, Homo sapiens
agactttagtgccctgcc

SEQ ID NO: 5835726 - DNA, 19 bp, Homo sapiens
agactttagtgccctgccc

SEQ ID NO: 5835727 - DNA, 22 bp, Homo sapiens
agactttccattacaagtattt

SEQ ID NO: 5835728 - DNA, 20 bp, Homo sapiens
agactttccccaacaatgtg

SEQ ID NO: 5835729 - DNA, 14 bp, Homo sapiens
agactttctgaagt

SEQ ID NO: 5835730 - DNA, 12 bp, Homo sapiens
agactttctgtt

SEQ ID NO: 5835731 - DNA, 15 bp, Homo sapiens
agactttcttctagt

SEQ ID NO: 5835732 - DNA, 14 bp, Homo sapiens
agactttctttaaa

SEQ ID NO: 5835733 - DNA, 20 bp, Homo sapiens
agactttctttttctacatg

SEQ ID NO: 5835734 - DNA, 20 bp, Homo sapiens
agactttgagcctgcatctt

SEQ ID NO: 5835735 - DNA, 18 bp, Homo sapiens
agactttgatccttggaa

SEQ ID NO: 5835736 - DNA, 19 bp, Homo sapiens
agactttgatccttggaaa

SEQ ID NO: 5835737 - DNA, 21 bp, Homo sapiens
agactttgatccttggaaacc

SEQ ID NO: 5835738 - DNA, 11 bp, Homo sapiens
agactttgatg

SEQ ID NO: 5835739 - DNA, 14 bp, Homo sapiens
agactttgatgtca

SEQ ID NO: 5835740 - DNA, 17 bp, Homo sapiens
agactttgatgtcagca

SEQ ID NO: 5835741 - DNA, 22 bp, Homo sapiens
agactttgctaaagacatgaag

SEQ ID NO: 5835742 - DNA, 20 bp, Homo sapiens
agactttgctgcattttaca

SEQ ID NO: 5835743 - DNA, 22 bp, Homo sapiens
agactttgctgcattttacaca

SEQ ID NO: 5835744 - DNA, 13 bp, Homo sapiens
agactttgctgtt

SEQ ID NO: 5835745 - DNA, 17 bp, Homo sapiens
agactttggaaagactt

SEQ ID NO: 5835746 - DNA, 15 bp, Homo sapiens
agactttggaaagag

SEQ ID NO: 5835747 - DNA, 17 bp, Homo sapiens
agactttggacagtggc

SEQ ID NO: 5835748 - DNA, 18 bp, Homo sapiens
agactttgtcacttattt

SEQ ID NO: 5835749 - DNA, 19 bp, Homo sapiens
agactttgtgactgtcact

SEQ ID NO: 5835750 - DNA, 21 bp, Homo sapiens
agactttgtgttcatttcatt

SEQ ID NO: 5835751 - DNA, 21 bp, Homo sapiens
agacttttagcggtttgcaaa

SEQ ID NO: 5835752 - DNA, 21 bp, Homo sapiens
agacttttatgtgagatttcc

SEQ ID NO: 5835753 - DNA, 17 bp, Homo sapiens
agacttttattaataaa

SEQ ID NO: 5835754 - DNA, 15 bp, Homo sapiens
agacttttcagaaga

SEQ ID NO: 5835755 - DNA, 16 bp, Homo sapiens
agacttttcagaagat

SEQ ID NO: 5835756 - DNA, 17 bp, Homo sapiens
agacttttggtagagaa

SEQ ID NO: 5835757 - DNA, 13 bp, Homo sapiens
agacttttgtaca

SEQ ID NO: 5835758 - DNA, 14 bp, Homo sapiens
agacttttgtacat

SEQ ID NO: 5835759 - DNA, 22 bp, Homo sapiens
agacttttgtacatctggctta

SEQ ID NO: 5835760 - DNA, 13 bp, Homo sapiens
agactttttggtg

SEQ ID NO: 5835761 - DNA, 22 bp, Homo sapiens
agacttttttttttcatgttat

SEQ ID NO: 5835762 - DNA, 11 bp, Homo sapiens
agagaaaaaaa

SEQ ID NO: 5835763 - DNA, 15 bp, Homo sapiens
agagaaaaaaaaata

SEQ ID NO: 5835764 - DNA, 21 bp, Homo sapiens
agagaaaaaaaaatatgtgta

SEQ ID NO: 5835765 - DNA, 23 bp, Homo sapiens
agagaaaaaaaaatatgtgtaca

SEQ ID NO: 5835766 - DNA, 21 bp, Homo sapiens
agagaaaaaaagtttgccaga

SEQ ID NO: 5835767 - DNA, 16 bp, Homo sapiens
agagaaaaaactagag

SEQ ID NO: 5835768 - DNA, 14 bp, Homo sapiens
agagaaaaaagcca

SEQ ID NO: 5835769 - DNA, 16 bp, Homo sapiens
agagaaaaaagcccgg

SEQ ID NO: 5835770 - DNA, 22 bp, Homo sapiens
agagaaaaaagtcaccattctg

SEQ ID NO: 5835771 - DNA, 13 bp, Homo sapiens
agagaaaaaatta

SEQ ID NO: 5835772 - DNA, 16 bp, Homo sapiens
agagaaaaaccaatga

SEQ ID NO: 5835773 - DNA, 17 bp, Homo sapiens
agagaaaaagaaagaac

SEQ ID NO: 5835774 - DNA, 21 bp, Homo sapiens
agagaaaaagaaatgcaaaaa

SEQ ID NO: 5835775 - DNA, 15 bp, Homo sapiens
agagaaaaagagaga

SEQ ID NO: 5835776 - DNA, 18 bp, Homo sapiens
agagaaaaagagagagca

SEQ ID NO: 5835777 - DNA, 24 bp, Homo sapiens
agagaaaaagagagagcagggtgg

SEQ ID NO: 5835778 - DNA, 14 bp, Homo sapiens
agagaaaaagccct

SEQ ID NO: 5835779 - DNA, 16 bp, Homo sapiens
agagaaaaagccctct

SEQ ID NO: 5835780 - DNA, 17 bp, Homo sapiens
agagaaaaagccctctt

SEQ ID NO: 5835781 - DNA, 19 bp, Homo sapiens
agagaaaaaggctgaaaag

SEQ ID NO: 5835782 - DNA, 21 bp, Homo sapiens
agagaaaaatgctttgctttg

SEQ ID NO: 5835783 - DNA, 15 bp, Homo sapiens
agagaaaacactttc

SEQ ID NO: 5835784 - DNA, 16 bp, Homo sapiens
agagaaaacatgcaga

SEQ ID NO: 5835785 - DNA, 13 bp, Homo sapiens
agagaaaacctta

SEQ ID NO: 5835786 - DNA, 14 bp, Homo sapiens
agagaaaaccttaa

SEQ ID NO: 5835787 - DNA, 16 bp, Homo sapiens
agagaaaactaaagaa

SEQ ID NO: 5835788 - DNA, 20 bp, Homo sapiens
agagaaaacttatttgagtg

SEQ ID NO: 5835789 - DNA, 18 bp, Homo sapiens
agagaaaagaaaaatcaa

SEQ ID NO: 5835790 - DNA, 14 bp, Homo sapiens
agagaaaagctgga

SEQ ID NO: 5835791 - DNA, 14 bp, Homo sapiens
agagaaaagggaaa

SEQ ID NO: 5835792 - DNA, 17 bp, Homo sapiens
agagatgagcccaccct

SEQ ID NO: 5835793 - DNA, 19 bp, Homo sapiens
agagatgagcccaccctgc

SEQ ID NO: 5835794 - DNA, 22 bp, Homo sapiens
agagatgaggaaataagacttt

SEQ ID NO: 5835795 - DNA, 17 bp, Homo sapiens
agagatgatactgactt

SEQ ID NO: 5835796 - DNA, 12 bp, Homo sapiens
agagatgattca

SEQ ID NO: 5835797 - DNA, 16 bp, Homo sapiens
agagatgcatgcgcag

SEQ ID NO: 5835798 - DNA, 17 bp, Homo sapiens
agagatgccagcccttc

SEQ ID NO: 5835799 - DNA, 21 bp, Homo sapiens
agagatgcctccaccgctgcc

SEQ ID NO: 5835800 - DNA, 15 bp, Homo sapiens
agagatgcctccctg

SEQ ID NO: 5835801 - DNA, 17 bp, Homo sapiens
agagatgctaaaattct

SEQ ID NO: 5835802 - DNA, 14 bp, Homo sapiens
agagatgcttggag

SEQ ID NO: 5835803 - DNA, 12 bp, Homo sapiens
agagatggacag

SEQ ID NO: 5835804 - DNA, 14 bp, Homo sapiens
agagatggaggagg

SEQ ID NO: 5835805 - DNA, 18 bp, Homo sapiens
agagatggaggaggaggc

SEQ ID NO: 5835806 - DNA, 18 bp, Homo sapiens
agagatggagtcttgcta

SEQ ID NO: 5835807 - DNA, 17 bp, Homo sapiens
agagatggcagagccat

SEQ ID NO: 5835808 - DNA, 14 bp, Homo sapiens
agagatgggatgct

SEQ ID NO: 5835809 - DNA, 22 bp, Homo sapiens
agagatgggggtgtattggaat

SEQ ID NO: 5835810 - DNA, 18 bp, Homo sapiens
agagatggggtttcacca

SEQ ID NO: 5835811 - DNA, 15 bp, Homo sapiens
agagatgtactgcaa

SEQ ID NO: 5835812 - DNA, 20 bp, Homo sapiens
agagatgtcaaaatgtgatt

SEQ ID NO: 5835813 - DNA, 17 bp, Homo sapiens
agagatgtcatcagagc

SEQ ID NO: 5835814 - DNA, 23 bp, Homo sapiens
agagatgtccatttttacaagtt

SEQ ID NO: 5835815 - DNA, 16 bp, Homo sapiens
agagatgtctcttata

SEQ ID NO: 5835816 - DNA, 15 bp, Homo sapiens
agagatgtctgttct

SEQ ID NO: 5835817 - DNA, 14 bp, Homo sapiens
agagatgtgcaccc

SEQ ID NO: 5835818 - DNA, 17 bp, Homo sapiens
agagatgtgcacccatg

SEQ ID NO: 5835819 - DNA, 15 bp, Homo sapiens
agagatgtgcagagt

SEQ ID NO: 5835820 - DNA, 20 bp, Homo sapiens
agagatgtgcccccaccccc

SEQ ID NO: 5835821 - DNA, 22 bp, Homo sapiens
agagatgtgcctgtgggagggg

SEQ ID NO: 5835822 - DNA, 12 bp, Homo sapiens
agagatgtgtgt

SEQ ID NO: 5835823 - DNA, 13 bp, Homo sapiens
agagatgtgtgtt

SEQ ID NO: 5835824 - DNA, 17 bp, Homo sapiens
agagatgtgtgttgata

SEQ ID NO: 5835825 - DNA, 22 bp, Homo sapiens
agagatgtgtgttgatactgtt

SEQ ID NO: 5835826 - DNA, 12 bp, Homo sapiens
agagatgttaag

SEQ ID NO: 5835827 - DNA, 14 bp, Homo sapiens
agagatgtttacag

SEQ ID NO: 5835828 - DNA, 16 bp, Homo sapiens
agagatgtttacagta

SEQ ID NO: 5835829 - DNA, 15 bp, Homo sapiens
agagatgttttcaag

SEQ ID NO: 5835830 - DNA, 17 bp, Homo sapiens
agagatgttttgttgat

SEQ ID NO: 5835831 - DNA, 16 bp, Homo sapiens
agagattaatttgtgt

SEQ ID NO: 5835832 - DNA, 16 bp, Homo sapiens
agagattacctcctga

SEQ ID NO: 5835833 - DNA, 19 bp, Homo sapiens
agagattagaacatttaat

SEQ ID NO: 5835834 - DNA, 20 bp, Homo sapiens
agagattagtaaatatgtga

SEQ ID NO: 5835835 - DNA, 15 bp, Homo sapiens
agagattataacaaa

SEQ ID NO: 5835836 - DNA, 20 bp, Homo sapiens
agagattattaaatcgttta

SEQ ID NO: 5835837 - DNA, 14 bp, Homo sapiens
agagattctggatc

SEQ ID NO: 5835838 - DNA, 23 bp, Homo sapiens
agagattctgtgatcttttaaag

SEQ ID NO: 5835839 - DNA, 12 bp, Homo sapiens
agagattcttag

SEQ ID NO: 5835840 - DNA, 19 bp, Homo sapiens
agagattcttctaggggta

SEQ ID NO: 5835841 - DNA, 17 bp, Homo sapiens
agagattgaactttgag

SEQ ID NO: 5835842 - DNA, 22 bp, Homo sapiens
agagattgcacagtcaaaacga

SEQ ID NO: 5835843 - DNA, 21 bp, Homo sapiens
agagattgggactgagtgctg

SEQ ID NO: 5835844 - DNA, 23 bp, Homo sapiens
agagattgggtttttggacttct

SEQ ID NO: 5835845 - DNA, 16 bp, Homo sapiens
agagattgtggtggtg

SEQ ID NO: 5835846 - DNA, 17 bp, Homo sapiens
agagatttaacactaaa

SEQ ID NO: 5835847 - DNA, 21 bp, Homo sapiens
agagatttcaacatatcattt

SEQ ID NO: 5835848 - DNA, 20 bp, Homo sapiens
agagatttcccttcatttaa

SEQ ID NO: 5835849 - DNA, 13 bp, Homo sapiens
agagatttctcat

SEQ ID NO: 5835850 - DNA, 21 bp, Homo sapiens
agagatttggggctaaagact

SEQ ID NO: 5835851 - DNA, 22 bp, Homo sapiens
agagatttggggctaaagactg

SEQ ID NO: 5835852 - DNA, 14 bp, Homo sapiens
agagattttatgtt

SEQ ID NO: 5835853 - DNA, 15 bp, Homo sapiens
agagattttcaacat

SEQ ID NO: 5835854 - DNA, 21 bp, Homo sapiens
agagattttcaacatttcaaa

SEQ ID NO: 5835855 - DNA, 20 bp, Homo sapiens
agagattttgtcgggacaga

SEQ ID NO: 5835856 - DNA, 13 bp, Homo sapiens
agagatttttcat

SEQ ID NO: 5835857 - DNA, 23 bp, Homo sapiens
agagatttttttgttgtttgttt

SEQ ID NO: 5835858 - DNA, 21 bp, Homo sapiens
agagatttttttttaaagaag

SEQ ID NO: 5835859 - DNA, 16 bp, Homo sapiens
agagcaaaaatgtaaa

SEQ ID NO: 5835860 - DNA, 18 bp, Homo sapiens
agagcaaaaatgtaaaaa

SEQ ID NO: 5835861 - DNA, 19 bp, Homo sapiens
agagcaaaaatgtaaaaaa

SEQ ID NO: 5835862 - DNA, 21 bp, Homo sapiens
agagcaaaaatgtaaaaaaca

SEQ ID NO: 5835863 - DNA, 14 bp, Homo sapiens
agagcaaactttag

SEQ ID NO: 5835864 - DNA, 22 bp, Homo sapiens
agagcaaaggagacaaagcagg

SEQ ID NO: 5835865 - DNA, 15 bp, Homo sapiens
agagcaaaggcccat

SEQ ID NO: 5835866 - DNA, 17 bp, Homo sapiens
agagcaaaggcccatgc

SEQ ID NO: 5835867 - DNA, 18 bp, Homo sapiens
agagcaaagtcatgtcag

SEQ ID NO: 5835868 - DNA, 23 bp, Homo sapiens
agagcaaagtcatgtcagaagga

SEQ ID NO: 5835869 - DNA, 14 bp, Homo sapiens
agagcaaagtgacc

SEQ ID NO: 5835870 - DNA, 24 bp, Homo sapiens
agagcaacccattaatcttttgta

SEQ ID NO: 5835871 - DNA, 23 bp, Homo sapiens
agagcaacccctggaccccagcc

SEQ ID NO: 5835872 - DNA, 14 bp, Homo sapiens
agagcaactctgag

SEQ ID NO: 5835873 - DNA, 18 bp, Homo sapiens
agagcaagaaaaaagtac

SEQ ID NO: 5835874 - DNA, 21 bp, Homo sapiens
agagcaagaaggaaagatttg

SEQ ID NO: 5835875 - DNA, 19 bp, Homo sapiens
agagcaagacgctgtgctg

SEQ ID NO: 5835876 - DNA, 23 bp, Homo sapiens
agagcaagacgctgtgctgccct

SEQ ID NO: 5835877 - DNA, 18 bp, Homo sapiens
agagcaagactccatctc

SEQ ID NO: 5835878 - DNA, 18 bp, Homo sapiens
agagcaagactccatttc

SEQ ID NO: 5835879 - DNA, 17 bp, Homo sapiens
agagcaagactccgtct

SEQ ID NO: 5835880 - DNA, 14 bp, Homo sapiens
agagcaagactctg

SEQ ID NO: 5835881 - DNA, 20 bp, Homo sapiens
agagcaagactctgtctcaa

SEQ ID NO: 5835882 - DNA, 23 bp, Homo sapiens
agagcaagatcctgtctttaagg

SEQ ID NO: 5835883 - DNA, 17 bp, Homo sapiens
agagcaaggaaggtaaa

SEQ ID NO: 5835884 - DNA, 19 bp, Homo sapiens
agagcaaggtcatgaagga

SEQ ID NO: 5835885 - DNA, 14 bp, Homo sapiens
agagcaagtctgca

SEQ ID NO: 5835886 - DNA, 23 bp, Homo sapiens
agagcaatgttggttttttataa

SEQ ID NO: 5835887 - DNA, 14 bp, Homo sapiens
agagcaattccagg

SEQ ID NO: 5835888 - DNA, 18 bp, Homo sapiens
agagcaattccaggctga

SEQ ID NO: 5835889 - DNA, 21 bp, Homo sapiens
agagcaattctgggagaatga

SEQ ID NO: 5835890 - DNA, 13 bp, Homo sapiens
agagcacaaacat

SEQ ID NO: 5835891 - DNA, 14 bp, Homo sapiens
agagcacaaagata

SEQ ID NO: 5835892 - DNA, 15 bp, Homo sapiens
agagcacaaagataa

SEQ ID NO: 5835893 - DNA, 19 bp, Homo sapiens
agagcacaagttccagctg

SEQ ID NO: 5835894 - DNA, 21 bp, Homo sapiens
agagcacacagagaagggaag

SEQ ID NO: 5835895 - DNA, 16 bp, Homo sapiens
agagcacacttattta

SEQ ID NO: 5835896 - DNA, 14 bp, Homo sapiens
agagcacagagccc

SEQ ID NO: 5835897 - DNA, 21 bp, Homo sapiens
agagcacagccaatctccagg

SEQ ID NO: 5835898 - DNA, 13 bp, Homo sapiens
agagcacagccct

SEQ ID NO: 5835899 - DNA, 14 bp, Homo sapiens
agagcacagccctc

SEQ ID NO: 5835900 - DNA, 15 bp, Homo sapiens
agagcacagccctcc

SEQ ID NO: 5835901 - DNA, 17 bp, Homo sapiens
agagcacagcgtttaca

SEQ ID NO: 5835902 - DNA, 14 bp, Homo sapiens
agagcacagcttct

SEQ ID NO: 5835903 - DNA, 18 bp, Homo sapiens
agagcacagcttcttctg

SEQ ID NO: 5835904 - DNA, 13 bp, Homo sapiens
agagcacatttag

SEQ ID NO: 5835905 - DNA, 15 bp, Homo sapiens
agagcacccacagcc

SEQ ID NO: 5835906 - DNA, 20 bp, Homo sapiens
agagcacccccaagcctggg

SEQ ID NO: 5835907 - DNA, 15 bp, Homo sapiens
agagcaccccctgct

SEQ ID NO: 5835908 - DNA, 16 bp, Homo sapiens
agagcacccctctctg

SEQ ID NO: 5835909 - DNA, 20 bp, Homo sapiens
agagcaccctcgagaagggt

SEQ ID NO: 5835910 - DNA, 18 bp, Homo sapiens
agagcacctagtccagtg

SEQ ID NO: 5835911 - DNA, 16 bp, Homo sapiens
agagcacctcaggacc

SEQ ID NO: 5835912 - DNA, 17 bp, Homo sapiens
agagcacctgctgtctg

SEQ ID NO: 5835913 - DNA, 15 bp, Homo sapiens
agagcacctggtggg

SEQ ID NO: 5835914 - DNA, 21 bp, Homo sapiens
agagcacctgttgtgtgcctg

SEQ ID NO: 5835915 - DNA, 21 bp, Homo sapiens
agagcaccttagacagtccct

SEQ ID NO: 5835916 - DNA, 20 bp, Homo sapiens
agagcaccttcctcacttcc

SEQ ID NO: 5835917 - DNA, 20 bp, Homo sapiens
agagcacctttgcacaggat

SEQ ID NO: 5835918 - DNA, 22 bp, Homo sapiens
agagcacgcctgccatcttctc

SEQ ID NO: 5835919 - DNA, 21 bp, Homo sapiens
agagcactaggttcaattccc

SEQ ID NO: 5835920 - DNA, 13 bp, Homo sapiens
agagcactcccta

SEQ ID NO: 5835921 - DNA, 13 bp, Homo sapiens
agagcactctcac

SEQ ID NO: 5835922 - DNA, 13 bp, Homo sapiens
agagcactgccac

SEQ ID NO: 5835923 - DNA, 14 bp, Homo sapiens
agagcactgccacc

SEQ ID NO: 5835924 - DNA, 12 bp, Homo sapiens
agagcactgcct

SEQ ID NO: 5835925 - DNA, 17 bp, Homo sapiens
agagcactgcctctatg

SEQ ID NO: 5835926 - DNA, 19 bp, Homo sapiens
agagcactgcctctatgcc

SEQ ID NO: 5835927 - DNA, 15 bp, Homo sapiens
agagcacttaagaga

SEQ ID NO: 5835928 - DNA, 22 bp, Homo sapiens
agagcacttaagagaatatttt

SEQ ID NO: 5835929 - DNA, 16 bp, Homo sapiens
agagcacttcacacag

SEQ ID NO: 5835930 - DNA, 23 bp, Homo sapiens
agagcactttaaaaacaggccag

SEQ ID NO: 5835931 - DNA, 13 bp, Homo sapiens
agagcactttagc

SEQ ID NO: 5835932 - DNA, 21 bp, Homo sapiens
agagcactttagcagatgtgg

SEQ ID NO: 5835933 - DNA, 19 bp, Homo sapiens
agagcacttttaacaaaaa

SEQ ID NO: 5835934 - DNA, 13 bp, Homo sapiens
agagcagaaataa

SEQ ID NO: 5835935 - DNA, 20 bp, Homo sapiens
agagcagaacagatctttta

SEQ ID NO: 5835936 - DNA, 20 bp, Homo sapiens
agagcagaacggagccccag

SEQ ID NO: 5835937 - DNA, 14 bp, Homo sapiens
agagcagacaggct

SEQ ID NO: 5835938 - DNA, 20 bp, Homo sapiens
agagcagagaagtacaggtc

SEQ ID NO: 5835939 - DNA, 16 bp, Homo sapiens
agagcagagcctacag

SEQ ID NO: 5835940 - DNA, 15 bp, Homo sapiens
agagcagatgcagag

SEQ ID NO: 5835941 - DNA, 12 bp, Homo sapiens
agagcagcaagg

SEQ ID NO: 5835942 - DNA, 12 bp, Homo sapiens
agagcagcagca

SEQ ID NO: 5835943 - DNA, 16 bp, Homo sapiens
agagcagcagcaccaa

SEQ ID NO: 5835944 - DNA, 21 bp, Homo sapiens
agagcagcattcccagggacc

SEQ ID NO: 5835945 - DNA, 19 bp, Homo sapiens
agagcagcctgatggccaa

SEQ ID NO: 5835946 - DNA, 12 bp, Homo sapiens
agagcagcctgg

SEQ ID NO: 5835947 - DNA, 13 bp, Homo sapiens
agagcagcctggc

SEQ ID NO: 5835948 - DNA, 16 bp, Homo sapiens
agagcagcctgtggca

SEQ ID NO: 5835949 - DNA, 19 bp, Homo sapiens
agagcagcctgtggcatct

SEQ ID NO: 5835950 - DNA, 19 bp, Homo sapiens
agagcagcgcccaggcctg

SEQ ID NO: 5835951 - DNA, 18 bp, Homo sapiens
agagcagctaactccgag

SEQ ID NO: 5835952 - DNA, 13 bp, Homo sapiens
agagcagctcccc

SEQ ID NO: 5835953 - DNA, 14 bp, Homo sapiens
agagcagctcccca

SEQ ID NO: 5835954 - DNA, 17 bp, Homo sapiens
agagcagctccccagga

SEQ ID NO: 5835955 - DNA, 21 bp, Homo sapiens
agagcagctccccaggagctc

SEQ ID NO: 5835956 - DNA, 12 bp, Homo sapiens
agagcagctggc

SEQ ID NO: 5835957 - DNA, 13 bp, Homo sapiens
agagcagctggct

SEQ ID NO: 5835958 - DNA, 21 bp, Homo sapiens
agagcagcttcggtgtgcaga

SEQ ID NO: 5835959 - DNA, 20 bp, Homo sapiens
agagcagcttctgccacttc

SEQ ID NO: 5835960 - DNA, 23 bp, Homo sapiens
agagcagcttctgccacttccca

SEQ ID NO: 5835961 - DNA, 20 bp, Homo sapiens
agagcagctttaaactcagg

SEQ ID NO: 5835962 - DNA, 23 bp, Homo sapiens
agagcaggaagccgatgtgactg

SEQ ID NO: 5835963 - DNA, 14 bp, Homo sapiens
agagcaggaatggg

SEQ ID NO: 5835964 - DNA, 21 bp, Homo sapiens
agagcaggacctgggacagga

SEQ ID NO: 5835965 - DNA, 13 bp, Homo sapiens
agagcaggactcc

SEQ ID NO: 5835966 - DNA, 19 bp, Homo sapiens
agagcaggactgatgtctc

SEQ ID NO: 5835967 - DNA, 22 bp, Homo sapiens
agagcaggagcccctggggctg

SEQ ID NO: 5835968 - DNA, 11 bp, Homo sapiens
agagcaggagg

SEQ ID NO: 5835969 - DNA, 13 bp, Homo sapiens
agagcaggaggcc

SEQ ID NO: 5835970 - DNA, 17 bp, Homo sapiens
agagctcagcctgcctg

SEQ ID NO: 5835971 - DNA, 18 bp, Homo sapiens
agagctcaggagaaggcc

SEQ ID NO: 5835972 - DNA, 12 bp, Homo sapiens
agagctcaggat

SEQ ID NO: 5835973 - DNA, 17 bp, Homo sapiens
agagctcagtacagggc

SEQ ID NO: 5835974 - DNA, 13 bp, Homo sapiens
agagctccacaga

SEQ ID NO: 5835975 - DNA, 21 bp, Homo sapiens
agagctcccccgtggtgcctg

SEQ ID NO: 5835976 - DNA, 23 bp, Homo sapiens
agagctcccccgtggtgcctgca

SEQ ID NO: 5835977 - DNA, 21 bp, Homo sapiens
agagctcccctacggaccagg

SEQ ID NO: 5835978 - DNA, 23 bp, Homo sapiens
agagctcccctccacagctgcag

SEQ ID NO: 5835979 - DNA, 22 bp, Homo sapiens
agagctcccgaggaagcacagc

SEQ ID NO: 5835980 - DNA, 16 bp, Homo sapiens
agagctccgatgcccg

SEQ ID NO: 5835981 - DNA, 17 bp, Homo sapiens
agagctcctccctctca

SEQ ID NO: 5835982 - DNA, 14 bp, Homo sapiens
agagctcctgagtg

SEQ ID NO: 5835983 - DNA, 14 bp, Homo sapiens
agagctcctgtccc

SEQ ID NO: 5835984 - DNA, 19 bp, Homo sapiens
agagctcctgtccctaccc

SEQ ID NO: 5835985 - DNA, 23 bp, Homo sapiens
agagctcctgtccctacccactc

SEQ ID NO: 5835986 - DNA, 16 bp, Homo sapiens
agagctcgaaataaag

SEQ ID NO: 5835987 - DNA, 23 bp, Homo sapiens
agagctctaagtacctttcctac

SEQ ID NO: 5835988 - DNA, 16 bp, Homo sapiens
agagctctcaagtcaa

SEQ ID NO: 5835989 - DNA, 14 bp, Homo sapiens
agagctctccagct

SEQ ID NO: 5835990 - DNA, 14 bp, Homo sapiens
agagctctccagga

SEQ ID NO: 5835991 - DNA, 14 bp, Homo sapiens
agagctctctctac

SEQ ID NO: 5835992 - DNA, 13 bp, Homo sapiens
agagctctctctt

SEQ ID NO: 5835993 - DNA, 14 bp, Homo sapiens
agagctctgaccca

SEQ ID NO: 5835994 - DNA, 19 bp, Homo sapiens
agagctctggagccacctg

SEQ ID NO: 5835995 - DNA, 17 bp, Homo sapiens
agagctcttcaagctgt

SEQ ID NO: 5835996 - DNA, 22 bp, Homo sapiens
agagctcttttttagctctctt

SEQ ID NO: 5835997 - DNA, 20 bp, Homo sapiens
agagctgaaggttgtggcct

SEQ ID NO: 5835998 - DNA, 22 bp, Homo sapiens
agagctgacacaaacctgcctg

SEQ ID NO: 5835999 - DNA, 15 bp, Homo sapiens
agagctgacgggagg

SEQ ID NO: 5836000 - DNA, 22 bp, Homo sapiens
agagctgacgggaggccccagc

SEQ ID NO: 5836001 - DNA, 18 bp, Homo sapiens
agagctgagaccttgctt

SEQ ID NO: 5836002 - DNA, 21 bp, Homo sapiens
agagctgagccagttgtccta

SEQ ID NO: 5836003 - DNA, 20 bp, Homo sapiens
agagctgaggatttcctgga

SEQ ID NO: 5836004 - DNA, 21 bp, Homo sapiens
agagctgaggatttcctggag

SEQ ID NO: 5836005 - DNA, 18 bp, Homo sapiens
agagctgagggccctgtg

SEQ ID NO: 5836006 - DNA, 10 bp, Homo sapiens
agagctgagt

SEQ ID NO: 5836007 - DNA, 17 bp, Homo sapiens
agagctgagtcggctgg

SEQ ID NO: 5836008 - DNA, 18 bp, Homo sapiens
agagctgagtcggctggg

SEQ ID NO: 5836009 - DNA, 21 bp, Homo sapiens
agagctgagtcggctgggcag

SEQ ID NO: 5836010 - DNA, 15 bp, Homo sapiens
agagctgagtgagct

SEQ ID NO: 5836011 - DNA, 12 bp, Homo sapiens
agagctgagtgg

SEQ ID NO: 5836012 - DNA, 23 bp, Homo sapiens
agagctgagttgggggtgtggct

SEQ ID NO: 5836013 - DNA, 16 bp, Homo sapiens
agagctgatggagaag

SEQ ID NO: 5836014 - DNA, 17 bp, Homo sapiens
agagctgatggagaagg

SEQ ID NO: 5836015 - DNA, 18 bp, Homo sapiens
agagctgatggagaagga

SEQ ID NO: 5836016 - DNA, 19 bp, Homo sapiens
agagctgatggagaaggaa

SEQ ID NO: 5836017 - DNA, 22 bp, Homo sapiens
agagctgatgtgagtgtgtgtg

SEQ ID NO: 5836018 - DNA, 20 bp, Homo sapiens
agagctgattgcagaaagga

SEQ ID NO: 5836019 - DNA, 22 bp, Homo sapiens
agagctgattgcagaaaggaga

SEQ ID NO: 5836020 - DNA, 18 bp, Homo sapiens
agagctgcacttggcctc

SEQ ID NO: 5836021 - DNA, 14 bp, Homo sapiens
agagctgcagccag

SEQ ID NO: 5836022 - DNA, 23 bp, Homo sapiens
agagctgcagccagtcaggcagg

SEQ ID NO: 5836023 - DNA, 15 bp, Homo sapiens
agagctgcagggtgg

SEQ ID NO: 5836024 - DNA, 15 bp, Homo sapiens
agagctgcagttgtg

SEQ ID NO: 5836025 - DNA, 12 bp, Homo sapiens
agagctgccact

SEQ ID NO: 5836026 - DNA, 17 bp, Homo sapiens
agagctgccactgggca

SEQ ID NO: 5836027 - DNA, 22 bp, Homo sapiens
agagctgccactgggcacctgc

SEQ ID NO: 5836028 - DNA, 12 bp, Homo sapiens
agagctgccagt

SEQ ID NO: 5836029 - DNA, 13 bp, Homo sapiens
agagctgccagtg

SEQ ID NO: 5836030 - DNA, 13 bp, Homo sapiens
agagctgccctcc

SEQ ID NO: 5836031 - DNA, 21 bp, Homo sapiens
agagctgccctccttgtccac

SEQ ID NO: 5836032 - DNA, 17 bp, Homo sapiens
agagctgccctctcctg

SEQ ID NO: 5836033 - DNA, 12 bp, Homo sapiens
agagctgcctcc

SEQ ID NO: 5836034 - DNA, 13 bp, Homo sapiens
agagctgcctccc

SEQ ID NO: 5836035 - DNA, 15 bp, Homo sapiens
agagctgcctcccca

SEQ ID NO: 5836036 - DNA, 12 bp, Homo sapiens
agagctgcctgg

SEQ ID NO: 5836037 - DNA, 14 bp, Homo sapiens
agagctgcctggat

SEQ ID NO: 5836038 - DNA, 15 bp, Homo sapiens
agagctgcctggatg

SEQ ID NO: 5836039 - DNA, 15 bp, Homo sapiens
agagctgcgggctga

SEQ ID NO: 5836040 - DNA, 15 bp, Homo sapiens
agagctgctcctttg

SEQ ID NO: 5836041 - DNA, 15 bp, Homo sapiens
agagctgctctggaa

SEQ ID NO: 5836042 - DNA, 23 bp, Homo sapiens
agagctgctctggaaaatgtgac

SEQ ID NO: 5836043 - DNA, 16 bp, Homo sapiens
agagctgctgcacaca

SEQ ID NO: 5836044 - DNA, 13 bp, Homo sapiens
agagctgctgtcc

SEQ ID NO: 5836045 - DNA, 19 bp, Homo sapiens
agagctgctgtccttttag

SEQ ID NO: 5836046 - DNA, 14 bp, Homo sapiens
agagctggaacaca

SEQ ID NO: 5836047 - DNA, 17 bp, Homo sapiens
agagctggaccagtggt

SEQ ID NO: 5836048 - DNA, 22 bp, Homo sapiens
agagctggagatgaggccagac

SEQ ID NO: 5836049 - DNA, 17 bp, Homo sapiens
agagctggagcccccag

SEQ ID NO: 5836050 - DNA, 18 bp, Homo sapiens
agagctggagcctggtgc

SEQ ID NO: 5836051 - DNA, 19 bp, Homo sapiens
agagctggagcctggtgcc

SEQ ID NO: 5836052 - DNA, 18 bp, Homo sapiens
agagctggcaaaggtggc

SEQ ID NO: 5836053 - DNA, 18 bp, Homo sapiens
agagctggcagcctccag

SEQ ID NO: 5836054 - DNA, 16 bp, Homo sapiens
agagctggcagtgtgc

SEQ ID NO: 5836055 - DNA, 12 bp, Homo sapiens
agagctggctct

SEQ ID NO: 5836056 - DNA, 14 bp, Homo sapiens
agagctggctgtct

SEQ ID NO: 5836057 - DNA, 21 bp, Homo sapiens
agagctgggaaacagggagcc

SEQ ID NO: 5836058 - DNA, 22 bp, Homo sapiens
agagctgggaaattcatgtgga

SEQ ID NO: 5836059 - DNA, 22 bp, Homo sapiens
agagctgggaggcatggccctg

SEQ ID NO: 5836060 - DNA, 17 bp, Homo sapiens
agagctgggatggggcc

SEQ ID NO: 5836061 - DNA, 18 bp, Homo sapiens
agagctggggctgccagc

SEQ ID NO: 5836062 - DNA, 18 bp, Homo sapiens
agagctgggtaccaggcc

SEQ ID NO: 5836063 - DNA, 16 bp, Homo sapiens
agagctgggtgagtgg

SEQ ID NO: 5836064 - DNA, 19 bp, Homo sapiens
agagctgggtgtcaagagg

SEQ ID NO: 5836065 - DNA, 23 bp, Homo sapiens
agagctggtagttagtagcatgt

SEQ ID NO: 5836066 - DNA, 19 bp, Homo sapiens
agagctggtgactttgggg

SEQ ID NO: 5836067 - DNA, 11 bp, Homo sapiens
agagctggtgc

SEQ ID NO: 5836068 - DNA, 12 bp, Homo sapiens
agagctggtgcg

SEQ ID NO: 5836069 - DNA, 15 bp, Homo sapiens
agagctggtgcggct

SEQ ID NO: 5836070 - DNA, 23 bp, Homo sapiens
agagctggtggtgcagccttccc

SEQ ID NO: 5836071 - DNA, 13 bp, Homo sapiens
agagctgtattaa

SEQ ID NO: 5836072 - DNA, 19 bp, Homo sapiens
agagctgtcctcctggcac

SEQ ID NO: 5836073 - DNA, 14 bp, Homo sapiens
agagctgtcttccc

SEQ ID NO: 5836074 - DNA, 20 bp, Homo sapiens
agagctgtgcctgctcagca

SEQ ID NO: 5836075 - DNA, 23 bp, Homo sapiens
agagctgtgcctgctcagcagcc

SEQ ID NO: 5836076 - DNA, 14 bp, Homo sapiens
agagctgtggagga

SEQ ID NO: 5836077 - DNA, 18 bp, Homo sapiens
agagctgtggctgggggg

SEQ ID NO: 5836078 - DNA, 19 bp, Homo sapiens
agagctgttatgctgtttc

SEQ ID NO: 5836079 - DNA, 24 bp, Homo sapiens
agagctgttatgctgtttcctagc

SEQ ID NO: 5836080 - DNA, 21 bp, Homo sapiens
agagctgttcacagccagact

SEQ ID NO: 5836081 - DNA, 13 bp, Homo sapiens
agagctgttcatg

SEQ ID NO: 5836082 - DNA, 20 bp, Homo sapiens
agagctgttcccaaattttc

SEQ ID NO: 5836083 - DNA, 21 bp, Homo sapiens
agagctgttctttttgactga

SEQ ID NO: 5836084 - DNA, 18 bp, Homo sapiens
agagctgttggcctcgcc

SEQ ID NO: 5836085 - DNA, 22 bp, Homo sapiens
agagctgttggcctcgcctggg

SEQ ID NO: 5836086 - DNA, 15 bp, Homo sapiens
agagctgttttggat

SEQ ID NO: 5836087 - DNA, 21 bp, Homo sapiens
agagctgttttggatgaatgc

SEQ ID NO: 5836088 - DNA, 14 bp, Homo sapiens
agagcttaaattgt

SEQ ID NO: 5836089 - DNA, 16 bp, Homo sapiens
agagcttattggccac

SEQ ID NO: 5836090 - DNA, 17 bp, Homo sapiens
agagcttcaggccccag

SEQ ID NO: 5836091 - DNA, 21 bp, Homo sapiens
agagcttccactgtcagccct

SEQ ID NO: 5836092 - DNA, 17 bp, Homo sapiens
agagcttccagagctct

SEQ ID NO: 5836093 - DNA, 13 bp, Homo sapiens
agagcttcctggg

SEQ ID NO: 5836094 - DNA, 15 bp, Homo sapiens
agagcttctggcact

SEQ ID NO: 5836095 - DNA, 19 bp, Homo sapiens
agagcttctgtattttcaa

SEQ ID NO: 5836096 - DNA, 20 bp, Homo sapiens
agagcttctgtattttcaaa

SEQ ID NO: 5836097 - DNA, 21 bp, Homo sapiens
agagcttctgttgctgcctca

SEQ ID NO: 5836098 - DNA, 23 bp, Homo sapiens
agagcttcttatattaaagaagt

SEQ ID NO: 5836099 - DNA, 19 bp, Homo sapiens
agagcttgattagaagcca

SEQ ID NO: 5836100 - DNA, 13 bp, Homo sapiens
agagcttgctcca

SEQ ID NO: 5836101 - DNA, 16 bp, Homo sapiens
agagcttgctccagat

SEQ ID NO: 5836102 - DNA, 22 bp, Homo sapiens
agagcttggacagtctgagctg

SEQ ID NO: 5836103 - DNA, 15 bp, Homo sapiens
agagcttggactaca

SEQ ID NO: 5836104 - DNA, 17 bp, Homo sapiens
agagcttggactacaca

SEQ ID NO: 5836105 - DNA, 19 bp, Homo sapiens
agagcttggactacacaat

SEQ ID NO: 5836106 - DNA, 20 bp, Homo sapiens
agagcttggactacacaata

SEQ ID NO: 5836107 - DNA, 16 bp, Homo sapiens
agagcttggtggctga

SEQ ID NO: 5836108 - DNA, 20 bp, Homo sapiens
agagcttggtggctgagctt

SEQ ID NO: 5836109 - DNA, 16 bp, Homo sapiens
agagcttgtaataaat

SEQ ID NO: 5836110 - DNA, 19 bp, Homo sapiens
agagcttgtaataaatact

SEQ ID NO: 5836111 - DNA, 17 bp, Homo sapiens
agagcttgtagccctgg

SEQ ID NO: 5836112 - DNA, 23 bp, Homo sapiens
agagctttaaaagtatctttaac

SEQ ID NO: 5836113 - DNA, 14 bp, Homo sapiens
agagctttactttg

SEQ ID NO: 5836114 - DNA, 15 bp, Homo sapiens
agagctttattgctg

SEQ ID NO: 5836115 - DNA, 21 bp, Homo sapiens
agagctttattgctgcatttt

SEQ ID NO: 5836116 - DNA, 19 bp, Homo sapiens
agagctttctgccttagcc

SEQ ID NO: 5836117 - DNA, 22 bp, Homo sapiens
agagctttctgtccttttggca

SEQ ID NO: 5836118 - DNA, 14 bp, Homo sapiens
agagctttctttca

SEQ ID NO: 5836119 - DNA, 19 bp, Homo sapiens
agagctttcttttgtatta

SEQ ID NO: 5836120 - DNA, 14 bp, Homo sapiens
agagctttgtcact

SEQ ID NO: 5836121 - DNA, 17 bp, Homo sapiens
agagctttgtcacttgc

SEQ ID NO: 5836122 - DNA, 22 bp, Homo sapiens
agagctttgtcacttgccacat

SEQ ID NO: 5836123 - DNA, 22 bp, Homo sapiens
agagcttttatttggtgtgttc

SEQ ID NO: 5836124 - DNA, 14 bp, Homo sapiens
agagcttttcagat

SEQ ID NO: 5836125 - DNA, 15 bp, Homo sapiens
agagcttttcagatt

SEQ ID NO: 5836126 - DNA, 16 bp, Homo sapiens
agagcttttgcatttc

SEQ ID NO: 5836127 - DNA, 16 bp, Homo sapiens
agaggaaaaaaatgac

SEQ ID NO: 5836128 - DNA, 17 bp, Homo sapiens
agaggaaaaacagagga

SEQ ID NO: 5836129 - DNA, 19 bp, Homo sapiens
agaggaaaaacagggaaaa

SEQ ID NO: 5836130 - DNA, 20 bp, Homo sapiens
agaggaaaaatgggagccag

SEQ ID NO: 5836131 - DNA, 23 bp, Homo sapiens
agaggaaaactattccatgtttt

SEQ ID NO: 5836132 - DNA, 21 bp, Homo sapiens
agaggaaaagctgcctctggt

SEQ ID NO: 5836133 - DNA, 22 bp, Homo sapiens
agaggaaaagctgtaagaaaat

SEQ ID NO: 5836134 - DNA, 13 bp, Homo sapiens
agaggaaaatcaa

SEQ ID NO: 5836135 - DNA, 13 bp, Homo sapiens
agaggaaaatgag

SEQ ID NO: 5836136 - DNA, 13 bp, Homo sapiens
agaggaaagacag

SEQ ID NO: 5836137 - DNA, 18 bp, Homo sapiens
agaggaaagcaaaggaga

SEQ ID NO: 5836138 - DNA, 22 bp, Homo sapiens
agaggaaaggacatgggtagca

SEQ ID NO: 5836139 - DNA, 19 bp, Homo sapiens
agaggaaataacagagaga

SEQ ID NO: 5836140 - DNA, 14 bp, Homo sapiens
agaggaaataagaa

SEQ ID NO: 5836141 - DNA, 22 bp, Homo sapiens
agaggaaataagaaaaatcatg

SEQ ID NO: 5836142 - DNA, 19 bp, Homo sapiens
agaggaaatattgctgggg

SEQ ID NO: 5836143 - DNA, 12 bp, Homo sapiens
agaggaaatcac

SEQ ID NO: 5836144 - DNA, 19 bp, Homo sapiens
agaggaaattcaaatccct

SEQ ID NO: 5836145 - DNA, 17 bp, Homo sapiens
agaggaaccgttttaca

SEQ ID NO: 5836146 - DNA, 20 bp, Homo sapiens
agaggaacgggcagcctggg

SEQ ID NO: 5836147 - DNA, 23 bp, Homo sapiens
agaggtcccagccccaggcctgg

SEQ ID NO: 5836148 - DNA, 15 bp, Homo sapiens
agaggtcccctgagg

SEQ ID NO: 5836149 - DNA, 16 bp, Homo sapiens
agaggtcccctgaggt

SEQ ID NO: 5836150 - DNA, 17 bp, Homo sapiens
agaggtcctctggagcc

SEQ ID NO: 5836151 - DNA, 20 bp, Homo sapiens
agaggtctcatctcccaggc

SEQ ID NO: 5836152 - DNA, 18 bp, Homo sapiens
agaggtctccccatcccc

SEQ ID NO: 5836153 - DNA, 19 bp, Homo sapiens
agaggtctccccatcccca

SEQ ID NO: 5836154 - DNA, 22 bp, Homo sapiens
agaggtctctgccggctctttc

SEQ ID NO: 5836155 - DNA, 21 bp, Homo sapiens
agaggtctgagccctggtgtg

SEQ ID NO: 5836156 - DNA, 15 bp, Homo sapiens
agaggtctgtaaaga

SEQ ID NO: 5836157 - DNA, 16 bp, Homo sapiens
agaggtctttcagaag

SEQ ID NO: 5836158 - DNA, 12 bp, Homo sapiens
agaggtcttttt

SEQ ID NO: 5836159 - DNA, 16 bp, Homo sapiens
agaggtcttttttaaa

SEQ ID NO: 5836160 - DNA, 15 bp, Homo sapiens
agaggtgaaaatgaa

SEQ ID NO: 5836161 - DNA, 19 bp, Homo sapiens
agaggtgaaaatgaagaag

SEQ ID NO: 5836162 - DNA, 16 bp, Homo sapiens
agaggtgaagccagct

SEQ ID NO: 5836163 - DNA, 17 bp, Homo sapiens
agaggtgagaaatttaa

SEQ ID NO: 5836164 - DNA, 18 bp, Homo sapiens
agaggtgagaactcagaa

SEQ ID NO: 5836165 - DNA, 19 bp, Homo sapiens
agaggtgagaactcagaag

SEQ ID NO: 5836166 - DNA, 14 bp, Homo sapiens
agaggtgagggaag

SEQ ID NO: 5836167 - DNA, 17 bp, Homo sapiens
agaggtgagggaggcct

SEQ ID NO: 5836168 - DNA, 20 bp, Homo sapiens
agaggtgattctcagggctg

SEQ ID NO: 5836169 - DNA, 19 bp, Homo sapiens
agaggtgattcttacatat

SEQ ID NO: 5836170 - DNA, 16 bp, Homo sapiens
agaggtgcacttgggg

SEQ ID NO: 5836171 - DNA, 14 bp, Homo sapiens
agaggtgccagcaa

SEQ ID NO: 5836172 - DNA, 18 bp, Homo sapiens
agaggtgccagcaactga

SEQ ID NO: 5836173 - DNA, 19 bp, Homo sapiens
agaggtgccagcaactgaa

SEQ ID NO: 5836174 - DNA, 22 bp, Homo sapiens
agaggtgccagcaactgaataa

SEQ ID NO: 5836175 - DNA, 21 bp, Homo sapiens
agaggtgccggggaggggcag

SEQ ID NO: 5836176 - DNA, 13 bp, Homo sapiens
agaggtgcctggg

SEQ ID NO: 5836177 - DNA, 16 bp, Homo sapiens
agaggtgcctgggagg

SEQ ID NO: 5836178 - DNA, 17 bp, Homo sapiens
agaggtgctagctctta

SEQ ID NO: 5836179 - DNA, 16 bp, Homo sapiens
agaggtgctgcaggca

SEQ ID NO: 5836180 - DNA, 13 bp, Homo sapiens
agaggtgcttcac

SEQ ID NO: 5836181 - DNA, 20 bp, Homo sapiens
agaggtggagaactgggatt

SEQ ID NO: 5836182 - DNA, 22 bp, Homo sapiens
agaggtggaggtgggctgatgg

SEQ ID NO: 5836183 - DNA, 17 bp, Homo sapiens
agaggtggattcctggg

SEQ ID NO: 5836184 - DNA, 19 bp, Homo sapiens
agaggtggattcctgggca

SEQ ID NO: 5836185 - DNA, 22 bp, Homo sapiens
agaggtggattcctgggcaaga

SEQ ID NO: 5836186 - DNA, 12 bp, Homo sapiens
agaggtggcagg

SEQ ID NO: 5836187 - DNA, 23 bp, Homo sapiens
agaggtggcaggagaatttctac

SEQ ID NO: 5836188 - DNA, 13 bp, Homo sapiens
agaggtggccaga

SEQ ID NO: 5836189 - DNA, 18 bp, Homo sapiens
agaggtggccccatatta

SEQ ID NO: 5836190 - DNA, 14 bp, Homo sapiens
agaggtggccctcc

SEQ ID NO: 5836191 - DNA, 23 bp, Homo sapiens
agaggtggcccttgtttacagtg

SEQ ID NO: 5836192 - DNA, 22 bp, Homo sapiens
agaggtggctgcgcccccagct

SEQ ID NO: 5836193 - DNA, 14 bp, Homo sapiens
agaggtggcttcag

SEQ ID NO: 5836194 - DNA, 22 bp, Homo sapiens
agaggtgggaggcccctggtgg

SEQ ID NO: 5836195 - DNA, 19 bp, Homo sapiens
agaggtgggatcctccctc

SEQ ID NO: 5836196 - DNA, 12 bp, Homo sapiens
agaggtgggcag

SEQ ID NO: 5836197 - DNA, 18 bp, Homo sapiens
agaggtgggcagcagctc

SEQ ID NO: 5836198 - DNA, 14 bp, Homo sapiens
agaggtgggcagct

SEQ ID NO: 5836199 - DNA, 19 bp, Homo sapiens
agaggtgggcagctgggcc

SEQ ID NO: 5836200 - DNA, 20 bp, Homo sapiens
agaggtgggcagctgggccc

SEQ ID NO: 5836201 - DNA, 24 bp, Homo sapiens
agaggtgggccagtctgtggatca

SEQ ID NO: 5836202 - DNA, 19 bp, Homo sapiens
agaggtggggaagagagcc

SEQ ID NO: 5836203 - DNA, 19 bp, Homo sapiens
agaggtggggatcctgcct

SEQ ID NO: 5836204 - DNA, 17 bp, Homo sapiens
agaggtgggggatgctg

SEQ ID NO: 5836205 - DNA, 23 bp, Homo sapiens
agaggtggggtgctggggctgca

SEQ ID NO: 5836206 - DNA, 18 bp, Homo sapiens
agaggtgtacactaacat

SEQ ID NO: 5836207 - DNA, 18 bp, Homo sapiens
agaggtgtgcacaccaaa

SEQ ID NO: 5836208 - DNA, 14 bp, Homo sapiens
agaggtgtgtgacg

SEQ ID NO: 5836209 - DNA, 22 bp, Homo sapiens
agaggttaaggtgggtccagga

SEQ ID NO: 5836210 - DNA, 23 bp, Homo sapiens
agaggttaaggtgggtccaggaa

SEQ ID NO: 5836211 - DNA, 14 bp, Homo sapiens
agaggttaatcaga

SEQ ID NO: 5836212 - DNA, 20 bp, Homo sapiens
agaggttactttagttagca

SEQ ID NO: 5836213 - DNA, 15 bp, Homo sapiens
agaggttagaatgat

SEQ ID NO: 5836214 - DNA, 14 bp, Homo sapiens
agaggttaggagta

SEQ ID NO: 5836215 - DNA, 20 bp, Homo sapiens
agaggttatctgcctggcct

SEQ ID NO: 5836216 - DNA, 17 bp, Homo sapiens
agaggttatctgtccca

SEQ ID NO: 5836217 - DNA, 16 bp, Homo sapiens
agaggttcaaagatat

SEQ ID NO: 5836218 - DNA, 17 bp, Homo sapiens
agaggttcatttcaaat

SEQ ID NO: 5836219 - DNA, 21 bp, Homo sapiens
agaggttcctggggtggattc

SEQ ID NO: 5836220 - DNA, 23 bp, Homo sapiens
agaggttcctgtttgaacccagg

SEQ ID NO: 5836221 - DNA, 17 bp, Homo sapiens
agaggttctcagcaagt

SEQ ID NO: 5836222 - DNA, 20 bp, Homo sapiens
agaggttctcagcaagtgta

SEQ ID NO: 5836223 - DNA, 16 bp, Homo sapiens
agaggttctgcactcc

SEQ ID NO: 5836224 - DNA, 19 bp, Homo sapiens
agaggttgtagtgagccca

SEQ ID NO: 5836225 - DNA, 13 bp, Homo sapiens
agaggttgtgaaa

SEQ ID NO: 5836226 - DNA, 17 bp, Homo sapiens
agaggtttgaaggagaa

SEQ ID NO: 5836227 - DNA, 17 bp, Homo sapiens
agaggtttgcagtccca

SEQ ID NO: 5836228 - DNA, 15 bp, Homo sapiens
agaggtttgtcaaca

SEQ ID NO: 5836229 - DNA, 19 bp, Homo sapiens
agaggtttgtcaacaaaaa

SEQ ID NO: 5836230 - DNA, 18 bp, Homo sapiens
agaggttttaaagtgatt

SEQ ID NO: 5836231 - DNA, 19 bp, Homo sapiens
agaggttttaaagtgatta

SEQ ID NO: 5836232 - DNA, 17 bp, Homo sapiens
agaggttttatttacat

SEQ ID NO: 5836233 - DNA, 19 bp, Homo sapiens
agaggttttgttgttttat

SEQ ID NO: 5836234 - DNA, 12 bp, Homo sapiens
agaggtttttct

SEQ ID NO: 5836235 - DNA, 15 bp, Homo sapiens
agagtaaaaactgaa

SEQ ID NO: 5836236 - DNA, 17 bp, Homo sapiens
agagtaaaaccaaaggt

SEQ ID NO: 5836237 - DNA, 21 bp, Homo sapiens
agagtaaaggaaataagagca

SEQ ID NO: 5836238 - DNA, 17 bp, Homo sapiens
agagtaaataaactgtt

SEQ ID NO: 5836239 - DNA, 21 bp, Homo sapiens
agagtaaataaactgtttata

SEQ ID NO: 5836240 - DNA, 18 bp, Homo sapiens
agagtaaatattgtcaca

SEQ ID NO: 5836241 - DNA, 19 bp, Homo sapiens
agagtaaatattgtcacaa

SEQ ID NO: 5836242 - DNA, 16 bp, Homo sapiens
agagtaaattgctctg

SEQ ID NO: 5836243 - DNA, 13 bp, Homo sapiens
agagtaacaggat

SEQ ID NO: 5836244 - DNA, 19 bp, Homo sapiens
agagtaacagtcatcattt

SEQ ID NO: 5836245 - DNA, 16 bp, Homo sapiens
agagtaacgagaagtg

SEQ ID NO: 5836246 - DNA, 12 bp, Homo sapiens
agagtaactatc

SEQ ID NO: 5836247 - DNA, 20 bp, Homo sapiens
agagtaactttactctgtgt

SEQ ID NO: 5836248 - DNA, 16 bp, Homo sapiens
agagtaagaaatttca

SEQ ID NO: 5836249 - DNA, 16 bp, Homo sapiens
agagtaagctgctttt

SEQ ID NO: 5836250 - DNA, 17 bp, Homo sapiens
agagtaagtattatgcc

SEQ ID NO: 5836251 - DNA, 22 bp, Homo sapiens
agagtaatccaagcaaatgtga

SEQ ID NO: 5836252 - DNA, 19 bp, Homo sapiens
agagtaatgccaccagatc

SEQ ID NO: 5836253 - DNA, 16 bp, Homo sapiens
agagtacaccctttcc

SEQ ID NO: 5836254 - DNA, 16 bp, Homo sapiens
agagtacactcagcca

SEQ ID NO: 5836255 - DNA, 17 bp, Homo sapiens
agagtacactcagccac

SEQ ID NO: 5836256 - DNA, 19 bp, Homo sapiens
agagtacagactgcagaca

SEQ ID NO: 5836257 - DNA, 20 bp, Homo sapiens
agagtacagactgcagacat

SEQ ID NO: 5836258 - DNA, 13 bp, Homo sapiens
agagtacatccat

SEQ ID NO: 5836259 - DNA, 17 bp, Homo sapiens
agagtacatttgcttta

SEQ ID NO: 5836260 - DNA, 15 bp, Homo sapiens
agagtacctgtgtgt

SEQ ID NO: 5836261 - DNA, 20 bp, Homo sapiens
agagtactcacttttcactt

SEQ ID NO: 5836262 - DNA, 17 bp, Homo sapiens
agagtactttggtttct

SEQ ID NO: 5836263 - DNA, 13 bp, Homo sapiens
agagtagaaaagg

SEQ ID NO: 5836264 - DNA, 15 bp, Homo sapiens
agagtagaaataaaa

SEQ ID NO: 5836265 - DNA, 15 bp, Homo sapiens
agagtagaattgcat

SEQ ID NO: 5836266 - DNA, 18 bp, Homo sapiens
agagtagagctcaaaact

SEQ ID NO: 5836267 - DNA, 12 bp, Homo sapiens
agagtagcaagt

SEQ ID NO: 5836268 - DNA, 18 bp, Homo sapiens
agagtagcatttcattct

SEQ ID NO: 5836269 - DNA, 17 bp, Homo sapiens
agagtagccatgaggag

SEQ ID NO: 5836270 - DNA, 15 bp, Homo sapiens
agagtagccattctt

SEQ ID NO: 5836271 - DNA, 17 bp, Homo sapiens
agagtagccgagagcct

SEQ ID NO: 5836272 - DNA, 22 bp, Homo sapiens
agagtagccgagagcctgctcc

SEQ ID NO: 5836273 - DNA, 17 bp, Homo sapiens
agagtagcctaaaatta

SEQ ID NO: 5836274 - DNA, 18 bp, Homo sapiens
agagtagggccctgacag

SEQ ID NO: 5836275 - DNA, 17 bp, Homo sapiens
agagtagggtagaagga

SEQ ID NO: 5836276 - DNA, 14 bp, Homo sapiens
agagtagtccaggt

SEQ ID NO: 5836277 - DNA, 15 bp, Homo sapiens
agagtagttagagaa

SEQ ID NO: 5836278 - DNA, 14 bp, Homo sapiens
agagtagttatata

SEQ ID NO: 5836279 - DNA, 17 bp, Homo sapiens
agagtatacaagtgttt

SEQ ID NO: 5836280 - DNA, 19 bp, Homo sapiens
agagtatacaagtgtttct

SEQ ID NO: 5836281 - DNA, 14 bp, Homo sapiens
agagtatatatgta

SEQ ID NO: 5836282 - DNA, 15 bp, Homo sapiens
agagtatatatgtac

SEQ ID NO: 5836283 - DNA, 16 bp, Homo sapiens
agagtatatatgtaca

SEQ ID NO: 5836284 - DNA, 17 bp, Homo sapiens
agagtatatatgtacag

SEQ ID NO: 5836285 - DNA, 21 bp, Homo sapiens
agagtatatattttatatata

SEQ ID NO: 5836286 - DNA, 16 bp, Homo sapiens
agagtatcaaaggcag

SEQ ID NO: 5836287 - DNA, 17 bp, Homo sapiens
agagtatcaaaggcaga

SEQ ID NO: 5836288 - DNA, 19 bp, Homo sapiens
agagtatcaaaggcagaaa

SEQ ID NO: 5836289 - DNA, 20 bp, Homo sapiens
agagtatcaaaggcagaaag

SEQ ID NO: 5836290 - DNA, 18 bp, Homo sapiens
agagtatctaatccttta

SEQ ID NO: 5836291 - DNA, 23 bp, Homo sapiens
agagtatctgaagggaattgttt

SEQ ID NO: 5836292 - DNA, 15 bp, Homo sapiens
agagtatgtgtatgt

SEQ ID NO: 5836293 - DNA, 15 bp, Homo sapiens
agagtatgttcttga

SEQ ID NO: 5836294 - DNA, 15 bp, Homo sapiens
agagtatttcccttc

SEQ ID NO: 5836295 - DNA, 21 bp, Homo sapiens
agagtatttcccttccaaaga

SEQ ID NO: 5836296 - DNA, 22 bp, Homo sapiens
agagtatttttaacacttaaat

SEQ ID NO: 5836297 - DNA, 14 bp, Homo sapiens
agagtatttttgac

SEQ ID NO: 5836298 - DNA, 15 bp, Homo sapiens
agagtatttttgaca

SEQ ID NO: 5836299 - DNA, 18 bp, Homo sapiens
agagtatttttgacagaa

SEQ ID NO: 5836300 - DNA, 20 bp, Homo sapiens
agagtatttttgacagaata

SEQ ID NO: 5836301 - DNA, 22 bp, Homo sapiens
agagtcaaagtagttagttttg

SEQ ID NO: 5836302 - DNA, 15 bp, Homo sapiens
agagtcaacaaatta

SEQ ID NO: 5836303 - DNA, 21 bp, Homo sapiens
agagtcaacaaattaaataaa

SEQ ID NO: 5836304 - DNA, 22 bp, Homo sapiens
agagtcaacaaattaaataaat

SEQ ID NO: 5836305 - DNA, 15 bp, Homo sapiens
agagtcaagctgatg

SEQ ID NO: 5836306 - DNA, 16 bp, Homo sapiens
agagtcaaggcctgct

SEQ ID NO: 5836307 - DNA, 22 bp, Homo sapiens
agagtcacaagtagcctctggg

SEQ ID NO: 5836308 - DNA, 21 bp, Homo sapiens
agagtcacacgggggcagctg

SEQ ID NO: 5836309 - DNA, 17 bp, Homo sapiens
agagtcaccacttcctc

SEQ ID NO: 5836310 - DNA, 17 bp, Homo sapiens
agagtcacccccccagg

SEQ ID NO: 5836311 - DNA, 20 bp, Homo sapiens
agagtcacccccccaggcct

SEQ ID NO: 5836312 - DNA, 14 bp, Homo sapiens
agagtcactcacac

SEQ ID NO: 5836313 - DNA, 15 bp, Homo sapiens
agagtcacttctaat

SEQ ID NO: 5836314 - DNA, 21 bp, Homo sapiens
agagtcagacatttctttgga

SEQ ID NO: 5836315 - DNA, 12 bp, Homo sapiens
agagtcagagat

SEQ ID NO: 5836316 - DNA, 18 bp, Homo sapiens
agagtcagccttccccct

SEQ ID NO: 5836317 - DNA, 17 bp, Homo sapiens
agagtcagctctctgcc

SEQ ID NO: 5836318 - DNA, 19 bp, Homo sapiens
agagtcagctctctgccct

SEQ ID NO: 5836319 - DNA, 21 bp, Homo sapiens
agagtcatatacattagtttt

SEQ ID NO: 5836320 - DNA, 22 bp, Homo sapiens
agagtcatatacattagtttta

SEQ ID NO: 5836321 - DNA, 21 bp, Homo sapiens
agagtcatctccatcagctgt

SEQ ID NO: 5836322 - DNA, 20 bp, Homo sapiens
agagtcatgtgagcctcgtg

SEQ ID NO: 5836323 - DNA, 16 bp, Homo sapiens
agagtcattcatattt

SEQ ID NO: 5836324 - DNA, 18 bp, Homo sapiens
agataacttactgtatat

SEQ ID NO: 5836325 - DNA, 17 bp, Homo sapiens
agataacttcttgaaaa

SEQ ID NO: 5836326 - DNA, 21 bp, Homo sapiens
agataacttcttgaaaaagat

SEQ ID NO: 5836327 - DNA, 19 bp, Homo sapiens
agataacttttttgagtca

SEQ ID NO: 5836328 - DNA, 20 bp, Homo sapiens
agataacttttttgagtcat

SEQ ID NO: 5836329 - DNA, 13 bp, Homo sapiens
agataagaaaagc

SEQ ID NO: 5836330 - DNA, 12 bp, Homo sapiens
agataagacata

SEQ ID NO: 5836331 - DNA, 21 bp, Homo sapiens
agataagatttctgtctacta

SEQ ID NO: 5836332 - DNA, 22 bp, Homo sapiens
agataagcaagagagatgtttt

SEQ ID NO: 5836333 - DNA, 16 bp, Homo sapiens
agataagcctgaaaca

SEQ ID NO: 5836334 - DNA, 14 bp, Homo sapiens
agataagcctgagc

SEQ ID NO: 5836335 - DNA, 15 bp, Homo sapiens
agataagcctgagcc

SEQ ID NO: 5836336 - DNA, 20 bp, Homo sapiens
agataagcctgagccttagc

SEQ ID NO: 5836337 - DNA, 20 bp, Homo sapiens
agataaggagaaagaaagta

SEQ ID NO: 5836338 - DNA, 19 bp, Homo sapiens
agataaggcagaactagga

SEQ ID NO: 5836339 - DNA, 17 bp, Homo sapiens
agataaggccgagccca

SEQ ID NO: 5836340 - DNA, 20 bp, Homo sapiens
agataaggccgagcccacac

SEQ ID NO: 5836341 - DNA, 13 bp, Homo sapiens
agataagtgcagt

SEQ ID NO: 5836342 - DNA, 14 bp, Homo sapiens
agataagtgtaaat

SEQ ID NO: 5836343 - DNA, 15 bp, Homo sapiens
agataagtgtaaata

SEQ ID NO: 5836344 - DNA, 16 bp, Homo sapiens
agataagtgtattttt

SEQ ID NO: 5836345 - DNA, 21 bp, Homo sapiens
agataagtgttcttcagtgta

SEQ ID NO: 5836346 - DNA, 15 bp, Homo sapiens
agataagttatttat

SEQ ID NO: 5836347 - DNA, 18 bp, Homo sapiens
agataagttatttataat

SEQ ID NO: 5836348 - DNA, 14 bp, Homo sapiens
agataagttttgtt

SEQ ID NO: 5836349 - DNA, 15 bp, Homo sapiens
agataataactgtct

SEQ ID NO: 5836350 - DNA, 16 bp, Homo sapiens
agataatacattccga

SEQ ID NO: 5836351 - DNA, 19 bp, Homo sapiens
agataatatctgtgaggtg

SEQ ID NO: 5836352 - DNA, 20 bp, Homo sapiens
agataatattgtttggtaaa

SEQ ID NO: 5836353 - DNA, 18 bp, Homo sapiens
agataatatttaaaatag

SEQ ID NO: 5836354 - DNA, 23 bp, Homo sapiens
agataatatttaaaatagttcca

SEQ ID NO: 5836355 - DNA, 14 bp, Homo sapiens
agataatatttctg

SEQ ID NO: 5836356 - DNA, 20 bp, Homo sapiens
agataatattttacatacac

SEQ ID NO: 5836357 - DNA, 14 bp, Homo sapiens
agataatatttttg

SEQ ID NO: 5836358 - DNA, 15 bp, Homo sapiens
agataatatttttgt

SEQ ID NO: 5836359 - DNA, 23 bp, Homo sapiens
agataatcaagggcactgtgata

SEQ ID NO: 5836360 - DNA, 16 bp, Homo sapiens
agataatctagaacac

SEQ ID NO: 5836361 - DNA, 13 bp, Homo sapiens
agataatgctttt

SEQ ID NO: 5836362 - DNA, 18 bp, Homo sapiens
agataatggataatcttc

SEQ ID NO: 5836363 - DNA, 14 bp, Homo sapiens
agataatggtaatt

SEQ ID NO: 5836364 - DNA, 12 bp, Homo sapiens
agataatgtgaa

SEQ ID NO: 5836365 - DNA, 13 bp, Homo sapiens
agataatgtgaaa

SEQ ID NO: 5836366 - DNA, 15 bp, Homo sapiens
agataattaaatgaa

SEQ ID NO: 5836367 - DNA, 12 bp, Homo sapiens
agataattataa

SEQ ID NO: 5836368 - DNA, 13 bp, Homo sapiens
agataattcattt

SEQ ID NO: 5836369 - DNA, 18 bp, Homo sapiens
agataattcatttgtatt

SEQ ID NO: 5836370 - DNA, 18 bp, Homo sapiens
agataattctagctttga

SEQ ID NO: 5836371 - DNA, 19 bp, Homo sapiens
agataattgtactttgaaa

SEQ ID NO: 5836372 - DNA, 21 bp, Homo sapiens
agataattgtttcattcatcc

SEQ ID NO: 5836373 - DNA, 21 bp, Homo sapiens
agataatttaaccctgcctct

SEQ ID NO: 5836374 - DNA, 13 bp, Homo sapiens
agataatttactt

SEQ ID NO: 5836375 - DNA, 20 bp, Homo sapiens
agataatttatttcaataaa

SEQ ID NO: 5836376 - DNA, 15 bp, Homo sapiens
agataatttcagggt

SEQ ID NO: 5836377 - DNA, 20 bp, Homo sapiens
agataatttgcatattctat

SEQ ID NO: 5836378 - DNA, 23 bp, Homo sapiens
agatacaaaaccttgtgtaagag

SEQ ID NO: 5836379 - DNA, 21 bp, Homo sapiens
agatacaagaaaaagtagaaa

SEQ ID NO: 5836380 - DNA, 22 bp, Homo sapiens
agatacaagaaaaagtagaaaa

SEQ ID NO: 5836381 - DNA, 23 bp, Homo sapiens
agatacaaggcccagaagcctga

SEQ ID NO: 5836382 - DNA, 12 bp, Homo sapiens
agatacaataaa

SEQ ID NO: 5836383 - DNA, 13 bp, Homo sapiens
agatacaataaat

SEQ ID NO: 5836384 - DNA, 17 bp, Homo sapiens
agatacaatcagctgct

SEQ ID NO: 5836385 - DNA, 23 bp, Homo sapiens
agatacacaagagggactgtatt

SEQ ID NO: 5836386 - DNA, 21 bp, Homo sapiens
agatacacagctccgagctgt

SEQ ID NO: 5836387 - DNA, 15 bp, Homo sapiens
agatacactcctgct

SEQ ID NO: 5836388 - DNA, 16 bp, Homo sapiens
agatacactgcacttt

SEQ ID NO: 5836389 - DNA, 23 bp, Homo sapiens
agatacactgcactttgtttaga

SEQ ID NO: 5836390 - DNA, 18 bp, Homo sapiens
agatacactgcagctgaa

SEQ ID NO: 5836391 - DNA, 18 bp, Homo sapiens
agatacagaactctttca

SEQ ID NO: 5836392 - DNA, 20 bp, Homo sapiens
agatacagaactctttcaaa

SEQ ID NO: 5836393 - DNA, 13 bp, Homo sapiens
agatacagacatt

SEQ ID NO: 5836394 - DNA, 12 bp, Homo sapiens
agatacagatcc

SEQ ID NO: 5836395 - DNA, 23 bp, Homo sapiens
agatacagatccgcatgtgtctg

SEQ ID NO: 5836396 - DNA, 20 bp, Homo sapiens
agatacaggaaaagctgctg

SEQ ID NO: 5836397 - DNA, 22 bp, Homo sapiens
agatacaggactggttccttcc

SEQ ID NO: 5836398 - DNA, 13 bp, Homo sapiens
agatacagttact

SEQ ID NO: 5836399 - DNA, 15 bp, Homo sapiens
agatacatacagaat

SEQ ID NO: 5836400 - DNA, 18 bp, Homo sapiens
agatacatagatggacca

SEQ ID NO: 5836401 - DNA, 22 bp, Homo sapiens
agatacatatgagtgtggaagc

SEQ ID NO: 5836402 - DNA, 17 bp, Homo sapiens
agatacatcacagtcac

SEQ ID NO: 5836403 - DNA, 17 bp, Homo sapiens
agatacatcttataaac

SEQ ID NO: 5836404 - DNA, 18 bp, Homo sapiens
agatacatttgtatgttg

SEQ ID NO: 5836405 - DNA, 15 bp, Homo sapiens
agataccaagcatgt

SEQ ID NO: 5836406 - DNA, 15 bp, Homo sapiens
agataccatcagcaa

SEQ ID NO: 5836407 - DNA, 22 bp, Homo sapiens
agataccatcagcaaagaattt

SEQ ID NO: 5836408 - DNA, 21 bp, Homo sapiens
agataccatgatgctgagccc

SEQ ID NO: 5836409 - DNA, 22 bp, Homo sapiens
agataccatgtataattttcta

SEQ ID NO: 5836410 - DNA, 23 bp, Homo sapiens
agataccattcaacccagcaatc

SEQ ID NO: 5836411 - DNA, 20 bp, Homo sapiens
agataccattttgaaatatt

SEQ ID NO: 5836412 - DNA, 13 bp, Homo sapiens
agatacccagaga

SEQ ID NO: 5836413 - DNA, 19 bp, Homo sapiens
agatacccatcttgaaaaa

SEQ ID NO: 5836414 - DNA, 15 bp, Homo sapiens
agataccctctgaga

SEQ ID NO: 5836415 - DNA, 14 bp, Homo sapiens
agatacctccaacc

SEQ ID NO: 5836416 - DNA, 19 bp, Homo sapiens
agatacctccaaccctgcc

SEQ ID NO: 5836417 - DNA, 20 bp, Homo sapiens
agatacctccaaccctgccg

SEQ ID NO: 5836418 - DNA, 13 bp, Homo sapiens
agatacctgtgag

SEQ ID NO: 5836419 - DNA, 20 bp, Homo sapiens
agataccttaaaatttgaaa

SEQ ID NO: 5836420 - DNA, 18 bp, Homo sapiens
agataccttgaaaggaag

SEQ ID NO: 5836421 - DNA, 13 bp, Homo sapiens
agatacgaaatca

SEQ ID NO: 5836422 - DNA, 19 bp, Homo sapiens
agatacgaatttctataga

SEQ ID NO: 5836423 - DNA, 16 bp, Homo sapiens
agatacgggggctgtg

SEQ ID NO: 5836424 - DNA, 15 bp, Homo sapiens
agatacggttgcttc

SEQ ID NO: 5836425 - DNA, 17 bp, Homo sapiens
agatacgtatattttta

SEQ ID NO: 5836426 - DNA, 16 bp, Homo sapiens
agatactaaagcaaat

SEQ ID NO: 5836427 - DNA, 18 bp, Homo sapiens
agatactaaggacgttgt

SEQ ID NO: 5836428 - DNA, 18 bp, Homo sapiens
agatactactttctcttt

SEQ ID NO: 5836429 - DNA, 19 bp, Homo sapiens
agatactactttctctttt

SEQ ID NO: 5836430 - DNA, 12 bp, Homo sapiens
agatactatttt

SEQ ID NO: 5836431 - DNA, 16 bp, Homo sapiens
agatactgctgtgtaa

SEQ ID NO: 5836432 - DNA, 12 bp, Homo sapiens
agatactggaaa

SEQ ID NO: 5836433 - DNA, 19 bp, Homo sapiens
agatactggaagttttgca

SEQ ID NO: 5836434 - DNA, 20 bp, Homo sapiens
agatactggaagttttgcat

SEQ ID NO: 5836435 - DNA, 13 bp, Homo sapiens
agatactggtgga

SEQ ID NO: 5836436 - DNA, 17 bp, Homo sapiens
agatactgtatatgtca

SEQ ID NO: 5836437 - DNA, 22 bp, Homo sapiens
agatactgtatatgtcaaaaat

SEQ ID NO: 5836438 - DNA, 20 bp, Homo sapiens
agatactgtgagcttacatt

SEQ ID NO: 5836439 - DNA, 22 bp, Homo sapiens
agatactgtgagcttacattga

SEQ ID NO: 5836440 - DNA, 15 bp, Homo sapiens
agatactgtgtatat

SEQ ID NO: 5836441 - DNA, 17 bp, Homo sapiens
agatacttatgcaagat

SEQ ID NO: 5836442 - DNA, 12 bp, Homo sapiens
agatacttcagc

SEQ ID NO: 5836443 - DNA, 14 bp, Homo sapiens
agatacttcccaaa

SEQ ID NO: 5836444 - DNA, 17 bp, Homo sapiens
agatacttcccaaagcc

SEQ ID NO: 5836445 - DNA, 20 bp, Homo sapiens
agatacttgatgcacttatt

SEQ ID NO: 5836446 - DNA, 17 bp, Homo sapiens
agatacttgtgaacatg

SEQ ID NO: 5836447 - DNA, 18 bp, Homo sapiens
agatacttgtgaacatgc

SEQ ID NO: 5836448 - DNA, 19 bp, Homo sapiens
agatactttgaagtgcagc

SEQ ID NO: 5836449 - DNA, 16 bp, Homo sapiens
agatactttgcattgt

SEQ ID NO: 5836450 - DNA, 11 bp, Homo sapiens
agatactttgt

SEQ ID NO: 5836451 - DNA, 12 bp, Homo sapiens
agatactttgta

SEQ ID NO: 5836452 - DNA, 13 bp, Homo sapiens
agatactttgtat

SEQ ID NO: 5836453 - DNA, 20 bp, Homo sapiens
agatactttgtattgtccta

SEQ ID NO: 5836454 - DNA, 20 bp, Homo sapiens
agatactttttcttttgtaa

SEQ ID NO: 5836455 - DNA, 18 bp, Homo sapiens
agatagaaaaggtccaaa

SEQ ID NO: 5836456 - DNA, 17 bp, Homo sapiens
agatagaaagcaataaa

SEQ ID NO: 5836457 - DNA, 12 bp, Homo sapiens
agatagaaagct

SEQ ID NO: 5836458 - DNA, 13 bp, Homo sapiens
agatagaaagctg

SEQ ID NO: 5836459 - DNA, 17 bp, Homo sapiens
agatagaaagctggact

SEQ ID NO: 5836460 - DNA, 18 bp, Homo sapiens
agatagaaagctggactg

SEQ ID NO: 5836461 - DNA, 19 bp, Homo sapiens
agatagaaagctggactga

SEQ ID NO: 5836462 - DNA, 16 bp, Homo sapiens
agatagaactgtggca

SEQ ID NO: 5836463 - DNA, 13 bp, Homo sapiens
agatagaagaaaa

SEQ ID NO: 5836464 - DNA, 14 bp, Homo sapiens
agatagaagaaaaa

SEQ ID NO: 5836465 - DNA, 17 bp, Homo sapiens
agatagaagatgtttgc

SEQ ID NO: 5836466 - DNA, 17 bp, Homo sapiens
agatagaagcctctcgt

SEQ ID NO: 5836467 - DNA, 16 bp, Homo sapiens
agatagaatgacagtc

SEQ ID NO: 5836468 - DNA, 17 bp, Homo sapiens
agatagaatttggccca

SEQ ID NO: 5836469 - DNA, 21 bp, Homo sapiens
agatagaatttggcccagaga

SEQ ID NO: 5836470 - DNA, 15 bp, Homo sapiens
agatagacaggtcct

SEQ ID NO: 5836471 - DNA, 20 bp, Homo sapiens
agatagacagtgctgccctg

SEQ ID NO: 5836472 - DNA, 23 bp, Homo sapiens
agatagacagtgctgccctgcga

SEQ ID NO: 5836473 - DNA, 20 bp, Homo sapiens
agatagacgggttgaaagac

SEQ ID NO: 5836474 - DNA, 21 bp, Homo sapiens
agatagacgggttgaaagaca

SEQ ID NO: 5836475 - DNA, 13 bp, Homo sapiens
agatagagaaata

SEQ ID NO: 5836476 - DNA, 20 bp, Homo sapiens
agatagagaaatagtgacaa

SEQ ID NO: 5836477 - DNA, 14 bp, Homo sapiens
agatagagagctat

SEQ ID NO: 5836478 - DNA, 21 bp, Homo sapiens
agatagagagtgagtacatgc

SEQ ID NO: 5836479 - DNA, 18 bp, Homo sapiens
agatagagagttgttgtg

SEQ ID NO: 5836480 - DNA, 24 bp, Homo sapiens
agatagagattcccctggaccaca

SEQ ID NO: 5836481 - DNA, 15 bp, Homo sapiens
agatagagctgggtg

SEQ ID NO: 5836482 - DNA, 20 bp, Homo sapiens
agatagagctgggtggcctg

SEQ ID NO: 5836483 - DNA, 14 bp, Homo sapiens
agatagatgacttt

SEQ ID NO: 5836484 - DNA, 23 bp, Homo sapiens
agatagatgtcgtggactccagc

SEQ ID NO: 5836485 - DNA, 17 bp, Homo sapiens
agatagatgttgctctt

SEQ ID NO: 5836486 - DNA, 12 bp, Homo sapiens
agatagcagagg

SEQ ID NO: 5836487 - DNA, 14 bp, Homo sapiens
agatagcattgtga

SEQ ID NO: 5836488 - DNA, 17 bp, Homo sapiens
agatagccagacacatg

SEQ ID NO: 5836489 - DNA, 13 bp, Homo sapiens
agatagcccagga

SEQ ID NO: 5836490 - DNA, 18 bp, Homo sapiens
agatagccctgtcctggt

SEQ ID NO: 5836491 - DNA, 19 bp, Homo sapiens
agatagccctgtcctggtg

SEQ ID NO: 5836492 - DNA, 20 bp, Homo sapiens
agatagccctgtcctggtgg

SEQ ID NO: 5836493 - DNA, 22 bp, Homo sapiens
agatagcctagggtgagggtga

SEQ ID NO: 5836494 - DNA, 14 bp, Homo sapiens
agatagctgcatgt

SEQ ID NO: 5836495 - DNA, 15 bp, Homo sapiens
agataggaaactgaa

SEQ ID NO: 5836496 - DNA, 14 bp, Homo sapiens
agataggaccttgg

SEQ ID NO: 5836497 - DNA, 16 bp, Homo sapiens
agataggaccttgggc

SEQ ID NO: 5836498 - DNA, 21 bp, Homo sapiens
agataggacgtatttataata

SEQ ID NO: 5836499 - DNA, 16 bp, Homo sapiens
agataggagttctctg

SEQ ID NO: 5836500 - DNA, 16 bp, Homo sapiens
agataggcccctgggg

SEQ ID NO: 5836501 - DNA, 21 bp, Homo sapiens
agataggctctgcacagatgg

SEQ ID NO: 5836502 - DNA, 20 bp, Homo sapiens
agatcgcaccactgcactcc

SEQ ID NO: 5836503 - DNA, 22 bp, Homo sapiens
agatcgcaccactgcactccag

SEQ ID NO: 5836504 - DNA, 16 bp, Homo sapiens
agatcgcatcattgca

SEQ ID NO: 5836505 - DNA, 20 bp, Homo sapiens
agatcgcgccactgcactcc

SEQ ID NO: 5836506 - DNA, 15 bp, Homo sapiens
agatcgctcactgtt

SEQ ID NO: 5836507 - DNA, 15 bp, Homo sapiens
agatcgctgtgttac

SEQ ID NO: 5836508 - DNA, 17 bp, Homo sapiens
agatcgcttgagcccag

SEQ ID NO: 5836509 - DNA, 14 bp, Homo sapiens
agatcggaacagct

SEQ ID NO: 5836510 - DNA, 13 bp, Homo sapiens
agatcggccacag

SEQ ID NO: 5836511 - DNA, 16 bp, Homo sapiens
agatcggccacagggc

SEQ ID NO: 5836512 - DNA, 20 bp, Homo sapiens
agatcggctttcatgtaatt

SEQ ID NO: 5836513 - DNA, 22 bp, Homo sapiens
agatcggctttcatgtaattat

SEQ ID NO: 5836514 - DNA, 19 bp, Homo sapiens
agatcggggccagaggcag

SEQ ID NO: 5836515 - DNA, 18 bp, Homo sapiens
agatcggttaacaaataa

SEQ ID NO: 5836516 - DNA, 14 bp, Homo sapiens
agatcgtattaatt

SEQ ID NO: 5836517 - DNA, 18 bp, Homo sapiens
agatcgtattaattatct

SEQ ID NO: 5836518 - DNA, 22 bp, Homo sapiens
agatcgtattaattatctgatc

SEQ ID NO: 5836519 - DNA, 21 bp, Homo sapiens
agatcgtgccgttactctcca

SEQ ID NO: 5836520 - DNA, 16 bp, Homo sapiens
agatcgttagtatcta

SEQ ID NO: 5836521 - DNA, 15 bp, Homo sapiens
agatcgttcattgcc

SEQ ID NO: 5836522 - DNA, 16 bp, Homo sapiens
agatcgttctctgcct

SEQ ID NO: 5836523 - DNA, 16 bp, Homo sapiens
agatcgttctgccact

SEQ ID NO: 5836524 - DNA, 21 bp, Homo sapiens
agatctaaacagttatttctg

SEQ ID NO: 5836525 - DNA, 11 bp, Homo sapiens
agatctaaata

SEQ ID NO: 5836526 - DNA, 18 bp, Homo sapiens
agatctaaataaaatgct

SEQ ID NO: 5836527 - DNA, 18 bp, Homo sapiens
agatctacacatgttgcc

SEQ ID NO: 5836528 - DNA, 18 bp, Homo sapiens
agatctacagaacaagaa

SEQ ID NO: 5836529 - DNA, 14 bp, Homo sapiens
agatctacatgaat

SEQ ID NO: 5836530 - DNA, 18 bp, Homo sapiens
agatctaccccagggaga

SEQ ID NO: 5836531 - DNA, 20 bp, Homo sapiens
agatctacctgcaacacaac

SEQ ID NO: 5836532 - DNA, 17 bp, Homo sapiens
agatctaccttggtgat

SEQ ID NO: 5836533 - DNA, 21 bp, Homo sapiens
agatctagttctcttctcctg

SEQ ID NO: 5836534 - DNA, 22 bp, Homo sapiens
agatctattgtttgttgcacta

SEQ ID NO: 5836535 - DNA, 22 bp, Homo sapiens
agatctcagataaagtgaccag

SEQ ID NO: 5836536 - DNA, 22 bp, Homo sapiens
agatctcagcagccagctcctg

SEQ ID NO: 5836537 - DNA, 23 bp, Homo sapiens
agatctcagcagccagctcctgg

SEQ ID NO: 5836538 - DNA, 16 bp, Homo sapiens
agatctcatagatgac

SEQ ID NO: 5836539 - DNA, 13 bp, Homo sapiens
agatctccaaagc

SEQ ID NO: 5836540 - DNA, 15 bp, Homo sapiens
agatctccaaagctt

SEQ ID NO: 5836541 - DNA, 21 bp, Homo sapiens
agatctccaaagctttcctgg

SEQ ID NO: 5836542 - DNA, 21 bp, Homo sapiens
agatctcccacatgccagggg

SEQ ID NO: 5836543 - DNA, 18 bp, Homo sapiens
agatctcctatttttcag

SEQ ID NO: 5836544 - DNA, 19 bp, Homo sapiens
agatctcctatttttcaga

SEQ ID NO: 5836545 - DNA, 20 bp, Homo sapiens
agatctcctatttttcagaa

SEQ ID NO: 5836546 - DNA, 18 bp, Homo sapiens
agatctcctggcaaaggc

SEQ ID NO: 5836547 - DNA, 16 bp, Homo sapiens
agatctcctgtaattt

SEQ ID NO: 5836548 - DNA, 23 bp, Homo sapiens
agatctcctgtaattttgtagta

SEQ ID NO: 5836549 - DNA, 14 bp, Homo sapiens
agatctcggtgctg

SEQ ID NO: 5836550 - DNA, 22 bp, Homo sapiens
agatctcggtttgccaaaattc

SEQ ID NO: 5836551 - DNA, 17 bp, Homo sapiens
agatctctattatatct

SEQ ID NO: 5836552 - DNA, 12 bp, Homo sapiens
agatctctctct

SEQ ID NO: 5836553 - DNA, 16 bp, Homo sapiens
agatctctgcagggcc

SEQ ID NO: 5836554 - DNA, 14 bp, Homo sapiens
agatctctttctaa

SEQ ID NO: 5836555 - DNA, 15 bp, Homo sapiens
agatctgaaaggcac

SEQ ID NO: 5836556 - DNA, 13 bp, Homo sapiens
agatctgaaagtt

SEQ ID NO: 5836557 - DNA, 19 bp, Homo sapiens
agatctgaacacagtttag

SEQ ID NO: 5836558 - DNA, 13 bp, Homo sapiens
agatctgagccct

SEQ ID NO: 5836559 - DNA, 16 bp, Homo sapiens
agatctgatggtgagc

SEQ ID NO: 5836560 - DNA, 14 bp, Homo sapiens
agatctgatttata

SEQ ID NO: 5836561 - DNA, 15 bp, Homo sapiens
agatctgcactgggt

SEQ ID NO: 5836562 - DNA, 12 bp, Homo sapiens
agatctgcaggc

SEQ ID NO: 5836563 - DNA, 21 bp, Homo sapiens
agatctgcagggggtgtgtct

SEQ ID NO: 5836564 - DNA, 16 bp, Homo sapiens
agatctgccagacctg

SEQ ID NO: 5836565 - DNA, 19 bp, Homo sapiens
agatctgccagacctgcat

SEQ ID NO: 5836566 - DNA, 13 bp, Homo sapiens
agatctgcctaag

SEQ ID NO: 5836567 - DNA, 14 bp, Homo sapiens
agatctgcctgggc

SEQ ID NO: 5836568 - DNA, 15 bp, Homo sapiens
agatctgcctgggcc

SEQ ID NO: 5836569 - DNA, 22 bp, Homo sapiens
agatctgcctgggcctgtgcag

SEQ ID NO: 5836570 - DNA, 24 bp, Homo sapiens
agatctgcctgggcctgtgcagca

SEQ ID NO: 5836571 - DNA, 23 bp, Homo sapiens
agatctgcttcttcatcttgaca

SEQ ID NO: 5836572 - DNA, 16 bp, Homo sapiens
agatctgctttctgtt

SEQ ID NO: 5836573 - DNA, 19 bp, Homo sapiens
agatctgctttctgttcat

SEQ ID NO: 5836574 - DNA, 15 bp, Homo sapiens
agatctggaacctca

SEQ ID NO: 5836575 - DNA, 20 bp, Homo sapiens
agatctggaacctcagcctg

SEQ ID NO: 5836576 - DNA, 17 bp, Homo sapiens
agatctggacttggcaa

SEQ ID NO: 5836577 - DNA, 16 bp, Homo sapiens
agatctggatcgttat

SEQ ID NO: 5836578 - DNA, 17 bp, Homo sapiens
agatctgggattatgta

SEQ ID NO: 5836579 - DNA, 12 bp, Homo sapiens
agatctggggag

SEQ ID NO: 5836580 - DNA, 13 bp, Homo sapiens
agatctggggagt

SEQ ID NO: 5836581 - DNA, 14 bp, Homo sapiens
agatctgtcctcag

SEQ ID NO: 5836582 - DNA, 19 bp, Homo sapiens
agatctgtcctcagccttg

SEQ ID NO: 5836583 - DNA, 12 bp, Homo sapiens
agatctgtcctg

SEQ ID NO: 5836584 - DNA, 14 bp, Homo sapiens
agatctgtcctggg

SEQ ID NO: 5836585 - DNA, 15 bp, Homo sapiens
agatctgtcctgggg

SEQ ID NO: 5836586 - DNA, 13 bp, Homo sapiens
agatctgtgcccc

SEQ ID NO: 5836587 - DNA, 16 bp, Homo sapiens
agatctgtgccccatg

SEQ ID NO: 5836588 - DNA, 19 bp, Homo sapiens
agatctgtgccccatgcct

SEQ ID NO: 5836589 - DNA, 15 bp, Homo sapiens
agatctgtgcctggg

SEQ ID NO: 5836590 - DNA, 21 bp, Homo sapiens
agatctgtgtggctcctgggc

SEQ ID NO: 5836591 - DNA, 23 bp, Homo sapiens
agatctgtgttttagtttaatag

SEQ ID NO: 5836592 - DNA, 13 bp, Homo sapiens
agatctgttaaaa

SEQ ID NO: 5836593 - DNA, 14 bp, Homo sapiens
agatctgttttgaa

SEQ ID NO: 5836594 - DNA, 21 bp, Homo sapiens
agatctgttttgaaggcaaaa

SEQ ID NO: 5836595 - DNA, 23 bp, Homo sapiens
agatctgttttgtggtttggaat

SEQ ID NO: 5836596 - DNA, 16 bp, Homo sapiens
agatcttaaattttgt

SEQ ID NO: 5836597 - DNA, 13 bp, Homo sapiens
agatcttaagcag

SEQ ID NO: 5836598 - DNA, 21 bp, Homo sapiens
agatcttaagcagtaatctgt

SEQ ID NO: 5836599 - DNA, 17 bp, Homo sapiens
agatcttacatctgcag

SEQ ID NO: 5836600 - DNA, 18 bp, Homo sapiens
agatcttaggcaaaatac

SEQ ID NO: 5836601 - DNA, 17 bp, Homo sapiens
agatcttatattggttt

SEQ ID NO: 5836602 - DNA, 20 bp, Homo sapiens
agatcttcccataataaagc

SEQ ID NO: 5836603 - DNA, 22 bp, Homo sapiens
agatcttccgtggtcagagtgc

SEQ ID NO: 5836604 - DNA, 15 bp, Homo sapiens
agatcttcctgctga

SEQ ID NO: 5836605 - DNA, 11 bp, Homo sapiens
agatcttcctt

SEQ ID NO: 5836606 - DNA, 15 bp, Homo sapiens
agatcttccttccgc

SEQ ID NO: 5836607 - DNA, 14 bp, Homo sapiens
agatcttctgtggg

SEQ ID NO: 5836608 - DNA, 13 bp, Homo sapiens
agatcttgtctcc

SEQ ID NO: 5836609 - DNA, 16 bp, Homo sapiens
agatcttgtctccact

SEQ ID NO: 5836610 - DNA, 17 bp, Homo sapiens
agatctttaaatacagt

SEQ ID NO: 5836611 - DNA, 19 bp, Homo sapiens
agatctttaaatacagtca

SEQ ID NO: 5836612 - DNA, 12 bp, Homo sapiens
agatctttacat

SEQ ID NO: 5836613 - DNA, 22 bp, Homo sapiens
agatctttattatggaaaacat

SEQ ID NO: 5836614 - DNA, 12 bp, Homo sapiens
agatctttcaga

SEQ ID NO: 5836615 - DNA, 14 bp, Homo sapiens
agatctttcagaaa

SEQ ID NO: 5836616 - DNA, 19 bp, Homo sapiens
agatctttcagaaatataa

SEQ ID NO: 5836617 - DNA, 20 bp, Homo sapiens
agatctttcagaaatataac

SEQ ID NO: 5836618 - DNA, 13 bp, Homo sapiens
agatctttcagga

SEQ ID NO: 5836619 - DNA, 12 bp, Homo sapiens
agatctttctct

SEQ ID NO: 5836620 - DNA, 17 bp, Homo sapiens
agatctttctcttccct

SEQ ID NO: 5836621 - DNA, 21 bp, Homo sapiens
agatctttctttccaaaacat

SEQ ID NO: 5836622 - DNA, 20 bp, Homo sapiens
agatctttgcaccagatact

SEQ ID NO: 5836623 - DNA, 22 bp, Homo sapiens
agatctttgcaccagatactca

SEQ ID NO: 5836624 - DNA, 14 bp, Homo sapiens
agatctttgtaaat

SEQ ID NO: 5836625 - DNA, 17 bp, Homo sapiens
agatctttgtaaatgca

SEQ ID NO: 5836626 - DNA, 12 bp, Homo sapiens
agatcttttaaa

SEQ ID NO: 5836627 - DNA, 15 bp, Homo sapiens
agatctttttgtgaa

SEQ ID NO: 5836628 - DNA, 20 bp, Homo sapiens
agatgaaaaagcatgtacag

SEQ ID NO: 5836629 - DNA, 22 bp, Homo sapiens
agatgaaaaagcatgtacagtg

SEQ ID NO: 5836630 - DNA, 23 bp, Homo sapiens
agatgaaaacctgcatttttaaa

SEQ ID NO: 5836631 - DNA, 12 bp, Homo sapiens
agatgaaaataa

SEQ ID NO: 5836632 - DNA, 20 bp, Homo sapiens
agatgaaactggttcctaca

SEQ ID NO: 5836633 - DNA, 14 bp, Homo sapiens
agatgaaagagcag

SEQ ID NO: 5836634 - DNA, 13 bp, Homo sapiens
agatgaaagagga

SEQ ID NO: 5836635 - DNA, 23 bp, Homo sapiens
agatgaaagaggaggtttggggt

SEQ ID NO: 5836636 - DNA, 15 bp, Homo sapiens
agatgaaatgcactg

SEQ ID NO: 5836637 - DNA, 16 bp, Homo sapiens
agatgaaatgcactgt

SEQ ID NO: 5836638 - DNA, 15 bp, Homo sapiens
agatgaaattccatt

SEQ ID NO: 5836639 - DNA, 17 bp, Homo sapiens
agatgaaattccatttg

SEQ ID NO: 5836640 - DNA, 18 bp, Homo sapiens
agatgaaattccatttgt

SEQ ID NO: 5836641 - DNA, 13 bp, Homo sapiens
agatgaacatctc

SEQ ID NO: 5836642 - DNA, 16 bp, Homo sapiens
agatgaacatctctgt

SEQ ID NO: 5836643 - DNA, 20 bp, Homo sapiens
agatgaacatctctgttatt

SEQ ID NO: 5836644 - DNA, 17 bp, Homo sapiens
agatgaacatctgggga

SEQ ID NO: 5836645 - DNA, 18 bp, Homo sapiens
agatgaaccctggcattt

SEQ ID NO: 5836646 - DNA, 20 bp, Homo sapiens
agatgaaccctggcatttgg

SEQ ID NO: 5836647 - DNA, 20 bp, Homo sapiens
agatgaactgactgaaggaa

SEQ ID NO: 5836648 - DNA, 13 bp, Homo sapiens
agatgaagaaaga

SEQ ID NO: 5836649 - DNA, 15 bp, Homo sapiens
agatgaagaaagaga

SEQ ID NO: 5836650 - DNA, 12 bp, Homo sapiens
agatgaagaagc

SEQ ID NO: 5836651 - DNA, 16 bp, Homo sapiens
agatgaagaagccttt

SEQ ID NO: 5836652 - DNA, 13 bp, Homo sapiens
agatgaagaagga

SEQ ID NO: 5836653 - DNA, 18 bp, Homo sapiens
agatgaagaaggagcaga

SEQ ID NO: 5836654 - DNA, 17 bp, Homo sapiens
agatgaagagtgagagg

SEQ ID NO: 5836655 - DNA, 20 bp, Homo sapiens
agatgaagagtgagagggca

SEQ ID NO: 5836656 - DNA, 18 bp, Homo sapiens
agatgaagcaaacacatt

SEQ ID NO: 5836657 - DNA, 20 bp, Homo sapiens
agatgaagctgtttttgtgc

SEQ ID NO: 5836658 - DNA, 15 bp, Homo sapiens
agatgaaggaaagga

SEQ ID NO: 5836659 - DNA, 17 bp, Homo sapiens
agatgaaggctgtatct

SEQ ID NO: 5836660 - DNA, 16 bp, Homo sapiens
agatgaatacaaacaa

SEQ ID NO: 5836661 - DNA, 19 bp, Homo sapiens
agatgaatagaagaaagaa

SEQ ID NO: 5836662 - DNA, 20 bp, Homo sapiens
agatgaatccaaatgtgaaa

SEQ ID NO: 5836663 - DNA, 23 bp, Homo sapiens
agatgaatccaaatgtgaaagat

SEQ ID NO: 5836664 - DNA, 23 bp, Homo sapiens
agatgaattgataaaagagttcc

SEQ ID NO: 5836665 - DNA, 17 bp, Homo sapiens
agatgacaaaccataac

SEQ ID NO: 5836666 - DNA, 15 bp, Homo sapiens
agatgacaaatattc

SEQ ID NO: 5836667 - DNA, 16 bp, Homo sapiens
agatgacaacaaattt

SEQ ID NO: 5836668 - DNA, 21 bp, Homo sapiens
agatgacaacaaattttggtt

SEQ ID NO: 5836669 - DNA, 17 bp, Homo sapiens
agatgacaacctccatt

SEQ ID NO: 5836670 - DNA, 19 bp, Homo sapiens
agatgacacataaatctgt

SEQ ID NO: 5836671 - DNA, 15 bp, Homo sapiens
agatgacagctcttc

SEQ ID NO: 5836672 - DNA, 17 bp, Homo sapiens
agatgacagggagctgg

SEQ ID NO: 5836673 - DNA, 18 bp, Homo sapiens
agatgacataaaatttac

SEQ ID NO: 5836674 - DNA, 18 bp, Homo sapiens
agatgacatctgtctagg

SEQ ID NO: 5836675 - DNA, 21 bp, Homo sapiens
agatgacattgctaagatgct

SEQ ID NO: 5836676 - DNA, 22 bp, Homo sapiens
agatgacattgctaagatgctc

SEQ ID NO: 5836677 - DNA, 15 bp, Homo sapiens
agatgacatttgctt

SEQ ID NO: 5836678 - DNA, 15 bp, Homo sapiens
agatgacattttaaa

SEQ ID NO: 5836679 - DNA, 20 bp, Homo sapiens
agatgaccaaagtcccttcc

SEQ ID NO: 5836680 - DNA, 16 bp, Homo sapiens
agatgttaacagtatt

SEQ ID NO: 5836681 - DNA, 16 bp, Homo sapiens
agatgttactacctta

SEQ ID NO: 5836682 - DNA, 14 bp, Homo sapiens
agatgttactgtgt

SEQ ID NO: 5836683 - DNA, 17 bp, Homo sapiens
agatgttagatcagggg

SEQ ID NO: 5836684 - DNA, 15 bp, Homo sapiens
agatgttatattaaa

SEQ ID NO: 5836685 - DNA, 17 bp, Homo sapiens
agatgttatattaaaga

SEQ ID NO: 5836686 - DNA, 18 bp, Homo sapiens
agatgttatattaaagaa

SEQ ID NO: 5836687 - DNA, 17 bp, Homo sapiens
agatgttatatttttct

SEQ ID NO: 5836688 - DNA, 16 bp, Homo sapiens
agatgttattactgtt

SEQ ID NO: 5836689 - DNA, 17 bp, Homo sapiens
agatgttattactgttt

SEQ ID NO: 5836690 - DNA, 14 bp, Homo sapiens
agatgttatttttg

SEQ ID NO: 5836691 - DNA, 20 bp, Homo sapiens
agatgttatttttgtatttt

SEQ ID NO: 5836692 - DNA, 23 bp, Homo sapiens
agatgttcatttttaaagcctgg

SEQ ID NO: 5836693 - DNA, 16 bp, Homo sapiens
agatgttccaaattta

SEQ ID NO: 5836694 - DNA, 14 bp, Homo sapiens
agatgttcggtttt

SEQ ID NO: 5836695 - DNA, 18 bp, Homo sapiens
agatgttctctatcattt

SEQ ID NO: 5836696 - DNA, 20 bp, Homo sapiens
agatgttctctatcatttaa

SEQ ID NO: 5836697 - DNA, 20 bp, Homo sapiens
agatgttctctcccaggggc

SEQ ID NO: 5836698 - DNA, 16 bp, Homo sapiens
agatgttctgtagcaa

SEQ ID NO: 5836699 - DNA, 15 bp, Homo sapiens
agatgttgaattctt

SEQ ID NO: 5836700 - DNA, 23 bp, Homo sapiens
agatgttgaattcttttgccaag

SEQ ID NO: 5836701 - DNA, 22 bp, Homo sapiens
agatgttgagaaacctgggctc

SEQ ID NO: 5836702 - DNA, 18 bp, Homo sapiens
agatgttgccatgtgttt

SEQ ID NO: 5836703 - DNA, 12 bp, Homo sapiens
agatgttgctaa

SEQ ID NO: 5836704 - DNA, 23 bp, Homo sapiens
agatgttgcttttgaaaagttga

SEQ ID NO: 5836705 - DNA, 23 bp, Homo sapiens
agatgttggtcttggtcatttgc

SEQ ID NO: 5836706 - DNA, 15 bp, Homo sapiens
agatgttgtcattat

SEQ ID NO: 5836707 - DNA, 15 bp, Homo sapiens
agatgttgtctgaac

SEQ ID NO: 5836708 - DNA, 13 bp, Homo sapiens
agatgttgtcttg

SEQ ID NO: 5836709 - DNA, 14 bp, Homo sapiens
agatgtttaaaaca

SEQ ID NO: 5836710 - DNA, 16 bp, Homo sapiens
agatgtttaaaacacc

SEQ ID NO: 5836711 - DNA, 15 bp, Homo sapiens
agatgtttatatcaa

SEQ ID NO: 5836712 - DNA, 19 bp, Homo sapiens
agatgtttattcttctaga

SEQ ID NO: 5836713 - DNA, 21 bp, Homo sapiens
agatgtttattcttctagagt

SEQ ID NO: 5836714 - DNA, 22 bp, Homo sapiens
agatgtttatttagaaactggt

SEQ ID NO: 5836715 - DNA, 16 bp, Homo sapiens
agatgtttatttcagg

SEQ ID NO: 5836716 - DNA, 21 bp, Homo sapiens
agatgtttcattttactgtat

SEQ ID NO: 5836717 - DNA, 23 bp, Homo sapiens
agatgtttcattttactgtatat

SEQ ID NO: 5836718 - DNA, 14 bp, Homo sapiens
agatgtttccagac

SEQ ID NO: 5836719 - DNA, 12 bp, Homo sapiens
agatgtttcttg

SEQ ID NO: 5836720 - DNA, 16 bp, Homo sapiens
agatgtttcttgcctt

SEQ ID NO: 5836721 - DNA, 23 bp, Homo sapiens
agatgtttcttgccttttgttaa

SEQ ID NO: 5836722 - DNA, 18 bp, Homo sapiens
agatgtttcttttgtatg

SEQ ID NO: 5836723 - DNA, 17 bp, Homo sapiens
agatgtttgatagattt

SEQ ID NO: 5836724 - DNA, 19 bp, Homo sapiens
agatgtttggaaaccacag

SEQ ID NO: 5836725 - DNA, 22 bp, Homo sapiens
agatgtttggatattttttggt

SEQ ID NO: 5836726 - DNA, 16 bp, Homo sapiens
agatgtttggcaagaa

SEQ ID NO: 5836727 - DNA, 24 bp, Homo sapiens
agatgtttgtcagatatgatatgt

SEQ ID NO: 5836728 - DNA, 23 bp, Homo sapiens
agatgtttgttttcaaaatactt

SEQ ID NO: 5836729 - DNA, 15 bp, Homo sapiens
agatgttttaactta

SEQ ID NO: 5836730 - DNA, 22 bp, Homo sapiens
agatgttttaccgtaataatta

SEQ ID NO: 5836731 - DNA, 22 bp, Homo sapiens
agatgttttacgcaaggaagga

SEQ ID NO: 5836732 - DNA, 23 bp, Homo sapiens
agatgttttacgcaaggaaggac

SEQ ID NO: 5836733 - DNA, 11 bp, Homo sapiens
agatgttttag

SEQ ID NO: 5836734 - DNA, 15 bp, Homo sapiens
agatgttttagttta

SEQ ID NO: 5836735 - DNA, 17 bp, Homo sapiens
agatgttttatttatga

SEQ ID NO: 5836736 - DNA, 18 bp, Homo sapiens
agatgttttatttatgaa

SEQ ID NO: 5836737 - DNA, 21 bp, Homo sapiens
agatgttttatttatgaagtt

SEQ ID NO: 5836738 - DNA, 20 bp, Homo sapiens
agatgttttgggatcaggag

SEQ ID NO: 5836739 - DNA, 22 bp, Homo sapiens
agatgttttggtagattaaata

SEQ ID NO: 5836740 - DNA, 15 bp, Homo sapiens
agatgttttgtataa

SEQ ID NO: 5836741 - DNA, 13 bp, Homo sapiens
agatgtttttaaa

SEQ ID NO: 5836742 - DNA, 22 bp, Homo sapiens
agatgtttttaaaagtttcaat

SEQ ID NO: 5836743 - DNA, 21 bp, Homo sapiens
agatgtttttaattctagtat

SEQ ID NO: 5836744 - DNA, 15 bp, Homo sapiens
agattaaaaattata

SEQ ID NO: 5836745 - DNA, 16 bp, Homo sapiens
agattaaaaattatag

SEQ ID NO: 5836746 - DNA, 21 bp, Homo sapiens
agattaaaaattataggaata

SEQ ID NO: 5836747 - DNA, 12 bp, Homo sapiens
agattaaaatat

SEQ ID NO: 5836748 - DNA, 13 bp, Homo sapiens
agattaaaatatt

SEQ ID NO: 5836749 - DNA, 16 bp, Homo sapiens
agattaaaattagtga

SEQ ID NO: 5836750 - DNA, 16 bp, Homo sapiens
agattaaactgagtga

SEQ ID NO: 5836751 - DNA, 11 bp, Homo sapiens
agattaaagga

SEQ ID NO: 5836752 - DNA, 14 bp, Homo sapiens
agattaaaggaagg

SEQ ID NO: 5836753 - DNA, 17 bp, Homo sapiens
agattaaaggaaggaaa

SEQ ID NO: 5836754 - DNA, 21 bp, Homo sapiens
agattaaatatatctttgtaa

SEQ ID NO: 5836755 - DNA, 22 bp, Homo sapiens
agattaaatatatctttgtaaa

SEQ ID NO: 5836756 - DNA, 15 bp, Homo sapiens
agattaaattacagc

SEQ ID NO: 5836757 - DNA, 18 bp, Homo sapiens
agattaaattacagcttt

SEQ ID NO: 5836758 - DNA, 21 bp, Homo sapiens
agattaaattacagcttttat

SEQ ID NO: 5836759 - DNA, 14 bp, Homo sapiens
agattaacaacact

SEQ ID NO: 5836760 - DNA, 19 bp, Homo sapiens
agattaactggtagttcat

SEQ ID NO: 5836761 - DNA, 13 bp, Homo sapiens
agattaagaaata

SEQ ID NO: 5836762 - DNA, 19 bp, Homo sapiens
agattaagatctgtgtttt

SEQ ID NO: 5836763 - DNA, 22 bp, Homo sapiens
agattaagatgccttgaattgt

SEQ ID NO: 5836764 - DNA, 17 bp, Homo sapiens
agattaagcttttcatt

SEQ ID NO: 5836765 - DNA, 20 bp, Homo sapiens
agattaagcttttcatttta

SEQ ID NO: 5836766 - DNA, 20 bp, Homo sapiens
agattaataacagaaataca

SEQ ID NO: 5836767 - DNA, 17 bp, Homo sapiens
agattaatactctattt

SEQ ID NO: 5836768 - DNA, 21 bp, Homo sapiens
agattaatctaccttgcagtg

SEQ ID NO: 5836769 - DNA, 19 bp, Homo sapiens
agattaatgacctgaattg

SEQ ID NO: 5836770 - DNA, 14 bp, Homo sapiens
agattaatggcact

SEQ ID NO: 5836771 - DNA, 13 bp, Homo sapiens
agattaatttgtg

SEQ ID NO: 5836772 - DNA, 14 bp, Homo sapiens
agattacaaaagca

SEQ ID NO: 5836773 - DNA, 13 bp, Homo sapiens
agattacaataaa

SEQ ID NO: 5836774 - DNA, 15 bp, Homo sapiens
agattacaataaatc

SEQ ID NO: 5836775 - DNA, 17 bp, Homo sapiens
agattacatctgcctta

SEQ ID NO: 5836776 - DNA, 17 bp, Homo sapiens
agattactccttccttc

SEQ ID NO: 5836777 - DNA, 15 bp, Homo sapiens
agattactttgtccc

SEQ ID NO: 5836778 - DNA, 16 bp, Homo sapiens
agattactttgtcccg

SEQ ID NO: 5836779 - DNA, 19 bp, Homo sapiens
agattagaaaaattcctaa

SEQ ID NO: 5836780 - DNA, 15 bp, Homo sapiens
agattagaagctgaa

SEQ ID NO: 5836781 - DNA, 23 bp, Homo sapiens
agattagaattctgtatagatta

SEQ ID NO: 5836782 - DNA, 21 bp, Homo sapiens
agattagagagtgttgaaacg

SEQ ID NO: 5836783 - DNA, 18 bp, Homo sapiens
agattagagggaggtgtt

SEQ ID NO: 5836784 - DNA, 22 bp, Homo sapiens
agattagatgtgccaataacca

SEQ ID NO: 5836785 - DNA, 23 bp, Homo sapiens
agattagatgtgccaataaccaa

SEQ ID NO: 5836786 - DNA, 21 bp, Homo sapiens
agattagcaaggtcatttctt

SEQ ID NO: 5836787 - DNA, 17 bp, Homo sapiens
agattagcatgaaaggt

SEQ ID NO: 5836788 - DNA, 17 bp, Homo sapiens
agattagctctggacca

SEQ ID NO: 5836789 - DNA, 19 bp, Homo sapiens
agattaggaagtcacagat

SEQ ID NO: 5836790 - DNA, 16 bp, Homo sapiens
agattaggacacagtg

SEQ ID NO: 5836791 - DNA, 15 bp, Homo sapiens
agattaggagaaaca

SEQ ID NO: 5836792 - DNA, 17 bp, Homo sapiens
agattaggagaaacaca

SEQ ID NO: 5836793 - DNA, 17 bp, Homo sapiens
agattaggcacacagat

SEQ ID NO: 5836794 - DNA, 16 bp, Homo sapiens
agattaggcctggagt

SEQ ID NO: 5836795 - DNA, 20 bp, Homo sapiens
agattaggtcgttttccaaa

SEQ ID NO: 5836796 - DNA, 14 bp, Homo sapiens
agattaggtcttgc

SEQ ID NO: 5836797 - DNA, 15 bp, Homo sapiens
agattaggtcttgct

SEQ ID NO: 5836798 - DNA, 17 bp, Homo sapiens
agattaggtcttgctgg

SEQ ID NO: 5836799 - DNA, 18 bp, Homo sapiens
agattaggtttgtcccag

SEQ ID NO: 5836800 - DNA, 21 bp, Homo sapiens
agattagtaaatatgtgaaga

SEQ ID NO: 5836801 - DNA, 23 bp, Homo sapiens
agattagtaaatatgtgaagaaa

SEQ ID NO: 5836802 - DNA, 21 bp, Homo sapiens
agattagtaactgttcctact

SEQ ID NO: 5836803 - DNA, 19 bp, Homo sapiens
agattagttctttttgcca

SEQ ID NO: 5836804 - DNA, 18 bp, Homo sapiens
agattataataaatatat

SEQ ID NO: 5836805 - DNA, 13 bp, Homo sapiens
agattataattgt

SEQ ID NO: 5836806 - DNA, 15 bp, Homo sapiens
agattatagattcta

SEQ ID NO: 5836807 - DNA, 18 bp, Homo sapiens
agattatagattctaaag

SEQ ID NO: 5836808 - DNA, 21 bp, Homo sapiens
agattatagctcccaaaagaa

SEQ ID NO: 5836809 - DNA, 20 bp, Homo sapiens
agattataggcacctaccac

SEQ ID NO: 5836810 - DNA, 17 bp, Homo sapiens
agattatatacaaagct

SEQ ID NO: 5836811 - DNA, 23 bp, Homo sapiens
agattatatatatttttttctga

SEQ ID NO: 5836812 - DNA, 19 bp, Homo sapiens
agattatatatcataaagt

SEQ ID NO: 5836813 - DNA, 18 bp, Homo sapiens
agattatatcaaagtatt

SEQ ID NO: 5836814 - DNA, 18 bp, Homo sapiens
agattatcacattaattt

SEQ ID NO: 5836815 - DNA, 17 bp, Homo sapiens
agattatcagtagaaag

SEQ ID NO: 5836816 - DNA, 13 bp, Homo sapiens
agattatcctgtt

SEQ ID NO: 5836817 - DNA, 18 bp, Homo sapiens
agattatcctgttactga

SEQ ID NO: 5836818 - DNA, 15 bp, Homo sapiens
agattatctatttgt

SEQ ID NO: 5836819 - DNA, 19 bp, Homo sapiens
agattatgagacacaggat

SEQ ID NO: 5836820 - DNA, 14 bp, Homo sapiens
agattatgatgcat

SEQ ID NO: 5836821 - DNA, 20 bp, Homo sapiens
agattatgatgcatacagtt

SEQ ID NO: 5836822 - DNA, 21 bp, Homo sapiens
agattatggcctttttaagta

SEQ ID NO: 5836823 - DNA, 14 bp, Homo sapiens
agattatgtgactt

SEQ ID NO: 5836824 - DNA, 19 bp, Homo sapiens
agattatgttcaatgaata

SEQ ID NO: 5836825 - DNA, 18 bp, Homo sapiens
agattatgttcctgctgt

SEQ ID NO: 5836826 - DNA, 21 bp, Homo sapiens
agattattaaatcgtttaatg

SEQ ID NO: 5836827 - DNA, 17 bp, Homo sapiens
agattattataaactat

SEQ ID NO: 5836828 - DNA, 19 bp, Homo sapiens
agattattataaactataa

SEQ ID NO: 5836829 - DNA, 23 bp, Homo sapiens
agattattataaactataaactt

SEQ ID NO: 5836830 - DNA, 18 bp, Homo sapiens
agattattccttcttcta

SEQ ID NO: 5836831 - DNA, 14 bp, Homo sapiens
agattattgaaata

SEQ ID NO: 5836832 - DNA, 21 bp, Homo sapiens
agattattgtagtgttcaaaa

SEQ ID NO: 5836833 - DNA, 21 bp, Homo sapiens
agattattgtgacttcactgt

SEQ ID NO: 5836834 - DNA, 23 bp, Homo sapiens
agattattgtgacttcactgtat

SEQ ID NO: 5836835 - DNA, 13 bp, Homo sapiens
agattatttaaat

SEQ ID NO: 5836836 - DNA, 14 bp, Homo sapiens
agattatttgccca

SEQ ID NO: 5836837 - DNA, 19 bp, Homo sapiens
agattatttgtgcatttta

SEQ ID NO: 5836838 - DNA, 21 bp, Homo sapiens
agattatttgtgcattttatt

SEQ ID NO: 5836839 - DNA, 20 bp, Homo sapiens
agattcaaaaaaaaaatata

SEQ ID NO: 5836840 - DNA, 21 bp, Homo sapiens
agattcaaagcccaactgtgg

SEQ ID NO: 5836841 - DNA, 14 bp, Homo sapiens
agattcaaaggttc

SEQ ID NO: 5836842 - DNA, 16 bp, Homo sapiens
agattcaaaggttcta

SEQ ID NO: 5836843 - DNA, 17 bp, Homo sapiens
agattcaaaggttctag

SEQ ID NO: 5836844 - DNA, 15 bp, Homo sapiens
agattcaagacaaga

SEQ ID NO: 5836845 - DNA, 14 bp, Homo sapiens
agattcaagttgtg

SEQ ID NO: 5836846 - DNA, 17 bp, Homo sapiens
agattcaatattatgaa

SEQ ID NO: 5836847 - DNA, 23 bp, Homo sapiens
agattcaatattgaatttttcct

SEQ ID NO: 5836848 - DNA, 17 bp, Homo sapiens
agattcaattttcttta

SEQ ID NO: 5836849 - DNA, 13 bp, Homo sapiens
agattcacactgt

SEQ ID NO: 5836850 - DNA, 17 bp, Homo sapiens
agattcacactgtctgg

SEQ ID NO: 5836851 - DNA, 14 bp, Homo sapiens
agattcacctgtaa

SEQ ID NO: 5836852 - DNA, 16 bp, Homo sapiens
agattcactcagaaga

SEQ ID NO: 5836853 - DNA, 21 bp, Homo sapiens
agattcactgtcttttgattc

SEQ ID NO: 5836854 - DNA, 20 bp, Homo sapiens
agattcagaatgagaatgga

SEQ ID NO: 5836855 - DNA, 14 bp, Homo sapiens
agattcagagaaat

SEQ ID NO: 5836856 - DNA, 16 bp, Homo sapiens
agatttttaagaactt

SEQ ID NO: 5836857 - DNA, 18 bp, Homo sapiens
agatttttaagaacttca

SEQ ID NO: 5836858 - DNA, 15 bp, Homo sapiens
agatttttatcttaa

SEQ ID NO: 5836859 - DNA, 15 bp, Homo sapiens
agatttttatgtttt

SEQ ID NO: 5836860 - DNA, 15 bp, Homo sapiens
agatttttatttatg

SEQ ID NO: 5836861 - DNA, 19 bp, Homo sapiens
agatttttattttgaaaaa

SEQ ID NO: 5836862 - DNA, 13 bp, Homo sapiens
agatttttcaaaa

SEQ ID NO: 5836863 - DNA, 19 bp, Homo sapiens
agatttttcatacttttct

SEQ ID NO: 5836864 - DNA, 21 bp, Homo sapiens
agatttttcatacttttctta

SEQ ID NO: 5836865 - DNA, 13 bp, Homo sapiens
agatttttcatgt

SEQ ID NO: 5836866 - DNA, 21 bp, Homo sapiens
agatttttcggaggccccact

SEQ ID NO: 5836867 - DNA, 17 bp, Homo sapiens
agatttttgattcagct

SEQ ID NO: 5836868 - DNA, 15 bp, Homo sapiens
agatttttgggctcc

SEQ ID NO: 5836869 - DNA, 22 bp, Homo sapiens
agatttttggtagtttctgggt

SEQ ID NO: 5836870 - DNA, 15 bp, Homo sapiens
agatttttggttttt

SEQ ID NO: 5836871 - DNA, 19 bp, Homo sapiens
agattttttaaaattttgg

SEQ ID NO: 5836872 - DNA, 17 bp, Homo sapiens
agattttttaattgttt

SEQ ID NO: 5836873 - DNA, 23 bp, Homo sapiens
agattttttaattgtttaaaaac

SEQ ID NO: 5836874 - DNA, 13 bp, Homo sapiens
agattttttattg

SEQ ID NO: 5836875 - DNA, 18 bp, Homo sapiens
agattttttattgctagt

SEQ ID NO: 5836876 - DNA, 16 bp, Homo sapiens
agattttttcagactt

SEQ ID NO: 5836877 - DNA, 22 bp, Homo sapiens
agattttttcagacttgtcaag

SEQ ID NO: 5836878 - DNA, 22 bp, Homo sapiens
agattttttctttaaataaaaa

SEQ ID NO: 5836879 - DNA, 21 bp, Homo sapiens
agatttttttcatagatttga

SEQ ID NO: 5836880 - DNA, 22 bp, Homo sapiens
agatttttttcatagatttgaa

SEQ ID NO: 5836881 - DNA, 14 bp, Homo sapiens
agatttttttcctg

SEQ ID NO: 5836882 - DNA, 15 bp, Homo sapiens
agatttttttgtaag

SEQ ID NO: 5836883 - DNA, 15 bp, Homo sapiens
agatttttttgttgt

SEQ ID NO: 5836884 - DNA, 18 bp, Homo sapiens
agatttttttgttgtttg

SEQ ID NO: 5836885 - DNA, 23 bp, Homo sapiens
agatttttttgttgtttgtttag

SEQ ID NO: 5836886 - DNA, 16 bp, Homo sapiens
agattttttttccgtg

SEQ ID NO: 5836887 - DNA, 21 bp, Homo sapiens
agatttttttttctcttttaa

SEQ ID NO: 5836888 - DNA, 16 bp, Homo sapiens
agattttttttttaat

SEQ ID NO: 5836889 - DNA, 19 bp, Homo sapiens
agcaaaaaaaacccatgtg

SEQ ID NO: 5836890 - DNA, 18 bp, Homo sapiens
agcaaaaaaagttgtatg

SEQ ID NO: 5836891 - DNA, 14 bp, Homo sapiens
agcaaaaaagagtt

SEQ ID NO: 5836892 - DNA, 22 bp, Homo sapiens
agcaaaaaagtccaattttaat

SEQ ID NO: 5836893 - DNA, 16 bp, Homo sapiens
agcaaaaaataatgac

SEQ ID NO: 5836894 - DNA, 20 bp, Homo sapiens
agcaaaaaatgaatgtctaa

SEQ ID NO: 5836895 - DNA, 16 bp, Homo sapiens
agcaaaaactacattt

SEQ ID NO: 5836896 - DNA, 16 bp, Homo sapiens
agcaaaaactgtggga

SEQ ID NO: 5836897 - DNA, 14 bp, Homo sapiens
agcaaaaagatgta

SEQ ID NO: 5836898 - DNA, 17 bp, Homo sapiens
agcaaaaagtggggcag

SEQ ID NO: 5836899 - DNA, 19 bp, Homo sapiens
agcaaaaatattttatgat

SEQ ID NO: 5836900 - DNA, 20 bp, Homo sapiens
agcaaaaatgacaacagaaa

SEQ ID NO: 5836901 - DNA, 13 bp, Homo sapiens
agcaaaaatgcta

SEQ ID NO: 5836902 - DNA, 20 bp, Homo sapiens
agcaaaaatgtaaaaaacaa

SEQ ID NO: 5836903 - DNA, 23 bp, Homo sapiens
agcaaaaatgtaaaaaacaaaaa

SEQ ID NO: 5836904 - DNA, 14 bp, Homo sapiens
agcaaaacagactg

SEQ ID NO: 5836905 - DNA, 17 bp, Homo sapiens
agcaaaacagattcaaa

SEQ ID NO: 5836906 - DNA, 16 bp, Homo sapiens
agcaaaacatctctgc

SEQ ID NO: 5836907 - DNA, 17 bp, Homo sapiens
agcaaaacatctctgca

SEQ ID NO: 5836908 - DNA, 21 bp, Homo sapiens
agcaaaacatcttttcctgat

SEQ ID NO: 5836909 - DNA, 16 bp, Homo sapiens
agcaaaacattttgta

SEQ ID NO: 5836910 - DNA, 16 bp, Homo sapiens
agcaaaaccattgctt

SEQ ID NO: 5836911 - DNA, 20 bp, Homo sapiens
agcaaaaccattgcttcact

SEQ ID NO: 5836912 - DNA, 14 bp, Homo sapiens
agcaaaacttttaa

SEQ ID NO: 5836913 - DNA, 16 bp, Homo sapiens
agcaaaacttttaaac

SEQ ID NO: 5836914 - DNA, 12 bp, Homo sapiens
agcaaaagaaaa

SEQ ID NO: 5836915 - DNA, 13 bp, Homo sapiens
agcaaaagaaaaa

SEQ ID NO: 5836916 - DNA, 16 bp, Homo sapiens
agcaaaagaagtaaca

SEQ ID NO: 5836917 - DNA, 13 bp, Homo sapiens
agcaaaaggatga

SEQ ID NO: 5836918 - DNA, 13 bp, Homo sapiens
agcaaaaggcagc

SEQ ID NO: 5836919 - DNA, 14 bp, Homo sapiens
agcaaaaggcagct

SEQ ID NO: 5836920 - DNA, 15 bp, Homo sapiens
agcaaaaggcagctc

SEQ ID NO: 5836921 - DNA, 18 bp, Homo sapiens
agcaaaagggtgtctgag

SEQ ID NO: 5836922 - DNA, 15 bp, Homo sapiens
agcaaaataaaaact

SEQ ID NO: 5836923 - DNA, 16 bp, Homo sapiens
agcaaaataaggaaga

SEQ ID NO: 5836924 - DNA, 16 bp, Homo sapiens
agcaaaataataaaat

SEQ ID NO: 5836925 - DNA, 21 bp, Homo sapiens
agcaaaataattttaaacaaa

SEQ ID NO: 5836926 - DNA, 14 bp, Homo sapiens
agcaaaatagtatt

SEQ ID NO: 5836927 - DNA, 14 bp, Homo sapiens
agcaaaatatttgt

SEQ ID NO: 5836928 - DNA, 13 bp, Homo sapiens
agcaaaatcaaga

SEQ ID NO: 5836929 - DNA, 20 bp, Homo sapiens
agcaaaatcatggaatggtt

SEQ ID NO: 5836930 - DNA, 14 bp, Homo sapiens
agcaaaatcatttt

SEQ ID NO: 5836931 - DNA, 11 bp, Homo sapiens
agcaaaatcca

SEQ ID NO: 5836932 - DNA, 13 bp, Homo sapiens
agcaaaatccaaa

SEQ ID NO: 5836933 - DNA, 17 bp, Homo sapiens
agcaaaatccaaactgc

SEQ ID NO: 5836934 - DNA, 13 bp, Homo sapiens
agcaaaatccctt

SEQ ID NO: 5836935 - DNA, 22 bp, Homo sapiens
agcaaaatgaaaagagaaactt

SEQ ID NO: 5836936 - DNA, 20 bp, Homo sapiens
agcaaaatgcatgtaatcaa

SEQ ID NO: 5836937 - DNA, 14 bp, Homo sapiens
agcaaaatgtgaat

SEQ ID NO: 5836938 - DNA, 19 bp, Homo sapiens
agcaaaattataagaagag

SEQ ID NO: 5836939 - DNA, 13 bp, Homo sapiens
agcaaaattgatg

SEQ ID NO: 5836940 - DNA, 23 bp, Homo sapiens
agcaaaattttttctctaggaaa

SEQ ID NO: 5836941 - DNA, 24 bp, Homo sapiens
agcaaaattttttctctaggaaat

SEQ ID NO: 5836942 - DNA, 23 bp, Homo sapiens
agcaaacaaaaatagaatatata

SEQ ID NO: 5836943 - DNA, 19 bp, Homo sapiens
agcaaacaactttctggaa

SEQ ID NO: 5836944 - DNA, 21 bp, Homo sapiens
agcaaacaactttctggaaaa

SEQ ID NO: 5836945 - DNA, 16 bp, Homo sapiens
agcaaacaatggtgtc

SEQ ID NO: 5836946 - DNA, 15 bp, Homo sapiens
agcaaacacaataag

SEQ ID NO: 5836947 - DNA, 12 bp, Homo sapiens
agcaaacacaca

SEQ ID NO: 5836948 - DNA, 15 bp, Homo sapiens
agcaaacaccagtga

SEQ ID NO: 5836949 - DNA, 21 bp, Homo sapiens
agcaaacagatgtttgttttc

SEQ ID NO: 5836950 - DNA, 13 bp, Homo sapiens
agcaaacagctga

SEQ ID NO: 5836951 - DNA, 23 bp, Homo sapiens
agcaaacagctgaaagaggagga

SEQ ID NO: 5836952 - DNA, 21 bp, Homo sapiens
agcaaacagggtggcccaggt

SEQ ID NO: 5836953 - DNA, 16 bp, Homo sapiens
agcaaacatcaaataa

SEQ ID NO: 5836954 - DNA, 21 bp, Homo sapiens
agcaaacatcaaataaatttc

SEQ ID NO: 5836955 - DNA, 17 bp, Homo sapiens
agcaaaccaagagattg

SEQ ID NO: 5836956 - DNA, 22 bp, Homo sapiens
agcaaaccaagagattgctaat

SEQ ID NO: 5836957 - DNA, 17 bp, Homo sapiens
agcaaaccatttttaaa

SEQ ID NO: 5836958 - DNA, 17 bp, Homo sapiens
agcaaacccaaagatgt

SEQ ID NO: 5836959 - DNA, 13 bp, Homo sapiens
agcaaacccagac

SEQ ID NO: 5836960 - DNA, 18 bp, Homo sapiens
agcaaacccagaggtgga

SEQ ID NO: 5836961 - DNA, 20 bp, Homo sapiens
agcaaaccctgtcaaacatt

SEQ ID NO: 5836962 - DNA, 20 bp, Homo sapiens
agcaaacctaattgcacaac

SEQ ID NO: 5836963 - DNA, 20 bp, Homo sapiens
agcaaacgtctattttgtat

SEQ ID NO: 5836964 - DNA, 18 bp, Homo sapiens
agcaaactatttgcgact

SEQ ID NO: 5836965 - DNA, 14 bp, Homo sapiens
agcaaactccaggt

SEQ ID NO: 5836966 - DNA, 17 bp, Homo sapiens
agcaaactgaaattagt

SEQ ID NO: 5836967 - DNA, 21 bp, Homo sapiens
agcaaactgaaattagtgttt

SEQ ID NO: 5836968 - DNA, 15 bp, Homo sapiens
agcaaactgatgctg

SEQ ID NO: 5836969 - DNA, 18 bp, Homo sapiens
agcaaactgatgctgagg

SEQ ID NO: 5836970 - DNA, 20 bp, Homo sapiens
agcaaactgcatgcccagag

SEQ ID NO: 5836971 - DNA, 18 bp, Homo sapiens
agcaaacttataaatcat

SEQ ID NO: 5836972 - DNA, 13 bp, Homo sapiens
agcaaacttggaa

SEQ ID NO: 5836973 - DNA, 16 bp, Homo sapiens
agcaaactttagtgtc

SEQ ID NO: 5836974 - DNA, 17 bp, Homo sapiens
agcaaagacagtttctt

SEQ ID NO: 5836975 - DNA, 14 bp, Homo sapiens
agcaaagacttaat

SEQ ID NO: 5836976 - DNA, 17 bp, Homo sapiens
agcaaagagaatgtatt

SEQ ID NO: 5836977 - DNA, 18 bp, Homo sapiens
agcaaagaggactcgctt

SEQ ID NO: 5836978 - DNA, 12 bp, Homo sapiens
agcaaagagtgg

SEQ ID NO: 5836979 - DNA, 16 bp, Homo sapiens
agcaaagagtgggctg

SEQ ID NO: 5836980 - DNA, 22 bp, Homo sapiens
agcaaagagtgggctgcatctg

SEQ ID NO: 5836981 - DNA, 15 bp, Homo sapiens
agcaaagatatatat

SEQ ID NO: 5836982 - DNA, 17 bp, Homo sapiens
agcaaagatatatattc

SEQ ID NO: 5836983 - DNA, 14 bp, Homo sapiens
agcaaagatttcaa

SEQ ID NO: 5836984 - DNA, 16 bp, Homo sapiens
agcaaagatttcagta

SEQ ID NO: 5836985 - DNA, 17 bp, Homo sapiens
agcaaagatttcagtag

SEQ ID NO: 5836986 - DNA, 13 bp, Homo sapiens
agcaaagcacaga

SEQ ID NO: 5836987 - DNA, 20 bp, Homo sapiens
agcaaagcacccatttcaat

SEQ ID NO: 5836988 - DNA, 19 bp, Homo sapiens
agcaaagccacattttgca

SEQ ID NO: 5836989 - DNA, 12 bp, Homo sapiens
agcaaagccata

SEQ ID NO: 5836990 - DNA, 21 bp, Homo sapiens
agcaaagccccatgctggagc

SEQ ID NO: 5836991 - DNA, 15 bp, Homo sapiens
agcaaagcccccaga

SEQ ID NO: 5836992 - DNA, 21 bp, Homo sapiens
agcaaagcccccagagcccag

SEQ ID NO: 5836993 - DNA, 14 bp, Homo sapiens
agcaaagcctccag

SEQ ID NO: 5836994 - DNA, 18 bp, Homo sapiens
agcaaagcctccagcatc

SEQ ID NO: 5836995 - DNA, 12 bp, Homo sapiens
agcaaagcctgt

SEQ ID NO: 5836996 - DNA, 16 bp, Homo sapiens
agcaaagcgcccaccc

SEQ ID NO: 5836997 - DNA, 17 bp, Homo sapiens
agcaaagctacaggact

SEQ ID NO: 5836998 - DNA, 21 bp, Homo sapiens
agcaaagctgatgacaacttc

SEQ ID NO: 5836999 - DNA, 23 bp, Homo sapiens
agcaaagctgatgacaacttccc

SEQ ID NO: 5837000 - DNA, 14 bp, Homo sapiens
agcaaagcttggtg

SEQ ID NO: 5837001 - DNA, 16 bp, Homo sapiens
agcaaaggaaaccaaa

SEQ ID NO: 5837002 - DNA, 18 bp, Homo sapiens
agcaaaggaaaccaaagg

SEQ ID NO: 5837003 - DNA, 23 bp, Homo sapiens
agcaaaggagtagaaagacagag

SEQ ID NO: 5837004 - DNA, 22 bp, Homo sapiens
agcaaaggcaggaggtgggtga

SEQ ID NO: 5837005 - DNA, 13 bp, Homo sapiens
agcaaaggcccat

SEQ ID NO: 5837006 - DNA, 12 bp, Homo sapiens
agcaaaggctcc

SEQ ID NO: 5837007 - DNA, 15 bp, Homo sapiens
agcaaaggctccctc

SEQ ID NO: 5837008 - DNA, 13 bp, Homo sapiens
agcaaagggggga

SEQ ID NO: 5837009 - DNA, 15 bp, Homo sapiens
agcaaaggggggagg

SEQ ID NO: 5837010 - DNA, 22 bp, Homo sapiens
agcaaagggtctgtggccagtt

SEQ ID NO: 5837011 - DNA, 20 bp, Homo sapiens
agcaaagtagatcatgcata

SEQ ID NO: 5837012 - DNA, 24 bp, Homo sapiens
agcaaagtagtacttcttctgtaa

SEQ ID NO: 5837013 - DNA, 18 bp, Homo sapiens
agcaaagtattgtgaaag

SEQ ID NO: 5837014 - DNA, 22 bp, Homo sapiens
agcaaagtctaaagtttacagt

SEQ ID NO: 5837015 - DNA, 17 bp, Homo sapiens
agcaaagtgtcagtgtt

SEQ ID NO: 5837016 - DNA, 20 bp, Homo sapiens
agcaaagttatcttaaatat

SEQ ID NO: 5837017 - DNA, 21 bp, Homo sapiens
agcaaagttgggcagagaaat

SEQ ID NO: 5837018 - DNA, 19 bp, Homo sapiens
agcaaataaaacagtgaaa

SEQ ID NO: 5837019 - DNA, 19 bp, Homo sapiens
agcaaataaacttacagat

SEQ ID NO: 5837020 - DNA, 14 bp, Homo sapiens
agcaaataaatacg

SEQ ID NO: 5837021 - DNA, 21 bp, Homo sapiens
agcaaataagtcatctgatga

SEQ ID NO: 5837022 - DNA, 20 bp, Homo sapiens
agcaaatacaattcacagca

SEQ ID NO: 5837023 - DNA, 18 bp, Homo sapiens
agcaaataccaaagcagt

SEQ ID NO: 5837024 - DNA, 12 bp, Homo sapiens
agcaaatactta

SEQ ID NO: 5837025 - DNA, 20 bp, Homo sapiens
agcaaatagattaatgacgt

SEQ ID NO: 5837026 - DNA, 18 bp, Homo sapiens
agcaaatataaacagcaa

SEQ ID NO: 5837027 - DNA, 21 bp, Homo sapiens
agcaaatatcatactgttcaa

SEQ ID NO: 5837028 - DNA, 19 bp, Homo sapiens
agcaaatatctaaataatg

SEQ ID NO: 5837029 - DNA, 11 bp, Homo sapiens
agcaaatcacc

SEQ ID NO: 5837030 - DNA, 14 bp, Homo sapiens
agcaaatcagaaaa

SEQ ID NO: 5837031 - DNA, 22 bp, Homo sapiens
agcaaatcagacacaattagag

SEQ ID NO: 5837032 - DNA, 19 bp, Homo sapiens
agcaaatcatttgtttaaa

SEQ ID NO: 5837033 - DNA, 18 bp, Homo sapiens
agcaaatcccatttcttg

SEQ ID NO: 5837034 - DNA, 14 bp, Homo sapiens
agcaatttactgat

SEQ ID NO: 5837035 - DNA, 23 bp, Homo sapiens
agcaatttactgatgagagaatg

SEQ ID NO: 5837036 - DNA, 22 bp, Homo sapiens
agcaatttatatctttatgcaa

SEQ ID NO: 5837037 - DNA, 16 bp, Homo sapiens
agcaatttcccccctc

SEQ ID NO: 5837038 - DNA, 13 bp, Homo sapiens
agcaatttctaat

SEQ ID NO: 5837039 - DNA, 21 bp, Homo sapiens
agcaatttcttgctctatctc

SEQ ID NO: 5837040 - DNA, 14 bp, Homo sapiens
agcaatttgaaata

SEQ ID NO: 5837041 - DNA, 21 bp, Homo sapiens
agcaatttgaaataattttca

SEQ ID NO: 5837042 - DNA, 12 bp, Homo sapiens
agcaattttcct

SEQ ID NO: 5837043 - DNA, 14 bp, Homo sapiens
agcaattttccttg

SEQ ID NO: 5837044 - DNA, 15 bp, Homo sapiens
agcaattttccttga

SEQ ID NO: 5837045 - DNA, 19 bp, Homo sapiens
agcaattttccttgaagcc

SEQ ID NO: 5837046 - DNA, 21 bp, Homo sapiens
agcaattttccttgaagccga

SEQ ID NO: 5837047 - DNA, 14 bp, Homo sapiens
agcaattttcgaac

SEQ ID NO: 5837048 - DNA, 18 bp, Homo sapiens
agcacaaaagacaagcat

SEQ ID NO: 5837049 - DNA, 14 bp, Homo sapiens
agcacaaaaggcag

SEQ ID NO: 5837050 - DNA, 13 bp, Homo sapiens
agcacaaacacaa

SEQ ID NO: 5837051 - DNA, 16 bp, Homo sapiens
agcacaaacacaaggt

SEQ ID NO: 5837052 - DNA, 18 bp, Homo sapiens
agcacaaacacaaggtca

SEQ ID NO: 5837053 - DNA, 21 bp, Homo sapiens
agcacaaacacacctctgcca

SEQ ID NO: 5837054 - DNA, 16 bp, Homo sapiens
agcacaaacattgctg

SEQ ID NO: 5837055 - DNA, 22 bp, Homo sapiens
agcacaaacattgctgcctttg

SEQ ID NO: 5837056 - DNA, 14 bp, Homo sapiens
agcacaaaccctgg

SEQ ID NO: 5837057 - DNA, 12 bp, Homo sapiens
agcacaaactgt

SEQ ID NO: 5837058 - DNA, 16 bp, Homo sapiens
agcacaaacttctgta

SEQ ID NO: 5837059 - DNA, 13 bp, Homo sapiens
agcacaaagaaga

SEQ ID NO: 5837060 - DNA, 18 bp, Homo sapiens
agcacaaagaagaaagct

SEQ ID NO: 5837061 - DNA, 11 bp, Homo sapiens
agcacaaagat

SEQ ID NO: 5837062 - DNA, 22 bp, Homo sapiens
agcacaaagataacgcaggaga

SEQ ID NO: 5837063 - DNA, 13 bp, Homo sapiens
agcacaaattagt

SEQ ID NO: 5837064 - DNA, 14 bp, Homo sapiens
agcacaacataatt

SEQ ID NO: 5837065 - DNA, 10 bp, Homo sapiens
agcacaaccc

SEQ ID NO: 5837066 - DNA, 15 bp, Homo sapiens
agcacaacccaccac

SEQ ID NO: 5837067 - DNA, 18 bp, Homo sapiens
agcacaacccccagctcc

SEQ ID NO: 5837068 - DNA, 16 bp, Homo sapiens
agcacaactcagtctg

SEQ ID NO: 5837069 - DNA, 23 bp, Homo sapiens
agcacaactcagtctgtgggagc

SEQ ID NO: 5837070 - DNA, 19 bp, Homo sapiens
agcacaactttaagaggac

SEQ ID NO: 5837071 - DNA, 12 bp, Homo sapiens
agcacaagaagc

SEQ ID NO: 5837072 - DNA, 14 bp, Homo sapiens
agcacaagaaggcc

SEQ ID NO: 5837073 - DNA, 17 bp, Homo sapiens
agcacaagaaggccagc

SEQ ID NO: 5837074 - DNA, 18 bp, Homo sapiens
agcacaagaaggccagcc

SEQ ID NO: 5837075 - DNA, 23 bp, Homo sapiens
agcacaagaaggccagcccactg

SEQ ID NO: 5837076 - DNA, 24 bp, Homo sapiens
agcacaagaaggccagcccactgg

SEQ ID NO: 5837077 - DNA, 18 bp, Homo sapiens
agcacaagaagtgggagt

SEQ ID NO: 5837078 - DNA, 22 bp, Homo sapiens
agcacaagaagtgggagtggga

SEQ ID NO: 5837079 - DNA, 19 bp, Homo sapiens
agcacaagaggaagagaga

SEQ ID NO: 5837080 - DNA, 15 bp, Homo sapiens
agcacaagataaatt

SEQ ID NO: 5837081 - DNA, 16 bp, Homo sapiens
agcacaagataaattg

SEQ ID NO: 5837082 - DNA, 14 bp, Homo sapiens
agcacaagatgttg

SEQ ID NO: 5837083 - DNA, 23 bp, Homo sapiens
agcacaagcagagtgcacagctg

SEQ ID NO: 5837084 - DNA, 20 bp, Homo sapiens
agcacaatcactaaacttta

SEQ ID NO: 5837085 - DNA, 20 bp, Homo sapiens
agcacaatcctattactctt

SEQ ID NO: 5837086 - DNA, 14 bp, Homo sapiens
agcacaatctgttc

SEQ ID NO: 5837087 - DNA, 17 bp, Homo sapiens
agcacaatctgttctac

SEQ ID NO: 5837088 - DNA, 23 bp, Homo sapiens
agcacaatgtctcacatgggaca

SEQ ID NO: 5837089 - DNA, 21 bp, Homo sapiens
agcacaatgtggatttgggga

SEQ ID NO: 5837090 - DNA, 15 bp, Homo sapiens
agcacaattaattaa

SEQ ID NO: 5837091 - DNA, 17 bp, Homo sapiens
agcacaatttaaaacaa

SEQ ID NO: 5837092 - DNA, 14 bp, Homo sapiens
agcacacaacaggc

SEQ ID NO: 5837093 - DNA, 19 bp, Homo sapiens
agcacacacaataaagaac

SEQ ID NO: 5837094 - DNA, 15 bp, Homo sapiens
agcacacacacacag

SEQ ID NO: 5837095 - DNA, 17 bp, Homo sapiens
agcacacacatctggcc

SEQ ID NO: 5837096 - DNA, 19 bp, Homo sapiens
agcacacacatctggccct

SEQ ID NO: 5837097 - DNA, 17 bp, Homo sapiens
agcacacaggcagccag

SEQ ID NO: 5837098 - DNA, 14 bp, Homo sapiens
agcacacagggcag

SEQ ID NO: 5837099 - DNA, 14 bp, Homo sapiens
agcacacaggtaca

SEQ ID NO: 5837100 - DNA, 22 bp, Homo sapiens
agcacaccaatcttactttgta

SEQ ID NO: 5837101 - DNA, 17 bp, Homo sapiens
agcacaccacaattctc

SEQ ID NO: 5837102 - DNA, 17 bp, Homo sapiens
agcacaccattgcatga

SEQ ID NO: 5837103 - DNA, 15 bp, Homo sapiens
agcacaccccaaggg

SEQ ID NO: 5837104 - DNA, 13 bp, Homo sapiens
agcacacccgtgt

SEQ ID NO: 5837105 - DNA, 13 bp, Homo sapiens
agcacaccgggcc

SEQ ID NO: 5837106 - DNA, 17 bp, Homo sapiens
agcacaccgggccaagt

SEQ ID NO: 5837107 - DNA, 16 bp, Homo sapiens
agcacacctctggggg

SEQ ID NO: 5837108 - DNA, 15 bp, Homo sapiens
agcacacctgtgtcc

SEQ ID NO: 5837109 - DNA, 20 bp, Homo sapiens
agcacacgaaccctgccagg

SEQ ID NO: 5837110 - DNA, 14 bp, Homo sapiens
agcacacggccctg

SEQ ID NO: 5837111 - DNA, 15 bp, Homo sapiens
agcacacggccctgc

SEQ ID NO: 5837112 - DNA, 19 bp, Homo sapiens
agcacacggccctgcccca

SEQ ID NO: 5837113 - DNA, 24 bp, Homo sapiens
agcacacggccctgccccatcctg

SEQ ID NO: 5837114 - DNA, 14 bp, Homo sapiens
agcacacggtgagg

SEQ ID NO: 5837115 - DNA, 19 bp, Homo sapiens
agcacactgagtttgaaca

SEQ ID NO: 5837116 - DNA, 16 bp, Homo sapiens
agcacactgcagggct

SEQ ID NO: 5837117 - DNA, 19 bp, Homo sapiens
agcacactggctcacccag

SEQ ID NO: 5837118 - DNA, 20 bp, Homo sapiens
agcacactggctcacccagt

SEQ ID NO: 5837119 - DNA, 15 bp, Homo sapiens
agcacactgtatgtt

SEQ ID NO: 5837120 - DNA, 15 bp, Homo sapiens
agcacagaaaactag

SEQ ID NO: 5837121 - DNA, 16 bp, Homo sapiens
agcacagaaggaggag

SEQ ID NO: 5837122 - DNA, 18 bp, Homo sapiens
agcacagacaattctaat

SEQ ID NO: 5837123 - DNA, 15 bp, Homo sapiens
agcacagacattaaa

SEQ ID NO: 5837124 - DNA, 12 bp, Homo sapiens
agcacagaccct

SEQ ID NO: 5837125 - DNA, 15 bp, Homo sapiens
agcacagaccctgcc

SEQ ID NO: 5837126 - DNA, 11 bp, Homo sapiens
agcacagagag

SEQ ID NO: 5837127 - DNA, 22 bp, Homo sapiens
agcacagagagcggcttcccca

SEQ ID NO: 5837128 - DNA, 12 bp, Homo sapiens
agcacagagagg

SEQ ID NO: 5837129 - DNA, 23 bp, Homo sapiens
agcacagagagggggccacctcc

SEQ ID NO: 5837130 - DNA, 15 bp, Homo sapiens
agcacagagccctga

SEQ ID NO: 5837131 - DNA, 17 bp, Homo sapiens
agcacagagcctggccc

SEQ ID NO: 5837132 - DNA, 21 bp, Homo sapiens
agcacagagcctggccccagg

SEQ ID NO: 5837133 - DNA, 16 bp, Homo sapiens
agcacagagcgtcctt

SEQ ID NO: 5837134 - DNA, 12 bp, Homo sapiens
agcacagaggcc

SEQ ID NO: 5837135 - DNA, 18 bp, Homo sapiens
agcacagaggcctgactg

SEQ ID NO: 5837136 - DNA, 17 bp, Homo sapiens
agcacagataaaaagtg

SEQ ID NO: 5837137 - DNA, 20 bp, Homo sapiens
agcacagataaaaagtggaa

SEQ ID NO: 5837138 - DNA, 21 bp, Homo sapiens
agcacagataaaaagtggaat

SEQ ID NO: 5837139 - DNA, 15 bp, Homo sapiens
agcacagatggccag

SEQ ID NO: 5837140 - DNA, 16 bp, Homo sapiens
agcacagatggccagc

SEQ ID NO: 5837141 - DNA, 21 bp, Homo sapiens
agcacagattttaattgtcat

SEQ ID NO: 5837142 - DNA, 17 bp, Homo sapiens
agcacagattttgaatc

SEQ ID NO: 5837143 - DNA, 19 bp, Homo sapiens
agcacagcaaggaggctgg

SEQ ID NO: 5837144 - DNA, 22 bp, Homo sapiens
agcacagcaaggaggctggctg

SEQ ID NO: 5837145 - DNA, 13 bp, Homo sapiens
agcacagcagctt

SEQ ID NO: 5837146 - DNA, 23 bp, Homo sapiens
agcacagccaacacgcacctgcc

SEQ ID NO: 5837147 - DNA, 23 bp, Homo sapiens
agcacagccagacttgcttcctg

SEQ ID NO: 5837148 - DNA, 23 bp, Homo sapiens
agcacagcccacggggatcacag

SEQ ID NO: 5837149 - DNA, 12 bp, Homo sapiens
agcacagcccag

SEQ ID NO: 5837150 - DNA, 14 bp, Homo sapiens
agcacagcccaggg

SEQ ID NO: 5837151 - DNA, 16 bp, Homo sapiens
agcacagcccagggcc

SEQ ID NO: 5837152 - DNA, 14 bp, Homo sapiens
agcacagccctccc

SEQ ID NO: 5837153 - DNA, 16 bp, Homo sapiens
agcacagccctcccgc

SEQ ID NO: 5837154 - DNA, 22 bp, Homo sapiens
agcacagccctcccgccccttc

SEQ ID NO: 5837155 - DNA, 15 bp, Homo sapiens
agcacagccctggga

SEQ ID NO: 5837156 - DNA, 18 bp, Homo sapiens
agcacagcctcacccctg

SEQ ID NO: 5837157 - DNA, 21 bp, Homo sapiens
agcacagcctcacccctgcag

SEQ ID NO: 5837158 - DNA, 12 bp, Homo sapiens
agcacagctccc

SEQ ID NO: 5837159 - DNA, 17 bp, Homo sapiens
agcacagctccctgcca

SEQ ID NO: 5837160 - DNA, 16 bp, Homo sapiens
agcacagctcccttct

SEQ ID NO: 5837161 - DNA, 15 bp, Homo sapiens
agcacagctcctccc

SEQ ID NO: 5837162 - DNA, 16 bp, Homo sapiens
agcacagctcctcccc

SEQ ID NO: 5837163 - DNA, 16 bp, Homo sapiens
agcacagctcctgcca

SEQ ID NO: 5837164 - DNA, 17 bp, Homo sapiens
agcacagctcctgccag

SEQ ID NO: 5837165 - DNA, 11 bp, Homo sapiens
agcacagctct

SEQ ID NO: 5837166 - DNA, 15 bp, Homo sapiens
agcacagctctcctc

SEQ ID NO: 5837167 - DNA, 17 bp, Homo sapiens
agcacagctgggcatgc

SEQ ID NO: 5837168 - DNA, 18 bp, Homo sapiens
agcacagcttagatttca

SEQ ID NO: 5837169 - DNA, 14 bp, Homo sapiens
agcacagcttcttc

SEQ ID NO: 5837170 - DNA, 13 bp, Homo sapiens
agcacaggagaca

SEQ ID NO: 5837171 - DNA, 16 bp, Homo sapiens
agcacaggcagcccca

SEQ ID NO: 5837172 - DNA, 15 bp, Homo sapiens
agcacaggcagctgg

SEQ ID NO: 5837173 - DNA, 13 bp, Homo sapiens
agcacagggcagg

SEQ ID NO: 5837174 - DNA, 21 bp, Homo sapiens
agcacaggtccaaggctggtc

SEQ ID NO: 5837175 - DNA, 23 bp, Homo sapiens
agcacaggtcccacctccagccc

SEQ ID NO: 5837176 - DNA, 17 bp, Homo sapiens
agcacaggtgtctgcct

SEQ ID NO: 5837177 - DNA, 17 bp, Homo sapiens
agcacaggttagggcat

SEQ ID NO: 5837178 - DNA, 19 bp, Homo sapiens
agcacaggttccagtactg

SEQ ID NO: 5837179 - DNA, 20 bp, Homo sapiens
agcacagtaggtcccggcca

SEQ ID NO: 5837180 - DNA, 19 bp, Homo sapiens
agcacagtatttaacattc

SEQ ID NO: 5837181 - DNA, 18 bp, Homo sapiens
agcacagtatttactgtg

SEQ ID NO: 5837182 - DNA, 15 bp, Homo sapiens
agcacagtcaggggc

SEQ ID NO: 5837183 - DNA, 16 bp, Homo sapiens
agcacagtcaggggct

SEQ ID NO: 5837184 - DNA, 15 bp, Homo sapiens
agcacagtgcctgca

SEQ ID NO: 5837185 - DNA, 23 bp, Homo sapiens
agcacagtggtggcagggcctag

SEQ ID NO: 5837186 - DNA, 16 bp, Homo sapiens
agcacagtgttaaatg

SEQ ID NO: 5837187 - DNA, 14 bp, Homo sapiens
agcacagtttgaac

SEQ ID NO: 5837188 - DNA, 14 bp, Homo sapiens
agcacagttttaag

SEQ ID NO: 5837189 - DNA, 21 bp, Homo sapiens
agcacataactggattttgaa

SEQ ID NO: 5837190 - DNA, 11 bp, Homo sapiens
agcacatacat

SEQ ID NO: 5837191 - DNA, 17 bp, Homo sapiens
agcacatactacctaga

SEQ ID NO: 5837192 - DNA, 18 bp, Homo sapiens
agcacatactacctagaa

SEQ ID NO: 5837193 - DNA, 22 bp, Homo sapiens
agcacatactacctagaagtaa

SEQ ID NO: 5837194 - DNA, 18 bp, Homo sapiens
agcacatagagcttttta

SEQ ID NO: 5837195 - DNA, 19 bp, Homo sapiens
agcacatagccctgttgac

SEQ ID NO: 5837196 - DNA, 16 bp, Homo sapiens
agcacatagcttgcct

SEQ ID NO: 5837197 - DNA, 20 bp, Homo sapiens
agcacatagtgtcctgccca

SEQ ID NO: 5837198 - DNA, 14 bp, Homo sapiens
agcacatcacctct

SEQ ID NO: 5837199 - DNA, 18 bp, Homo sapiens
agcacatcacctctttgc

SEQ ID NO: 5837200 - DNA, 15 bp, Homo sapiens
agcacatcactgaga

SEQ ID NO: 5837201 - DNA, 21 bp, Homo sapiens
agcacatcatggcagtgggac

SEQ ID NO: 5837202 - DNA, 11 bp, Homo sapiens
agcacatccac

SEQ ID NO: 5837203 - DNA, 22 bp, Homo sapiens
agcacatccaccaaactcctgc

SEQ ID NO: 5837204 - DNA, 22 bp, Homo sapiens
agcacatccaggcaatggccta

SEQ ID NO: 5837205 - DNA, 16 bp, Homo sapiens
agcacatctcaacagg

SEQ ID NO: 5837206 - DNA, 15 bp, Homo sapiens
agcacatctcttcat

SEQ ID NO: 5837207 - DNA, 15 bp, Homo sapiens
agcacatctgcattt

SEQ ID NO: 5837208 - DNA, 16 bp, Homo sapiens
agcacatctgcatttt

SEQ ID NO: 5837209 - DNA, 23 bp, Homo sapiens
agcacatctgcattttcacccca

SEQ ID NO: 5837210 - DNA, 11 bp, Homo sapiens
agcacatgatt

SEQ ID NO: 5837211 - DNA, 19 bp, Homo sapiens
agcacatgcactactgaaa

SEQ ID NO: 5837212 - DNA, 20 bp, Homo sapiens
agcacatgccagggaaaaag

SEQ ID NO: 5837213 - DNA, 21 bp, Homo sapiens
agcagaaaagtgcttagaaag

SEQ ID NO: 5837214 - DNA, 19 bp, Homo sapiens
agcagaaaatacagctgga

SEQ ID NO: 5837215 - DNA, 19 bp, Homo sapiens
agcagaaaatataaatggt

SEQ ID NO: 5837216 - DNA, 23 bp, Homo sapiens
agcagaaaatataaatggtaagc

SEQ ID NO: 5837217 - DNA, 15 bp, Homo sapiens
agcagaaacaaaatg

SEQ ID NO: 5837218 - DNA, 11 bp, Homo sapiens
agcagaaacag

SEQ ID NO: 5837219 - DNA, 18 bp, Homo sapiens
agcagaaaccaacaagaa

SEQ ID NO: 5837220 - DNA, 22 bp, Homo sapiens
agcagaaaccaacaagaaccac

SEQ ID NO: 5837221 - DNA, 18 bp, Homo sapiens
agcagaaacccatgtgca

SEQ ID NO: 5837222 - DNA, 21 bp, Homo sapiens
agcagaaacccccaggaggag

SEQ ID NO: 5837223 - DNA, 18 bp, Homo sapiens
agcagaaagaagagaagt

SEQ ID NO: 5837224 - DNA, 15 bp, Homo sapiens
agcagaaagattaaa

SEQ ID NO: 5837225 - DNA, 18 bp, Homo sapiens
agcagaaagctgtgaaca

SEQ ID NO: 5837226 - DNA, 22 bp, Homo sapiens
agcagaaaggaaaagattcctg

SEQ ID NO: 5837227 - DNA, 18 bp, Homo sapiens
agcagaaaggcacgtcca

SEQ ID NO: 5837228 - DNA, 18 bp, Homo sapiens
agcagaaagtgcctttca

SEQ ID NO: 5837229 - DNA, 11 bp, Homo sapiens
agcagaaataa

SEQ ID NO: 5837230 - DNA, 13 bp, Homo sapiens
agcagaaatacat

SEQ ID NO: 5837231 - DNA, 23 bp, Homo sapiens
agcagaaatatattatgaaaatt

SEQ ID NO: 5837232 - DNA, 11 bp, Homo sapiens
agcagaaatgc

SEQ ID NO: 5837233 - DNA, 21 bp, Homo sapiens
agcagaaattctgtttttaaa

SEQ ID NO: 5837234 - DNA, 14 bp, Homo sapiens
agcagaacaaatgt

SEQ ID NO: 5837235 - DNA, 15 bp, Homo sapiens
agcagaacaaatgtg

SEQ ID NO: 5837236 - DNA, 17 bp, Homo sapiens
agcagaacagccatttt

SEQ ID NO: 5837237 - DNA, 16 bp, Homo sapiens
agcagaacatactgtt

SEQ ID NO: 5837238 - DNA, 15 bp, Homo sapiens
agcagaacctgcaca

SEQ ID NO: 5837239 - DNA, 16 bp, Homo sapiens
agcagaaccttaaaca

SEQ ID NO: 5837240 - DNA, 18 bp, Homo sapiens
agcagaactgaagccact

SEQ ID NO: 5837241 - DNA, 17 bp, Homo sapiens
agcagaagaccagatcc

SEQ ID NO: 5837242 - DNA, 19 bp, Homo sapiens
agcagaagccccacagcct

SEQ ID NO: 5837243 - DNA, 13 bp, Homo sapiens
agcagaagcctcc

SEQ ID NO: 5837244 - DNA, 23 bp, Homo sapiens
agcagaagcctccaagcacagag

SEQ ID NO: 5837245 - DNA, 14 bp, Homo sapiens
agcagaagctctcg

SEQ ID NO: 5837246 - DNA, 13 bp, Homo sapiens
agcagaaggaagg

SEQ ID NO: 5837247 - DNA, 22 bp, Homo sapiens
agcagaaggaaggatgccactt

SEQ ID NO: 5837248 - DNA, 17 bp, Homo sapiens
agcagaaggggagatgg

SEQ ID NO: 5837249 - DNA, 23 bp, Homo sapiens
agcagaaggggagatggacgaca

SEQ ID NO: 5837250 - DNA, 12 bp, Homo sapiens
agcagaaggggg

SEQ ID NO: 5837251 - DNA, 15 bp, Homo sapiens
agcagaagtgaccaa

SEQ ID NO: 5837252 - DNA, 13 bp, Homo sapiens
agcagaataaagc

SEQ ID NO: 5837253 - DNA, 14 bp, Homo sapiens
agcagaataaagca

SEQ ID NO: 5837254 - DNA, 21 bp, Homo sapiens
agcagaataaagcaattttcc

SEQ ID NO: 5837255 - DNA, 23 bp, Homo sapiens
agcagaataaatgttttacaact

SEQ ID NO: 5837256 - DNA, 22 bp, Homo sapiens
agcagaatacaatgggaaaaga

SEQ ID NO: 5837257 - DNA, 19 bp, Homo sapiens
agcagaatagcaaggtgct

SEQ ID NO: 5837258 - DNA, 23 bp, Homo sapiens
agcagaatcctcagttggaatca

SEQ ID NO: 5837259 - DNA, 22 bp, Homo sapiens
agcagaatctgttgagttgctg

SEQ ID NO: 5837260 - DNA, 13 bp, Homo sapiens
agcagaatgaaga

SEQ ID NO: 5837261 - DNA, 16 bp, Homo sapiens
agcagaatgactctgg

SEQ ID NO: 5837262 - DNA, 15 bp, Homo sapiens
agcagaatggagaaa

SEQ ID NO: 5837263 - DNA, 18 bp, Homo sapiens
agcagaatggagaaagta

SEQ ID NO: 5837264 - DNA, 17 bp, Homo sapiens
agcagaatggaggcagg

SEQ ID NO: 5837265 - DNA, 15 bp, Homo sapiens
agcagaattcattca

SEQ ID NO: 5837266 - DNA, 16 bp, Homo sapiens
agcagaattcattcat

SEQ ID NO: 5837267 - DNA, 23 bp, Homo sapiens
agcagaattgacagttgaacaga

SEQ ID NO: 5837268 - DNA, 13 bp, Homo sapiens
agcagaattggaa

SEQ ID NO: 5837269 - DNA, 17 bp, Homo sapiens
agcagaattttaatgtg

SEQ ID NO: 5837270 - DNA, 14 bp, Homo sapiens
agcagacacacaca

SEQ ID NO: 5837271 - DNA, 15 bp, Homo sapiens
agcagacacacatgg

SEQ ID NO: 5837272 - DNA, 21 bp, Homo sapiens
agcagacacacatgggcagcc

SEQ ID NO: 5837273 - DNA, 23 bp, Homo sapiens
agcagacacacatgggcagccca

SEQ ID NO: 5837274 - DNA, 14 bp, Homo sapiens
agcagacactccag

SEQ ID NO: 5837275 - DNA, 13 bp, Homo sapiens
agcagacagagaa

SEQ ID NO: 5837276 - DNA, 14 bp, Homo sapiens
agcagacagagaaa

SEQ ID NO: 5837277 - DNA, 16 bp, Homo sapiens
agcagacagagaaatg

SEQ ID NO: 5837278 - DNA, 15 bp, Homo sapiens
agcagacagccctgg

SEQ ID NO: 5837279 - DNA, 13 bp, Homo sapiens
agcagacattgtc

SEQ ID NO: 5837280 - DNA, 22 bp, Homo sapiens
agcagaccattggggctcccag

SEQ ID NO: 5837281 - DNA, 17 bp, Homo sapiens
agcagacccagcttaga

SEQ ID NO: 5837282 - DNA, 20 bp, Homo sapiens
agcagacctaaagcaagcct

SEQ ID NO: 5837283 - DNA, 22 bp, Homo sapiens
agcagacctaaagcaagcctga

SEQ ID NO: 5837284 - DNA, 16 bp, Homo sapiens
agcagacgcagcagct

SEQ ID NO: 5837285 - DNA, 20 bp, Homo sapiens
agcagacgtccatagctcct

SEQ ID NO: 5837286 - DNA, 16 bp, Homo sapiens
agcagactcagctgct

SEQ ID NO: 5837287 - DNA, 20 bp, Homo sapiens
agcagactccagcccctgga

SEQ ID NO: 5837288 - DNA, 21 bp, Homo sapiens
agcagactccagcccctggac

SEQ ID NO: 5837289 - DNA, 23 bp, Homo sapiens
agcagactcctgctctctatcca

SEQ ID NO: 5837290 - DNA, 18 bp, Homo sapiens
agcagactgatcaggacc

SEQ ID NO: 5837291 - DNA, 19 bp, Homo sapiens
agcagactgatcaggacct

SEQ ID NO: 5837292 - DNA, 19 bp, Homo sapiens
agcagactggtgagcagac

SEQ ID NO: 5837293 - DNA, 16 bp, Homo sapiens
agcagactgtgtttcg

SEQ ID NO: 5837294 - DNA, 23 bp, Homo sapiens
agcagactgttctaaaatataat

SEQ ID NO: 5837295 - DNA, 18 bp, Homo sapiens
agcagactttctctgtgt

SEQ ID NO: 5837296 - DNA, 21 bp, Homo sapiens
agcagagaattctcttatcca

SEQ ID NO: 5837297 - DNA, 16 bp, Homo sapiens
agcagagaccatccct

SEQ ID NO: 5837298 - DNA, 20 bp, Homo sapiens
agcagagaccatccctgaag

SEQ ID NO: 5837299 - DNA, 22 bp, Homo sapiens
agcagagagagagagagagaaa

SEQ ID NO: 5837300 - DNA, 23 bp, Homo sapiens
agcagagagcaaaggagaaatct

SEQ ID NO: 5837301 - DNA, 13 bp, Homo sapiens
agcagagagccaa

SEQ ID NO: 5837302 - DNA, 16 bp, Homo sapiens
agcagagagccaaatc

SEQ ID NO: 5837303 - DNA, 17 bp, Homo sapiens
agcagagagccaaatct

SEQ ID NO: 5837304 - DNA, 13 bp, Homo sapiens
agcagagagccct

SEQ ID NO: 5837305 - DNA, 14 bp, Homo sapiens
agcagagaggtggc

SEQ ID NO: 5837306 - DNA, 23 bp, Homo sapiens
agcagagaggtttcgatatttat

SEQ ID NO: 5837307 - DNA, 15 bp, Homo sapiens
agcagagatgtactg

SEQ ID NO: 5837308 - DNA, 18 bp, Homo sapiens
agcagagcaaaatgctct

SEQ ID NO: 5837309 - DNA, 17 bp, Homo sapiens
agcagagcaagtctgca

SEQ ID NO: 5837310 - DNA, 20 bp, Homo sapiens
agcagagcaagtctgcaggt

SEQ ID NO: 5837311 - DNA, 14 bp, Homo sapiens
agcagagcatgttg

SEQ ID NO: 5837312 - DNA, 16 bp, Homo sapiens
agcagagcatgttgga

SEQ ID NO: 5837313 - DNA, 14 bp, Homo sapiens
agcagagcattgtc

SEQ ID NO: 5837314 - DNA, 18 bp, Homo sapiens
agcagagccaaggccacc

SEQ ID NO: 5837315 - DNA, 16 bp, Homo sapiens
agcagagccagggcag

SEQ ID NO: 5837316 - DNA, 21 bp, Homo sapiens
agcagagcccggagctccggc

SEQ ID NO: 5837317 - DNA, 15 bp, Homo sapiens
agcagagccgttcct

SEQ ID NO: 5837318 - DNA, 18 bp, Homo sapiens
agcagagccgttcctggg

SEQ ID NO: 5837319 - DNA, 11 bp, Homo sapiens
agcagagccta

SEQ ID NO: 5837320 - DNA, 17 bp, Homo sapiens
agcagagcctcctggga

SEQ ID NO: 5837321 - DNA, 13 bp, Homo sapiens
agcagagcctggg

SEQ ID NO: 5837322 - DNA, 14 bp, Homo sapiens
agcagagcctgggg

SEQ ID NO: 5837323 - DNA, 20 bp, Homo sapiens
agcagagcctggggtgggtg

SEQ ID NO: 5837324 - DNA, 19 bp, Homo sapiens
agcagagcgcagcccccac

SEQ ID NO: 5837325 - DNA, 12 bp, Homo sapiens
agcagagcggga

SEQ ID NO: 5837326 - DNA, 15 bp, Homo sapiens
agcagaggaaggaaa

SEQ ID NO: 5837327 - DNA, 16 bp, Homo sapiens
agcagaggaaggaaac

SEQ ID NO: 5837328 - DNA, 22 bp, Homo sapiens
agcagaggaaggaaacatagaa

SEQ ID NO: 5837329 - DNA, 14 bp, Homo sapiens
agcagaggaccagg

SEQ ID NO: 5837330 - DNA, 16 bp, Homo sapiens
agcagaggaccagggc

SEQ ID NO: 5837331 - DNA, 13 bp, Homo sapiens
agcagaggagctg

SEQ ID NO: 5837332 - DNA, 12 bp, Homo sapiens
agcagaggaggg

SEQ ID NO: 5837333 - DNA, 13 bp, Homo sapiens
agcagaggcagtg

SEQ ID NO: 5837334 - DNA, 16 bp, Homo sapiens
agcagaggccctgccc

SEQ ID NO: 5837335 - DNA, 21 bp, Homo sapiens
agcagaggccctgcccccacc

SEQ ID NO: 5837336 - DNA, 17 bp, Homo sapiens
agcagaggctggcctca

SEQ ID NO: 5837337 - DNA, 18 bp, Homo sapiens
agcagagggactttgtat

SEQ ID NO: 5837338 - DNA, 13 bp, Homo sapiens
agcagagggagga

SEQ ID NO: 5837339 - DNA, 20 bp, Homo sapiens
agcagaggggcagaggccca

SEQ ID NO: 5837340 - DNA, 17 bp, Homo sapiens
agcagaggggccaggcc

SEQ ID NO: 5837341 - DNA, 19 bp, Homo sapiens
agcagaggggccaggccca

SEQ ID NO: 5837342 - DNA, 22 bp, Homo sapiens
agcagaggggccaggcccaggc

SEQ ID NO: 5837343 - DNA, 23 bp, Homo sapiens
agcagaggggccaggcccaggca

SEQ ID NO: 5837344 - DNA, 15 bp, Homo sapiens
agcagaggtggaaaa

SEQ ID NO: 5837345 - DNA, 17 bp, Homo sapiens
agcagagtataggatgg

SEQ ID NO: 5837346 - DNA, 19 bp, Homo sapiens
agcagagtctgggcctctg

SEQ ID NO: 5837347 - DNA, 19 bp, Homo sapiens
agcagagtgaaattcaatt

SEQ ID NO: 5837348 - DNA, 21 bp, Homo sapiens
agcagagtgagcaagggggcc

SEQ ID NO: 5837349 - DNA, 14 bp, Homo sapiens
agcagagtgaggat

SEQ ID NO: 5837350 - DNA, 18 bp, Homo sapiens
agcagagtgaggatgtgt

SEQ ID NO: 5837351 - DNA, 20 bp, Homo sapiens
agcagagtgaggatgtgttt

SEQ ID NO: 5837352 - DNA, 17 bp, Homo sapiens
agcagagtgattcaggg

SEQ ID NO: 5837353 - DNA, 15 bp, Homo sapiens
agcagagtggactgc

SEQ ID NO: 5837354 - DNA, 16 bp, Homo sapiens
agcagagtggactgca

SEQ ID NO: 5837355 - DNA, 16 bp, Homo sapiens
agcagagttctttgca

SEQ ID NO: 5837356 - DNA, 15 bp, Homo sapiens
agcagagttttcatt

SEQ ID NO: 5837357 - DNA, 23 bp, Homo sapiens
agcagagttttcattaaatcctt

SEQ ID NO: 5837358 - DNA, 14 bp, Homo sapiens
agcagataactttt

SEQ ID NO: 5837359 - DNA, 20 bp, Homo sapiens
agcagataaggccgagccca

SEQ ID NO: 5837360 - DNA, 22 bp, Homo sapiens
agcagataaggccgagcccaca

SEQ ID NO: 5837361 - DNA, 15 bp, Homo sapiens
agcagatatgtatta

SEQ ID NO: 5837362 - DNA, 16 bp, Homo sapiens
agcagatccacctgca

SEQ ID NO: 5837363 - DNA, 17 bp, Homo sapiens
agcagatccacctgcac

SEQ ID NO: 5837364 - DNA, 18 bp, Homo sapiens
agcagatccacctgcaca

SEQ ID NO: 5837365 - DNA, 22 bp, Homo sapiens
agcagatccacctgcacaaaca

SEQ ID NO: 5837366 - DNA, 18 bp, Homo sapiens
agcagatcgtgccgtgga

SEQ ID NO: 5837367 - DNA, 22 bp, Homo sapiens
agcagatcgtgccgtggagctt

SEQ ID NO: 5837368 - DNA, 17 bp, Homo sapiens
agcagatgacccctccc

SEQ ID NO: 5837369 - DNA, 15 bp, Homo sapiens
agcagatgactgaga

SEQ ID NO: 5837370 - DNA, 19 bp, Homo sapiens
agcagatgcaaagaggcaa

SEQ ID NO: 5837371 - DNA, 13 bp, Homo sapiens
agcagatgcagag

SEQ ID NO: 5837372 - DNA, 18 bp, Homo sapiens
agcagatgcagagagcca

SEQ ID NO: 5837373 - DNA, 16 bp, Homo sapiens
agcagatgccagtgaa

SEQ ID NO: 5837374 - DNA, 21 bp, Homo sapiens
agcagatgctgttgtgaagct

SEQ ID NO: 5837375 - DNA, 22 bp, Homo sapiens
agcagatgctgttgtgaagcta

SEQ ID NO: 5837376 - DNA, 15 bp, Homo sapiens
agcagatggaaagaa

SEQ ID NO: 5837377 - DNA, 21 bp, Homo sapiens
agcagatggaatgctgtgtta

SEQ ID NO: 5837378 - DNA, 18 bp, Homo sapiens
agcagatggtcctccatt

SEQ ID NO: 5837379 - DNA, 17 bp, Homo sapiens
agcagatgttgaagaca

SEQ ID NO: 5837380 - DNA, 20 bp, Homo sapiens
agcagattacctcttgccct

SEQ ID NO: 5837381 - DNA, 13 bp, Homo sapiens
agcagattccaca

SEQ ID NO: 5837382 - DNA, 17 bp, Homo sapiens
agcagattggaaggaga

SEQ ID NO: 5837383 - DNA, 22 bp, Homo sapiens
agcagattttaattttgaataa

SEQ ID NO: 5837384 - DNA, 16 bp, Homo sapiens
agcagattttcctaag

SEQ ID NO: 5837385 - DNA, 22 bp, Homo sapiens
agcagattttcctaaggccact

SEQ ID NO: 5837386 - DNA, 20 bp, Homo sapiens
agcagcaaaaatataaaata

SEQ ID NO: 5837387 - DNA, 22 bp, Homo sapiens
agcagcaaaatccttacttcca

SEQ ID NO: 5837388 - DNA, 12 bp, Homo sapiens
agcagcaaatag

SEQ ID NO: 5837389 - DNA, 14 bp, Homo sapiens
agcagcaaatagca

SEQ ID NO: 5837390 - DNA, 22 bp, Homo sapiens
agcagggattaacctctgcact

SEQ ID NO: 5837391 - DNA, 15 bp, Homo sapiens
agcagggcaggcccc

SEQ ID NO: 5837392 - DNA, 16 bp, Homo sapiens
agcagggcaggccccc

SEQ ID NO: 5837393 - DNA, 19 bp, Homo sapiens
agcagggcatggctgggaa

SEQ ID NO: 5837394 - DNA, 16 bp, Homo sapiens
agcagggccctcagag

SEQ ID NO: 5837395 - DNA, 23 bp, Homo sapiens
agcagggcggctgccgactcccc

SEQ ID NO: 5837396 - DNA, 18 bp, Homo sapiens
agcagggcgggccaggag

SEQ ID NO: 5837397 - DNA, 15 bp, Homo sapiens
agcagggctcagcgg

SEQ ID NO: 5837398 - DNA, 16 bp, Homo sapiens
agcagggctgctgtga

SEQ ID NO: 5837399 - DNA, 13 bp, Homo sapiens
agcagggctgggc

SEQ ID NO: 5837400 - DNA, 15 bp, Homo sapiens
agcagggctgggcct

SEQ ID NO: 5837401 - DNA, 23 bp, Homo sapiens
agcagggctggtcacctcccatc

SEQ ID NO: 5837402 - DNA, 21 bp, Homo sapiens
agcaggggaagcaggacccag

SEQ ID NO: 5837403 - DNA, 15 bp, Homo sapiens
agcaggggagcttgg

SEQ ID NO: 5837404 - DNA, 17 bp, Homo sapiens
agcaggggagcttggga

SEQ ID NO: 5837405 - DNA, 22 bp, Homo sapiens
agcaggggagcttgggactcag

SEQ ID NO: 5837406 - DNA, 18 bp, Homo sapiens
agcaggggcaggcgcaga

SEQ ID NO: 5837407 - DNA, 17 bp, Homo sapiens
agcaggggccagatgat

SEQ ID NO: 5837408 - DNA, 19 bp, Homo sapiens
agcaggggcccctggggac

SEQ ID NO: 5837409 - DNA, 16 bp, Homo sapiens
agcaggggcgtggagg

SEQ ID NO: 5837410 - DNA, 16 bp, Homo sapiens
agcaggggctacaaga

SEQ ID NO: 5837411 - DNA, 21 bp, Homo sapiens
agcaggggctacaagagggaa

SEQ ID NO: 5837412 - DNA, 15 bp, Homo sapiens
agcaggggctccagc

SEQ ID NO: 5837413 - DNA, 16 bp, Homo sapiens
agcaggggctccagca

SEQ ID NO: 5837414 - DNA, 14 bp, Homo sapiens
agcaggggctgccc

SEQ ID NO: 5837415 - DNA, 16 bp, Homo sapiens
agcaggggctgctggg

SEQ ID NO: 5837416 - DNA, 18 bp, Homo sapiens
agcaggggctgctggggg

SEQ ID NO: 5837417 - DNA, 21 bp, Homo sapiens
agcagggggacctaggctcct

SEQ ID NO: 5837418 - DNA, 23 bp, Homo sapiens
agcagggggagaaacccttcaca

SEQ ID NO: 5837419 - DNA, 19 bp, Homo sapiens
agcaggggggctgtgccaa

SEQ ID NO: 5837420 - DNA, 22 bp, Homo sapiens
agcagggggggaaatgcattta

SEQ ID NO: 5837421 - DNA, 22 bp, Homo sapiens
agcaggggggttgggttccaga

SEQ ID NO: 5837422 - DNA, 22 bp, Homo sapiens
agcaggggtccttggtgtgacc

SEQ ID NO: 5837423 - DNA, 15 bp, Homo sapiens
agcaggggtctgagc

SEQ ID NO: 5837424 - DNA, 17 bp, Homo sapiens
agcagggtctgggcagg

SEQ ID NO: 5837425 - DNA, 18 bp, Homo sapiens
agcagggtcttttcatct

SEQ ID NO: 5837426 - DNA, 17 bp, Homo sapiens
agcagggtggggtctgg

SEQ ID NO: 5837427 - DNA, 18 bp, Homo sapiens
agcagggtggggtctggg

SEQ ID NO: 5837428 - DNA, 20 bp, Homo sapiens
agcagggtggggtctgggag

SEQ ID NO: 5837429 - DNA, 23 bp, Homo sapiens
agcagggtggggtctgggagggg

SEQ ID NO: 5837430 - DNA, 17 bp, Homo sapiens
agcaggtagaagaaaag

SEQ ID NO: 5837431 - DNA, 12 bp, Homo sapiens
agcaggtctctg

SEQ ID NO: 5837432 - DNA, 16 bp, Homo sapiens
agcaggtctctggcag

SEQ ID NO: 5837433 - DNA, 19 bp, Homo sapiens
agcaggtctctggcagaga

SEQ ID NO: 5837434 - DNA, 17 bp, Homo sapiens
agcaggtctgcaggcca

SEQ ID NO: 5837435 - DNA, 19 bp, Homo sapiens
agcaggtgcaagagacaga

SEQ ID NO: 5837436 - DNA, 21 bp, Homo sapiens
agcaggtgcaagagacagagc

SEQ ID NO: 5837437 - DNA, 16 bp, Homo sapiens
agcaggtgcccccagg

SEQ ID NO: 5837438 - DNA, 17 bp, Homo sapiens
agcaggtgcccccaggt

SEQ ID NO: 5837439 - DNA, 22 bp, Homo sapiens
agcaggtgcctggtgggccacg

SEQ ID NO: 5837440 - DNA, 16 bp, Homo sapiens
agcaggtgctgctacc

SEQ ID NO: 5837441 - DNA, 20 bp, Homo sapiens
agcaggtgctgggctggact

SEQ ID NO: 5837442 - DNA, 16 bp, Homo sapiens
agcaggtggcatctct

SEQ ID NO: 5837443 - DNA, 13 bp, Homo sapiens
agcaggtggtcct

SEQ ID NO: 5837444 - DNA, 17 bp, Homo sapiens
agcaggtggtcctgaga

SEQ ID NO: 5837445 - DNA, 18 bp, Homo sapiens
agcaggtggtcctgagac

SEQ ID NO: 5837446 - DNA, 21 bp, Homo sapiens
agcaggtggtcctgagacctg

SEQ ID NO: 5837447 - DNA, 21 bp, Homo sapiens
agcaggtgtcctttcccctct

SEQ ID NO: 5837448 - DNA, 16 bp, Homo sapiens
agcaggtgtgaccctg

SEQ ID NO: 5837449 - DNA, 18 bp, Homo sapiens
agcaggtgtggtggctca

SEQ ID NO: 5837450 - DNA, 14 bp, Homo sapiens
agcaggttaaatgt

SEQ ID NO: 5837451 - DNA, 18 bp, Homo sapiens
agcaggttaaatgttttg

SEQ ID NO: 5837452 - DNA, 13 bp, Homo sapiens
agcaggttagaga

SEQ ID NO: 5837453 - DNA, 22 bp, Homo sapiens
agcaggttccccaagggccctg

SEQ ID NO: 5837454 - DNA, 23 bp, Homo sapiens
agcaggttccccaagggccctgg

SEQ ID NO: 5837455 - DNA, 15 bp, Homo sapiens
agcaggttctaggct

SEQ ID NO: 5837456 - DNA, 15 bp, Homo sapiens
agcaggttcttgatg

SEQ ID NO: 5837457 - DNA, 21 bp, Homo sapiens
agcaggttgaatgggttctca

SEQ ID NO: 5837458 - DNA, 20 bp, Homo sapiens
agcaggttgaggggctcctg

SEQ ID NO: 5837459 - DNA, 21 bp, Homo sapiens
agcaggttgaggggctcctgg

SEQ ID NO: 5837460 - DNA, 22 bp, Homo sapiens
agcaggttgaggggctcctgga

SEQ ID NO: 5837461 - DNA, 14 bp, Homo sapiens
agcaggtttcaagg

SEQ ID NO: 5837462 - DNA, 22 bp, Homo sapiens
agcaggtttcactattcctatg

SEQ ID NO: 5837463 - DNA, 17 bp, Homo sapiens
agcaggtttttctcctc

SEQ ID NO: 5837464 - DNA, 23 bp, Homo sapiens
agcagtaaaagataaatttgttg

SEQ ID NO: 5837465 - DNA, 14 bp, Homo sapiens
agcagtaaaataaa

SEQ ID NO: 5837466 - DNA, 19 bp, Homo sapiens
agcagtaaaataaaaaacc

SEQ ID NO: 5837467 - DNA, 21 bp, Homo sapiens
agcagtaaactttctctgcaa

SEQ ID NO: 5837468 - DNA, 21 bp, Homo sapiens
agcagtaaatgtatattgatg

SEQ ID NO: 5837469 - DNA, 17 bp, Homo sapiens
agcagtaaatttgctag

SEQ ID NO: 5837470 - DNA, 20 bp, Homo sapiens
agcagtaaatttgctagcag

SEQ ID NO: 5837471 - DNA, 17 bp, Homo sapiens
agcagtaactgacaact

SEQ ID NO: 5837472 - DNA, 21 bp, Homo sapiens
agcagtaattaatatctcctg

SEQ ID NO: 5837473 - DNA, 19 bp, Homo sapiens
agcagtaatttgtggcact

SEQ ID NO: 5837474 - DNA, 21 bp, Homo sapiens
agcagtacatcttgtgcatgc

SEQ ID NO: 5837475 - DNA, 16 bp, Homo sapiens
agcagtaccatcccac

SEQ ID NO: 5837476 - DNA, 21 bp, Homo sapiens
agcagtaccatcccactgata

SEQ ID NO: 5837477 - DNA, 17 bp, Homo sapiens
agcagtagacattttaa

SEQ ID NO: 5837478 - DNA, 22 bp, Homo sapiens
agcagtagccaaacaccacttt

SEQ ID NO: 5837479 - DNA, 16 bp, Homo sapiens
agcagtagtgagccac

SEQ ID NO: 5837480 - DNA, 22 bp, Homo sapiens
agcagtatatattctttcacaa

SEQ ID NO: 5837481 - DNA, 20 bp, Homo sapiens
agcagtatatgttaatttgt

SEQ ID NO: 5837482 - DNA, 15 bp, Homo sapiens
agcagtatattagta

SEQ ID NO: 5837483 - DNA, 21 bp, Homo sapiens
agcagtatcacaggccagatg

SEQ ID NO: 5837484 - DNA, 16 bp, Homo sapiens
agcagtatcatgaagc

SEQ ID NO: 5837485 - DNA, 14 bp, Homo sapiens
agcagtatgaatga

SEQ ID NO: 5837486 - DNA, 15 bp, Homo sapiens
agcagtatgaatgat

SEQ ID NO: 5837487 - DNA, 14 bp, Homo sapiens
agcagtatgtgtgc

SEQ ID NO: 5837488 - DNA, 20 bp, Homo sapiens
agcagtattctatttggtta

SEQ ID NO: 5837489 - DNA, 20 bp, Homo sapiens
agcagtatttaaatcttgca

SEQ ID NO: 5837490 - DNA, 13 bp, Homo sapiens
agcagtcaattaa

SEQ ID NO: 5837491 - DNA, 14 bp, Homo sapiens
agcagtcacaacag

SEQ ID NO: 5837492 - DNA, 14 bp, Homo sapiens
agcagtcacaggcc

SEQ ID NO: 5837493 - DNA, 18 bp, Homo sapiens
agcagtcacaggcccagg

SEQ ID NO: 5837494 - DNA, 14 bp, Homo sapiens
agcagtcactggga

SEQ ID NO: 5837495 - DNA, 16 bp, Homo sapiens
agcagtcagagtccag

SEQ ID NO: 5837496 - DNA, 23 bp, Homo sapiens
agcagtcaggggtcaggtgtcag

SEQ ID NO: 5837497 - DNA, 18 bp, Homo sapiens
agcagtcagggtgggaag

SEQ ID NO: 5837498 - DNA, 14 bp, Homo sapiens
agcagtcatcatct

SEQ ID NO: 5837499 - DNA, 15 bp, Homo sapiens
agcagtccaaagaac

SEQ ID NO: 5837500 - DNA, 22 bp, Homo sapiens
agcagtccaaggtattgagaca

SEQ ID NO: 5837501 - DNA, 13 bp, Homo sapiens
agcagtccatgca

SEQ ID NO: 5837502 - DNA, 24 bp, Homo sapiens
agcagtccatttttgagtaaaact

SEQ ID NO: 5837503 - DNA, 21 bp, Homo sapiens
agcagtcccagtattctcaga

SEQ ID NO: 5837504 - DNA, 15 bp, Homo sapiens
agcagtccccttccc

SEQ ID NO: 5837505 - DNA, 14 bp, Homo sapiens
agcagtccctgctt

SEQ ID NO: 5837506 - DNA, 14 bp, Homo sapiens
agcagtcctgggcc

SEQ ID NO: 5837507 - DNA, 12 bp, Homo sapiens
agcagtccttgg

SEQ ID NO: 5837508 - DNA, 18 bp, Homo sapiens
agcagtccttggcctgct

SEQ ID NO: 5837509 - DNA, 14 bp, Homo sapiens
agcagtcgcctgcc

SEQ ID NO: 5837510 - DNA, 17 bp, Homo sapiens
agcagtcgcctgcctgc

SEQ ID NO: 5837511 - DNA, 18 bp, Homo sapiens
agcagtcgcgagcacatg

SEQ ID NO: 5837512 - DNA, 16 bp, Homo sapiens
agcagtcgtgcctgtg

SEQ ID NO: 5837513 - DNA, 15 bp, Homo sapiens
agcagtctaaacaga

SEQ ID NO: 5837514 - DNA, 17 bp, Homo sapiens
agcagtctaaacagagt

SEQ ID NO: 5837515 - DNA, 13 bp, Homo sapiens
agcagtctaaatt

SEQ ID NO: 5837516 - DNA, 23 bp, Homo sapiens
agcagtctacccacctcagcctc

SEQ ID NO: 5837517 - DNA, 19 bp, Homo sapiens
agcagtctatcattgcagg

SEQ ID NO: 5837518 - DNA, 23 bp, Homo sapiens
agcagtctcactgcagtcttatt

SEQ ID NO: 5837519 - DNA, 14 bp, Homo sapiens
agcagtctctgcct

SEQ ID NO: 5837520 - DNA, 17 bp, Homo sapiens
agcagtctctgccttgc

SEQ ID NO: 5837521 - DNA, 19 bp, Homo sapiens
agcagtctctgccttgcct

SEQ ID NO: 5837522 - DNA, 15 bp, Homo sapiens
agcagtctgcctgga

SEQ ID NO: 5837523 - DNA, 21 bp, Homo sapiens
agcagtgaatgattcagtgtt

SEQ ID NO: 5837524 - DNA, 13 bp, Homo sapiens
agcagtgagcaga

SEQ ID NO: 5837525 - DNA, 19 bp, Homo sapiens
agcagtgatattctttgtt

SEQ ID NO: 5837526 - DNA, 21 bp, Homo sapiens
agcagtgatattctttgttaa

SEQ ID NO: 5837527 - DNA, 16 bp, Homo sapiens
agcagtgatctcaggg

SEQ ID NO: 5837528 - DNA, 18 bp, Homo sapiens
agcagtgcatgctgtccc

SEQ ID NO: 5837529 - DNA, 20 bp, Homo sapiens
agcagtgcatgctgtccctt

SEQ ID NO: 5837530 - DNA, 12 bp, Homo sapiens
agcagtgcccag

SEQ ID NO: 5837531 - DNA, 23 bp, Homo sapiens
agcagtgcccaggtggctgtgga

SEQ ID NO: 5837532 - DNA, 16 bp, Homo sapiens
agcagtgccctctgga

SEQ ID NO: 5837533 - DNA, 24 bp, Homo sapiens
agcagtgccctctggacagcttga

SEQ ID NO: 5837534 - DNA, 21 bp, Homo sapiens
agcagtgcctcgaggcaccgg

SEQ ID NO: 5837535 - DNA, 13 bp, Homo sapiens
agcagtgcctgcc

SEQ ID NO: 5837536 - DNA, 19 bp, Homo sapiens
agcagtgccttccataatt

SEQ ID NO: 5837537 - DNA, 23 bp, Homo sapiens
agcagtgccttccataattatga

SEQ ID NO: 5837538 - DNA, 11 bp, Homo sapiens
agcagtgctgg

SEQ ID NO: 5837539 - DNA, 19 bp, Homo sapiens
agcagtgctgggcccagcc

SEQ ID NO: 5837540 - DNA, 14 bp, Homo sapiens
agcagtgcttctca

SEQ ID NO: 5837541 - DNA, 12 bp, Homo sapiens
agcagtggcaaa

SEQ ID NO: 5837542 - DNA, 16 bp, Homo sapiens
agcagtggcaaaatat

SEQ ID NO: 5837543 - DNA, 21 bp, Homo sapiens
agcagtggcaaaatattatgt

SEQ ID NO: 5837544 - DNA, 13 bp, Homo sapiens
agcagtggcagga

SEQ ID NO: 5837545 - DNA, 20 bp, Homo sapiens
agcagtggcccatgtgactg

SEQ ID NO: 5837546 - DNA, 12 bp, Homo sapiens
agcagtggctgg

SEQ ID NO: 5837547 - DNA, 17 bp, Homo sapiens
agcagtggctggtccag

SEQ ID NO: 5837548 - DNA, 18 bp, Homo sapiens
agcagtggctggtccagg

SEQ ID NO: 5837549 - DNA, 21 bp, Homo sapiens
agcagtggctggtccagggct

SEQ ID NO: 5837550 - DNA, 17 bp, Homo sapiens
agcagtggctggtgccc

SEQ ID NO: 5837551 - DNA, 14 bp, Homo sapiens
agcagtgggcaggt

SEQ ID NO: 5837552 - DNA, 14 bp, Homo sapiens
agcagtgggccctg

SEQ ID NO: 5837553 - DNA, 17 bp, Homo sapiens
agcagtgggccctggct

SEQ ID NO: 5837554 - DNA, 13 bp, Homo sapiens
agcagtggggtga

SEQ ID NO: 5837555 - DNA, 12 bp, Homo sapiens
agcagtgtctct

SEQ ID NO: 5837556 - DNA, 17 bp, Homo sapiens
agcagtgtctgtacctc

SEQ ID NO: 5837557 - DNA, 20 bp, Homo sapiens
agcagtgtcttccataatgt

SEQ ID NO: 5837558 - DNA, 22 bp, Homo sapiens
agcagtgtcttccataatgtat

SEQ ID NO: 5837559 - DNA, 22 bp, Homo sapiens
agcagtgtgaatagcctggcca

SEQ ID NO: 5837560 - DNA, 15 bp, Homo sapiens
agcagtgtgaggcca

SEQ ID NO: 5837561 - DNA, 21 bp, Homo sapiens
agcagtgtgaggccagggcag

SEQ ID NO: 5837562 - DNA, 19 bp, Homo sapiens
agcagtgtgctttgcattt

SEQ ID NO: 5837563 - DNA, 22 bp, Homo sapiens
agcagtgtggggggacagacag

SEQ ID NO: 5837564 - DNA, 21 bp, Homo sapiens
agcagtgtgtctcctgcatgc

SEQ ID NO: 5837565 - DNA, 13 bp, Homo sapiens
agcagtgttagct

SEQ ID NO: 5837566 - DNA, 19 bp, Homo sapiens
agcatgcgcgctgtgggca

SEQ ID NO: 5837567 - DNA, 17 bp, Homo sapiens
agcatgcggagccagca

SEQ ID NO: 5837568 - DNA, 18 bp, Homo sapiens
agcatgcggagccagcag

SEQ ID NO: 5837569 - DNA, 15 bp, Homo sapiens
agcatgcttccctgc

SEQ ID NO: 5837570 - DNA, 18 bp, Homo sapiens
agcatgcttccctgcagc

SEQ ID NO: 5837571 - DNA, 20 bp, Homo sapiens
agcatgcttccctgcagctg

SEQ ID NO: 5837572 - DNA, 22 bp, Homo sapiens
agcatgcttccctgcagctgac

SEQ ID NO: 5837573 - DNA, 18 bp, Homo sapiens
agcatgcttcctttctct

SEQ ID NO: 5837574 - DNA, 19 bp, Homo sapiens
agcatgcttcctttctctc

SEQ ID NO: 5837575 - DNA, 22 bp, Homo sapiens
agcatgcttgtgaaaatgtgtt

SEQ ID NO: 5837576 - DNA, 11 bp, Homo sapiens
agcatgctttc

SEQ ID NO: 5837577 - DNA, 13 bp, Homo sapiens
agcatgctttctg

SEQ ID NO: 5837578 - DNA, 19 bp, Homo sapiens
agcatgctttgctgctatg

SEQ ID NO: 5837579 - DNA, 18 bp, Homo sapiens
agcatggaacaaagcatg

SEQ ID NO: 5837580 - DNA, 14 bp, Homo sapiens
agcatggaatctga

SEQ ID NO: 5837581 - DNA, 20 bp, Homo sapiens
agcatggaatctgatgaaaa

SEQ ID NO: 5837582 - DNA, 17 bp, Homo sapiens
agcatggacatttagaa

SEQ ID NO: 5837583 - DNA, 18 bp, Homo sapiens
agcatggacatttagaag

SEQ ID NO: 5837584 - DNA, 23 bp, Homo sapiens
agcatggactaaccccaacgcac

SEQ ID NO: 5837585 - DNA, 16 bp, Homo sapiens
agcatggagacagcag

SEQ ID NO: 5837586 - DNA, 18 bp, Homo sapiens
agcatggagacaggtaga

SEQ ID NO: 5837587 - DNA, 20 bp, Homo sapiens
agcatggagagaggcctgtg

SEQ ID NO: 5837588 - DNA, 16 bp, Homo sapiens
agcatggatgcatttc

SEQ ID NO: 5837589 - DNA, 17 bp, Homo sapiens
agcatggcactccctcc

SEQ ID NO: 5837590 - DNA, 18 bp, Homo sapiens
agcatggcactccctcca

SEQ ID NO: 5837591 - DNA, 11 bp, Homo sapiens
agcatggcata

SEQ ID NO: 5837592 - DNA, 17 bp, Homo sapiens
agcatggcatagccccg

SEQ ID NO: 5837593 - DNA, 16 bp, Homo sapiens
agcatggctgtctgca

SEQ ID NO: 5837594 - DNA, 22 bp, Homo sapiens
agcatggctgtctgcacagagg

SEQ ID NO: 5837595 - DNA, 13 bp, Homo sapiens
agcatggctgtga

SEQ ID NO: 5837596 - DNA, 17 bp, Homo sapiens
agcatgggaatacaaaa

SEQ ID NO: 5837597 - DNA, 19 bp, Homo sapiens
agcatgggcctggccacct

SEQ ID NO: 5837598 - DNA, 14 bp, Homo sapiens
agcatggggccagg

SEQ ID NO: 5837599 - DNA, 15 bp, Homo sapiens
agcatggggcccctg

SEQ ID NO: 5837600 - DNA, 16 bp, Homo sapiens
agcatggggcccctgg

SEQ ID NO: 5837601 - DNA, 17 bp, Homo sapiens
agcatgggggacccctt

SEQ ID NO: 5837602 - DNA, 16 bp, Homo sapiens
agcatgggggctgcca

SEQ ID NO: 5837603 - DNA, 16 bp, Homo sapiens
agcatggggtttttat

SEQ ID NO: 5837604 - DNA, 20 bp, Homo sapiens
agcatgggtccaagagacat

SEQ ID NO: 5837605 - DNA, 18 bp, Homo sapiens
agcatgggtccagaagac

SEQ ID NO: 5837606 - DNA, 20 bp, Homo sapiens
agcatggtagtggcaaagag

SEQ ID NO: 5837607 - DNA, 21 bp, Homo sapiens
agcatggtagtggcaaagaga

SEQ ID NO: 5837608 - DNA, 16 bp, Homo sapiens
agcatggtcacaagca

SEQ ID NO: 5837609 - DNA, 22 bp, Homo sapiens
agcatggtcccacatccctggg

SEQ ID NO: 5837610 - DNA, 15 bp, Homo sapiens
agcatggtgcatgcc

SEQ ID NO: 5837611 - DNA, 12 bp, Homo sapiens
agcatggtgttt

SEQ ID NO: 5837612 - DNA, 18 bp, Homo sapiens
agcatggttgcagataaa

SEQ ID NO: 5837613 - DNA, 13 bp, Homo sapiens
agcatgtaagtgt

SEQ ID NO: 5837614 - DNA, 13 bp, Homo sapiens
agcatgtaatggt

SEQ ID NO: 5837615 - DNA, 21 bp, Homo sapiens
agcatgtaatgttaatgttat

SEQ ID NO: 5837616 - DNA, 12 bp, Homo sapiens
agcatgtacagt

SEQ ID NO: 5837617 - DNA, 20 bp, Homo sapiens
agcatgtacggattttcagt

SEQ ID NO: 5837618 - DNA, 15 bp, Homo sapiens
agcatgtagggtgat

SEQ ID NO: 5837619 - DNA, 15 bp, Homo sapiens
agcatgtatgtctgc

SEQ ID NO: 5837620 - DNA, 23 bp, Homo sapiens
agcatgtattgtgtcttttgcat

SEQ ID NO: 5837621 - DNA, 20 bp, Homo sapiens
agcatgtatttttgtcaatt

SEQ ID NO: 5837622 - DNA, 16 bp, Homo sapiens
agcatgtcactcccag

SEQ ID NO: 5837623 - DNA, 14 bp, Homo sapiens
agcatgtcctatcc

SEQ ID NO: 5837624 - DNA, 17 bp, Homo sapiens
agcatgtctactgcttg

SEQ ID NO: 5837625 - DNA, 19 bp, Homo sapiens
agcatgtctattcagcttc

SEQ ID NO: 5837626 - DNA, 15 bp, Homo sapiens
agcatgtctctctgc

SEQ ID NO: 5837627 - DNA, 22 bp, Homo sapiens
agcatgtctctctgccaagatc

SEQ ID NO: 5837628 - DNA, 20 bp, Homo sapiens
agcatgtgaggggtagtggg

SEQ ID NO: 5837629 - DNA, 19 bp, Homo sapiens
agcatgtgatgttgtctta

SEQ ID NO: 5837630 - DNA, 12 bp, Homo sapiens
agcatgtgcaat

SEQ ID NO: 5837631 - DNA, 13 bp, Homo sapiens
agcatgtgcaata

SEQ ID NO: 5837632 - DNA, 15 bp, Homo sapiens
agcatgtgccctcct

SEQ ID NO: 5837633 - DNA, 16 bp, Homo sapiens
agcatgtgccttaatg

SEQ ID NO: 5837634 - DNA, 20 bp, Homo sapiens
agcatgtgctcagccccaga

SEQ ID NO: 5837635 - DNA, 17 bp, Homo sapiens
agcatgtggcatgttca

SEQ ID NO: 5837636 - DNA, 18 bp, Homo sapiens
agcatgtggcatgttcat

SEQ ID NO: 5837637 - DNA, 17 bp, Homo sapiens
agcatgtggggaagcaa

SEQ ID NO: 5837638 - DNA, 17 bp, Homo sapiens
agcatgtgggggaaggc

SEQ ID NO: 5837639 - DNA, 16 bp, Homo sapiens
agcatgtgtcatgcat

SEQ ID NO: 5837640 - DNA, 17 bp, Homo sapiens
agcatgtgtgtgtctct

SEQ ID NO: 5837641 - DNA, 22 bp, Homo sapiens
agcatgtgttaatcttaatgta

SEQ ID NO: 5837642 - DNA, 18 bp, Homo sapiens
agcatgtgttgcagctgt

SEQ ID NO: 5837643 - DNA, 16 bp, Homo sapiens
agcatgttaactttat

SEQ ID NO: 5837644 - DNA, 17 bp, Homo sapiens
agcatgttgctgaggag

SEQ ID NO: 5837645 - DNA, 18 bp, Homo sapiens
agcatgttgctgaggagt

SEQ ID NO: 5837646 - DNA, 21 bp, Homo sapiens
agcatgttgttttttcatagt

SEQ ID NO: 5837647 - DNA, 13 bp, Homo sapiens
agcatgtttagac

SEQ ID NO: 5837648 - DNA, 23 bp, Homo sapiens
agcatgtttagactttaacataa

SEQ ID NO: 5837649 - DNA, 14 bp, Homo sapiens
agcatgtttcatgt

SEQ ID NO: 5837650 - DNA, 17 bp, Homo sapiens
agcatgtttcatgtttt

SEQ ID NO: 5837651 - DNA, 18 bp, Homo sapiens
agcatgtttcatgttttg

SEQ ID NO: 5837652 - DNA, 21 bp, Homo sapiens
agcatgtttcatgttttgtga

SEQ ID NO: 5837653 - DNA, 14 bp, Homo sapiens
agcatgtttgctga

SEQ ID NO: 5837654 - DNA, 12 bp, Homo sapiens
agcatgttttct

SEQ ID NO: 5837655 - DNA, 15 bp, Homo sapiens
agcatgttttctgct

SEQ ID NO: 5837656 - DNA, 20 bp, Homo sapiens
agcatgttttctgctttaaa

SEQ ID NO: 5837657 - DNA, 21 bp, Homo sapiens
agcatgttttctgctttaaat

SEQ ID NO: 5837658 - DNA, 15 bp, Homo sapiens
agcattaaaaataaa

SEQ ID NO: 5837659 - DNA, 16 bp, Homo sapiens
agcattaaagttctag

SEQ ID NO: 5837660 - DNA, 13 bp, Homo sapiens
agcattaaatata

SEQ ID NO: 5837661 - DNA, 17 bp, Homo sapiens
agcattaactaaatgct

SEQ ID NO: 5837662 - DNA, 17 bp, Homo sapiens
agcattaacttctctgg

SEQ ID NO: 5837663 - DNA, 14 bp, Homo sapiens
agcattaagcccaa

SEQ ID NO: 5837664 - DNA, 18 bp, Homo sapiens
agcattaataaaactgtg

SEQ ID NO: 5837665 - DNA, 17 bp, Homo sapiens
agcattacaaattgctt

SEQ ID NO: 5837666 - DNA, 21 bp, Homo sapiens
agcattacattattaaacgat

SEQ ID NO: 5837667 - DNA, 16 bp, Homo sapiens
agcattacctaatttt

SEQ ID NO: 5837668 - DNA, 17 bp, Homo sapiens
agcattacgtgagccag

SEQ ID NO: 5837669 - DNA, 18 bp, Homo sapiens
agcattacgtgagccagg

SEQ ID NO: 5837670 - DNA, 19 bp, Homo sapiens
agcattactctttttcaat

SEQ ID NO: 5837671 - DNA, 13 bp, Homo sapiens
agcattactttaa

SEQ ID NO: 5837672 - DNA, 13 bp, Homo sapiens
agcattactttat

SEQ ID NO: 5837673 - DNA, 17 bp, Homo sapiens
agcattagatagtcatg

SEQ ID NO: 5837674 - DNA, 21 bp, Homo sapiens
agcattagatagtcatgctgc

SEQ ID NO: 5837675 - DNA, 22 bp, Homo sapiens
agcattagctacttttcagaat

SEQ ID NO: 5837676 - DNA, 17 bp, Homo sapiens
agcattagctttaatta

SEQ ID NO: 5837677 - DNA, 23 bp, Homo sapiens
agcattagctttaattaagctct

SEQ ID NO: 5837678 - DNA, 14 bp, Homo sapiens
agcattaggctttt

SEQ ID NO: 5837679 - DNA, 18 bp, Homo sapiens
agcattatccttttatct

SEQ ID NO: 5837680 - DNA, 15 bp, Homo sapiens
agcattatcttatca

SEQ ID NO: 5837681 - DNA, 15 bp, Homo sapiens
agcattatgcaatta

SEQ ID NO: 5837682 - DNA, 16 bp, Homo sapiens
agcattatgcaattag

SEQ ID NO: 5837683 - DNA, 22 bp, Homo sapiens
agcattattcctggtcaaagct

SEQ ID NO: 5837684 - DNA, 12 bp, Homo sapiens
agcattattgcc

SEQ ID NO: 5837685 - DNA, 21 bp, Homo sapiens
agcattcaaaatagttctatt

SEQ ID NO: 5837686 - DNA, 22 bp, Homo sapiens
agcattcaatttattcaagaaa

SEQ ID NO: 5837687 - DNA, 23 bp, Homo sapiens
agcattcaatttattcaagaaaa

SEQ ID NO: 5837688 - DNA, 19 bp, Homo sapiens
agcattcagaagaaaaaga

SEQ ID NO: 5837689 - DNA, 16 bp, Homo sapiens
agcattcagagagcag

SEQ ID NO: 5837690 - DNA, 17 bp, Homo sapiens
agcattcagagagcagc

SEQ ID NO: 5837691 - DNA, 15 bp, Homo sapiens
agcattcagcacaca

SEQ ID NO: 5837692 - DNA, 20 bp, Homo sapiens
agcattcagcacaccccaag

SEQ ID NO: 5837693 - DNA, 14 bp, Homo sapiens
agcattccaacaaa

SEQ ID NO: 5837694 - DNA, 15 bp, Homo sapiens
agcattccaacaaag

SEQ ID NO: 5837695 - DNA, 19 bp, Homo sapiens
agcattccaacaaagggtt

SEQ ID NO: 5837696 - DNA, 16 bp, Homo sapiens
agcattccagacttca

SEQ ID NO: 5837697 - DNA, 17 bp, Homo sapiens
agcattccagctctgcc

SEQ ID NO: 5837698 - DNA, 20 bp, Homo sapiens
agcattccagctctgccccc

SEQ ID NO: 5837699 - DNA, 13 bp, Homo sapiens
agcattcccaatt

SEQ ID NO: 5837700 - DNA, 13 bp, Homo sapiens
agcattcccaggt

SEQ ID NO: 5837701 - DNA, 14 bp, Homo sapiens
agcattccctccca

SEQ ID NO: 5837702 - DNA, 20 bp, Homo sapiens
agcattccttagcagctcag

SEQ ID NO: 5837703 - DNA, 22 bp, Homo sapiens
agcattccttagcagctcaggc

SEQ ID NO: 5837704 - DNA, 16 bp, Homo sapiens
agcattccttctttga

SEQ ID NO: 5837705 - DNA, 19 bp, Homo sapiens
agcattccttctttgataa

SEQ ID NO: 5837706 - DNA, 14 bp, Homo sapiens
agcattctaaatga

SEQ ID NO: 5837707 - DNA, 22 bp, Homo sapiens
agcattctcactcctacctggt

SEQ ID NO: 5837708 - DNA, 19 bp, Homo sapiens
agcattctcaggcaccagt

SEQ ID NO: 5837709 - DNA, 13 bp, Homo sapiens
agcattctcccca

SEQ ID NO: 5837710 - DNA, 12 bp, Homo sapiens
agcattctctcc

SEQ ID NO: 5837711 - DNA, 16 bp, Homo sapiens
agcattctgcagcccg

SEQ ID NO: 5837712 - DNA, 17 bp, Homo sapiens
agcattctggcagtttt

SEQ ID NO: 5837713 - DNA, 12 bp, Homo sapiens
agcattctgtct

SEQ ID NO: 5837714 - DNA, 18 bp, Homo sapiens
agcattcttagcctgtgg

SEQ ID NO: 5837715 - DNA, 19 bp, Homo sapiens
agcattcttagcctgtggc

SEQ ID NO: 5837716 - DNA, 23 bp, Homo sapiens
agcattcttagcctgtggcagta

SEQ ID NO: 5837717 - DNA, 22 bp, Homo sapiens
agcattcttgtcacaataaatg

SEQ ID NO: 5837718 - DNA, 24 bp, Homo sapiens
agcattctttggagttaaaatgca

SEQ ID NO: 5837719 - DNA, 16 bp, Homo sapiens
agcattgaaataataa

SEQ ID NO: 5837720 - DNA, 16 bp, Homo sapiens
agcattgaaattatag

SEQ ID NO: 5837721 - DNA, 22 bp, Homo sapiens
agcattgaacatttcttatgat

SEQ ID NO: 5837722 - DNA, 20 bp, Homo sapiens
agcattgataatcttcaggt

SEQ ID NO: 5837723 - DNA, 13 bp, Homo sapiens
agcattgcagcct

SEQ ID NO: 5837724 - DNA, 13 bp, Homo sapiens
agcattgccattc

SEQ ID NO: 5837725 - DNA, 14 bp, Homo sapiens
agcattgccattcc

SEQ ID NO: 5837726 - DNA, 17 bp, Homo sapiens
agcattgcctggccttc

SEQ ID NO: 5837727 - DNA, 12 bp, Homo sapiens
agcattgctaaa

SEQ ID NO: 5837728 - DNA, 15 bp, Homo sapiens
agcattgctgttatg

SEQ ID NO: 5837729 - DNA, 23 bp, Homo sapiens
agcattgctgttatgtctgttta

SEQ ID NO: 5837730 - DNA, 13 bp, Homo sapiens
agcattgctttct

SEQ ID NO: 5837731 - DNA, 15 bp, Homo sapiens
agcattgctttctga

SEQ ID NO: 5837732 - DNA, 16 bp, Homo sapiens
agcattgctttctgaa

SEQ ID NO: 5837733 - DNA, 17 bp, Homo sapiens
agcattgctttctgaaa

SEQ ID NO: 5837734 - DNA, 21 bp, Homo sapiens
agcattgcttttattttgaaa

SEQ ID NO: 5837735 - DNA, 14 bp, Homo sapiens
agcattggcccctg

SEQ ID NO: 5837736 - DNA, 16 bp, Homo sapiens
agcattggcccctgag

SEQ ID NO: 5837737 - DNA, 17 bp, Homo sapiens
agcattggcccctgagc

SEQ ID NO: 5837738 - DNA, 21 bp, Homo sapiens
agcattggcctggccagacca

SEQ ID NO: 5837739 - DNA, 22 bp, Homo sapiens
agcattggcctggccagaccag

SEQ ID NO: 5837740 - DNA, 22 bp, Homo sapiens
agcattgtaagcgtatggcttt

SEQ ID NO: 5837741 - DNA, 21 bp, Homo sapiens
agcattgtaattatgtaaata

SEQ ID NO: 5837742 - DNA, 15 bp, Homo sapiens
agcattgtagtgctt

SEQ ID NO: 5837743 - DNA, 20 bp, Homo sapiens
agcattgtagtgctttgaga

SEQ ID NO: 5837744 - DNA, 12 bp, Homo sapiens
agccacctccca

SEQ ID NO: 5837745 - DNA, 16 bp, Homo sapiens
agccacctcccaagga

SEQ ID NO: 5837746 - DNA, 15 bp, Homo sapiens
agccacctcccaccc

SEQ ID NO: 5837747 - DNA, 17 bp, Homo sapiens
agccacctcccacccca

SEQ ID NO: 5837748 - DNA, 22 bp, Homo sapiens
agccacctcccaccccactcca

SEQ ID NO: 5837749 - DNA, 23 bp, Homo sapiens
agccacctcccaccccactccag

SEQ ID NO: 5837750 - DNA, 18 bp, Homo sapiens
agccacctccgccagacc

SEQ ID NO: 5837751 - DNA, 14 bp, Homo sapiens
agccacctccttgg

SEQ ID NO: 5837752 - DNA, 15 bp, Homo sapiens
agccacctccttggc

SEQ ID NO: 5837753 - DNA, 16 bp, Homo sapiens
agccacctctctgcct

SEQ ID NO: 5837754 - DNA, 13 bp, Homo sapiens
agccacctgctgc

SEQ ID NO: 5837755 - DNA, 16 bp, Homo sapiens
agccacctggcagggc

SEQ ID NO: 5837756 - DNA, 12 bp, Homo sapiens
agccacctggga

SEQ ID NO: 5837757 - DNA, 17 bp, Homo sapiens
agccacctgggaacaca

SEQ ID NO: 5837758 - DNA, 22 bp, Homo sapiens
agccacctgggaacacagttct

SEQ ID NO: 5837759 - DNA, 13 bp, Homo sapiens
agccacctgggct

SEQ ID NO: 5837760 - DNA, 19 bp, Homo sapiens
agccacctgggctgggaga

SEQ ID NO: 5837761 - DNA, 21 bp, Homo sapiens
agccacctgggctgggagaag

SEQ ID NO: 5837762 - DNA, 16 bp, Homo sapiens
agccacctgtcccacc

SEQ ID NO: 5837763 - DNA, 16 bp, Homo sapiens
agccaccttcccaccc

SEQ ID NO: 5837764 - DNA, 21 bp, Homo sapiens
agccaccttcctgactgggaa

SEQ ID NO: 5837765 - DNA, 18 bp, Homo sapiens
agccaccttgattttctt

SEQ ID NO: 5837766 - DNA, 17 bp, Homo sapiens
agccacgaacagcccgc

SEQ ID NO: 5837767 - DNA, 18 bp, Homo sapiens
agccacgaccagcccctt

SEQ ID NO: 5837768 - DNA, 22 bp, Homo sapiens
agccacgaccagccccttcctg

SEQ ID NO: 5837769 - DNA, 15 bp, Homo sapiens
agccacgactgccat

SEQ ID NO: 5837770 - DNA, 15 bp, Homo sapiens
agccacgattggaga

SEQ ID NO: 5837771 - DNA, 14 bp, Homo sapiens
agccacgcagggcc

SEQ ID NO: 5837772 - DNA, 22 bp, Homo sapiens
agccacgcagggccatccactg

SEQ ID NO: 5837773 - DNA, 15 bp, Homo sapiens
agccacgccctccct

SEQ ID NO: 5837774 - DNA, 16 bp, Homo sapiens
agccacgccctccctg

SEQ ID NO: 5837775 - DNA, 17 bp, Homo sapiens
agccacgccctccctgc

SEQ ID NO: 5837776 - DNA, 18 bp, Homo sapiens
agccacgccctccctgct

SEQ ID NO: 5837777 - DNA, 20 bp, Homo sapiens
agccacgccctccctgctag

SEQ ID NO: 5837778 - DNA, 21 bp, Homo sapiens
agccacgccctccctgctagc

SEQ ID NO: 5837779 - DNA, 13 bp, Homo sapiens
agccacgcctctc

SEQ ID NO: 5837780 - DNA, 21 bp, Homo sapiens
agccacgcctctctcagccca

SEQ ID NO: 5837781 - DNA, 14 bp, Homo sapiens
agccacgcctgcga

SEQ ID NO: 5837782 - DNA, 15 bp, Homo sapiens
agccacgcctgcgat

SEQ ID NO: 5837783 - DNA, 24 bp, Homo sapiens
agccacgcctgcgatggtgctgca

SEQ ID NO: 5837784 - DNA, 16 bp, Homo sapiens
agccacgctggccttc

SEQ ID NO: 5837785 - DNA, 14 bp, Homo sapiens
agccacgctgtcct

SEQ ID NO: 5837786 - DNA, 20 bp, Homo sapiens
agccacggaccgcatcctcc

SEQ ID NO: 5837787 - DNA, 22 bp, Homo sapiens
agccacggaccgcatcctccag

SEQ ID NO: 5837788 - DNA, 16 bp, Homo sapiens
agccacggagggaggc

SEQ ID NO: 5837789 - DNA, 23 bp, Homo sapiens
agccacggccccgggtccaggag

SEQ ID NO: 5837790 - DNA, 15 bp, Homo sapiens
agccacggtgttctg

SEQ ID NO: 5837791 - DNA, 15 bp, Homo sapiens
agccacgtgaatggc

SEQ ID NO: 5837792 - DNA, 19 bp, Homo sapiens
agccacgtgctggagagta

SEQ ID NO: 5837793 - DNA, 18 bp, Homo sapiens
agccacgttccttactgc

SEQ ID NO: 5837794 - DNA, 20 bp, Homo sapiens
agccactaaccttgcctggt

SEQ ID NO: 5837795 - DNA, 22 bp, Homo sapiens
agccactaaccttgcctggtac

SEQ ID NO: 5837796 - DNA, 14 bp, Homo sapiens
agccactaactaga

SEQ ID NO: 5837797 - DNA, 16 bp, Homo sapiens
agccactacctttgtc

SEQ ID NO: 5837798 - DNA, 15 bp, Homo sapiens
agccactcaggaggc

SEQ ID NO: 5837799 - DNA, 22 bp, Homo sapiens
agccactcaggaggctgaggca

SEQ ID NO: 5837800 - DNA, 19 bp, Homo sapiens
agccactcagtctcttcca

SEQ ID NO: 5837801 - DNA, 20 bp, Homo sapiens
agccactcagtctcttccac

SEQ ID NO: 5837802 - DNA, 19 bp, Homo sapiens
agccactccaagccccctg

SEQ ID NO: 5837803 - DNA, 23 bp, Homo sapiens
agccactccaagccccctggcag

SEQ ID NO: 5837804 - DNA, 13 bp, Homo sapiens
agccactccccag

SEQ ID NO: 5837805 - DNA, 19 bp, Homo sapiens
agccactcccctccactct

SEQ ID NO: 5837806 - DNA, 22 bp, Homo sapiens
agccactcccgccacacgctca

SEQ ID NO: 5837807 - DNA, 11 bp, Homo sapiens
agccactccct

SEQ ID NO: 5837808 - DNA, 13 bp, Homo sapiens
agccactccctcc

SEQ ID NO: 5837809 - DNA, 12 bp, Homo sapiens
agccactcctct

SEQ ID NO: 5837810 - DNA, 13 bp, Homo sapiens
agccactcctctg

SEQ ID NO: 5837811 - DNA, 21 bp, Homo sapiens
agccactcctctgactcaggg

SEQ ID NO: 5837812 - DNA, 22 bp, Homo sapiens
agccactcctgtcccgccttcc

SEQ ID NO: 5837813 - DNA, 19 bp, Homo sapiens
agccactcgggaggctgag

SEQ ID NO: 5837814 - DNA, 14 bp, Homo sapiens
agccactctatgag

SEQ ID NO: 5837815 - DNA, 15 bp, Homo sapiens
agccactctctgccc

SEQ ID NO: 5837816 - DNA, 16 bp, Homo sapiens
agccactcttcaagta

SEQ ID NO: 5837817 - DNA, 13 bp, Homo sapiens
agccactgaagct

SEQ ID NO: 5837818 - DNA, 15 bp, Homo sapiens
agccactgagcctgg

SEQ ID NO: 5837819 - DNA, 17 bp, Homo sapiens
agccactgagcctggcc

SEQ ID NO: 5837820 - DNA, 20 bp, Homo sapiens
agccactgagcctggccctg

SEQ ID NO: 5837821 - DNA, 18 bp, Homo sapiens
agccactgcaccgggcca

SEQ ID NO: 5837822 - DNA, 21 bp, Homo sapiens
agccactgcaccgggccacag

SEQ ID NO: 5837823 - DNA, 15 bp, Homo sapiens
agccactgcagcaca

SEQ ID NO: 5837824 - DNA, 19 bp, Homo sapiens
agccactgccaagcttcct

SEQ ID NO: 5837825 - DNA, 21 bp, Homo sapiens
agccactgccactccagtcct

SEQ ID NO: 5837826 - DNA, 21 bp, Homo sapiens
agccactgcctctccctctgg

SEQ ID NO: 5837827 - DNA, 16 bp, Homo sapiens
agccactggaaggagc

SEQ ID NO: 5837828 - DNA, 21 bp, Homo sapiens
agccactggaggaagctgttt

SEQ ID NO: 5837829 - DNA, 11 bp, Homo sapiens
agccactgggc

SEQ ID NO: 5837830 - DNA, 14 bp, Homo sapiens
agccactgggcccc

SEQ ID NO: 5837831 - DNA, 15 bp, Homo sapiens
agccactgggcccct

SEQ ID NO: 5837832 - DNA, 20 bp, Homo sapiens
agccactgggcccctgtccc

SEQ ID NO: 5837833 - DNA, 18 bp, Homo sapiens
agccactggggtgggagg

SEQ ID NO: 5837834 - DNA, 23 bp, Homo sapiens
agccactggggtgggagggggca

SEQ ID NO: 5837835 - DNA, 19 bp, Homo sapiens
agccactggtttctcagaa

SEQ ID NO: 5837836 - DNA, 17 bp, Homo sapiens
agccactgtgcccagca

SEQ ID NO: 5837837 - DNA, 23 bp, Homo sapiens
agccactgtgcccagcccggata

SEQ ID NO: 5837838 - DNA, 16 bp, Homo sapiens
agccacttaccttcaa

SEQ ID NO: 5837839 - DNA, 17 bp, Homo sapiens
agccacttccccctctt

SEQ ID NO: 5837840 - DNA, 22 bp, Homo sapiens
agccacttccccctcttcttct

SEQ ID NO: 5837841 - DNA, 13 bp, Homo sapiens
agccacttctccc

SEQ ID NO: 5837842 - DNA, 17 bp, Homo sapiens
agccacttctccccaga

SEQ ID NO: 5837843 - DNA, 18 bp, Homo sapiens
agccacttctccccagaa

SEQ ID NO: 5837844 - DNA, 13 bp, Homo sapiens
agccacttctggc

SEQ ID NO: 5837845 - DNA, 19 bp, Homo sapiens
agccacttgcctgtgctac

SEQ ID NO: 5837846 - DNA, 15 bp, Homo sapiens
agccacttggcccag

SEQ ID NO: 5837847 - DNA, 12 bp, Homo sapiens
agccacttgtga

SEQ ID NO: 5837848 - DNA, 20 bp, Homo sapiens
agccactttcaatcttcaat

SEQ ID NO: 5837849 - DNA, 20 bp, Homo sapiens
agccacttttagctactgct

SEQ ID NO: 5837850 - DNA, 21 bp, Homo sapiens
agccagaaaaagatctttcat

SEQ ID NO: 5837851 - DNA, 17 bp, Homo sapiens
agccagaaactgaactg

SEQ ID NO: 5837852 - DNA, 14 bp, Homo sapiens
agccagaaagcact

SEQ ID NO: 5837853 - DNA, 13 bp, Homo sapiens
agccagaaagggt

SEQ ID NO: 5837854 - DNA, 13 bp, Homo sapiens
agccagaaatggg

SEQ ID NO: 5837855 - DNA, 17 bp, Homo sapiens
agccagaaatgggcagt

SEQ ID NO: 5837856 - DNA, 18 bp, Homo sapiens
agccagaaatgggcagtt

SEQ ID NO: 5837857 - DNA, 23 bp, Homo sapiens
agccagaaatgggcagttctccc

SEQ ID NO: 5837858 - DNA, 14 bp, Homo sapiens
agccagaacctcag

SEQ ID NO: 5837859 - DNA, 12 bp, Homo sapiens
agccagaagctg

SEQ ID NO: 5837860 - DNA, 13 bp, Homo sapiens
agccagaaggaaa

SEQ ID NO: 5837861 - DNA, 19 bp, Homo sapiens
agccagaatcagcacagat

SEQ ID NO: 5837862 - DNA, 20 bp, Homo sapiens
agccagaatctcattactgc

SEQ ID NO: 5837863 - DNA, 16 bp, Homo sapiens
agccagaatgccctgt

SEQ ID NO: 5837864 - DNA, 12 bp, Homo sapiens
agccagaattca

SEQ ID NO: 5837865 - DNA, 20 bp, Homo sapiens
agccagaattctaccctgga

SEQ ID NO: 5837866 - DNA, 21 bp, Homo sapiens
agccagacaaaatttgagaat

SEQ ID NO: 5837867 - DNA, 20 bp, Homo sapiens
agccagacaacttctgtttc

SEQ ID NO: 5837868 - DNA, 22 bp, Homo sapiens
agccagacaacttctgtttctt

SEQ ID NO: 5837869 - DNA, 14 bp, Homo sapiens
agccagacacatgg

SEQ ID NO: 5837870 - DNA, 16 bp, Homo sapiens
agccagacactctgct

SEQ ID NO: 5837871 - DNA, 14 bp, Homo sapiens
agccagactctggt

SEQ ID NO: 5837872 - DNA, 18 bp, Homo sapiens
agccagactctggtcttc

SEQ ID NO: 5837873 - DNA, 13 bp, Homo sapiens
agccagactctgt

SEQ ID NO: 5837874 - DNA, 14 bp, Homo sapiens
agccagacttgctt

SEQ ID NO: 5837875 - DNA, 12 bp, Homo sapiens
agccagagaagg

SEQ ID NO: 5837876 - DNA, 15 bp, Homo sapiens
agccagagaagtgac

SEQ ID NO: 5837877 - DNA, 17 bp, Homo sapiens
agccagagaagtgacag

SEQ ID NO: 5837878 - DNA, 14 bp, Homo sapiens
agccagagacagag

SEQ ID NO: 5837879 - DNA, 22 bp, Homo sapiens
agccagagacagaggatgtggc

SEQ ID NO: 5837880 - DNA, 15 bp, Homo sapiens
agccagagagacaga

SEQ ID NO: 5837881 - DNA, 18 bp, Homo sapiens
agccagagaggagcacct

SEQ ID NO: 5837882 - DNA, 20 bp, Homo sapiens
agccagagaggagcacctga

SEQ ID NO: 5837883 - DNA, 14 bp, Homo sapiens
agccagagccccaa

SEQ ID NO: 5837884 - DNA, 13 bp, Homo sapiens
agccagagctggg

SEQ ID NO: 5837885 - DNA, 14 bp, Homo sapiens
agccagagctgggt

SEQ ID NO: 5837886 - DNA, 16 bp, Homo sapiens
agccagagctgggtgg

SEQ ID NO: 5837887 - DNA, 19 bp, Homo sapiens
agccagagctgtgcctgct

SEQ ID NO: 5837888 - DNA, 21 bp, Homo sapiens
agccagagctgtgcctgctca

SEQ ID NO: 5837889 - DNA, 10 bp, Homo sapiens
agccagagga

SEQ ID NO: 5837890 - DNA, 14 bp, Homo sapiens
agccagaggactgt

SEQ ID NO: 5837891 - DNA, 11 bp, Homo sapiens
agccagaggag

SEQ ID NO: 5837892 - DNA, 15 bp, Homo sapiens
agccagaggagagag

SEQ ID NO: 5837893 - DNA, 17 bp, Homo sapiens
agccagaggccaggatg

SEQ ID NO: 5837894 - DNA, 11 bp, Homo sapiens
agccagaggct

SEQ ID NO: 5837895 - DNA, 13 bp, Homo sapiens
agccagaggctgg

SEQ ID NO: 5837896 - DNA, 14 bp, Homo sapiens
agccagaggctgga

SEQ ID NO: 5837897 - DNA, 18 bp, Homo sapiens
agccagaggctggagaca

SEQ ID NO: 5837898 - DNA, 20 bp, Homo sapiens
agccagaggctggagacagg

SEQ ID NO: 5837899 - DNA, 18 bp, Homo sapiens
agccagaggctgggttca

SEQ ID NO: 5837900 - DNA, 15 bp, Homo sapiens
agccagagggagctg

SEQ ID NO: 5837901 - DNA, 22 bp, Homo sapiens
agccagagggtgggagcctaag

SEQ ID NO: 5837902 - DNA, 17 bp, Homo sapiens
agccagagggtgggagg

SEQ ID NO: 5837903 - DNA, 10 bp, Homo sapiens
agccagaggt

SEQ ID NO: 5837904 - DNA, 18 bp, Homo sapiens
agccagaggtggagccaa

SEQ ID NO: 5837905 - DNA, 17 bp, Homo sapiens
agccagagtttgcctcc

SEQ ID NO: 5837906 - DNA, 23 bp, Homo sapiens
agccagagtttgcctccctgcac

SEQ ID NO: 5837907 - DNA, 21 bp, Homo sapiens
agccagagtttttaaagcctt

SEQ ID NO: 5837908 - DNA, 22 bp, Homo sapiens
agccagagtttttaaagccttc

SEQ ID NO: 5837909 - DNA, 13 bp, Homo sapiens
agccagatcccca

SEQ ID NO: 5837910 - DNA, 15 bp, Homo sapiens
agccagatccccagg

SEQ ID NO: 5837911 - DNA, 16 bp, Homo sapiens
agccagatccccaggg

SEQ ID NO: 5837912 - DNA, 18 bp, Homo sapiens
agccagatccccagggca

SEQ ID NO: 5837913 - DNA, 19 bp, Homo sapiens
agccagatccccagggcag

SEQ ID NO: 5837914 - DNA, 20 bp, Homo sapiens
agccagatccccagggcagc

SEQ ID NO: 5837915 - DNA, 21 bp, Homo sapiens
agccagatccccagggcagcc

SEQ ID NO: 5837916 - DNA, 22 bp, Homo sapiens
agccagatccccagggcagcct

SEQ ID NO: 5837917 - DNA, 12 bp, Homo sapiens
agccagatcctc

SEQ ID NO: 5837918 - DNA, 14 bp, Homo sapiens
agccagatgacagg

SEQ ID NO: 5837919 - DNA, 23 bp, Homo sapiens
agccagatgcctccccaagactg

SEQ ID NO: 5837920 - DNA, 14 bp, Homo sapiens
agccagatgctaga

SEQ ID NO: 5837921 - DNA, 22 bp, Homo sapiens
agccagatgctagagcctctgc

SEQ ID NO: 5837922 - DNA, 23 bp, Homo sapiens
agccagatgctagagcctctgcc

SEQ ID NO: 5837923 - DNA, 16 bp, Homo sapiens
agccatgcctcatgcc

SEQ ID NO: 5837924 - DNA, 17 bp, Homo sapiens
agccatgcctcatgcca

SEQ ID NO: 5837925 - DNA, 16 bp, Homo sapiens
agccatgcgccccctc

SEQ ID NO: 5837926 - DNA, 22 bp, Homo sapiens
agccatgcgcgcgctctctctc

SEQ ID NO: 5837927 - DNA, 13 bp, Homo sapiens
agccatgcgtggc

SEQ ID NO: 5837928 - DNA, 12 bp, Homo sapiens
agccatgctctt

SEQ ID NO: 5837929 - DNA, 21 bp, Homo sapiens
agccatgctgctttgcacaca

SEQ ID NO: 5837930 - DNA, 22 bp, Homo sapiens
agccatgctgctttgcacacac

SEQ ID NO: 5837931 - DNA, 18 bp, Homo sapiens
agccatgctggaaaataa

SEQ ID NO: 5837932 - DNA, 20 bp, Homo sapiens
agccatggcaggacagctcc

SEQ ID NO: 5837933 - DNA, 20 bp, Homo sapiens
agccatggcggcccctcagc

SEQ ID NO: 5837934 - DNA, 24 bp, Homo sapiens
agccatggcggcccctcagcctgc

SEQ ID NO: 5837935 - DNA, 19 bp, Homo sapiens
agccatggctggatgtgca

SEQ ID NO: 5837936 - DNA, 13 bp, Homo sapiens
agccatggctggc

SEQ ID NO: 5837937 - DNA, 20 bp, Homo sapiens
agccatgggaaatgagccag

SEQ ID NO: 5837938 - DNA, 13 bp, Homo sapiens
agccatgggacca

SEQ ID NO: 5837939 - DNA, 19 bp, Homo sapiens
agccatgggacctcctccc

SEQ ID NO: 5837940 - DNA, 23 bp, Homo sapiens
agccatgggcacaaagggcccag

SEQ ID NO: 5837941 - DNA, 22 bp, Homo sapiens
agccatgggcctgggcctgctt

SEQ ID NO: 5837942 - DNA, 22 bp, Homo sapiens
agccatggggtccatccccttc

SEQ ID NO: 5837943 - DNA, 21 bp, Homo sapiens
agccatggtgacacacagcag

SEQ ID NO: 5837944 - DNA, 20 bp, Homo sapiens
agccatgtactcaagtacca

SEQ ID NO: 5837945 - DNA, 17 bp, Homo sapiens
agccatgtatttcaggg

SEQ ID NO: 5837946 - DNA, 23 bp, Homo sapiens
agccatgtccaaacccatcttca

SEQ ID NO: 5837947 - DNA, 23 bp, Homo sapiens
agccatgtctacaaaagcaaagt

SEQ ID NO: 5837948 - DNA, 17 bp, Homo sapiens
agccatgtcttctccct

SEQ ID NO: 5837949 - DNA, 20 bp, Homo sapiens
agccatgtggggttgctgaa

SEQ ID NO: 5837950 - DNA, 18 bp, Homo sapiens
agccatgtgtcatgtaat

SEQ ID NO: 5837951 - DNA, 14 bp, Homo sapiens
agccatgttaaatg

SEQ ID NO: 5837952 - DNA, 15 bp, Homo sapiens
agccatgttaaatga

SEQ ID NO: 5837953 - DNA, 18 bp, Homo sapiens
agccatgtttaagattta

SEQ ID NO: 5837954 - DNA, 16 bp, Homo sapiens
agccatgtttattaca

SEQ ID NO: 5837955 - DNA, 15 bp, Homo sapiens
agccatgtttcacaa

SEQ ID NO: 5837956 - DNA, 13 bp, Homo sapiens
agccattaaaata

SEQ ID NO: 5837957 - DNA, 17 bp, Homo sapiens
agccattaaaataaaac

SEQ ID NO: 5837958 - DNA, 18 bp, Homo sapiens
agccattaaaataaaaca

SEQ ID NO: 5837959 - DNA, 23 bp, Homo sapiens
agccattaaaataaaacaagcct

SEQ ID NO: 5837960 - DNA, 17 bp, Homo sapiens
agccattaaatgaatat

SEQ ID NO: 5837961 - DNA, 20 bp, Homo sapiens
agccattaccatggagacaa

SEQ ID NO: 5837962 - DNA, 14 bp, Homo sapiens
agccattcacaaca

SEQ ID NO: 5837963 - DNA, 15 bp, Homo sapiens
agccattcacaacac

SEQ ID NO: 5837964 - DNA, 18 bp, Homo sapiens
agccattcatctgggctg

SEQ ID NO: 5837965 - DNA, 21 bp, Homo sapiens
agccattcatctgggctggca

SEQ ID NO: 5837966 - DNA, 23 bp, Homo sapiens
agccattcatctgggctggcaga

SEQ ID NO: 5837967 - DNA, 14 bp, Homo sapiens
agccattcctgttc

SEQ ID NO: 5837968 - DNA, 22 bp, Homo sapiens
agccattcctgttctctttgcc

SEQ ID NO: 5837969 - DNA, 14 bp, Homo sapiens
agccattctggcac

SEQ ID NO: 5837970 - DNA, 20 bp, Homo sapiens
agccattctggcactttaat

SEQ ID NO: 5837971 - DNA, 18 bp, Homo sapiens
agccattgaacagctgtg

SEQ ID NO: 5837972 - DNA, 19 bp, Homo sapiens
agccattgaacagctgtga

SEQ ID NO: 5837973 - DNA, 21 bp, Homo sapiens
agccattgcggccccaggagg

SEQ ID NO: 5837974 - DNA, 19 bp, Homo sapiens
agccattgcttctccctca

SEQ ID NO: 5837975 - DNA, 22 bp, Homo sapiens
agccattggctatttaaaactt

SEQ ID NO: 5837976 - DNA, 17 bp, Homo sapiens
agccattgtcttcggaa

SEQ ID NO: 5837977 - DNA, 19 bp, Homo sapiens
agccatttaaagaccaata

SEQ ID NO: 5837978 - DNA, 16 bp, Homo sapiens
agccatttaattttta

SEQ ID NO: 5837979 - DNA, 19 bp, Homo sapiens
agccatttaatttttaaat

SEQ ID NO: 5837980 - DNA, 15 bp, Homo sapiens
agccatttactttgc

SEQ ID NO: 5837981 - DNA, 22 bp, Homo sapiens
agccatttagagggtgaaggag

SEQ ID NO: 5837982 - DNA, 19 bp, Homo sapiens
agccatttattttttaaaa

SEQ ID NO: 5837983 - DNA, 17 bp, Homo sapiens
agccatttccccctcct

SEQ ID NO: 5837984 - DNA, 22 bp, Homo sapiens
agccatttctccatggagttgc

SEQ ID NO: 5837985 - DNA, 18 bp, Homo sapiens
agccatttctccatgggc

SEQ ID NO: 5837986 - DNA, 23 bp, Homo sapiens
agccatttgccccaacttaagtt

SEQ ID NO: 5837987 - DNA, 22 bp, Homo sapiens
agccatttggtcttaattctga

SEQ ID NO: 5837988 - DNA, 14 bp, Homo sapiens
agccatttgtccca

SEQ ID NO: 5837989 - DNA, 17 bp, Homo sapiens
agccatttgtcccaagt

SEQ ID NO: 5837990 - DNA, 16 bp, Homo sapiens
agccattttgtaactg

SEQ ID NO: 5837991 - DNA, 15 bp, Homo sapiens
agccattttgtgaat

SEQ ID NO: 5837992 - DNA, 12 bp, Homo sapiens
agccatttttag

SEQ ID NO: 5837993 - DNA, 18 bp, Homo sapiens
agccatttttcaaagcaa

SEQ ID NO: 5837994 - DNA, 19 bp, Homo sapiens
agccattttttgaggagag

SEQ ID NO: 5837995 - DNA, 16 bp, Homo sapiens
agcccaaaacccaggg

SEQ ID NO: 5837996 - DNA, 15 bp, Homo sapiens
agcccaaaagagggc

SEQ ID NO: 5837997 - DNA, 14 bp, Homo sapiens
agcccaaaatttga

SEQ ID NO: 5837998 - DNA, 23 bp, Homo sapiens
agcccaaacaccctcctggcaca

SEQ ID NO: 5837999 - DNA, 22 bp, Homo sapiens
agcccaaaccaccagaagccca

SEQ ID NO: 5838000 - DNA, 15 bp, Homo sapiens
agcccaaacctggga

SEQ ID NO: 5838001 - DNA, 22 bp, Homo sapiens
agcccaaaccttgggccctgga

SEQ ID NO: 5838002 - DNA, 17 bp, Homo sapiens
agcccaaactcctttct

SEQ ID NO: 5838003 - DNA, 16 bp, Homo sapiens
agcccaaagaaggaaa

SEQ ID NO: 5838004 - DNA, 13 bp, Homo sapiens
agcccaaagcctg

SEQ ID NO: 5838005 - DNA, 21 bp, Homo sapiens
agcccaaaggggacaggcctc

SEQ ID NO: 5838006 - DNA, 13 bp, Homo sapiens
agcccaaattctc

SEQ ID NO: 5838007 - DNA, 17 bp, Homo sapiens
agcccaacacacactcg

SEQ ID NO: 5838008 - DNA, 16 bp, Homo sapiens
agcccaaccaggaggg

SEQ ID NO: 5838009 - DNA, 23 bp, Homo sapiens
agcccaacctacattccaccctg

SEQ ID NO: 5838010 - DNA, 18 bp, Homo sapiens
agcccaacttcttacccg

SEQ ID NO: 5838011 - DNA, 17 bp, Homo sapiens
agcccaagacaccatga

SEQ ID NO: 5838012 - DNA, 19 bp, Homo sapiens
agcccaagaggtctgagcc

SEQ ID NO: 5838013 - DNA, 16 bp, Homo sapiens
agcccaagcagagtga

SEQ ID NO: 5838014 - DNA, 20 bp, Homo sapiens
agcccaagctaagctgcagg

SEQ ID NO: 5838015 - DNA, 21 bp, Homo sapiens
agcccaagctaagctgcaggc

SEQ ID NO: 5838016 - DNA, 21 bp, Homo sapiens
agcccaagcttaatagccctc

SEQ ID NO: 5838017 - DNA, 14 bp, Homo sapiens
agcccaagcttccc

SEQ ID NO: 5838018 - DNA, 14 bp, Homo sapiens
agcccaaggacagt

SEQ ID NO: 5838019 - DNA, 19 bp, Homo sapiens
agcccaaggacagttcaga

SEQ ID NO: 5838020 - DNA, 22 bp, Homo sapiens
agcccaagggcggggctatgcc

SEQ ID NO: 5838021 - DNA, 23 bp, Homo sapiens
agcccaaggtgctgatgtcaaag

SEQ ID NO: 5838022 - DNA, 17 bp, Homo sapiens
agcccaagtgaggcagc

SEQ ID NO: 5838023 - DNA, 15 bp, Homo sapiens
agcccaagtgccatc

SEQ ID NO: 5838024 - DNA, 16 bp, Homo sapiens
agcccaagtgccatcc

SEQ ID NO: 5838025 - DNA, 22 bp, Homo sapiens
agcccaagtgccatcccacatt

SEQ ID NO: 5838026 - DNA, 10 bp, Homo sapiens
agcccaataa

SEQ ID NO: 5838027 - DNA, 15 bp, Homo sapiens
agcccaatattataa

SEQ ID NO: 5838028 - DNA, 20 bp, Homo sapiens
agcccaatattataattttt

SEQ ID NO: 5838029 - DNA, 20 bp, Homo sapiens
agcccaatgcatagagccct

SEQ ID NO: 5838030 - DNA, 17 bp, Homo sapiens
agcccaatggagaaatg

SEQ ID NO: 5838031 - DNA, 21 bp, Homo sapiens
agcccacaagatccaggcaga

SEQ ID NO: 5838032 - DNA, 15 bp, Homo sapiens
agcccacaccatctg

SEQ ID NO: 5838033 - DNA, 19 bp, Homo sapiens
agcccacaccatctggccc

SEQ ID NO: 5838034 - DNA, 16 bp, Homo sapiens
agcccacacccctcca

SEQ ID NO: 5838035 - DNA, 23 bp, Homo sapiens
agcccacactatgcacagagccc

SEQ ID NO: 5838036 - DNA, 16 bp, Homo sapiens
agcccacagagcctga

SEQ ID NO: 5838037 - DNA, 13 bp, Homo sapiens
agcccacagagga

SEQ ID NO: 5838038 - DNA, 14 bp, Homo sapiens
agcccacagaggac

SEQ ID NO: 5838039 - DNA, 21 bp, Homo sapiens
agcccacagatgatgaagaaa

SEQ ID NO: 5838040 - DNA, 21 bp, Homo sapiens
agcccacagcagcaatatgct

SEQ ID NO: 5838041 - DNA, 22 bp, Homo sapiens
agcccacagcgagcctgtgcct

SEQ ID NO: 5838042 - DNA, 16 bp, Homo sapiens
agcccacaggcctgtt

SEQ ID NO: 5838043 - DNA, 18 bp, Homo sapiens
agcccacaggcctgttcc

SEQ ID NO: 5838044 - DNA, 19 bp, Homo sapiens
agcccacagtatattttat

SEQ ID NO: 5838045 - DNA, 16 bp, Homo sapiens
agcccacagtgctcag

SEQ ID NO: 5838046 - DNA, 22 bp, Homo sapiens
agcccacagtgctcagttgtac

SEQ ID NO: 5838047 - DNA, 13 bp, Homo sapiens
agcccaccaccct

SEQ ID NO: 5838048 - DNA, 13 bp, Homo sapiens
agcccaccagcca

SEQ ID NO: 5838049 - DNA, 17 bp, Homo sapiens
agcccaccagccacctc

SEQ ID NO: 5838050 - DNA, 14 bp, Homo sapiens
agcccaccagccag

SEQ ID NO: 5838051 - DNA, 19 bp, Homo sapiens
agcccaccagccagccctg

SEQ ID NO: 5838052 - DNA, 21 bp, Homo sapiens
agcccaccaggagcacctgga

SEQ ID NO: 5838053 - DNA, 21 bp, Homo sapiens
agcccaccatttggcatccct

SEQ ID NO: 5838054 - DNA, 13 bp, Homo sapiens
agcccacccagca

SEQ ID NO: 5838055 - DNA, 16 bp, Homo sapiens
agcccacccccctcat

SEQ ID NO: 5838056 - DNA, 17 bp, Homo sapiens
agcccacccgccccaga

SEQ ID NO: 5838057 - DNA, 20 bp, Homo sapiens
agcccacccgccccagagac

SEQ ID NO: 5838058 - DNA, 12 bp, Homo sapiens
agcccaccctgc

SEQ ID NO: 5838059 - DNA, 15 bp, Homo sapiens
agcccaccctgcccc

SEQ ID NO: 5838060 - DNA, 22 bp, Homo sapiens
agcccaccctgctgctggtgca

SEQ ID NO: 5838061 - DNA, 14 bp, Homo sapiens
agcccaccctggga

SEQ ID NO: 5838062 - DNA, 22 bp, Homo sapiens
agcccacctcggccctccctgc

SEQ ID NO: 5838063 - DNA, 10 bp, Homo sapiens
agcccacctg

SEQ ID NO: 5838064 - DNA, 22 bp, Homo sapiens
agcccacctgaaagcctgtctc

SEQ ID NO: 5838065 - DNA, 12 bp, Homo sapiens
agcccacctgca

SEQ ID NO: 5838066 - DNA, 13 bp, Homo sapiens
agcccacctgcac

SEQ ID NO: 5838067 - DNA, 19 bp, Homo sapiens
agcccacctgctcccaggc

SEQ ID NO: 5838068 - DNA, 17 bp, Homo sapiens
agcccacctgggctggg

SEQ ID NO: 5838069 - DNA, 20 bp, Homo sapiens
agcccacgacactgcagccc

SEQ ID NO: 5838070 - DNA, 22 bp, Homo sapiens
agcccacgctgactacagggcc

SEQ ID NO: 5838071 - DNA, 23 bp, Homo sapiens
agcccacgctgactacagggccg

SEQ ID NO: 5838072 - DNA, 23 bp, Homo sapiens
agcccacggggatcacagcgttt

SEQ ID NO: 5838073 - DNA, 17 bp, Homo sapiens
agcccacggggcaaagc

SEQ ID NO: 5838074 - DNA, 21 bp, Homo sapiens
agcccacggggcaaagctgct

SEQ ID NO: 5838075 - DNA, 23 bp, Homo sapiens
agcccacgtcacgtgtagtgtcc

SEQ ID NO: 5838076 - DNA, 20 bp, Homo sapiens
agcccacgtcaggcctggcc

SEQ ID NO: 5838077 - DNA, 20 bp, Homo sapiens
agcccactaactgaggagct

SEQ ID NO: 5838078 - DNA, 21 bp, Homo sapiens
agcccactccatctggtagaa

SEQ ID NO: 5838079 - DNA, 12 bp, Homo sapiens
agcccactccct

SEQ ID NO: 5838080 - DNA, 15 bp, Homo sapiens
agcccactccctgcc

SEQ ID NO: 5838081 - DNA, 16 bp, Homo sapiens
agcccactccctgcct

SEQ ID NO: 5838082 - DNA, 19 bp, Homo sapiens
agcccactctactgcccca

SEQ ID NO: 5838083 - DNA, 15 bp, Homo sapiens
agcccactctgctcg

SEQ ID NO: 5838084 - DNA, 15 bp, Homo sapiens
agcccactgcctcct

SEQ ID NO: 5838085 - DNA, 17 bp, Homo sapiens
agcccactgcctcctcc

SEQ ID NO: 5838086 - DNA, 22 bp, Homo sapiens
agcccactgcctcctccctggc

SEQ ID NO: 5838087 - DNA, 23 bp, Homo sapiens
agcccactgcctcctccctggct

SEQ ID NO: 5838088 - DNA, 12 bp, Homo sapiens
agcccactgggc

SEQ ID NO: 5838089 - DNA, 14 bp, Homo sapiens
agcccactgggccc

SEQ ID NO: 5838090 - DNA, 17 bp, Homo sapiens
agcccactgggccctgg

SEQ ID NO: 5838091 - DNA, 18 bp, Homo sapiens
agcccactgggccctggg

SEQ ID NO: 5838092 - DNA, 19 bp, Homo sapiens
agcccactgggccctgggg

SEQ ID NO: 5838093 - DNA, 23 bp, Homo sapiens
agcccactgggtttaaagatgtt

SEQ ID NO: 5838094 - DNA, 19 bp, Homo sapiens
agcccactgtcctgggcct

SEQ ID NO: 5838095 - DNA, 15 bp, Homo sapiens
agcccacttctgcca

SEQ ID NO: 5838096 - DNA, 15 bp, Homo sapiens
agcccacttgtcatc

SEQ ID NO: 5838097 - DNA, 18 bp, Homo sapiens
agcccagaaaacctccag

SEQ ID NO: 5838098 - DNA, 13 bp, Homo sapiens
agccccaacggga

SEQ ID NO: 5838099 - DNA, 17 bp, Homo sapiens
agccccaacgggaaagg

SEQ ID NO: 5838100 - DNA, 18 bp, Homo sapiens
agccccaacgggaaagga

SEQ ID NO: 5838101 - DNA, 18 bp, Homo sapiens
agccccaactccaggggc

SEQ ID NO: 5838102 - DNA, 22 bp, Homo sapiens
agccccaactccaggggcacct

SEQ ID NO: 5838103 - DNA, 18 bp, Homo sapiens
agccccaagaaggctggg

SEQ ID NO: 5838104 - DNA, 19 bp, Homo sapiens
agccccaagtcctgaagag

SEQ ID NO: 5838105 - DNA, 22 bp, Homo sapiens
agccccaatatggtggccctgg

SEQ ID NO: 5838106 - DNA, 16 bp, Homo sapiens
agccccaatccagaga

SEQ ID NO: 5838107 - DNA, 11 bp, Homo sapiens
agccccacacc

SEQ ID NO: 5838108 - DNA, 23 bp, Homo sapiens
agccccacaccagggccagcctc

SEQ ID NO: 5838109 - DNA, 11 bp, Homo sapiens
agccccacagc

SEQ ID NO: 5838110 - DNA, 18 bp, Homo sapiens
agccccacagcacccagg

SEQ ID NO: 5838111 - DNA, 21 bp, Homo sapiens
agccccacagcacccaggctc

SEQ ID NO: 5838112 - DNA, 12 bp, Homo sapiens
agccccacagcc

SEQ ID NO: 5838113 - DNA, 13 bp, Homo sapiens
agccccacagccc

SEQ ID NO: 5838114 - DNA, 15 bp, Homo sapiens
agccccacagcccac

SEQ ID NO: 5838115 - DNA, 20 bp, Homo sapiens
agccccaccacatagcatgc

SEQ ID NO: 5838116 - DNA, 13 bp, Homo sapiens
agccccacccaga

SEQ ID NO: 5838117 - DNA, 14 bp, Homo sapiens
agccccacccagag

SEQ ID NO: 5838118 - DNA, 19 bp, Homo sapiens
agccccacccagaggtggc

SEQ ID NO: 5838119 - DNA, 23 bp, Homo sapiens
agccccacccagaggtggccctc

SEQ ID NO: 5838120 - DNA, 14 bp, Homo sapiens
agccccacccaggc

SEQ ID NO: 5838121 - DNA, 16 bp, Homo sapiens
agccccacccaggcca

SEQ ID NO: 5838122 - DNA, 14 bp, Homo sapiens
agccccaccccagg

SEQ ID NO: 5838123 - DNA, 16 bp, Homo sapiens
agccccacccccagcc

SEQ ID NO: 5838124 - DNA, 19 bp, Homo sapiens
agccccacccccagccagg

SEQ ID NO: 5838125 - DNA, 21 bp, Homo sapiens
agccccacccctaagtgccca

SEQ ID NO: 5838126 - DNA, 19 bp, Homo sapiens
agccccacccttgtccctc

SEQ ID NO: 5838127 - DNA, 15 bp, Homo sapiens
agccccacctctcca

SEQ ID NO: 5838128 - DNA, 19 bp, Homo sapiens
agccccactcccggccagg

SEQ ID NO: 5838129 - DNA, 14 bp, Homo sapiens
agccccactctcag

SEQ ID NO: 5838130 - DNA, 22 bp, Homo sapiens
agccccactctcagaggcccca

SEQ ID NO: 5838131 - DNA, 12 bp, Homo sapiens
agccccactgcc

SEQ ID NO: 5838132 - DNA, 17 bp, Homo sapiens
agccccactgccagcag

SEQ ID NO: 5838133 - DNA, 13 bp, Homo sapiens
agccccactgccc

SEQ ID NO: 5838134 - DNA, 18 bp, Homo sapiens
agccccactgccctccag

SEQ ID NO: 5838135 - DNA, 14 bp, Homo sapiens
agccccagaagaaa

SEQ ID NO: 5838136 - DNA, 21 bp, Homo sapiens
agccccagacaacagcccagg

SEQ ID NO: 5838137 - DNA, 12 bp, Homo sapiens
agccccagactg

SEQ ID NO: 5838138 - DNA, 22 bp, Homo sapiens
agccccagactgggcccaggca

SEQ ID NO: 5838139 - DNA, 13 bp, Homo sapiens
agccccagcacca

SEQ ID NO: 5838140 - DNA, 15 bp, Homo sapiens
agccccagcagccct

SEQ ID NO: 5838141 - DNA, 13 bp, Homo sapiens
agccccagccagg

SEQ ID NO: 5838142 - DNA, 14 bp, Homo sapiens
agccccagccccct

SEQ ID NO: 5838143 - DNA, 18 bp, Homo sapiens
agccccagccccctttgg

SEQ ID NO: 5838144 - DNA, 21 bp, Homo sapiens
agccccagccccgtcccagag

SEQ ID NO: 5838145 - DNA, 21 bp, Homo sapiens
agccccagcgagtctggagac

SEQ ID NO: 5838146 - DNA, 16 bp, Homo sapiens
agccccagcgggctgg

SEQ ID NO: 5838147 - DNA, 23 bp, Homo sapiens
agccccagcttatctcctcctcc

SEQ ID NO: 5838148 - DNA, 19 bp, Homo sapiens
agccccagcttggctcaca

SEQ ID NO: 5838149 - DNA, 14 bp, Homo sapiens
agccccaggaccaa

SEQ ID NO: 5838150 - DNA, 15 bp, Homo sapiens
agccccaggaccaag

SEQ ID NO: 5838151 - DNA, 20 bp, Homo sapiens
agccccaggcaggctgtgcg

SEQ ID NO: 5838152 - DNA, 12 bp, Homo sapiens
agccccaggcca

SEQ ID NO: 5838153 - DNA, 15 bp, Homo sapiens
agccccaggccagct

SEQ ID NO: 5838154 - DNA, 16 bp, Homo sapiens
agccccaggccagctg

SEQ ID NO: 5838155 - DNA, 12 bp, Homo sapiens
agccccaggccc

SEQ ID NO: 5838156 - DNA, 18 bp, Homo sapiens
agccccaggcctctgtgt

SEQ ID NO: 5838157 - DNA, 13 bp, Homo sapiens
agccccaggcctg

SEQ ID NO: 5838158 - DNA, 20 bp, Homo sapiens
agccccaggcctggcctcgc

SEQ ID NO: 5838159 - DNA, 15 bp, Homo sapiens
agccccagggccctg

SEQ ID NO: 5838160 - DNA, 16 bp, Homo sapiens
agccccagggccctgc

SEQ ID NO: 5838161 - DNA, 11 bp, Homo sapiens
agccccagggg

SEQ ID NO: 5838162 - DNA, 17 bp, Homo sapiens
agccccaggggggcctc

SEQ ID NO: 5838163 - DNA, 20 bp, Homo sapiens
agccccaggggggcctcctc

SEQ ID NO: 5838164 - DNA, 22 bp, Homo sapiens
agccccagggtcttccctacct

SEQ ID NO: 5838165 - DNA, 12 bp, Homo sapiens
agccccagggtg

SEQ ID NO: 5838166 - DNA, 15 bp, Homo sapiens
agccccagtcagaag

SEQ ID NO: 5838167 - DNA, 16 bp, Homo sapiens
agccccagtgcccaca

SEQ ID NO: 5838168 - DNA, 23 bp, Homo sapiens
agccccataattttttttttcct

SEQ ID NO: 5838169 - DNA, 17 bp, Homo sapiens
agccccatcagctccag

SEQ ID NO: 5838170 - DNA, 15 bp, Homo sapiens
agccccatcctctgt

SEQ ID NO: 5838171 - DNA, 18 bp, Homo sapiens
agccccatcctgccgccc

SEQ ID NO: 5838172 - DNA, 20 bp, Homo sapiens
agccccatccttcccgcagc

SEQ ID NO: 5838173 - DNA, 16 bp, Homo sapiens
agccccatctagggga

SEQ ID NO: 5838174 - DNA, 18 bp, Homo sapiens
agccccatctctcctgct

SEQ ID NO: 5838175 - DNA, 14 bp, Homo sapiens
agccccatcttcac

SEQ ID NO: 5838176 - DNA, 22 bp, Homo sapiens
agccccatcttggtcctgtcac

SEQ ID NO: 5838177 - DNA, 16 bp, Homo sapiens
agccccatgctggagc

SEQ ID NO: 5838178 - DNA, 17 bp, Homo sapiens
agccccatgctggagcc

SEQ ID NO: 5838179 - DNA, 17 bp, Homo sapiens
agccccattcacggcct

SEQ ID NO: 5838180 - DNA, 23 bp, Homo sapiens
agccccattcacggcctggcatg

SEQ ID NO: 5838181 - DNA, 24 bp, Homo sapiens
agccccattcacggcctggcatgc

SEQ ID NO: 5838182 - DNA, 13 bp, Homo sapiens
agccccattctgc

SEQ ID NO: 5838183 - DNA, 21 bp, Homo sapiens
agccccattctgcctgcccag

SEQ ID NO: 5838184 - DNA, 22 bp, Homo sapiens
agccccattctgcctgcccagg

SEQ ID NO: 5838185 - DNA, 20 bp, Homo sapiens
agcccccaaagagctgtggc

SEQ ID NO: 5838186 - DNA, 21 bp, Homo sapiens
agcccccaaagagctgtggct

SEQ ID NO: 5838187 - DNA, 14 bp, Homo sapiens
agcccccaacacag

SEQ ID NO: 5838188 - DNA, 21 bp, Homo sapiens
agcccccaaccccgcggtgct

SEQ ID NO: 5838189 - DNA, 13 bp, Homo sapiens
agcccccacagcc

SEQ ID NO: 5838190 - DNA, 16 bp, Homo sapiens
agcccccacagccctg

SEQ ID NO: 5838191 - DNA, 17 bp, Homo sapiens
agcccccacagccctgg

SEQ ID NO: 5838192 - DNA, 19 bp, Homo sapiens
agcccccacagccctggaa

SEQ ID NO: 5838193 - DNA, 11 bp, Homo sapiens
agcccccacca

SEQ ID NO: 5838194 - DNA, 17 bp, Homo sapiens
agcccccaccagcagca

SEQ ID NO: 5838195 - DNA, 20 bp, Homo sapiens
agcccccaccagcagcacaa

SEQ ID NO: 5838196 - DNA, 22 bp, Homo sapiens
agcccccacccatgccagcgca

SEQ ID NO: 5838197 - DNA, 17 bp, Homo sapiens
agcccccaccccagcac

SEQ ID NO: 5838198 - DNA, 21 bp, Homo sapiens
agcccccacccccgtcacccc

SEQ ID NO: 5838199 - DNA, 13 bp, Homo sapiens
agcccccaccctg

SEQ ID NO: 5838200 - DNA, 17 bp, Homo sapiens
agcccccaccctgttcc

SEQ ID NO: 5838201 - DNA, 21 bp, Homo sapiens
agcccccacctccgccccaga

SEQ ID NO: 5838202 - DNA, 17 bp, Homo sapiens
agcccccacctgcctga

SEQ ID NO: 5838203 - DNA, 14 bp, Homo sapiens
agcccccactgacc

SEQ ID NO: 5838204 - DNA, 15 bp, Homo sapiens
agcccccactgacct

SEQ ID NO: 5838205 - DNA, 21 bp, Homo sapiens
agcccccactgacctgcccat

SEQ ID NO: 5838206 - DNA, 22 bp, Homo sapiens
agcccccactgacctgcccatg

SEQ ID NO: 5838207 - DNA, 19 bp, Homo sapiens
agcccccactgcacccctg

SEQ ID NO: 5838208 - DNA, 23 bp, Homo sapiens
agcccccactttcctacaaaatg

SEQ ID NO: 5838209 - DNA, 14 bp, Homo sapiens
agcccccagagccc

SEQ ID NO: 5838210 - DNA, 22 bp, Homo sapiens
agcccccagatagagctgggtg

SEQ ID NO: 5838211 - DNA, 19 bp, Homo sapiens
agcccccagcagaggcagg

SEQ ID NO: 5838212 - DNA, 16 bp, Homo sapiens
agcccccagccctggg

SEQ ID NO: 5838213 - DNA, 14 bp, Homo sapiens
agcccccagcctgt

SEQ ID NO: 5838214 - DNA, 18 bp, Homo sapiens
agcccccagccttgtttc

SEQ ID NO: 5838215 - DNA, 16 bp, Homo sapiens
agcccccagcttccag

SEQ ID NO: 5838216 - DNA, 20 bp, Homo sapiens
agcccccagcttccagcagg

SEQ ID NO: 5838217 - DNA, 15 bp, Homo sapiens
agcccccaggaagac

SEQ ID NO: 5838218 - DNA, 17 bp, Homo sapiens
agcccccaggctgctgg

SEQ ID NO: 5838219 - DNA, 18 bp, Homo sapiens
agcccccaggctgctgga

SEQ ID NO: 5838220 - DNA, 12 bp, Homo sapiens
agcccccagggc

SEQ ID NO: 5838221 - DNA, 14 bp, Homo sapiens
agcccccagggccc

SEQ ID NO: 5838222 - DNA, 17 bp, Homo sapiens
agcccccagggcctcca

SEQ ID NO: 5838223 - DNA, 20 bp, Homo sapiens
agcccccagggcctccaggg

SEQ ID NO: 5838224 - DNA, 20 bp, Homo sapiens
agcccccatgggctcctgcc

SEQ ID NO: 5838225 - DNA, 22 bp, Homo sapiens
agccccccacctttctcgctgg

SEQ ID NO: 5838226 - DNA, 13 bp, Homo sapiens
agccccccactca

SEQ ID NO: 5838227 - DNA, 13 bp, Homo sapiens
agccccccagcac

SEQ ID NO: 5838228 - DNA, 12 bp, Homo sapiens
agccccccagct

SEQ ID NO: 5838229 - DNA, 16 bp, Homo sapiens
agccccccagctccca

SEQ ID NO: 5838230 - DNA, 19 bp, Homo sapiens
agccccccagctcccacac

SEQ ID NO: 5838231 - DNA, 14 bp, Homo sapiens
agccccccaggctg

SEQ ID NO: 5838232 - DNA, 18 bp, Homo sapiens
agcccccccaacactgtg

SEQ ID NO: 5838233 - DNA, 20 bp, Homo sapiens
agcccccccaacactgtgcc

SEQ ID NO: 5838234 - DNA, 22 bp, Homo sapiens
agcccccccaacactgtgccct

SEQ ID NO: 5838235 - DNA, 13 bp, Homo sapiens
agcccccccaccc

SEQ ID NO: 5838236 - DNA, 17 bp, Homo sapiens
agcccccccacccaccc

SEQ ID NO: 5838237 - DNA, 23 bp, Homo sapiens
agcccccccactccagcccgcag

SEQ ID NO: 5838238 - DNA, 22 bp, Homo sapiens
agccccccccttgaatctgcag

SEQ ID NO: 5838239 - DNA, 15 bp, Homo sapiens
agcccccccttccac

SEQ ID NO: 5838240 - DNA, 13 bp, Homo sapiens
agcccccctagca

SEQ ID NO: 5838241 - DNA, 20 bp, Homo sapiens
agcccccctgctgctgcccg

SEQ ID NO: 5838242 - DNA, 13 bp, Homo sapiens
agcccccctttgg

SEQ ID NO: 5838243 - DNA, 21 bp, Homo sapiens
agcccccctttggcactggat

SEQ ID NO: 5838244 - DNA, 23 bp, Homo sapiens
agcccccgcagtcgtcagcctcc

SEQ ID NO: 5838245 - DNA, 16 bp, Homo sapiens
agcccccgccccagag

SEQ ID NO: 5838246 - DNA, 17 bp, Homo sapiens
agcccccgccccagagt

SEQ ID NO: 5838247 - DNA, 23 bp, Homo sapiens
agcccccgccccgccccacattc

SEQ ID NO: 5838248 - DNA, 19 bp, Homo sapiens
agccccctaagagagcacc

SEQ ID NO: 5838249 - DNA, 14 bp, Homo sapiens
agccccctcacagt

SEQ ID NO: 5838250 - DNA, 17 bp, Homo sapiens
agccccctccacaccag

SEQ ID NO: 5838251 - DNA, 16 bp, Homo sapiens
agccccctccagctca

SEQ ID NO: 5838252 - DNA, 16 bp, Homo sapiens
agccccctcccaccgc

SEQ ID NO: 5838253 - DNA, 17 bp, Homo sapiens
agccccctcccaccgct

SEQ ID NO: 5838254 - DNA, 18 bp, Homo sapiens
agccccctcccaccgctg

SEQ ID NO: 5838255 - DNA, 22 bp, Homo sapiens
agccccctcccaccgctgcctc

SEQ ID NO: 5838256 - DNA, 13 bp, Homo sapiens
agccccctcctgg

SEQ ID NO: 5838257 - DNA, 14 bp, Homo sapiens
agccccctcttcct

SEQ ID NO: 5838258 - DNA, 15 bp, Homo sapiens
agccccctcttcctc

SEQ ID NO: 5838259 - DNA, 14 bp, Homo sapiens
agccccctgcaccc

SEQ ID NO: 5838260 - DNA, 13 bp, Homo sapiens
agccccctgccct

SEQ ID NO: 5838261 - DNA, 17 bp, Homo sapiens
agccccctgcttctccc

SEQ ID NO: 5838262 - DNA, 22 bp, Homo sapiens
agccccctggcagctgcccctc

SEQ ID NO: 5838263 - DNA, 15 bp, Homo sapiens
agccccctggcctct

SEQ ID NO: 5838264 - DNA, 14 bp, Homo sapiens
agccccctggcggc

SEQ ID NO: 5838265 - DNA, 22 bp, Homo sapiens
agccccctggtctttgagctcc

SEQ ID NO: 5838266 - DNA, 14 bp, Homo sapiens
agccccctgtcctt

SEQ ID NO: 5838267 - DNA, 23 bp, Homo sapiens
agccccctgtccttcccacggcc

SEQ ID NO: 5838268 - DNA, 12 bp, Homo sapiens
agccccctgtgc

SEQ ID NO: 5838269 - DNA, 14 bp, Homo sapiens
agccccctgtgccc

SEQ ID NO: 5838270 - DNA, 17 bp, Homo sapiens
agcccccttctccatgg

SEQ ID NO: 5838271 - DNA, 16 bp, Homo sapiens
agcccccttgacaccg

SEQ ID NO: 5838272 - DNA, 19 bp, Homo sapiens
agccccctttgggcccagg

SEQ ID NO: 5838273 - DNA, 21 bp, Homo sapiens
agccccctttgggcccaggga

SEQ ID NO: 5838274 - DNA, 21 bp, Homo sapiens
agccccgacccctgtccagcg

SEQ ID NO: 5838275 - DNA, 15 bp, Homo sapiens
agccccgactccagc

SEQ ID NO: 5838276 - DNA, 18 bp, Homo sapiens
agccccgactccagccag

SEQ ID NO: 5838277 - DNA, 13 bp, Homo sapiens
agccctgactcct

SEQ ID NO: 5838278 - DNA, 15 bp, Homo sapiens
agccctgactcctgg

SEQ ID NO: 5838279 - DNA, 17 bp, Homo sapiens
agccctgactcctggac

SEQ ID NO: 5838280 - DNA, 18 bp, Homo sapiens
agccctgactcctggact

SEQ ID NO: 5838281 - DNA, 17 bp, Homo sapiens
agccctgactggtgcta

SEQ ID NO: 5838282 - DNA, 15 bp, Homo sapiens
agccctgagcccaga

SEQ ID NO: 5838283 - DNA, 19 bp, Homo sapiens
agccctgagcccggccctc

SEQ ID NO: 5838284 - DNA, 20 bp, Homo sapiens
agccctgagcccggccctcc

SEQ ID NO: 5838285 - DNA, 16 bp, Homo sapiens
agccctgagcctggca

SEQ ID NO: 5838286 - DNA, 16 bp, Homo sapiens
agccctgagctcaggc

SEQ ID NO: 5838287 - DNA, 17 bp, Homo sapiens
agccctgagctcaggct

SEQ ID NO: 5838288 - DNA, 15 bp, Homo sapiens
agccctgagctttct

SEQ ID NO: 5838289 - DNA, 19 bp, Homo sapiens
agccctgaggacagatgcc

SEQ ID NO: 5838290 - DNA, 20 bp, Homo sapiens
agccctgaggacctctcagc

SEQ ID NO: 5838291 - DNA, 21 bp, Homo sapiens
agccctgaggacctctcagca

SEQ ID NO: 5838292 - DNA, 11 bp, Homo sapiens
agccctgaggg

SEQ ID NO: 5838293 - DNA, 14 bp, Homo sapiens
agccctgaggggtg

SEQ ID NO: 5838294 - DNA, 16 bp, Homo sapiens
agccctgaggggtgga

SEQ ID NO: 5838295 - DNA, 18 bp, Homo sapiens
agccctgagtggtcactg

SEQ ID NO: 5838296 - DNA, 22 bp, Homo sapiens
agccctgagtggtcactggtca

SEQ ID NO: 5838297 - DNA, 14 bp, Homo sapiens
agccctgagtgtcc

SEQ ID NO: 5838298 - DNA, 20 bp, Homo sapiens
agccctgagttggcatcacc

SEQ ID NO: 5838299 - DNA, 22 bp, Homo sapiens
agccctgagttggcatcacctg

SEQ ID NO: 5838300 - DNA, 23 bp, Homo sapiens
agccctgagtttcaagtatcctt

SEQ ID NO: 5838301 - DNA, 23 bp, Homo sapiens
agccctgatgtgtcctcagggag

SEQ ID NO: 5838302 - DNA, 12 bp, Homo sapiens
agccctgcaaat

SEQ ID NO: 5838303 - DNA, 13 bp, Homo sapiens
agccctgcaccat

SEQ ID NO: 5838304 - DNA, 14 bp, Homo sapiens
agccctgcaccatg

SEQ ID NO: 5838305 - DNA, 14 bp, Homo sapiens
agccctgcagaggg

SEQ ID NO: 5838306 - DNA, 16 bp, Homo sapiens
agccctgcagagggca

SEQ ID NO: 5838307 - DNA, 23 bp, Homo sapiens
agccctgcagccaaacagagcct

SEQ ID NO: 5838308 - DNA, 15 bp, Homo sapiens
agccctgcagcccaa

SEQ ID NO: 5838309 - DNA, 16 bp, Homo sapiens
agccctgcattttcat

SEQ ID NO: 5838310 - DNA, 13 bp, Homo sapiens
agccctgccactc

SEQ ID NO: 5838311 - DNA, 15 bp, Homo sapiens
agccctgccaggagg

SEQ ID NO: 5838312 - DNA, 16 bp, Homo sapiens
agccctgccaggaggc

SEQ ID NO: 5838313 - DNA, 17 bp, Homo sapiens
agccctgccaggaggct

SEQ ID NO: 5838314 - DNA, 14 bp, Homo sapiens
agccctgcccagag

SEQ ID NO: 5838315 - DNA, 11 bp, Homo sapiens
agccctgcccc

SEQ ID NO: 5838316 - DNA, 22 bp, Homo sapiens
agccctgccccacacctcctct

SEQ ID NO: 5838317 - DNA, 16 bp, Homo sapiens
agccctgccccaccca

SEQ ID NO: 5838318 - DNA, 14 bp, Homo sapiens
agccctgccctcac

SEQ ID NO: 5838319 - DNA, 16 bp, Homo sapiens
agccctgccctcccaa

SEQ ID NO: 5838320 - DNA, 19 bp, Homo sapiens
agccctgcctatcctctgt

SEQ ID NO: 5838321 - DNA, 12 bp, Homo sapiens
agccctgcctct

SEQ ID NO: 5838322 - DNA, 15 bp, Homo sapiens
agccctgcctctccg

SEQ ID NO: 5838323 - DNA, 18 bp, Homo sapiens
agccctgcctctccgccc

SEQ ID NO: 5838324 - DNA, 13 bp, Homo sapiens
agccctgcctctg

SEQ ID NO: 5838325 - DNA, 14 bp, Homo sapiens
agccctgcctggag

SEQ ID NO: 5838326 - DNA, 17 bp, Homo sapiens
agccctgcctggaggac

SEQ ID NO: 5838327 - DNA, 12 bp, Homo sapiens
agccctgctccc

SEQ ID NO: 5838328 - DNA, 13 bp, Homo sapiens
agccctgctccct

SEQ ID NO: 5838329 - DNA, 15 bp, Homo sapiens
agccctgctccctgc

SEQ ID NO: 5838330 - DNA, 17 bp, Homo sapiens
agccctgctccctgcct

SEQ ID NO: 5838331 - DNA, 22 bp, Homo sapiens
agccctgctcttctctccccag

SEQ ID NO: 5838332 - DNA, 13 bp, Homo sapiens
agccctgctcttt

SEQ ID NO: 5838333 - DNA, 18 bp, Homo sapiens
agccctgctctttctctg

SEQ ID NO: 5838334 - DNA, 19 bp, Homo sapiens
agccctgctctttctctga

SEQ ID NO: 5838335 - DNA, 21 bp, Homo sapiens
agccctgctctttctctgaga

SEQ ID NO: 5838336 - DNA, 12 bp, Homo sapiens
agccctgctgct

SEQ ID NO: 5838337 - DNA, 19 bp, Homo sapiens
agccctgctgctgcctgcc

SEQ ID NO: 5838338 - DNA, 21 bp, Homo sapiens
agccctgctgcttcctaactt

SEQ ID NO: 5838339 - DNA, 17 bp, Homo sapiens
agccctgctggccgcct

SEQ ID NO: 5838340 - DNA, 20 bp, Homo sapiens
agccctgctttgggctgccc

SEQ ID NO: 5838341 - DNA, 21 bp, Homo sapiens
agccctgctttgggctgccct

SEQ ID NO: 5838342 - DNA, 22 bp, Homo sapiens
agccctgctttgggctgccctg

SEQ ID NO: 5838343 - DNA, 22 bp, Homo sapiens
agccctgcttttgcataatgca

SEQ ID NO: 5838344 - DNA, 19 bp, Homo sapiens
agccctggacacccctgct

SEQ ID NO: 5838345 - DNA, 21 bp, Homo sapiens
agccctggacacccctgctct

SEQ ID NO: 5838346 - DNA, 12 bp, Homo sapiens
agccctggagac

SEQ ID NO: 5838347 - DNA, 22 bp, Homo sapiens
agccctggagagccccatggtg

SEQ ID NO: 5838348 - DNA, 18 bp, Homo sapiens
agccctggagccaactgc

SEQ ID NO: 5838349 - DNA, 19 bp, Homo sapiens
agccctggagccaactgct

SEQ ID NO: 5838350 - DNA, 12 bp, Homo sapiens
agccctggaggc

SEQ ID NO: 5838351 - DNA, 16 bp, Homo sapiens
agccctggaggtgcca

SEQ ID NO: 5838352 - DNA, 17 bp, Homo sapiens
agccctggaggtgccag

SEQ ID NO: 5838353 - DNA, 18 bp, Homo sapiens
agccctggatggcctctg

SEQ ID NO: 5838354 - DNA, 19 bp, Homo sapiens
agccctggatggcctctgg

SEQ ID NO: 5838355 - DNA, 12 bp, Homo sapiens
agccctggcagg

SEQ ID NO: 5838356 - DNA, 21 bp, Homo sapiens
agccctggcaggatgaccctg

SEQ ID NO: 5838357 - DNA, 14 bp, Homo sapiens
agccctggccaagc

SEQ ID NO: 5838358 - DNA, 15 bp, Homo sapiens
agccctggccaagct

SEQ ID NO: 5838359 - DNA, 12 bp, Homo sapiens
agccctggccag

SEQ ID NO: 5838360 - DNA, 15 bp, Homo sapiens
agccctggccagagg

SEQ ID NO: 5838361 - DNA, 13 bp, Homo sapiens
agccctggccagc

SEQ ID NO: 5838362 - DNA, 16 bp, Homo sapiens
agccctggccagccct

SEQ ID NO: 5838363 - DNA, 21 bp, Homo sapiens
agccctggccagcccttcctc

SEQ ID NO: 5838364 - DNA, 12 bp, Homo sapiens
agccctggcccc

SEQ ID NO: 5838365 - DNA, 14 bp, Homo sapiens
agccctggccccca

SEQ ID NO: 5838366 - DNA, 23 bp, Homo sapiens
agccctggcccccatcagccctg

SEQ ID NO: 5838367 - DNA, 14 bp, Homo sapiens
agccctggcccggt

SEQ ID NO: 5838368 - DNA, 15 bp, Homo sapiens
agccctggcccggtc

SEQ ID NO: 5838369 - DNA, 21 bp, Homo sapiens
agccctggcccggtcccagtc

SEQ ID NO: 5838370 - DNA, 16 bp, Homo sapiens
agccctggccctgccc

SEQ ID NO: 5838371 - DNA, 17 bp, Homo sapiens
agccctggccctgccca

SEQ ID NO: 5838372 - DNA, 13 bp, Homo sapiens
agccctggccttt

SEQ ID NO: 5838373 - DNA, 18 bp, Homo sapiens
agccctggctcccacctg

SEQ ID NO: 5838374 - DNA, 15 bp, Homo sapiens
agccctggctctgca

SEQ ID NO: 5838375 - DNA, 12 bp, Homo sapiens
agccctggctga

SEQ ID NO: 5838376 - DNA, 13 bp, Homo sapiens
agccctggctgaa

SEQ ID NO: 5838377 - DNA, 21 bp, Homo sapiens
agccctggctgaaggactgtg

SEQ ID NO: 5838378 - DNA, 15 bp, Homo sapiens
agccctgggaaccac

SEQ ID NO: 5838379 - DNA, 15 bp, Homo sapiens
agccctgggaccgct

SEQ ID NO: 5838380 - DNA, 20 bp, Homo sapiens
agccctgggaccgctacacc

SEQ ID NO: 5838381 - DNA, 18 bp, Homo sapiens
agccctgggaggctctgg

SEQ ID NO: 5838382 - DNA, 16 bp, Homo sapiens
agccctgggccccacc

SEQ ID NO: 5838383 - DNA, 21 bp, Homo sapiens
agccctgggccccaccaccta

SEQ ID NO: 5838384 - DNA, 12 bp, Homo sapiens
agccctgggctt

SEQ ID NO: 5838385 - DNA, 17 bp, Homo sapiens
agccctgggcttggctc

SEQ ID NO: 5838386 - DNA, 19 bp, Homo sapiens
agccctgggcttggctctt

SEQ ID NO: 5838387 - DNA, 18 bp, Homo sapiens
agccctggggactgttcc

SEQ ID NO: 5838388 - DNA, 15 bp, Homo sapiens
agccctggggcaggg

SEQ ID NO: 5838389 - DNA, 17 bp, Homo sapiens
agccctggggcagggtg

SEQ ID NO: 5838390 - DNA, 13 bp, Homo sapiens
agccctggggctg

SEQ ID NO: 5838391 - DNA, 15 bp, Homo sapiens
agccctgggggagcc

SEQ ID NO: 5838392 - DNA, 15 bp, Homo sapiens
agccctgggggccag

SEQ ID NO: 5838393 - DNA, 14 bp, Homo sapiens
agccctggtctcag

SEQ ID NO: 5838394 - DNA, 16 bp, Homo sapiens
agccctggtctcagca

SEQ ID NO: 5838395 - DNA, 16 bp, Homo sapiens
agccctggtgaccaga

SEQ ID NO: 5838396 - DNA, 18 bp, Homo sapiens
agccctggtgctcctgcc

SEQ ID NO: 5838397 - DNA, 22 bp, Homo sapiens
agccctggtggccaagcctgcc

SEQ ID NO: 5838398 - DNA, 20 bp, Homo sapiens
agccctggttagctgacagt

SEQ ID NO: 5838399 - DNA, 21 bp, Homo sapiens
agccctggttctccatcccca

SEQ ID NO: 5838400 - DNA, 22 bp, Homo sapiens
agccctggttctccatccccat

SEQ ID NO: 5838401 - DNA, 15 bp, Homo sapiens
agccctggttctggc

SEQ ID NO: 5838402 - DNA, 17 bp, Homo sapiens
agccctgtcagtgcagc

SEQ ID NO: 5838403 - DNA, 20 bp, Homo sapiens
agccctgtcagtgcagcccg

SEQ ID NO: 5838404 - DNA, 13 bp, Homo sapiens
agccctgtcctgg

SEQ ID NO: 5838405 - DNA, 17 bp, Homo sapiens
agccctgtcctggtggt

SEQ ID NO: 5838406 - DNA, 19 bp, Homo sapiens
agccctgtcctggttcctt

SEQ ID NO: 5838407 - DNA, 18 bp, Homo sapiens
agccctgtccttcagtct

SEQ ID NO: 5838408 - DNA, 19 bp, Homo sapiens
agccctgtccttcagtctt

SEQ ID NO: 5838409 - DNA, 17 bp, Homo sapiens
agccctgtcgagacact

SEQ ID NO: 5838410 - DNA, 21 bp, Homo sapiens
agccctgtcgagacacttgcc

SEQ ID NO: 5838411 - DNA, 11 bp, Homo sapiens
agccctgtctc

SEQ ID NO: 5838412 - DNA, 22 bp, Homo sapiens
agccctgtggccgactctgcac

SEQ ID NO: 5838413 - DNA, 21 bp, Homo sapiens
agccctgtggccgccacctga

SEQ ID NO: 5838414 - DNA, 20 bp, Homo sapiens
agccctgtgtctgtcacagg

SEQ ID NO: 5838415 - DNA, 17 bp, Homo sapiens
agccctgttcctccctc

SEQ ID NO: 5838416 - DNA, 13 bp, Homo sapiens
agccctgttctcg

SEQ ID NO: 5838417 - DNA, 17 bp, Homo sapiens
agccctgttgacacagg

SEQ ID NO: 5838418 - DNA, 18 bp, Homo sapiens
agccctgttgacacaggt

SEQ ID NO: 5838419 - DNA, 20 bp, Homo sapiens
agccctgttggcagctctag

SEQ ID NO: 5838420 - DNA, 19 bp, Homo sapiens
agcccttagcacagagagg

SEQ ID NO: 5838421 - DNA, 16 bp, Homo sapiens
agcccttagggagagc

SEQ ID NO: 5838422 - DNA, 16 bp, Homo sapiens
agcccttatggccaat

SEQ ID NO: 5838423 - DNA, 17 bp, Homo sapiens
agcccttcactgccatg

SEQ ID NO: 5838424 - DNA, 18 bp, Homo sapiens
agcccttcactgccatga

SEQ ID NO: 5838425 - DNA, 15 bp, Homo sapiens
agcccttcaggaagc

SEQ ID NO: 5838426 - DNA, 14 bp, Homo sapiens
agcccttcatttgg

SEQ ID NO: 5838427 - DNA, 10 bp, Homo sapiens
agcccttcca

SEQ ID NO: 5838428 - DNA, 14 bp, Homo sapiens
agcccttccagcct

SEQ ID NO: 5838429 - DNA, 17 bp, Homo sapiens
agcccttccagcctggg

SEQ ID NO: 5838430 - DNA, 18 bp, Homo sapiens
agcccttccagcctggga

SEQ ID NO: 5838431 - DNA, 14 bp, Homo sapiens
agcccttccagtgg

SEQ ID NO: 5838432 - DNA, 22 bp, Homo sapiens
agcccttccagtggtaccagct

SEQ ID NO: 5838433 - DNA, 22 bp, Homo sapiens
agcccttccatgtcgcctctgc

SEQ ID NO: 5838434 - DNA, 18 bp, Homo sapiens
agcccttcccaggccagc

SEQ ID NO: 5838435 - DNA, 17 bp, Homo sapiens
agcccttcccagggcac

SEQ ID NO: 5838436 - DNA, 22 bp, Homo sapiens
agcccttcccagggcacccagg

SEQ ID NO: 5838437 - DNA, 11 bp, Homo sapiens
agcccttccct

SEQ ID NO: 5838438 - DNA, 13 bp, Homo sapiens
agcccttccctga

SEQ ID NO: 5838439 - DNA, 15 bp, Homo sapiens
agcccttccctgcct

SEQ ID NO: 5838440 - DNA, 17 bp, Homo sapiens
agcccttccctgctttg

SEQ ID NO: 5838441 - DNA, 14 bp, Homo sapiens
agcccttcctcctg

SEQ ID NO: 5838442 - DNA, 22 bp, Homo sapiens
agcccttcctctcactcctgcc

SEQ ID NO: 5838443 - DNA, 17 bp, Homo sapiens
agcccttcctctgctcc

SEQ ID NO: 5838444 - DNA, 21 bp, Homo sapiens
agcccttcctctgctccccct

SEQ ID NO: 5838445 - DNA, 15 bp, Homo sapiens
agcccttccttgggc

SEQ ID NO: 5838446 - DNA, 16 bp, Homo sapiens
agcccttccttgggga

SEQ ID NO: 5838447 - DNA, 17 bp, Homo sapiens
agcccttccttggggaa

SEQ ID NO: 5838448 - DNA, 18 bp, Homo sapiens
agcccttcggtcacctgt

SEQ ID NO: 5838449 - DNA, 23 bp, Homo sapiens
agcccttctaccttcctgcaaca

SEQ ID NO: 5838450 - DNA, 13 bp, Homo sapiens
agcccttctcttt

SEQ ID NO: 5838451 - DNA, 15 bp, Homo sapiens
agcccttctctttga

SEQ ID NO: 5838452 - DNA, 14 bp, Homo sapiens
agcccttctgcctt

SEQ ID NO: 5838453 - DNA, 15 bp, Homo sapiens
agcccttctgccttt

SEQ ID NO: 5838454 - DNA, 19 bp, Homo sapiens
agcccttgaagtcacccgg

SEQ ID NO: 5838455 - DNA, 20 bp, Homo sapiens
agcccttgactgtacagaga

SEQ ID NO: 5838456 - DNA, 22 bp, Homo sapiens
agcccttgactgtacagagact

SEQ ID NO: 5838457 - DNA, 22 bp, Homo sapiens
agcctctcccggctgcctgccg

SEQ ID NO: 5838458 - DNA, 19 bp, Homo sapiens
agcctctccgactctgcac

SEQ ID NO: 5838459 - DNA, 20 bp, Homo sapiens
agcctctccgactctgcacc

SEQ ID NO: 5838460 - DNA, 18 bp, Homo sapiens
agcctctccttgcctggt

SEQ ID NO: 5838461 - DNA, 14 bp, Homo sapiens
agcctctcctttgt

SEQ ID NO: 5838462 - DNA, 15 bp, Homo sapiens
agcctctcctttgta

SEQ ID NO: 5838463 - DNA, 14 bp, Homo sapiens
agcctctctcccag

SEQ ID NO: 5838464 - DNA, 16 bp, Homo sapiens
agcctctctcccagtc

SEQ ID NO: 5838465 - DNA, 13 bp, Homo sapiens
agcctctctcctt

SEQ ID NO: 5838466 - DNA, 18 bp, Homo sapiens
agcctctctccttggcca

SEQ ID NO: 5838467 - DNA, 20 bp, Homo sapiens
agcctctctccttggccaca

SEQ ID NO: 5838468 - DNA, 23 bp, Homo sapiens
agcctctctccttggccacagac

SEQ ID NO: 5838469 - DNA, 16 bp, Homo sapiens
agcctctctctccctc

SEQ ID NO: 5838470 - DNA, 15 bp, Homo sapiens
agcctctctgctata

SEQ ID NO: 5838471 - DNA, 13 bp, Homo sapiens
agcctctctggct

SEQ ID NO: 5838472 - DNA, 15 bp, Homo sapiens
agcctctcttcactg

SEQ ID NO: 5838473 - DNA, 19 bp, Homo sapiens
agcctctgaagttggacag

SEQ ID NO: 5838474 - DNA, 19 bp, Homo sapiens
agcctctgacccctcctca

SEQ ID NO: 5838475 - DNA, 20 bp, Homo sapiens
agcctctgacccctcctcac

SEQ ID NO: 5838476 - DNA, 21 bp, Homo sapiens
agcctctgacccctcctcact

SEQ ID NO: 5838477 - DNA, 21 bp, Homo sapiens
agcctctgagatgatgcatga

SEQ ID NO: 5838478 - DNA, 18 bp, Homo sapiens
agcctctgagcccctggg

SEQ ID NO: 5838479 - DNA, 14 bp, Homo sapiens
agcctctgatctgt

SEQ ID NO: 5838480 - DNA, 15 bp, Homo sapiens
agcctctgatctgtg

SEQ ID NO: 5838481 - DNA, 19 bp, Homo sapiens
agcctctgcaactgcaaga

SEQ ID NO: 5838482 - DNA, 14 bp, Homo sapiens
agcctctgcagact

SEQ ID NO: 5838483 - DNA, 22 bp, Homo sapiens
agcctctgcagtcgcttgccaa

SEQ ID NO: 5838484 - DNA, 14 bp, Homo sapiens
agcctctgccaggc

SEQ ID NO: 5838485 - DNA, 22 bp, Homo sapiens
agcctctgcccaggcactgcta

SEQ ID NO: 5838486 - DNA, 12 bp, Homo sapiens
agcctctgcccc

SEQ ID NO: 5838487 - DNA, 15 bp, Homo sapiens
agcctctgccccaag

SEQ ID NO: 5838488 - DNA, 20 bp, Homo sapiens
agcctctgccccaaggggcc

SEQ ID NO: 5838489 - DNA, 19 bp, Homo sapiens
agcctctgccccacccatc

SEQ ID NO: 5838490 - DNA, 14 bp, Homo sapiens
agcctctgccctgc

SEQ ID NO: 5838491 - DNA, 20 bp, Homo sapiens
agcctctgccgctgccatgc

SEQ ID NO: 5838492 - DNA, 21 bp, Homo sapiens
agcctctgccgctgccatgct

SEQ ID NO: 5838493 - DNA, 22 bp, Homo sapiens
agcctctgccgctgccatgctt

SEQ ID NO: 5838494 - DNA, 21 bp, Homo sapiens
agcctctgcgcctctccactg

SEQ ID NO: 5838495 - DNA, 22 bp, Homo sapiens
agcctctgcgcctctccactgt

SEQ ID NO: 5838496 - DNA, 16 bp, Homo sapiens
agcctctgctccccag

SEQ ID NO: 5838497 - DNA, 12 bp, Homo sapiens
agcctctgctgc

SEQ ID NO: 5838498 - DNA, 14 bp, Homo sapiens
agcctctgctggaa

SEQ ID NO: 5838499 - DNA, 15 bp, Homo sapiens
agcctctgctggaga

SEQ ID NO: 5838500 - DNA, 16 bp, Homo sapiens
agcctctgctggagaa

SEQ ID NO: 5838501 - DNA, 20 bp, Homo sapiens
agcctctggaagggagggct

SEQ ID NO: 5838502 - DNA, 17 bp, Homo sapiens
agcctctggacagccag

SEQ ID NO: 5838503 - DNA, 18 bp, Homo sapiens
agcctctggactggaaag

SEQ ID NO: 5838504 - DNA, 22 bp, Homo sapiens
agcctctggcattagaattatt

SEQ ID NO: 5838505 - DNA, 13 bp, Homo sapiens
agcctctggcccc

SEQ ID NO: 5838506 - DNA, 18 bp, Homo sapiens
agcctctggcccctcacc

SEQ ID NO: 5838507 - DNA, 11 bp, Homo sapiens
agcctctggct

SEQ ID NO: 5838508 - DNA, 13 bp, Homo sapiens
agcctctggctag

SEQ ID NO: 5838509 - DNA, 15 bp, Homo sapiens
agcctctggctagag

SEQ ID NO: 5838510 - DNA, 20 bp, Homo sapiens
agcctctggctagaggccag

SEQ ID NO: 5838511 - DNA, 12 bp, Homo sapiens
agcctctggctt

SEQ ID NO: 5838512 - DNA, 17 bp, Homo sapiens
agcctctgggatctgcc

SEQ ID NO: 5838513 - DNA, 18 bp, Homo sapiens
agcctctgggatctgcca

SEQ ID NO: 5838514 - DNA, 12 bp, Homo sapiens
agcctctggggc

SEQ ID NO: 5838515 - DNA, 18 bp, Homo sapiens
agcctctggggcagagct

SEQ ID NO: 5838516 - DNA, 13 bp, Homo sapiens
agcctctgggggg

SEQ ID NO: 5838517 - DNA, 20 bp, Homo sapiens
agcctctggggggtggccag

SEQ ID NO: 5838518 - DNA, 21 bp, Homo sapiens
agcctctggggggtggccagg

SEQ ID NO: 5838519 - DNA, 16 bp, Homo sapiens
agcctctgtccgcctt

SEQ ID NO: 5838520 - DNA, 14 bp, Homo sapiens
agcctctgtctggc

SEQ ID NO: 5838521 - DNA, 14 bp, Homo sapiens
agcctctgtctttt

SEQ ID NO: 5838522 - DNA, 11 bp, Homo sapiens
agcctctgtgt

SEQ ID NO: 5838523 - DNA, 18 bp, Homo sapiens
agcctctgtgtcactggc

SEQ ID NO: 5838524 - DNA, 21 bp, Homo sapiens
agcctctgtgtcactggctgc

SEQ ID NO: 5838525 - DNA, 22 bp, Homo sapiens
agcctcttaaagctgcctgtag

SEQ ID NO: 5838526 - DNA, 24 bp, Homo sapiens
agcctcttaacctcttcttaccct

SEQ ID NO: 5838527 - DNA, 21 bp, Homo sapiens
agcctcttattccaggagaag

SEQ ID NO: 5838528 - DNA, 14 bp, Homo sapiens
agcctcttcagccc

SEQ ID NO: 5838529 - DNA, 11 bp, Homo sapiens
agcctcttcct

SEQ ID NO: 5838530 - DNA, 20 bp, Homo sapiens
agcctcttggaaatcaggta

SEQ ID NO: 5838531 - DNA, 19 bp, Homo sapiens
agcctcttgtgtaactaat

SEQ ID NO: 5838532 - DNA, 21 bp, Homo sapiens
agcctcttgtgtaactaattt

SEQ ID NO: 5838533 - DNA, 19 bp, Homo sapiens
agcctctttgtgtttttgt

SEQ ID NO: 5838534 - DNA, 15 bp, Homo sapiens
agcctctttttcctt

SEQ ID NO: 5838535 - DNA, 16 bp, Homo sapiens
agcctctttttccttc

SEQ ID NO: 5838536 - DNA, 23 bp, Homo sapiens
agcctctttttccttcttcagca

SEQ ID NO: 5838537 - DNA, 17 bp, Homo sapiens
agcctgaaagatacagg

SEQ ID NO: 5838538 - DNA, 20 bp, Homo sapiens
agcctgaaagatacagggga

SEQ ID NO: 5838539 - DNA, 16 bp, Homo sapiens
agcctgaaagtaattt

SEQ ID NO: 5838540 - DNA, 19 bp, Homo sapiens
agcctgaaccccagggctg

SEQ ID NO: 5838541 - DNA, 20 bp, Homo sapiens
agcctgaaccgttacaaaag

SEQ ID NO: 5838542 - DNA, 15 bp, Homo sapiens
agcctgaactattta

SEQ ID NO: 5838543 - DNA, 18 bp, Homo sapiens
agcctgaactgagcccca

SEQ ID NO: 5838544 - DNA, 15 bp, Homo sapiens
agcctgaactgaggc

SEQ ID NO: 5838545 - DNA, 18 bp, Homo sapiens
agcctgaagatcagagct

SEQ ID NO: 5838546 - DNA, 19 bp, Homo sapiens
agcctgaagatcagagctg

SEQ ID NO: 5838547 - DNA, 16 bp, Homo sapiens
agcctgaagcctggat

SEQ ID NO: 5838548 - DNA, 17 bp, Homo sapiens
agcctgaagctggcctg

SEQ ID NO: 5838549 - DNA, 20 bp, Homo sapiens
agcctgaagctggcctggac

SEQ ID NO: 5838550 - DNA, 15 bp, Homo sapiens
agcctgaagggcctc

SEQ ID NO: 5838551 - DNA, 20 bp, Homo sapiens
agcctgaataaaccaagaca

SEQ ID NO: 5838552 - DNA, 21 bp, Homo sapiens
agcctgaattgctttctgctc

SEQ ID NO: 5838553 - DNA, 15 bp, Homo sapiens
agcctgacaacagcc

SEQ ID NO: 5838554 - DNA, 18 bp, Homo sapiens
agcctgacaacagcctga

SEQ ID NO: 5838555 - DNA, 19 bp, Homo sapiens
agcctgacaacagcctgag

SEQ ID NO: 5838556 - DNA, 17 bp, Homo sapiens
agcctgaccaaaagtga

SEQ ID NO: 5838557 - DNA, 19 bp, Homo sapiens
agcctgacccggaggaaag

SEQ ID NO: 5838558 - DNA, 16 bp, Homo sapiens
agcctgacctttctga

SEQ ID NO: 5838559 - DNA, 17 bp, Homo sapiens
agcctgacgctcagccc

SEQ ID NO: 5838560 - DNA, 22 bp, Homo sapiens
agcctgacgctcagccccaggc

SEQ ID NO: 5838561 - DNA, 13 bp, Homo sapiens
agcctgactagaa

SEQ ID NO: 5838562 - DNA, 23 bp, Homo sapiens
agcctgactagaactcctgtctt

SEQ ID NO: 5838563 - DNA, 16 bp, Homo sapiens
agcctgactgccagga

SEQ ID NO: 5838564 - DNA, 19 bp, Homo sapiens
agcctgactttggggacac

SEQ ID NO: 5838565 - DNA, 11 bp, Homo sapiens
agcctgagaat

SEQ ID NO: 5838566 - DNA, 13 bp, Homo sapiens
agcctgagactgg

SEQ ID NO: 5838567 - DNA, 12 bp, Homo sapiens
agcctgagagct

SEQ ID NO: 5838568 - DNA, 16 bp, Homo sapiens
agcctgagagctggcc

SEQ ID NO: 5838569 - DNA, 20 bp, Homo sapiens
agcctgagatggatggacag

SEQ ID NO: 5838570 - DNA, 21 bp, Homo sapiens
agcctgagatggatggacaga

SEQ ID NO: 5838571 - DNA, 21 bp, Homo sapiens
agcctgagcaactcttgatta

SEQ ID NO: 5838572 - DNA, 22 bp, Homo sapiens
agcctgagcaagacgccctctc

SEQ ID NO: 5838573 - DNA, 14 bp, Homo sapiens
agcctgagccacag

SEQ ID NO: 5838574 - DNA, 20 bp, Homo sapiens
agcctgagccacagtggggc

SEQ ID NO: 5838575 - DNA, 21 bp, Homo sapiens
agcctgagccttagctcccag

SEQ ID NO: 5838576 - DNA, 21 bp, Homo sapiens
agcctgagcggaggctcggcc

SEQ ID NO: 5838577 - DNA, 14 bp, Homo sapiens
agcctgagctccac

SEQ ID NO: 5838578 - DNA, 16 bp, Homo sapiens
agcctgagctccaccc

SEQ ID NO: 5838579 - DNA, 14 bp, Homo sapiens
agcctgaggaagtt

SEQ ID NO: 5838580 - DNA, 14 bp, Homo sapiens
agcctgaggacaga

SEQ ID NO: 5838581 - DNA, 12 bp, Homo sapiens
agcctgaggcag

SEQ ID NO: 5838582 - DNA, 16 bp, Homo sapiens
agcctgaggcaggaga

SEQ ID NO: 5838583 - DNA, 13 bp, Homo sapiens
agcctgaggcctt

SEQ ID NO: 5838584 - DNA, 11 bp, Homo sapiens
agcctgaggct

SEQ ID NO: 5838585 - DNA, 19 bp, Homo sapiens
agcctgagggaaaggccag

SEQ ID NO: 5838586 - DNA, 15 bp, Homo sapiens
agcctgagggaggag

SEQ ID NO: 5838587 - DNA, 13 bp, Homo sapiens
agcctgaggtccc

SEQ ID NO: 5838588 - DNA, 19 bp, Homo sapiens
agcctgagtactccacact

SEQ ID NO: 5838589 - DNA, 19 bp, Homo sapiens
agcctgagtcagggcccag

SEQ ID NO: 5838590 - DNA, 18 bp, Homo sapiens
agcctgagtctcctgtgc

SEQ ID NO: 5838591 - DNA, 14 bp, Homo sapiens
agcctgagtggtga

SEQ ID NO: 5838592 - DNA, 15 bp, Homo sapiens
agcctgagtggtgag

SEQ ID NO: 5838593 - DNA, 19 bp, Homo sapiens
agcctgatcacctgccctg

SEQ ID NO: 5838594 - DNA, 21 bp, Homo sapiens
agcctgatcaggcttcctggt

SEQ ID NO: 5838595 - DNA, 17 bp, Homo sapiens
agcctgatctcttcctg

SEQ ID NO: 5838596 - DNA, 22 bp, Homo sapiens
agcctgatctttgggcatcaga

SEQ ID NO: 5838597 - DNA, 17 bp, Homo sapiens
agcctgatgatggaagg

SEQ ID NO: 5838598 - DNA, 19 bp, Homo sapiens
agcctgatggtatactact

SEQ ID NO: 5838599 - DNA, 14 bp, Homo sapiens
agcctgattaaaga

SEQ ID NO: 5838600 - DNA, 21 bp, Homo sapiens
agcctgcaactcatctttcat

SEQ ID NO: 5838601 - DNA, 16 bp, Homo sapiens
agcctgcacacacctg

SEQ ID NO: 5838602 - DNA, 18 bp, Homo sapiens
agcctgcacacacctgcc

SEQ ID NO: 5838603 - DNA, 19 bp, Homo sapiens
agcctgcacacacctgcct

SEQ ID NO: 5838604 - DNA, 21 bp, Homo sapiens
agcctgcacacacctgcctgc

SEQ ID NO: 5838605 - DNA, 24 bp, Homo sapiens
agcctgcacccctccggccccgtc

SEQ ID NO: 5838606 - DNA, 19 bp, Homo sapiens
agcctgcacctgccccgtg

SEQ ID NO: 5838607 - DNA, 22 bp, Homo sapiens
agcctgcacctgccccgtgtgt

SEQ ID NO: 5838608 - DNA, 23 bp, Homo sapiens
agcctgcacttgggggctcagca

SEQ ID NO: 5838609 - DNA, 16 bp, Homo sapiens
agcctgcactttgatg

SEQ ID NO: 5838610 - DNA, 17 bp, Homo sapiens
agcctgcactttgatgt

SEQ ID NO: 5838611 - DNA, 12 bp, Homo sapiens
agcctgcagagc

SEQ ID NO: 5838612 - DNA, 14 bp, Homo sapiens
agcctgcagagctg

SEQ ID NO: 5838613 - DNA, 15 bp, Homo sapiens
agcctgcagagctgc

SEQ ID NO: 5838614 - DNA, 16 bp, Homo sapiens
agcctgcagcgagctg

SEQ ID NO: 5838615 - DNA, 18 bp, Homo sapiens
agcctgcagcgagctgag

SEQ ID NO: 5838616 - DNA, 21 bp, Homo sapiens
agcctgcaggacctcgtgcca

SEQ ID NO: 5838617 - DNA, 16 bp, Homo sapiens
agcctgcaggcaggtg

SEQ ID NO: 5838618 - DNA, 19 bp, Homo sapiens
agcctgcagggaagcccca

SEQ ID NO: 5838619 - DNA, 23 bp, Homo sapiens
agcctgcagggtggtgctgggac

SEQ ID NO: 5838620 - DNA, 15 bp, Homo sapiens
agcctgcaggtgctg

SEQ ID NO: 5838621 - DNA, 20 bp, Homo sapiens
agcctgcaggtgctgctgcg

SEQ ID NO: 5838622 - DNA, 23 bp, Homo sapiens
agcctgcagttattaacactaac

SEQ ID NO: 5838623 - DNA, 21 bp, Homo sapiens
agcctgcatcccaggatgctg

SEQ ID NO: 5838624 - DNA, 22 bp, Homo sapiens
agcctgcatctagctggagccc

SEQ ID NO: 5838625 - DNA, 23 bp, Homo sapiens
agcctgcattatgcacgtgtctg

SEQ ID NO: 5838626 - DNA, 14 bp, Homo sapiens
agcctgcattctgc

SEQ ID NO: 5838627 - DNA, 21 bp, Homo sapiens
agcctgcattctgcacgctgc

SEQ ID NO: 5838628 - DNA, 11 bp, Homo sapiens
agcctgccagc

SEQ ID NO: 5838629 - DNA, 13 bp, Homo sapiens
agcctgccaggcc

SEQ ID NO: 5838630 - DNA, 14 bp, Homo sapiens
agcctgccaggccc

SEQ ID NO: 5838631 - DNA, 20 bp, Homo sapiens
agcctgccaggccctccagc

SEQ ID NO: 5838632 - DNA, 21 bp, Homo sapiens
agcctgccaggccctccagca

SEQ ID NO: 5838633 - DNA, 21 bp, Homo sapiens
agcctgcccaagcccaggcca

SEQ ID NO: 5838634 - DNA, 20 bp, Homo sapiens
agccttacgacactttggtt

SEQ ID NO: 5838635 - DNA, 15 bp, Homo sapiens
agccttacttcaaag

SEQ ID NO: 5838636 - DNA, 22 bp, Homo sapiens
agccttacttcaaagtgcctgg

SEQ ID NO: 5838637 - DNA, 22 bp, Homo sapiens
agccttagaagtcacacagtat

SEQ ID NO: 5838638 - DNA, 16 bp, Homo sapiens
agccttagcagccctg

SEQ ID NO: 5838639 - DNA, 20 bp, Homo sapiens
agccttagcatcccctgtga

SEQ ID NO: 5838640 - DNA, 22 bp, Homo sapiens
agccttagcccggatgcccacc

SEQ ID NO: 5838641 - DNA, 13 bp, Homo sapiens
agccttagctgcc

SEQ ID NO: 5838642 - DNA, 20 bp, Homo sapiens
agccttagggaagctggcct

SEQ ID NO: 5838643 - DNA, 23 bp, Homo sapiens
agccttagtgtcacctttcttct

SEQ ID NO: 5838644 - DNA, 21 bp, Homo sapiens
agccttagttaccctgatctg

SEQ ID NO: 5838645 - DNA, 18 bp, Homo sapiens
agccttagtttcagctga

SEQ ID NO: 5838646 - DNA, 17 bp, Homo sapiens
agccttatcaagtgtct

SEQ ID NO: 5838647 - DNA, 19 bp, Homo sapiens
agccttatcaagtgtcttc

SEQ ID NO: 5838648 - DNA, 18 bp, Homo sapiens
agccttatgaaaattata

SEQ ID NO: 5838649 - DNA, 16 bp, Homo sapiens
agccttattaaaatat

SEQ ID NO: 5838650 - DNA, 18 bp, Homo sapiens
agccttattaaaatattt

SEQ ID NO: 5838651 - DNA, 16 bp, Homo sapiens
agccttattctaaggt

SEQ ID NO: 5838652 - DNA, 19 bp, Homo sapiens
agccttatttacctagtgc

SEQ ID NO: 5838653 - DNA, 14 bp, Homo sapiens
agccttatttctag

SEQ ID NO: 5838654 - DNA, 22 bp, Homo sapiens
agccttatttctagaagcacat

SEQ ID NO: 5838655 - DNA, 21 bp, Homo sapiens
agccttatttttgtatgcctt

SEQ ID NO: 5838656 - DNA, 22 bp, Homo sapiens
agccttatttttgtatgccttt

SEQ ID NO: 5838657 - DNA, 22 bp, Homo sapiens
agccttcaaaactatagcttgc

SEQ ID NO: 5838658 - DNA, 18 bp, Homo sapiens
agccttcaagaatcagaa

SEQ ID NO: 5838659 - DNA, 15 bp, Homo sapiens
agccttcaagctctg

SEQ ID NO: 5838660 - DNA, 17 bp, Homo sapiens
agccttcaagctctgag

SEQ ID NO: 5838661 - DNA, 19 bp, Homo sapiens
agccttcaagctctgaggg

SEQ ID NO: 5838662 - DNA, 15 bp, Homo sapiens
agccttcaagtgcca

SEQ ID NO: 5838663 - DNA, 15 bp, Homo sapiens
agccttcacatgaaa

SEQ ID NO: 5838664 - DNA, 15 bp, Homo sapiens
agccttcactggaga

SEQ ID NO: 5838665 - DNA, 13 bp, Homo sapiens
agccttcagcagc

SEQ ID NO: 5838666 - DNA, 17 bp, Homo sapiens
agccttcaggccagctg

SEQ ID NO: 5838667 - DNA, 18 bp, Homo sapiens
agccttcaggccagctgg

SEQ ID NO: 5838668 - DNA, 23 bp, Homo sapiens
agccttcagtcttgaatttctaa

SEQ ID NO: 5838669 - DNA, 22 bp, Homo sapiens
agccttcatcagaactcttcct

SEQ ID NO: 5838670 - DNA, 22 bp, Homo sapiens
agccttcatttgcaattcatgt

SEQ ID NO: 5838671 - DNA, 13 bp, Homo sapiens
agccttccaacat

SEQ ID NO: 5838672 - DNA, 19 bp, Homo sapiens
agccttccaacatttcttg

SEQ ID NO: 5838673 - DNA, 21 bp, Homo sapiens
agccttccaactagctgggac

SEQ ID NO: 5838674 - DNA, 14 bp, Homo sapiens
agccttccacccag

SEQ ID NO: 5838675 - DNA, 15 bp, Homo sapiens
agccttccacccagg

SEQ ID NO: 5838676 - DNA, 23 bp, Homo sapiens
agccttccaccggcactcatgac

SEQ ID NO: 5838677 - DNA, 14 bp, Homo sapiens
agccttccaggggt

SEQ ID NO: 5838678 - DNA, 15 bp, Homo sapiens
agccttccagtggct

SEQ ID NO: 5838679 - DNA, 20 bp, Homo sapiens
agccttccagtggcttctcc

SEQ ID NO: 5838680 - DNA, 13 bp, Homo sapiens
agccttccagttt

SEQ ID NO: 5838681 - DNA, 15 bp, Homo sapiens
agccttccagttttg

SEQ ID NO: 5838682 - DNA, 19 bp, Homo sapiens
agccttcccccagcaaggc

SEQ ID NO: 5838683 - DNA, 19 bp, Homo sapiens
agccttccccctcccaggg

SEQ ID NO: 5838684 - DNA, 13 bp, Homo sapiens
agccttcccctcc

SEQ ID NO: 5838685 - DNA, 14 bp, Homo sapiens
agccttcccctccc

SEQ ID NO: 5838686 - DNA, 18 bp, Homo sapiens
agccttccctctgcattg

SEQ ID NO: 5838687 - DNA, 23 bp, Homo sapiens
agccttcctccacatcctttcta

SEQ ID NO: 5838688 - DNA, 14 bp, Homo sapiens
agccttccttctgc

SEQ ID NO: 5838689 - DNA, 21 bp, Homo sapiens
agccttcctttctcctgcccc

SEQ ID NO: 5838690 - DNA, 18 bp, Homo sapiens
agccttcgaaaagaaatt

SEQ ID NO: 5838691 - DNA, 12 bp, Homo sapiens
agccttcggaca

SEQ ID NO: 5838692 - DNA, 22 bp, Homo sapiens
agccttctaaatgagtcactga

SEQ ID NO: 5838693 - DNA, 18 bp, Homo sapiens
agccttctcaccccagga

SEQ ID NO: 5838694 - DNA, 18 bp, Homo sapiens
agccttctcagaagcaca

SEQ ID NO: 5838695 - DNA, 11 bp, Homo sapiens
agccttctccc

SEQ ID NO: 5838696 - DNA, 15 bp, Homo sapiens
agccttctcctccca

SEQ ID NO: 5838697 - DNA, 13 bp, Homo sapiens
agccttctcctgc

SEQ ID NO: 5838698 - DNA, 14 bp, Homo sapiens
agccttctctctct

SEQ ID NO: 5838699 - DNA, 15 bp, Homo sapiens
agccttctctgttca

SEQ ID NO: 5838700 - DNA, 22 bp, Homo sapiens
agccttctctgttcatttcctc

SEQ ID NO: 5838701 - DNA, 19 bp, Homo sapiens
agccttctgagctggcctc

SEQ ID NO: 5838702 - DNA, 14 bp, Homo sapiens
agccttctgccacc

SEQ ID NO: 5838703 - DNA, 13 bp, Homo sapiens
agccttctggatc

SEQ ID NO: 5838704 - DNA, 17 bp, Homo sapiens
agccttctggatccatg

SEQ ID NO: 5838705 - DNA, 18 bp, Homo sapiens
agccttctggatccatgg

SEQ ID NO: 5838706 - DNA, 20 bp, Homo sapiens
agccttcttatatctgaaga

SEQ ID NO: 5838707 - DNA, 21 bp, Homo sapiens
agccttcttccctcggggagc

SEQ ID NO: 5838708 - DNA, 15 bp, Homo sapiens
agccttcttgctgcc

SEQ ID NO: 5838709 - DNA, 16 bp, Homo sapiens
agccttcttgctgccc

SEQ ID NO: 5838710 - DNA, 17 bp, Homo sapiens
agccttcttgctgccca

SEQ ID NO: 5838711 - DNA, 18 bp, Homo sapiens
agccttcttgctgcccac

SEQ ID NO: 5838712 - DNA, 18 bp, Homo sapiens
agccttctttttctggac

SEQ ID NO: 5838713 - DNA, 16 bp, Homo sapiens
agccttgaactttgac

SEQ ID NO: 5838714 - DNA, 20 bp, Homo sapiens
agccttgaagaaaatgactt

SEQ ID NO: 5838715 - DNA, 22 bp, Homo sapiens
agccttgaagaaaatgacttta

SEQ ID NO: 5838716 - DNA, 17 bp, Homo sapiens
agccttgagagacccag

SEQ ID NO: 5838717 - DNA, 17 bp, Homo sapiens
agccttgataatacttg

SEQ ID NO: 5838718 - DNA, 19 bp, Homo sapiens
agccttgataatacttgac

SEQ ID NO: 5838719 - DNA, 21 bp, Homo sapiens
agccttgattcccttgttatt

SEQ ID NO: 5838720 - DNA, 17 bp, Homo sapiens
agccttgatttgttctt

SEQ ID NO: 5838721 - DNA, 20 bp, Homo sapiens
agccttgatttgttcttaca

SEQ ID NO: 5838722 - DNA, 23 bp, Homo sapiens
agccttgcaacccaaggtgaggt

SEQ ID NO: 5838723 - DNA, 17 bp, Homo sapiens
agccttgcacacccact

SEQ ID NO: 5838724 - DNA, 18 bp, Homo sapiens
agccttgcacacccactg

SEQ ID NO: 5838725 - DNA, 19 bp, Homo sapiens
agccttgcacacccactgc

SEQ ID NO: 5838726 - DNA, 22 bp, Homo sapiens
agccttgcacacccactgcccc

SEQ ID NO: 5838727 - DNA, 23 bp, Homo sapiens
agccttgcactaggttgcagaga

SEQ ID NO: 5838728 - DNA, 18 bp, Homo sapiens
agccttgcactgtggggg

SEQ ID NO: 5838729 - DNA, 23 bp, Homo sapiens
agccttgcagatatctgcatgtg

SEQ ID NO: 5838730 - DNA, 18 bp, Homo sapiens
agccttgcatgtacttga

SEQ ID NO: 5838731 - DNA, 22 bp, Homo sapiens
agccttgcatgtacttgaagga

SEQ ID NO: 5838732 - DNA, 17 bp, Homo sapiens
agccttgccagagatcc

SEQ ID NO: 5838733 - DNA, 19 bp, Homo sapiens
agccttgccagagatccaa

SEQ ID NO: 5838734 - DNA, 13 bp, Homo sapiens
agccttgcccagc

SEQ ID NO: 5838735 - DNA, 15 bp, Homo sapiens
agccttgcccagctt

SEQ ID NO: 5838736 - DNA, 21 bp, Homo sapiens
agccttgcccggattctggga

SEQ ID NO: 5838737 - DNA, 22 bp, Homo sapiens
agccttgcctaaatttaatgct

SEQ ID NO: 5838738 - DNA, 23 bp, Homo sapiens
agccttgcctaaatttaatgctg

SEQ ID NO: 5838739 - DNA, 19 bp, Homo sapiens
agccttgcgcaaaacccag

SEQ ID NO: 5838740 - DNA, 13 bp, Homo sapiens
agccttgcgctgt

SEQ ID NO: 5838741 - DNA, 21 bp, Homo sapiens
agccttgcgctgtcccaggca

SEQ ID NO: 5838742 - DNA, 16 bp, Homo sapiens
agccttgctcaggtgc

SEQ ID NO: 5838743 - DNA, 11 bp, Homo sapiens
agccttgctct

SEQ ID NO: 5838744 - DNA, 16 bp, Homo sapiens
agccttgctctcttca

SEQ ID NO: 5838745 - DNA, 14 bp, Homo sapiens
agccttgctgccaa

SEQ ID NO: 5838746 - DNA, 11 bp, Homo sapiens
agccttgctgg

SEQ ID NO: 5838747 - DNA, 15 bp, Homo sapiens
agccttgctgggcca

SEQ ID NO: 5838748 - DNA, 17 bp, Homo sapiens
agccttgctgggccagg

SEQ ID NO: 5838749 - DNA, 17 bp, Homo sapiens
agccttgctgtagagac

SEQ ID NO: 5838750 - DNA, 22 bp, Homo sapiens
agccttgctgtagagacttccg

SEQ ID NO: 5838751 - DNA, 23 bp, Homo sapiens
agccttggaaccagccccatcag

SEQ ID NO: 5838752 - DNA, 20 bp, Homo sapiens
agccttggataatgctgttg

SEQ ID NO: 5838753 - DNA, 22 bp, Homo sapiens
agccttggataatgctgttgcc

SEQ ID NO: 5838754 - DNA, 23 bp, Homo sapiens
agccttggcacgaggggggccag

SEQ ID NO: 5838755 - DNA, 22 bp, Homo sapiens
agccttggccgcataggcccag

SEQ ID NO: 5838756 - DNA, 17 bp, Homo sapiens
agccttggcctcagagg

SEQ ID NO: 5838757 - DNA, 19 bp, Homo sapiens
agccttggcctctttcctc

SEQ ID NO: 5838758 - DNA, 17 bp, Homo sapiens
agccttggcctgacctg

SEQ ID NO: 5838759 - DNA, 17 bp, Homo sapiens
agccttggctcgttctc

SEQ ID NO: 5838760 - DNA, 22 bp, Homo sapiens
agccttggctcgttctcttctc

SEQ ID NO: 5838761 - DNA, 17 bp, Homo sapiens
agccttgggcctttcag

SEQ ID NO: 5838762 - DNA, 22 bp, Homo sapiens
agccttgggcctttcagtccca

SEQ ID NO: 5838763 - DNA, 19 bp, Homo sapiens
agccttgggggggctgcct

SEQ ID NO: 5838764 - DNA, 22 bp, Homo sapiens
agccttgggggggctgcctttg

SEQ ID NO: 5838765 - DNA, 22 bp, Homo sapiens
agccttggtgggggagcctctg

SEQ ID NO: 5838766 - DNA, 18 bp, Homo sapiens
agccttggtgtccacctg

SEQ ID NO: 5838767 - DNA, 20 bp, Homo sapiens
agccttggttcatcagtgtt

SEQ ID NO: 5838768 - DNA, 15 bp, Homo sapiens
agccttggttcctga

SEQ ID NO: 5838769 - DNA, 18 bp, Homo sapiens
agccttgtacagtctgct

SEQ ID NO: 5838770 - DNA, 22 bp, Homo sapiens
agccttgtacagtctgctcctc

SEQ ID NO: 5838771 - DNA, 13 bp, Homo sapiens
agccttgtcagtg

SEQ ID NO: 5838772 - DNA, 16 bp, Homo sapiens
agccttgtcagtgtgt

SEQ ID NO: 5838773 - DNA, 21 bp, Homo sapiens
agccttgtgagatccttcaca

SEQ ID NO: 5838774 - DNA, 14 bp, Homo sapiens
agccttgtgccctg

SEQ ID NO: 5838775 - DNA, 16 bp, Homo sapiens
agccttgtgccctgcc

SEQ ID NO: 5838776 - DNA, 20 bp, Homo sapiens
agccttgtgtctacagagaa

SEQ ID NO: 5838777 - DNA, 14 bp, Homo sapiens
agccttgtttctga

SEQ ID NO: 5838778 - DNA, 20 bp, Homo sapiens
agccttgttttctctgtgtg

SEQ ID NO: 5838779 - DNA, 14 bp, Homo sapiens
agcctttaaaacca

SEQ ID NO: 5838780 - DNA, 22 bp, Homo sapiens
agcctttaaatcatttttatat

SEQ ID NO: 5838781 - DNA, 13 bp, Homo sapiens
agcctttaaattg

SEQ ID NO: 5838782 - DNA, 14 bp, Homo sapiens
agcctttaatgcat

SEQ ID NO: 5838783 - DNA, 23 bp, Homo sapiens
agcctttaccctcctctatttct

SEQ ID NO: 5838784 - DNA, 19 bp, Homo sapiens
agcctttaccttttatgca

SEQ ID NO: 5838785 - DNA, 22 bp, Homo sapiens
agcctttactgaccctggggct

SEQ ID NO: 5838786 - DNA, 16 bp, Homo sapiens
agcctttactgtttga

SEQ ID NO: 5838787 - DNA, 19 bp, Homo sapiens
agcctttactgtttgatat

SEQ ID NO: 5838788 - DNA, 18 bp, Homo sapiens
agcctttatctatgggag

SEQ ID NO: 5838789 - DNA, 16 bp, Homo sapiens
agcctttcattttgct

SEQ ID NO: 5838790 - DNA, 21 bp, Homo sapiens
agcctttcattttgctttaat

SEQ ID NO: 5838791 - DNA, 14 bp, Homo sapiens
agcctttccagaac

SEQ ID NO: 5838792 - DNA, 14 bp, Homo sapiens
agcctttccagcct

SEQ ID NO: 5838793 - DNA, 22 bp, Homo sapiens
agcctttccataaggaatgtag

SEQ ID NO: 5838794 - DNA, 23 bp, Homo sapiens
agcctttctaaggctcagcccca

SEQ ID NO: 5838795 - DNA, 13 bp, Homo sapiens
agcctttctccag

SEQ ID NO: 5838796 - DNA, 15 bp, Homo sapiens
agcctttctctcttt

SEQ ID NO: 5838797 - DNA, 22 bp, Homo sapiens
agcctttctgtatcaagcccct

SEQ ID NO: 5838798 - DNA, 23 bp, Homo sapiens
agcctttctgtggagagtgagaa

SEQ ID NO: 5838799 - DNA, 15 bp, Homo sapiens
agcctttgaaaatac

SEQ ID NO: 5838800 - DNA, 11 bp, Homo sapiens
agcctttgaat

SEQ ID NO: 5838801 - DNA, 21 bp, Homo sapiens
agcctttgaataaaaatgcac

SEQ ID NO: 5838802 - DNA, 20 bp, Homo sapiens
agcctttgaatgctaagaat

SEQ ID NO: 5838803 - DNA, 17 bp, Homo sapiens
agcctttgaatgtaacc

SEQ ID NO: 5838804 - DNA, 21 bp, Homo sapiens
agcctttgccgtgagcatgca

SEQ ID NO: 5838805 - DNA, 17 bp, Homo sapiens
agcctttgcgctctggg

SEQ ID NO: 5838806 - DNA, 18 bp, Homo sapiens
agcctttgctccctcccc

SEQ ID NO: 5838807 - DNA, 17 bp, Homo sapiens
agcctttggctctggag

SEQ ID NO: 5838808 - DNA, 23 bp, Homo sapiens
agcctttggctctggagacagcc

SEQ ID NO: 5838809 - DNA, 17 bp, Homo sapiens
agcgggcccgggtccca

SEQ ID NO: 5838810 - DNA, 17 bp, Homo sapiens
agcgggcctcttccctc

SEQ ID NO: 5838811 - DNA, 13 bp, Homo sapiens
agcgggcgcctgt

SEQ ID NO: 5838812 - DNA, 15 bp, Homo sapiens
agcgggcgcgggaca

SEQ ID NO: 5838813 - DNA, 15 bp, Homo sapiens
agcgggcgctgctgg

SEQ ID NO: 5838814 - DNA, 17 bp, Homo sapiens
agcgggcgctgctggga

SEQ ID NO: 5838815 - DNA, 16 bp, Homo sapiens
agcggggacagctcct

SEQ ID NO: 5838816 - DNA, 22 bp, Homo sapiens
agcggggacagctccttctgtc

SEQ ID NO: 5838817 - DNA, 19 bp, Homo sapiens
agcggggcgaagcccaggc

SEQ ID NO: 5838818 - DNA, 22 bp, Homo sapiens
agcggggcttcatctgcaaagg

SEQ ID NO: 5838819 - DNA, 15 bp, Homo sapiens
agcggggcttctggg

SEQ ID NO: 5838820 - DNA, 17 bp, Homo sapiens
agcggggcttctgggcg

SEQ ID NO: 5838821 - DNA, 12 bp, Homo sapiens
agcgggggaggg

SEQ ID NO: 5838822 - DNA, 16 bp, Homo sapiens
agcgggggccagggaa

SEQ ID NO: 5838823 - DNA, 18 bp, Homo sapiens
agcgggggcctaaaaaaa

SEQ ID NO: 5838824 - DNA, 19 bp, Homo sapiens
agcgggggctaactggccc

SEQ ID NO: 5838825 - DNA, 21 bp, Homo sapiens
agcgggggctaactggcccca

SEQ ID NO: 5838826 - DNA, 22 bp, Homo sapiens
agcgggggctaactggccccag

SEQ ID NO: 5838827 - DNA, 16 bp, Homo sapiens
agcggggtcccctctg

SEQ ID NO: 5838828 - DNA, 17 bp, Homo sapiens
agcgggtaaaaagagaa

SEQ ID NO: 5838829 - DNA, 13 bp, Homo sapiens
agcgggtctgctc

SEQ ID NO: 5838830 - DNA, 16 bp, Homo sapiens
agcgggtctgctccca

SEQ ID NO: 5838831 - DNA, 19 bp, Homo sapiens
agcgggtgacgtgtgttct

SEQ ID NO: 5838832 - DNA, 16 bp, Homo sapiens
agcgggtgcaagcact

SEQ ID NO: 5838833 - DNA, 17 bp, Homo sapiens
agcgggtggtggctctg

SEQ ID NO: 5838834 - DNA, 21 bp, Homo sapiens
agcggtaccaatgcagaactc

SEQ ID NO: 5838835 - DNA, 18 bp, Homo sapiens
agcggtcagactggaggt

SEQ ID NO: 5838836 - DNA, 19 bp, Homo sapiens
agcggtccaacgccgcctt

SEQ ID NO: 5838837 - DNA, 22 bp, Homo sapiens
agcggtgaccagcctgtcaccc

SEQ ID NO: 5838838 - DNA, 15 bp, Homo sapiens
agcggtggaggaagg

SEQ ID NO: 5838839 - DNA, 16 bp, Homo sapiens
agcggtggaggaaggc

SEQ ID NO: 5838840 - DNA, 22 bp, Homo sapiens
agcggtggaggaaggctctgtc

SEQ ID NO: 5838841 - DNA, 15 bp, Homo sapiens
agcggtggccctgtc

SEQ ID NO: 5838842 - DNA, 18 bp, Homo sapiens
agcggtgggaaggaaagg

SEQ ID NO: 5838843 - DNA, 21 bp, Homo sapiens
agcggtgggaaggaaaggcag

SEQ ID NO: 5838844 - DNA, 20 bp, Homo sapiens
agcggtgggggaggagggtt

SEQ ID NO: 5838845 - DNA, 20 bp, Homo sapiens
agcggtgtctctcctgcccc

SEQ ID NO: 5838846 - DNA, 17 bp, Homo sapiens
agcggtgtggaccgagg

SEQ ID NO: 5838847 - DNA, 15 bp, Homo sapiens
agcggttcctgtgca

SEQ ID NO: 5838848 - DNA, 14 bp, Homo sapiens
agcggttgccagga

SEQ ID NO: 5838849 - DNA, 19 bp, Homo sapiens
agcggtttggggagcagag

SEQ ID NO: 5838850 - DNA, 16 bp, Homo sapiens
agcgtaaaatggtgaa

SEQ ID NO: 5838851 - DNA, 22 bp, Homo sapiens
agcgtacttgaatttttcttcc

SEQ ID NO: 5838852 - DNA, 14 bp, Homo sapiens
agcgtagcctctcc

SEQ ID NO: 5838853 - DNA, 19 bp, Homo sapiens
agcgtatatacttaagaat

SEQ ID NO: 5838854 - DNA, 14 bp, Homo sapiens
agcgtattcttgaa

SEQ ID NO: 5838855 - DNA, 12 bp, Homo sapiens
agcgtcaaagaa

SEQ ID NO: 5838856 - DNA, 15 bp, Homo sapiens
agcgtcaagacattt

SEQ ID NO: 5838857 - DNA, 16 bp, Homo sapiens
agcgtcaagacatttg

SEQ ID NO: 5838858 - DNA, 13 bp, Homo sapiens
agcgtcactccag

SEQ ID NO: 5838859 - DNA, 20 bp, Homo sapiens
agcgtcactccagtgctcag

SEQ ID NO: 5838860 - DNA, 21 bp, Homo sapiens
agcgtcactgcccaccaaagg

SEQ ID NO: 5838861 - DNA, 13 bp, Homo sapiens
agcgtcagaagtc

SEQ ID NO: 5838862 - DNA, 23 bp, Homo sapiens
agcgtcagggttggtgtgctgag

SEQ ID NO: 5838863 - DNA, 17 bp, Homo sapiens
agcgtcagtttcactcc

SEQ ID NO: 5838864 - DNA, 20 bp, Homo sapiens
agcgtcagtttcactccctc

SEQ ID NO: 5838865 - DNA, 14 bp, Homo sapiens
agcgtccatttctt

SEQ ID NO: 5838866 - DNA, 16 bp, Homo sapiens
agcgtcccagtctctg

SEQ ID NO: 5838867 - DNA, 13 bp, Homo sapiens
agcgtccctggcg

SEQ ID NO: 5838868 - DNA, 15 bp, Homo sapiens
agcgtccctggcgca

SEQ ID NO: 5838869 - DNA, 22 bp, Homo sapiens
agcgtcctccatcttccaggat

SEQ ID NO: 5838870 - DNA, 17 bp, Homo sapiens
agcgtcctcgttcaaaa

SEQ ID NO: 5838871 - DNA, 22 bp, Homo sapiens
agcgtcctcgttcaaaacattc

SEQ ID NO: 5838872 - DNA, 14 bp, Homo sapiens
agcgtcctgaggaa

SEQ ID NO: 5838873 - DNA, 11 bp, Homo sapiens
agcgtcctgcc

SEQ ID NO: 5838874 - DNA, 16 bp, Homo sapiens
agcgtccttccccctg

SEQ ID NO: 5838875 - DNA, 16 bp, Homo sapiens
agcgtccttgtccccg

SEQ ID NO: 5838876 - DNA, 16 bp, Homo sapiens
agcgtcgccccagtgg

SEQ ID NO: 5838877 - DNA, 16 bp, Homo sapiens
agcgtcggtctgtgcc

SEQ ID NO: 5838878 - DNA, 23 bp, Homo sapiens
agcgtctccccatgctgggctca

SEQ ID NO: 5838879 - DNA, 22 bp, Homo sapiens
agcgtctgagcggccgcctgtc

SEQ ID NO: 5838880 - DNA, 13 bp, Homo sapiens
agcgtctgcaggg

SEQ ID NO: 5838881 - DNA, 21 bp, Homo sapiens
agcgtctgcagggtgacgcct

SEQ ID NO: 5838882 - DNA, 23 bp, Homo sapiens
agcgtctgcagggtgacgcctga

SEQ ID NO: 5838883 - DNA, 12 bp, Homo sapiens
agcgtctgttgt

SEQ ID NO: 5838884 - DNA, 23 bp, Homo sapiens
agcgtcttgctctgttcacagtc

SEQ ID NO: 5838885 - DNA, 13 bp, Homo sapiens
agcgtctttaaga

SEQ ID NO: 5838886 - DNA, 20 bp, Homo sapiens
agcgtctttttaacctcaga

SEQ ID NO: 5838887 - DNA, 22 bp, Homo sapiens
agcgtgagacgccaccattcct

SEQ ID NO: 5838888 - DNA, 13 bp, Homo sapiens
agcgtgagccact

SEQ ID NO: 5838889 - DNA, 19 bp, Homo sapiens
agcgtgagccactgcaccg

SEQ ID NO: 5838890 - DNA, 20 bp, Homo sapiens
agcgtgagcttaaaatacaa

SEQ ID NO: 5838891 - DNA, 14 bp, Homo sapiens
agcgtgcaccccgc

SEQ ID NO: 5838892 - DNA, 20 bp, Homo sapiens
agcgtgcaccgtgcagcccg

SEQ ID NO: 5838893 - DNA, 21 bp, Homo sapiens
agcgtgcagtagagagcaaag

SEQ ID NO: 5838894 - DNA, 15 bp, Homo sapiens
agcgtgccctgcccc

SEQ ID NO: 5838895 - DNA, 15 bp, Homo sapiens
agcgtgccgagccag

SEQ ID NO: 5838896 - DNA, 16 bp, Homo sapiens
agcgtgccgagccagc

SEQ ID NO: 5838897 - DNA, 17 bp, Homo sapiens
agcgtgccgagccagca

SEQ ID NO: 5838898 - DNA, 20 bp, Homo sapiens
agcgtgcgcactgcatggga

SEQ ID NO: 5838899 - DNA, 20 bp, Homo sapiens
agcgtgctccagcctggctc

SEQ ID NO: 5838900 - DNA, 14 bp, Homo sapiens
agcgtgctgcctct

SEQ ID NO: 5838901 - DNA, 20 bp, Homo sapiens
agcgtgctgcctctcttctg

SEQ ID NO: 5838902 - DNA, 21 bp, Homo sapiens
agcgtgctggcgacactcagg

SEQ ID NO: 5838903 - DNA, 22 bp, Homo sapiens
agcgtgctggcgacactcaggg

SEQ ID NO: 5838904 - DNA, 16 bp, Homo sapiens
agcgtggaagggggag

SEQ ID NO: 5838905 - DNA, 15 bp, Homo sapiens
agcgtggacaggtgt

SEQ ID NO: 5838906 - DNA, 18 bp, Homo sapiens
agcgtggactctgctaga

SEQ ID NO: 5838907 - DNA, 14 bp, Homo sapiens
agcgtggccttggg

SEQ ID NO: 5838908 - DNA, 16 bp, Homo sapiens
agcgtggccttgggag

SEQ ID NO: 5838909 - DNA, 17 bp, Homo sapiens
agcgtggctgtgctctc

SEQ ID NO: 5838910 - DNA, 20 bp, Homo sapiens
agcgtgggctcagcagggct

SEQ ID NO: 5838911 - DNA, 17 bp, Homo sapiens
agcgtggggaggggctg

SEQ ID NO: 5838912 - DNA, 22 bp, Homo sapiens
agcgtggggaggggctgaggat

SEQ ID NO: 5838913 - DNA, 23 bp, Homo sapiens
agcgtgggtgttgaatccagcac

SEQ ID NO: 5838914 - DNA, 23 bp, Homo sapiens
agcgtggtggacatgcacagcta

SEQ ID NO: 5838915 - DNA, 19 bp, Homo sapiens
agcgtggtttttatgtgta

SEQ ID NO: 5838916 - DNA, 13 bp, Homo sapiens
agcgtgtaagctt

SEQ ID NO: 5838917 - DNA, 23 bp, Homo sapiens
agcgtgtctgtatttatgtgtga

SEQ ID NO: 5838918 - DNA, 13 bp, Homo sapiens
agcgtgtggagca

SEQ ID NO: 5838919 - DNA, 17 bp, Homo sapiens
agcgtgtggagcagagc

SEQ ID NO: 5838920 - DNA, 14 bp, Homo sapiens
agcgtgtgggtccc

SEQ ID NO: 5838921 - DNA, 11 bp, Homo sapiens
agcgtgtgtat

SEQ ID NO: 5838922 - DNA, 14 bp, Homo sapiens
agcgtgtgtatccg

SEQ ID NO: 5838923 - DNA, 18 bp, Homo sapiens
agcgtgtgtatccgactc

SEQ ID NO: 5838924 - DNA, 23 bp, Homo sapiens
agcgtgtgtatccgactctaagc

SEQ ID NO: 5838925 - DNA, 16 bp, Homo sapiens
agcgtgtgtgccacct

SEQ ID NO: 5838926 - DNA, 13 bp, Homo sapiens
agcgtgttctcag

SEQ ID NO: 5838927 - DNA, 16 bp, Homo sapiens
agcgttaagggcagag

SEQ ID NO: 5838928 - DNA, 17 bp, Homo sapiens
agcgttaagggcagagt

SEQ ID NO: 5838929 - DNA, 14 bp, Homo sapiens
agcgttaatgtaaa

SEQ ID NO: 5838930 - DNA, 20 bp, Homo sapiens
agcgttcaaactgctggaaa

SEQ ID NO: 5838931 - DNA, 13 bp, Homo sapiens
agcgttcccagca

SEQ ID NO: 5838932 - DNA, 19 bp, Homo sapiens
agcgttcccttctccccct

SEQ ID NO: 5838933 - DNA, 22 bp, Homo sapiens
agcgttcccttctcccccttgt

SEQ ID NO: 5838934 - DNA, 15 bp, Homo sapiens
agcgttctctgtcct

SEQ ID NO: 5838935 - DNA, 14 bp, Homo sapiens
agcgttctggactc

SEQ ID NO: 5838936 - DNA, 19 bp, Homo sapiens
agcgttctggactctgccc

SEQ ID NO: 5838937 - DNA, 13 bp, Homo sapiens
agcgttcttcagg

SEQ ID NO: 5838938 - DNA, 16 bp, Homo sapiens
agcgttggatgtagca

SEQ ID NO: 5838939 - DNA, 13 bp, Homo sapiens
agcgttgggtttg

SEQ ID NO: 5838940 - DNA, 22 bp, Homo sapiens
agcgttgggtttgctcatgtaa

SEQ ID NO: 5838941 - DNA, 22 bp, Homo sapiens
agcgtttgcccaaatctgccta

SEQ ID NO: 5838942 - DNA, 22 bp, Homo sapiens
agcgttttgcaaggtaaaattt

SEQ ID NO: 5838943 - DNA, 14 bp, Homo sapiens
agcgtttttctcaa

SEQ ID NO: 5838944 - DNA, 14 bp, Homo sapiens
agcgttttttaaat

SEQ ID NO: 5838945 - DNA, 18 bp, Homo sapiens
agcgttttttaaatgtat

SEQ ID NO: 5838946 - DNA, 19 bp, Homo sapiens
agcgttttttaaatgtata

SEQ ID NO: 5838947 - DNA, 14 bp, Homo sapiens
agctaaaaatatta

SEQ ID NO: 5838948 - DNA, 15 bp, Homo sapiens
agctaaaacctgagc

SEQ ID NO: 5838949 - DNA, 11 bp, Homo sapiens
agctaaaagca

SEQ ID NO: 5838950 - DNA, 17 bp, Homo sapiens
agctaaaagcatccctg

SEQ ID NO: 5838951 - DNA, 21 bp, Homo sapiens
agctaaaataaaccagactca

SEQ ID NO: 5838952 - DNA, 20 bp, Homo sapiens
agctaaaatgattttatctg

SEQ ID NO: 5838953 - DNA, 19 bp, Homo sapiens
agctaaaccaaggactgag

SEQ ID NO: 5838954 - DNA, 17 bp, Homo sapiens
agctaaacggattccaa

SEQ ID NO: 5838955 - DNA, 18 bp, Homo sapiens
agctaaactccttcctgg

SEQ ID NO: 5838956 - DNA, 13 bp, Homo sapiens
agctaaagaaact

SEQ ID NO: 5838957 - DNA, 15 bp, Homo sapiens
agctaaagaggtggg

SEQ ID NO: 5838958 - DNA, 15 bp, Homo sapiens
agctaaagtaacaga

SEQ ID NO: 5838959 - DNA, 18 bp, Homo sapiens
agctaaagtaacagagca

SEQ ID NO: 5838960 - DNA, 21 bp, Homo sapiens
agctaaagtttggttttgaca

SEQ ID NO: 5838961 - DNA, 11 bp, Homo sapiens
agctaaataaa

SEQ ID NO: 5838962 - DNA, 20 bp, Homo sapiens
agctaaataacttgccattt

SEQ ID NO: 5838963 - DNA, 22 bp, Homo sapiens
agctaaataacttgccatttct

SEQ ID NO: 5838964 - DNA, 20 bp, Homo sapiens
agctaaatacctcaatcagt

SEQ ID NO: 5838965 - DNA, 17 bp, Homo sapiens
agctaaatgcaatttaa

SEQ ID NO: 5838966 - DNA, 12 bp, Homo sapiens
agctaaatgctt

SEQ ID NO: 5838967 - DNA, 18 bp, Homo sapiens
agctaaatgtaacttatt

SEQ ID NO: 5838968 - DNA, 12 bp, Homo sapiens
agctaacaaaag

SEQ ID NO: 5838969 - DNA, 13 bp, Homo sapiens
agctaacaaaaga

SEQ ID NO: 5838970 - DNA, 18 bp, Homo sapiens
agctaacacacagctccc

SEQ ID NO: 5838971 - DNA, 16 bp, Homo sapiens
agctaacactggcccc

SEQ ID NO: 5838972 - DNA, 13 bp, Homo sapiens
agctaacagggaa

SEQ ID NO: 5838973 - DNA, 18 bp, Homo sapiens
agctaacagggaaggcag

SEQ ID NO: 5838974 - DNA, 23 bp, Homo sapiens
agctaacagtgaagatttacctc

SEQ ID NO: 5838975 - DNA, 12 bp, Homo sapiens
agctaacatctt

SEQ ID NO: 5838976 - DNA, 19 bp, Homo sapiens
agctaacatggaagtacta

SEQ ID NO: 5838977 - DNA, 23 bp, Homo sapiens
agctaacccccttctactgagcc

SEQ ID NO: 5838978 - DNA, 13 bp, Homo sapiens
agctaaccctagt

SEQ ID NO: 5838979 - DNA, 19 bp, Homo sapiens
agctaacgttagaatagtg

SEQ ID NO: 5838980 - DNA, 16 bp, Homo sapiens
agctaactaattctgt

SEQ ID NO: 5838981 - DNA, 17 bp, Homo sapiens
agctaactccgagagca

SEQ ID NO: 5838982 - DNA, 16 bp, Homo sapiens
agctaactgtaaatca

SEQ ID NO: 5838983 - DNA, 16 bp, Homo sapiens
agctaactgtggagaa

SEQ ID NO: 5838984 - DNA, 12 bp, Homo sapiens
agctaagaacct

SEQ ID NO: 5838985 - DNA, 13 bp, Homo sapiens
agctaagaacctg

SEQ ID NO: 5838986 - DNA, 16 bp, Homo sapiens
agctaagaacctggaa

SEQ ID NO: 5838987 - DNA, 19 bp, Homo sapiens
agctaagatagaaagctgg

SEQ ID NO: 5838988 - DNA, 13 bp, Homo sapiens
agctccactctga

SEQ ID NO: 5838989 - DNA, 19 bp, Homo sapiens
agctccactctgaagtccc

SEQ ID NO: 5838990 - DNA, 13 bp, Homo sapiens
agctccactctgc

SEQ ID NO: 5838991 - DNA, 14 bp, Homo sapiens
agctccactctgct

SEQ ID NO: 5838992 - DNA, 17 bp, Homo sapiens
agctccactctgcttct

SEQ ID NO: 5838993 - DNA, 22 bp, Homo sapiens
agctccactctgcttctctgac

SEQ ID NO: 5838994 - DNA, 23 bp, Homo sapiens
agctccactctgcttctctgact

SEQ ID NO: 5838995 - DNA, 23 bp, Homo sapiens
agctccactgtcaccctccacct

SEQ ID NO: 5838996 - DNA, 19 bp, Homo sapiens
agctccagcccctttccaa

SEQ ID NO: 5838997 - DNA, 22 bp, Homo sapiens
agctccagcccgagtggtctcc

SEQ ID NO: 5838998 - DNA, 13 bp, Homo sapiens
agctccagcctga

SEQ ID NO: 5838999 - DNA, 24 bp, Homo sapiens
agctccagcgatggtgctgcccag

SEQ ID NO: 5839000 - DNA, 13 bp, Homo sapiens
agctccagctcac

SEQ ID NO: 5839001 - DNA, 17 bp, Homo sapiens
agctccagctcaccagc

SEQ ID NO: 5839002 - DNA, 19 bp, Homo sapiens
agctccagctcaccagccc

SEQ ID NO: 5839003 - DNA, 18 bp, Homo sapiens
agctccaggagggcttga

SEQ ID NO: 5839004 - DNA, 20 bp, Homo sapiens
agctccaggatggggagggg

SEQ ID NO: 5839005 - DNA, 13 bp, Homo sapiens
agctccaggcagg

SEQ ID NO: 5839006 - DNA, 20 bp, Homo sapiens
agctccagggagcttattca

SEQ ID NO: 5839007 - DNA, 12 bp, Homo sapiens
agctccagggca

SEQ ID NO: 5839008 - DNA, 16 bp, Homo sapiens
agctccaggtgccctg

SEQ ID NO: 5839009 - DNA, 20 bp, Homo sapiens
agctccagtgccgctcctgc

SEQ ID NO: 5839010 - DNA, 21 bp, Homo sapiens
agctccagtgccgctcctgct

SEQ ID NO: 5839011 - DNA, 14 bp, Homo sapiens
agctccagtggaag

SEQ ID NO: 5839012 - DNA, 19 bp, Homo sapiens
agctccagtggaagaagaa

SEQ ID NO: 5839013 - DNA, 20 bp, Homo sapiens
agctccagtgtcctgagctc

SEQ ID NO: 5839014 - DNA, 22 bp, Homo sapiens
agctccagtgtcctgagctcag

SEQ ID NO: 5839015 - DNA, 16 bp, Homo sapiens
agctccagtttccaag

SEQ ID NO: 5839016 - DNA, 14 bp, Homo sapiens
agctccagtttctc

SEQ ID NO: 5839017 - DNA, 16 bp, Homo sapiens
agctccagtttctctt

SEQ ID NO: 5839018 - DNA, 22 bp, Homo sapiens
agctccagtttctcttaagctg

SEQ ID NO: 5839019 - DNA, 15 bp, Homo sapiens
agctccagttttcgt

SEQ ID NO: 5839020 - DNA, 23 bp, Homo sapiens
agctccatactctgtccccccag

SEQ ID NO: 5839021 - DNA, 18 bp, Homo sapiens
agctccatcctcttgact

SEQ ID NO: 5839022 - DNA, 16 bp, Homo sapiens
agctccatctccactc

SEQ ID NO: 5839023 - DNA, 21 bp, Homo sapiens
agctccatctccactccagat

SEQ ID NO: 5839024 - DNA, 16 bp, Homo sapiens
agctccatgtgcatat

SEQ ID NO: 5839025 - DNA, 17 bp, Homo sapiens
agctccatgtgcatata

SEQ ID NO: 5839026 - DNA, 20 bp, Homo sapiens
agctccatgtgcatataaag

SEQ ID NO: 5839027 - DNA, 14 bp, Homo sapiens
agctccatttaaac

SEQ ID NO: 5839028 - DNA, 14 bp, Homo sapiens
agctcccaaaagaa

SEQ ID NO: 5839029 - DNA, 18 bp, Homo sapiens
agctcccacaagcctctg

SEQ ID NO: 5839030 - DNA, 12 bp, Homo sapiens
agctcccacacc

SEQ ID NO: 5839031 - DNA, 21 bp, Homo sapiens
agctcccacaccgcgtcccag

SEQ ID NO: 5839032 - DNA, 22 bp, Homo sapiens
agctcccacccacctgtagggc

SEQ ID NO: 5839033 - DNA, 21 bp, Homo sapiens
agctcccacctccccttgggc

SEQ ID NO: 5839034 - DNA, 16 bp, Homo sapiens
agctcccacctccctt

SEQ ID NO: 5839035 - DNA, 19 bp, Homo sapiens
agctcccacctcccttccc

SEQ ID NO: 5839036 - DNA, 17 bp, Homo sapiens
agctcccagatgctggg

SEQ ID NO: 5839037 - DNA, 14 bp, Homo sapiens
agctcccagatggc

SEQ ID NO: 5839038 - DNA, 18 bp, Homo sapiens
agctcccagctagggggc

SEQ ID NO: 5839039 - DNA, 21 bp, Homo sapiens
agctcccaggacgcagggaga

SEQ ID NO: 5839040 - DNA, 11 bp, Homo sapiens
agctcccaggc

SEQ ID NO: 5839041 - DNA, 14 bp, Homo sapiens
agctcccaggccga

SEQ ID NO: 5839042 - DNA, 21 bp, Homo sapiens
agctcccaggccgagaagcca

SEQ ID NO: 5839043 - DNA, 22 bp, Homo sapiens
agctcccaggtgcagccagagg

SEQ ID NO: 5839044 - DNA, 17 bp, Homo sapiens
agctcccatagcgctgg

SEQ ID NO: 5839045 - DNA, 20 bp, Homo sapiens
agctcccatagcgctggctc

SEQ ID NO: 5839046 - DNA, 21 bp, Homo sapiens
agctcccatagcgctggctca

SEQ ID NO: 5839047 - DNA, 22 bp, Homo sapiens
agctcccatagcgctggctcag

SEQ ID NO: 5839048 - DNA, 18 bp, Homo sapiens
agctcccatttctactct

SEQ ID NO: 5839049 - DNA, 18 bp, Homo sapiens
agctccccaatccctgac

SEQ ID NO: 5839050 - DNA, 14 bp, Homo sapiens
agctccccaccacc

SEQ ID NO: 5839051 - DNA, 18 bp, Homo sapiens
agctccccagagtcctct

SEQ ID NO: 5839052 - DNA, 11 bp, Homo sapiens
agctccccagg

SEQ ID NO: 5839053 - DNA, 15 bp, Homo sapiens
agctccccaggactc

SEQ ID NO: 5839054 - DNA, 18 bp, Homo sapiens
agctccccaggagctcag

SEQ ID NO: 5839055 - DNA, 14 bp, Homo sapiens
agctcccccagctc

SEQ ID NO: 5839056 - DNA, 13 bp, Homo sapiens
agctcccccaggc

SEQ ID NO: 5839057 - DNA, 14 bp, Homo sapiens
agctcccccaggca

SEQ ID NO: 5839058 - DNA, 16 bp, Homo sapiens
agctcccccaggcaga

SEQ ID NO: 5839059 - DNA, 15 bp, Homo sapiens
agctccccccacctc

SEQ ID NO: 5839060 - DNA, 19 bp, Homo sapiens
agctcccccgtggtgcctg

SEQ ID NO: 5839061 - DNA, 20 bp, Homo sapiens
agctcccccgtggtgcctgc

SEQ ID NO: 5839062 - DNA, 15 bp, Homo sapiens
agctccccctccctc

SEQ ID NO: 5839063 - DNA, 13 bp, Homo sapiens
agctccccctgtc

SEQ ID NO: 5839064 - DNA, 14 bp, Homo sapiens
agctccccctgtcc

SEQ ID NO: 5839065 - DNA, 19 bp, Homo sapiens
agctccccctgtcccctca

SEQ ID NO: 5839066 - DNA, 22 bp, Homo sapiens
agctcccccttcccagtagctc

SEQ ID NO: 5839067 - DNA, 20 bp, Homo sapiens
agctccccgcttctgcctgc

SEQ ID NO: 5839068 - DNA, 15 bp, Homo sapiens
agctcccctccacag

SEQ ID NO: 5839069 - DNA, 16 bp, Homo sapiens
agctcccctccacagc

SEQ ID NO: 5839070 - DNA, 21 bp, Homo sapiens
agctcccctccacagctgcag

SEQ ID NO: 5839071 - DNA, 15 bp, Homo sapiens
agctcccctccccaa

SEQ ID NO: 5839072 - DNA, 22 bp, Homo sapiens
agctcccctcggagaagagctg

SEQ ID NO: 5839073 - DNA, 15 bp, Homo sapiens
agctcccctcttttg

SEQ ID NO: 5839074 - DNA, 23 bp, Homo sapiens
agctcccctgccttaacctggga

SEQ ID NO: 5839075 - DNA, 13 bp, Homo sapiens
agctcccctggct

SEQ ID NO: 5839076 - DNA, 18 bp, Homo sapiens
agctcccgctccgggctc

SEQ ID NO: 5839077 - DNA, 16 bp, Homo sapiens
agctccctagactgca

SEQ ID NO: 5839078 - DNA, 17 bp, Homo sapiens
agctccctagactgcat

SEQ ID NO: 5839079 - DNA, 15 bp, Homo sapiens
agctccctagtggct

SEQ ID NO: 5839080 - DNA, 14 bp, Homo sapiens
agctccctcccctg

SEQ ID NO: 5839081 - DNA, 17 bp, Homo sapiens
agctccctcccctgctc

SEQ ID NO: 5839082 - DNA, 18 bp, Homo sapiens
agctccctcccctgctca

SEQ ID NO: 5839083 - DNA, 11 bp, Homo sapiens
agctccctcct

SEQ ID NO: 5839084 - DNA, 14 bp, Homo sapiens
agctccctcctcag

SEQ ID NO: 5839085 - DNA, 20 bp, Homo sapiens
agctccctcctcccatctcc

SEQ ID NO: 5839086 - DNA, 21 bp, Homo sapiens
agctccctcctcccatctcct

SEQ ID NO: 5839087 - DNA, 13 bp, Homo sapiens
agctccctcctgc

SEQ ID NO: 5839088 - DNA, 15 bp, Homo sapiens
agctccctcgctgta

SEQ ID NO: 5839089 - DNA, 18 bp, Homo sapiens
agctccctcgctgtatga

SEQ ID NO: 5839090 - DNA, 19 bp, Homo sapiens
agctccctgaccccctgtc

SEQ ID NO: 5839091 - DNA, 12 bp, Homo sapiens
agctccctgcac

SEQ ID NO: 5839092 - DNA, 13 bp, Homo sapiens
agctccctgcacc

SEQ ID NO: 5839093 - DNA, 21 bp, Homo sapiens
agctccctgcaccgccgcaga

SEQ ID NO: 5839094 - DNA, 12 bp, Homo sapiens
agctccctgcca

SEQ ID NO: 5839095 - DNA, 17 bp, Homo sapiens
agctccctgcctgtttc

SEQ ID NO: 5839096 - DNA, 18 bp, Homo sapiens
agctccctgcctgtttcc

SEQ ID NO: 5839097 - DNA, 20 bp, Homo sapiens
agctccctgcctgtttcccg

SEQ ID NO: 5839098 - DNA, 12 bp, Homo sapiens
agctccctggag

SEQ ID NO: 5839099 - DNA, 14 bp, Homo sapiens
agctccctggagcc

SEQ ID NO: 5839100 - DNA, 16 bp, Homo sapiens
agctccctggagccct

SEQ ID NO: 5839101 - DNA, 13 bp, Homo sapiens
agctccctggtga

SEQ ID NO: 5839102 - DNA, 14 bp, Homo sapiens
agctccctggtgag

SEQ ID NO: 5839103 - DNA, 21 bp, Homo sapiens
agctccctggtgagggagcct

SEQ ID NO: 5839104 - DNA, 23 bp, Homo sapiens
agctccctgtggggcaggagtgc

SEQ ID NO: 5839105 - DNA, 15 bp, Homo sapiens
agctcccttccctgc

SEQ ID NO: 5839106 - DNA, 17 bp, Homo sapiens
agctcccttccctgcag

SEQ ID NO: 5839107 - DNA, 12 bp, Homo sapiens
agctcccttccg

SEQ ID NO: 5839108 - DNA, 16 bp, Homo sapiens
agctcccttctctgta

SEQ ID NO: 5839109 - DNA, 19 bp, Homo sapiens
agctccctttttgaattgt

SEQ ID NO: 5839110 - DNA, 14 bp, Homo sapiens
agctccgacctctc

SEQ ID NO: 5839111 - DNA, 16 bp, Homo sapiens
agctccgacctctctc

SEQ ID NO: 5839112 - DNA, 17 bp, Homo sapiens
agctccgagctgtagga

SEQ ID NO: 5839113 - DNA, 21 bp, Homo sapiens
agctccgagtggctcccgtgt

SEQ ID NO: 5839114 - DNA, 14 bp, Homo sapiens
agctccgcctggca

SEQ ID NO: 5839115 - DNA, 15 bp, Homo sapiens
agctccgcctggcac

SEQ ID NO: 5839116 - DNA, 17 bp, Homo sapiens
agctccgcctggcaccc

SEQ ID NO: 5839117 - DNA, 20 bp, Homo sapiens
agctccggagggggtcctcc

SEQ ID NO: 5839118 - DNA, 19 bp, Homo sapiens
agctccggcgtgtgttcag

SEQ ID NO: 5839119 - DNA, 15 bp, Homo sapiens
agctccgtcatctgc

SEQ ID NO: 5839120 - DNA, 21 bp, Homo sapiens
agctccgtcatctgcggggct

SEQ ID NO: 5839121 - DNA, 14 bp, Homo sapiens
agctccgtggagca

SEQ ID NO: 5839122 - DNA, 13 bp, Homo sapiens
agctccgtgtttc

SEQ ID NO: 5839123 - DNA, 18 bp, Homo sapiens
agctccgtgtttctctaa

SEQ ID NO: 5839124 - DNA, 22 bp, Homo sapiens
agctcctcacccagggccccca

SEQ ID NO: 5839125 - DNA, 23 bp, Homo sapiens
agctcctcacccagggcccccaa

SEQ ID NO: 5839126 - DNA, 16 bp, Homo sapiens
agctcctcagcggctc

SEQ ID NO: 5839127 - DNA, 15 bp, Homo sapiens
agctcctcatccagg

SEQ ID NO: 5839128 - DNA, 18 bp, Homo sapiens
agctcctcatccagggct

SEQ ID NO: 5839129 - DNA, 21 bp, Homo sapiens
agctcctcatccagggctctg

SEQ ID NO: 5839130 - DNA, 10 bp, Homo sapiens
agctcctcca

SEQ ID NO: 5839131 - DNA, 15 bp, Homo sapiens
agctcctccagccct

SEQ ID NO: 5839132 - DNA, 21 bp, Homo sapiens
agctcctcccacggggtcccc

SEQ ID NO: 5839133 - DNA, 11 bp, Homo sapiens
agctcctcccc

SEQ ID NO: 5839134 - DNA, 13 bp, Homo sapiens
agctcctcccctg

SEQ ID NO: 5839135 - DNA, 14 bp, Homo sapiens
agctcctcccctgc

SEQ ID NO: 5839136 - DNA, 17 bp, Homo sapiens
agctcctcccctgccgc

SEQ ID NO: 5839137 - DNA, 18 bp, Homo sapiens
agctcctcccctgccgcc

SEQ ID NO: 5839138 - DNA, 20 bp, Homo sapiens
agctcctcccctgccgcctc

SEQ ID NO: 5839139 - DNA, 13 bp, Homo sapiens
agctcctcccctt

SEQ ID NO: 5839140 - DNA, 20 bp, Homo sapiens
agctcctccctccagctgcg

SEQ ID NO: 5839141 - DNA, 13 bp, Homo sapiens
agctcctccctct

SEQ ID NO: 5839142 - DNA, 14 bp, Homo sapiens
agctcctccctctc

SEQ ID NO: 5839143 - DNA, 15 bp, Homo sapiens
agctcctccctctca

SEQ ID NO: 5839144 - DNA, 17 bp, Homo sapiens
agctcctcctcctgggc

SEQ ID NO: 5839145 - DNA, 20 bp, Homo sapiens
agctcctcctcggaaccgct

SEQ ID NO: 5839146 - DNA, 22 bp, Homo sapiens
agctcctcctcttggagctgag

SEQ ID NO: 5839147 - DNA, 21 bp, Homo sapiens
agctcctctaggggcagcctc

SEQ ID NO: 5839148 - DNA, 22 bp, Homo sapiens
agctcctctaggggcagcctcc

SEQ ID NO: 5839149 - DNA, 21 bp, Homo sapiens
agctcctctccagacacagag

SEQ ID NO: 5839150 - DNA, 18 bp, Homo sapiens
agctcctctccccagccc

SEQ ID NO: 5839151 - DNA, 19 bp, Homo sapiens
agctcctctccccagccca

SEQ ID NO: 5839152 - DNA, 20 bp, Homo sapiens
agctcctctccccagcccag

SEQ ID NO: 5839153 - DNA, 20 bp, Homo sapiens
agctcctctccctcacaagc

SEQ ID NO: 5839154 - DNA, 17 bp, Homo sapiens
agctcctctcctggagg

SEQ ID NO: 5839155 - DNA, 15 bp, Homo sapiens
agctcctctccttgg

SEQ ID NO: 5839156 - DNA, 18 bp, Homo sapiens
agctcctctccttgggct

SEQ ID NO: 5839157 - DNA, 21 bp, Homo sapiens
agctcctctccttgggctcct

SEQ ID NO: 5839158 - DNA, 22 bp, Homo sapiens
agctcctctccttgggctcctg

SEQ ID NO: 5839159 - DNA, 14 bp, Homo sapiens
agctcctctgctcc

SEQ ID NO: 5839160 - DNA, 14 bp, Homo sapiens
agctcctctgctgc

SEQ ID NO: 5839161 - DNA, 14 bp, Homo sapiens
agctcctctgggca

SEQ ID NO: 5839162 - DNA, 15 bp, Homo sapiens
agctcctctgggcag

SEQ ID NO: 5839163 - DNA, 12 bp, Homo sapiens
agctcctctgtc

SEQ ID NO: 5839164 - DNA, 24 bp, Homo sapiens
agctcctctgtctcgagcgccctg

SEQ ID NO: 5839165 - DNA, 13 bp, Homo sapiens
agctcctcttcca

SEQ ID NO: 5839166 - DNA, 10 bp, Homo sapiens
agctcctgac

SEQ ID NO: 5839167 - DNA, 22 bp, Homo sapiens
agctgaagattaggcacacaga

SEQ ID NO: 5839168 - DNA, 16 bp, Homo sapiens
agctgaagccagctcc

SEQ ID NO: 5839169 - DNA, 23 bp, Homo sapiens
agctgaagcccatgctttcccac

SEQ ID NO: 5839170 - DNA, 18 bp, Homo sapiens
agctgaagcctatttatt

SEQ ID NO: 5839171 - DNA, 16 bp, Homo sapiens
agctgaagcctggacg

SEQ ID NO: 5839172 - DNA, 21 bp, Homo sapiens
agctgaagcctggacgcagcc

SEQ ID NO: 5839173 - DNA, 22 bp, Homo sapiens
agctgaagcctggacgcagcca

SEQ ID NO: 5839174 - DNA, 12 bp, Homo sapiens
agctgaagctac

SEQ ID NO: 5839175 - DNA, 23 bp, Homo sapiens
agctgaaggttgtggcctttgcg

SEQ ID NO: 5839176 - DNA, 22 bp, Homo sapiens
agctgaagtagaggggacgtga

SEQ ID NO: 5839177 - DNA, 21 bp, Homo sapiens
agctgaagtgaaggagaaagg

SEQ ID NO: 5839178 - DNA, 16 bp, Homo sapiens
agctgaataacctgca

SEQ ID NO: 5839179 - DNA, 19 bp, Homo sapiens
agctgaataacctgcacag

SEQ ID NO: 5839180 - DNA, 22 bp, Homo sapiens
agctgaataacctgcacaggct

SEQ ID NO: 5839181 - DNA, 15 bp, Homo sapiens
agctgaatacattct

SEQ ID NO: 5839182 - DNA, 22 bp, Homo sapiens
agctgaatattttttatttcta

SEQ ID NO: 5839183 - DNA, 22 bp, Homo sapiens
agctgaatccttccatttcttc

SEQ ID NO: 5839184 - DNA, 17 bp, Homo sapiens
agctgaatgagtctgct

SEQ ID NO: 5839185 - DNA, 18 bp, Homo sapiens
agctgaatgagtctgctt

SEQ ID NO: 5839186 - DNA, 17 bp, Homo sapiens
agctgaatgcctcctgt

SEQ ID NO: 5839187 - DNA, 18 bp, Homo sapiens
agctgaatgcctcctgtg

SEQ ID NO: 5839188 - DNA, 19 bp, Homo sapiens
agctgaatgtcaaacagtg

SEQ ID NO: 5839189 - DNA, 22 bp, Homo sapiens
agctgaatgtttttctaaagga

SEQ ID NO: 5839190 - DNA, 15 bp, Homo sapiens
agctgaattttctgg

SEQ ID NO: 5839191 - DNA, 17 bp, Homo sapiens
agctgaattttctggaa

SEQ ID NO: 5839192 - DNA, 19 bp, Homo sapiens
agctgacaaaattttgctc

SEQ ID NO: 5839193 - DNA, 19 bp, Homo sapiens
agctgacacaaacctgcct

SEQ ID NO: 5839194 - DNA, 22 bp, Homo sapiens
agctgacacaaacctgcctggg

SEQ ID NO: 5839195 - DNA, 14 bp, Homo sapiens
agctgacagccaca

SEQ ID NO: 5839196 - DNA, 17 bp, Homo sapiens
agctgacagtcagctgt

SEQ ID NO: 5839197 - DNA, 14 bp, Homo sapiens
agctgacagtcctc

SEQ ID NO: 5839198 - DNA, 16 bp, Homo sapiens
agctgacagtcctctc

SEQ ID NO: 5839199 - DNA, 12 bp, Homo sapiens
agctgacataat

SEQ ID NO: 5839200 - DNA, 14 bp, Homo sapiens
agctgacatggaaa

SEQ ID NO: 5839201 - DNA, 16 bp, Homo sapiens
agctgacattgccaaa

SEQ ID NO: 5839202 - DNA, 17 bp, Homo sapiens
agctgaccacaggcagt

SEQ ID NO: 5839203 - DNA, 21 bp, Homo sapiens
agctgaccagaagtggcagga

SEQ ID NO: 5839204 - DNA, 22 bp, Homo sapiens
agctgaccagaagtggcaggag

SEQ ID NO: 5839205 - DNA, 17 bp, Homo sapiens
agctgaccattgaacta

SEQ ID NO: 5839206 - DNA, 14 bp, Homo sapiens
agctgaccccctcc

SEQ ID NO: 5839207 - DNA, 15 bp, Homo sapiens
agctgaccccctccc

SEQ ID NO: 5839208 - DNA, 17 bp, Homo sapiens
agctgacgaggctgggc

SEQ ID NO: 5839209 - DNA, 18 bp, Homo sapiens
agctgacgggaggcccca

SEQ ID NO: 5839210 - DNA, 21 bp, Homo sapiens
agctgacgggaggccccagct

SEQ ID NO: 5839211 - DNA, 23 bp, Homo sapiens
agctgacgggaggccccagctct

SEQ ID NO: 5839212 - DNA, 16 bp, Homo sapiens
agctgactcattcttt

SEQ ID NO: 5839213 - DNA, 16 bp, Homo sapiens
agctgactgaatgcag

SEQ ID NO: 5839214 - DNA, 17 bp, Homo sapiens
agctgactggccccagg

SEQ ID NO: 5839215 - DNA, 22 bp, Homo sapiens
agctgactggccccagggactc

SEQ ID NO: 5839216 - DNA, 20 bp, Homo sapiens
agctgactggtttctcctgg

SEQ ID NO: 5839217 - DNA, 23 bp, Homo sapiens
agctgactggtttctcctggtag

SEQ ID NO: 5839218 - DNA, 19 bp, Homo sapiens
agctgactgtggccccctc

SEQ ID NO: 5839219 - DNA, 20 bp, Homo sapiens
agctgacttgcacagggatt

SEQ ID NO: 5839220 - DNA, 15 bp, Homo sapiens
agctgacttggcact

SEQ ID NO: 5839221 - DNA, 17 bp, Homo sapiens
agctgacttggctggtg

SEQ ID NO: 5839222 - DNA, 14 bp, Homo sapiens
agctgactttcatt

SEQ ID NO: 5839223 - DNA, 17 bp, Homo sapiens
agctgactttcatttgg

SEQ ID NO: 5839224 - DNA, 13 bp, Homo sapiens
agctgagaaaagt

SEQ ID NO: 5839225 - DNA, 22 bp, Homo sapiens
agctgagaaaagtattctcaaa

SEQ ID NO: 5839226 - DNA, 17 bp, Homo sapiens
agctgagaactcctgac

SEQ ID NO: 5839227 - DNA, 18 bp, Homo sapiens
agctgagaagaagctgag

SEQ ID NO: 5839228 - DNA, 13 bp, Homo sapiens
agctgagaagact

SEQ ID NO: 5839229 - DNA, 14 bp, Homo sapiens
agctgagaatagaa

SEQ ID NO: 5839230 - DNA, 15 bp, Homo sapiens
agctgagaatagaag

SEQ ID NO: 5839231 - DNA, 16 bp, Homo sapiens
agctgagaccagggtc

SEQ ID NO: 5839232 - DNA, 14 bp, Homo sapiens
agctgagaccttgc

SEQ ID NO: 5839233 - DNA, 17 bp, Homo sapiens
agctgagactacaggtg

SEQ ID NO: 5839234 - DNA, 18 bp, Homo sapiens
agctgagagaccctggcc

SEQ ID NO: 5839235 - DNA, 16 bp, Homo sapiens
agctgagaggaagatg

SEQ ID NO: 5839236 - DNA, 23 bp, Homo sapiens
agctgagaggaagatgaagagaa

SEQ ID NO: 5839237 - DNA, 22 bp, Homo sapiens
agctgagagtctgaaagacaga

SEQ ID NO: 5839238 - DNA, 23 bp, Homo sapiens
agctgagagtctgaaagacagaa

SEQ ID NO: 5839239 - DNA, 21 bp, Homo sapiens
agctgagagtgccccactgca

SEQ ID NO: 5839240 - DNA, 20 bp, Homo sapiens
agctgagatcgtgccactgc

SEQ ID NO: 5839241 - DNA, 22 bp, Homo sapiens
agctgagatcgtgccactgcac

SEQ ID NO: 5839242 - DNA, 17 bp, Homo sapiens
agctgagatgagcccca

SEQ ID NO: 5839243 - DNA, 15 bp, Homo sapiens
agctgagcaccaggg

SEQ ID NO: 5839244 - DNA, 20 bp, Homo sapiens
agctgagcacccagctctgt

SEQ ID NO: 5839245 - DNA, 16 bp, Homo sapiens
agctgagcagcctctg

SEQ ID NO: 5839246 - DNA, 14 bp, Homo sapiens
agctgagcaggaca

SEQ ID NO: 5839247 - DNA, 13 bp, Homo sapiens
agctgagcaggga

SEQ ID NO: 5839248 - DNA, 15 bp, Homo sapiens
agctgagcagggaga

SEQ ID NO: 5839249 - DNA, 22 bp, Homo sapiens
agctgagcatggagacagcagt

SEQ ID NO: 5839250 - DNA, 20 bp, Homo sapiens
agctgagcccctccctcctg

SEQ ID NO: 5839251 - DNA, 13 bp, Homo sapiens
agctgagccctgg

SEQ ID NO: 5839252 - DNA, 12 bp, Homo sapiens
agctgagcctga

SEQ ID NO: 5839253 - DNA, 17 bp, Homo sapiens
agctgagcgccaggatg

SEQ ID NO: 5839254 - DNA, 11 bp, Homo sapiens
agctgagctgg

SEQ ID NO: 5839255 - DNA, 12 bp, Homo sapiens
agctgagctgga

SEQ ID NO: 5839256 - DNA, 15 bp, Homo sapiens
agctgagctggaagg

SEQ ID NO: 5839257 - DNA, 19 bp, Homo sapiens
agctgagcttagctctgcc

SEQ ID NO: 5839258 - DNA, 21 bp, Homo sapiens
agctgagcttcggttctccag

SEQ ID NO: 5839259 - DNA, 13 bp, Homo sapiens
agctgagcttgag

SEQ ID NO: 5839260 - DNA, 13 bp, Homo sapiens
agctgagcttttg

SEQ ID NO: 5839261 - DNA, 22 bp, Homo sapiens
agctgaggaacaggttcctgtg

SEQ ID NO: 5839262 - DNA, 19 bp, Homo sapiens
agctgaggaccctcagccc

SEQ ID NO: 5839263 - DNA, 15 bp, Homo sapiens
agctgaggagccctt

SEQ ID NO: 5839264 - DNA, 24 bp, Homo sapiens
agctgaggatcctcacaggagcag

SEQ ID NO: 5839265 - DNA, 17 bp, Homo sapiens
agctgaggatgacagag

SEQ ID NO: 5839266 - DNA, 18 bp, Homo sapiens
agctgaggatttcctgga

SEQ ID NO: 5839267 - DNA, 20 bp, Homo sapiens
agctgaggatttcctggagt

SEQ ID NO: 5839268 - DNA, 20 bp, Homo sapiens
agctgaggccattccctgta

SEQ ID NO: 5839269 - DNA, 23 bp, Homo sapiens
agctgaggccattccctgtagga

SEQ ID NO: 5839270 - DNA, 17 bp, Homo sapiens
agctgaggccccagggc

SEQ ID NO: 5839271 - DNA, 17 bp, Homo sapiens
agctgaggcctatgcag

SEQ ID NO: 5839272 - DNA, 15 bp, Homo sapiens
agctgaggctgctgc

SEQ ID NO: 5839273 - DNA, 21 bp, Homo sapiens
agctgaggctgctgccaggcc

SEQ ID NO: 5839274 - DNA, 23 bp, Homo sapiens
agctgaggctttggtacccccaa

SEQ ID NO: 5839275 - DNA, 14 bp, Homo sapiens
agctgagggaggga

SEQ ID NO: 5839276 - DNA, 19 bp, Homo sapiens
agctgagggagggagccat

SEQ ID NO: 5839277 - DNA, 13 bp, Homo sapiens
agctgagggccct

SEQ ID NO: 5839278 - DNA, 23 bp, Homo sapiens
agctgagggccctgtggagtcca

SEQ ID NO: 5839279 - DNA, 13 bp, Homo sapiens
agctgaggggcag

SEQ ID NO: 5839280 - DNA, 22 bp, Homo sapiens
agctgaggggggccgtgcccag

SEQ ID NO: 5839281 - DNA, 23 bp, Homo sapiens
agctgaggggggccgtgcccagg

SEQ ID NO: 5839282 - DNA, 23 bp, Homo sapiens
agctgaggtctcttgagggagct

SEQ ID NO: 5839283 - DNA, 17 bp, Homo sapiens
agctgaggtgcccagga

SEQ ID NO: 5839284 - DNA, 22 bp, Homo sapiens
agctgaggtgcccaggagaaga

SEQ ID NO: 5839285 - DNA, 18 bp, Homo sapiens
agctgagtactcaggcca

SEQ ID NO: 5839286 - DNA, 19 bp, Homo sapiens
agctgagtattaaaatgta

SEQ ID NO: 5839287 - DNA, 13 bp, Homo sapiens
agctgagtcacct

SEQ ID NO: 5839288 - DNA, 18 bp, Homo sapiens
agctgagtcggctgggca

SEQ ID NO: 5839289 - DNA, 22 bp, Homo sapiens
agctgagtcggctgggcagggc

SEQ ID NO: 5839290 - DNA, 23 bp, Homo sapiens
agctgagtcggctgggcagggcc

SEQ ID NO: 5839291 - DNA, 13 bp, Homo sapiens
agctgagtggcca

SEQ ID NO: 5839292 - DNA, 21 bp, Homo sapiens
agctgagttacttgtctgagg

SEQ ID NO: 5839293 - DNA, 22 bp, Homo sapiens
agctgagttccttataagaatt

SEQ ID NO: 5839294 - DNA, 23 bp, Homo sapiens
agctgagttccttataagaatta

SEQ ID NO: 5839295 - DNA, 16 bp, Homo sapiens
agctgagttgttgtgg

SEQ ID NO: 5839296 - DNA, 21 bp, Homo sapiens
agctgagtttcctatgggaac

SEQ ID NO: 5839297 - DNA, 15 bp, Homo sapiens
agctgatacagagag

SEQ ID NO: 5839298 - DNA, 16 bp, Homo sapiens
agctgatacttcattt

SEQ ID NO: 5839299 - DNA, 20 bp, Homo sapiens
agctgatactttgacagtgt

SEQ ID NO: 5839300 - DNA, 17 bp, Homo sapiens
agctgatagctcctcca

SEQ ID NO: 5839301 - DNA, 20 bp, Homo sapiens
agctgatagtgtttcgttaa

SEQ ID NO: 5839302 - DNA, 15 bp, Homo sapiens
agctgatataaattc

SEQ ID NO: 5839303 - DNA, 20 bp, Homo sapiens
agctgatattatggcaagtg

SEQ ID NO: 5839304 - DNA, 20 bp, Homo sapiens
agctgatattatttcttctc

SEQ ID NO: 5839305 - DNA, 22 bp, Homo sapiens
agctgatattatttcttctctt

SEQ ID NO: 5839306 - DNA, 12 bp, Homo sapiens
agctgatccagt

SEQ ID NO: 5839307 - DNA, 23 bp, Homo sapiens
agctgatccttcaactctgtgag

SEQ ID NO: 5839308 - DNA, 15 bp, Homo sapiens
agctgatgactcaag

SEQ ID NO: 5839309 - DNA, 22 bp, Homo sapiens
agctgatgactcaagattccca

SEQ ID NO: 5839310 - DNA, 20 bp, Homo sapiens
agctgatgaggatcagagcg

SEQ ID NO: 5839311 - DNA, 17 bp, Homo sapiens
agctgatggagaaggaa

SEQ ID NO: 5839312 - DNA, 19 bp, Homo sapiens
agctgattactgtcaataa

SEQ ID NO: 5839313 - DNA, 13 bp, Homo sapiens
agctgattagtgt

SEQ ID NO: 5839314 - DNA, 19 bp, Homo sapiens
agctgattccagaacaaat

SEQ ID NO: 5839315 - DNA, 19 bp, Homo sapiens
agctgattcccagagcaga

SEQ ID NO: 5839316 - DNA, 17 bp, Homo sapiens
agctgattgcagaaagg

SEQ ID NO: 5839317 - DNA, 21 bp, Homo sapiens
agctgattgcagaaaggagag

SEQ ID NO: 5839318 - DNA, 22 bp, Homo sapiens
agctgattgcagaaaggagaga

SEQ ID NO: 5839319 - DNA, 15 bp, Homo sapiens
agctgatttccaggc

SEQ ID NO: 5839320 - DNA, 16 bp, Homo sapiens
agctgatttccaggcc

SEQ ID NO: 5839321 - DNA, 17 bp, Homo sapiens
agctgatttccaggccc

SEQ ID NO: 5839322 - DNA, 15 bp, Homo sapiens
agctgatttgtatat

SEQ ID NO: 5839323 - DNA, 16 bp, Homo sapiens
agctgattttaacaat

SEQ ID NO: 5839324 - DNA, 20 bp, Homo sapiens
agctgattttgtcactgtct

SEQ ID NO: 5839325 - DNA, 18 bp, Homo sapiens
agctgatttttgtctttt

SEQ ID NO: 5839326 - DNA, 16 bp, Homo sapiens
agctgcaaaaggcctg

SEQ ID NO: 5839327 - DNA, 13 bp, Homo sapiens
agctgcaaaggac

SEQ ID NO: 5839328 - DNA, 12 bp, Homo sapiens
agctgcaaagtg

SEQ ID NO: 5839329 - DNA, 13 bp, Homo sapiens
agctgcaaagtgt

SEQ ID NO: 5839330 - DNA, 15 bp, Homo sapiens
agctgcaaagtgttt

SEQ ID NO: 5839331 - DNA, 23 bp, Homo sapiens
agctgcaaggtactctggtgagt

SEQ ID NO: 5839332 - DNA, 14 bp, Homo sapiens
agctgcacacacct

SEQ ID NO: 5839333 - DNA, 15 bp, Homo sapiens
agctgcacacacctg

SEQ ID NO: 5839334 - DNA, 21 bp, Homo sapiens
agctgcacagcaaaagaaact

SEQ ID NO: 5839335 - DNA, 15 bp, Homo sapiens
agctgcacagggcag

SEQ ID NO: 5839336 - DNA, 20 bp, Homo sapiens
agctgcacagggcagctggg

SEQ ID NO: 5839337 - DNA, 11 bp, Homo sapiens
agctgcacatg

SEQ ID NO: 5839338 - DNA, 14 bp, Homo sapiens
agctgcacattcct

SEQ ID NO: 5839339 - DNA, 15 bp, Homo sapiens
agctgcacattcctg

SEQ ID NO: 5839340 - DNA, 19 bp, Homo sapiens
agctgcacattcctggccc

SEQ ID NO: 5839341 - DNA, 20 bp, Homo sapiens
agctgcacattcctggcccc

SEQ ID NO: 5839342 - DNA, 14 bp, Homo sapiens
agctgcaccagagc

SEQ ID NO: 5839343 - DNA, 12 bp, Homo sapiens
agctgggtgggg

SEQ ID NO: 5839344 - DNA, 13 bp, Homo sapiens
agctgggtggggc

SEQ ID NO: 5839345 - DNA, 14 bp, Homo sapiens
agctgggtggtcca

SEQ ID NO: 5839346 - DNA, 22 bp, Homo sapiens
agctgggtgtcaagagggtctg

SEQ ID NO: 5839347 - DNA, 18 bp, Homo sapiens
agctgggtgtggtggcat

SEQ ID NO: 5839348 - DNA, 18 bp, Homo sapiens
agctgggttccgggaggc

SEQ ID NO: 5839349 - DNA, 16 bp, Homo sapiens
agctggtaaaaatgac

SEQ ID NO: 5839350 - DNA, 20 bp, Homo sapiens
agctggtaatcttgctctgc

SEQ ID NO: 5839351 - DNA, 15 bp, Homo sapiens
agctggtagttagta

SEQ ID NO: 5839352 - DNA, 15 bp, Homo sapiens
agctggtcacacaag

SEQ ID NO: 5839353 - DNA, 21 bp, Homo sapiens
agctggtcagtctttgctcag

SEQ ID NO: 5839354 - DNA, 15 bp, Homo sapiens
agctggtcccactca

SEQ ID NO: 5839355 - DNA, 18 bp, Homo sapiens
agctggtcccactcagtc

SEQ ID NO: 5839356 - DNA, 19 bp, Homo sapiens
agctggtcccactcagtcc

SEQ ID NO: 5839357 - DNA, 12 bp, Homo sapiens
agctggtcctgt

SEQ ID NO: 5839358 - DNA, 14 bp, Homo sapiens
agctggtctgccag

SEQ ID NO: 5839359 - DNA, 20 bp, Homo sapiens
agctggtctgtttccaggtc

SEQ ID NO: 5839360 - DNA, 23 bp, Homo sapiens
agctggtcttttctcctactctt

SEQ ID NO: 5839361 - DNA, 14 bp, Homo sapiens
agctggtgactttg

SEQ ID NO: 5839362 - DNA, 13 bp, Homo sapiens
agctggtgccaga

SEQ ID NO: 5839363 - DNA, 21 bp, Homo sapiens
agctggtgccccacctgcctg

SEQ ID NO: 5839364 - DNA, 13 bp, Homo sapiens
agctggtgcggct

SEQ ID NO: 5839365 - DNA, 19 bp, Homo sapiens
agctggtgcggctggccat

SEQ ID NO: 5839366 - DNA, 18 bp, Homo sapiens
agctggtgctgcaaggaa

SEQ ID NO: 5839367 - DNA, 17 bp, Homo sapiens
agctggtggatggtgac

SEQ ID NO: 5839368 - DNA, 16 bp, Homo sapiens
agctggtggcagagtc

SEQ ID NO: 5839369 - DNA, 20 bp, Homo sapiens
agctggtggccctgtgcctg

SEQ ID NO: 5839370 - DNA, 21 bp, Homo sapiens
agctggtggtatctgagttga

SEQ ID NO: 5839371 - DNA, 15 bp, Homo sapiens
agctggtggtgcagc

SEQ ID NO: 5839372 - DNA, 17 bp, Homo sapiens
agctggtggttgtgcct

SEQ ID NO: 5839373 - DNA, 20 bp, Homo sapiens
agctggtggttgtgcctttt

SEQ ID NO: 5839374 - DNA, 13 bp, Homo sapiens
agctggtgtagct

SEQ ID NO: 5839375 - DNA, 18 bp, Homo sapiens
agctggtgtagctacaga

SEQ ID NO: 5839376 - DNA, 22 bp, Homo sapiens
agctggtgtagctacagagaaa

SEQ ID NO: 5839377 - DNA, 19 bp, Homo sapiens
agctggtgtcactctgcct

SEQ ID NO: 5839378 - DNA, 18 bp, Homo sapiens
agctggtgtcagcccctc

SEQ ID NO: 5839379 - DNA, 18 bp, Homo sapiens
agctggtgtctgattgtt

SEQ ID NO: 5839380 - DNA, 17 bp, Homo sapiens
agctggtgttataatac

SEQ ID NO: 5839381 - DNA, 16 bp, Homo sapiens
agctggttactcaggg

SEQ ID NO: 5839382 - DNA, 22 bp, Homo sapiens
agctggttcctgctagaaatgg

SEQ ID NO: 5839383 - DNA, 15 bp, Homo sapiens
agctggttggagagc

SEQ ID NO: 5839384 - DNA, 20 bp, Homo sapiens
agctggtttgtcaaacaaca

SEQ ID NO: 5839385 - DNA, 18 bp, Homo sapiens
agctggttttctctgatg

SEQ ID NO: 5839386 - DNA, 15 bp, Homo sapiens
agctgtaaaaagaga

SEQ ID NO: 5839387 - DNA, 19 bp, Homo sapiens
agctgtaaaaagagagaaa

SEQ ID NO: 5839388 - DNA, 19 bp, Homo sapiens
agctgtaaaacgctgtcaa

SEQ ID NO: 5839389 - DNA, 19 bp, Homo sapiens
agctgtaaactgaatataa

SEQ ID NO: 5839390 - DNA, 16 bp, Homo sapiens
agctgtaactaactca

SEQ ID NO: 5839391 - DNA, 18 bp, Homo sapiens
agctgtaagaagagactg

SEQ ID NO: 5839392 - DNA, 17 bp, Homo sapiens
agctgtaaggcatgaag

SEQ ID NO: 5839393 - DNA, 16 bp, Homo sapiens
agctgtaagggcagtg

SEQ ID NO: 5839394 - DNA, 19 bp, Homo sapiens
agctgtaagggcagtgccc

SEQ ID NO: 5839395 - DNA, 18 bp, Homo sapiens
agctgtacgcgtttgtct

SEQ ID NO: 5839396 - DNA, 13 bp, Homo sapiens
agctgtactcaga

SEQ ID NO: 5839397 - DNA, 14 bp, Homo sapiens
agctgtactcagag

SEQ ID NO: 5839398 - DNA, 19 bp, Homo sapiens
agctgtactcagagcagag

SEQ ID NO: 5839399 - DNA, 20 bp, Homo sapiens
agctgtactcagagcagagc

SEQ ID NO: 5839400 - DNA, 22 bp, Homo sapiens
agctgtactcttctgactgccc

SEQ ID NO: 5839401 - DNA, 17 bp, Homo sapiens
agctgtagaactctgca

SEQ ID NO: 5839402 - DNA, 20 bp, Homo sapiens
agctgtagaactctgcaggc

SEQ ID NO: 5839403 - DNA, 23 bp, Homo sapiens
agctgtagaactctgcaggcaga

SEQ ID NO: 5839404 - DNA, 16 bp, Homo sapiens
agctgtagaggaccag

SEQ ID NO: 5839405 - DNA, 21 bp, Homo sapiens
agctgtagagtaacgagaagt

SEQ ID NO: 5839406 - DNA, 20 bp, Homo sapiens
agctgtagccatggctcagg

SEQ ID NO: 5839407 - DNA, 21 bp, Homo sapiens
agctgtagccatggctcaggc

SEQ ID NO: 5839408 - DNA, 21 bp, Homo sapiens
agctgtagtagccctttctgt

SEQ ID NO: 5839409 - DNA, 22 bp, Homo sapiens
agctgtagtagccctttctgtg

SEQ ID NO: 5839410 - DNA, 23 bp, Homo sapiens
agctgtagtagccctttctgtgt

SEQ ID NO: 5839411 - DNA, 11 bp, Homo sapiens
agctgtagtgg

SEQ ID NO: 5839412 - DNA, 21 bp, Homo sapiens
agctgtagtttccgctttgct

SEQ ID NO: 5839413 - DNA, 22 bp, Homo sapiens
agctgtataactgtgcagagac

SEQ ID NO: 5839414 - DNA, 21 bp, Homo sapiens
agctgtataattaattgtcat

SEQ ID NO: 5839415 - DNA, 14 bp, Homo sapiens
agctgtatataaac

SEQ ID NO: 5839416 - DNA, 20 bp, Homo sapiens
agctgtatataaacgtgtcc

SEQ ID NO: 5839417 - DNA, 23 bp, Homo sapiens
agctgtatatatatatgtgtgtg

SEQ ID NO: 5839418 - DNA, 15 bp, Homo sapiens
agctgtatgatttgt

SEQ ID NO: 5839419 - DNA, 17 bp, Homo sapiens
agctgtatgatttgttt

SEQ ID NO: 5839420 - DNA, 22 bp, Homo sapiens
agctgtatgatttgttttgaat

SEQ ID NO: 5839421 - DNA, 13 bp, Homo sapiens
agctgtatgtact

SEQ ID NO: 5839422 - DNA, 17 bp, Homo sapiens
agctgtattcatatatt

SEQ ID NO: 5839423 - DNA, 18 bp, Homo sapiens
agctgtattcatatattg

SEQ ID NO: 5839424 - DNA, 11 bp, Homo sapiens
agctgtattga

SEQ ID NO: 5839425 - DNA, 16 bp, Homo sapiens
agctgtattgaatcat

SEQ ID NO: 5839426 - DNA, 19 bp, Homo sapiens
agctgtattgaatcatgta

SEQ ID NO: 5839427 - DNA, 15 bp, Homo sapiens
agctgtcacaacttg

SEQ ID NO: 5839428 - DNA, 22 bp, Homo sapiens
agctgtcacaggttttcagaga

SEQ ID NO: 5839429 - DNA, 18 bp, Homo sapiens
agctgtcaccaaggaaac

SEQ ID NO: 5839430 - DNA, 14 bp, Homo sapiens
agctgtcaccacta

SEQ ID NO: 5839431 - DNA, 20 bp, Homo sapiens
agctgtcacctgctcacagg

SEQ ID NO: 5839432 - DNA, 22 bp, Homo sapiens
agctgtcacctgctcacaggga

SEQ ID NO: 5839433 - DNA, 20 bp, Homo sapiens
agctgtcactcacaaaaggc

SEQ ID NO: 5839434 - DNA, 14 bp, Homo sapiens
agctgtcagaagtt

SEQ ID NO: 5839435 - DNA, 18 bp, Homo sapiens
agctgtcagatgtcacat

SEQ ID NO: 5839436 - DNA, 13 bp, Homo sapiens
agctgtcagcctg

SEQ ID NO: 5839437 - DNA, 22 bp, Homo sapiens
agctgtcataaaatgaaacttt

SEQ ID NO: 5839438 - DNA, 11 bp, Homo sapiens
agctgtcatca

SEQ ID NO: 5839439 - DNA, 21 bp, Homo sapiens
agctgtcatggaaaagcccag

SEQ ID NO: 5839440 - DNA, 19 bp, Homo sapiens
agctgtcatggtgcaattt

SEQ ID NO: 5839441 - DNA, 22 bp, Homo sapiens
agctgtccccccactccctcac

SEQ ID NO: 5839442 - DNA, 19 bp, Homo sapiens
agctgtccctgcagggcca

SEQ ID NO: 5839443 - DNA, 14 bp, Homo sapiens
agctgtccctgtca

SEQ ID NO: 5839444 - DNA, 16 bp, Homo sapiens
agctgtcctcctggca

SEQ ID NO: 5839445 - DNA, 20 bp, Homo sapiens
agctgtcctttttcctctcc

SEQ ID NO: 5839446 - DNA, 15 bp, Homo sapiens
agctgtcgcatctca

SEQ ID NO: 5839447 - DNA, 12 bp, Homo sapiens
agctgtcgctgc

SEQ ID NO: 5839448 - DNA, 15 bp, Homo sapiens
agctgtcgctgcctc

SEQ ID NO: 5839449 - DNA, 14 bp, Homo sapiens
agctgtcggagggc

SEQ ID NO: 5839450 - DNA, 16 bp, Homo sapiens
agctgtcgggggccac

SEQ ID NO: 5839451 - DNA, 16 bp, Homo sapiens
agctgtcgtctgactc

SEQ ID NO: 5839452 - DNA, 21 bp, Homo sapiens
agctgtctaacccccagctgg

SEQ ID NO: 5839453 - DNA, 15 bp, Homo sapiens
agctgtctactggac

SEQ ID NO: 5839454 - DNA, 18 bp, Homo sapiens
agctgtctatgcagcctg

SEQ ID NO: 5839455 - DNA, 19 bp, Homo sapiens
agctgtctatgcagcctgc

SEQ ID NO: 5839456 - DNA, 19 bp, Homo sapiens
agctgtctcaaacctccaa

SEQ ID NO: 5839457 - DNA, 13 bp, Homo sapiens
agctgtctccagg

SEQ ID NO: 5839458 - DNA, 15 bp, Homo sapiens
agctgtctctaactt

SEQ ID NO: 5839459 - DNA, 15 bp, Homo sapiens
agctgtctctcttgt

SEQ ID NO: 5839460 - DNA, 16 bp, Homo sapiens
agctgtctgaagccca

SEQ ID NO: 5839461 - DNA, 23 bp, Homo sapiens
agctgtctgaagcccaaagcctg

SEQ ID NO: 5839462 - DNA, 14 bp, Homo sapiens
agctgtctgactgc

SEQ ID NO: 5839463 - DNA, 17 bp, Homo sapiens
agctgtctgcggagcca

SEQ ID NO: 5839464 - DNA, 20 bp, Homo sapiens
agctgtctgcggagccagcg

SEQ ID NO: 5839465 - DNA, 11 bp, Homo sapiens
agctgtctgct

SEQ ID NO: 5839466 - DNA, 13 bp, Homo sapiens
agctgtctgtgaa

SEQ ID NO: 5839467 - DNA, 14 bp, Homo sapiens
agctgtcttcacat

SEQ ID NO: 5839468 - DNA, 13 bp, Homo sapiens
agctgtcttcccc

SEQ ID NO: 5839469 - DNA, 17 bp, Homo sapiens
agctgtcttcccctgag

SEQ ID NO: 5839470 - DNA, 12 bp, Homo sapiens
agctgtcttgga

SEQ ID NO: 5839471 - DNA, 11 bp, Homo sapiens
agctgtcttgt

SEQ ID NO: 5839472 - DNA, 18 bp, Homo sapiens
agctgtcttgtcatcttt

SEQ ID NO: 5839473 - DNA, 11 bp, Homo sapiens
agctgtgaaat

SEQ ID NO: 5839474 - DNA, 17 bp, Homo sapiens
agctgtgaaatgtgcaa

SEQ ID NO: 5839475 - DNA, 12 bp, Homo sapiens
agctgtgaaatt

SEQ ID NO: 5839476 - DNA, 17 bp, Homo sapiens
agctgtgaacatggact

SEQ ID NO: 5839477 - DNA, 15 bp, Homo sapiens
agctgtgaagagact

SEQ ID NO: 5839478 - DNA, 22 bp, Homo sapiens
agctgtgaaggcttcactctta

SEQ ID NO: 5839479 - DNA, 15 bp, Homo sapiens
agctgtgaatggctg

SEQ ID NO: 5839480 - DNA, 17 bp, Homo sapiens
agctgtgaatggctgtg

SEQ ID NO: 5839481 - DNA, 17 bp, Homo sapiens
agctgtgacctgctgag

SEQ ID NO: 5839482 - DNA, 18 bp, Homo sapiens
agctgtgactgagggcct

SEQ ID NO: 5839483 - DNA, 21 bp, Homo sapiens
agctgtgagacagtgggaaat

SEQ ID NO: 5839484 - DNA, 19 bp, Homo sapiens
agctgtgagcaaacagagg

SEQ ID NO: 5839485 - DNA, 20 bp, Homo sapiens
agctgtgagcaaacagagga

SEQ ID NO: 5839486 - DNA, 19 bp, Homo sapiens
agctgtgagccatgcctcc

SEQ ID NO: 5839487 - DNA, 17 bp, Homo sapiens
agctgtgagccttggct

SEQ ID NO: 5839488 - DNA, 22 bp, Homo sapiens
agctgtgagtgcgtgtgtgtga

SEQ ID NO: 5839489 - DNA, 19 bp, Homo sapiens
agctgtgagttctccctgt

SEQ ID NO: 5839490 - DNA, 21 bp, Homo sapiens
agctgtgcaattactgcctgc

SEQ ID NO: 5839491 - DNA, 10 bp, Homo sapiens
agctgtgcag

SEQ ID NO: 5839492 - DNA, 22 bp, Homo sapiens
agctgtgcagcacgtctcagag

SEQ ID NO: 5839493 - DNA, 14 bp, Homo sapiens
agctgtgcaggcat

SEQ ID NO: 5839494 - DNA, 13 bp, Homo sapiens
agctgtgcagtgg

SEQ ID NO: 5839495 - DNA, 12 bp, Homo sapiens
agctgtgccacc

SEQ ID NO: 5839496 - DNA, 18 bp, Homo sapiens
agctgtgccaccctgggc

SEQ ID NO: 5839497 - DNA, 14 bp, Homo sapiens
agctgtgccagcag

SEQ ID NO: 5839498 - DNA, 17 bp, Homo sapiens
agctgtgccagcagggg

SEQ ID NO: 5839499 - DNA, 13 bp, Homo sapiens
agctgtgccagct

SEQ ID NO: 5839500 - DNA, 15 bp, Homo sapiens
agctgtgccagctgc

SEQ ID NO: 5839501 - DNA, 16 bp, Homo sapiens
agctgtgccagctgct

SEQ ID NO: 5839502 - DNA, 17 bp, Homo sapiens
agctgtgccagctgctt

SEQ ID NO: 5839503 - DNA, 21 bp, Homo sapiens
agctgtgccagctgcttctgc

SEQ ID NO: 5839504 - DNA, 17 bp, Homo sapiens
agctgtgccccctctgg

SEQ ID NO: 5839505 - DNA, 18 bp, Homo sapiens
agctgtgccccctctggt

SEQ ID NO: 5839506 - DNA, 18 bp, Homo sapiens
agctgtgcccctccccca

SEQ ID NO: 5839507 - DNA, 20 bp, Homo sapiens
agctgtgcccctcccccagg

SEQ ID NO: 5839508 - DNA, 20 bp, Homo sapiens
agctgtgccctattgtgtgg

SEQ ID NO: 5839509 - DNA, 16 bp, Homo sapiens
agctgtgcctgctcag

SEQ ID NO: 5839510 - DNA, 17 bp, Homo sapiens
agctgtgcctgctcagc

SEQ ID NO: 5839511 - DNA, 18 bp, Homo sapiens
agctgtgcctgctcagca

SEQ ID NO: 5839512 - DNA, 20 bp, Homo sapiens
agctgtgcctgctcagcagc

SEQ ID NO: 5839513 - DNA, 22 bp, Homo sapiens
agctgtgcctgctcagcagcca

SEQ ID NO: 5839514 - DNA, 22 bp, Homo sapiens
agctgtgccttttttagcttca

SEQ ID NO: 5839515 - DNA, 20 bp, Homo sapiens
agctgtgcgagaacacaagc

SEQ ID NO: 5839516 - DNA, 21 bp, Homo sapiens
agctgtgctctggacaggcat

SEQ ID NO: 5839517 - DNA, 23 bp, Homo sapiens
agctgtgctgggaagcccggact

SEQ ID NO: 5839518 - DNA, 21 bp, Homo sapiens
agctgtggcagagttacagtt

SEQ ID NO: 5839519 - DNA, 13 bp, Homo sapiens
agctgtggcagcc

SEQ ID NO: 5839520 - DNA, 20 bp, Homo sapiens
agctgtggcagccgtcccag

SEQ ID NO: 5839521 - DNA, 19 bp, Homo sapiens
agcttcttcagagtgaaga

SEQ ID NO: 5839522 - DNA, 12 bp, Homo sapiens
agcttcttccag

SEQ ID NO: 5839523 - DNA, 22 bp, Homo sapiens
agcttcttcctaggtccaagcc

SEQ ID NO: 5839524 - DNA, 17 bp, Homo sapiens
agcttcttcgttcctgc

SEQ ID NO: 5839525 - DNA, 16 bp, Homo sapiens
agcttcttctgaaaga

SEQ ID NO: 5839526 - DNA, 12 bp, Homo sapiens
agcttcttctgc

SEQ ID NO: 5839527 - DNA, 12 bp, Homo sapiens
agcttcttgggc

SEQ ID NO: 5839528 - DNA, 23 bp, Homo sapiens
agcttcttgtgatcctttggggc

SEQ ID NO: 5839529 - DNA, 22 bp, Homo sapiens
agcttctttcccttagtgactc

SEQ ID NO: 5839530 - DNA, 11 bp, Homo sapiens
agcttctttct

SEQ ID NO: 5839531 - DNA, 14 bp, Homo sapiens
agcttctttgccaa

SEQ ID NO: 5839532 - DNA, 17 bp, Homo sapiens
agcttgaaactgagatg

SEQ ID NO: 5839533 - DNA, 18 bp, Homo sapiens
agcttgaacctgcttcct

SEQ ID NO: 5839534 - DNA, 22 bp, Homo sapiens
agcttgaagatcgttagtatct

SEQ ID NO: 5839535 - DNA, 22 bp, Homo sapiens
agcttgaatgtccccattctat

SEQ ID NO: 5839536 - DNA, 20 bp, Homo sapiens
agcttgacattatgttttat

SEQ ID NO: 5839537 - DNA, 17 bp, Homo sapiens
agcttgaccagacctag

SEQ ID NO: 5839538 - DNA, 16 bp, Homo sapiens
agcttgacctgaggct

SEQ ID NO: 5839539 - DNA, 15 bp, Homo sapiens
agcttgactcccaag

SEQ ID NO: 5839540 - DNA, 22 bp, Homo sapiens
agcttgagagttttctttcttt

SEQ ID NO: 5839541 - DNA, 23 bp, Homo sapiens
agcttgagccgggcccctgggct

SEQ ID NO: 5839542 - DNA, 21 bp, Homo sapiens
agcttgagcctcccccaaagc

SEQ ID NO: 5839543 - DNA, 15 bp, Homo sapiens
agcttgagcctgaaa

SEQ ID NO: 5839544 - DNA, 19 bp, Homo sapiens
agcttgaggcaattttaat

SEQ ID NO: 5839545 - DNA, 21 bp, Homo sapiens
agcttgaggccaagatggctg

SEQ ID NO: 5839546 - DNA, 23 bp, Homo sapiens
agcttgaggccaagatggctgct

SEQ ID NO: 5839547 - DNA, 18 bp, Homo sapiens
agcttgataaagggccaa

SEQ ID NO: 5839548 - DNA, 15 bp, Homo sapiens
agcttgattaaatca

SEQ ID NO: 5839549 - DNA, 15 bp, Homo sapiens
agcttgcaagaagca

SEQ ID NO: 5839550 - DNA, 19 bp, Homo sapiens
agcttgcaatgagccaaga

SEQ ID NO: 5839551 - DNA, 12 bp, Homo sapiens
agcttgcacagc

SEQ ID NO: 5839552 - DNA, 15 bp, Homo sapiens
agcttgcacagccaa

SEQ ID NO: 5839553 - DNA, 14 bp, Homo sapiens
agcttgcacatttg

SEQ ID NO: 5839554 - DNA, 14 bp, Homo sapiens
agcttgcagctgga

SEQ ID NO: 5839555 - DNA, 20 bp, Homo sapiens
agcttgcagtgaagtgttct

SEQ ID NO: 5839556 - DNA, 15 bp, Homo sapiens
agcttgccagatgct

SEQ ID NO: 5839557 - DNA, 12 bp, Homo sapiens
agcttgcccccg

SEQ ID NO: 5839558 - DNA, 20 bp, Homo sapiens
agcttgccctggtgcctcac

SEQ ID NO: 5839559 - DNA, 19 bp, Homo sapiens
agcttgccctgttaaaaga

SEQ ID NO: 5839560 - DNA, 15 bp, Homo sapiens
agcttgcctaatggc

SEQ ID NO: 5839561 - DNA, 14 bp, Homo sapiens
agcttgcctcaggg

SEQ ID NO: 5839562 - DNA, 14 bp, Homo sapiens
agcttgcctgcctg

SEQ ID NO: 5839563 - DNA, 22 bp, Homo sapiens
agcttgcgcattctcatggaga

SEQ ID NO: 5839564 - DNA, 23 bp, Homo sapiens
agcttgcgcattctcatggagaa

SEQ ID NO: 5839565 - DNA, 21 bp, Homo sapiens
agcttgctccagattctgatg

SEQ ID NO: 5839566 - DNA, 15 bp, Homo sapiens
agcttgctccctgtg

SEQ ID NO: 5839567 - DNA, 14 bp, Homo sapiens
agcttgctcttcag

SEQ ID NO: 5839568 - DNA, 19 bp, Homo sapiens
agcttgctcttcagtggga

SEQ ID NO: 5839569 - DNA, 14 bp, Homo sapiens
agcttgctgagggg

SEQ ID NO: 5839570 - DNA, 20 bp, Homo sapiens
agcttgctgaggggcaggga

SEQ ID NO: 5839571 - DNA, 21 bp, Homo sapiens
agcttgctgaggggcagggag

SEQ ID NO: 5839572 - DNA, 20 bp, Homo sapiens
agcttgctgccctaggctcc

SEQ ID NO: 5839573 - DNA, 20 bp, Homo sapiens
agcttgctggagagtggcat

SEQ ID NO: 5839574 - DNA, 15 bp, Homo sapiens
agcttgctgggcttt

SEQ ID NO: 5839575 - DNA, 20 bp, Homo sapiens
agcttgctgtcacttcttca

SEQ ID NO: 5839576 - DNA, 19 bp, Homo sapiens
agcttgcttcattgggctg

SEQ ID NO: 5839577 - DNA, 20 bp, Homo sapiens
agcttgcttcattgggctgt

SEQ ID NO: 5839578 - DNA, 18 bp, Homo sapiens
agcttgctttgatttaca

SEQ ID NO: 5839579 - DNA, 18 bp, Homo sapiens
agcttggaaagggaagat

SEQ ID NO: 5839580 - DNA, 17 bp, Homo sapiens
agcttggaagagcctgc

SEQ ID NO: 5839581 - DNA, 23 bp, Homo sapiens
agcttggactacacaatacagta

SEQ ID NO: 5839582 - DNA, 18 bp, Homo sapiens
agcttggagacaggattc

SEQ ID NO: 5839583 - DNA, 16 bp, Homo sapiens
agcttggagccccctg

SEQ ID NO: 5839584 - DNA, 18 bp, Homo sapiens
agcttggagccccctggc

SEQ ID NO: 5839585 - DNA, 20 bp, Homo sapiens
agcttggagccccctggcgg

SEQ ID NO: 5839586 - DNA, 14 bp, Homo sapiens
agcttggaggaggg

SEQ ID NO: 5839587 - DNA, 15 bp, Homo sapiens
agcttggagtgccac

SEQ ID NO: 5839588 - DNA, 19 bp, Homo sapiens
agcttggagtgccacgtgg

SEQ ID NO: 5839589 - DNA, 17 bp, Homo sapiens
agcttggcaattcatgg

SEQ ID NO: 5839590 - DNA, 21 bp, Homo sapiens
agcttggcaattcatggggca

SEQ ID NO: 5839591 - DNA, 17 bp, Homo sapiens
agcttggcagccgagct

SEQ ID NO: 5839592 - DNA, 20 bp, Homo sapiens
agcttggcagccgagctcgt

SEQ ID NO: 5839593 - DNA, 15 bp, Homo sapiens
agcttggcatgacct

SEQ ID NO: 5839594 - DNA, 17 bp, Homo sapiens
agcttggcatggtggca

SEQ ID NO: 5839595 - DNA, 14 bp, Homo sapiens
agcttggccagaag

SEQ ID NO: 5839596 - DNA, 18 bp, Homo sapiens
agcttggccctgcgccct

SEQ ID NO: 5839597 - DNA, 20 bp, Homo sapiens
agcttggctctcctctggct

SEQ ID NO: 5839598 - DNA, 16 bp, Homo sapiens
agcttggctgtagaag

SEQ ID NO: 5839599 - DNA, 15 bp, Homo sapiens
agcttggcttcctct

SEQ ID NO: 5839600 - DNA, 14 bp, Homo sapiens
agcttgggaatgga

SEQ ID NO: 5839601 - DNA, 18 bp, Homo sapiens
agcttgggactcaggtct

SEQ ID NO: 5839602 - DNA, 18 bp, Homo sapiens
agcttgggataaagcaag

SEQ ID NO: 5839603 - DNA, 11 bp, Homo sapiens
agcttgggcag

SEQ ID NO: 5839604 - DNA, 19 bp, Homo sapiens
agcttgggcagtgccccag

SEQ ID NO: 5839605 - DNA, 20 bp, Homo sapiens
agcttgggcagtgccccagg

SEQ ID NO: 5839606 - DNA, 21 bp, Homo sapiens
agcttgggcagtgccccaggg

SEQ ID NO: 5839607 - DNA, 23 bp, Homo sapiens
agcttgggcccagctgggctctg

SEQ ID NO: 5839608 - DNA, 15 bp, Homo sapiens
agcttgggcttcttc

SEQ ID NO: 5839609 - DNA, 18 bp, Homo sapiens
agcttgggcttcttcctc

SEQ ID NO: 5839610 - DNA, 20 bp, Homo sapiens
agcttggggaacccatgagt

SEQ ID NO: 5839611 - DNA, 14 bp, Homo sapiens
agcttggggaagac

SEQ ID NO: 5839612 - DNA, 15 bp, Homo sapiens
agcttggggacctga

SEQ ID NO: 5839613 - DNA, 21 bp, Homo sapiens
agcttggggccaccaaagctg

SEQ ID NO: 5839614 - DNA, 14 bp, Homo sapiens
agcttggggccagg

SEQ ID NO: 5839615 - DNA, 16 bp, Homo sapiens
agcttggggccaggga

SEQ ID NO: 5839616 - DNA, 22 bp, Homo sapiens
agcttggggctttttccatctt

SEQ ID NO: 5839617 - DNA, 20 bp, Homo sapiens
agcttgggtcaggttcttgc

SEQ ID NO: 5839618 - DNA, 18 bp, Homo sapiens
agcttgggtccaccatgc

SEQ ID NO: 5839619 - DNA, 22 bp, Homo sapiens
agcttgggtccaccatgcagaa

SEQ ID NO: 5839620 - DNA, 15 bp, Homo sapiens
agcttgggtctctct

SEQ ID NO: 5839621 - DNA, 18 bp, Homo sapiens
agcttggtatgagacaga

SEQ ID NO: 5839622 - DNA, 19 bp, Homo sapiens
agcttggtgacaaaattca

SEQ ID NO: 5839623 - DNA, 16 bp, Homo sapiens
agcttggtggctgagc

SEQ ID NO: 5839624 - DNA, 14 bp, Homo sapiens
agcttggttccagg

SEQ ID NO: 5839625 - DNA, 21 bp, Homo sapiens
agcttgtaaatagctcaggtg

SEQ ID NO: 5839626 - DNA, 14 bp, Homo sapiens
agcttgtaaatatg

SEQ ID NO: 5839627 - DNA, 18 bp, Homo sapiens
agcttgtacacatataca

SEQ ID NO: 5839628 - DNA, 15 bp, Homo sapiens
agcttgtagccagcc

SEQ ID NO: 5839629 - DNA, 17 bp, Homo sapiens
agcttgtatatacatat

SEQ ID NO: 5839630 - DNA, 18 bp, Homo sapiens
agcttgtatatacatatt

SEQ ID NO: 5839631 - DNA, 19 bp, Homo sapiens
agcttgtatatacatatta

SEQ ID NO: 5839632 - DNA, 13 bp, Homo sapiens
agcttgtatctga

SEQ ID NO: 5839633 - DNA, 15 bp, Homo sapiens
agcttgtatgtaagg

SEQ ID NO: 5839634 - DNA, 23 bp, Homo sapiens
agcttgtatgtaaggaggtttgt

SEQ ID NO: 5839635 - DNA, 21 bp, Homo sapiens
agcttgtccaggttgatcttg

SEQ ID NO: 5839636 - DNA, 22 bp, Homo sapiens
agcttgtccaggttgatcttga

SEQ ID NO: 5839637 - DNA, 15 bp, Homo sapiens
agcttgtccttgctc

SEQ ID NO: 5839638 - DNA, 16 bp, Homo sapiens
agcttgtctcttgcct

SEQ ID NO: 5839639 - DNA, 20 bp, Homo sapiens
agcttgtctgtgatctctgc

SEQ ID NO: 5839640 - DNA, 16 bp, Homo sapiens
agcttgtcttttctgc

SEQ ID NO: 5839641 - DNA, 22 bp, Homo sapiens
agcttgtcttttctgctgagga

SEQ ID NO: 5839642 - DNA, 11 bp, Homo sapiens
agcttgtgaaa

SEQ ID NO: 5839643 - DNA, 13 bp, Homo sapiens
agcttgtgaagat

SEQ ID NO: 5839644 - DNA, 23 bp, Homo sapiens
agcttgtgaatgtttagtgtgct

SEQ ID NO: 5839645 - DNA, 17 bp, Homo sapiens
agcttgtgagagctggt

SEQ ID NO: 5839646 - DNA, 18 bp, Homo sapiens
agcttgtgattcctaccc

SEQ ID NO: 5839647 - DNA, 19 bp, Homo sapiens
agcttgtgcacaattctgt

SEQ ID NO: 5839648 - DNA, 12 bp, Homo sapiens
agcttgtgcctt

SEQ ID NO: 5839649 - DNA, 18 bp, Homo sapiens
agcttgtgctcctcttga

SEQ ID NO: 5839650 - DNA, 17 bp, Homo sapiens
agcttgtggcaagtgaa

SEQ ID NO: 5839651 - DNA, 16 bp, Homo sapiens
agcttgtggtggggca

SEQ ID NO: 5839652 - DNA, 21 bp, Homo sapiens
agcttgtggtgttcctgaagc

SEQ ID NO: 5839653 - DNA, 20 bp, Homo sapiens
agcttgtgtatccattatca

SEQ ID NO: 5839654 - DNA, 15 bp, Homo sapiens
agcttgtgtatcttg

SEQ ID NO: 5839655 - DNA, 19 bp, Homo sapiens
agcttgtgtatcttgatta

SEQ ID NO: 5839656 - DNA, 18 bp, Homo sapiens
agcttgtgtcctgtcctt

SEQ ID NO: 5839657 - DNA, 17 bp, Homo sapiens
agcttgttccctgtctt

SEQ ID NO: 5839658 - DNA, 16 bp, Homo sapiens
agcttgttctgggctc

SEQ ID NO: 5839659 - DNA, 11 bp, Homo sapiens
agcttgttgaa

SEQ ID NO: 5839660 - DNA, 17 bp, Homo sapiens
agcttgttgaaaaccca

SEQ ID NO: 5839661 - DNA, 22 bp, Homo sapiens
agcttgttgtcccaatgaaata

SEQ ID NO: 5839662 - DNA, 15 bp, Homo sapiens
agcttgttgtctcca

SEQ ID NO: 5839663 - DNA, 15 bp, Homo sapiens
agcttgtttccctgc

SEQ ID NO: 5839664 - DNA, 22 bp, Homo sapiens
agcttgtttccctgctggccaa

SEQ ID NO: 5839665 - DNA, 13 bp, Homo sapiens
agcttgtttctat

SEQ ID NO: 5839666 - DNA, 15 bp, Homo sapiens
agcttgtttctgtca

SEQ ID NO: 5839667 - DNA, 22 bp, Homo sapiens
agcttgtttctgtcaagcatat

SEQ ID NO: 5839668 - DNA, 17 bp, Homo sapiens
agcttgtttgttctagt

SEQ ID NO: 5839669 - DNA, 17 bp, Homo sapiens
agcttgttttattttgt

SEQ ID NO: 5839670 - DNA, 19 bp, Homo sapiens
agcttgttttggactttgt

SEQ ID NO: 5839671 - DNA, 21 bp, Homo sapiens
agcttgttttggactttgtta

SEQ ID NO: 5839672 - DNA, 17 bp, Homo sapiens
agctttaaaaaaataat

SEQ ID NO: 5839673 - DNA, 20 bp, Homo sapiens
agctttaaaaaaataattgg

SEQ ID NO: 5839674 - DNA, 16 bp, Homo sapiens
agctttaaaaaataaa

SEQ ID NO: 5839675 - DNA, 15 bp, Homo sapiens
agctttaaaaagaaa

SEQ ID NO: 5839676 - DNA, 16 bp, Homo sapiens
agctttaaaagtatct

SEQ ID NO: 5839677 - DNA, 18 bp, Homo sapiens
agctttaaaagtatcttt

SEQ ID NO: 5839678 - DNA, 16 bp, Homo sapiens
agctttaaaggccagg

SEQ ID NO: 5839679 - DNA, 14 bp, Homo sapiens
agctttaaatcatt

SEQ ID NO: 5839680 - DNA, 15 bp, Homo sapiens
agctttaaatgacag

SEQ ID NO: 5839681 - DNA, 19 bp, Homo sapiens
agctttaaatgacagtaat

SEQ ID NO: 5839682 - DNA, 16 bp, Homo sapiens
agctttaaatggcaat

SEQ ID NO: 5839683 - DNA, 12 bp, Homo sapiens
agctttaaatta

SEQ ID NO: 5839684 - DNA, 13 bp, Homo sapiens
agctttaacattt

SEQ ID NO: 5839685 - DNA, 16 bp, Homo sapiens
agctttaatcaatcat

SEQ ID NO: 5839686 - DNA, 16 bp, Homo sapiens
agctttaattaagctc

SEQ ID NO: 5839687 - DNA, 17 bp, Homo sapiens
agctttacaacttccat

SEQ ID NO: 5839688 - DNA, 13 bp, Homo sapiens
agctttacacaca

SEQ ID NO: 5839689 - DNA, 18 bp, Homo sapiens
agctttacatattccttt

SEQ ID NO: 5839690 - DNA, 15 bp, Homo sapiens
agctttacatgcaat

SEQ ID NO: 5839691 - DNA, 21 bp, Homo sapiens
agctttacatgcaatttatta

SEQ ID NO: 5839692 - DNA, 19 bp, Homo sapiens
agctttaccaggttgtcct

SEQ ID NO: 5839693 - DNA, 13 bp, Homo sapiens
agctttaccctca

SEQ ID NO: 5839694 - DNA, 20 bp, Homo sapiens
agctttaccctcaggcatag

SEQ ID NO: 5839695 - DNA, 23 bp, Homo sapiens
agctttactctttcatgccattt

SEQ ID NO: 5839696 - DNA, 20 bp, Homo sapiens
agctttactgtggctgtctg

SEQ ID NO: 5839697 - DNA, 16 bp, Homo sapiens
agctttactgtttctc

SEQ ID NO: 5839698 - DNA, 12 bp, Homo sapiens
agctttagaaat

SEQ ID NO: 5839699 - DNA, 15 bp, Homo sapiens
aggaactggaacaca

SEQ ID NO: 5839700 - DNA, 14 bp, Homo sapiens
aggaactggctcct

SEQ ID NO: 5839701 - DNA, 23 bp, Homo sapiens
aggaactggggctttgccttgca

SEQ ID NO: 5839702 - DNA, 22 bp, Homo sapiens
aggaactggtccaggccaggcc

SEQ ID NO: 5839703 - DNA, 18 bp, Homo sapiens
aggaactgtagatgatgt

SEQ ID NO: 5839704 - DNA, 16 bp, Homo sapiens
aggaactgtccagaga

SEQ ID NO: 5839705 - DNA, 21 bp, Homo sapiens
aggaacttaaataatgtgaaa

SEQ ID NO: 5839706 - DNA, 23 bp, Homo sapiens
aggaacttaaataatgtgaaact

SEQ ID NO: 5839707 - DNA, 13 bp, Homo sapiens
aggaacttcagag

SEQ ID NO: 5839708 - DNA, 14 bp, Homo sapiens
aggaacttgaatac

SEQ ID NO: 5839709 - DNA, 18 bp, Homo sapiens
aggaacttgagaacttta

SEQ ID NO: 5839710 - DNA, 18 bp, Homo sapiens
aggaacttgctgctgtgc

SEQ ID NO: 5839711 - DNA, 21 bp, Homo sapiens
aggaacttgctgctgtgcctg

SEQ ID NO: 5839712 - DNA, 13 bp, Homo sapiens
aggaactttcccc

SEQ ID NO: 5839713 - DNA, 23 bp, Homo sapiens
aggaactttctggtcccttcagt

SEQ ID NO: 5839714 - DNA, 13 bp, Homo sapiens
aggaagaaaaaag

SEQ ID NO: 5839715 - DNA, 17 bp, Homo sapiens
aggaagaaaaaagatcc

SEQ ID NO: 5839716 - DNA, 12 bp, Homo sapiens
aggaagaaaacg

SEQ ID NO: 5839717 - DNA, 14 bp, Homo sapiens
aggaagaaaacgga

SEQ ID NO: 5839718 - DNA, 19 bp, Homo sapiens
aggaagaaacagaagagag

SEQ ID NO: 5839719 - DNA, 16 bp, Homo sapiens
aggaagaaaccccaag

SEQ ID NO: 5839720 - DNA, 17 bp, Homo sapiens
aggaagaaaccccaagc

SEQ ID NO: 5839721 - DNA, 11 bp, Homo sapiens
aggaagaaatc

SEQ ID NO: 5839722 - DNA, 16 bp, Homo sapiens
aggaagaaattaactt

SEQ ID NO: 5839723 - DNA, 15 bp, Homo sapiens
aggaagaaattcagg

SEQ ID NO: 5839724 - DNA, 17 bp, Homo sapiens
aggaagaaattcaggta

SEQ ID NO: 5839725 - DNA, 20 bp, Homo sapiens
aggaagaacgcggtgtgtaa

SEQ ID NO: 5839726 - DNA, 22 bp, Homo sapiens
aggaagaacggggctcttctca

SEQ ID NO: 5839727 - DNA, 16 bp, Homo sapiens
aggaagaacgtttttt

SEQ ID NO: 5839728 - DNA, 20 bp, Homo sapiens
aggaagaagcttaggcaggg

SEQ ID NO: 5839729 - DNA, 12 bp, Homo sapiens
aggaagaaggtg

SEQ ID NO: 5839730 - DNA, 20 bp, Homo sapiens
aggaagaagtggtactagtg

SEQ ID NO: 5839731 - DNA, 17 bp, Homo sapiens
aggaagaatagggccca

SEQ ID NO: 5839732 - DNA, 23 bp, Homo sapiens
aggaagaatggtgtgtttcccta

SEQ ID NO: 5839733 - DNA, 17 bp, Homo sapiens
aggaagaattacaattt

SEQ ID NO: 5839734 - DNA, 18 bp, Homo sapiens
aggaagaattcctgccat

SEQ ID NO: 5839735 - DNA, 16 bp, Homo sapiens
aggaagacataaaact

SEQ ID NO: 5839736 - DNA, 22 bp, Homo sapiens
aggaagacatctgtagggaatt

SEQ ID NO: 5839737 - DNA, 14 bp, Homo sapiens
aggaagactctgga

SEQ ID NO: 5839738 - DNA, 18 bp, Homo sapiens
aggaagactggagaaatg

SEQ ID NO: 5839739 - DNA, 13 bp, Homo sapiens
aggaagacttcat

SEQ ID NO: 5839740 - DNA, 22 bp, Homo sapiens
aggaagacttggcccaggaaaa

SEQ ID NO: 5839741 - DNA, 13 bp, Homo sapiens
aggaagactttgg

SEQ ID NO: 5839742 - DNA, 14 bp, Homo sapiens
aggaagactttgga

SEQ ID NO: 5839743 - DNA, 15 bp, Homo sapiens
aggaagactttggaa

SEQ ID NO: 5839744 - DNA, 14 bp, Homo sapiens
aggaagagaagaca

SEQ ID NO: 5839745 - DNA, 14 bp, Homo sapiens
aggaagagaaggag

SEQ ID NO: 5839746 - DNA, 14 bp, Homo sapiens
aggaagagacactc

SEQ ID NO: 5839747 - DNA, 21 bp, Homo sapiens
aggaagagacatgagaaaggg

SEQ ID NO: 5839748 - DNA, 12 bp, Homo sapiens
aggaagagagag

SEQ ID NO: 5839749 - DNA, 14 bp, Homo sapiens
aggaagagagcatg

SEQ ID NO: 5839750 - DNA, 12 bp, Homo sapiens
aggaagagcagg

SEQ ID NO: 5839751 - DNA, 20 bp, Homo sapiens
aggaagagccacctgcaaga

SEQ ID NO: 5839752 - DNA, 14 bp, Homo sapiens
aggaagagccagcc

SEQ ID NO: 5839753 - DNA, 19 bp, Homo sapiens
aggaagagcccgcagggcc

SEQ ID NO: 5839754 - DNA, 17 bp, Homo sapiens
aggaagagccttccacc

SEQ ID NO: 5839755 - DNA, 19 bp, Homo sapiens
aggaagagccttccaccca

SEQ ID NO: 5839756 - DNA, 13 bp, Homo sapiens
aggaagaggccca

SEQ ID NO: 5839757 - DNA, 14 bp, Homo sapiens
aggaagaggcccac

SEQ ID NO: 5839758 - DNA, 13 bp, Homo sapiens
aggaagaggccgc

SEQ ID NO: 5839759 - DNA, 15 bp, Homo sapiens
aggaagaggctgcac

SEQ ID NO: 5839760 - DNA, 17 bp, Homo sapiens
aggaagagggctgagct

SEQ ID NO: 5839761 - DNA, 18 bp, Homo sapiens
aggaagagggctgagctg

SEQ ID NO: 5839762 - DNA, 16 bp, Homo sapiens
aggaagaggggcgctg

SEQ ID NO: 5839763 - DNA, 20 bp, Homo sapiens
aggaagagggtagacagggg

SEQ ID NO: 5839764 - DNA, 15 bp, Homo sapiens
aggaagagtcttggt

SEQ ID NO: 5839765 - DNA, 12 bp, Homo sapiens
aggaagagttta

SEQ ID NO: 5839766 - DNA, 18 bp, Homo sapiens
aggaagatatcatgaaag

SEQ ID NO: 5839767 - DNA, 21 bp, Homo sapiens
aggaagatcactttgctctga

SEQ ID NO: 5839768 - DNA, 18 bp, Homo sapiens
aggaagatcccccagaaa

SEQ ID NO: 5839769 - DNA, 20 bp, Homo sapiens
aggaagatcctgaagcagtt

SEQ ID NO: 5839770 - DNA, 18 bp, Homo sapiens
aggaagatcttaaatttt

SEQ ID NO: 5839771 - DNA, 20 bp, Homo sapiens
aggaagatcttgagagctgc

SEQ ID NO: 5839772 - DNA, 15 bp, Homo sapiens
aggaagatgaagaga

SEQ ID NO: 5839773 - DNA, 20 bp, Homo sapiens
aggaagatgaagagaagctg

SEQ ID NO: 5839774 - DNA, 22 bp, Homo sapiens
aggaagatgctcatctgagcca

SEQ ID NO: 5839775 - DNA, 16 bp, Homo sapiens
aggaagatgggaggtg

SEQ ID NO: 5839776 - DNA, 20 bp, Homo sapiens
aggaagatgggggcaagaag

SEQ ID NO: 5839777 - DNA, 14 bp, Homo sapiens
aggaagatgttcaa

SEQ ID NO: 5839778 - DNA, 15 bp, Homo sapiens
aggaagatgttctgt

SEQ ID NO: 5839779 - DNA, 16 bp, Homo sapiens
aggaagatgtttacat

SEQ ID NO: 5839780 - DNA, 20 bp, Homo sapiens
aggaagattaaaaccacaga

SEQ ID NO: 5839781 - DNA, 23 bp, Homo sapiens
aggaagattccctcttcctgcca

SEQ ID NO: 5839782 - DNA, 18 bp, Homo sapiens
aggaagatttgtctactt

SEQ ID NO: 5839783 - DNA, 19 bp, Homo sapiens
aggaagatttgtctacttg

SEQ ID NO: 5839784 - DNA, 16 bp, Homo sapiens
aggaagcaagaaagcc

SEQ ID NO: 5839785 - DNA, 21 bp, Homo sapiens
aggaagcacaaaagacaagca

SEQ ID NO: 5839786 - DNA, 21 bp, Homo sapiens
aggaagcacaagaagtgggag

SEQ ID NO: 5839787 - DNA, 22 bp, Homo sapiens
aggaagcacaagaagtgggagt

SEQ ID NO: 5839788 - DNA, 20 bp, Homo sapiens
aggaagcacactgcagggct

SEQ ID NO: 5839789 - DNA, 21 bp, Homo sapiens
aggaagcacactgcagggctg

SEQ ID NO: 5839790 - DNA, 23 bp, Homo sapiens
aggaagcacactgcagggctgct

SEQ ID NO: 5839791 - DNA, 16 bp, Homo sapiens
aggaagcacaggccag

SEQ ID NO: 5839792 - DNA, 21 bp, Homo sapiens
aggaagcacaggtccaaggct

SEQ ID NO: 5839793 - DNA, 17 bp, Homo sapiens
aggaagcacatgcctct

SEQ ID NO: 5839794 - DNA, 24 bp, Homo sapiens
aggaagcacatgcctctctcaggc

SEQ ID NO: 5839795 - DNA, 15 bp, Homo sapiens
aggaagcacctctca

SEQ ID NO: 5839796 - DNA, 19 bp, Homo sapiens
aggaagcagaataaagcaa

SEQ ID NO: 5839797 - DNA, 20 bp, Homo sapiens
aggaagcagaataaagcaat

SEQ ID NO: 5839798 - DNA, 16 bp, Homo sapiens
aggaagcagagcactg

SEQ ID NO: 5839799 - DNA, 15 bp, Homo sapiens
aggaagcagatacct

SEQ ID NO: 5839800 - DNA, 15 bp, Homo sapiens
aggaagcagcaatta

SEQ ID NO: 5839801 - DNA, 12 bp, Homo sapiens
aggaagcaggga

SEQ ID NO: 5839802 - DNA, 19 bp, Homo sapiens
aggaagcagggagagttgg

SEQ ID NO: 5839803 - DNA, 19 bp, Homo sapiens
aggaagcaggtgtcctttc

SEQ ID NO: 5839804 - DNA, 22 bp, Homo sapiens
aggaagcaggtgtcctttcccc

SEQ ID NO: 5839805 - DNA, 18 bp, Homo sapiens
aggaagcagttggggccc

SEQ ID NO: 5839806 - DNA, 18 bp, Homo sapiens
aggaagcatccaaagatt

SEQ ID NO: 5839807 - DNA, 19 bp, Homo sapiens
aggaagcatccaaagattg

SEQ ID NO: 5839808 - DNA, 18 bp, Homo sapiens
aggaagcattcagagagc

SEQ ID NO: 5839809 - DNA, 22 bp, Homo sapiens
aggaagccaaagagactgggcc

SEQ ID NO: 5839810 - DNA, 15 bp, Homo sapiens
aggaagccaaattta

SEQ ID NO: 5839811 - DNA, 16 bp, Homo sapiens
aggaagccaaatttat

SEQ ID NO: 5839812 - DNA, 20 bp, Homo sapiens
aggaagccacgtgctggaga

SEQ ID NO: 5839813 - DNA, 12 bp, Homo sapiens
aggaagccagag

SEQ ID NO: 5839814 - DNA, 16 bp, Homo sapiens
aggaagccagctggct

SEQ ID NO: 5839815 - DNA, 21 bp, Homo sapiens
aggaagccatagatgctggct

SEQ ID NO: 5839816 - DNA, 16 bp, Homo sapiens
aggaagcccaaggcag

SEQ ID NO: 5839817 - DNA, 17 bp, Homo sapiens
aggaagcccaaggcagt

SEQ ID NO: 5839818 - DNA, 14 bp, Homo sapiens
aggaagcccacata

SEQ ID NO: 5839819 - DNA, 22 bp, Homo sapiens
aggaagcccaggctcggaggac

SEQ ID NO: 5839820 - DNA, 14 bp, Homo sapiens
aggaagcccctgag

SEQ ID NO: 5839821 - DNA, 17 bp, Homo sapiens
aggaagccctctcagat

SEQ ID NO: 5839822 - DNA, 19 bp, Homo sapiens
aggaagccgctggggccag

SEQ ID NO: 5839823 - DNA, 21 bp, Homo sapiens
aggaagccggtgcctgggtgg

SEQ ID NO: 5839824 - DNA, 14 bp, Homo sapiens
aggaagccggtgtc

SEQ ID NO: 5839825 - DNA, 13 bp, Homo sapiens
aggaagcctcaga

SEQ ID NO: 5839826 - DNA, 14 bp, Homo sapiens
aggaagcctcagat

SEQ ID NO: 5839827 - DNA, 18 bp, Homo sapiens
aggaagcctgattaaaga

SEQ ID NO: 5839828 - DNA, 19 bp, Homo sapiens
aggaagcctgcagtcctgg

SEQ ID NO: 5839829 - DNA, 20 bp, Homo sapiens
aggaagcctgcagtcctgga

SEQ ID NO: 5839830 - DNA, 15 bp, Homo sapiens
aggaagctcagcctt

SEQ ID NO: 5839831 - DNA, 13 bp, Homo sapiens
aggaagctcaggg

SEQ ID NO: 5839832 - DNA, 14 bp, Homo sapiens
aggaagctccagat

SEQ ID NO: 5839833 - DNA, 20 bp, Homo sapiens
aggaagctccagtcctgctc

SEQ ID NO: 5839834 - DNA, 14 bp, Homo sapiens
aggaagctgaatta

SEQ ID NO: 5839835 - DNA, 19 bp, Homo sapiens
aggaagctgtgttgaaaca

SEQ ID NO: 5839836 - DNA, 23 bp, Homo sapiens
aggaagctgtgttgaaacagaaa

SEQ ID NO: 5839837 - DNA, 18 bp, Homo sapiens
aggaagcttggctgctca

SEQ ID NO: 5839838 - DNA, 19 bp, Homo sapiens
aggaagcttggctgctcag

SEQ ID NO: 5839839 - DNA, 20 bp, Homo sapiens
aggaagcttggctgctcagt

SEQ ID NO: 5839840 - DNA, 16 bp, Homo sapiens
aggaagctttggaagc

SEQ ID NO: 5839841 - DNA, 11 bp, Homo sapiens
aggaaggaaaa

SEQ ID NO: 5839842 - DNA, 14 bp, Homo sapiens
aggaaggaaaaaat

SEQ ID NO: 5839843 - DNA, 16 bp, Homo sapiens
aggaaggaaaaaataa

SEQ ID NO: 5839844 - DNA, 13 bp, Homo sapiens
aggaaggaaaact

SEQ ID NO: 5839845 - DNA, 13 bp, Homo sapiens
aggaaggaaacaa

SEQ ID NO: 5839846 - DNA, 23 bp, Homo sapiens
aggaaggaaacaacaaaggaagt

SEQ ID NO: 5839847 - DNA, 14 bp, Homo sapiens
aggaaggaaacaat

SEQ ID NO: 5839848 - DNA, 14 bp, Homo sapiens
aggaaggaaacaga

SEQ ID NO: 5839849 - DNA, 16 bp, Homo sapiens
aggaaggaaacagatt

SEQ ID NO: 5839850 - DNA, 22 bp, Homo sapiens
aggaaggaaacatagaaagaca

SEQ ID NO: 5839851 - DNA, 19 bp, Homo sapiens
aggaaggaaacccagctct

SEQ ID NO: 5839852 - DNA, 12 bp, Homo sapiens
aggaaggaaact

SEQ ID NO: 5839853 - DNA, 16 bp, Homo sapiens
aggaaggaacaaagac

SEQ ID NO: 5839854 - DNA, 17 bp, Homo sapiens
aggaaggaagcaagcat

SEQ ID NO: 5839855 - DNA, 23 bp, Homo sapiens
aggaaggacacattgttttccag

SEQ ID NO: 5839856 - DNA, 15 bp, Homo sapiens
aggaaggacaggaag

SEQ ID NO: 5839857 - DNA, 13 bp, Homo sapiens
aggaaggaccagg

SEQ ID NO: 5839858 - DNA, 16 bp, Homo sapiens
aggaaggactatgaaa

SEQ ID NO: 5839859 - DNA, 23 bp, Homo sapiens
aggaaggagactcacctctgcct

SEQ ID NO: 5839860 - DNA, 14 bp, Homo sapiens
aggaaggagagatg

SEQ ID NO: 5839861 - DNA, 17 bp, Homo sapiens
aggaaggagagcctgct

SEQ ID NO: 5839862 - DNA, 20 bp, Homo sapiens
aggaaggagccagctcccag

SEQ ID NO: 5839863 - DNA, 14 bp, Homo sapiens
aggaaggagctgcc

SEQ ID NO: 5839864 - DNA, 20 bp, Homo sapiens
aggaaggagctgcctggacc

SEQ ID NO: 5839865 - DNA, 21 bp, Homo sapiens
aggaaggaggacccaggacag

SEQ ID NO: 5839866 - DNA, 13 bp, Homo sapiens
aggaaggcaaagc

SEQ ID NO: 5839867 - DNA, 19 bp, Homo sapiens
aggaaggcagctgctctta

SEQ ID NO: 5839868 - DNA, 15 bp, Homo sapiens
aggaaggcaggaaga

SEQ ID NO: 5839869 - DNA, 17 bp, Homo sapiens
aggaaggcaggaagaga

SEQ ID NO: 5839870 - DNA, 19 bp, Homo sapiens
aggaaggcaggaagagagc

SEQ ID NO: 5839871 - DNA, 19 bp, Homo sapiens
aggaaggccaaaatcaaga

SEQ ID NO: 5839872 - DNA, 22 bp, Homo sapiens
aggaaggccatggggcagcctc

SEQ ID NO: 5839873 - DNA, 14 bp, Homo sapiens
aggaaggcccaggg

SEQ ID NO: 5839874 - DNA, 17 bp, Homo sapiens
aggaaggcctaggctag

SEQ ID NO: 5839875 - DNA, 14 bp, Homo sapiens
aggaaggcctgagc

SEQ ID NO: 5839876 - DNA, 17 bp, Homo sapiens
aggaaggcctgagcccc

SEQ ID NO: 5839877 - DNA, 20 bp, Homo sapiens
aggacagtttatcctgtctg

SEQ ID NO: 5839878 - DNA, 16 bp, Homo sapiens
aggacataaaatttaa

SEQ ID NO: 5839879 - DNA, 15 bp, Homo sapiens
aggacataatggggt

SEQ ID NO: 5839880 - DNA, 17 bp, Homo sapiens
aggacatactgcatgta

SEQ ID NO: 5839881 - DNA, 12 bp, Homo sapiens
aggacatcagca

SEQ ID NO: 5839882 - DNA, 11 bp, Homo sapiens
aggacatctta

SEQ ID NO: 5839883 - DNA, 19 bp, Homo sapiens
aggacatgagtctgtagga

SEQ ID NO: 5839884 - DNA, 22 bp, Homo sapiens
aggacatgatactgatgccatg

SEQ ID NO: 5839885 - DNA, 21 bp, Homo sapiens
aggacatgatggagcgcacct

SEQ ID NO: 5839886 - DNA, 15 bp, Homo sapiens
aggacatgcggcctg

SEQ ID NO: 5839887 - DNA, 21 bp, Homo sapiens
aggacatggcttctgaacctg

SEQ ID NO: 5839888 - DNA, 22 bp, Homo sapiens
aggacatggggcatagaaactg

SEQ ID NO: 5839889 - DNA, 18 bp, Homo sapiens
aggacatgtactgagaca

SEQ ID NO: 5839890 - DNA, 15 bp, Homo sapiens
aggacatgtttttgt

SEQ ID NO: 5839891 - DNA, 16 bp, Homo sapiens
aggacattatgtgtgc

SEQ ID NO: 5839892 - DNA, 16 bp, Homo sapiens
aggacattcactgctg

SEQ ID NO: 5839893 - DNA, 14 bp, Homo sapiens
aggacattcttgta

SEQ ID NO: 5839894 - DNA, 22 bp, Homo sapiens
aggacattgatttgatttttat

SEQ ID NO: 5839895 - DNA, 17 bp, Homo sapiens
aggacattgcggacagc

SEQ ID NO: 5839896 - DNA, 19 bp, Homo sapiens
aggacattgcggacagcca

SEQ ID NO: 5839897 - DNA, 20 bp, Homo sapiens
aggacattgtatgcagggag

SEQ ID NO: 5839898 - DNA, 21 bp, Homo sapiens
aggacattgtatgcagggagc

SEQ ID NO: 5839899 - DNA, 22 bp, Homo sapiens
aggacattgtatgcagggagca

SEQ ID NO: 5839900 - DNA, 14 bp, Homo sapiens
aggacatttctcta

SEQ ID NO: 5839901 - DNA, 21 bp, Homo sapiens
aggacatttgggactgtcttg

SEQ ID NO: 5839902 - DNA, 15 bp, Homo sapiens
aggacatttggtttt

SEQ ID NO: 5839903 - DNA, 16 bp, Homo sapiens
aggacatttgtgggca

SEQ ID NO: 5839904 - DNA, 23 bp, Homo sapiens
aggacatttgtgggcaagcagat

SEQ ID NO: 5839905 - DNA, 21 bp, Homo sapiens
aggacattttctctttaaaag

SEQ ID NO: 5839906 - DNA, 18 bp, Homo sapiens
aggaccaacaagggcagt

SEQ ID NO: 5839907 - DNA, 19 bp, Homo sapiens
aggaccaacaagggcagtg

SEQ ID NO: 5839908 - DNA, 13 bp, Homo sapiens
aggaccaatgctt

SEQ ID NO: 5839909 - DNA, 14 bp, Homo sapiens
aggaccacacagtc

SEQ ID NO: 5839910 - DNA, 20 bp, Homo sapiens
aggaccacacagtccccaga

SEQ ID NO: 5839911 - DNA, 21 bp, Homo sapiens
aggaccacacagtccccagac

SEQ ID NO: 5839912 - DNA, 23 bp, Homo sapiens
aggaccacacagtccccagactc

SEQ ID NO: 5839913 - DNA, 19 bp, Homo sapiens
aggaccacaggtgtgagcc

SEQ ID NO: 5839914 - DNA, 17 bp, Homo sapiens
aggaccaccagcaggca

SEQ ID NO: 5839915 - DNA, 18 bp, Homo sapiens
aggaccaccctgccaagg

SEQ ID NO: 5839916 - DNA, 19 bp, Homo sapiens
aggaccaccctgccaaggc

SEQ ID NO: 5839917 - DNA, 20 bp, Homo sapiens
aggaccacctcctctgccag

SEQ ID NO: 5839918 - DNA, 21 bp, Homo sapiens
aggaccacctcctctgccagc

SEQ ID NO: 5839919 - DNA, 22 bp, Homo sapiens
aggaccacctcctctgccagca

SEQ ID NO: 5839920 - DNA, 22 bp, Homo sapiens
aggaccagaagctcccccagca

SEQ ID NO: 5839921 - DNA, 22 bp, Homo sapiens
aggaccagaaggcaatcaagag

SEQ ID NO: 5839922 - DNA, 12 bp, Homo sapiens
aggaccagagcg

SEQ ID NO: 5839923 - DNA, 14 bp, Homo sapiens
aggaccagcccacg

SEQ ID NO: 5839924 - DNA, 13 bp, Homo sapiens
aggaccagcctgt

SEQ ID NO: 5839925 - DNA, 18 bp, Homo sapiens
aggaccagctcaggacag

SEQ ID NO: 5839926 - DNA, 23 bp, Homo sapiens
aggaccagctcaggacagatgcc

SEQ ID NO: 5839927 - DNA, 14 bp, Homo sapiens
aggaccagctgggg

SEQ ID NO: 5839928 - DNA, 12 bp, Homo sapiens
aggaccaggact

SEQ ID NO: 5839929 - DNA, 22 bp, Homo sapiens
aggaccaggactatagcccagg

SEQ ID NO: 5839930 - DNA, 13 bp, Homo sapiens
aggaccaggactc

SEQ ID NO: 5839931 - DNA, 17 bp, Homo sapiens
aggaccaggactccctc

SEQ ID NO: 5839932 - DNA, 12 bp, Homo sapiens
aggaccaggaga

SEQ ID NO: 5839933 - DNA, 12 bp, Homo sapiens
aggaccaggagc

SEQ ID NO: 5839934 - DNA, 15 bp, Homo sapiens
aggaccaggagccag

SEQ ID NO: 5839935 - DNA, 12 bp, Homo sapiens
aggaccaggcca

SEQ ID NO: 5839936 - DNA, 15 bp, Homo sapiens
aggaccagggccctg

SEQ ID NO: 5839937 - DNA, 20 bp, Homo sapiens
aggaccagggccctgggcag

SEQ ID NO: 5839938 - DNA, 13 bp, Homo sapiens
aggaccagggcct

SEQ ID NO: 5839939 - DNA, 14 bp, Homo sapiens
aggaccagtcagga

SEQ ID NO: 5839940 - DNA, 14 bp, Homo sapiens
aggaccattttaga

SEQ ID NO: 5839941 - DNA, 21 bp, Homo sapiens
aggacccaaatttccctgggg

SEQ ID NO: 5839942 - DNA, 19 bp, Homo sapiens
aggacccacactgctacac

SEQ ID NO: 5839943 - DNA, 18 bp, Homo sapiens
aggacccaccactggaag

SEQ ID NO: 5839944 - DNA, 12 bp, Homo sapiens
aggacccacctg

SEQ ID NO: 5839945 - DNA, 12 bp, Homo sapiens
aggacccagacc

SEQ ID NO: 5839946 - DNA, 14 bp, Homo sapiens
aggacccagagctg

SEQ ID NO: 5839947 - DNA, 13 bp, Homo sapiens
aggacccagagga

SEQ ID NO: 5839948 - DNA, 15 bp, Homo sapiens
aggacccagccctcg

SEQ ID NO: 5839949 - DNA, 14 bp, Homo sapiens
aggacccaggaaag

SEQ ID NO: 5839950 - DNA, 13 bp, Homo sapiens
aggacccaggccc

SEQ ID NO: 5839951 - DNA, 14 bp, Homo sapiens
aggacccaggccct

SEQ ID NO: 5839952 - DNA, 17 bp, Homo sapiens
aggacccaggcgctgca

SEQ ID NO: 5839953 - DNA, 20 bp, Homo sapiens
aggacccaggcgctgcatac

SEQ ID NO: 5839954 - DNA, 12 bp, Homo sapiens
aggacccagggc

SEQ ID NO: 5839955 - DNA, 14 bp, Homo sapiens
aggacccagggctc

SEQ ID NO: 5839956 - DNA, 15 bp, Homo sapiens
aggacccagggctct

SEQ ID NO: 5839957 - DNA, 13 bp, Homo sapiens
aggacccagggtc

SEQ ID NO: 5839958 - DNA, 18 bp, Homo sapiens
aggacccagggtcccctc

SEQ ID NO: 5839959 - DNA, 19 bp, Homo sapiens
aggacccatccctgcctgg

SEQ ID NO: 5839960 - DNA, 22 bp, Homo sapiens
aggacccatccctgcctggagg

SEQ ID NO: 5839961 - DNA, 14 bp, Homo sapiens
aggaccccacatcc

SEQ ID NO: 5839962 - DNA, 11 bp, Homo sapiens
aggaccccagg

SEQ ID NO: 5839963 - DNA, 16 bp, Homo sapiens
aggaccccaggtcagg

SEQ ID NO: 5839964 - DNA, 17 bp, Homo sapiens
aggaccccattctggga

SEQ ID NO: 5839965 - DNA, 18 bp, Homo sapiens
aggacccctcaccacccc

SEQ ID NO: 5839966 - DNA, 15 bp, Homo sapiens
aggacccctcacctt

SEQ ID NO: 5839967 - DNA, 17 bp, Homo sapiens
aggacccctgccttcct

SEQ ID NO: 5839968 - DNA, 16 bp, Homo sapiens
aggacccctgtccagg

SEQ ID NO: 5839969 - DNA, 23 bp, Homo sapiens
aggaccccttaatcttgctttct

SEQ ID NO: 5839970 - DNA, 18 bp, Homo sapiens
aggacccgcctgctccca

SEQ ID NO: 5839971 - DNA, 17 bp, Homo sapiens
aggacccggaggggcct

SEQ ID NO: 5839972 - DNA, 20 bp, Homo sapiens
aggacccggaggggcctggc

SEQ ID NO: 5839973 - DNA, 16 bp, Homo sapiens
aggacccgtctccagc

SEQ ID NO: 5839974 - DNA, 18 bp, Homo sapiens
aggaccctaacacagtat

SEQ ID NO: 5839975 - DNA, 12 bp, Homo sapiens
aggaccctcagc

SEQ ID NO: 5839976 - DNA, 13 bp, Homo sapiens
aggaccctcagcc

SEQ ID NO: 5839977 - DNA, 14 bp, Homo sapiens
aggaccctcagccc

SEQ ID NO: 5839978 - DNA, 15 bp, Homo sapiens
aggaccctcagccct

SEQ ID NO: 5839979 - DNA, 13 bp, Homo sapiens
aggaccctcagga

SEQ ID NO: 5839980 - DNA, 14 bp, Homo sapiens
aggaccctgaccct

SEQ ID NO: 5839981 - DNA, 19 bp, Homo sapiens
aggaccctgccaggcacag

SEQ ID NO: 5839982 - DNA, 14 bp, Homo sapiens
aggaccctggacct

SEQ ID NO: 5839983 - DNA, 23 bp, Homo sapiens
aggaccctgggtcaccttcctgg

SEQ ID NO: 5839984 - DNA, 13 bp, Homo sapiens
aggaccctgtcag

SEQ ID NO: 5839985 - DNA, 13 bp, Homo sapiens
aggaccctgtcct

SEQ ID NO: 5839986 - DNA, 17 bp, Homo sapiens
aggaccctgtcctgcag

SEQ ID NO: 5839987 - DNA, 18 bp, Homo sapiens
aggaccctgtttctgtag

SEQ ID NO: 5839988 - DNA, 20 bp, Homo sapiens
aggaccctgtttctgtagaa

SEQ ID NO: 5839989 - DNA, 12 bp, Homo sapiens
aggacccttccc

SEQ ID NO: 5839990 - DNA, 22 bp, Homo sapiens
aggacccttcccttgagccctc

SEQ ID NO: 5839991 - DNA, 20 bp, Homo sapiens
aggaccgaggctacagctcc

SEQ ID NO: 5839992 - DNA, 21 bp, Homo sapiens
aggaccgaggctacagctcca

SEQ ID NO: 5839993 - DNA, 16 bp, Homo sapiens
aggaccgccaaagaat

SEQ ID NO: 5839994 - DNA, 23 bp, Homo sapiens
aggaccgccccaaccctcggagc

SEQ ID NO: 5839995 - DNA, 15 bp, Homo sapiens
aggaccgcctgccct

SEQ ID NO: 5839996 - DNA, 20 bp, Homo sapiens
aggaccgggcactcccggga

SEQ ID NO: 5839997 - DNA, 23 bp, Homo sapiens
aggaccgtggccctgccctctcc

SEQ ID NO: 5839998 - DNA, 19 bp, Homo sapiens
aggacctagctgttgtaaa

SEQ ID NO: 5839999 - DNA, 19 bp, Homo sapiens
aggacctagggatgttctg

SEQ ID NO: 5840000 - DNA, 22 bp, Homo sapiens
aggacctatcccaaatgtggaa

SEQ ID NO: 5840001 - DNA, 21 bp, Homo sapiens
aggacctatgtttgctcagaa

SEQ ID NO: 5840002 - DNA, 14 bp, Homo sapiens
aggacctcaggcgg

SEQ ID NO: 5840003 - DNA, 13 bp, Homo sapiens
aggacctcaggtg

SEQ ID NO: 5840004 - DNA, 20 bp, Homo sapiens
aggacctcaggtgagaagca

SEQ ID NO: 5840005 - DNA, 19 bp, Homo sapiens
aggacctcatatcttcctc

SEQ ID NO: 5840006 - DNA, 13 bp, Homo sapiens
aggacctccacct

SEQ ID NO: 5840007 - DNA, 16 bp, Homo sapiens
aggacctccacctggg

SEQ ID NO: 5840008 - DNA, 19 bp, Homo sapiens
aggacctccccctgtgtgg

SEQ ID NO: 5840009 - DNA, 22 bp, Homo sapiens
aggacctccccctgtgtggccc

SEQ ID NO: 5840010 - DNA, 15 bp, Homo sapiens
aggacctcccttccg

SEQ ID NO: 5840011 - DNA, 19 bp, Homo sapiens
aggacctccggagcgccct

SEQ ID NO: 5840012 - DNA, 14 bp, Homo sapiens
aggacctcgtgcca

SEQ ID NO: 5840013 - DNA, 18 bp, Homo sapiens
aggacctctgaaaccctg

SEQ ID NO: 5840014 - DNA, 13 bp, Homo sapiens
aggacctctgggg

SEQ ID NO: 5840015 - DNA, 18 bp, Homo sapiens
aggacctcttcagctgct

SEQ ID NO: 5840016 - DNA, 20 bp, Homo sapiens
aggacctctttactctctcc

SEQ ID NO: 5840017 - DNA, 15 bp, Homo sapiens
aggacctgacacaat

SEQ ID NO: 5840018 - DNA, 16 bp, Homo sapiens
aggacctgagacctga

SEQ ID NO: 5840019 - DNA, 12 bp, Homo sapiens
aggacctgagcc

SEQ ID NO: 5840020 - DNA, 15 bp, Homo sapiens
aggacctgagcctgc

SEQ ID NO: 5840021 - DNA, 21 bp, Homo sapiens
aggacctgagcctgccgagca

SEQ ID NO: 5840022 - DNA, 17 bp, Homo sapiens
aggacctgagctggcca

SEQ ID NO: 5840023 - DNA, 22 bp, Homo sapiens
aggacctgagctggccaggccc

SEQ ID NO: 5840024 - DNA, 18 bp, Homo sapiens
aggacctgagtttgggag

SEQ ID NO: 5840025 - DNA, 20 bp, Homo sapiens
aggacctgagtttgggagag

SEQ ID NO: 5840026 - DNA, 22 bp, Homo sapiens
aggacctgcatccttcctgggg

SEQ ID NO: 5840027 - DNA, 15 bp, Homo sapiens
aggacctgcctagca

SEQ ID NO: 5840028 - DNA, 22 bp, Homo sapiens
aggacctggcatcatggtggat

SEQ ID NO: 5840029 - DNA, 13 bp, Homo sapiens
aggacctggggca

SEQ ID NO: 5840030 - DNA, 16 bp, Homo sapiens
aggacctggggcacag

SEQ ID NO: 5840031 - DNA, 22 bp, Homo sapiens
aggacctggggcacagtccagg

SEQ ID NO: 5840032 - DNA, 23 bp, Homo sapiens
aggacctggggcacagtccagga

SEQ ID NO: 5840033 - DNA, 16 bp, Homo sapiens
aggacctgtgctttga

SEQ ID NO: 5840034 - DNA, 21 bp, Homo sapiens
aggacctgtggccaagttctt

SEQ ID NO: 5840035 - DNA, 16 bp, Homo sapiens
aggaccttaaatgcta

SEQ ID NO: 5840036 - DNA, 15 bp, Homo sapiens
aggaccttatctgtg

SEQ ID NO: 5840037 - DNA, 23 bp, Homo sapiens
aggaccttcactctaagatgtta

SEQ ID NO: 5840038 - DNA, 23 bp, Homo sapiens
aggaccttctggtggttctgctg

SEQ ID NO: 5840039 - DNA, 22 bp, Homo sapiens
aggacctttaggtcaaactccc

SEQ ID NO: 5840040 - DNA, 16 bp, Homo sapiens
aggaccttttcccaat

SEQ ID NO: 5840041 - DNA, 20 bp, Homo sapiens
aggacgaacatccaaccttc

SEQ ID NO: 5840042 - DNA, 18 bp, Homo sapiens
aggacgagacccccatcc

SEQ ID NO: 5840043 - DNA, 17 bp, Homo sapiens
aggacgcaccgccgcca

SEQ ID NO: 5840044 - DNA, 23 bp, Homo sapiens
aggacgcaccgccgccaccagcc

SEQ ID NO: 5840045 - DNA, 18 bp, Homo sapiens
aggacgcacgctcgctgc

SEQ ID NO: 5840046 - DNA, 19 bp, Homo sapiens
aggacgcagggagaccctg

SEQ ID NO: 5840047 - DNA, 20 bp, Homo sapiens
aggacgcagggagaccctgg

SEQ ID NO: 5840048 - DNA, 18 bp, Homo sapiens
aggacgcatgcagggccc

SEQ ID NO: 5840049 - DNA, 22 bp, Homo sapiens
aggacgccaacttctcccaccc

SEQ ID NO: 5840050 - DNA, 17 bp, Homo sapiens
aggacgccactcatttc

SEQ ID NO: 5840051 - DNA, 16 bp, Homo sapiens
aggacgctctctggcc

SEQ ID NO: 5840052 - DNA, 17 bp, Homo sapiens
aggacgctctctggcct

SEQ ID NO: 5840053 - DNA, 20 bp, Homo sapiens
aggacgctctctggccttcg

SEQ ID NO: 5840054 - DNA, 20 bp, Homo sapiens
aggacgcttcacaggacagg

SEQ ID NO: 5840055 - DNA, 18 bp, Homo sapiens
aggagaggatgagagccc

SEQ ID NO: 5840056 - DNA, 19 bp, Homo sapiens
aggagaggatgagagccca

SEQ ID NO: 5840057 - DNA, 20 bp, Homo sapiens
aggagaggcaaagaaaggag

SEQ ID NO: 5840058 - DNA, 13 bp, Homo sapiens
aggagaggcagca

SEQ ID NO: 5840059 - DNA, 15 bp, Homo sapiens
aggagaggcagcatg

SEQ ID NO: 5840060 - DNA, 20 bp, Homo sapiens
aggagaggcgggagaactga

SEQ ID NO: 5840061 - DNA, 13 bp, Homo sapiens
aggagagggcaga

SEQ ID NO: 5840062 - DNA, 18 bp, Homo sapiens
aggagagggcagaggtcc

SEQ ID NO: 5840063 - DNA, 12 bp, Homo sapiens
aggagagggcct

SEQ ID NO: 5840064 - DNA, 23 bp, Homo sapiens
aggagagggcctcgtagtggcac

SEQ ID NO: 5840065 - DNA, 14 bp, Homo sapiens
aggagaggggcaca

SEQ ID NO: 5840066 - DNA, 18 bp, Homo sapiens
aggagaggggcacagggt

SEQ ID NO: 5840067 - DNA, 13 bp, Homo sapiens
aggagaggggtgg

SEQ ID NO: 5840068 - DNA, 15 bp, Homo sapiens
aggagagggtggcat

SEQ ID NO: 5840069 - DNA, 23 bp, Homo sapiens
aggagaggttaaagcaaaccagc

SEQ ID NO: 5840070 - DNA, 20 bp, Homo sapiens
aggagagtcccagagcagga

SEQ ID NO: 5840071 - DNA, 17 bp, Homo sapiens
aggagagtcttgcagtg

SEQ ID NO: 5840072 - DNA, 14 bp, Homo sapiens
aggagagtggcctg

SEQ ID NO: 5840073 - DNA, 22 bp, Homo sapiens
aggagagtggcctgggtcccag

SEQ ID NO: 5840074 - DNA, 15 bp, Homo sapiens
aggagataacatttc

SEQ ID NO: 5840075 - DNA, 18 bp, Homo sapiens
aggagataacatttcaac

SEQ ID NO: 5840076 - DNA, 14 bp, Homo sapiens
aggagatagacggg

SEQ ID NO: 5840077 - DNA, 20 bp, Homo sapiens
aggagatataaaatctagat

SEQ ID NO: 5840078 - DNA, 15 bp, Homo sapiens
aggagatcagaaaaa

SEQ ID NO: 5840079 - DNA, 16 bp, Homo sapiens
aggagatcagaaaaat

SEQ ID NO: 5840080 - DNA, 23 bp, Homo sapiens
aggagatcgagaccatcctggct

SEQ ID NO: 5840081 - DNA, 22 bp, Homo sapiens
aggagatgaatagaagaaagaa

SEQ ID NO: 5840082 - DNA, 19 bp, Homo sapiens
aggagatgaccagggatgc

SEQ ID NO: 5840083 - DNA, 23 bp, Homo sapiens
aggagatgaggctggataggaga

SEQ ID NO: 5840084 - DNA, 21 bp, Homo sapiens
aggagatggaaacaatgtgga

SEQ ID NO: 5840085 - DNA, 23 bp, Homo sapiens
aggagatggaaacaatgtggagt

SEQ ID NO: 5840086 - DNA, 20 bp, Homo sapiens
aggagatggaagttgcagtg

SEQ ID NO: 5840087 - DNA, 15 bp, Homo sapiens
aggagatggaatatc

SEQ ID NO: 5840088 - DNA, 15 bp, Homo sapiens
aggagatggagggct

SEQ ID NO: 5840089 - DNA, 14 bp, Homo sapiens
aggagatggccata

SEQ ID NO: 5840090 - DNA, 20 bp, Homo sapiens
aggagatgtaatgacagaga

SEQ ID NO: 5840091 - DNA, 21 bp, Homo sapiens
aggagatgtaatgacagagag

SEQ ID NO: 5840092 - DNA, 22 bp, Homo sapiens
aggagatgtaatgacagagagt

SEQ ID NO: 5840093 - DNA, 19 bp, Homo sapiens
aggagatgtgatcaggccc

SEQ ID NO: 5840094 - DNA, 22 bp, Homo sapiens
aggagatgttgaggggaggagg

SEQ ID NO: 5840095 - DNA, 16 bp, Homo sapiens
aggagattaacacact

SEQ ID NO: 5840096 - DNA, 18 bp, Homo sapiens
aggagattaacacactga

SEQ ID NO: 5840097 - DNA, 12 bp, Homo sapiens
aggagattccac

SEQ ID NO: 5840098 - DNA, 21 bp, Homo sapiens
aggagattctgcctttgccag

SEQ ID NO: 5840099 - DNA, 21 bp, Homo sapiens
aggagattctttgagatagcc

SEQ ID NO: 5840100 - DNA, 13 bp, Homo sapiens
aggagattgagaa

SEQ ID NO: 5840101 - DNA, 19 bp, Homo sapiens
aggagattgagaaggagag

SEQ ID NO: 5840102 - DNA, 19 bp, Homo sapiens
aggagattggccagtgaga

SEQ ID NO: 5840103 - DNA, 22 bp, Homo sapiens
aggagattgggagacaattagc

SEQ ID NO: 5840104 - DNA, 19 bp, Homo sapiens
aggagatttaccacttttt

SEQ ID NO: 5840105 - DNA, 15 bp, Homo sapiens
aggagattttccttc

SEQ ID NO: 5840106 - DNA, 20 bp, Homo sapiens
aggagcaaaaatctgagaaa

SEQ ID NO: 5840107 - DNA, 19 bp, Homo sapiens
aggagcaaacactgaaata

SEQ ID NO: 5840108 - DNA, 13 bp, Homo sapiens
aggagcaaacagg

SEQ ID NO: 5840109 - DNA, 15 bp, Homo sapiens
aggagcaaaggctga

SEQ ID NO: 5840110 - DNA, 22 bp, Homo sapiens
aggagcaaatgtttctgcagta

SEQ ID NO: 5840111 - DNA, 22 bp, Homo sapiens
aggagcaaccgtgcagccacga

SEQ ID NO: 5840112 - DNA, 18 bp, Homo sapiens
aggagcaaggctgccctg

SEQ ID NO: 5840113 - DNA, 18 bp, Homo sapiens
aggagcaagtgaggccgg

SEQ ID NO: 5840114 - DNA, 16 bp, Homo sapiens
aggagcaatgggactg

SEQ ID NO: 5840115 - DNA, 18 bp, Homo sapiens
aggagcaatgggactgga

SEQ ID NO: 5840116 - DNA, 15 bp, Homo sapiens
aggagcaatttgcac

SEQ ID NO: 5840117 - DNA, 16 bp, Homo sapiens
aggagcacaagccaca

SEQ ID NO: 5840118 - DNA, 20 bp, Homo sapiens
aggagcacacatccaagagg

SEQ ID NO: 5840119 - DNA, 15 bp, Homo sapiens
aggagcacacccagc

SEQ ID NO: 5840120 - DNA, 17 bp, Homo sapiens
aggagcacacggccctg

SEQ ID NO: 5840121 - DNA, 21 bp, Homo sapiens
aggagcacacggccctgcccc

SEQ ID NO: 5840122 - DNA, 20 bp, Homo sapiens
aggagcacagccatagcaga

SEQ ID NO: 5840123 - DNA, 15 bp, Homo sapiens
aggagcacaggcagc

SEQ ID NO: 5840124 - DNA, 9 bp, Homo sapiens
aggagcacc

SEQ ID NO: 5840125 - DNA, 15 bp, Homo sapiens
aggagcacccccagc

SEQ ID NO: 5840126 - DNA, 18 bp, Homo sapiens
aggagcacccccagcctc

SEQ ID NO: 5840127 - DNA, 13 bp, Homo sapiens
aggagcacctgga

SEQ ID NO: 5840128 - DNA, 19 bp, Homo sapiens
aggagcacctggaccccct

SEQ ID NO: 5840129 - DNA, 14 bp, Homo sapiens
aggagcacgaggtc

SEQ ID NO: 5840130 - DNA, 13 bp, Homo sapiens
aggagcactagaa

SEQ ID NO: 5840131 - DNA, 16 bp, Homo sapiens
aggagcagaaagatta

SEQ ID NO: 5840132 - DNA, 16 bp, Homo sapiens
aggagcagaataaatg

SEQ ID NO: 5840133 - DNA, 17 bp, Homo sapiens
aggagcagcagccagca

SEQ ID NO: 5840134 - DNA, 20 bp, Homo sapiens
aggagcagcaggagggggga

SEQ ID NO: 5840135 - DNA, 12 bp, Homo sapiens
aggagcagcatc

SEQ ID NO: 5840136 - DNA, 13 bp, Homo sapiens
aggagcagccaca

SEQ ID NO: 5840137 - DNA, 12 bp, Homo sapiens
aggagcagccag

SEQ ID NO: 5840138 - DNA, 20 bp, Homo sapiens
aggagcagcccacccagcag

SEQ ID NO: 5840139 - DNA, 21 bp, Homo sapiens
aggagcagcccacctgctgcc

SEQ ID NO: 5840140 - DNA, 14 bp, Homo sapiens
aggagcagccctgg

SEQ ID NO: 5840141 - DNA, 19 bp, Homo sapiens
aggagcagcctcagaacaa

SEQ ID NO: 5840142 - DNA, 14 bp, Homo sapiens
aggagcagcctcca

SEQ ID NO: 5840143 - DNA, 21 bp, Homo sapiens
aggagcagcctccaagaaact

SEQ ID NO: 5840144 - DNA, 21 bp, Homo sapiens
aggagcagctagctgcttttc

SEQ ID NO: 5840145 - DNA, 15 bp, Homo sapiens
aggagcagctggcac

SEQ ID NO: 5840146 - DNA, 16 bp, Homo sapiens
aggagcagctggcact

SEQ ID NO: 5840147 - DNA, 17 bp, Homo sapiens
aggagcagctggcactg

SEQ ID NO: 5840148 - DNA, 18 bp, Homo sapiens
aggagcagctggcactga

SEQ ID NO: 5840149 - DNA, 18 bp, Homo sapiens
aggagcagctggggtagg

SEQ ID NO: 5840150 - DNA, 12 bp, Homo sapiens
aggagcagctgt

SEQ ID NO: 5840151 - DNA, 13 bp, Homo sapiens
aggagcagctgtg

SEQ ID NO: 5840152 - DNA, 18 bp, Homo sapiens
aggagcagcttccttctg

SEQ ID NO: 5840153 - DNA, 23 bp, Homo sapiens
aggagcagcttttggtctccttg

SEQ ID NO: 5840154 - DNA, 18 bp, Homo sapiens
aggagcaggaacagagac

SEQ ID NO: 5840155 - DNA, 19 bp, Homo sapiens
aggagcaggaacagagact

SEQ ID NO: 5840156 - DNA, 13 bp, Homo sapiens
aggagcaggaagc

SEQ ID NO: 5840157 - DNA, 17 bp, Homo sapiens
aggagcaggaagcaagg

SEQ ID NO: 5840158 - DNA, 21 bp, Homo sapiens
aggagcaggaagcaaggccag

SEQ ID NO: 5840159 - DNA, 12 bp, Homo sapiens
aggagcaggccc

SEQ ID NO: 5840160 - DNA, 15 bp, Homo sapiens
aggagcaggccctgg

SEQ ID NO: 5840161 - DNA, 19 bp, Homo sapiens
aggagcaggccctgggcct

SEQ ID NO: 5840162 - DNA, 21 bp, Homo sapiens
aggagcaggcttgtggcagcc

SEQ ID NO: 5840163 - DNA, 20 bp, Homo sapiens
aggagcaggggcgtggaggg

SEQ ID NO: 5840164 - DNA, 14 bp, Homo sapiens
aggagcagtgcagg

SEQ ID NO: 5840165 - DNA, 16 bp, Homo sapiens
aggagcatccacctcc

SEQ ID NO: 5840166 - DNA, 18 bp, Homo sapiens
aggagcatgcgcagaggc

SEQ ID NO: 5840167 - DNA, 23 bp, Homo sapiens
aggagccaaatgaccgagccctg

SEQ ID NO: 5840168 - DNA, 16 bp, Homo sapiens
aggagccacctgggct

SEQ ID NO: 5840169 - DNA, 23 bp, Homo sapiens
aggagccacctgggctgggagaa

SEQ ID NO: 5840170 - DNA, 14 bp, Homo sapiens
aggagccagacaga

SEQ ID NO: 5840171 - DNA, 15 bp, Homo sapiens
aggagccagagaagg

SEQ ID NO: 5840172 - DNA, 19 bp, Homo sapiens
aggagccagagaaggtggt

SEQ ID NO: 5840173 - DNA, 14 bp, Homo sapiens
aggagccagcaggg

SEQ ID NO: 5840174 - DNA, 21 bp, Homo sapiens
aggagccagcagggcgggcca

SEQ ID NO: 5840175 - DNA, 14 bp, Homo sapiens
aggagccagctccc

SEQ ID NO: 5840176 - DNA, 17 bp, Homo sapiens
aggagccagctcccagc

SEQ ID NO: 5840177 - DNA, 12 bp, Homo sapiens
aggagccaggca

SEQ ID NO: 5840178 - DNA, 15 bp, Homo sapiens
aggagccaggcccca

SEQ ID NO: 5840179 - DNA, 22 bp, Homo sapiens
aggagccaggccccaccccttc

SEQ ID NO: 5840180 - DNA, 20 bp, Homo sapiens
aggagcccacgacactgcag

SEQ ID NO: 5840181 - DNA, 17 bp, Homo sapiens
aggagcccagaaaacct

SEQ ID NO: 5840182 - DNA, 20 bp, Homo sapiens
aggagcccagagggccaaga

SEQ ID NO: 5840183 - DNA, 20 bp, Homo sapiens
aggagcccagccagaaagca

SEQ ID NO: 5840184 - DNA, 21 bp, Homo sapiens
aggagcccagcggcccaagag

SEQ ID NO: 5840185 - DNA, 20 bp, Homo sapiens
aggagcccaggccaggactc

SEQ ID NO: 5840186 - DNA, 22 bp, Homo sapiens
aggagcccaggccaggactctg

SEQ ID NO: 5840187 - DNA, 15 bp, Homo sapiens
aggagcccagtgggc

SEQ ID NO: 5840188 - DNA, 19 bp, Homo sapiens
aggagcccagtgggctgca

SEQ ID NO: 5840189 - DNA, 20 bp, Homo sapiens
aggagcccatactcagcctg

SEQ ID NO: 5840190 - DNA, 13 bp, Homo sapiens
aggagccccagcc

SEQ ID NO: 5840191 - DNA, 14 bp, Homo sapiens
aggagccccagcca

SEQ ID NO: 5840192 - DNA, 15 bp, Homo sapiens
aggagccccagccag

SEQ ID NO: 5840193 - DNA, 16 bp, Homo sapiens
aggagccccagccagc

SEQ ID NO: 5840194 - DNA, 17 bp, Homo sapiens
aggagccccagccagcc

SEQ ID NO: 5840195 - DNA, 16 bp, Homo sapiens
aggagccccagccccg

SEQ ID NO: 5840196 - DNA, 19 bp, Homo sapiens
aggagcccccaacacaggc

SEQ ID NO: 5840197 - DNA, 19 bp, Homo sapiens
aggagcccccaccctgttc

SEQ ID NO: 5840198 - DNA, 22 bp, Homo sapiens
aggagccccgaggccttctctg

SEQ ID NO: 5840199 - DNA, 20 bp, Homo sapiens
aggagccccgccaggtgccc

SEQ ID NO: 5840200 - DNA, 14 bp, Homo sapiens
aggagcccctgagt

SEQ ID NO: 5840201 - DNA, 18 bp, Homo sapiens
aggagcccctggacatgc

SEQ ID NO: 5840202 - DNA, 19 bp, Homo sapiens
aggagcccctggacatgcc

SEQ ID NO: 5840203 - DNA, 23 bp, Homo sapiens
aggagcccctggacatgcctgtc

SEQ ID NO: 5840204 - DNA, 13 bp, Homo sapiens
aggagccctcatc

SEQ ID NO: 5840205 - DNA, 13 bp, Homo sapiens
aggagccctgcct

SEQ ID NO: 5840206 - DNA, 18 bp, Homo sapiens
aggagccctgggaggctc

SEQ ID NO: 5840207 - DNA, 23 bp, Homo sapiens
aggagccctgggaggctctggag

SEQ ID NO: 5840208 - DNA, 21 bp, Homo sapiens
aggagcccttatctgtgctca

SEQ ID NO: 5840209 - DNA, 18 bp, Homo sapiens
aggagcccttctctttga

SEQ ID NO: 5840210 - DNA, 19 bp, Homo sapiens
aggagccggacacttctca

SEQ ID NO: 5840211 - DNA, 22 bp, Homo sapiens
aggagccggccaccagatgctg

SEQ ID NO: 5840212 - DNA, 23 bp, Homo sapiens
aggagccggccaccagatgctga

SEQ ID NO: 5840213 - DNA, 14 bp, Homo sapiens
aggagcctagagga

SEQ ID NO: 5840214 - DNA, 15 bp, Homo sapiens
aggagcctagaggag

SEQ ID NO: 5840215 - DNA, 17 bp, Homo sapiens
aggagcctagaggagga

SEQ ID NO: 5840216 - DNA, 14 bp, Homo sapiens
aggagcctcactgg

SEQ ID NO: 5840217 - DNA, 21 bp, Homo sapiens
aggagcctcagaagaaaacaa

SEQ ID NO: 5840218 - DNA, 21 bp, Homo sapiens
aggagcctcatccagcctcag

SEQ ID NO: 5840219 - DNA, 15 bp, Homo sapiens
aggagcctccctgca

SEQ ID NO: 5840220 - DNA, 16 bp, Homo sapiens
aggagcctccctgcac

SEQ ID NO: 5840221 - DNA, 20 bp, Homo sapiens
aggagcctcctgaccctgtg

SEQ ID NO: 5840222 - DNA, 16 bp, Homo sapiens
aggagcctcctgccct

SEQ ID NO: 5840223 - DNA, 17 bp, Homo sapiens
aggagcctcctgccctt

SEQ ID NO: 5840224 - DNA, 18 bp, Homo sapiens
aggagcctcgtgtcctgc

SEQ ID NO: 5840225 - DNA, 19 bp, Homo sapiens
aggagcctcgtgtcctgct

SEQ ID NO: 5840226 - DNA, 20 bp, Homo sapiens
aggagcctcgtgtcctgcta

SEQ ID NO: 5840227 - DNA, 22 bp, Homo sapiens
aggagcctcgtgtcctgctagc

SEQ ID NO: 5840228 - DNA, 14 bp, Homo sapiens
aggagcctctgatc

SEQ ID NO: 5840229 - DNA, 13 bp, Homo sapiens
aggagcctgcggc

SEQ ID NO: 5840230 - DNA, 21 bp, Homo sapiens
aggagcctgcggctgctggca

SEQ ID NO: 5840231 - DNA, 14 bp, Homo sapiens
aggagcctgctaag

SEQ ID NO: 5840232 - DNA, 22 bp, Homo sapiens
aggagtaccgccagcagctgtc

SEQ ID NO: 5840233 - DNA, 14 bp, Homo sapiens
aggagtagctgaga

SEQ ID NO: 5840234 - DNA, 20 bp, Homo sapiens
aggagtagctgagaggaaga

SEQ ID NO: 5840235 - DNA, 18 bp, Homo sapiens
aggagtatgcagggagct

SEQ ID NO: 5840236 - DNA, 12 bp, Homo sapiens
aggagtattttt

SEQ ID NO: 5840237 - DNA, 17 bp, Homo sapiens
aggagtcaactggctgg

SEQ ID NO: 5840238 - DNA, 17 bp, Homo sapiens
aggagtcactgagacca

SEQ ID NO: 5840239 - DNA, 14 bp, Homo sapiens
aggagtcagagaga

SEQ ID NO: 5840240 - DNA, 20 bp, Homo sapiens
aggagtcagatgaggccctg

SEQ ID NO: 5840241 - DNA, 20 bp, Homo sapiens
aggagtcaggggctctgtgt

SEQ ID NO: 5840242 - DNA, 22 bp, Homo sapiens
aggagtcagtgcccatgtgtat

SEQ ID NO: 5840243 - DNA, 16 bp, Homo sapiens
aggagtccactgcctc

SEQ ID NO: 5840244 - DNA, 18 bp, Homo sapiens
aggagtccactgcctcca

SEQ ID NO: 5840245 - DNA, 12 bp, Homo sapiens
aggagtccagac

SEQ ID NO: 5840246 - DNA, 20 bp, Homo sapiens
aggagtccagcccctcctcc

SEQ ID NO: 5840247 - DNA, 22 bp, Homo sapiens
aggagtccaggccatggaggca

SEQ ID NO: 5840248 - DNA, 22 bp, Homo sapiens
aggagtcccactccaagccagc

SEQ ID NO: 5840249 - DNA, 12 bp, Homo sapiens
aggagtccctgg

SEQ ID NO: 5840250 - DNA, 21 bp, Homo sapiens
aggagtcccttagaagatctg

SEQ ID NO: 5840251 - DNA, 15 bp, Homo sapiens
aggagtcctttcttt

SEQ ID NO: 5840252 - DNA, 20 bp, Homo sapiens
aggagtctcaacatgtgttt

SEQ ID NO: 5840253 - DNA, 16 bp, Homo sapiens
aggagtctctgccacc

SEQ ID NO: 5840254 - DNA, 18 bp, Homo sapiens
aggagtctctgccaccca

SEQ ID NO: 5840255 - DNA, 20 bp, Homo sapiens
aggagtctgagaccagcctg

SEQ ID NO: 5840256 - DNA, 16 bp, Homo sapiens
aggagtctgaggactg

SEQ ID NO: 5840257 - DNA, 13 bp, Homo sapiens
aggagtctgccac

SEQ ID NO: 5840258 - DNA, 14 bp, Homo sapiens
aggagtctgtgctc

SEQ ID NO: 5840259 - DNA, 19 bp, Homo sapiens
aggagtcttatatcccagg

SEQ ID NO: 5840260 - DNA, 21 bp, Homo sapiens
aggagtcttcactgctctgcc

SEQ ID NO: 5840261 - DNA, 18 bp, Homo sapiens
aggagtcttcagacccag

SEQ ID NO: 5840262 - DNA, 19 bp, Homo sapiens
aggagtcttcagacccaga

SEQ ID NO: 5840263 - DNA, 20 bp, Homo sapiens
aggagtcttcagacccagag

SEQ ID NO: 5840264 - DNA, 21 bp, Homo sapiens
aggagtcttcagacccagaga

SEQ ID NO: 5840265 - DNA, 23 bp, Homo sapiens
aggagtcttctaatgtaaatttt

SEQ ID NO: 5840266 - DNA, 14 bp, Homo sapiens
aggagtgacatgaa

SEQ ID NO: 5840267 - DNA, 15 bp, Homo sapiens
aggagtgacatgaag

SEQ ID NO: 5840268 - DNA, 18 bp, Homo sapiens
aggagtgaccgggcactg

SEQ ID NO: 5840269 - DNA, 15 bp, Homo sapiens
aggagtgactctggc

SEQ ID NO: 5840270 - DNA, 17 bp, Homo sapiens
aggagtgactttgcagg

SEQ ID NO: 5840271 - DNA, 14 bp, Homo sapiens
aggagtgagcacta

SEQ ID NO: 5840272 - DNA, 21 bp, Homo sapiens
aggagtgagtgaaactcccac

SEQ ID NO: 5840273 - DNA, 20 bp, Homo sapiens
aggagtgagtgtatgtgtgt

SEQ ID NO: 5840274 - DNA, 21 bp, Homo sapiens
aggagtgatcgtcagatgtgt

SEQ ID NO: 5840275 - DNA, 21 bp, Homo sapiens
aggagtgatgggcaaggggcc

SEQ ID NO: 5840276 - DNA, 22 bp, Homo sapiens
aggagtgatgggcaaggggcca

SEQ ID NO: 5840277 - DNA, 23 bp, Homo sapiens
aggagtgatgggcaaggggccag

SEQ ID NO: 5840278 - DNA, 18 bp, Homo sapiens
aggagtgcatggccacag

SEQ ID NO: 5840279 - DNA, 16 bp, Homo sapiens
aggagtgccaggacca

SEQ ID NO: 5840280 - DNA, 18 bp, Homo sapiens
aggagtgccaggaccagc

SEQ ID NO: 5840281 - DNA, 20 bp, Homo sapiens
aggagtgccataccttctcc

SEQ ID NO: 5840282 - DNA, 22 bp, Homo sapiens
aggagtgccataccttctccca

SEQ ID NO: 5840283 - DNA, 16 bp, Homo sapiens
aggagtgcccccggga

SEQ ID NO: 5840284 - DNA, 20 bp, Homo sapiens
aggagtgcgtggcccaccag

SEQ ID NO: 5840285 - DNA, 22 bp, Homo sapiens
aggagtgcgtggcccaccaggc

SEQ ID NO: 5840286 - DNA, 18 bp, Homo sapiens
aggagtggacgctgtcca

SEQ ID NO: 5840287 - DNA, 16 bp, Homo sapiens
aggagtggagggtggg

SEQ ID NO: 5840288 - DNA, 17 bp, Homo sapiens
aggagtggccacagcac

SEQ ID NO: 5840289 - DNA, 11 bp, Homo sapiens
aggagtggctg

SEQ ID NO: 5840290 - DNA, 17 bp, Homo sapiens
aggagtggctgaccagg

SEQ ID NO: 5840291 - DNA, 20 bp, Homo sapiens
aggagtggctgaccaggccc

SEQ ID NO: 5840292 - DNA, 22 bp, Homo sapiens
aggagtggctgaccaggccctg

SEQ ID NO: 5840293 - DNA, 18 bp, Homo sapiens
aggagtgggacagacagc

SEQ ID NO: 5840294 - DNA, 21 bp, Homo sapiens
aggagtgggacagacagcagc

SEQ ID NO: 5840295 - DNA, 12 bp, Homo sapiens
aggagtggggtg

SEQ ID NO: 5840296 - DNA, 19 bp, Homo sapiens
aggagtgggtcgcccacgg

SEQ ID NO: 5840297 - DNA, 22 bp, Homo sapiens
aggagtggtacttaagctcccc

SEQ ID NO: 5840298 - DNA, 17 bp, Homo sapiens
aggagtggtgatttgaa

SEQ ID NO: 5840299 - DNA, 18 bp, Homo sapiens
aggagtggtgcagacaga

SEQ ID NO: 5840300 - DNA, 22 bp, Homo sapiens
aggagtggttgggctgtgcctg

SEQ ID NO: 5840301 - DNA, 19 bp, Homo sapiens
aggagtggtttttcttttc

SEQ ID NO: 5840302 - DNA, 19 bp, Homo sapiens
aggagtgtatgagtgtgag

SEQ ID NO: 5840303 - DNA, 12 bp, Homo sapiens
aggagtgtcctg

SEQ ID NO: 5840304 - DNA, 15 bp, Homo sapiens
aggagtgtcctgccc

SEQ ID NO: 5840305 - DNA, 16 bp, Homo sapiens
aggagtgtcctggctg

SEQ ID NO: 5840306 - DNA, 15 bp, Homo sapiens
aggagtgtcctgtct

SEQ ID NO: 5840307 - DNA, 16 bp, Homo sapiens
aggagtgtgagaatca

SEQ ID NO: 5840308 - DNA, 12 bp, Homo sapiens
aggagtgtgcaa

SEQ ID NO: 5840309 - DNA, 17 bp, Homo sapiens
aggagttatttgtaatg

SEQ ID NO: 5840310 - DNA, 17 bp, Homo sapiens
aggagttcaagaccagc

SEQ ID NO: 5840311 - DNA, 19 bp, Homo sapiens
aggagttcaagaccagcct

SEQ ID NO: 5840312 - DNA, 22 bp, Homo sapiens
aggagttcaagactagcctggc

SEQ ID NO: 5840313 - DNA, 15 bp, Homo sapiens
aggagttcaatgatc

SEQ ID NO: 5840314 - DNA, 16 bp, Homo sapiens
aggagttcaatgatct

SEQ ID NO: 5840315 - DNA, 17 bp, Homo sapiens
aggagttcaatgatcta

SEQ ID NO: 5840316 - DNA, 21 bp, Homo sapiens
aggagttcagcggagctagca

SEQ ID NO: 5840317 - DNA, 13 bp, Homo sapiens
aggagttcataga

SEQ ID NO: 5840318 - DNA, 15 bp, Homo sapiens
aggagttccagtgct

SEQ ID NO: 5840319 - DNA, 21 bp, Homo sapiens
aggagttcgagaccagcccag

SEQ ID NO: 5840320 - DNA, 19 bp, Homo sapiens
aggagttcgagaccagcct

SEQ ID NO: 5840321 - DNA, 22 bp, Homo sapiens
aggagttcgagagcagcctggc

SEQ ID NO: 5840322 - DNA, 17 bp, Homo sapiens
aggagttcgaggctgca

SEQ ID NO: 5840323 - DNA, 13 bp, Homo sapiens
aggagttctctga

SEQ ID NO: 5840324 - DNA, 19 bp, Homo sapiens
aggagttctctgatgcaga

SEQ ID NO: 5840325 - DNA, 21 bp, Homo sapiens
aggagttctctgatgcagaaa

SEQ ID NO: 5840326 - DNA, 13 bp, Homo sapiens
aggagttgcctga

SEQ ID NO: 5840327 - DNA, 13 bp, Homo sapiens
aggagttgctcct

SEQ ID NO: 5840328 - DNA, 16 bp, Homo sapiens
aggagttggaatgttg

SEQ ID NO: 5840329 - DNA, 22 bp, Homo sapiens
aggagttggagaccaggcctga

SEQ ID NO: 5840330 - DNA, 19 bp, Homo sapiens
aggagttgtacctccattg

SEQ ID NO: 5840331 - DNA, 17 bp, Homo sapiens
aggagttgtctgtcctg

SEQ ID NO: 5840332 - DNA, 18 bp, Homo sapiens
aggagttgtctgtcctgg

SEQ ID NO: 5840333 - DNA, 20 bp, Homo sapiens
aggagttgtctgtcctggtc

SEQ ID NO: 5840334 - DNA, 15 bp, Homo sapiens
aggagtttattacaa

SEQ ID NO: 5840335 - DNA, 20 bp, Homo sapiens
aggagtttattacaatgtat

SEQ ID NO: 5840336 - DNA, 23 bp, Homo sapiens
aggagtttattacaatgtatctt

SEQ ID NO: 5840337 - DNA, 19 bp, Homo sapiens
aggagtttcgaggtagagt

SEQ ID NO: 5840338 - DNA, 19 bp, Homo sapiens
aggagtttcgttttcaaaa

SEQ ID NO: 5840339 - DNA, 15 bp, Homo sapiens
aggagtttgagacca

SEQ ID NO: 5840340 - DNA, 21 bp, Homo sapiens
aggagtttgagaccaacctgg

SEQ ID NO: 5840341 - DNA, 21 bp, Homo sapiens
aggagtttgagaccagcttag

SEQ ID NO: 5840342 - DNA, 19 bp, Homo sapiens
aggagtttgagaccaggct

SEQ ID NO: 5840343 - DNA, 20 bp, Homo sapiens
aggagtttgagaccaggctg

SEQ ID NO: 5840344 - DNA, 22 bp, Homo sapiens
aggagtttgagaccaggctggg

SEQ ID NO: 5840345 - DNA, 19 bp, Homo sapiens
aggagtttgaggctgcagc

SEQ ID NO: 5840346 - DNA, 12 bp, Homo sapiens
aggagtttggcc

SEQ ID NO: 5840347 - DNA, 15 bp, Homo sapiens
aggagtttggccaga

SEQ ID NO: 5840348 - DNA, 16 bp, Homo sapiens
aggagtttggccagaa

SEQ ID NO: 5840349 - DNA, 15 bp, Homo sapiens
aggagtttgtgtgtc

SEQ ID NO: 5840350 - DNA, 17 bp, Homo sapiens
aggagttttactgcctg

SEQ ID NO: 5840351 - DNA, 21 bp, Homo sapiens
aggagttttatatactgtgta

SEQ ID NO: 5840352 - DNA, 15 bp, Homo sapiens
aggagttttctgtgt

SEQ ID NO: 5840353 - DNA, 23 bp, Homo sapiens
aggagttttctgtgtggtctcca

SEQ ID NO: 5840354 - DNA, 17 bp, Homo sapiens
aggagttttttttaacc

SEQ ID NO: 5840355 - DNA, 20 bp, Homo sapiens
aggataaaaagccagggctg

SEQ ID NO: 5840356 - DNA, 21 bp, Homo sapiens
aggataaaaaggaaggagaga

SEQ ID NO: 5840357 - DNA, 13 bp, Homo sapiens
aggataaaataat

SEQ ID NO: 5840358 - DNA, 19 bp, Homo sapiens
aggataaaccaatcatctt

SEQ ID NO: 5840359 - DNA, 15 bp, Homo sapiens
aggataaagccactt

SEQ ID NO: 5840360 - DNA, 20 bp, Homo sapiens
aggataaattaatgagtttt

SEQ ID NO: 5840361 - DNA, 14 bp, Homo sapiens
aggataaattgcca

SEQ ID NO: 5840362 - DNA, 15 bp, Homo sapiens
aggataaattgccat

SEQ ID NO: 5840363 - DNA, 18 bp, Homo sapiens
aggataaattttagaaaa

SEQ ID NO: 5840364 - DNA, 18 bp, Homo sapiens
aggataacacaagtaaaa

SEQ ID NO: 5840365 - DNA, 21 bp, Homo sapiens
aggataacttccttgcccctg

SEQ ID NO: 5840366 - DNA, 13 bp, Homo sapiens
aggataagtgaaa

SEQ ID NO: 5840367 - DNA, 14 bp, Homo sapiens
aggataatatattt

SEQ ID NO: 5840368 - DNA, 17 bp, Homo sapiens
aggataatgaaataatc

SEQ ID NO: 5840369 - DNA, 15 bp, Homo sapiens
aggataatgagatgt

SEQ ID NO: 5840370 - DNA, 19 bp, Homo sapiens
aggataatttttaaaagag

SEQ ID NO: 5840371 - DNA, 13 bp, Homo sapiens
aggatacagctct

SEQ ID NO: 5840372 - DNA, 16 bp, Homo sapiens
aggatacagctcttct

SEQ ID NO: 5840373 - DNA, 21 bp, Homo sapiens
aggatacagctcttctcagtg

SEQ ID NO: 5840374 - DNA, 14 bp, Homo sapiens
aggatacaggtgac

SEQ ID NO: 5840375 - DNA, 22 bp, Homo sapiens
aggataccatatacagctcaga

SEQ ID NO: 5840376 - DNA, 22 bp, Homo sapiens
aggataccccaaagtccaggct

SEQ ID NO: 5840377 - DNA, 13 bp, Homo sapiens
aggataccttcca

SEQ ID NO: 5840378 - DNA, 18 bp, Homo sapiens
aggataccttccatctca

SEQ ID NO: 5840379 - DNA, 18 bp, Homo sapiens
aggatacgacagtacact

SEQ ID NO: 5840380 - DNA, 22 bp, Homo sapiens
aggatactgtaacactttacaa

SEQ ID NO: 5840381 - DNA, 16 bp, Homo sapiens
aggatacttatttaaa

SEQ ID NO: 5840382 - DNA, 16 bp, Homo sapiens
aggatagaaaaaggat

SEQ ID NO: 5840383 - DNA, 19 bp, Homo sapiens
aggatagaaaaaggatgga

SEQ ID NO: 5840384 - DNA, 17 bp, Homo sapiens
aggatagacactggaca

SEQ ID NO: 5840385 - DNA, 19 bp, Homo sapiens
aggatagacactggacatg

SEQ ID NO: 5840386 - DNA, 16 bp, Homo sapiens
aggatagataactctt

SEQ ID NO: 5840387 - DNA, 20 bp, Homo sapiens
aggatagataactctttgga

SEQ ID NO: 5840388 - DNA, 19 bp, Homo sapiens
aggatagatgctggcccag

SEQ ID NO: 5840389 - DNA, 20 bp, Homo sapiens
aggatagatgctggcccagg

SEQ ID NO: 5840390 - DNA, 22 bp, Homo sapiens
aggatagatgctggcccagggc

SEQ ID NO: 5840391 - DNA, 14 bp, Homo sapiens
aggatagcattttt

SEQ ID NO: 5840392 - DNA, 16 bp, Homo sapiens
aggatagcctcagcca

SEQ ID NO: 5840393 - DNA, 23 bp, Homo sapiens
aggatagctatattttatttctg

SEQ ID NO: 5840394 - DNA, 13 bp, Homo sapiens
aggataggaaaag

SEQ ID NO: 5840395 - DNA, 14 bp, Homo sapiens
aggataggaaaaga

SEQ ID NO: 5840396 - DNA, 21 bp, Homo sapiens
aggataggagttcacttcatc

SEQ ID NO: 5840397 - DNA, 20 bp, Homo sapiens
aggatagtagttaaataact

SEQ ID NO: 5840398 - DNA, 22 bp, Homo sapiens
aggatagtgtgaagatctttgg

SEQ ID NO: 5840399 - DNA, 17 bp, Homo sapiens
aggatagttgatgcatg

SEQ ID NO: 5840400 - DNA, 17 bp, Homo sapiens
aggatataaaaggatgt

SEQ ID NO: 5840401 - DNA, 15 bp, Homo sapiens
aggatataatgtgtg

SEQ ID NO: 5840402 - DNA, 15 bp, Homo sapiens
aggatatagcaacat

SEQ ID NO: 5840403 - DNA, 18 bp, Homo sapiens
aggatatattttcacttt

SEQ ID NO: 5840404 - DNA, 21 bp, Homo sapiens
aggatatattttcactttgtg

SEQ ID NO: 5840405 - DNA, 16 bp, Homo sapiens
aggatatccccaggga

SEQ ID NO: 5840406 - DNA, 19 bp, Homo sapiens
aggatatccccagggaaac

SEQ ID NO: 5840407 - DNA, 17 bp, Homo sapiens
aggatatccttatcaga

SEQ ID NO: 5840408 - DNA, 16 bp, Homo sapiens
aggcaacagacttaaa

SEQ ID NO: 5840409 - DNA, 13 bp, Homo sapiens
aggcaacaggatt

SEQ ID NO: 5840410 - DNA, 19 bp, Homo sapiens
aggcaacattacaaacaaa

SEQ ID NO: 5840411 - DNA, 22 bp, Homo sapiens
aggcaacattacaaacaaagga

SEQ ID NO: 5840412 - DNA, 14 bp, Homo sapiens
aggcaaccaataaa

SEQ ID NO: 5840413 - DNA, 15 bp, Homo sapiens
aggcaacgcagacca

SEQ ID NO: 5840414 - DNA, 17 bp, Homo sapiens
aggcaactattaataat

SEQ ID NO: 5840415 - DNA, 16 bp, Homo sapiens
aggcaactcaaagatg

SEQ ID NO: 5840416 - DNA, 13 bp, Homo sapiens
aggcaactcagca

SEQ ID NO: 5840417 - DNA, 15 bp, Homo sapiens
aggcaactcagcagg

SEQ ID NO: 5840418 - DNA, 18 bp, Homo sapiens
aggcaactgaacaaaaaa

SEQ ID NO: 5840419 - DNA, 19 bp, Homo sapiens
aggcaactgaggcagacag

SEQ ID NO: 5840420 - DNA, 14 bp, Homo sapiens
aggcaacttgaaga

SEQ ID NO: 5840421 - DNA, 16 bp, Homo sapiens
aggcaacttgaagaaa

SEQ ID NO: 5840422 - DNA, 21 bp, Homo sapiens
aggcaacttgaagaaacgctt

SEQ ID NO: 5840423 - DNA, 16 bp, Homo sapiens
aggcaacttgggaact

SEQ ID NO: 5840424 - DNA, 14 bp, Homo sapiens
aggcaacttttaaa

SEQ ID NO: 5840425 - DNA, 22 bp, Homo sapiens
aggcaagaaaagcgcagagaaa

SEQ ID NO: 5840426 - DNA, 13 bp, Homo sapiens
aggcaagaaaagg

SEQ ID NO: 5840427 - DNA, 18 bp, Homo sapiens
aggcaagaaagcttcctt

SEQ ID NO: 5840428 - DNA, 17 bp, Homo sapiens
aggcaagaagtgggatt

SEQ ID NO: 5840429 - DNA, 12 bp, Homo sapiens
aggcaagagaaa

SEQ ID NO: 5840430 - DNA, 14 bp, Homo sapiens
aggcaagagaaatg

SEQ ID NO: 5840431 - DNA, 20 bp, Homo sapiens
aggcaagagaaatgaggaag

SEQ ID NO: 5840432 - DNA, 14 bp, Homo sapiens
aggcaagagggagg

SEQ ID NO: 5840433 - DNA, 19 bp, Homo sapiens
aggcaagagggaggggaca

SEQ ID NO: 5840434 - DNA, 17 bp, Homo sapiens
aggcaagagggggtgga

SEQ ID NO: 5840435 - DNA, 24 bp, Homo sapiens
aggcaagaggggtggagactgctt

SEQ ID NO: 5840436 - DNA, 20 bp, Homo sapiens
aggcaagagtgttcttttct

SEQ ID NO: 5840437 - DNA, 20 bp, Homo sapiens
aggcaagattggaaagacag

SEQ ID NO: 5840438 - DNA, 21 bp, Homo sapiens
aggcaagattggaaagacagg

SEQ ID NO: 5840439 - DNA, 22 bp, Homo sapiens
aggcaagattggaaagacagga

SEQ ID NO: 5840440 - DNA, 22 bp, Homo sapiens
aggcaagcacaatggtttcaaa

SEQ ID NO: 5840441 - DNA, 15 bp, Homo sapiens
aggcaagcaggacct

SEQ ID NO: 5840442 - DNA, 17 bp, Homo sapiens
aggcaagcaggacctgg

SEQ ID NO: 5840443 - DNA, 19 bp, Homo sapiens
aggcaagcaggacctggca

SEQ ID NO: 5840444 - DNA, 14 bp, Homo sapiens
aggcaagcatgaat

SEQ ID NO: 5840445 - DNA, 16 bp, Homo sapiens
aggcaagccacagaaa

SEQ ID NO: 5840446 - DNA, 15 bp, Homo sapiens
aggcaagcccctcag

SEQ ID NO: 5840447 - DNA, 21 bp, Homo sapiens
aggcaagcccttcggtcacct

SEQ ID NO: 5840448 - DNA, 18 bp, Homo sapiens
aggcaagcgtgttctcag

SEQ ID NO: 5840449 - DNA, 15 bp, Homo sapiens
aggcaagctgaaatt

SEQ ID NO: 5840450 - DNA, 16 bp, Homo sapiens
aggcaagctgaaattt

SEQ ID NO: 5840451 - DNA, 17 bp, Homo sapiens
aggcaagctggcaggag

SEQ ID NO: 5840452 - DNA, 22 bp, Homo sapiens
aggcaagctggcaggagggtgg

SEQ ID NO: 5840453 - DNA, 20 bp, Homo sapiens
aggcaagcttgaggccaaga

SEQ ID NO: 5840454 - DNA, 22 bp, Homo sapiens
aggcaagcttgaggccaagatg

SEQ ID NO: 5840455 - DNA, 20 bp, Homo sapiens
aggcaaggaaagaaatacag

SEQ ID NO: 5840456 - DNA, 22 bp, Homo sapiens
aggcaaggaacagaagtgagga

SEQ ID NO: 5840457 - DNA, 12 bp, Homo sapiens
aggcaaggagga

SEQ ID NO: 5840458 - DNA, 14 bp, Homo sapiens
aggcaaggaggagg

SEQ ID NO: 5840459 - DNA, 15 bp, Homo sapiens
aggcaaggaggagga

SEQ ID NO: 5840460 - DNA, 16 bp, Homo sapiens
aggcaaggatggtggg

SEQ ID NO: 5840461 - DNA, 15 bp, Homo sapiens
aggcaaggcaggtgc

SEQ ID NO: 5840462 - DNA, 22 bp, Homo sapiens
aggcaaggcaggtgcctccagg

SEQ ID NO: 5840463 - DNA, 23 bp, Homo sapiens
aggcaaggcccagacctggcctc

SEQ ID NO: 5840464 - DNA, 15 bp, Homo sapiens
aggcaaggccctgcc

SEQ ID NO: 5840465 - DNA, 19 bp, Homo sapiens
aggcaaggccctgccctgc

SEQ ID NO: 5840466 - DNA, 20 bp, Homo sapiens
aggcaaggctgccggctgca

SEQ ID NO: 5840467 - DNA, 16 bp, Homo sapiens
aggcaaggctgtcaat

SEQ ID NO: 5840468 - DNA, 12 bp, Homo sapiens
aggcaaggggca

SEQ ID NO: 5840469 - DNA, 19 bp, Homo sapiens
aggcaaggggtgcctggga

SEQ ID NO: 5840470 - DNA, 17 bp, Homo sapiens
aggcaaggttatatgca

SEQ ID NO: 5840471 - DNA, 20 bp, Homo sapiens
aggcaagtggtagggatgag

SEQ ID NO: 5840472 - DNA, 18 bp, Homo sapiens
aggcaagttaagagaaac

SEQ ID NO: 5840473 - DNA, 19 bp, Homo sapiens
aggcaagttaagagaaact

SEQ ID NO: 5840474 - DNA, 22 bp, Homo sapiens
aggcaagttttccctgaagtta

SEQ ID NO: 5840475 - DNA, 17 bp, Homo sapiens
aggcaataaataaatgt

SEQ ID NO: 5840476 - DNA, 20 bp, Homo sapiens
aggcaataatattttctgtg

SEQ ID NO: 5840477 - DNA, 19 bp, Homo sapiens
aggcaatagtgttgaggag

SEQ ID NO: 5840478 - DNA, 20 bp, Homo sapiens
aggcaatagtgttgaggagg

SEQ ID NO: 5840479 - DNA, 16 bp, Homo sapiens
aggcaatatctttaat

SEQ ID NO: 5840480 - DNA, 20 bp, Homo sapiens
aggcaatcaagagcttccag

SEQ ID NO: 5840481 - DNA, 22 bp, Homo sapiens
aggcaatcaagagcttccagaa

SEQ ID NO: 5840482 - DNA, 20 bp, Homo sapiens
aggcaatgactgcgcagagt

SEQ ID NO: 5840483 - DNA, 10 bp, Homo sapiens
aggcaatgat

SEQ ID NO: 5840484 - DNA, 14 bp, Homo sapiens
aggcaatgctggct

SEQ ID NO: 5840485 - DNA, 16 bp, Homo sapiens
aggcaatgctggctgt

SEQ ID NO: 5840486 - DNA, 17 bp, Homo sapiens
aggcaatgctgtacttt

SEQ ID NO: 5840487 - DNA, 18 bp, Homo sapiens
aggcaatggtttgtgtca

SEQ ID NO: 5840488 - DNA, 19 bp, Homo sapiens
aggcaatgtcaggaacaga

SEQ ID NO: 5840489 - DNA, 17 bp, Homo sapiens
aggcaatttctctgcac

SEQ ID NO: 5840490 - DNA, 18 bp, Homo sapiens
aggcaattttagtgtatt

SEQ ID NO: 5840491 - DNA, 19 bp, Homo sapiens
aggcaattttagtgtatta

SEQ ID NO: 5840492 - DNA, 13 bp, Homo sapiens
aggcacaaatcac

SEQ ID NO: 5840493 - DNA, 22 bp, Homo sapiens
aggcacaaggttggttgctaag

SEQ ID NO: 5840494 - DNA, 17 bp, Homo sapiens
aggcacacaaggggccc

SEQ ID NO: 5840495 - DNA, 18 bp, Homo sapiens
aggcacacaaggggccct

SEQ ID NO: 5840496 - DNA, 23 bp, Homo sapiens
aggcacacaccaccacgcctggc

SEQ ID NO: 5840497 - DNA, 20 bp, Homo sapiens
aggcacacacgccttcatgc

SEQ ID NO: 5840498 - DNA, 14 bp, Homo sapiens
aggcacacactgtg

SEQ ID NO: 5840499 - DNA, 19 bp, Homo sapiens
aggcacacactgtgctttc

SEQ ID NO: 5840500 - DNA, 20 bp, Homo sapiens
aggcacacactgtgctttct

SEQ ID NO: 5840501 - DNA, 21 bp, Homo sapiens
aggcacacactgtgctttcta

SEQ ID NO: 5840502 - DNA, 11 bp, Homo sapiens
aggcacacagc

SEQ ID NO: 5840503 - DNA, 17 bp, Homo sapiens
aggcacacagcagcccc

SEQ ID NO: 5840504 - DNA, 23 bp, Homo sapiens
aggcacacagcagccccccagca

SEQ ID NO: 5840505 - DNA, 13 bp, Homo sapiens
aggcacacagcta

SEQ ID NO: 5840506 - DNA, 23 bp, Homo sapiens
aggcacacagctgcagagacaga

SEQ ID NO: 5840507 - DNA, 15 bp, Homo sapiens
aggcacaccttgcag

SEQ ID NO: 5840508 - DNA, 19 bp, Homo sapiens
aggcacactgagcaagttt

SEQ ID NO: 5840509 - DNA, 20 bp, Homo sapiens
aggcacacttcttcttggtc

SEQ ID NO: 5840510 - DNA, 14 bp, Homo sapiens
aggcacagcaaact

SEQ ID NO: 5840511 - DNA, 16 bp, Homo sapiens
aggcacagcaaactgt

SEQ ID NO: 5840512 - DNA, 12 bp, Homo sapiens
aggcacagcaca

SEQ ID NO: 5840513 - DNA, 22 bp, Homo sapiens
aggcacagcagtttcaccatct

SEQ ID NO: 5840514 - DNA, 15 bp, Homo sapiens
aggcacaggatgctg

SEQ ID NO: 5840515 - DNA, 12 bp, Homo sapiens
aggcacaggcag

SEQ ID NO: 5840516 - DNA, 18 bp, Homo sapiens
aggcacaggctgttgaag

SEQ ID NO: 5840517 - DNA, 15 bp, Homo sapiens
aggcacagggagaag

SEQ ID NO: 5840518 - DNA, 17 bp, Homo sapiens
aggcacagggcccgcag

SEQ ID NO: 5840519 - DNA, 22 bp, Homo sapiens
aggcacaggtcaggggtgacac

SEQ ID NO: 5840520 - DNA, 14 bp, Homo sapiens
aggcacagtgggag

SEQ ID NO: 5840521 - DNA, 17 bp, Homo sapiens
aggcacagtgggagctg

SEQ ID NO: 5840522 - DNA, 21 bp, Homo sapiens
aggcacagtgggagctgagct

SEQ ID NO: 5840523 - DNA, 23 bp, Homo sapiens
aggcacagtgggagctgagctgg

SEQ ID NO: 5840524 - DNA, 23 bp, Homo sapiens
aggcacataggctggtggccttg

SEQ ID NO: 5840525 - DNA, 12 bp, Homo sapiens
aggcacatattg

SEQ ID NO: 5840526 - DNA, 17 bp, Homo sapiens
aggcacatggaggagct

SEQ ID NO: 5840527 - DNA, 15 bp, Homo sapiens
aggcacatggctggg

SEQ ID NO: 5840528 - DNA, 17 bp, Homo sapiens
aggcacatggctggggg

SEQ ID NO: 5840529 - DNA, 12 bp, Homo sapiens
aggcacatgttg

SEQ ID NO: 5840530 - DNA, 14 bp, Homo sapiens
aggcaccaccagga

SEQ ID NO: 5840531 - DNA, 16 bp, Homo sapiens
aggcaccaccaggagc

SEQ ID NO: 5840532 - DNA, 19 bp, Homo sapiens
aggcaccacctctgtcacg

SEQ ID NO: 5840533 - DNA, 14 bp, Homo sapiens
aggcaccagaagaa

SEQ ID NO: 5840534 - DNA, 20 bp, Homo sapiens
aggcaccagcatccaccttg

SEQ ID NO: 5840535 - DNA, 14 bp, Homo sapiens
aggcaccagctctg

SEQ ID NO: 5840536 - DNA, 15 bp, Homo sapiens
aggcaccagctctgt

SEQ ID NO: 5840537 - DNA, 19 bp, Homo sapiens
aggcaccagctctgtggcc

SEQ ID NO: 5840538 - DNA, 16 bp, Homo sapiens
aggcaccaggaagccg

SEQ ID NO: 5840539 - DNA, 14 bp, Homo sapiens
aggcaccagtccag

SEQ ID NO: 5840540 - DNA, 20 bp, Homo sapiens
aggcaccagtccagcaaata

SEQ ID NO: 5840541 - DNA, 16 bp, Homo sapiens
aggcaccagtccctgt

SEQ ID NO: 5840542 - DNA, 16 bp, Homo sapiens
aggcaccatctgccaa

SEQ ID NO: 5840543 - DNA, 20 bp, Homo sapiens
aggcaccatctgccaatgcc

SEQ ID NO: 5840544 - DNA, 18 bp, Homo sapiens
aggcaccatgctgggccg

SEQ ID NO: 5840545 - DNA, 17 bp, Homo sapiens
aggcaccattcaggaac

SEQ ID NO: 5840546 - DNA, 22 bp, Homo sapiens
aggcacccaccatcatgtctgg

SEQ ID NO: 5840547 - DNA, 12 bp, Homo sapiens
aggcacccatcc

SEQ ID NO: 5840548 - DNA, 22 bp, Homo sapiens
aggcacccatgtgggcgcccac

SEQ ID NO: 5840549 - DNA, 15 bp, Homo sapiens
aggcaccccctggag

SEQ ID NO: 5840550 - DNA, 16 bp, Homo sapiens
aggcaccccctggctt

SEQ ID NO: 5840551 - DNA, 17 bp, Homo sapiens
aggcaccccctggcttg

SEQ ID NO: 5840552 - DNA, 22 bp, Homo sapiens
aggcacccctttccccagcctc

SEQ ID NO: 5840553 - DNA, 22 bp, Homo sapiens
aggcacccgccctttccttgcc

SEQ ID NO: 5840554 - DNA, 23 bp, Homo sapiens
aggcacccgccctttccttgcct

SEQ ID NO: 5840555 - DNA, 23 bp, Homo sapiens
aggcacccggggccagagacata

SEQ ID NO: 5840556 - DNA, 22 bp, Homo sapiens
aggcacccgtccccacacgagg

SEQ ID NO: 5840557 - DNA, 13 bp, Homo sapiens
aggcacccttcca

SEQ ID NO: 5840558 - DNA, 20 bp, Homo sapiens
aggcacccttctttcctctt

SEQ ID NO: 5840559 - DNA, 15 bp, Homo sapiens
aggcaccgagaatgt

SEQ ID NO: 5840560 - DNA, 16 bp, Homo sapiens
aggcaccgagaatgtt

SEQ ID NO: 5840561 - DNA, 18 bp, Homo sapiens
aggcaccgagaatgttgt

SEQ ID NO: 5840562 - DNA, 16 bp, Homo sapiens
aggcaccgcagcctgt

SEQ ID NO: 5840563 - DNA, 21 bp, Homo sapiens
aggcaccgcagcctgtcagcc

SEQ ID NO: 5840564 - DNA, 20 bp, Homo sapiens
aggcaccgccagagtgtcct

SEQ ID NO: 5840565 - DNA, 21 bp, Homo sapiens
aggcaccgccagagtgtcctg

SEQ ID NO: 5840566 - DNA, 22 bp, Homo sapiens
aggcaccgccagagtgtcctgc

SEQ ID NO: 5840567 - DNA, 20 bp, Homo sapiens
aggcaccgcctgcccccagc

SEQ ID NO: 5840568 - DNA, 23 bp, Homo sapiens
aggcaccgctgggttctgactct

SEQ ID NO: 5840569 - DNA, 17 bp, Homo sapiens
aggcaccggacgctgga

SEQ ID NO: 5840570 - DNA, 16 bp, Homo sapiens
aggcaccggcgctgca

SEQ ID NO: 5840571 - DNA, 17 bp, Homo sapiens
aggcaccggcgctgcag

SEQ ID NO: 5840572 - DNA, 18 bp, Homo sapiens
aggcaccggcgctgcagg

SEQ ID NO: 5840573 - DNA, 19 bp, Homo sapiens
aggcaccggcgctgcaggt

SEQ ID NO: 5840574 - DNA, 15 bp, Homo sapiens
aggcaccgggctggc

SEQ ID NO: 5840575 - DNA, 17 bp, Homo sapiens
aggcaccgggctggctg

SEQ ID NO: 5840576 - DNA, 18 bp, Homo sapiens
aggcaccgggctggctgc

SEQ ID NO: 5840577 - DNA, 21 bp, Homo sapiens
aggcaccgtccaggccccacc

SEQ ID NO: 5840578 - DNA, 23 bp, Homo sapiens
aggcacctacactcacctgcact

SEQ ID NO: 5840579 - DNA, 20 bp, Homo sapiens
aggcacctaccaccacgccc

SEQ ID NO: 5840580 - DNA, 15 bp, Homo sapiens
aggcacctccaggca

SEQ ID NO: 5840581 - DNA, 22 bp, Homo sapiens
aggcacctccaggcaggccagg

SEQ ID NO: 5840582 - DNA, 20 bp, Homo sapiens
aggcacctccccgctctccc

SEQ ID NO: 5840583 - DNA, 13 bp, Homo sapiens
aggcacctgcccc

SEQ ID NO: 5840584 - DNA, 14 bp, Homo sapiens
aggcagcgccactg

SEQ ID NO: 5840585 - DNA, 16 bp, Homo sapiens
aggcagcgcctgtccc

SEQ ID NO: 5840586 - DNA, 12 bp, Homo sapiens
aggcagcgtgcc

SEQ ID NO: 5840587 - DNA, 22 bp, Homo sapiens
aggcagcgtgccgagccagcaa

SEQ ID NO: 5840588 - DNA, 17 bp, Homo sapiens
aggcagcgtgggctctg

SEQ ID NO: 5840589 - DNA, 20 bp, Homo sapiens
aggcagcgtgggctctgcca

SEQ ID NO: 5840590 - DNA, 21 bp, Homo sapiens
aggcagcgtgggctctgccaa

SEQ ID NO: 5840591 - DNA, 23 bp, Homo sapiens
aggcagcgtgggctctgccaatg

SEQ ID NO: 5840592 - DNA, 20 bp, Homo sapiens
aggcagctaagatagaaagc

SEQ ID NO: 5840593 - DNA, 21 bp, Homo sapiens
aggcagctaagatagaaagct

SEQ ID NO: 5840594 - DNA, 17 bp, Homo sapiens
aggcagctaaggggcag

SEQ ID NO: 5840595 - DNA, 15 bp, Homo sapiens
aggcagctaggcagg

SEQ ID NO: 5840596 - DNA, 16 bp, Homo sapiens
aggcagctaggcaggg

SEQ ID NO: 5840597 - DNA, 17 bp, Homo sapiens
aggcagctaggcaggga

SEQ ID NO: 5840598 - DNA, 19 bp, Homo sapiens
aggcagctaggcagggagg

SEQ ID NO: 5840599 - DNA, 21 bp, Homo sapiens
aggcagctaggcagggagggg

SEQ ID NO: 5840600 - DNA, 20 bp, Homo sapiens
aggcagctatttcagcctcc

SEQ ID NO: 5840601 - DNA, 12 bp, Homo sapiens
aggcagctcacc

SEQ ID NO: 5840602 - DNA, 16 bp, Homo sapiens
aggcagctcacccctg

SEQ ID NO: 5840603 - DNA, 17 bp, Homo sapiens
aggcagctcacccctgg

SEQ ID NO: 5840604 - DNA, 21 bp, Homo sapiens
aggcagctcacccctgggcag

SEQ ID NO: 5840605 - DNA, 16 bp, Homo sapiens
aggcagctctgtcgtg

SEQ ID NO: 5840606 - DNA, 13 bp, Homo sapiens
aggcagctcttct

SEQ ID NO: 5840607 - DNA, 16 bp, Homo sapiens
aggcagctcttctgga

SEQ ID NO: 5840608 - DNA, 19 bp, Homo sapiens
aggcagctcttctggagtt

SEQ ID NO: 5840609 - DNA, 18 bp, Homo sapiens
aggcagctgaaaagtaaa

SEQ ID NO: 5840610 - DNA, 14 bp, Homo sapiens
aggcagctgaaatt

SEQ ID NO: 5840611 - DNA, 19 bp, Homo sapiens
aggcagctgagaccagggt

SEQ ID NO: 5840612 - DNA, 13 bp, Homo sapiens
aggcagctgcctc

SEQ ID NO: 5840613 - DNA, 14 bp, Homo sapiens
aggcagctgcctct

SEQ ID NO: 5840614 - DNA, 16 bp, Homo sapiens
aggcagctgcctctgc

SEQ ID NO: 5840615 - DNA, 17 bp, Homo sapiens
aggcagctgcctctgct

SEQ ID NO: 5840616 - DNA, 13 bp, Homo sapiens
aggcagctgctct

SEQ ID NO: 5840617 - DNA, 11 bp, Homo sapiens
aggcagctggc

SEQ ID NO: 5840618 - DNA, 15 bp, Homo sapiens
aggcagctggcagga

SEQ ID NO: 5840619 - DNA, 17 bp, Homo sapiens
aggcagctgtcctgtga

SEQ ID NO: 5840620 - DNA, 14 bp, Homo sapiens
aggcagctgtgtct

SEQ ID NO: 5840621 - DNA, 18 bp, Homo sapiens
aggcagctgtgtctgagc

SEQ ID NO: 5840622 - DNA, 22 bp, Homo sapiens
aggcagctgtgtgggctgcaga

SEQ ID NO: 5840623 - DNA, 19 bp, Homo sapiens
aggcagcttcaagtgcctt

SEQ ID NO: 5840624 - DNA, 14 bp, Homo sapiens
aggcagcttctaag

SEQ ID NO: 5840625 - DNA, 23 bp, Homo sapiens
aggcagctttaaccattaaaact

SEQ ID NO: 5840626 - DNA, 20 bp, Homo sapiens
aggcagctttttctctccca

SEQ ID NO: 5840627 - DNA, 15 bp, Homo sapiens
aggcaggaagagaga

SEQ ID NO: 5840628 - DNA, 16 bp, Homo sapiens
aggcaggaagagagag

SEQ ID NO: 5840629 - DNA, 17 bp, Homo sapiens
aggcaggaagagagaga

SEQ ID NO: 5840630 - DNA, 14 bp, Homo sapiens
aggcaggaagggaa

SEQ ID NO: 5840631 - DNA, 16 bp, Homo sapiens
aggcaggaagggaagc

SEQ ID NO: 5840632 - DNA, 20 bp, Homo sapiens
aggcaggaagggcaggaagg

SEQ ID NO: 5840633 - DNA, 16 bp, Homo sapiens
aggcaggaagtcagga

SEQ ID NO: 5840634 - DNA, 17 bp, Homo sapiens
aggcaggaagtcaggag

SEQ ID NO: 5840635 - DNA, 24 bp, Homo sapiens
aggcaggaagtcaggagccagcag

SEQ ID NO: 5840636 - DNA, 17 bp, Homo sapiens
aggcaggaatgggggtc

SEQ ID NO: 5840637 - DNA, 19 bp, Homo sapiens
aggcaggacatgctgaagc

SEQ ID NO: 5840638 - DNA, 21 bp, Homo sapiens
aggcaggacatgctgaagcca

SEQ ID NO: 5840639 - DNA, 15 bp, Homo sapiens
aggcaggactcctgg

SEQ ID NO: 5840640 - DNA, 17 bp, Homo sapiens
aggcaggagaatggcat

SEQ ID NO: 5840641 - DNA, 18 bp, Homo sapiens
aggcaggagaatggcgtg

SEQ ID NO: 5840642 - DNA, 18 bp, Homo sapiens
aggcaggagaatggtgtg

SEQ ID NO: 5840643 - DNA, 17 bp, Homo sapiens
aggcaggagccttcctt

SEQ ID NO: 5840644 - DNA, 16 bp, Homo sapiens
aggcaggaggatcact

SEQ ID NO: 5840645 - DNA, 19 bp, Homo sapiens
aggcaggagggcatgtgca

SEQ ID NO: 5840646 - DNA, 18 bp, Homo sapiens
aggcaggaggtgggtgag

SEQ ID NO: 5840647 - DNA, 13 bp, Homo sapiens
aggcaggagtggc

SEQ ID NO: 5840648 - DNA, 15 bp, Homo sapiens
aggcaggagtggcag

SEQ ID NO: 5840649 - DNA, 20 bp, Homo sapiens
aggcaggatcaaagacacac

SEQ ID NO: 5840650 - DNA, 12 bp, Homo sapiens
aggcaggatggc

SEQ ID NO: 5840651 - DNA, 22 bp, Homo sapiens
aggcaggattgaaaatgtccag

SEQ ID NO: 5840652 - DNA, 21 bp, Homo sapiens
aggcaggcacctagcaattcc

SEQ ID NO: 5840653 - DNA, 13 bp, Homo sapiens
aggcaggcacctg

SEQ ID NO: 5840654 - DNA, 14 bp, Homo sapiens
aggcaggcagcctg

SEQ ID NO: 5840655 - DNA, 15 bp, Homo sapiens
aggcaggcagggctc

SEQ ID NO: 5840656 - DNA, 15 bp, Homo sapiens
aggcaggcatggccc

SEQ ID NO: 5840657 - DNA, 15 bp, Homo sapiens
aggcaggcattcctg

SEQ ID NO: 5840658 - DNA, 23 bp, Homo sapiens
aggcaggcccagcctctgcccca

SEQ ID NO: 5840659 - DNA, 13 bp, Homo sapiens
aggcaggcctccg

SEQ ID NO: 5840660 - DNA, 13 bp, Homo sapiens
aggcaggcctttc

SEQ ID NO: 5840661 - DNA, 15 bp, Homo sapiens
aggcaggcctttcct

SEQ ID NO: 5840662 - DNA, 22 bp, Homo sapiens
aggcaggcgggggctgctcagc

SEQ ID NO: 5840663 - DNA, 16 bp, Homo sapiens
aggcaggctccccctg

SEQ ID NO: 5840664 - DNA, 23 bp, Homo sapiens
aggcaggctgggacggaccagca

SEQ ID NO: 5840665 - DNA, 14 bp, Homo sapiens
aggcaggctttgtt

SEQ ID NO: 5840666 - DNA, 21 bp, Homo sapiens
aggcagggaacatggggagga

SEQ ID NO: 5840667 - DNA, 22 bp, Homo sapiens
aggcagggacctaaagggacta

SEQ ID NO: 5840668 - DNA, 23 bp, Homo sapiens
aggcagggagacggtttccaggg

SEQ ID NO: 5840669 - DNA, 16 bp, Homo sapiens
aggcagggagagagta

SEQ ID NO: 5840670 - DNA, 11 bp, Homo sapiens
aggcagggagg

SEQ ID NO: 5840671 - DNA, 21 bp, Homo sapiens
aggcagggaggctctgtgtgt

SEQ ID NO: 5840672 - DNA, 12 bp, Homo sapiens
aggcagggaggg

SEQ ID NO: 5840673 - DNA, 16 bp, Homo sapiens
aggcagggaggggact

SEQ ID NO: 5840674 - DNA, 17 bp, Homo sapiens
aggcagggagggggctg

SEQ ID NO: 5840675 - DNA, 20 bp, Homo sapiens
aggcagggcagcatggagac

SEQ ID NO: 5840676 - DNA, 16 bp, Homo sapiens
aggcagggcaggacca

SEQ ID NO: 5840677 - DNA, 17 bp, Homo sapiens
aggcagggcaggaccag

SEQ ID NO: 5840678 - DNA, 20 bp, Homo sapiens
aggcagggcaggaccagccc

SEQ ID NO: 5840679 - DNA, 22 bp, Homo sapiens
aggcagggcaggaccagcccac

SEQ ID NO: 5840680 - DNA, 11 bp, Homo sapiens
aggcagggcca

SEQ ID NO: 5840681 - DNA, 13 bp, Homo sapiens
aggcagggccctg

SEQ ID NO: 5840682 - DNA, 14 bp, Homo sapiens
aggcagggccctgg

SEQ ID NO: 5840683 - DNA, 16 bp, Homo sapiens
aggcagggcctggctc

SEQ ID NO: 5840684 - DNA, 18 bp, Homo sapiens
aggcagggcctggctcca

SEQ ID NO: 5840685 - DNA, 21 bp, Homo sapiens
aggcagggcctggctccagtc

SEQ ID NO: 5840686 - DNA, 21 bp, Homo sapiens
aggcagggccttgcccagaga

SEQ ID NO: 5840687 - DNA, 22 bp, Homo sapiens
aggcagggccttgcccagagat

SEQ ID NO: 5840688 - DNA, 19 bp, Homo sapiens
aggcagggctcctccctgg

SEQ ID NO: 5840689 - DNA, 12 bp, Homo sapiens
aggcagggctct

SEQ ID NO: 5840690 - DNA, 13 bp, Homo sapiens
aggcagggctctc

SEQ ID NO: 5840691 - DNA, 16 bp, Homo sapiens
aggcagggctctcccg

SEQ ID NO: 5840692 - DNA, 19 bp, Homo sapiens
aggcagggctctcctggct

SEQ ID NO: 5840693 - DNA, 11 bp, Homo sapiens
aggcagggctg

SEQ ID NO: 5840694 - DNA, 12 bp, Homo sapiens
aggcagggctgg

SEQ ID NO: 5840695 - DNA, 19 bp, Homo sapiens
aggcagggctgggccaggt

SEQ ID NO: 5840696 - DNA, 20 bp, Homo sapiens
aggcagggctgggccaggtc

SEQ ID NO: 5840697 - DNA, 19 bp, Homo sapiens
aggcaggggaatgtatgtg

SEQ ID NO: 5840698 - DNA, 21 bp, Homo sapiens
aggcaggggacaagggaggca

SEQ ID NO: 5840699 - DNA, 16 bp, Homo sapiens
aggcaggggagtctgc

SEQ ID NO: 5840700 - DNA, 16 bp, Homo sapiens
aggcaggggcatctgt

SEQ ID NO: 5840701 - DNA, 19 bp, Homo sapiens
aggcaggggcatctgtctg

SEQ ID NO: 5840702 - DNA, 20 bp, Homo sapiens
aggcaggggcatctgtctgt

SEQ ID NO: 5840703 - DNA, 22 bp, Homo sapiens
aggcaggggcccacttggggcc

SEQ ID NO: 5840704 - DNA, 19 bp, Homo sapiens
aggcaggggccctgcagct

SEQ ID NO: 5840705 - DNA, 19 bp, Homo sapiens
aggcaggggctgggcagag

SEQ ID NO: 5840706 - DNA, 16 bp, Homo sapiens
aggcaggggcttcctg

SEQ ID NO: 5840707 - DNA, 18 bp, Homo sapiens
aggcaggggcttcctggt

SEQ ID NO: 5840708 - DNA, 16 bp, Homo sapiens
aggcaggggcttggct

SEQ ID NO: 5840709 - DNA, 23 bp, Homo sapiens
aggcagggggaaggtggggtcct

SEQ ID NO: 5840710 - DNA, 15 bp, Homo sapiens
aggcagggggccctg

SEQ ID NO: 5840711 - DNA, 23 bp, Homo sapiens
aggcaggggtcctgcaggtcctg

SEQ ID NO: 5840712 - DNA, 23 bp, Homo sapiens
aggcaggggtgggagagccagct

SEQ ID NO: 5840713 - DNA, 16 bp, Homo sapiens
aggcaggggtgggggt

SEQ ID NO: 5840714 - DNA, 21 bp, Homo sapiens
aggcagggtcccatttctcac

SEQ ID NO: 5840715 - DNA, 21 bp, Homo sapiens
aggcagggtctcactctgttg

SEQ ID NO: 5840716 - DNA, 20 bp, Homo sapiens
aggcagggttaaactgcagg

SEQ ID NO: 5840717 - DNA, 13 bp, Homo sapiens
aggcaggtcccca

SEQ ID NO: 5840718 - DNA, 16 bp, Homo sapiens
aggcaggtcgggctgc

SEQ ID NO: 5840719 - DNA, 17 bp, Homo sapiens
aggcaggtcgggctgcc

SEQ ID NO: 5840720 - DNA, 20 bp, Homo sapiens
aggcaggtcgggctgccagc

SEQ ID NO: 5840721 - DNA, 17 bp, Homo sapiens
aggcaggtctgcaaggg

SEQ ID NO: 5840722 - DNA, 19 bp, Homo sapiens
aggcaggtctgcaagggcc

SEQ ID NO: 5840723 - DNA, 18 bp, Homo sapiens
aggcaggtgaattgtttg

SEQ ID NO: 5840724 - DNA, 18 bp, Homo sapiens
aggcaggtgacagtgagg

SEQ ID NO: 5840725 - DNA, 20 bp, Homo sapiens
aggcaggtgagaacccagag

SEQ ID NO: 5840726 - DNA, 20 bp, Homo sapiens
aggcaggtgatctgctgcag

SEQ ID NO: 5840727 - DNA, 23 bp, Homo sapiens
aggcaggtgatctgctgcagagc

SEQ ID NO: 5840728 - DNA, 13 bp, Homo sapiens
aggcaggtgcctg

SEQ ID NO: 5840729 - DNA, 20 bp, Homo sapiens
aggcaggtgcttttggcaga

SEQ ID NO: 5840730 - DNA, 17 bp, Homo sapiens
aggcaggtggactgact

SEQ ID NO: 5840731 - DNA, 22 bp, Homo sapiens
aggcaggtggatcatgaggtca

SEQ ID NO: 5840732 - DNA, 23 bp, Homo sapiens
aggcaggtgggggctgcgtccct

SEQ ID NO: 5840733 - DNA, 23 bp, Homo sapiens
aggcaggtgggtggtaagaggga

SEQ ID NO: 5840734 - DNA, 22 bp, Homo sapiens
aggcaggtgtcttggacccacc

SEQ ID NO: 5840735 - DNA, 17 bp, Homo sapiens
aggcaggttagaagaac

SEQ ID NO: 5840736 - DNA, 12 bp, Homo sapiens
aggcagtagact

SEQ ID NO: 5840737 - DNA, 15 bp, Homo sapiens
aggcagtagttttca

SEQ ID NO: 5840738 - DNA, 19 bp, Homo sapiens
aggcagtattttgtgtcct

SEQ ID NO: 5840739 - DNA, 21 bp, Homo sapiens
aggcagtattttgtgtcctcc

SEQ ID NO: 5840740 - DNA, 13 bp, Homo sapiens
aggcagtccagag

SEQ ID NO: 5840741 - DNA, 20 bp, Homo sapiens
aggcagtccaggcctctctc

SEQ ID NO: 5840742 - DNA, 22 bp, Homo sapiens
aggcagtccaggcctctctctg

SEQ ID NO: 5840743 - DNA, 16 bp, Homo sapiens
aggcagtctctctctt

SEQ ID NO: 5840744 - DNA, 16 bp, Homo sapiens
aggcagtctgaaccct

SEQ ID NO: 5840745 - DNA, 12 bp, Homo sapiens
aggcagtgcatg

SEQ ID NO: 5840746 - DNA, 15 bp, Homo sapiens
aggcagtgcatgcat

SEQ ID NO: 5840747 - DNA, 12 bp, Homo sapiens
aggcagtggcag

SEQ ID NO: 5840748 - DNA, 18 bp, Homo sapiens
aggcagtggcaggggagc

SEQ ID NO: 5840749 - DNA, 15 bp, Homo sapiens
aggcagtggcccagg

SEQ ID NO: 5840750 - DNA, 14 bp, Homo sapiens
aggcagtggcttgg

SEQ ID NO: 5840751 - DNA, 14 bp, Homo sapiens
aggcagtgggaggc

SEQ ID NO: 5840752 - DNA, 21 bp, Homo sapiens
aggcagtggggctggaagcag

SEQ ID NO: 5840753 - DNA, 18 bp, Homo sapiens
aggcagtgggtcccactt

SEQ ID NO: 5840754 - DNA, 19 bp, Homo sapiens
aggcagtgggtcccacttc

SEQ ID NO: 5840755 - DNA, 13 bp, Homo sapiens
aggcagtgtcatt

SEQ ID NO: 5840756 - DNA, 13 bp, Homo sapiens
aggcagtgtctta

SEQ ID NO: 5840757 - DNA, 23 bp, Homo sapiens
aggcagtgtcttaaggagactgg

SEQ ID NO: 5840758 - DNA, 23 bp, Homo sapiens
aggcagttaccattaaaccatct

SEQ ID NO: 5840759 - DNA, 24 bp, Homo sapiens
aggcagttaccattaaaccatctc

SEQ ID NO: 5840760 - DNA, 18 bp, Homo sapiens
aggcagttagagatgcct

SEQ ID NO: 5840761 - DNA, 12 bp, Homo sapiens
aggccccctcct

SEQ ID NO: 5840762 - DNA, 21 bp, Homo sapiens
aggccccctctcaggagccat

SEQ ID NO: 5840763 - DNA, 18 bp, Homo sapiens
aggccccctgcctgccct

SEQ ID NO: 5840764 - DNA, 17 bp, Homo sapiens
aggccccgaggacccag

SEQ ID NO: 5840765 - DNA, 23 bp, Homo sapiens
aggccccgaggacccagacccag

SEQ ID NO: 5840766 - DNA, 19 bp, Homo sapiens
aggccccgatggactcctg

SEQ ID NO: 5840767 - DNA, 20 bp, Homo sapiens
aggccccgatggactcctga

SEQ ID NO: 5840768 - DNA, 20 bp, Homo sapiens
aggccccgccccatgggccc

SEQ ID NO: 5840769 - DNA, 23 bp, Homo sapiens
aggccccgcccgtctctgctctg

SEQ ID NO: 5840770 - DNA, 23 bp, Homo sapiens
aggccccgccttttcccccaccc

SEQ ID NO: 5840771 - DNA, 15 bp, Homo sapiens
aggccccgcttgtcc

SEQ ID NO: 5840772 - DNA, 19 bp, Homo sapiens
aggcccctaggtgcccagg

SEQ ID NO: 5840773 - DNA, 22 bp, Homo sapiens
aggcccctaggtgcccagggcc

SEQ ID NO: 5840774 - DNA, 23 bp, Homo sapiens
aggcccctaggtgcccagggcca

SEQ ID NO: 5840775 - DNA, 14 bp, Homo sapiens
aggcccctcccagt

SEQ ID NO: 5840776 - DNA, 20 bp, Homo sapiens
aggcccctccctctccagca

SEQ ID NO: 5840777 - DNA, 15 bp, Homo sapiens
aggcccctcctagac

SEQ ID NO: 5840778 - DNA, 19 bp, Homo sapiens
aggcccctcctagacccag

SEQ ID NO: 5840779 - DNA, 12 bp, Homo sapiens
aggcccctgagg

SEQ ID NO: 5840780 - DNA, 15 bp, Homo sapiens
aggcccctgaggact

SEQ ID NO: 5840781 - DNA, 20 bp, Homo sapiens
aggcccctgaggactggaga

SEQ ID NO: 5840782 - DNA, 22 bp, Homo sapiens
aggcccctgagggacgagcaga

SEQ ID NO: 5840783 - DNA, 12 bp, Homo sapiens
aggcccctgcct

SEQ ID NO: 5840784 - DNA, 13 bp, Homo sapiens
aggcccctgcctc

SEQ ID NO: 5840785 - DNA, 22 bp, Homo sapiens
aggcccctggaggctgcctccc

SEQ ID NO: 5840786 - DNA, 14 bp, Homo sapiens
aggcccctggccca

SEQ ID NO: 5840787 - DNA, 20 bp, Homo sapiens
aggcccctggcccagcggcc

SEQ ID NO: 5840788 - DNA, 17 bp, Homo sapiens
aggcccctgggctctca

SEQ ID NO: 5840789 - DNA, 21 bp, Homo sapiens
aggcccctgggctctcaccca

SEQ ID NO: 5840790 - DNA, 15 bp, Homo sapiens
aggcccctgggtttc

SEQ ID NO: 5840791 - DNA, 13 bp, Homo sapiens
aggccccttccac

SEQ ID NO: 5840792 - DNA, 18 bp, Homo sapiens
aggccccttctctccctg

SEQ ID NO: 5840793 - DNA, 20 bp, Homo sapiens
aggccccttctctccctgcc

SEQ ID NO: 5840794 - DNA, 21 bp, Homo sapiens
aggcccgaaggtctctctggc

SEQ ID NO: 5840795 - DNA, 22 bp, Homo sapiens
aggcccgaaggtctctctggct

SEQ ID NO: 5840796 - DNA, 23 bp, Homo sapiens
aggcccgagatgtgacccaccag

SEQ ID NO: 5840797 - DNA, 22 bp, Homo sapiens
aggcccgagcagctgagcaggg

SEQ ID NO: 5840798 - DNA, 17 bp, Homo sapiens
aggcccgaggaggccga

SEQ ID NO: 5840799 - DNA, 15 bp, Homo sapiens
aggcccgaggcaccg

SEQ ID NO: 5840800 - DNA, 19 bp, Homo sapiens
aggcccgcactgggggcaa

SEQ ID NO: 5840801 - DNA, 19 bp, Homo sapiens
aggcccgcatgcggcccag

SEQ ID NO: 5840802 - DNA, 22 bp, Homo sapiens
aggcccgccctctgcctcctca

SEQ ID NO: 5840803 - DNA, 15 bp, Homo sapiens
aggcccgccctgccc

SEQ ID NO: 5840804 - DNA, 18 bp, Homo sapiens
aggcccggcatgaggccc

SEQ ID NO: 5840805 - DNA, 19 bp, Homo sapiens
aggcccggcatgaggcccc

SEQ ID NO: 5840806 - DNA, 21 bp, Homo sapiens
aggcccggcccagcctaggcc

SEQ ID NO: 5840807 - DNA, 13 bp, Homo sapiens
aggcccggcctct

SEQ ID NO: 5840808 - DNA, 15 bp, Homo sapiens
aggcccggctccagg

SEQ ID NO: 5840809 - DNA, 21 bp, Homo sapiens
aggcccggctccaggctcctt

SEQ ID NO: 5840810 - DNA, 21 bp, Homo sapiens
aggcccggctgagccccccat

SEQ ID NO: 5840811 - DNA, 13 bp, Homo sapiens
aggcccgggagga

SEQ ID NO: 5840812 - DNA, 22 bp, Homo sapiens
aggcccgtcagcatcactgatg

SEQ ID NO: 5840813 - DNA, 21 bp, Homo sapiens
aggcccgtcggagctgcctgc

SEQ ID NO: 5840814 - DNA, 14 bp, Homo sapiens
aggcccgtctgtcc

SEQ ID NO: 5840815 - DNA, 20 bp, Homo sapiens
aggcccgtctgtccatctgc

SEQ ID NO: 5840816 - DNA, 18 bp, Homo sapiens
aggccctacacacagacc

SEQ ID NO: 5840817 - DNA, 23 bp, Homo sapiens
aggccctacacacagaccgcgcc

SEQ ID NO: 5840818 - DNA, 17 bp, Homo sapiens
aggccctaggattcctc

SEQ ID NO: 5840819 - DNA, 22 bp, Homo sapiens
aggccctaggcgggatgggctc

SEQ ID NO: 5840820 - DNA, 22 bp, Homo sapiens
aggccctatctgtttacagtgt

SEQ ID NO: 5840821 - DNA, 18 bp, Homo sapiens
aggccctccacacctgcg

SEQ ID NO: 5840822 - DNA, 12 bp, Homo sapiens
aggccctccagt

SEQ ID NO: 5840823 - DNA, 13 bp, Homo sapiens
aggccctcccacc

SEQ ID NO: 5840824 - DNA, 20 bp, Homo sapiens
aggccctcccaccaccccat

SEQ ID NO: 5840825 - DNA, 17 bp, Homo sapiens
aggccctccctgactcc

SEQ ID NO: 5840826 - DNA, 22 bp, Homo sapiens
aggccctccctgtctccagggc

SEQ ID NO: 5840827 - DNA, 23 bp, Homo sapiens
aggccctccctgttccccagaga

SEQ ID NO: 5840828 - DNA, 16 bp, Homo sapiens
aggccctcctgctggc

SEQ ID NO: 5840829 - DNA, 19 bp, Homo sapiens
aggccctcctgctggctga

SEQ ID NO: 5840830 - DNA, 17 bp, Homo sapiens
aggccctcgctgccagc

SEQ ID NO: 5840831 - DNA, 22 bp, Homo sapiens
aggccctcgctgccagctctgt

SEQ ID NO: 5840832 - DNA, 18 bp, Homo sapiens
aggccctcggagctggct

SEQ ID NO: 5840833 - DNA, 19 bp, Homo sapiens
aggccctcgggcccagccc

SEQ ID NO: 5840834 - DNA, 18 bp, Homo sapiens
aggccctctctgcagtcc

SEQ ID NO: 5840835 - DNA, 13 bp, Homo sapiens
aggccctctgccc

SEQ ID NO: 5840836 - DNA, 14 bp, Homo sapiens
aggccctctgccca

SEQ ID NO: 5840837 - DNA, 19 bp, Homo sapiens
aggccctctgcccactccc

SEQ ID NO: 5840838 - DNA, 16 bp, Homo sapiens
aggccctctgcctgca

SEQ ID NO: 5840839 - DNA, 23 bp, Homo sapiens
aggccctctgcctgcactccctg

SEQ ID NO: 5840840 - DNA, 15 bp, Homo sapiens
aggccctctggagtg

SEQ ID NO: 5840841 - DNA, 17 bp, Homo sapiens
aggccctctgtggcctg

SEQ ID NO: 5840842 - DNA, 19 bp, Homo sapiens
aggccctgaagcctccgtg

SEQ ID NO: 5840843 - DNA, 21 bp, Homo sapiens
aggccctgaagcctccgtgga

SEQ ID NO: 5840844 - DNA, 15 bp, Homo sapiens
aggccctgaggcgga

SEQ ID NO: 5840845 - DNA, 17 bp, Homo sapiens
aggccctgcactgtcct

SEQ ID NO: 5840846 - DNA, 19 bp, Homo sapiens
aggccctgcactgtcctgc

SEQ ID NO: 5840847 - DNA, 24 bp, Homo sapiens
aggccctgcactgtcctgctccac

SEQ ID NO: 5840848 - DNA, 19 bp, Homo sapiens
aggccctgccattggcctc

SEQ ID NO: 5840849 - DNA, 22 bp, Homo sapiens
aggccctgccattggcctcttg

SEQ ID NO: 5840850 - DNA, 14 bp, Homo sapiens
aggccctgcccagc

SEQ ID NO: 5840851 - DNA, 15 bp, Homo sapiens
aggccctgcccagcc

SEQ ID NO: 5840852 - DNA, 18 bp, Homo sapiens
aggccctgcccagccagc

SEQ ID NO: 5840853 - DNA, 20 bp, Homo sapiens
aggccctgcccagccagcca

SEQ ID NO: 5840854 - DNA, 12 bp, Homo sapiens
aggccctgcccc

SEQ ID NO: 5840855 - DNA, 17 bp, Homo sapiens
aggccctgcccccaccc

SEQ ID NO: 5840856 - DNA, 22 bp, Homo sapiens
aggccctgcccccaccccttcc

SEQ ID NO: 5840857 - DNA, 15 bp, Homo sapiens
aggccctgccccctc

SEQ ID NO: 5840858 - DNA, 19 bp, Homo sapiens
aggccctgccccctcccac

SEQ ID NO: 5840859 - DNA, 12 bp, Homo sapiens
aggccctgcctc

SEQ ID NO: 5840860 - DNA, 12 bp, Homo sapiens
aggccctgcctg

SEQ ID NO: 5840861 - DNA, 22 bp, Homo sapiens
aggccctgcctgacccatccct

SEQ ID NO: 5840862 - DNA, 12 bp, Homo sapiens
aggccctgctca

SEQ ID NO: 5840863 - DNA, 17 bp, Homo sapiens
aggccctgctcctgcag

SEQ ID NO: 5840864 - DNA, 21 bp, Homo sapiens
aggccctgctttttttcttaa

SEQ ID NO: 5840865 - DNA, 12 bp, Homo sapiens
aggccctggagg

SEQ ID NO: 5840866 - DNA, 14 bp, Homo sapiens
aggccctggaggga

SEQ ID NO: 5840867 - DNA, 15 bp, Homo sapiens
aggccctggagggca

SEQ ID NO: 5840868 - DNA, 19 bp, Homo sapiens
aggccctggagggcagaga

SEQ ID NO: 5840869 - DNA, 21 bp, Homo sapiens
aggccctggaggtctccaggg

SEQ ID NO: 5840870 - DNA, 13 bp, Homo sapiens
aggccctggatca

SEQ ID NO: 5840871 - DNA, 18 bp, Homo sapiens
aggccctggatcagcgtg

SEQ ID NO: 5840872 - DNA, 12 bp, Homo sapiens
aggccctggcag

SEQ ID NO: 5840873 - DNA, 15 bp, Homo sapiens
aggccctggcctccc

SEQ ID NO: 5840874 - DNA, 13 bp, Homo sapiens
aggccctgggcct

SEQ ID NO: 5840875 - DNA, 19 bp, Homo sapiens
aggccctgggcctccacct

SEQ ID NO: 5840876 - DNA, 21 bp, Homo sapiens
aggccctggggagcttttgcc

SEQ ID NO: 5840877 - DNA, 20 bp, Homo sapiens
aggccctggtcctggcctcc

SEQ ID NO: 5840878 - DNA, 14 bp, Homo sapiens
aggccctggtctgg

SEQ ID NO: 5840879 - DNA, 15 bp, Homo sapiens
aggccctggtctggc

SEQ ID NO: 5840880 - DNA, 20 bp, Homo sapiens
aggccctggtctggctttgg

SEQ ID NO: 5840881 - DNA, 19 bp, Homo sapiens
aggccctggtgtcaggcag

SEQ ID NO: 5840882 - DNA, 13 bp, Homo sapiens
aggccctgtccag

SEQ ID NO: 5840883 - DNA, 13 bp, Homo sapiens
aggccctgtctct

SEQ ID NO: 5840884 - DNA, 18 bp, Homo sapiens
aggccctgtctctggcta

SEQ ID NO: 5840885 - DNA, 20 bp, Homo sapiens
aggccctgtggtctggggag

SEQ ID NO: 5840886 - DNA, 20 bp, Homo sapiens
aggcccttattttcaagaaa

SEQ ID NO: 5840887 - DNA, 15 bp, Homo sapiens
aggcccttcctctcc

SEQ ID NO: 5840888 - DNA, 17 bp, Homo sapiens
aggcccttcctctccac

SEQ ID NO: 5840889 - DNA, 12 bp, Homo sapiens
aggcccttctct

SEQ ID NO: 5840890 - DNA, 14 bp, Homo sapiens
aggcccttggctgc

SEQ ID NO: 5840891 - DNA, 23 bp, Homo sapiens
aggcccttggtagagctggtgcc

SEQ ID NO: 5840892 - DNA, 18 bp, Homo sapiens
aggcccttgtcctgccag

SEQ ID NO: 5840893 - DNA, 19 bp, Homo sapiens
aggcccttgtcctgccagc

SEQ ID NO: 5840894 - DNA, 20 bp, Homo sapiens
aggcccttgtcctgccagct

SEQ ID NO: 5840895 - DNA, 17 bp, Homo sapiens
aggccctttcctcaggc

SEQ ID NO: 5840896 - DNA, 14 bp, Homo sapiens
aggccctttgctgt

SEQ ID NO: 5840897 - DNA, 15 bp, Homo sapiens
aggcccttttctggc

SEQ ID NO: 5840898 - DNA, 19 bp, Homo sapiens
aggcccttttctggctcct

SEQ ID NO: 5840899 - DNA, 21 bp, Homo sapiens
aggcccttttctggctcctgt

SEQ ID NO: 5840900 - DNA, 15 bp, Homo sapiens
aggccgaagctctgg

SEQ ID NO: 5840901 - DNA, 19 bp, Homo sapiens
aggccgaaggtgcctcaga

SEQ ID NO: 5840902 - DNA, 20 bp, Homo sapiens
aggccgaaggtgcctcagac

SEQ ID NO: 5840903 - DNA, 21 bp, Homo sapiens
aggccgacaccactcctgcca

SEQ ID NO: 5840904 - DNA, 22 bp, Homo sapiens
aggccgacaccactcctgccag

SEQ ID NO: 5840905 - DNA, 23 bp, Homo sapiens
aggccgacaccactcctgccagc

SEQ ID NO: 5840906 - DNA, 24 bp, Homo sapiens
aggccgacaccactcctgccagcc

SEQ ID NO: 5840907 - DNA, 15 bp, Homo sapiens
aggccgacaggaggc

SEQ ID NO: 5840908 - DNA, 23 bp, Homo sapiens
aggccgacaggaggccatgccca

SEQ ID NO: 5840909 - DNA, 16 bp, Homo sapiens
aggccgactgggctgc

SEQ ID NO: 5840910 - DNA, 18 bp, Homo sapiens
aggccgactgggctgctg

SEQ ID NO: 5840911 - DNA, 14 bp, Homo sapiens
aggccgagcccaca

SEQ ID NO: 5840912 - DNA, 15 bp, Homo sapiens
aggccgagcccacac

SEQ ID NO: 5840913 - DNA, 18 bp, Homo sapiens
aggccgaggaccaccagc

SEQ ID NO: 5840914 - DNA, 24 bp, Homo sapiens
aggccgaggcaggggctgggcaga

SEQ ID NO: 5840915 - DNA, 14 bp, Homo sapiens
aggccgaggcaggt

SEQ ID NO: 5840916 - DNA, 15 bp, Homo sapiens
aggccgaggcaggtg

SEQ ID NO: 5840917 - DNA, 17 bp, Homo sapiens
aggccgaggcaggtgga

SEQ ID NO: 5840918 - DNA, 16 bp, Homo sapiens
aggccgaggcgggtgg

SEQ ID NO: 5840919 - DNA, 15 bp, Homo sapiens
aggccgagggccagg

SEQ ID NO: 5840920 - DNA, 17 bp, Homo sapiens
aggccgagggccaggca

SEQ ID NO: 5840921 - DNA, 18 bp, Homo sapiens
aggccgagggccaggcag

SEQ ID NO: 5840922 - DNA, 14 bp, Homo sapiens
aggccgagtctgtc

SEQ ID NO: 5840923 - DNA, 17 bp, Homo sapiens
aggccgagtctgtcctg

SEQ ID NO: 5840924 - DNA, 15 bp, Homo sapiens
aggccgagtggctgc

SEQ ID NO: 5840925 - DNA, 18 bp, Homo sapiens
aggccgagtggctgccgg

SEQ ID NO: 5840926 - DNA, 22 bp, Homo sapiens
aggccgatggggaaggagaagg

SEQ ID NO: 5840927 - DNA, 17 bp, Homo sapiens
aggccgcagctcttgcc

SEQ ID NO: 5840928 - DNA, 21 bp, Homo sapiens
aggccgcagctcttgcccttc

SEQ ID NO: 5840929 - DNA, 22 bp, Homo sapiens
aggccgcatggcccctccagga

SEQ ID NO: 5840930 - DNA, 20 bp, Homo sapiens
aggccgccagcgtgtggagc

SEQ ID NO: 5840931 - DNA, 18 bp, Homo sapiens
aggccgccccagcctctg

SEQ ID NO: 5840932 - DNA, 15 bp, Homo sapiens
aggccgcctgccata

SEQ ID NO: 5840933 - DNA, 17 bp, Homo sapiens
aggccgcgcccagcaga

SEQ ID NO: 5840934 - DNA, 16 bp, Homo sapiens
aggccgcgccctttcc

SEQ ID NO: 5840935 - DNA, 18 bp, Homo sapiens
aggccgcgcgtccagctg

SEQ ID NO: 5840936 - DNA, 19 bp, Homo sapiens
aggccgcgcgtccagctgc

SEQ ID NO: 5840937 - DNA, 19 bp, Homo sapiens
aggccttcatcctcctccc

SEQ ID NO: 5840938 - DNA, 21 bp, Homo sapiens
aggccttcatcctcctcccca

SEQ ID NO: 5840939 - DNA, 18 bp, Homo sapiens
aggccttccagctgctgt

SEQ ID NO: 5840940 - DNA, 20 bp, Homo sapiens
aggccttccagctgctgtct

SEQ ID NO: 5840941 - DNA, 18 bp, Homo sapiens
aggccttcccatggccat

SEQ ID NO: 5840942 - DNA, 19 bp, Homo sapiens
aggccttcccctggcactg

SEQ ID NO: 5840943 - DNA, 15 bp, Homo sapiens
aggccttcctctctc

SEQ ID NO: 5840944 - DNA, 16 bp, Homo sapiens
aggccttcctctctcc

SEQ ID NO: 5840945 - DNA, 12 bp, Homo sapiens
aggccttctgtg

SEQ ID NO: 5840946 - DNA, 13 bp, Homo sapiens
aggccttctgtgg

SEQ ID NO: 5840947 - DNA, 16 bp, Homo sapiens
aggccttctgtggggc

SEQ ID NO: 5840948 - DNA, 14 bp, Homo sapiens
aggccttcttgtga

SEQ ID NO: 5840949 - DNA, 9 bp, Homo sapiens
aggccttgc

SEQ ID NO: 5840950 - DNA, 13 bp, Homo sapiens
aggccttgccagt

SEQ ID NO: 5840951 - DNA, 15 bp, Homo sapiens
aggccttgccagttt

SEQ ID NO: 5840952 - DNA, 20 bp, Homo sapiens
aggccttgcggctcctcagg

SEQ ID NO: 5840953 - DNA, 22 bp, Homo sapiens
aggccttgcggctcctcaggga

SEQ ID NO: 5840954 - DNA, 23 bp, Homo sapiens
aggccttgcggctcctcagggac

SEQ ID NO: 5840955 - DNA, 22 bp, Homo sapiens
aggccttgctgactctctgagc

SEQ ID NO: 5840956 - DNA, 23 bp, Homo sapiens
aggccttgctgactctctgagct

SEQ ID NO: 5840957 - DNA, 17 bp, Homo sapiens
aggccttggcccacctg

SEQ ID NO: 5840958 - DNA, 17 bp, Homo sapiens
aggccttgggctctgct

SEQ ID NO: 5840959 - DNA, 19 bp, Homo sapiens
aggccttgggctctgctga

SEQ ID NO: 5840960 - DNA, 21 bp, Homo sapiens
aggccttggggcatgacccag

SEQ ID NO: 5840961 - DNA, 18 bp, Homo sapiens
aggccttggggtgggggc

SEQ ID NO: 5840962 - DNA, 20 bp, Homo sapiens
aggccttggggtgggggcca

SEQ ID NO: 5840963 - DNA, 19 bp, Homo sapiens
aggccttggtggagcagcc

SEQ ID NO: 5840964 - DNA, 22 bp, Homo sapiens
aggccttggtggagcagccaga

SEQ ID NO: 5840965 - DNA, 13 bp, Homo sapiens
aggccttgtccta

SEQ ID NO: 5840966 - DNA, 20 bp, Homo sapiens
aggccttgtgtgtcaggccc

SEQ ID NO: 5840967 - DNA, 14 bp, Homo sapiens
aggcctttaaccat

SEQ ID NO: 5840968 - DNA, 16 bp, Homo sapiens
aggcctttcaggaagg

SEQ ID NO: 5840969 - DNA, 23 bp, Homo sapiens
aggcctttcaggaagggagagga

SEQ ID NO: 5840970 - DNA, 17 bp, Homo sapiens
aggcctttccccagtgt

SEQ ID NO: 5840971 - DNA, 18 bp, Homo sapiens
aggcctttccctaagcca

SEQ ID NO: 5840972 - DNA, 20 bp, Homo sapiens
aggcctttccctaagccagc

SEQ ID NO: 5840973 - DNA, 13 bp, Homo sapiens
aggcctttcctct

SEQ ID NO: 5840974 - DNA, 21 bp, Homo sapiens
aggcctttcctctgcacgctc

SEQ ID NO: 5840975 - DNA, 11 bp, Homo sapiens
aggcctttctt

SEQ ID NO: 5840976 - DNA, 12 bp, Homo sapiens
aggcctttcttc

SEQ ID NO: 5840977 - DNA, 14 bp, Homo sapiens
aggcctttcttctg

SEQ ID NO: 5840978 - DNA, 12 bp, Homo sapiens
aggcctttggga

SEQ ID NO: 5840979 - DNA, 16 bp, Homo sapiens
aggccttttaacattt

SEQ ID NO: 5840980 - DNA, 18 bp, Homo sapiens
aggccttttatgtaattt

SEQ ID NO: 5840981 - DNA, 13 bp, Homo sapiens
aggccttttcacg

SEQ ID NO: 5840982 - DNA, 21 bp, Homo sapiens
aggcgaataaatgttcaaact

SEQ ID NO: 5840983 - DNA, 13 bp, Homo sapiens
aggcgaattgtag

SEQ ID NO: 5840984 - DNA, 21 bp, Homo sapiens
aggcgacaaaatctcctggct

SEQ ID NO: 5840985 - DNA, 22 bp, Homo sapiens
aggcgaccaccgcccctggccg

SEQ ID NO: 5840986 - DNA, 19 bp, Homo sapiens
aggcgagagaggagccaga

SEQ ID NO: 5840987 - DNA, 23 bp, Homo sapiens
aggcgagagaggagccagacaga

SEQ ID NO: 5840988 - DNA, 15 bp, Homo sapiens
aggcgagcagggcag

SEQ ID NO: 5840989 - DNA, 18 bp, Homo sapiens
aggcgagcagggcaggcc

SEQ ID NO: 5840990 - DNA, 22 bp, Homo sapiens
aggcgagccagattaggcctgg

SEQ ID NO: 5840991 - DNA, 23 bp, Homo sapiens
aggcgagccagattaggcctgga

SEQ ID NO: 5840992 - DNA, 15 bp, Homo sapiens
aggcgaggagagtgg

SEQ ID NO: 5840993 - DNA, 20 bp, Homo sapiens
aggcgaggcccttggcgggc

SEQ ID NO: 5840994 - DNA, 19 bp, Homo sapiens
aggcgaggctgcctctggg

SEQ ID NO: 5840995 - DNA, 15 bp, Homo sapiens
aggcgagtcaccctc

SEQ ID NO: 5840996 - DNA, 16 bp, Homo sapiens
aggcgagtctggggac

SEQ ID NO: 5840997 - DNA, 14 bp, Homo sapiens
aggcgagtgccagg

SEQ ID NO: 5840998 - DNA, 15 bp, Homo sapiens
aggcgagtgccagga

SEQ ID NO: 5840999 - DNA, 17 bp, Homo sapiens
aggcgagtgccaggact

SEQ ID NO: 5841000 - DNA, 18 bp, Homo sapiens
aggcgagtgccaggactc

SEQ ID NO: 5841001 - DNA, 17 bp, Homo sapiens
aggcgattttgtctacc

SEQ ID NO: 5841002 - DNA, 20 bp, Homo sapiens
aggcgcaagggaggcccagc

SEQ ID NO: 5841003 - DNA, 21 bp, Homo sapiens
aggcgcactgtgacccccagc

SEQ ID NO: 5841004 - DNA, 19 bp, Homo sapiens
aggcgcagaggtcccagcc

SEQ ID NO: 5841005 - DNA, 21 bp, Homo sapiens
aggcgcagaggtcccagcccc

SEQ ID NO: 5841006 - DNA, 19 bp, Homo sapiens
aggcgcagcccgaagccca

SEQ ID NO: 5841007 - DNA, 17 bp, Homo sapiens
aggcgcagccctagtgg

SEQ ID NO: 5841008 - DNA, 14 bp, Homo sapiens
aggcgcagggacat

SEQ ID NO: 5841009 - DNA, 21 bp, Homo sapiens
aggcgcatgagtatctgtggg

SEQ ID NO: 5841010 - DNA, 13 bp, Homo sapiens
aggcgcatgtctg

SEQ ID NO: 5841011 - DNA, 14 bp, Homo sapiens
aggcgcatgtgcca

SEQ ID NO: 5841012 - DNA, 14 bp, Homo sapiens
aggcgcccacctgc

SEQ ID NO: 5841013 - DNA, 16 bp, Homo sapiens
aggcgcccacctgccc

SEQ ID NO: 5841014 - DNA, 19 bp, Homo sapiens
aggcgcccacctgcccagt

SEQ ID NO: 5841015 - DNA, 19 bp, Homo sapiens
aggcgcccccgccccaggc

SEQ ID NO: 5841016 - DNA, 12 bp, Homo sapiens
aggcgcccgcca

SEQ ID NO: 5841017 - DNA, 22 bp, Homo sapiens
aggcgcccgccaacacgcctgg

SEQ ID NO: 5841018 - DNA, 20 bp, Homo sapiens
aggcgccgcctcgcccccgg

SEQ ID NO: 5841019 - DNA, 23 bp, Homo sapiens
aggcgccgcctcgcccccgggcc

SEQ ID NO: 5841020 - DNA, 23 bp, Homo sapiens
aggcgcctataatcccagctact

SEQ ID NO: 5841021 - DNA, 24 bp, Homo sapiens
aggcgcctataatcccagctactg

SEQ ID NO: 5841022 - DNA, 15 bp, Homo sapiens
aggcgcctgccttgg

SEQ ID NO: 5841023 - DNA, 17 bp, Homo sapiens
aggcgccttcctgggtt

SEQ ID NO: 5841024 - DNA, 19 bp, Homo sapiens
aggcgcgcaccgcccaacc

SEQ ID NO: 5841025 - DNA, 20 bp, Homo sapiens
aggcgcgctcagatgccgga

SEQ ID NO: 5841026 - DNA, 13 bp, Homo sapiens
aggcgcggcctcc

SEQ ID NO: 5841027 - DNA, 21 bp, Homo sapiens
aggcgcggcggctctgcccac

SEQ ID NO: 5841028 - DNA, 23 bp, Homo sapiens
aggcgcggttcaggtcagggcta

SEQ ID NO: 5841029 - DNA, 22 bp, Homo sapiens
aggcgcgtgtaaatggttttgt

SEQ ID NO: 5841030 - DNA, 23 bp, Homo sapiens
aggcgctaacttgcttaaatgtg

SEQ ID NO: 5841031 - DNA, 15 bp, Homo sapiens
aggcgctagcacagc

SEQ ID NO: 5841032 - DNA, 19 bp, Homo sapiens
aggcgctagcacagctccc

SEQ ID NO: 5841033 - DNA, 13 bp, Homo sapiens
aggcgctcagagg

SEQ ID NO: 5841034 - DNA, 15 bp, Homo sapiens
aggcgctcagaggcc

SEQ ID NO: 5841035 - DNA, 20 bp, Homo sapiens
aggcgctcagaggccgctct

SEQ ID NO: 5841036 - DNA, 18 bp, Homo sapiens
aggcgctccgggaacagt

SEQ ID NO: 5841037 - DNA, 21 bp, Homo sapiens
aggcgctgcatacaggggagg

SEQ ID NO: 5841038 - DNA, 15 bp, Homo sapiens
aggcgctgctggtgt

SEQ ID NO: 5841039 - DNA, 20 bp, Homo sapiens
aggcgctgggggctggacct

SEQ ID NO: 5841040 - DNA, 21 bp, Homo sapiens
aggcgctgggggctggacctg

SEQ ID NO: 5841041 - DNA, 14 bp, Homo sapiens
aggcgctgggtgcc

SEQ ID NO: 5841042 - DNA, 22 bp, Homo sapiens
aggcgcttctccaatgctctgg

SEQ ID NO: 5841043 - DNA, 23 bp, Homo sapiens
aggcgcttctccaatgctctgga

SEQ ID NO: 5841044 - DNA, 12 bp, Homo sapiens
aggcggaaacct

SEQ ID NO: 5841045 - DNA, 13 bp, Homo sapiens
aggcggagctcca

SEQ ID NO: 5841046 - DNA, 13 bp, Homo sapiens
aggcggagggtct

SEQ ID NO: 5841047 - DNA, 14 bp, Homo sapiens
aggcggcagctggg

SEQ ID NO: 5841048 - DNA, 15 bp, Homo sapiens
aggcggcaggcagag

SEQ ID NO: 5841049 - DNA, 16 bp, Homo sapiens
aggcggcaggcagaga

SEQ ID NO: 5841050 - DNA, 16 bp, Homo sapiens
aggcggccagggcggc

SEQ ID NO: 5841051 - DNA, 20 bp, Homo sapiens
aggcggccagggcggccagg

SEQ ID NO: 5841052 - DNA, 14 bp, Homo sapiens
aggcggcccctccc

SEQ ID NO: 5841053 - DNA, 21 bp, Homo sapiens
aggcggcccggccagcgggca

SEQ ID NO: 5841054 - DNA, 13 bp, Homo sapiens
aggcggccctcag

SEQ ID NO: 5841055 - DNA, 15 bp, Homo sapiens
aggcggccctcagtg

SEQ ID NO: 5841056 - DNA, 18 bp, Homo sapiens
aggcggccctcagtgcat

SEQ ID NO: 5841057 - DNA, 15 bp, Homo sapiens
aggcggccctgggga

SEQ ID NO: 5841058 - DNA, 17 bp, Homo sapiens
aggcggccctggggagg

SEQ ID NO: 5841059 - DNA, 21 bp, Homo sapiens
aggcggcctttgttgctcagc

SEQ ID NO: 5841060 - DNA, 19 bp, Homo sapiens
aggcgggactatcaggagt

SEQ ID NO: 5841061 - DNA, 14 bp, Homo sapiens
aggcgggaggaggt

SEQ ID NO: 5841062 - DNA, 17 bp, Homo sapiens
aggcgggccagccaggc

SEQ ID NO: 5841063 - DNA, 13 bp, Homo sapiens
aggcgggctcctt

SEQ ID NO: 5841064 - DNA, 12 bp, Homo sapiens
aggcggggagga

SEQ ID NO: 5841065 - DNA, 13 bp, Homo sapiens
aggcggggaggag

SEQ ID NO: 5841066 - DNA, 17 bp, Homo sapiens
aggcggggctcctcctg

SEQ ID NO: 5841067 - DNA, 21 bp, Homo sapiens
aggcggggctcctcctgaagg

SEQ ID NO: 5841068 - DNA, 15 bp, Homo sapiens
aggcggggcttgcct

SEQ ID NO: 5841069 - DNA, 18 bp, Homo sapiens
aggcggggcttgccttct

SEQ ID NO: 5841070 - DNA, 14 bp, Homo sapiens
aggcgggggagcct

SEQ ID NO: 5841071 - DNA, 16 bp, Homo sapiens
aggcgggggagcctgg

SEQ ID NO: 5841072 - DNA, 17 bp, Homo sapiens
aggcgggggagcctgga

SEQ ID NO: 5841073 - DNA, 18 bp, Homo sapiens
aggcgggggatcctggag

SEQ ID NO: 5841074 - DNA, 21 bp, Homo sapiens
aggcgggggatcctggagccc

SEQ ID NO: 5841075 - DNA, 23 bp, Homo sapiens
aggcggggggggcgcctggagag

SEQ ID NO: 5841076 - DNA, 13 bp, Homo sapiens
aggcggtacacta

SEQ ID NO: 5841077 - DNA, 16 bp, Homo sapiens
aggcggtatccagagg

SEQ ID NO: 5841078 - DNA, 16 bp, Homo sapiens
aggcggtcatgtgtgc

SEQ ID NO: 5841079 - DNA, 20 bp, Homo sapiens
aggcggtccccatccccacc

SEQ ID NO: 5841080 - DNA, 17 bp, Homo sapiens
aggcggtgaggagtcca

SEQ ID NO: 5841081 - DNA, 19 bp, Homo sapiens
aggcggtgcactcactcct

SEQ ID NO: 5841082 - DNA, 16 bp, Homo sapiens
aggcggtttccaggaa

SEQ ID NO: 5841083 - DNA, 16 bp, Homo sapiens
aggcggtttcctgaat

SEQ ID NO: 5841084 - DNA, 14 bp, Homo sapiens
aggcggtttgggag

SEQ ID NO: 5841085 - DNA, 20 bp, Homo sapiens
aggcgtactacccagctctg

SEQ ID NO: 5841086 - DNA, 21 bp, Homo sapiens
aggcgtactacccagctctgt

SEQ ID NO: 5841087 - DNA, 17 bp, Homo sapiens
aggcgtagggccagggc

SEQ ID NO: 5841088 - DNA, 19 bp, Homo sapiens
aggcgtagggccagggctc

SEQ ID NO: 5841089 - DNA, 19 bp, Homo sapiens
aggcgtcaacgtgcatttt

SEQ ID NO: 5841090 - DNA, 15 bp, Homo sapiens
aggcgtcctggtgag

SEQ ID NO: 5841091 - DNA, 17 bp, Homo sapiens
aggcgtcgctggattta

SEQ ID NO: 5841092 - DNA, 21 bp, Homo sapiens
aggcgtcttcatctccctgcc

SEQ ID NO: 5841093 - DNA, 15 bp, Homo sapiens
aggcgtcttgtattt

SEQ ID NO: 5841094 - DNA, 19 bp, Homo sapiens
aggcgtgagccactgcgcc

SEQ ID NO: 5841095 - DNA, 14 bp, Homo sapiens
aggcgtgaggatgg

SEQ ID NO: 5841096 - DNA, 18 bp, Homo sapiens
aggcgtgcaaggggctca

SEQ ID NO: 5841097 - DNA, 19 bp, Homo sapiens
aggcgtgcaaggggctcag

SEQ ID NO: 5841098 - DNA, 13 bp, Homo sapiens
aggcgtgcagggg

SEQ ID NO: 5841099 - DNA, 16 bp, Homo sapiens
aggcgtgcccccctcc

SEQ ID NO: 5841100 - DNA, 18 bp, Homo sapiens
aggcgtgcccccctcctc

SEQ ID NO: 5841101 - DNA, 22 bp, Homo sapiens
aggcgtgcccccctcctccagt

SEQ ID NO: 5841102 - DNA, 19 bp, Homo sapiens
aggcgtggaggagaggaga

SEQ ID NO: 5841103 - DNA, 22 bp, Homo sapiens
aggcgtgggatccagagagaag

SEQ ID NO: 5841104 - DNA, 18 bp, Homo sapiens
aggcgtgggctgaccagg

SEQ ID NO: 5841105 - DNA, 22 bp, Homo sapiens
aggcgtgggctgaccaggcttc

SEQ ID NO: 5841106 - DNA, 17 bp, Homo sapiens
aggcgtggtggctggcg

SEQ ID NO: 5841107 - DNA, 17 bp, Homo sapiens
aggcgtgtgcaggccga

SEQ ID NO: 5841108 - DNA, 17 bp, Homo sapiens
aggcgttagtgggcagg

SEQ ID NO: 5841109 - DNA, 18 bp, Homo sapiens
aggcgttagtgggcaggt

SEQ ID NO: 5841110 - DNA, 14 bp, Homo sapiens
aggcgttctcctgc

SEQ ID NO: 5841111 - DNA, 16 bp, Homo sapiens
aggcgttctcctgctt

SEQ ID NO: 5841112 - DNA, 14 bp, Homo sapiens
aggcgttggtgcca

SEQ ID NO: 5841113 - DNA, 13 bp, Homo sapiens
aggcgttttttgg

SEQ ID NO: 5841114 - DNA, 22 bp, Homo sapiens
aggctgcattgaaaagagctga

SEQ ID NO: 5841115 - DNA, 17 bp, Homo sapiens
aggctgccagacatgga

SEQ ID NO: 5841116 - DNA, 18 bp, Homo sapiens
aggctgccagacatggac

SEQ ID NO: 5841117 - DNA, 21 bp, Homo sapiens
aggctgccaggggatttcgaa

SEQ ID NO: 5841118 - DNA, 16 bp, Homo sapiens
aggctgcccagagctg

SEQ ID NO: 5841119 - DNA, 18 bp, Homo sapiens
aggctgcccagcggctct

SEQ ID NO: 5841120 - DNA, 17 bp, Homo sapiens
aggctgccccacccctc

SEQ ID NO: 5841121 - DNA, 13 bp, Homo sapiens
aggctgccccagg

SEQ ID NO: 5841122 - DNA, 14 bp, Homo sapiens
aggctgccccaggc

SEQ ID NO: 5841123 - DNA, 15 bp, Homo sapiens
aggctgccccaggcc

SEQ ID NO: 5841124 - DNA, 24 bp, Homo sapiens
aggctgccccaggccggagcccag

SEQ ID NO: 5841125 - DNA, 22 bp, Homo sapiens
aggctgccccaggggcactgtg

SEQ ID NO: 5841126 - DNA, 23 bp, Homo sapiens
aggctgcccccaacactccaggc

SEQ ID NO: 5841127 - DNA, 15 bp, Homo sapiens
aggctgcccccatcc

SEQ ID NO: 5841128 - DNA, 17 bp, Homo sapiens
aggctgcccccatccag

SEQ ID NO: 5841129 - DNA, 13 bp, Homo sapiens
aggctgcccctgt

SEQ ID NO: 5841130 - DNA, 14 bp, Homo sapiens
aggctgccctcctg

SEQ ID NO: 5841131 - DNA, 18 bp, Homo sapiens
aggctgccctgaggggct

SEQ ID NO: 5841132 - DNA, 22 bp, Homo sapiens
aggctgcctatgttggggggga

SEQ ID NO: 5841133 - DNA, 12 bp, Homo sapiens
aggctgcctcag

SEQ ID NO: 5841134 - DNA, 17 bp, Homo sapiens
aggctgcctcagccagt

SEQ ID NO: 5841135 - DNA, 22 bp, Homo sapiens
aggctgcctcagccagtggcac

SEQ ID NO: 5841136 - DNA, 14 bp, Homo sapiens
aggctgcctcccaa

SEQ ID NO: 5841137 - DNA, 16 bp, Homo sapiens
aggctgcctcccaaca

SEQ ID NO: 5841138 - DNA, 18 bp, Homo sapiens
aggctgcctcctgccctt

SEQ ID NO: 5841139 - DNA, 18 bp, Homo sapiens
aggctgcctcggactcca

SEQ ID NO: 5841140 - DNA, 13 bp, Homo sapiens
aggctgcctctgg

SEQ ID NO: 5841141 - DNA, 15 bp, Homo sapiens
aggctgcctctgggt

SEQ ID NO: 5841142 - DNA, 17 bp, Homo sapiens
aggctgcctctgggtga

SEQ ID NO: 5841143 - DNA, 24 bp, Homo sapiens
aggctgcctctgggtgagtggctg

SEQ ID NO: 5841144 - DNA, 19 bp, Homo sapiens
aggctgcctgctatgtatt

SEQ ID NO: 5841145 - DNA, 11 bp, Homo sapiens
aggctgcctgg

SEQ ID NO: 5841146 - DNA, 13 bp, Homo sapiens
aggctgcctggag

SEQ ID NO: 5841147 - DNA, 14 bp, Homo sapiens
aggctgcctggaga

SEQ ID NO: 5841148 - DNA, 18 bp, Homo sapiens
aggctgcctggagaaagg

SEQ ID NO: 5841149 - DNA, 16 bp, Homo sapiens
aggctgcgcctgcccg

SEQ ID NO: 5841150 - DNA, 20 bp, Homo sapiens
aggctgcgtccctccgagct

SEQ ID NO: 5841151 - DNA, 16 bp, Homo sapiens
aggctgctaagtggaa

SEQ ID NO: 5841152 - DNA, 17 bp, Homo sapiens
aggctgctaagtggaag

SEQ ID NO: 5841153 - DNA, 18 bp, Homo sapiens
aggctgctaagtggaaga

SEQ ID NO: 5841154 - DNA, 19 bp, Homo sapiens
aggctgctaagtggaagac

SEQ ID NO: 5841155 - DNA, 10 bp, Homo sapiens
aggctgctag

SEQ ID NO: 5841156 - DNA, 17 bp, Homo sapiens
aggctgctcagggctgg

SEQ ID NO: 5841157 - DNA, 18 bp, Homo sapiens
aggctgctcggctactgg

SEQ ID NO: 5841158 - DNA, 17 bp, Homo sapiens
aggctgctcggggtgca

SEQ ID NO: 5841159 - DNA, 23 bp, Homo sapiens
aggctgctcggggtgcacaggag

SEQ ID NO: 5841160 - DNA, 14 bp, Homo sapiens
aggctgctcttgaa

SEQ ID NO: 5841161 - DNA, 17 bp, Homo sapiens
aggctgctgccaggccc

SEQ ID NO: 5841162 - DNA, 18 bp, Homo sapiens
aggctgctgccaggcccg

SEQ ID NO: 5841163 - DNA, 13 bp, Homo sapiens
aggctgctgccat

SEQ ID NO: 5841164 - DNA, 20 bp, Homo sapiens
aggctgctgccccctggctt

SEQ ID NO: 5841165 - DNA, 12 bp, Homo sapiens
aggctgctgccg

SEQ ID NO: 5841166 - DNA, 15 bp, Homo sapiens
aggctgctggaggaa

SEQ ID NO: 5841167 - DNA, 16 bp, Homo sapiens
aggctgctggaggaaa

SEQ ID NO: 5841168 - DNA, 11 bp, Homo sapiens
aggctgctggc

SEQ ID NO: 5841169 - DNA, 18 bp, Homo sapiens
aggctgctggcgcctctg

SEQ ID NO: 5841170 - DNA, 21 bp, Homo sapiens
aggctgctggcgcctctgcaa

SEQ ID NO: 5841171 - DNA, 14 bp, Homo sapiens
aggctgctggcttc

SEQ ID NO: 5841172 - DNA, 20 bp, Homo sapiens
aggctgctggcttcagggag

SEQ ID NO: 5841173 - DNA, 15 bp, Homo sapiens
aggctgctgggagat

SEQ ID NO: 5841174 - DNA, 22 bp, Homo sapiens
aggctgctgtactgaagtaaaa

SEQ ID NO: 5841175 - DNA, 22 bp, Homo sapiens
aggctgcttcccagaggagcag

SEQ ID NO: 5841176 - DNA, 23 bp, Homo sapiens
aggctgcttctctacagaggtga

SEQ ID NO: 5841177 - DNA, 13 bp, Homo sapiens
aggctgcttggga

SEQ ID NO: 5841178 - DNA, 14 bp, Homo sapiens
aggctgctttccaa

SEQ ID NO: 5841179 - DNA, 15 bp, Homo sapiens
aggctgctttccaaa

SEQ ID NO: 5841180 - DNA, 15 bp, Homo sapiens
aggctgctttctgcc

SEQ ID NO: 5841181 - DNA, 20 bp, Homo sapiens
aggctgctttttgctttctt

SEQ ID NO: 5841182 - DNA, 20 bp, Homo sapiens
aggctggaaaagggctcaga

SEQ ID NO: 5841183 - DNA, 13 bp, Homo sapiens
aggctggaagcca

SEQ ID NO: 5841184 - DNA, 21 bp, Homo sapiens
aggctggaaggaaagcaaggc

SEQ ID NO: 5841185 - DNA, 17 bp, Homo sapiens
aggctggaatgagggag

SEQ ID NO: 5841186 - DNA, 18 bp, Homo sapiens
aggctggacaccctctgc

SEQ ID NO: 5841187 - DNA, 14 bp, Homo sapiens
aggctggaccaact

SEQ ID NO: 5841188 - DNA, 22 bp, Homo sapiens
aggctggactccagatctgcac

SEQ ID NO: 5841189 - DNA, 12 bp, Homo sapiens
aggctggagaag

SEQ ID NO: 5841190 - DNA, 13 bp, Homo sapiens
aggctggagaagc

SEQ ID NO: 5841191 - DNA, 14 bp, Homo sapiens
aggctggagaagct

SEQ ID NO: 5841192 - DNA, 20 bp, Homo sapiens
aggctggagaagctcaccca

SEQ ID NO: 5841193 - DNA, 21 bp, Homo sapiens
aggctggagactggaccgctg

SEQ ID NO: 5841194 - DNA, 15 bp, Homo sapiens
aggctggagagcact

SEQ ID NO: 5841195 - DNA, 15 bp, Homo sapiens
aggctggaggaaggg

SEQ ID NO: 5841196 - DNA, 13 bp, Homo sapiens
aggctggaggcag

SEQ ID NO: 5841197 - DNA, 19 bp, Homo sapiens
aggctggaggcagggcctt

SEQ ID NO: 5841198 - DNA, 18 bp, Homo sapiens
aggctggagtgcagtggc

SEQ ID NO: 5841199 - DNA, 20 bp, Homo sapiens
aggctggagtggagtggcac

SEQ ID NO: 5841200 - DNA, 20 bp, Homo sapiens
aggctggagtggagtggcgt

SEQ ID NO: 5841201 - DNA, 18 bp, Homo sapiens
aggctggagttgtcactg

SEQ ID NO: 5841202 - DNA, 17 bp, Homo sapiens
aggctggataggagagg

SEQ ID NO: 5841203 - DNA, 16 bp, Homo sapiens
aggctggatggctccc

SEQ ID NO: 5841204 - DNA, 22 bp, Homo sapiens
aggctggatgtgcattagcctg

SEQ ID NO: 5841205 - DNA, 18 bp, Homo sapiens
aggctggatgtgctttca

SEQ ID NO: 5841206 - DNA, 21 bp, Homo sapiens
aggctggcaaaccctcccaga

SEQ ID NO: 5841207 - DNA, 15 bp, Homo sapiens
aggctggcaccatgg

SEQ ID NO: 5841208 - DNA, 15 bp, Homo sapiens
aggctggcactcccc

SEQ ID NO: 5841209 - DNA, 15 bp, Homo sapiens
aggctggcagctctc

SEQ ID NO: 5841210 - DNA, 22 bp, Homo sapiens
aggctggcatcctggctggctg

SEQ ID NO: 5841211 - DNA, 21 bp, Homo sapiens
aggctggccaaggtgtccagg

SEQ ID NO: 5841212 - DNA, 12 bp, Homo sapiens
aggctggccagc

SEQ ID NO: 5841213 - DNA, 21 bp, Homo sapiens
aggctggccagcaaggcaggt

SEQ ID NO: 5841214 - DNA, 16 bp, Homo sapiens
aggctggccagcccca

SEQ ID NO: 5841215 - DNA, 19 bp, Homo sapiens
aggctggccagccccacag

SEQ ID NO: 5841216 - DNA, 21 bp, Homo sapiens
aggctggccagccccacagcc

SEQ ID NO: 5841217 - DNA, 14 bp, Homo sapiens
aggctggccagccg

SEQ ID NO: 5841218 - DNA, 15 bp, Homo sapiens
aggctggccagccgc

SEQ ID NO: 5841219 - DNA, 16 bp, Homo sapiens
aggctggcccccaccc

SEQ ID NO: 5841220 - DNA, 17 bp, Homo sapiens
aggctggcccccaccca

SEQ ID NO: 5841221 - DNA, 12 bp, Homo sapiens
aggctggccctg

SEQ ID NO: 5841222 - DNA, 16 bp, Homo sapiens
aggctggccctgccct

SEQ ID NO: 5841223 - DNA, 19 bp, Homo sapiens
aggctggccctgccctggt

SEQ ID NO: 5841224 - DNA, 21 bp, Homo sapiens
aggctggcctatgtggtctaa

SEQ ID NO: 5841225 - DNA, 13 bp, Homo sapiens
aggctggcctcag

SEQ ID NO: 5841226 - DNA, 14 bp, Homo sapiens
aggctggcctcaga

SEQ ID NO: 5841227 - DNA, 15 bp, Homo sapiens
aggctggcctcagac

SEQ ID NO: 5841228 - DNA, 18 bp, Homo sapiens
aggctggcgagagtctgg

SEQ ID NO: 5841229 - DNA, 19 bp, Homo sapiens
aggctggcgagagtctggc

SEQ ID NO: 5841230 - DNA, 22 bp, Homo sapiens
aggctggcgagagtctggccct

SEQ ID NO: 5841231 - DNA, 15 bp, Homo sapiens
aggctggcgcagcca

SEQ ID NO: 5841232 - DNA, 14 bp, Homo sapiens
aggctggcggggtc

SEQ ID NO: 5841233 - DNA, 18 bp, Homo sapiens
aggctggcggggtctgct

SEQ ID NO: 5841234 - DNA, 13 bp, Homo sapiens
aggctggcgtgca

SEQ ID NO: 5841235 - DNA, 17 bp, Homo sapiens
aggctggcgtgcagtgg

SEQ ID NO: 5841236 - DNA, 19 bp, Homo sapiens
aggctggctccagatgcag

SEQ ID NO: 5841237 - DNA, 23 bp, Homo sapiens
aggctggctcctggggatggcca

SEQ ID NO: 5841238 - DNA, 20 bp, Homo sapiens
aggctggctcgtaggcctgc

SEQ ID NO: 5841239 - DNA, 20 bp, Homo sapiens
aggctggctgaaaatcacta

SEQ ID NO: 5841240 - DNA, 13 bp, Homo sapiens
aggctggctggcc

SEQ ID NO: 5841241 - DNA, 13 bp, Homo sapiens
aggctggctgggg

SEQ ID NO: 5841242 - DNA, 17 bp, Homo sapiens
aggctggctggggccta

SEQ ID NO: 5841243 - DNA, 16 bp, Homo sapiens
aggctggctgtgtata

SEQ ID NO: 5841244 - DNA, 14 bp, Homo sapiens
aggctggcttgtcc

SEQ ID NO: 5841245 - DNA, 19 bp, Homo sapiens
aggctgggacgctctgctg

SEQ ID NO: 5841246 - DNA, 22 bp, Homo sapiens
aggctgggagagccttccaggg

SEQ ID NO: 5841247 - DNA, 12 bp, Homo sapiens
aggctgggagca

SEQ ID NO: 5841248 - DNA, 22 bp, Homo sapiens
aggctgggagcatagcagaggg

SEQ ID NO: 5841249 - DNA, 11 bp, Homo sapiens
aggctgggagg

SEQ ID NO: 5841250 - DNA, 18 bp, Homo sapiens
aggctgggaggagcccct

SEQ ID NO: 5841251 - DNA, 19 bp, Homo sapiens
aggctgggaggagcccctg

SEQ ID NO: 5841252 - DNA, 21 bp, Homo sapiens
aggctgggaggagcccctgga

SEQ ID NO: 5841253 - DNA, 22 bp, Homo sapiens
aggctgggcagcacaaggcctt

SEQ ID NO: 5841254 - DNA, 20 bp, Homo sapiens
aggctgggcagccccagaga

SEQ ID NO: 5841255 - DNA, 21 bp, Homo sapiens
aggctgggcagggcctggcgg

SEQ ID NO: 5841256 - DNA, 12 bp, Homo sapiens
aggctgggccaa

SEQ ID NO: 5841257 - DNA, 16 bp, Homo sapiens
aggctgggccagcctc

SEQ ID NO: 5841258 - DNA, 18 bp, Homo sapiens
aggctgggccagcctcag

SEQ ID NO: 5841259 - DNA, 22 bp, Homo sapiens
aggctgggccagcctcagctca

SEQ ID NO: 5841260 - DNA, 12 bp, Homo sapiens
aggctgggccat

SEQ ID NO: 5841261 - DNA, 21 bp, Homo sapiens
aggctgggccatgtccaaaga

SEQ ID NO: 5841262 - DNA, 22 bp, Homo sapiens
aggctgggccatgtccaaagag

SEQ ID NO: 5841263 - DNA, 15 bp, Homo sapiens
aggctgggcccagag

SEQ ID NO: 5841264 - DNA, 21 bp, Homo sapiens
aggctgggccgcaagggcctg

SEQ ID NO: 5841265 - DNA, 22 bp, Homo sapiens
aggctgggccgcaagggcctgg

SEQ ID NO: 5841266 - DNA, 22 bp, Homo sapiens
aggctgggcctcccctgggcag

SEQ ID NO: 5841267 - DNA, 14 bp, Homo sapiens
aggctgggctccct

SEQ ID NO: 5841268 - DNA, 18 bp, Homo sapiens
aggctgggctcccttccc

SEQ ID NO: 5841269 - DNA, 21 bp, Homo sapiens
aggctgggctctgcctgtctg

SEQ ID NO: 5841270 - DNA, 14 bp, Homo sapiens
aggctgggctctgg

SEQ ID NO: 5841271 - DNA, 18 bp, Homo sapiens
aggctgggctgggcactg

SEQ ID NO: 5841272 - DNA, 17 bp, Homo sapiens
aggctgggctgggtggc

SEQ ID NO: 5841273 - DNA, 22 bp, Homo sapiens
aggctgggctgggtggcacacc

SEQ ID NO: 5841274 - DNA, 19 bp, Homo sapiens
aggctgggcttcagtggca

SEQ ID NO: 5841275 - DNA, 21 bp, Homo sapiens
aggctgggcttcagtggcagc

SEQ ID NO: 5841276 - DNA, 22 bp, Homo sapiens
aggctgggcttcagtggcagct

SEQ ID NO: 5841277 - DNA, 13 bp, Homo sapiens
aggctggggacac

SEQ ID NO: 5841278 - DNA, 23 bp, Homo sapiens
aggctggggacacaggatcctgg

SEQ ID NO: 5841279 - DNA, 17 bp, Homo sapiens
aggctggggaggtgctg

SEQ ID NO: 5841280 - DNA, 17 bp, Homo sapiens
aggctggggatggtagg

SEQ ID NO: 5841281 - DNA, 18 bp, Homo sapiens
aggctggggatggtagga

SEQ ID NO: 5841282 - DNA, 13 bp, Homo sapiens
aggctggggcatg

SEQ ID NO: 5841283 - DNA, 19 bp, Homo sapiens
aggctggggccccatcttg

SEQ ID NO: 5841284 - DNA, 16 bp, Homo sapiens
aggctggggctgacct

SEQ ID NO: 5841285 - DNA, 22 bp, Homo sapiens
aggctgggggaagaagctctct

SEQ ID NO: 5841286 - DNA, 19 bp, Homo sapiens
aggctgggggagagccgtg

SEQ ID NO: 5841287 - DNA, 22 bp, Homo sapiens
aggctggggtttttgttttgtt

SEQ ID NO: 5841288 - DNA, 17 bp, Homo sapiens
aggctgggtcaaaagag

SEQ ID NO: 5841289 - DNA, 22 bp, Homo sapiens
aggctgggtcaaaagagccctg

SEQ ID NO: 5841290 - DNA, 17 bp, Homo sapiens
aggctgggtccagggga

SEQ ID NO: 5841291 - DNA, 17 bp, Homo sapiens
aggctgggtcctgccag

SEQ ID NO: 5841292 - DNA, 14 bp, Homo sapiens
agggaagggagaaa

SEQ ID NO: 5841293 - DNA, 12 bp, Homo sapiens
agggaagggagc

SEQ ID NO: 5841294 - DNA, 13 bp, Homo sapiens
agggaagggcctg

SEQ ID NO: 5841295 - DNA, 13 bp, Homo sapiens
agggaaggggaca

SEQ ID NO: 5841296 - DNA, 22 bp, Homo sapiens
agggaaggggacaaggactagg

SEQ ID NO: 5841297 - DNA, 15 bp, Homo sapiens
agggaaggggatgga

SEQ ID NO: 5841298 - DNA, 16 bp, Homo sapiens
agggaaggggatggag

SEQ ID NO: 5841299 - DNA, 21 bp, Homo sapiens
agggaagggggaacatgagcc

SEQ ID NO: 5841300 - DNA, 18 bp, Homo sapiens
agggaagggtgcctggct

SEQ ID NO: 5841301 - DNA, 20 bp, Homo sapiens
agggaagggtgcctggctgg

SEQ ID NO: 5841302 - DNA, 21 bp, Homo sapiens
agggaagggtgcctggctggg

SEQ ID NO: 5841303 - DNA, 12 bp, Homo sapiens
agggaagggtgg

SEQ ID NO: 5841304 - DNA, 17 bp, Homo sapiens
agggaagggtttctcta

SEQ ID NO: 5841305 - DNA, 14 bp, Homo sapiens
agggaaggtgaaac

SEQ ID NO: 5841306 - DNA, 20 bp, Homo sapiens
agggaaggtgaagatgaaga

SEQ ID NO: 5841307 - DNA, 21 bp, Homo sapiens
agggaaggtggccacagcaag

SEQ ID NO: 5841308 - DNA, 15 bp, Homo sapiens
agggaaggtggggcc

SEQ ID NO: 5841309 - DNA, 23 bp, Homo sapiens
agggaagtcgcttttggtgcctg

SEQ ID NO: 5841310 - DNA, 17 bp, Homo sapiens
agggaagtgaggcccaa

SEQ ID NO: 5841311 - DNA, 18 bp, Homo sapiens
agggaagtgaggcccaag

SEQ ID NO: 5841312 - DNA, 22 bp, Homo sapiens
agggaagtgaggcccaaggagc

SEQ ID NO: 5841313 - DNA, 16 bp, Homo sapiens
agggaagtgcagagct

SEQ ID NO: 5841314 - DNA, 14 bp, Homo sapiens
agggaagtggaagg

SEQ ID NO: 5841315 - DNA, 13 bp, Homo sapiens
agggaagtgtgag

SEQ ID NO: 5841316 - DNA, 20 bp, Homo sapiens
agggaagtgtgagcgccttg

SEQ ID NO: 5841317 - DNA, 20 bp, Homo sapiens
agggaagttgctggaaagag

SEQ ID NO: 5841318 - DNA, 20 bp, Homo sapiens
agggaagttgtctccttcca

SEQ ID NO: 5841319 - DNA, 23 bp, Homo sapiens
agggaataaaatcctaagacaca

SEQ ID NO: 5841320 - DNA, 15 bp, Homo sapiens
agggaataaattttt

SEQ ID NO: 5841321 - DNA, 19 bp, Homo sapiens
agggaataaatttttgtct

SEQ ID NO: 5841322 - DNA, 18 bp, Homo sapiens
agggaatactcacatttt

SEQ ID NO: 5841323 - DNA, 22 bp, Homo sapiens
agggaatatatatttttctatg

SEQ ID NO: 5841324 - DNA, 20 bp, Homo sapiens
agggaatatgtaagtcagga

SEQ ID NO: 5841325 - DNA, 15 bp, Homo sapiens
agggaatcacatctt

SEQ ID NO: 5841326 - DNA, 15 bp, Homo sapiens
agggaatccagctcc

SEQ ID NO: 5841327 - DNA, 20 bp, Homo sapiens
agggaatccatatcagctct

SEQ ID NO: 5841328 - DNA, 23 bp, Homo sapiens
agggaatccattgaactggaaga

SEQ ID NO: 5841329 - DNA, 20 bp, Homo sapiens
agggaatccccgaaggtgct

SEQ ID NO: 5841330 - DNA, 22 bp, Homo sapiens
agggaatctaatatccccaaat

SEQ ID NO: 5841331 - DNA, 16 bp, Homo sapiens
agggaatctggattat

SEQ ID NO: 5841332 - DNA, 21 bp, Homo sapiens
agggaatgaaggtgtcagaat

SEQ ID NO: 5841333 - DNA, 21 bp, Homo sapiens
agggaatgagagttccttctc

SEQ ID NO: 5841334 - DNA, 22 bp, Homo sapiens
agggaatgcctgagtgcctggc

SEQ ID NO: 5841335 - DNA, 16 bp, Homo sapiens
agggaatggccacaaa

SEQ ID NO: 5841336 - DNA, 14 bp, Homo sapiens
agggaatgtgaaat

SEQ ID NO: 5841337 - DNA, 16 bp, Homo sapiens
agggaatgtgagcaca

SEQ ID NO: 5841338 - DNA, 16 bp, Homo sapiens
agggaatgttccctgc

SEQ ID NO: 5841339 - DNA, 17 bp, Homo sapiens
agggaatgttccctgca

SEQ ID NO: 5841340 - DNA, 19 bp, Homo sapiens
agggaatgttccctgcacc

SEQ ID NO: 5841341 - DNA, 22 bp, Homo sapiens
agggaatgttccctgcaccctg

SEQ ID NO: 5841342 - DNA, 15 bp, Homo sapiens
agggaattcctgggg

SEQ ID NO: 5841343 - DNA, 21 bp, Homo sapiens
agggaattcttacagccaagt

SEQ ID NO: 5841344 - DNA, 21 bp, Homo sapiens
agggaattgtttttataaaaa

SEQ ID NO: 5841345 - DNA, 16 bp, Homo sapiens
agggaatttctatcta

SEQ ID NO: 5841346 - DNA, 13 bp, Homo sapiens
agggacaaaactt

SEQ ID NO: 5841347 - DNA, 22 bp, Homo sapiens
agggacaaaaggtactggtgag

SEQ ID NO: 5841348 - DNA, 14 bp, Homo sapiens
agggacaaaggagc

SEQ ID NO: 5841349 - DNA, 17 bp, Homo sapiens
agggacaaaggagcctg

SEQ ID NO: 5841350 - DNA, 20 bp, Homo sapiens
agggacaaatttaaaacaaa

SEQ ID NO: 5841351 - DNA, 16 bp, Homo sapiens
agggacaaccagaagg

SEQ ID NO: 5841352 - DNA, 13 bp, Homo sapiens
agggacaagggat

SEQ ID NO: 5841353 - DNA, 19 bp, Homo sapiens
agggacaagtggactcagg

SEQ ID NO: 5841354 - DNA, 18 bp, Homo sapiens
agggacacacagcctagc

SEQ ID NO: 5841355 - DNA, 21 bp, Homo sapiens
agggacacacagtgacaaaag

SEQ ID NO: 5841356 - DNA, 11 bp, Homo sapiens
agggacacagg

SEQ ID NO: 5841357 - DNA, 19 bp, Homo sapiens
agggacacaggagaccacc

SEQ ID NO: 5841358 - DNA, 20 bp, Homo sapiens
agggacacaggagaccaccc

SEQ ID NO: 5841359 - DNA, 17 bp, Homo sapiens
agggacacatgcccctc

SEQ ID NO: 5841360 - DNA, 19 bp, Homo sapiens
agggacacatgcccctccc

SEQ ID NO: 5841361 - DNA, 21 bp, Homo sapiens
agggacaccagccaggctctg

SEQ ID NO: 5841362 - DNA, 20 bp, Homo sapiens
agggacacgggcagcctggc

SEQ ID NO: 5841363 - DNA, 14 bp, Homo sapiens
agggacactcctcc

SEQ ID NO: 5841364 - DNA, 18 bp, Homo sapiens
agggacagaaaagaaagc

SEQ ID NO: 5841365 - DNA, 18 bp, Homo sapiens
agggacagaagcaggagt

SEQ ID NO: 5841366 - DNA, 19 bp, Homo sapiens
agggacagagcccgggaga

SEQ ID NO: 5841367 - DNA, 23 bp, Homo sapiens
agggacagagcccgggagagact

SEQ ID NO: 5841368 - DNA, 17 bp, Homo sapiens
agggacagaggccaagg

SEQ ID NO: 5841369 - DNA, 20 bp, Homo sapiens
agggacagaggccaaggact

SEQ ID NO: 5841370 - DNA, 20 bp, Homo sapiens
agggacagaggccccagcct

SEQ ID NO: 5841371 - DNA, 13 bp, Homo sapiens
agggacagagggg

SEQ ID NO: 5841372 - DNA, 23 bp, Homo sapiens
agggacagagggggtggcctccc

SEQ ID NO: 5841373 - DNA, 22 bp, Homo sapiens
agggacagatgaatgccgtgga

SEQ ID NO: 5841374 - DNA, 15 bp, Homo sapiens
agggacagcaagtga

SEQ ID NO: 5841375 - DNA, 13 bp, Homo sapiens
agggacagcagcc

SEQ ID NO: 5841376 - DNA, 21 bp, Homo sapiens
agggacagcccactgagaagt

SEQ ID NO: 5841377 - DNA, 13 bp, Homo sapiens
agggacagcctgc

SEQ ID NO: 5841378 - DNA, 20 bp, Homo sapiens
agggacaggaccccagctct

SEQ ID NO: 5841379 - DNA, 14 bp, Homo sapiens
agggacagggcagg

SEQ ID NO: 5841380 - DNA, 15 bp, Homo sapiens
agggacagggcaggc

SEQ ID NO: 5841381 - DNA, 15 bp, Homo sapiens
agggacagggcttgg

SEQ ID NO: 5841382 - DNA, 16 bp, Homo sapiens
agggacagggcttggg

SEQ ID NO: 5841383 - DNA, 12 bp, Homo sapiens
agggacaggtgg

SEQ ID NO: 5841384 - DNA, 16 bp, Homo sapiens
agggacagtctggagg

SEQ ID NO: 5841385 - DNA, 18 bp, Homo sapiens
agggacagtctggaggtc

SEQ ID NO: 5841386 - DNA, 14 bp, Homo sapiens
agggacagtggtct

SEQ ID NO: 5841387 - DNA, 23 bp, Homo sapiens
agggacagttacaaaccaggtca

SEQ ID NO: 5841388 - DNA, 18 bp, Homo sapiens
agggacatatcagtgacc

SEQ ID NO: 5841389 - DNA, 15 bp, Homo sapiens
agggacatgatgggg

SEQ ID NO: 5841390 - DNA, 18 bp, Homo sapiens
agggacatgctcacctct

SEQ ID NO: 5841391 - DNA, 14 bp, Homo sapiens
agggacatggggca

SEQ ID NO: 5841392 - DNA, 21 bp, Homo sapiens
agggacatggggcaagccagg

SEQ ID NO: 5841393 - DNA, 14 bp, Homo sapiens
agggacatgtggaa

SEQ ID NO: 5841394 - DNA, 19 bp, Homo sapiens
agggacatgttttgataaa

SEQ ID NO: 5841395 - DNA, 20 bp, Homo sapiens
agggacatgttttgataaag

SEQ ID NO: 5841396 - DNA, 18 bp, Homo sapiens
agggaccaaattgcttct

SEQ ID NO: 5841397 - DNA, 14 bp, Homo sapiens
agggaccaaggacc

SEQ ID NO: 5841398 - DNA, 14 bp, Homo sapiens
agggaccaaggaga

SEQ ID NO: 5841399 - DNA, 12 bp, Homo sapiens
agggaccaaggc

SEQ ID NO: 5841400 - DNA, 17 bp, Homo sapiens
agggaccaaggcaaggc

SEQ ID NO: 5841401 - DNA, 18 bp, Homo sapiens
agggaccacaccctgtac

SEQ ID NO: 5841402 - DNA, 14 bp, Homo sapiens
agggaccaccctcc

SEQ ID NO: 5841403 - DNA, 15 bp, Homo sapiens
agggaccaccctccc

SEQ ID NO: 5841404 - DNA, 20 bp, Homo sapiens
agggaccaccctccctgact

SEQ ID NO: 5841405 - DNA, 16 bp, Homo sapiens
agggaccactgggtga

SEQ ID NO: 5841406 - DNA, 21 bp, Homo sapiens
agggaccactgggtgagagag

SEQ ID NO: 5841407 - DNA, 14 bp, Homo sapiens
agggaccagccaag

SEQ ID NO: 5841408 - DNA, 18 bp, Homo sapiens
agggaccagctccccggg

SEQ ID NO: 5841409 - DNA, 14 bp, Homo sapiens
agggaccagctggg

SEQ ID NO: 5841410 - DNA, 18 bp, Homo sapiens
agggaccagggccaccgc

SEQ ID NO: 5841411 - DNA, 23 bp, Homo sapiens
agggaccagtgggatgggctcta

SEQ ID NO: 5841412 - DNA, 21 bp, Homo sapiens
agggaccatcaagaacctaca

SEQ ID NO: 5841413 - DNA, 19 bp, Homo sapiens
agggaccatctgctgcagt

SEQ ID NO: 5841414 - DNA, 21 bp, Homo sapiens
agggaccatctgctgcagtta

SEQ ID NO: 5841415 - DNA, 23 bp, Homo sapiens
agggaccatctgctgcagttacc

SEQ ID NO: 5841416 - DNA, 15 bp, Homo sapiens
agggacccaggtgtg

SEQ ID NO: 5841417 - DNA, 18 bp, Homo sapiens
agggacccaggtgtgcct

SEQ ID NO: 5841418 - DNA, 21 bp, Homo sapiens
agggacccaggtgtgcctgtg

SEQ ID NO: 5841419 - DNA, 22 bp, Homo sapiens
agggacccaggtgtgcctgtgc

SEQ ID NO: 5841420 - DNA, 18 bp, Homo sapiens
agggacccccgaggcccc

SEQ ID NO: 5841421 - DNA, 22 bp, Homo sapiens
agggacccctcgccccagcctc

SEQ ID NO: 5841422 - DNA, 15 bp, Homo sapiens
agggacccctgccct

SEQ ID NO: 5841423 - DNA, 17 bp, Homo sapiens
agggacccgaagcccag

SEQ ID NO: 5841424 - DNA, 21 bp, Homo sapiens
agggacccggggtctcctgga

SEQ ID NO: 5841425 - DNA, 15 bp, Homo sapiens
agggacccttgcctg

SEQ ID NO: 5841426 - DNA, 18 bp, Homo sapiens
agggacccttgcctgcct

SEQ ID NO: 5841427 - DNA, 20 bp, Homo sapiens
agggacccttgcctgcctcc

SEQ ID NO: 5841428 - DNA, 17 bp, Homo sapiens
agggaccctttgggggt

SEQ ID NO: 5841429 - DNA, 15 bp, Homo sapiens
agggaccgagcccag

SEQ ID NO: 5841430 - DNA, 19 bp, Homo sapiens
agggaccggcagagctcta

SEQ ID NO: 5841431 - DNA, 14 bp, Homo sapiens
agggaccggcggac

SEQ ID NO: 5841432 - DNA, 22 bp, Homo sapiens
agggaccggcggaccccagcca

SEQ ID NO: 5841433 - DNA, 15 bp, Homo sapiens
agggaccggtgctgc

SEQ ID NO: 5841434 - DNA, 18 bp, Homo sapiens
agggaccggtgctgcagg

SEQ ID NO: 5841435 - DNA, 21 bp, Homo sapiens
agggacctactgaacccagag

SEQ ID NO: 5841436 - DNA, 15 bp, Homo sapiens
agggacctcaggggc

SEQ ID NO: 5841437 - DNA, 13 bp, Homo sapiens
agggacctctccc

SEQ ID NO: 5841438 - DNA, 15 bp, Homo sapiens
agggacctctcccag

SEQ ID NO: 5841439 - DNA, 15 bp, Homo sapiens
agggacctgctgctc

SEQ ID NO: 5841440 - DNA, 18 bp, Homo sapiens
agggaccttcagggagag

SEQ ID NO: 5841441 - DNA, 16 bp, Homo sapiens
agggaccttcatgccc

SEQ ID NO: 5841442 - DNA, 14 bp, Homo sapiens
agggaccttgaagg

SEQ ID NO: 5841443 - DNA, 14 bp, Homo sapiens
agggacgaagaaag

SEQ ID NO: 5841444 - DNA, 15 bp, Homo sapiens
agggacgaagaaagg

SEQ ID NO: 5841445 - DNA, 22 bp, Homo sapiens
agggacgaagaagagccacagt

SEQ ID NO: 5841446 - DNA, 22 bp, Homo sapiens
agggacgacccggggcgggctg

SEQ ID NO: 5841447 - DNA, 20 bp, Homo sapiens
agggacgactttctttaaca

SEQ ID NO: 5841448 - DNA, 15 bp, Homo sapiens
agggacgcctggggg

SEQ ID NO: 5841449 - DNA, 23 bp, Homo sapiens
agggacgcctgggggtgccagga

SEQ ID NO: 5841450 - DNA, 19 bp, Homo sapiens
agggacgcggaggaggaag

SEQ ID NO: 5841451 - DNA, 21 bp, Homo sapiens
agggacgctacccgggaaggg

SEQ ID NO: 5841452 - DNA, 21 bp, Homo sapiens
agggacgctttgggagaatgt

SEQ ID NO: 5841453 - DNA, 19 bp, Homo sapiens
agggacggggactggccct

SEQ ID NO: 5841454 - DNA, 18 bp, Homo sapiens
agggacgtctcatctccc

SEQ ID NO: 5841455 - DNA, 23 bp, Homo sapiens
agggacgtctcatctcccatgtg

SEQ ID NO: 5841456 - DNA, 20 bp, Homo sapiens
agggactaaatttgtaaaaa

SEQ ID NO: 5841457 - DNA, 15 bp, Homo sapiens
agggactagtgagtc

SEQ ID NO: 5841458 - DNA, 22 bp, Homo sapiens
agggactatctttgctgcagag

SEQ ID NO: 5841459 - DNA, 20 bp, Homo sapiens
agggactatgaatgggcaaa

SEQ ID NO: 5841460 - DNA, 20 bp, Homo sapiens
agggactcaagggtccagaa

SEQ ID NO: 5841461 - DNA, 20 bp, Homo sapiens
agggactcaatttctcccca

SEQ ID NO: 5841462 - DNA, 16 bp, Homo sapiens
agggactcaggccagt

SEQ ID NO: 5841463 - DNA, 19 bp, Homo sapiens
agggactcaggccagtcac

SEQ ID NO: 5841464 - DNA, 22 bp, Homo sapiens
agggactcatctttccctcctt

SEQ ID NO: 5841465 - DNA, 12 bp, Homo sapiens
agggactccaga

SEQ ID NO: 5841466 - DNA, 20 bp, Homo sapiens
agggactcggcccagggccg

SEQ ID NO: 5841467 - DNA, 21 bp, Homo sapiens
agggactctgaagcctctggg

SEQ ID NO: 5841468 - DNA, 14 bp, Homo sapiens
agggcatcaggcac

SEQ ID NO: 5841469 - DNA, 15 bp, Homo sapiens
agggcatcaggcact

SEQ ID NO: 5841470 - DNA, 17 bp, Homo sapiens
agggcatcatgcatctt

SEQ ID NO: 5841471 - DNA, 21 bp, Homo sapiens
agggcatcggtcagcggggca

SEQ ID NO: 5841472 - DNA, 19 bp, Homo sapiens
agggcatctcaatggcatg

SEQ ID NO: 5841473 - DNA, 13 bp, Homo sapiens
agggcatctcctg

SEQ ID NO: 5841474 - DNA, 21 bp, Homo sapiens
agggcatctcctgtgcatggg

SEQ ID NO: 5841475 - DNA, 15 bp, Homo sapiens
agggcatctctgggc

SEQ ID NO: 5841476 - DNA, 16 bp, Homo sapiens
agggcatctctgggct

SEQ ID NO: 5841477 - DNA, 13 bp, Homo sapiens
agggcatcttgct

SEQ ID NO: 5841478 - DNA, 14 bp, Homo sapiens
agggcatgaaatga

SEQ ID NO: 5841479 - DNA, 21 bp, Homo sapiens
agggcatgccccggccacctc

SEQ ID NO: 5841480 - DNA, 13 bp, Homo sapiens
agggcatgcctgg

SEQ ID NO: 5841481 - DNA, 15 bp, Homo sapiens
agggcatgcctggcc

SEQ ID NO: 5841482 - DNA, 16 bp, Homo sapiens
agggcatgcctggcct

SEQ ID NO: 5841483 - DNA, 13 bp, Homo sapiens
agggcatgccttg

SEQ ID NO: 5841484 - DNA, 16 bp, Homo sapiens
agggcatgggagggag

SEQ ID NO: 5841485 - DNA, 17 bp, Homo sapiens
agggcatgggagggagg

SEQ ID NO: 5841486 - DNA, 19 bp, Homo sapiens
agggcatgggttggcaggg

SEQ ID NO: 5841487 - DNA, 16 bp, Homo sapiens
agggcatgtgcggctg

SEQ ID NO: 5841488 - DNA, 15 bp, Homo sapiens
agggcatgtgtatgt

SEQ ID NO: 5841489 - DNA, 13 bp, Homo sapiens
agggcattgctca

SEQ ID NO: 5841490 - DNA, 18 bp, Homo sapiens
agggcattgctcagcccg

SEQ ID NO: 5841491 - DNA, 19 bp, Homo sapiens
agggcattgctcagcccgc

SEQ ID NO: 5841492 - DNA, 13 bp, Homo sapiens
agggcattggcca

SEQ ID NO: 5841493 - DNA, 23 bp, Homo sapiens
agggcatttggcttcctctgctg

SEQ ID NO: 5841494 - DNA, 16 bp, Homo sapiens
agggcatttttcttgg

SEQ ID NO: 5841495 - DNA, 18 bp, Homo sapiens
agggccaaaagcttccct

SEQ ID NO: 5841496 - DNA, 17 bp, Homo sapiens
agggccaaacccacttc

SEQ ID NO: 5841497 - DNA, 20 bp, Homo sapiens
agggccaaacgctgagccac

SEQ ID NO: 5841498 - DNA, 16 bp, Homo sapiens
agggccaaagaaccaa

SEQ ID NO: 5841499 - DNA, 17 bp, Homo sapiens
agggccaaagcacagct

SEQ ID NO: 5841500 - DNA, 19 bp, Homo sapiens
agggccaaagcacagctgg

SEQ ID NO: 5841501 - DNA, 17 bp, Homo sapiens
agggccaacccttctcc

SEQ ID NO: 5841502 - DNA, 16 bp, Homo sapiens
agggccaagacttggc

SEQ ID NO: 5841503 - DNA, 15 bp, Homo sapiens
agggccaagccggcc

SEQ ID NO: 5841504 - DNA, 17 bp, Homo sapiens
agggccaagccggccca

SEQ ID NO: 5841505 - DNA, 19 bp, Homo sapiens
agggccaagccggcccaac

SEQ ID NO: 5841506 - DNA, 22 bp, Homo sapiens
agggccaagcgggggcgtggct

SEQ ID NO: 5841507 - DNA, 19 bp, Homo sapiens
agggccaataccctactgt

SEQ ID NO: 5841508 - DNA, 18 bp, Homo sapiens
agggccacatagatgctg

SEQ ID NO: 5841509 - DNA, 19 bp, Homo sapiens
agggccacatcccactgcc

SEQ ID NO: 5841510 - DNA, 17 bp, Homo sapiens
agggccaccaggaagca

SEQ ID NO: 5841511 - DNA, 16 bp, Homo sapiens
agggccaccccactct

SEQ ID NO: 5841512 - DNA, 15 bp, Homo sapiens
agggccaccctgctg

SEQ ID NO: 5841513 - DNA, 20 bp, Homo sapiens
agggccaccctgctgcacta

SEQ ID NO: 5841514 - DNA, 23 bp, Homo sapiens
agggccacctacaatacatctga

SEQ ID NO: 5841515 - DNA, 16 bp, Homo sapiens
agggccacctgcagga

SEQ ID NO: 5841516 - DNA, 18 bp, Homo sapiens
agggccacgtgccaggcc

SEQ ID NO: 5841517 - DNA, 23 bp, Homo sapiens
agggccactggtccccaacaatg

SEQ ID NO: 5841518 - DNA, 19 bp, Homo sapiens
agggccactttttttttat

SEQ ID NO: 5841519 - DNA, 16 bp, Homo sapiens
agggccagaaggaggg

SEQ ID NO: 5841520 - DNA, 22 bp, Homo sapiens
agggccagaaggagggcagagc

SEQ ID NO: 5841521 - DNA, 17 bp, Homo sapiens
agggccagaagtagctt

SEQ ID NO: 5841522 - DNA, 13 bp, Homo sapiens
agggccagacaga

SEQ ID NO: 5841523 - DNA, 13 bp, Homo sapiens
agggccagactgg

SEQ ID NO: 5841524 - DNA, 17 bp, Homo sapiens
agggccagactggaaga

SEQ ID NO: 5841525 - DNA, 11 bp, Homo sapiens
agggccagagc

SEQ ID NO: 5841526 - DNA, 14 bp, Homo sapiens
agggccagagcagc

SEQ ID NO: 5841527 - DNA, 15 bp, Homo sapiens
agggccagagcagct

SEQ ID NO: 5841528 - DNA, 22 bp, Homo sapiens
agggccagcaggcagcgcctgt

SEQ ID NO: 5841529 - DNA, 22 bp, Homo sapiens
agggccagccctacatcttcag

SEQ ID NO: 5841530 - DNA, 17 bp, Homo sapiens
agggccagctaattttt

SEQ ID NO: 5841531 - DNA, 15 bp, Homo sapiens
agggccaggaaggac

SEQ ID NO: 5841532 - DNA, 22 bp, Homo sapiens
agggccaggaaggacagactgg

SEQ ID NO: 5841533 - DNA, 21 bp, Homo sapiens
agggccaggactgagccccgc

SEQ ID NO: 5841534 - DNA, 15 bp, Homo sapiens
agggccaggagagag

SEQ ID NO: 5841535 - DNA, 16 bp, Homo sapiens
agggccaggagagaga

SEQ ID NO: 5841536 - DNA, 15 bp, Homo sapiens
agggccaggagatgg

SEQ ID NO: 5841537 - DNA, 16 bp, Homo sapiens
agggccaggagatgga

SEQ ID NO: 5841538 - DNA, 14 bp, Homo sapiens
agggccaggattca

SEQ ID NO: 5841539 - DNA, 18 bp, Homo sapiens
agggccaggattcaggcc

SEQ ID NO: 5841540 - DNA, 10 bp, Homo sapiens
agggccaggc

SEQ ID NO: 5841541 - DNA, 13 bp, Homo sapiens
agggccaggcacc

SEQ ID NO: 5841542 - DNA, 12 bp, Homo sapiens
agggccaggcag

SEQ ID NO: 5841543 - DNA, 13 bp, Homo sapiens
agggccaggcaga

SEQ ID NO: 5841544 - DNA, 21 bp, Homo sapiens
agggccaggcaggtgcctgga

SEQ ID NO: 5841545 - DNA, 12 bp, Homo sapiens
agggccaggccc

SEQ ID NO: 5841546 - DNA, 19 bp, Homo sapiens
agggccaggcccaggcctc

SEQ ID NO: 5841547 - DNA, 16 bp, Homo sapiens
agggccaggcctctgc

SEQ ID NO: 5841548 - DNA, 14 bp, Homo sapiens
agggccagggaccc

SEQ ID NO: 5841549 - DNA, 16 bp, Homo sapiens
agggccagggaggcag

SEQ ID NO: 5841550 - DNA, 15 bp, Homo sapiens
agggccagggcaatg

SEQ ID NO: 5841551 - DNA, 18 bp, Homo sapiens
agggccagggcaatgcca

SEQ ID NO: 5841552 - DNA, 21 bp, Homo sapiens
agggccagggcaatgccatca

SEQ ID NO: 5841553 - DNA, 15 bp, Homo sapiens
agggccagggctctg

SEQ ID NO: 5841554 - DNA, 18 bp, Homo sapiens
agggccagggctctggca

SEQ ID NO: 5841555 - DNA, 20 bp, Homo sapiens
agggccaggggtctccctgg

SEQ ID NO: 5841556 - DNA, 13 bp, Homo sapiens
agggccaggtcct

SEQ ID NO: 5841557 - DNA, 21 bp, Homo sapiens
agggccaggtcctcacagcag

SEQ ID NO: 5841558 - DNA, 22 bp, Homo sapiens
agggccaggtgcagaccttggg

SEQ ID NO: 5841559 - DNA, 20 bp, Homo sapiens
agggccaggtgcggcctggg

SEQ ID NO: 5841560 - DNA, 24 bp, Homo sapiens
agggccagtcatggctgtcccctg

SEQ ID NO: 5841561 - DNA, 13 bp, Homo sapiens
agggccagtcctg

SEQ ID NO: 5841562 - DNA, 18 bp, Homo sapiens
agggccagtcctgcctgg

SEQ ID NO: 5841563 - DNA, 19 bp, Homo sapiens
agggccagtcctgcctggc

SEQ ID NO: 5841564 - DNA, 21 bp, Homo sapiens
agggccagtcctgcctggcca

SEQ ID NO: 5841565 - DNA, 18 bp, Homo sapiens
agggccagtgatgatgtt

SEQ ID NO: 5841566 - DNA, 15 bp, Homo sapiens
agggccatgaacttt

SEQ ID NO: 5841567 - DNA, 14 bp, Homo sapiens
agggccatgcagac

SEQ ID NO: 5841568 - DNA, 19 bp, Homo sapiens
agggccatgctgaagggac

SEQ ID NO: 5841569 - DNA, 20 bp, Homo sapiens
agggccatgctgaggcctgg

SEQ ID NO: 5841570 - DNA, 16 bp, Homo sapiens
agggccatggctcagg

SEQ ID NO: 5841571 - DNA, 17 bp, Homo sapiens
agggccatgtgctgccc

SEQ ID NO: 5841572 - DNA, 16 bp, Homo sapiens
agggcccaaagaattg

SEQ ID NO: 5841573 - DNA, 21 bp, Homo sapiens
agggcccaaagcttgtaaata

SEQ ID NO: 5841574 - DNA, 16 bp, Homo sapiens
agggcccaagtccctg

SEQ ID NO: 5841575 - DNA, 14 bp, Homo sapiens
agggcccacacctg

SEQ ID NO: 5841576 - DNA, 18 bp, Homo sapiens
agggcccacccatgtcac

SEQ ID NO: 5841577 - DNA, 14 bp, Homo sapiens
agggcccacctcct

SEQ ID NO: 5841578 - DNA, 18 bp, Homo sapiens
agggcccacctcctccag

SEQ ID NO: 5841579 - DNA, 12 bp, Homo sapiens
agggcccacctt

SEQ ID NO: 5841580 - DNA, 18 bp, Homo sapiens
agggcccagaccctgggc

SEQ ID NO: 5841581 - DNA, 19 bp, Homo sapiens
agggcccagaccctgggca

SEQ ID NO: 5841582 - DNA, 12 bp, Homo sapiens
agggcccagaga

SEQ ID NO: 5841583 - DNA, 14 bp, Homo sapiens
agggcccagagagg

SEQ ID NO: 5841584 - DNA, 23 bp, Homo sapiens
agggcccagagagggtggtgacc

SEQ ID NO: 5841585 - DNA, 13 bp, Homo sapiens
agggcccagagca

SEQ ID NO: 5841586 - DNA, 14 bp, Homo sapiens
agggcccagagcag

SEQ ID NO: 5841587 - DNA, 18 bp, Homo sapiens
agggcccagagcaggaag

SEQ ID NO: 5841588 - DNA, 13 bp, Homo sapiens
agggcccagagcc

SEQ ID NO: 5841589 - DNA, 14 bp, Homo sapiens
agggcccagagccc

SEQ ID NO: 5841590 - DNA, 18 bp, Homo sapiens
agggcccagagcccagct

SEQ ID NO: 5841591 - DNA, 21 bp, Homo sapiens
agggcccagaggggcggggcc

SEQ ID NO: 5841592 - DNA, 23 bp, Homo sapiens
agggcccagaggggcggggccag

SEQ ID NO: 5841593 - DNA, 12 bp, Homo sapiens
agggcccagagt

SEQ ID NO: 5841594 - DNA, 14 bp, Homo sapiens
agggcccagccagg

SEQ ID NO: 5841595 - DNA, 18 bp, Homo sapiens
agggcccagcccagagcc

SEQ ID NO: 5841596 - DNA, 22 bp, Homo sapiens
agggcccagcccagagccacct

SEQ ID NO: 5841597 - DNA, 17 bp, Homo sapiens
agggcccagctgtagcc

SEQ ID NO: 5841598 - DNA, 19 bp, Homo sapiens
agggcccagctgtagccat

SEQ ID NO: 5841599 - DNA, 12 bp, Homo sapiens
agggcccaggag

SEQ ID NO: 5841600 - DNA, 13 bp, Homo sapiens
agggcccaggcca

SEQ ID NO: 5841601 - DNA, 17 bp, Homo sapiens
agggcccaggcctggag

SEQ ID NO: 5841602 - DNA, 18 bp, Homo sapiens
agggcccaggcctggagc

SEQ ID NO: 5841603 - DNA, 13 bp, Homo sapiens
agggcccagggag

SEQ ID NO: 5841604 - DNA, 14 bp, Homo sapiens
agggcccagggagg

SEQ ID NO: 5841605 - DNA, 19 bp, Homo sapiens
agggcccagggaggtggca

SEQ ID NO: 5841606 - DNA, 14 bp, Homo sapiens
agggccccacgtcc

SEQ ID NO: 5841607 - DNA, 12 bp, Homo sapiens
agggccccagca

SEQ ID NO: 5841608 - DNA, 18 bp, Homo sapiens
agggccccagcactaaag

SEQ ID NO: 5841609 - DNA, 17 bp, Homo sapiens
agggccccaggggcagc

SEQ ID NO: 5841610 - DNA, 17 bp, Homo sapiens
agggcccccaataaacc

SEQ ID NO: 5841611 - DNA, 18 bp, Homo sapiens
agggcccccaataaacca

SEQ ID NO: 5841612 - DNA, 23 bp, Homo sapiens
agggcccccaataaaccagtgtg

SEQ ID NO: 5841613 - DNA, 18 bp, Homo sapiens
agggcccccacagttgct

SEQ ID NO: 5841614 - DNA, 19 bp, Homo sapiens
agggcccctcaccctgcct

SEQ ID NO: 5841615 - DNA, 13 bp, Homo sapiens
agggcccctcact

SEQ ID NO: 5841616 - DNA, 20 bp, Homo sapiens
agggcccctcactggctgga

SEQ ID NO: 5841617 - DNA, 13 bp, Homo sapiens
agggcccctccct

SEQ ID NO: 5841618 - DNA, 19 bp, Homo sapiens
agggcccctccctctgccc

SEQ ID NO: 5841619 - DNA, 20 bp, Homo sapiens
agggcccctccctctgcccc

SEQ ID NO: 5841620 - DNA, 12 bp, Homo sapiens
agggcccctctc

SEQ ID NO: 5841621 - DNA, 21 bp, Homo sapiens
agggcccctgaagtgacccca

SEQ ID NO: 5841622 - DNA, 17 bp, Homo sapiens
agggcccgcagtgctgg

SEQ ID NO: 5841623 - DNA, 18 bp, Homo sapiens
agggcccgggcccaggca

SEQ ID NO: 5841624 - DNA, 15 bp, Homo sapiens
agggccctaggcccc

SEQ ID NO: 5841625 - DNA, 18 bp, Homo sapiens
agggccctaggtttgctc

SEQ ID NO: 5841626 - DNA, 17 bp, Homo sapiens
agggccctcactcagga

SEQ ID NO: 5841627 - DNA, 20 bp, Homo sapiens
agggccctcactcaggaacc

SEQ ID NO: 5841628 - DNA, 18 bp, Homo sapiens
agggccctcagaggaaag

SEQ ID NO: 5841629 - DNA, 20 bp, Homo sapiens
agggccctcagaggaaaggc

SEQ ID NO: 5841630 - DNA, 17 bp, Homo sapiens
agggccctctgaggctc

SEQ ID NO: 5841631 - DNA, 20 bp, Homo sapiens
agggccctctgaggctcagc

SEQ ID NO: 5841632 - DNA, 22 bp, Homo sapiens
agggccctctgaggctcagccc

SEQ ID NO: 5841633 - DNA, 22 bp, Homo sapiens
agggccctctggggctcagccc

SEQ ID NO: 5841634 - DNA, 18 bp, Homo sapiens
agggccctgacaggcctt

SEQ ID NO: 5841635 - DNA, 15 bp, Homo sapiens
agggccctgagctga

SEQ ID NO: 5841636 - DNA, 21 bp, Homo sapiens
agggccctgaggaataaagct

SEQ ID NO: 5841637 - DNA, 21 bp, Homo sapiens
agggccctgccccaggcctgg

SEQ ID NO: 5841638 - DNA, 22 bp, Homo sapiens
agggccctgccccaggcctgga

SEQ ID NO: 5841639 - DNA, 14 bp, Homo sapiens
agggccctgccctg

SEQ ID NO: 5841640 - DNA, 22 bp, Homo sapiens
agggccctgctcaggcctcacc

SEQ ID NO: 5841641 - DNA, 18 bp, Homo sapiens
agggccctggagctcagg

SEQ ID NO: 5841642 - DNA, 13 bp, Homo sapiens
agggccctggagg

SEQ ID NO: 5841643 - DNA, 14 bp, Homo sapiens
agggccctggaggc

SEQ ID NO: 5841644 - DNA, 11 bp, Homo sapiens
agggccctggc

SEQ ID NO: 5841645 - DNA, 13 bp, Homo sapiens
agggccctgggca

SEQ ID NO: 5841646 - DNA, 14 bp, Homo sapiens
agggccctgggcag

SEQ ID NO: 5841647 - DNA, 18 bp, Homo sapiens
agggctcagatggggcct

SEQ ID NO: 5841648 - DNA, 22 bp, Homo sapiens
agggctcagatggggcctgggc

SEQ ID NO: 5841649 - DNA, 15 bp, Homo sapiens
agggctcagcctggt

SEQ ID NO: 5841650 - DNA, 20 bp, Homo sapiens
agggctcagcggggacagct

SEQ ID NO: 5841651 - DNA, 17 bp, Homo sapiens
agggctcagctagacat

SEQ ID NO: 5841652 - DNA, 13 bp, Homo sapiens
agggctcaggatt

SEQ ID NO: 5841653 - DNA, 20 bp, Homo sapiens
agggctccagcatccagcct

SEQ ID NO: 5841654 - DNA, 23 bp, Homo sapiens
agggctccagcccctcttggaga

SEQ ID NO: 5841655 - DNA, 17 bp, Homo sapiens
agggctccagcctgtcg

SEQ ID NO: 5841656 - DNA, 23 bp, Homo sapiens
agggctccagcctgtcggccaca

SEQ ID NO: 5841657 - DNA, 20 bp, Homo sapiens
agggctccaggagcctcatc

SEQ ID NO: 5841658 - DNA, 14 bp, Homo sapiens
agggctccagggcc

SEQ ID NO: 5841659 - DNA, 22 bp, Homo sapiens
agggctccatgctgaaggctcc

SEQ ID NO: 5841660 - DNA, 13 bp, Homo sapiens
agggctcccaggg

SEQ ID NO: 5841661 - DNA, 22 bp, Homo sapiens
agggctcccaggggtctccctg

SEQ ID NO: 5841662 - DNA, 19 bp, Homo sapiens
agggctcccggagagggag

SEQ ID NO: 5841663 - DNA, 18 bp, Homo sapiens
agggctccctcctggagc

SEQ ID NO: 5841664 - DNA, 20 bp, Homo sapiens
agggctccctcctggagcat

SEQ ID NO: 5841665 - DNA, 14 bp, Homo sapiens
agggctcctcccag

SEQ ID NO: 5841666 - DNA, 15 bp, Homo sapiens
agggctcctcccagc

SEQ ID NO: 5841667 - DNA, 13 bp, Homo sapiens
agggctcctccct

SEQ ID NO: 5841668 - DNA, 14 bp, Homo sapiens
agggctcctccctg

SEQ ID NO: 5841669 - DNA, 15 bp, Homo sapiens
agggctcctccctgg

SEQ ID NO: 5841670 - DNA, 16 bp, Homo sapiens
agggctcctccctgga

SEQ ID NO: 5841671 - DNA, 18 bp, Homo sapiens
agggctcctccctggagc

SEQ ID NO: 5841672 - DNA, 16 bp, Homo sapiens
agggctcctgaaggaa

SEQ ID NO: 5841673 - DNA, 15 bp, Homo sapiens
agggctcctgccttc

SEQ ID NO: 5841674 - DNA, 22 bp, Homo sapiens
agggctcctgccttctgtcctg

SEQ ID NO: 5841675 - DNA, 15 bp, Homo sapiens
agggctcctgtggca

SEQ ID NO: 5841676 - DNA, 18 bp, Homo sapiens
agggctccttgtgggcct

SEQ ID NO: 5841677 - DNA, 19 bp, Homo sapiens
agggctccttgtgggcctg

SEQ ID NO: 5841678 - DNA, 19 bp, Homo sapiens
agggctcgggcgctgtggc

SEQ ID NO: 5841679 - DNA, 23 bp, Homo sapiens
agggctcggggtgtgtcatttct

SEQ ID NO: 5841680 - DNA, 24 bp, Homo sapiens
agggctcggggtgtgtcatttcta

SEQ ID NO: 5841681 - DNA, 16 bp, Homo sapiens
agggctctcctggctt

SEQ ID NO: 5841682 - DNA, 16 bp, Homo sapiens
agggctctcttaggca

SEQ ID NO: 5841683 - DNA, 21 bp, Homo sapiens
agggctctctttccttcttgc

SEQ ID NO: 5841684 - DNA, 15 bp, Homo sapiens
agggctctgaccagt

SEQ ID NO: 5841685 - DNA, 17 bp, Homo sapiens
agggctctgatctaaca

SEQ ID NO: 5841686 - DNA, 16 bp, Homo sapiens
agggctctgcaggcca

SEQ ID NO: 5841687 - DNA, 17 bp, Homo sapiens
agggctctgcaggccac

SEQ ID NO: 5841688 - DNA, 16 bp, Homo sapiens
agggctctgccccagt

SEQ ID NO: 5841689 - DNA, 14 bp, Homo sapiens
agggctctgggggc

SEQ ID NO: 5841690 - DNA, 17 bp, Homo sapiens
agggctctgggggcaga

SEQ ID NO: 5841691 - DNA, 14 bp, Homo sapiens
agggctctgtttgt

SEQ ID NO: 5841692 - DNA, 15 bp, Homo sapiens
agggctctttagcca

SEQ ID NO: 5841693 - DNA, 19 bp, Homo sapiens
agggctgaaaacggagagg

SEQ ID NO: 5841694 - DNA, 17 bp, Homo sapiens
agggctgaaccctcagc

SEQ ID NO: 5841695 - DNA, 19 bp, Homo sapiens
agggctgacctgcctctca

SEQ ID NO: 5841696 - DNA, 20 bp, Homo sapiens
agggctgacttctccaggac

SEQ ID NO: 5841697 - DNA, 20 bp, Homo sapiens
agggctgagcacctctcaga

SEQ ID NO: 5841698 - DNA, 14 bp, Homo sapiens
agggctgagcccct

SEQ ID NO: 5841699 - DNA, 18 bp, Homo sapiens
agggctgagcccctcctc

SEQ ID NO: 5841700 - DNA, 20 bp, Homo sapiens
agggctgagcgtggaagggg

SEQ ID NO: 5841701 - DNA, 17 bp, Homo sapiens
agggctgagctgagctt

SEQ ID NO: 5841702 - DNA, 16 bp, Homo sapiens
agggctgagctgggga

SEQ ID NO: 5841703 - DNA, 17 bp, Homo sapiens
agggctgaggagcagcc

SEQ ID NO: 5841704 - DNA, 20 bp, Homo sapiens
agggctgaggagcagccagg

SEQ ID NO: 5841705 - DNA, 21 bp, Homo sapiens
agggctgaggggcctgcgccc

SEQ ID NO: 5841706 - DNA, 20 bp, Homo sapiens
agggctgagtccttgctgtg

SEQ ID NO: 5841707 - DNA, 20 bp, Homo sapiens
agggctgatagagtgatttt

SEQ ID NO: 5841708 - DNA, 20 bp, Homo sapiens
agggctgatggattccaaac

SEQ ID NO: 5841709 - DNA, 23 bp, Homo sapiens
agggctgcaaaactggaagcaca

SEQ ID NO: 5841710 - DNA, 16 bp, Homo sapiens
agggctgcacattgcc

SEQ ID NO: 5841711 - DNA, 15 bp, Homo sapiens
agggctgcagagcct

SEQ ID NO: 5841712 - DNA, 16 bp, Homo sapiens
agggctgcagagcctg

SEQ ID NO: 5841713 - DNA, 11 bp, Homo sapiens
agggctgcagg

SEQ ID NO: 5841714 - DNA, 15 bp, Homo sapiens
agggctgcagtcaca

SEQ ID NO: 5841715 - DNA, 12 bp, Homo sapiens
agggctgcagtt

SEQ ID NO: 5841716 - DNA, 21 bp, Homo sapiens
agggctgcatcccgagcaacc

SEQ ID NO: 5841717 - DNA, 12 bp, Homo sapiens
agggctgcatga

SEQ ID NO: 5841718 - DNA, 18 bp, Homo sapiens
agggctgccagcagcccc

SEQ ID NO: 5841719 - DNA, 12 bp, Homo sapiens
agggctgcccct

SEQ ID NO: 5841720 - DNA, 22 bp, Homo sapiens
agggctgcccctgtaggttgct

SEQ ID NO: 5841721 - DNA, 15 bp, Homo sapiens
agggctgccctgaga

SEQ ID NO: 5841722 - DNA, 16 bp, Homo sapiens
agggctgccctgagaa

SEQ ID NO: 5841723 - DNA, 11 bp, Homo sapiens
agggctgcctg

SEQ ID NO: 5841724 - DNA, 12 bp, Homo sapiens
agggctgctccc

SEQ ID NO: 5841725 - DNA, 14 bp, Homo sapiens
agggctgctctttc

SEQ ID NO: 5841726 - DNA, 22 bp, Homo sapiens
agggctgctctttccacttgcc

SEQ ID NO: 5841727 - DNA, 12 bp, Homo sapiens
agggctgctgct

SEQ ID NO: 5841728 - DNA, 15 bp, Homo sapiens
agggctgctgcttct

SEQ ID NO: 5841729 - DNA, 23 bp, Homo sapiens
agggctgctgggggcaactggcc

SEQ ID NO: 5841730 - DNA, 20 bp, Homo sapiens
agggctgctgtggcccagtc

SEQ ID NO: 5841731 - DNA, 18 bp, Homo sapiens
agggctgcttttcttaag

SEQ ID NO: 5841732 - DNA, 22 bp, Homo sapiens
agggctggaaaagtcacacaga

SEQ ID NO: 5841733 - DNA, 21 bp, Homo sapiens
agggctggaatgggagacctg

SEQ ID NO: 5841734 - DNA, 15 bp, Homo sapiens
agggctggagaccag

SEQ ID NO: 5841735 - DNA, 13 bp, Homo sapiens
agggctggatgga

SEQ ID NO: 5841736 - DNA, 15 bp, Homo sapiens
agggctggatggaca

SEQ ID NO: 5841737 - DNA, 20 bp, Homo sapiens
agggctggatggacagacac

SEQ ID NO: 5841738 - DNA, 13 bp, Homo sapiens
agggctggcccag

SEQ ID NO: 5841739 - DNA, 14 bp, Homo sapiens
agggctggccccag

SEQ ID NO: 5841740 - DNA, 12 bp, Homo sapiens
agggctggcccg

SEQ ID NO: 5841741 - DNA, 15 bp, Homo sapiens
agggctggccctagg

SEQ ID NO: 5841742 - DNA, 17 bp, Homo sapiens
agggctggccctaggca

SEQ ID NO: 5841743 - DNA, 21 bp, Homo sapiens
agggctggccctaggcactga

SEQ ID NO: 5841744 - DNA, 16 bp, Homo sapiens
agggctggccgggact

SEQ ID NO: 5841745 - DNA, 21 bp, Homo sapiens
agggctggccgggactgctgc

SEQ ID NO: 5841746 - DNA, 17 bp, Homo sapiens
agggctggctcaattga

SEQ ID NO: 5841747 - DNA, 14 bp, Homo sapiens
agggctggctcccc

SEQ ID NO: 5841748 - DNA, 13 bp, Homo sapiens
agggctggctcct

SEQ ID NO: 5841749 - DNA, 17 bp, Homo sapiens
agggctggctcctctgc

SEQ ID NO: 5841750 - DNA, 19 bp, Homo sapiens
agggctggctcctgatcca

SEQ ID NO: 5841751 - DNA, 18 bp, Homo sapiens
agggctggctctgcacta

SEQ ID NO: 5841752 - DNA, 13 bp, Homo sapiens
agggctggctgga

SEQ ID NO: 5841753 - DNA, 15 bp, Homo sapiens
agggctggctggagg

SEQ ID NO: 5841754 - DNA, 22 bp, Homo sapiens
agggctgggaaacactccttgc

SEQ ID NO: 5841755 - DNA, 16 bp, Homo sapiens
agggctgggaggaagg

SEQ ID NO: 5841756 - DNA, 18 bp, Homo sapiens
agggctgggaggaaggac

SEQ ID NO: 5841757 - DNA, 16 bp, Homo sapiens
agggctgggcagggcc

SEQ ID NO: 5841758 - DNA, 19 bp, Homo sapiens
agggctgggcagggccctg

SEQ ID NO: 5841759 - DNA, 14 bp, Homo sapiens
agggctgggcccac

SEQ ID NO: 5841760 - DNA, 11 bp, Homo sapiens
agggctgggga

SEQ ID NO: 5841761 - DNA, 16 bp, Homo sapiens
agggctggggactggg

SEQ ID NO: 5841762 - DNA, 18 bp, Homo sapiens
agggctggggcagcctct

SEQ ID NO: 5841763 - DNA, 19 bp, Homo sapiens
agggctggggccaagagga

SEQ ID NO: 5841764 - DNA, 18 bp, Homo sapiens
agggctggggcggagctg

SEQ ID NO: 5841765 - DNA, 13 bp, Homo sapiens
agggctggggctg

SEQ ID NO: 5841766 - DNA, 11 bp, Homo sapiens
agggctggggt

SEQ ID NO: 5841767 - DNA, 15 bp, Homo sapiens
agggctggggtgagc

SEQ ID NO: 5841768 - DNA, 16 bp, Homo sapiens
agggctggggttgcca

SEQ ID NO: 5841769 - DNA, 17 bp, Homo sapiens
agggctgggtcacagga

SEQ ID NO: 5841770 - DNA, 11 bp, Homo sapiens
agggctgggtg

SEQ ID NO: 5841771 - DNA, 17 bp, Homo sapiens
agggctggtccttattt

SEQ ID NO: 5841772 - DNA, 14 bp, Homo sapiens
agggctggtcttgg

SEQ ID NO: 5841773 - DNA, 20 bp, Homo sapiens
agggctgtagacttactttc

SEQ ID NO: 5841774 - DNA, 15 bp, Homo sapiens
agggctgtcccagcc

SEQ ID NO: 5841775 - DNA, 18 bp, Homo sapiens
agggctgtcccagccccg

SEQ ID NO: 5841776 - DNA, 19 bp, Homo sapiens
agggctgtgagcatcctgg

SEQ ID NO: 5841777 - DNA, 21 bp, Homo sapiens
agggctgtgcttgaaggccct

SEQ ID NO: 5841778 - DNA, 22 bp, Homo sapiens
agggctgtgcttgaaggccctg

SEQ ID NO: 5841779 - DNA, 15 bp, Homo sapiens
agggctgtggctggg

SEQ ID NO: 5841780 - DNA, 16 bp, Homo sapiens
agggctgtgggtgggg

SEQ ID NO: 5841781 - DNA, 21 bp, Homo sapiens
agggctgtgtgggtaaatgct

SEQ ID NO: 5841782 - DNA, 18 bp, Homo sapiens
agggctgttccctccagg

SEQ ID NO: 5841783 - DNA, 20 bp, Homo sapiens
agggctgttgctagggagag

SEQ ID NO: 5841784 - DNA, 18 bp, Homo sapiens
agggcttacctgtacact

SEQ ID NO: 5841785 - DNA, 18 bp, Homo sapiens
agggcttacggccctggc

SEQ ID NO: 5841786 - DNA, 15 bp, Homo sapiens
agggcttactatttc

SEQ ID NO: 5841787 - DNA, 23 bp, Homo sapiens
agggcttatctagccaaagagct

SEQ ID NO: 5841788 - DNA, 19 bp, Homo sapiens
agggcttccccatcagctc

SEQ ID NO: 5841789 - DNA, 22 bp, Homo sapiens
agggcttccccatcagctccca

SEQ ID NO: 5841790 - DNA, 23 bp, Homo sapiens
agggcttccccatcagctcccaa

SEQ ID NO: 5841791 - DNA, 20 bp, Homo sapiens
agggcttcctctagaagcca

SEQ ID NO: 5841792 - DNA, 22 bp, Homo sapiens
agggcttcctctagaagccaag

SEQ ID NO: 5841793 - DNA, 19 bp, Homo sapiens
agggcttcggccacaggca

SEQ ID NO: 5841794 - DNA, 17 bp, Homo sapiens
agggcttctaccagaga

SEQ ID NO: 5841795 - DNA, 14 bp, Homo sapiens
agggcttctcctgc

SEQ ID NO: 5841796 - DNA, 15 bp, Homo sapiens
agggcttctcctgcg

SEQ ID NO: 5841797 - DNA, 23 bp, Homo sapiens
agggcttctcctgcgggggcgag

SEQ ID NO: 5841798 - DNA, 13 bp, Homo sapiens
agggcttctcttt

SEQ ID NO: 5841799 - DNA, 19 bp, Homo sapiens
agggcttctgcaccctcca

SEQ ID NO: 5841800 - DNA, 19 bp, Homo sapiens
agggcttggatcgtggaag

SEQ ID NO: 5841801 - DNA, 18 bp, Homo sapiens
agggcttggcccagcgcc

SEQ ID NO: 5841802 - DNA, 21 bp, Homo sapiens
agggcttggggagcaggtctc

SEQ ID NO: 5841803 - DNA, 13 bp, Homo sapiens
agggcttggggct

SEQ ID NO: 5841804 - DNA, 22 bp, Homo sapiens
agggcttggggctgcacctcct

SEQ ID NO: 5841805 - DNA, 15 bp, Homo sapiens
agggcttggtggcca

SEQ ID NO: 5841806 - DNA, 22 bp, Homo sapiens
agggcttggtggccaagcctgg

SEQ ID NO: 5841807 - DNA, 23 bp, Homo sapiens
agggcttggtggccaagcctggc

SEQ ID NO: 5841808 - DNA, 15 bp, Homo sapiens
agggcttgtagttct

SEQ ID NO: 5841809 - DNA, 23 bp, Homo sapiens
agggcttgtggactctctgcctg

SEQ ID NO: 5841810 - DNA, 23 bp, Homo sapiens
agggctttaaaattctcttccaa

SEQ ID NO: 5841811 - DNA, 21 bp, Homo sapiens
agggctttaaggcacaggctg

SEQ ID NO: 5841812 - DNA, 15 bp, Homo sapiens
agggctttcagcgcc

SEQ ID NO: 5841813 - DNA, 16 bp, Homo sapiens
agggctttcagcgccc

SEQ ID NO: 5841814 - DNA, 19 bp, Homo sapiens
agggctttgaatctgggac

SEQ ID NO: 5841815 - DNA, 15 bp, Homo sapiens
agggctttggttcct

SEQ ID NO: 5841816 - DNA, 19 bp, Homo sapiens
agggctttggttccttctc

SEQ ID NO: 5841817 - DNA, 12 bp, Homo sapiens
agggctttttaa

SEQ ID NO: 5841818 - DNA, 17 bp, Homo sapiens
aggggaaaacctcagtt

SEQ ID NO: 5841819 - DNA, 20 bp, Homo sapiens
aggggaaaatgtgaagctga

SEQ ID NO: 5841820 - DNA, 21 bp, Homo sapiens
aggggaaaccagtgtagcctt

SEQ ID NO: 5841821 - DNA, 23 bp, Homo sapiens
aggggaaaccagtgtagccttgc

SEQ ID NO: 5841822 - DNA, 17 bp, Homo sapiens
aggggaaacctgtgaaa

SEQ ID NO: 5841823 - DNA, 19 bp, Homo sapiens
aggggaaacgtctcccaga

SEQ ID NO: 5841824 - DNA, 15 bp, Homo sapiens
aggggaaactctggt

SEQ ID NO: 5841825 - DNA, 21 bp, Homo sapiens
aggggctcctgggttggaggg

SEQ ID NO: 5841826 - DNA, 22 bp, Homo sapiens
aggggctcctgggttggaggga

SEQ ID NO: 5841827 - DNA, 23 bp, Homo sapiens
aggggctcctgggttggagggaa

SEQ ID NO: 5841828 - DNA, 15 bp, Homo sapiens
aggggctctgagccc

SEQ ID NO: 5841829 - DNA, 15 bp, Homo sapiens
aggggctctgtggca

SEQ ID NO: 5841830 - DNA, 22 bp, Homo sapiens
aggggctgactctccagggagc

SEQ ID NO: 5841831 - DNA, 13 bp, Homo sapiens
aggggctgcaggg

SEQ ID NO: 5841832 - DNA, 18 bp, Homo sapiens
aggggctgcatcctcagc

SEQ ID NO: 5841833 - DNA, 23 bp, Homo sapiens
aggggctgcatcctcagccccag

SEQ ID NO: 5841834 - DNA, 19 bp, Homo sapiens
aggggctgcccgctcccag

SEQ ID NO: 5841835 - DNA, 20 bp, Homo sapiens
aggggctgcccgctcccagt

SEQ ID NO: 5841836 - DNA, 20 bp, Homo sapiens
aggggctgcgctagcagccc

SEQ ID NO: 5841837 - DNA, 22 bp, Homo sapiens
aggggctgctgacctccacagc

SEQ ID NO: 5841838 - DNA, 13 bp, Homo sapiens
aggggctgctggg

SEQ ID NO: 5841839 - DNA, 14 bp, Homo sapiens
aggggctgctgggg

SEQ ID NO: 5841840 - DNA, 16 bp, Homo sapiens
aggggctgctgggggc

SEQ ID NO: 5841841 - DNA, 15 bp, Homo sapiens
aggggctgcttcctc

SEQ ID NO: 5841842 - DNA, 18 bp, Homo sapiens
aggggctgcttcctcctg

SEQ ID NO: 5841843 - DNA, 21 bp, Homo sapiens
aggggctgcttcctcctggaa

SEQ ID NO: 5841844 - DNA, 13 bp, Homo sapiens
aggggctgcttct

SEQ ID NO: 5841845 - DNA, 16 bp, Homo sapiens
aggggctgcttctggg

SEQ ID NO: 5841846 - DNA, 19 bp, Homo sapiens
aggggctgcttgcttttgc

SEQ ID NO: 5841847 - DNA, 12 bp, Homo sapiens
aggggctggagg

SEQ ID NO: 5841848 - DNA, 21 bp, Homo sapiens
aggggctggagggctgggcag

SEQ ID NO: 5841849 - DNA, 23 bp, Homo sapiens
aggggctggccttcctgccctac

SEQ ID NO: 5841850 - DNA, 17 bp, Homo sapiens
aggggctggctggagtc

SEQ ID NO: 5841851 - DNA, 17 bp, Homo sapiens
aggggctggcttcagga

SEQ ID NO: 5841852 - DNA, 12 bp, Homo sapiens
aggggctgggct

SEQ ID NO: 5841853 - DNA, 18 bp, Homo sapiens
aggggctgggctccctga

SEQ ID NO: 5841854 - DNA, 19 bp, Homo sapiens
aggggctgggctccctgat

SEQ ID NO: 5841855 - DNA, 16 bp, Homo sapiens
aggggctgggctgggc

SEQ ID NO: 5841856 - DNA, 21 bp, Homo sapiens
aggggctggggacttgtgtct

SEQ ID NO: 5841857 - DNA, 15 bp, Homo sapiens
aggggctggggaggg

SEQ ID NO: 5841858 - DNA, 16 bp, Homo sapiens
aggggctggggagggg

SEQ ID NO: 5841859 - DNA, 12 bp, Homo sapiens
aggggctggggc

SEQ ID NO: 5841860 - DNA, 18 bp, Homo sapiens
aggggctggggcaggctc

SEQ ID NO: 5841861 - DNA, 18 bp, Homo sapiens
aggggctgggggtgaggg

SEQ ID NO: 5841862 - DNA, 20 bp, Homo sapiens
aggggctgggggtgctggat

SEQ ID NO: 5841863 - DNA, 10 bp, Homo sapiens
aggggctggt

SEQ ID NO: 5841864 - DNA, 21 bp, Homo sapiens
aggggctggtggagatgtagg

SEQ ID NO: 5841865 - DNA, 14 bp, Homo sapiens
aggggctgtacagt

SEQ ID NO: 5841866 - DNA, 22 bp, Homo sapiens
aggggctgtcctccttcctggg

SEQ ID NO: 5841867 - DNA, 18 bp, Homo sapiens
aggggctgttaggacagc

SEQ ID NO: 5841868 - DNA, 14 bp, Homo sapiens
aggggctgttcttc

SEQ ID NO: 5841869 - DNA, 22 bp, Homo sapiens
aggggcttacctgttctctagt

SEQ ID NO: 5841870 - DNA, 17 bp, Homo sapiens
aggggcttccctctgct

SEQ ID NO: 5841871 - DNA, 15 bp, Homo sapiens
aggggcttcctgggt

SEQ ID NO: 5841872 - DNA, 16 bp, Homo sapiens
aggggcttcctggtgc

SEQ ID NO: 5841873 - DNA, 12 bp, Homo sapiens
aggggcttctaa

SEQ ID NO: 5841874 - DNA, 15 bp, Homo sapiens
aggggcttctaatga

SEQ ID NO: 5841875 - DNA, 14 bp, Homo sapiens
aggggcttctcccc

SEQ ID NO: 5841876 - DNA, 17 bp, Homo sapiens
aggggcttggagcagag

SEQ ID NO: 5841877 - DNA, 13 bp, Homo sapiens
aggggctttgggc

SEQ ID NO: 5841878 - DNA, 17 bp, Homo sapiens
agggggaagatgccaag

SEQ ID NO: 5841879 - DNA, 22 bp, Homo sapiens
agggggaaggtggggtcctgga

SEQ ID NO: 5841880 - DNA, 19 bp, Homo sapiens
agggggaatattttaaaaa

SEQ ID NO: 5841881 - DNA, 16 bp, Homo sapiens
agggggaatggcagca

SEQ ID NO: 5841882 - DNA, 18 bp, Homo sapiens
agggggacctcgggctgt

SEQ ID NO: 5841883 - DNA, 22 bp, Homo sapiens
agggggacctcgggctgttctg

SEQ ID NO: 5841884 - DNA, 18 bp, Homo sapiens
agggggacgtttctggaa

SEQ ID NO: 5841885 - DNA, 16 bp, Homo sapiens
agggggagactatgtg

SEQ ID NO: 5841886 - DNA, 16 bp, Homo sapiens
agggggagagggctgc

SEQ ID NO: 5841887 - DNA, 23 bp, Homo sapiens
agggggagccggtaactgtcctg

SEQ ID NO: 5841888 - DNA, 20 bp, Homo sapiens
agggggagggggttacaaac

SEQ ID NO: 5841889 - DNA, 12 bp, Homo sapiens
agggggagggtg

SEQ ID NO: 5841890 - DNA, 15 bp, Homo sapiens
agggggagtctttgc

SEQ ID NO: 5841891 - DNA, 20 bp, Homo sapiens
agggggatccgactgctttg

SEQ ID NO: 5841892 - DNA, 23 bp, Homo sapiens
agggggatgccactcctccctcc

SEQ ID NO: 5841893 - DNA, 20 bp, Homo sapiens
agggggatgcccctggccct

SEQ ID NO: 5841894 - DNA, 21 bp, Homo sapiens
agggggatgcccctggccctg

SEQ ID NO: 5841895 - DNA, 20 bp, Homo sapiens
agggggattctgagcagtgc

SEQ ID NO: 5841896 - DNA, 17 bp, Homo sapiens
agggggattggagggaa

SEQ ID NO: 5841897 - DNA, 15 bp, Homo sapiens
agggggcaaggagaa

SEQ ID NO: 5841898 - DNA, 14 bp, Homo sapiens
agggggcactgtgg

SEQ ID NO: 5841899 - DNA, 23 bp, Homo sapiens
agggggcagagtggcctgtgagc

SEQ ID NO: 5841900 - DNA, 15 bp, Homo sapiens
agggggcaggctgag

SEQ ID NO: 5841901 - DNA, 18 bp, Homo sapiens
agggggcaggggcagggg

SEQ ID NO: 5841902 - DNA, 19 bp, Homo sapiens
agggggcaggggcaggggc

SEQ ID NO: 5841903 - DNA, 17 bp, Homo sapiens
agggggcatctggcctt

SEQ ID NO: 5841904 - DNA, 20 bp, Homo sapiens
agggggcccatccctgccca

SEQ ID NO: 5841905 - DNA, 19 bp, Homo sapiens
agggggccccgccagggct

SEQ ID NO: 5841906 - DNA, 20 bp, Homo sapiens
agggggccccgccagggctg

SEQ ID NO: 5841907 - DNA, 22 bp, Homo sapiens
agggggccccgccagggctggg

SEQ ID NO: 5841908 - DNA, 23 bp, Homo sapiens
agggggccccgccagggctgggg

SEQ ID NO: 5841909 - DNA, 18 bp, Homo sapiens
agggggcccggctgggcc

SEQ ID NO: 5841910 - DNA, 22 bp, Homo sapiens
agggggcccggctgggcccgag

SEQ ID NO: 5841911 - DNA, 19 bp, Homo sapiens
agggggccctgccccaccc

SEQ ID NO: 5841912 - DNA, 14 bp, Homo sapiens
agggggccctggct

SEQ ID NO: 5841913 - DNA, 15 bp, Homo sapiens
agggggcctcattgt

SEQ ID NO: 5841914 - DNA, 19 bp, Homo sapiens
agggggcctgcaggcccca

SEQ ID NO: 5841915 - DNA, 22 bp, Homo sapiens
agggggcctggagcatggacag

SEQ ID NO: 5841916 - DNA, 16 bp, Homo sapiens
agggggcctgggatgc

SEQ ID NO: 5841917 - DNA, 20 bp, Homo sapiens
agggggccttgcggaagcca

SEQ ID NO: 5841918 - DNA, 21 bp, Homo sapiens
agggggccttgcggaagccat

SEQ ID NO: 5841919 - DNA, 24 bp, Homo sapiens
agggggccttgcggaagccatagg

SEQ ID NO: 5841920 - DNA, 16 bp, Homo sapiens
agggggccttgctgga

SEQ ID NO: 5841921 - DNA, 15 bp, Homo sapiens
agggggccttggaat

SEQ ID NO: 5841922 - DNA, 22 bp, Homo sapiens
agggggcgctcaggacccaggc

SEQ ID NO: 5841923 - DNA, 23 bp, Homo sapiens
agggggcgctcaggacccaggcc

SEQ ID NO: 5841924 - DNA, 15 bp, Homo sapiens
agggggcggcctatg

SEQ ID NO: 5841925 - DNA, 15 bp, Homo sapiens
agggggcggggcggg

SEQ ID NO: 5841926 - DNA, 17 bp, Homo sapiens
agggggctccatggagg

SEQ ID NO: 5841927 - DNA, 21 bp, Homo sapiens
agggggctctgcccacctggg

SEQ ID NO: 5841928 - DNA, 15 bp, Homo sapiens
agggggctgctccca

SEQ ID NO: 5841929 - DNA, 16 bp, Homo sapiens
agggggctgctcccac

SEQ ID NO: 5841930 - DNA, 13 bp, Homo sapiens
agggggctgctgc

SEQ ID NO: 5841931 - DNA, 19 bp, Homo sapiens
agggggctgctgctgggct

SEQ ID NO: 5841932 - DNA, 21 bp, Homo sapiens
agggggctggagacaaggata

SEQ ID NO: 5841933 - DNA, 13 bp, Homo sapiens
agggggctggagg

SEQ ID NO: 5841934 - DNA, 16 bp, Homo sapiens
agggggctggaggagc

SEQ ID NO: 5841935 - DNA, 12 bp, Homo sapiens
agggggctggcc

SEQ ID NO: 5841936 - DNA, 14 bp, Homo sapiens
agggggctggccat

SEQ ID NO: 5841937 - DNA, 13 bp, Homo sapiens
agggggctgggct

SEQ ID NO: 5841938 - DNA, 14 bp, Homo sapiens
agggggctgggctc

SEQ ID NO: 5841939 - DNA, 12 bp, Homo sapiens
agggggctgggg

SEQ ID NO: 5841940 - DNA, 22 bp, Homo sapiens
agggggctggggtcacagaggc

SEQ ID NO: 5841941 - DNA, 19 bp, Homo sapiens
agggggcttgaagccaaag

SEQ ID NO: 5841942 - DNA, 18 bp, Homo sapiens
agggggctttctggggcc

SEQ ID NO: 5841943 - DNA, 17 bp, Homo sapiens
aggggggaacatgcatt

SEQ ID NO: 5841944 - DNA, 19 bp, Homo sapiens
aggggggaacatgcatttt

SEQ ID NO: 5841945 - DNA, 15 bp, Homo sapiens
aggggggagccagag

SEQ ID NO: 5841946 - DNA, 20 bp, Homo sapiens
aggggggagccagaggccag

SEQ ID NO: 5841947 - DNA, 14 bp, Homo sapiens
aggggggagctggg

SEQ ID NO: 5841948 - DNA, 14 bp, Homo sapiens
aggggggagggctg

SEQ ID NO: 5841949 - DNA, 12 bp, Homo sapiens
aggggggagggg

SEQ ID NO: 5841950 - DNA, 23 bp, Homo sapiens
aggggggcacatgctgagtctcc

SEQ ID NO: 5841951 - DNA, 15 bp, Homo sapiens
aggggggcgggtgac

SEQ ID NO: 5841952 - DNA, 16 bp, Homo sapiens
agggggggctccctgg

SEQ ID NO: 5841953 - DNA, 22 bp, Homo sapiens
aggggggggtgggtgagagaga

SEQ ID NO: 5841954 - DNA, 19 bp, Homo sapiens
aggggggtcagccagccct

SEQ ID NO: 5841955 - DNA, 20 bp, Homo sapiens
aggggggtcggaagcctgtc

SEQ ID NO: 5841956 - DNA, 19 bp, Homo sapiens
aggggggtgctggccccca

SEQ ID NO: 5841957 - DNA, 19 bp, Homo sapiens
agggggtaatggaggccaa

SEQ ID NO: 5841958 - DNA, 18 bp, Homo sapiens
agggggtacctcatgagg

SEQ ID NO: 5841959 - DNA, 21 bp, Homo sapiens
agggggtcagcccaagattct

SEQ ID NO: 5841960 - DNA, 21 bp, Homo sapiens
agggggtcagttgggccccca

SEQ ID NO: 5841961 - DNA, 18 bp, Homo sapiens
agggggtcattgttctcc

SEQ ID NO: 5841962 - DNA, 16 bp, Homo sapiens
agggggtccacccagc

SEQ ID NO: 5841963 - DNA, 19 bp, Homo sapiens
agggggtcccagtgggagg

SEQ ID NO: 5841964 - DNA, 20 bp, Homo sapiens
agggggtcccagtgggaggg

SEQ ID NO: 5841965 - DNA, 15 bp, Homo sapiens
agggggtccgtggaa

SEQ ID NO: 5841966 - DNA, 20 bp, Homo sapiens
agggggtccgtggtagaggc

SEQ ID NO: 5841967 - DNA, 16 bp, Homo sapiens
agggggtcgtggagag

SEQ ID NO: 5841968 - DNA, 18 bp, Homo sapiens
agggggtcgtggagagct

SEQ ID NO: 5841969 - DNA, 19 bp, Homo sapiens
agggggtgaaggcaggagt

SEQ ID NO: 5841970 - DNA, 18 bp, Homo sapiens
agggggtgacagtcctcc

SEQ ID NO: 5841971 - DNA, 14 bp, Homo sapiens
agggggtgactgga

SEQ ID NO: 5841972 - DNA, 14 bp, Homo sapiens
agggggtgagaggc

SEQ ID NO: 5841973 - DNA, 23 bp, Homo sapiens
agggggtgattagagggaggaga

SEQ ID NO: 5841974 - DNA, 22 bp, Homo sapiens
agggggtgcaaagactctgagc

SEQ ID NO: 5841975 - DNA, 20 bp, Homo sapiens
agggggtgggaaggggatgg

SEQ ID NO: 5841976 - DNA, 12 bp, Homo sapiens
agggggtggggg

SEQ ID NO: 5841977 - DNA, 19 bp, Homo sapiens
agggggtgtcatctgagga

SEQ ID NO: 5841978 - DNA, 20 bp, Homo sapiens
agggggtgtctcaggccaca

SEQ ID NO: 5841979 - DNA, 22 bp, Homo sapiens
agggggtgtctggaagctgagc

SEQ ID NO: 5841980 - DNA, 19 bp, Homo sapiens
agggggttacaaactgcaa

SEQ ID NO: 5841981 - DNA, 14 bp, Homo sapiens
agggggttctggga

SEQ ID NO: 5841982 - DNA, 16 bp, Homo sapiens
agggggttctgggacc

SEQ ID NO: 5841983 - DNA, 21 bp, Homo sapiens
agggggttctgggacccactc

SEQ ID NO: 5841984 - DNA, 15 bp, Homo sapiens
aggggtaaatatatg

SEQ ID NO: 5841985 - DNA, 16 bp, Homo sapiens
aggggtaaatatatgt

SEQ ID NO: 5841986 - DNA, 22 bp, Homo sapiens
aggggtaaatatatgttttgag

SEQ ID NO: 5841987 - DNA, 23 bp, Homo sapiens
aggggtaaatatatgttttgaga

SEQ ID NO: 5841988 - DNA, 19 bp, Homo sapiens
aggggtaatatattgctgc

SEQ ID NO: 5841989 - DNA, 16 bp, Homo sapiens
aggggtaccactgaat

SEQ ID NO: 5841990 - DNA, 19 bp, Homo sapiens
aggggtaggcagagccttt

SEQ ID NO: 5841991 - DNA, 16 bp, Homo sapiens
aggggtaggggctggg

SEQ ID NO: 5841992 - DNA, 18 bp, Homo sapiens
aggggtaggggctgggaa

SEQ ID NO: 5841993 - DNA, 23 bp, Homo sapiens
aggggtatgttccctcttgtccc

SEQ ID NO: 5841994 - DNA, 22 bp, Homo sapiens
aggggtcacacccaccccctgc

SEQ ID NO: 5841995 - DNA, 17 bp, Homo sapiens
aggggtcaccttgagag

SEQ ID NO: 5841996 - DNA, 13 bp, Homo sapiens
aggggtcaggctc

SEQ ID NO: 5841997 - DNA, 15 bp, Homo sapiens
aggggtcaggctcca

SEQ ID NO: 5841998 - DNA, 14 bp, Homo sapiens
aggggtccaggccc

SEQ ID NO: 5841999 - DNA, 15 bp, Homo sapiens
aggggtccaggcccc

SEQ ID NO: 5842000 - DNA, 18 bp, Homo sapiens
aggggtcccagccacccc

SEQ ID NO: 5842001 - DNA, 17 bp, Homo sapiens
aggtaatctgaaacaca

SEQ ID NO: 5842002 - DNA, 19 bp, Homo sapiens
aggtaatgaccatgaaaga

SEQ ID NO: 5842003 - DNA, 20 bp, Homo sapiens
aggtaatgaccatgaaagac

SEQ ID NO: 5842004 - DNA, 21 bp, Homo sapiens
aggtaatgaccatgaaagact

SEQ ID NO: 5842005 - DNA, 14 bp, Homo sapiens
aggtaatgagggac

SEQ ID NO: 5842006 - DNA, 14 bp, Homo sapiens
aggtaatggcatga

SEQ ID NO: 5842007 - DNA, 12 bp, Homo sapiens
aggtaatgtttt

SEQ ID NO: 5842008 - DNA, 15 bp, Homo sapiens
aggtaatgttttgta

SEQ ID NO: 5842009 - DNA, 20 bp, Homo sapiens
aggtaatgttttgtatatac

SEQ ID NO: 5842010 - DNA, 21 bp, Homo sapiens
aggtaatttttaccctaatgt

SEQ ID NO: 5842011 - DNA, 17 bp, Homo sapiens
aggtaatttttttttgt

SEQ ID NO: 5842012 - DNA, 19 bp, Homo sapiens
aggtaatttttttttgtaa

SEQ ID NO: 5842013 - DNA, 14 bp, Homo sapiens
aggtacaaaatctt

SEQ ID NO: 5842014 - DNA, 22 bp, Homo sapiens
aggtacaacagaataatgcatg

SEQ ID NO: 5842015 - DNA, 18 bp, Homo sapiens
aggtacaaccggatgcca

SEQ ID NO: 5842016 - DNA, 16 bp, Homo sapiens
aggtacacagctctag

SEQ ID NO: 5842017 - DNA, 21 bp, Homo sapiens
aggtacacctccccctgcgcc

SEQ ID NO: 5842018 - DNA, 12 bp, Homo sapiens
aggtacactctt

SEQ ID NO: 5842019 - DNA, 22 bp, Homo sapiens
aggtacactggtatttatattt

SEQ ID NO: 5842020 - DNA, 15 bp, Homo sapiens
aggtacagagaagga

SEQ ID NO: 5842021 - DNA, 16 bp, Homo sapiens
aggtacagagaaggaa

SEQ ID NO: 5842022 - DNA, 17 bp, Homo sapiens
aggtaccaaacaaggaa

SEQ ID NO: 5842023 - DNA, 20 bp, Homo sapiens
aggtaccaagatcacaaata

SEQ ID NO: 5842024 - DNA, 15 bp, Homo sapiens
aggtaccacccttca

SEQ ID NO: 5842025 - DNA, 16 bp, Homo sapiens
aggtaccagctgcgct

SEQ ID NO: 5842026 - DNA, 18 bp, Homo sapiens
aggtaccatggccattca

SEQ ID NO: 5842027 - DNA, 18 bp, Homo sapiens
aggtacccaaggtcacat

SEQ ID NO: 5842028 - DNA, 15 bp, Homo sapiens
aggtacccaccgtcc

SEQ ID NO: 5842029 - DNA, 17 bp, Homo sapiens
aggtaccccagctctgc

SEQ ID NO: 5842030 - DNA, 21 bp, Homo sapiens
aggtaccccagctctgcttgc

SEQ ID NO: 5842031 - DNA, 17 bp, Homo sapiens
aggtacccctttctggc

SEQ ID NO: 5842032 - DNA, 16 bp, Homo sapiens
aggtaccgtctacatt

SEQ ID NO: 5842033 - DNA, 15 bp, Homo sapiens
aggtacctcatggga

SEQ ID NO: 5842034 - DNA, 23 bp, Homo sapiens
aggtacctttccacccagaccct

SEQ ID NO: 5842035 - DNA, 21 bp, Homo sapiens
aggtacgagtagaggtttaaa

SEQ ID NO: 5842036 - DNA, 14 bp, Homo sapiens
aggtacggagaaga

SEQ ID NO: 5842037 - DNA, 23 bp, Homo sapiens
aggtacgttttatattatataag

SEQ ID NO: 5842038 - DNA, 15 bp, Homo sapiens
aggtactaaatacct

SEQ ID NO: 5842039 - DNA, 16 bp, Homo sapiens
aggtactagaatgctt

SEQ ID NO: 5842040 - DNA, 15 bp, Homo sapiens
aggtactatatttgc

SEQ ID NO: 5842041 - DNA, 13 bp, Homo sapiens
aggtactctcctg

SEQ ID NO: 5842042 - DNA, 14 bp, Homo sapiens
aggtactctcctgg

SEQ ID NO: 5842043 - DNA, 19 bp, Homo sapiens
aggtactgaaggcttctgc

SEQ ID NO: 5842044 - DNA, 17 bp, Homo sapiens
aggtactgagtggggag

SEQ ID NO: 5842045 - DNA, 20 bp, Homo sapiens
aggtactgatcctgtttctt

SEQ ID NO: 5842046 - DNA, 20 bp, Homo sapiens
aggtactgccatatttttct

SEQ ID NO: 5842047 - DNA, 16 bp, Homo sapiens
aggtactgctgtgtaa

SEQ ID NO: 5842048 - DNA, 22 bp, Homo sapiens
aggtactgtcatgggctaggca

SEQ ID NO: 5842049 - DNA, 20 bp, Homo sapiens
aggtactgtctgcttctctc

SEQ ID NO: 5842050 - DNA, 20 bp, Homo sapiens
aggtacttcctcctgatggc

SEQ ID NO: 5842051 - DNA, 16 bp, Homo sapiens
aggtacttttggaatc

SEQ ID NO: 5842052 - DNA, 20 bp, Homo sapiens
aggtactttttgtgaagacg

SEQ ID NO: 5842053 - DNA, 16 bp, Homo sapiens
aggtagaaaaagggtc

SEQ ID NO: 5842054 - DNA, 17 bp, Homo sapiens
aggtagaaaaagggtca

SEQ ID NO: 5842055 - DNA, 19 bp, Homo sapiens
aggtagaaatatctgaaaa

SEQ ID NO: 5842056 - DNA, 15 bp, Homo sapiens
aggtagaacctcacc

SEQ ID NO: 5842057 - DNA, 17 bp, Homo sapiens
aggtagaacgccaggga

SEQ ID NO: 5842058 - DNA, 18 bp, Homo sapiens
aggtagaatgaccttgta

SEQ ID NO: 5842059 - DNA, 21 bp, Homo sapiens
aggtagaatgtaaagcttgtc

SEQ ID NO: 5842060 - DNA, 17 bp, Homo sapiens
aggtagaatgttttcaa

SEQ ID NO: 5842061 - DNA, 16 bp, Homo sapiens
aggtagagatgtgtgt

SEQ ID NO: 5842062 - DNA, 15 bp, Homo sapiens
aggtagagtctgagg

SEQ ID NO: 5842063 - DNA, 17 bp, Homo sapiens
aggtagagtttgaagga

SEQ ID NO: 5842064 - DNA, 20 bp, Homo sapiens
aggtagagtttgaaggaggt

SEQ ID NO: 5842065 - DNA, 23 bp, Homo sapiens
aggtagagtttgaaggaggtgag

SEQ ID NO: 5842066 - DNA, 22 bp, Homo sapiens
aggtagatcgcttgagcccagg

SEQ ID NO: 5842067 - DNA, 18 bp, Homo sapiens
aggtagattaaggtatct

SEQ ID NO: 5842068 - DNA, 18 bp, Homo sapiens
aggtagattttacagaga

SEQ ID NO: 5842069 - DNA, 16 bp, Homo sapiens
aggtagcaagagagca

SEQ ID NO: 5842070 - DNA, 18 bp, Homo sapiens
aggtagcaagagagcagc

SEQ ID NO: 5842071 - DNA, 14 bp, Homo sapiens
aggtagcacagcac

SEQ ID NO: 5842072 - DNA, 16 bp, Homo sapiens
aggtagcactctcaga

SEQ ID NO: 5842073 - DNA, 12 bp, Homo sapiens
aggtagcccagc

SEQ ID NO: 5842074 - DNA, 16 bp, Homo sapiens
aggtagcccagcactg

SEQ ID NO: 5842075 - DNA, 19 bp, Homo sapiens
aggtagcccagcactgtga

SEQ ID NO: 5842076 - DNA, 20 bp, Homo sapiens
aggtagcccagcactgtgaa

SEQ ID NO: 5842077 - DNA, 23 bp, Homo sapiens
aggtagcccagcactgtgaagac

SEQ ID NO: 5842078 - DNA, 20 bp, Homo sapiens
aggtagccctggccagaggc

SEQ ID NO: 5842079 - DNA, 21 bp, Homo sapiens
aggtagccgagtcacacccgg

SEQ ID NO: 5842080 - DNA, 19 bp, Homo sapiens
aggtagcgagctgctctgc

SEQ ID NO: 5842081 - DNA, 18 bp, Homo sapiens
aggtagctacacagcatc

SEQ ID NO: 5842082 - DNA, 20 bp, Homo sapiens
aggtagctatagttgcagcc

SEQ ID NO: 5842083 - DNA, 22 bp, Homo sapiens
aggtagctatagttgcagccca

SEQ ID NO: 5842084 - DNA, 18 bp, Homo sapiens
aggtagctcccagcactc

SEQ ID NO: 5842085 - DNA, 23 bp, Homo sapiens
aggtagctgcagataagtggcct

SEQ ID NO: 5842086 - DNA, 14 bp, Homo sapiens
aggtagctgcccct

SEQ ID NO: 5842087 - DNA, 18 bp, Homo sapiens
aggtagctggggagccct

SEQ ID NO: 5842088 - DNA, 13 bp, Homo sapiens
aggtagcttcagc

SEQ ID NO: 5842089 - DNA, 23 bp, Homo sapiens
aggtagctttgaggtggaagagg

SEQ ID NO: 5842090 - DNA, 14 bp, Homo sapiens
aggtaggaaacaat

SEQ ID NO: 5842091 - DNA, 13 bp, Homo sapiens
aggtaggaagagc

SEQ ID NO: 5842092 - DNA, 19 bp, Homo sapiens
aggtaggagaattgcttga

SEQ ID NO: 5842093 - DNA, 23 bp, Homo sapiens
aggtaggccaaggtgtcctacag

SEQ ID NO: 5842094 - DNA, 13 bp, Homo sapiens
aggtaggcccttg

SEQ ID NO: 5842095 - DNA, 23 bp, Homo sapiens
aggtaggcccttgtcctgccagc

SEQ ID NO: 5842096 - DNA, 16 bp, Homo sapiens
aggtaggctgtggggt

SEQ ID NO: 5842097 - DNA, 18 bp, Homo sapiens
aggtaggctgtggggtgg

SEQ ID NO: 5842098 - DNA, 15 bp, Homo sapiens
aggtagggagatatt

SEQ ID NO: 5842099 - DNA, 19 bp, Homo sapiens
aggtaggggccgtgtcccg

SEQ ID NO: 5842100 - DNA, 23 bp, Homo sapiens
aggtagggtgtgtatatataaaa

SEQ ID NO: 5842101 - DNA, 13 bp, Homo sapiens
aggtaggttttaa

SEQ ID NO: 5842102 - DNA, 16 bp, Homo sapiens
aggtaggttttaaaaa

SEQ ID NO: 5842103 - DNA, 20 bp, Homo sapiens
aggtaggttttaaaaataag

SEQ ID NO: 5842104 - DNA, 19 bp, Homo sapiens
aggtagtagaatctcagca

SEQ ID NO: 5842105 - DNA, 20 bp, Homo sapiens
aggtagtattacaccaccgg

SEQ ID NO: 5842106 - DNA, 15 bp, Homo sapiens
aggtagtctcactgc

SEQ ID NO: 5842107 - DNA, 23 bp, Homo sapiens
aggtagtgattaactgtgaataa

SEQ ID NO: 5842108 - DNA, 18 bp, Homo sapiens
aggtagtgggtgaatgtg

SEQ ID NO: 5842109 - DNA, 17 bp, Homo sapiens
aggtagttggtgaacag

SEQ ID NO: 5842110 - DNA, 14 bp, Homo sapiens
aggtagtttctcat

SEQ ID NO: 5842111 - DNA, 14 bp, Homo sapiens
aggtagtttggata

SEQ ID NO: 5842112 - DNA, 16 bp, Homo sapiens
aggtataaaaaataag

SEQ ID NO: 5842113 - DNA, 21 bp, Homo sapiens
aggtataaaaaataagtaaag

SEQ ID NO: 5842114 - DNA, 19 bp, Homo sapiens
aggtataagtggtgtgtgt

SEQ ID NO: 5842115 - DNA, 15 bp, Homo sapiens
aggtataataaaatt

SEQ ID NO: 5842116 - DNA, 19 bp, Homo sapiens
aggtataattgtgtgatat

SEQ ID NO: 5842117 - DNA, 14 bp, Homo sapiens
aggtatacaaaaga

SEQ ID NO: 5842118 - DNA, 15 bp, Homo sapiens
aggtatacctcactt

SEQ ID NO: 5842119 - DNA, 15 bp, Homo sapiens
aggtatactatgtaa

SEQ ID NO: 5842120 - DNA, 16 bp, Homo sapiens
aggtatactatgtaag

SEQ ID NO: 5842121 - DNA, 16 bp, Homo sapiens
aggtatatcaggaggg

SEQ ID NO: 5842122 - DNA, 19 bp, Homo sapiens
aggtatatctaggtttatg

SEQ ID NO: 5842123 - DNA, 22 bp, Homo sapiens
aggtatatctaggtttatgaca

SEQ ID NO: 5842124 - DNA, 19 bp, Homo sapiens
aggtatatgttttataatt

SEQ ID NO: 5842125 - DNA, 21 bp, Homo sapiens
aggtatcaggcacaggcagga

SEQ ID NO: 5842126 - DNA, 17 bp, Homo sapiens
aggtatcagttatatga

SEQ ID NO: 5842127 - DNA, 22 bp, Homo sapiens
aggtatcagttgcaataatact

SEQ ID NO: 5842128 - DNA, 16 bp, Homo sapiens
aggtatcccagctttg

SEQ ID NO: 5842129 - DNA, 20 bp, Homo sapiens
aggtatggaagggtttgtgg

SEQ ID NO: 5842130 - DNA, 17 bp, Homo sapiens
aggtatggccatgccct

SEQ ID NO: 5842131 - DNA, 21 bp, Homo sapiens
aggtatggccatgccctagac

SEQ ID NO: 5842132 - DNA, 13 bp, Homo sapiens
aggtatggctctg

SEQ ID NO: 5842133 - DNA, 22 bp, Homo sapiens
aggtatgtcagaaaaaatatgt

SEQ ID NO: 5842134 - DNA, 19 bp, Homo sapiens
aggtatgtgcccctcctgg

SEQ ID NO: 5842135 - DNA, 22 bp, Homo sapiens
aggtatgtgcccctcctgggtg

SEQ ID NO: 5842136 - DNA, 14 bp, Homo sapiens
aggtattaaagatg

SEQ ID NO: 5842137 - DNA, 19 bp, Homo sapiens
aggtattaaagatgtgttg

SEQ ID NO: 5842138 - DNA, 17 bp, Homo sapiens
aggtattacaagtaatg

SEQ ID NO: 5842139 - DNA, 22 bp, Homo sapiens
aggtattacaagtaatgtaaag

SEQ ID NO: 5842140 - DNA, 13 bp, Homo sapiens
aggtattatacat

SEQ ID NO: 5842141 - DNA, 15 bp, Homo sapiens
aggtattattatctt

SEQ ID NO: 5842142 - DNA, 20 bp, Homo sapiens
aggtattcaatatcctttgc

SEQ ID NO: 5842143 - DNA, 18 bp, Homo sapiens
aggtattccttgttcttc

SEQ ID NO: 5842144 - DNA, 20 bp, Homo sapiens
aggtattcgttatctaatag

SEQ ID NO: 5842145 - DNA, 20 bp, Homo sapiens
aggtattctgaccttgtgaa

SEQ ID NO: 5842146 - DNA, 22 bp, Homo sapiens
aggtattgagccattttttaaa

SEQ ID NO: 5842147 - DNA, 19 bp, Homo sapiens
aggtattgattgaaaaaag

SEQ ID NO: 5842148 - DNA, 14 bp, Homo sapiens
aggtattggcctgt

SEQ ID NO: 5842149 - DNA, 12 bp, Homo sapiens
aggtattgtctt

SEQ ID NO: 5842150 - DNA, 20 bp, Homo sapiens
aggtatttaaagtattttct

SEQ ID NO: 5842151 - DNA, 13 bp, Homo sapiens
aggtatttaagac

SEQ ID NO: 5842152 - DNA, 16 bp, Homo sapiens
aggtatttaagactga

SEQ ID NO: 5842153 - DNA, 20 bp, Homo sapiens
aggtatttaagactgataat

SEQ ID NO: 5842154 - DNA, 14 bp, Homo sapiens
aggtatttcaaaac

SEQ ID NO: 5842155 - DNA, 20 bp, Homo sapiens
aggtatttcgaaactgccaa

SEQ ID NO: 5842156 - DNA, 14 bp, Homo sapiens
aggtatttctccag

SEQ ID NO: 5842157 - DNA, 13 bp, Homo sapiens
aggtatttgaaaa

SEQ ID NO: 5842158 - DNA, 17 bp, Homo sapiens
aggtattttaactgtgt

SEQ ID NO: 5842159 - DNA, 18 bp, Homo sapiens
aggtattttgtagatgtg

SEQ ID NO: 5842160 - DNA, 19 bp, Homo sapiens
aggtattttgtagatgtga

SEQ ID NO: 5842161 - DNA, 20 bp, Homo sapiens
aggtatttttccaatcacag

SEQ ID NO: 5842162 - DNA, 19 bp, Homo sapiens
aggtatttttttaaatcaa

SEQ ID NO: 5842163 - DNA, 15 bp, Homo sapiens
aggtcaaacaggctg

SEQ ID NO: 5842164 - DNA, 19 bp, Homo sapiens
aggtcaaacaggctgtaat

SEQ ID NO: 5842165 - DNA, 21 bp, Homo sapiens
aggtcaaacccaagttagttc

SEQ ID NO: 5842166 - DNA, 20 bp, Homo sapiens
aggtcaaactaattctcaca

SEQ ID NO: 5842167 - DNA, 21 bp, Homo sapiens
aggtcaaactaattctcacat

SEQ ID NO: 5842168 - DNA, 14 bp, Homo sapiens
aggtcaacacaggt

SEQ ID NO: 5842169 - DNA, 14 bp, Homo sapiens
aggtcaacagaatg

SEQ ID NO: 5842170 - DNA, 17 bp, Homo sapiens
aggtcaacagaatgaaa

SEQ ID NO: 5842171 - DNA, 14 bp, Homo sapiens
aggtcaacattgtt

SEQ ID NO: 5842172 - DNA, 17 bp, Homo sapiens
aggtcaagaacatgcaa

SEQ ID NO: 5842173 - DNA, 19 bp, Homo sapiens
aggtcaagaagaagatgga

SEQ ID NO: 5842174 - DNA, 16 bp, Homo sapiens
aggtcaaggaaggaaa

SEQ ID NO: 5842175 - DNA, 17 bp, Homo sapiens
aggtcaaggaaggaaaa

SEQ ID NO: 5842176 - DNA, 19 bp, Homo sapiens
aggtcaaggcctgtccctg

SEQ ID NO: 5842177 - DNA, 21 bp, Homo sapiens
aggtgcctcagttttccttct

SEQ ID NO: 5842178 - DNA, 22 bp, Homo sapiens
aggtgcctcagttttccttctg

SEQ ID NO: 5842179 - DNA, 16 bp, Homo sapiens
aggtgcctcatagcat

SEQ ID NO: 5842180 - DNA, 21 bp, Homo sapiens
aggtgcctcatagcatagcca

SEQ ID NO: 5842181 - DNA, 11 bp, Homo sapiens
aggtgcctcca

SEQ ID NO: 5842182 - DNA, 12 bp, Homo sapiens
aggtgcctccag

SEQ ID NO: 5842183 - DNA, 14 bp, Homo sapiens
aggtgcctccaggt

SEQ ID NO: 5842184 - DNA, 15 bp, Homo sapiens
aggtgcctccaggtg

SEQ ID NO: 5842185 - DNA, 23 bp, Homo sapiens
aggtgcctcccagccctgcccag

SEQ ID NO: 5842186 - DNA, 22 bp, Homo sapiens
aggtgcctcccagtggcctggc

SEQ ID NO: 5842187 - DNA, 13 bp, Homo sapiens
aggtgcctcctga

SEQ ID NO: 5842188 - DNA, 15 bp, Homo sapiens
aggtgcctcctgtct

SEQ ID NO: 5842189 - DNA, 21 bp, Homo sapiens
aggtgcctgagagcagaatga

SEQ ID NO: 5842190 - DNA, 16 bp, Homo sapiens
aggtgcctgagctggg

SEQ ID NO: 5842191 - DNA, 12 bp, Homo sapiens
aggtgcctgcca

SEQ ID NO: 5842192 - DNA, 21 bp, Homo sapiens
aggtgcctgccatagccagga

SEQ ID NO: 5842193 - DNA, 12 bp, Homo sapiens
aggtgcctggcc

SEQ ID NO: 5842194 - DNA, 20 bp, Homo sapiens
aggtgcctggcttgctgtgg

SEQ ID NO: 5842195 - DNA, 14 bp, Homo sapiens
aggtgcctgggagg

SEQ ID NO: 5842196 - DNA, 18 bp, Homo sapiens
aggtgcctgggaggagtg

SEQ ID NO: 5842197 - DNA, 19 bp, Homo sapiens
aggtgcctggggctggctg

SEQ ID NO: 5842198 - DNA, 20 bp, Homo sapiens
aggtgcctggggctggctgc

SEQ ID NO: 5842199 - DNA, 18 bp, Homo sapiens
aggtgcctggtgggccac

SEQ ID NO: 5842200 - DNA, 11 bp, Homo sapiens
aggtgcctgtg

SEQ ID NO: 5842201 - DNA, 17 bp, Homo sapiens
aggtgcctgtgaggcag

SEQ ID NO: 5842202 - DNA, 20 bp, Homo sapiens
aggtgcctgtgaggcagggg

SEQ ID NO: 5842203 - DNA, 21 bp, Homo sapiens
aggtgcctgtgaggcaggggc

SEQ ID NO: 5842204 - DNA, 11 bp, Homo sapiens
aggtgccttct

SEQ ID NO: 5842205 - DNA, 22 bp, Homo sapiens
aggtgccttcttcagggcctgg

SEQ ID NO: 5842206 - DNA, 21 bp, Homo sapiens
aggtgccttggagggtcccaa

SEQ ID NO: 5842207 - DNA, 23 bp, Homo sapiens
aggtgccttggagggtcccaagc

SEQ ID NO: 5842208 - DNA, 22 bp, Homo sapiens
aggtgcgctcacctcagagcag

SEQ ID NO: 5842209 - DNA, 19 bp, Homo sapiens
aggtgcgtgttcagcagaa

SEQ ID NO: 5842210 - DNA, 15 bp, Homo sapiens
aggtgctaaaaggaa

SEQ ID NO: 5842211 - DNA, 15 bp, Homo sapiens
aggtgctaaatctgc

SEQ ID NO: 5842212 - DNA, 15 bp, Homo sapiens
aggtgctaaattgtc

SEQ ID NO: 5842213 - DNA, 15 bp, Homo sapiens
aggtgctaacataga

SEQ ID NO: 5842214 - DNA, 21 bp, Homo sapiens
aggtgctacaaaaacacagca

SEQ ID NO: 5842215 - DNA, 24 bp, Homo sapiens
aggtgctacaaaaacacagcaagg

SEQ ID NO: 5842216 - DNA, 19 bp, Homo sapiens
aggtgctaggaacactcct

SEQ ID NO: 5842217 - DNA, 19 bp, Homo sapiens
aggtgctagggtgcctgct

SEQ ID NO: 5842218 - DNA, 22 bp, Homo sapiens
aggtgctagggtgcctgctctc

SEQ ID NO: 5842219 - DNA, 19 bp, Homo sapiens
aggtgctatgaagccaact

SEQ ID NO: 5842220 - DNA, 17 bp, Homo sapiens
aggtgctattgttactc

SEQ ID NO: 5842221 - DNA, 17 bp, Homo sapiens
aggtgctcaaaatgcaa

SEQ ID NO: 5842222 - DNA, 16 bp, Homo sapiens
aggtgctcaaagatgt

SEQ ID NO: 5842223 - DNA, 18 bp, Homo sapiens
aggtgctcaaagatgtac

SEQ ID NO: 5842224 - DNA, 11 bp, Homo sapiens
aggtgctcaga

SEQ ID NO: 5842225 - DNA, 15 bp, Homo sapiens
aggtgctcagcccag

SEQ ID NO: 5842226 - DNA, 15 bp, Homo sapiens
aggtgctcatgctgc

SEQ ID NO: 5842227 - DNA, 17 bp, Homo sapiens
aggtgctcatgctgctc

SEQ ID NO: 5842228 - DNA, 15 bp, Homo sapiens
aggtgctcattggct

SEQ ID NO: 5842229 - DNA, 18 bp, Homo sapiens
aggtgctgaactgtgcat

SEQ ID NO: 5842230 - DNA, 20 bp, Homo sapiens
aggtgctgagcttagccttg

SEQ ID NO: 5842231 - DNA, 21 bp, Homo sapiens
aggtgctgatctgtggtctac

SEQ ID NO: 5842232 - DNA, 23 bp, Homo sapiens
aggtgctgatgtcaaagtgtaac

SEQ ID NO: 5842233 - DNA, 17 bp, Homo sapiens
aggtgctgccatccagg

SEQ ID NO: 5842234 - DNA, 12 bp, Homo sapiens
aggtgctgcctt

SEQ ID NO: 5842235 - DNA, 13 bp, Homo sapiens
aggtgctgccttg

SEQ ID NO: 5842236 - DNA, 18 bp, Homo sapiens
aggtgctgcggcgcgggc

SEQ ID NO: 5842237 - DNA, 23 bp, Homo sapiens
aggtgctgcggcgcgggcccctc

SEQ ID NO: 5842238 - DNA, 21 bp, Homo sapiens
aggtgctgctaccctccctgc

SEQ ID NO: 5842239 - DNA, 23 bp, Homo sapiens
aggtgctgctaccctccctgctg

SEQ ID NO: 5842240 - DNA, 15 bp, Homo sapiens
aggtgctgctttgct

SEQ ID NO: 5842241 - DNA, 16 bp, Homo sapiens
aggtgctggagcactg

SEQ ID NO: 5842242 - DNA, 20 bp, Homo sapiens
aggtgctggatgctttgtca

SEQ ID NO: 5842243 - DNA, 13 bp, Homo sapiens
aggtgctggcatg

SEQ ID NO: 5842244 - DNA, 12 bp, Homo sapiens
aggtgctggccc

SEQ ID NO: 5842245 - DNA, 21 bp, Homo sapiens
aggtgctggcccagcatggaa

SEQ ID NO: 5842246 - DNA, 20 bp, Homo sapiens
aggtgctgggaatacatctg

SEQ ID NO: 5842247 - DNA, 13 bp, Homo sapiens
aggtgctgggagg

SEQ ID NO: 5842248 - DNA, 18 bp, Homo sapiens
aggtgctgggctggactg

SEQ ID NO: 5842249 - DNA, 22 bp, Homo sapiens
aggtgctgggctggactggcca

SEQ ID NO: 5842250 - DNA, 14 bp, Homo sapiens
aggtgctgtagatg

SEQ ID NO: 5842251 - DNA, 23 bp, Homo sapiens
aggtgctgtccccactgccccac

SEQ ID NO: 5842252 - DNA, 14 bp, Homo sapiens
aggtgctgtgacac

SEQ ID NO: 5842253 - DNA, 20 bp, Homo sapiens
aggtgctgtgcgccttgtag

SEQ ID NO: 5842254 - DNA, 16 bp, Homo sapiens
aggtgcttacctcaca

SEQ ID NO: 5842255 - DNA, 21 bp, Homo sapiens
aggtgcttctagttctgccag

SEQ ID NO: 5842256 - DNA, 20 bp, Homo sapiens
aggtgcttctcaccacggga

SEQ ID NO: 5842257 - DNA, 12 bp, Homo sapiens
aggtgcttgagg

SEQ ID NO: 5842258 - DNA, 18 bp, Homo sapiens
aggtgcttgatctatcta

SEQ ID NO: 5842259 - DNA, 18 bp, Homo sapiens
aggtgcttttggcagaga

SEQ ID NO: 5842260 - DNA, 21 bp, Homo sapiens
aggtggaaaaactgagacagg

SEQ ID NO: 5842261 - DNA, 15 bp, Homo sapiens
aggtggaaagagaaa

SEQ ID NO: 5842262 - DNA, 15 bp, Homo sapiens
aggtggaacaggagg

SEQ ID NO: 5842263 - DNA, 17 bp, Homo sapiens
aggtggaacaggaggaa

SEQ ID NO: 5842264 - DNA, 19 bp, Homo sapiens
aggtggaacaggaggaact

SEQ ID NO: 5842265 - DNA, 19 bp, Homo sapiens
aggtggaagaagggagaag

SEQ ID NO: 5842266 - DNA, 16 bp, Homo sapiens
aggtggaagagggctg

SEQ ID NO: 5842267 - DNA, 15 bp, Homo sapiens
aggtggaagcagagg

SEQ ID NO: 5842268 - DNA, 18 bp, Homo sapiens
aggtggaagcagaggccc

SEQ ID NO: 5842269 - DNA, 13 bp, Homo sapiens
aggtggaagccct

SEQ ID NO: 5842270 - DNA, 17 bp, Homo sapiens
aggtggaagccctcctt

SEQ ID NO: 5842271 - DNA, 23 bp, Homo sapiens
aggtggaaggaccctgtgccctc

SEQ ID NO: 5842272 - DNA, 17 bp, Homo sapiens
aggtggaattacttaaa

SEQ ID NO: 5842273 - DNA, 15 bp, Homo sapiens
aggtggacaaatgtt

SEQ ID NO: 5842274 - DNA, 21 bp, Homo sapiens
aggtggacacaacagcagtct

SEQ ID NO: 5842275 - DNA, 15 bp, Homo sapiens
aggtggaccttttaa

SEQ ID NO: 5842276 - DNA, 16 bp, Homo sapiens
aggtggacgctgcaga

SEQ ID NO: 5842277 - DNA, 16 bp, Homo sapiens
aggtggactggaaggg

SEQ ID NO: 5842278 - DNA, 21 bp, Homo sapiens
aggtggacttgtctcccagtc

SEQ ID NO: 5842279 - DNA, 19 bp, Homo sapiens
aggtggagaaaattggaac

SEQ ID NO: 5842280 - DNA, 22 bp, Homo sapiens
aggtggagaactgggatttgaa

SEQ ID NO: 5842281 - DNA, 17 bp, Homo sapiens
aggtggagagcactaga

SEQ ID NO: 5842282 - DNA, 22 bp, Homo sapiens
aggtggagagggagatgtgtga

SEQ ID NO: 5842283 - DNA, 18 bp, Homo sapiens
aggtggagcaaagtgagg

SEQ ID NO: 5842284 - DNA, 21 bp, Homo sapiens
aggtggagccaagtggtccag

SEQ ID NO: 5842285 - DNA, 15 bp, Homo sapiens
aggtggagggaagga

SEQ ID NO: 5842286 - DNA, 14 bp, Homo sapiens
aggtggagggaggg

SEQ ID NO: 5842287 - DNA, 20 bp, Homo sapiens
aggtggagggcacagccctc

SEQ ID NO: 5842288 - DNA, 16 bp, Homo sapiens
aggtggaggtgccagg

SEQ ID NO: 5842289 - DNA, 17 bp, Homo sapiens
aggtggaggtgccagga

SEQ ID NO: 5842290 - DNA, 20 bp, Homo sapiens
aggtggaggttgcagtgagc

SEQ ID NO: 5842291 - DNA, 14 bp, Homo sapiens
aggtggagtctcat

SEQ ID NO: 5842292 - DNA, 15 bp, Homo sapiens
aggtggagtggatgc

SEQ ID NO: 5842293 - DNA, 20 bp, Homo sapiens
aggtggatactggggggcag

SEQ ID NO: 5842294 - DNA, 21 bp, Homo sapiens
aggtggatactggggggcagg

SEQ ID NO: 5842295 - DNA, 15 bp, Homo sapiens
aggtggatctatttc

SEQ ID NO: 5842296 - DNA, 18 bp, Homo sapiens
aggtggatctccttgaga

SEQ ID NO: 5842297 - DNA, 23 bp, Homo sapiens
aggtggatggccccagcacagct

SEQ ID NO: 5842298 - DNA, 20 bp, Homo sapiens
aggtggatgttatgaacagc

SEQ ID NO: 5842299 - DNA, 22 bp, Homo sapiens
aggtggatgttatgaacagctg

SEQ ID NO: 5842300 - DNA, 23 bp, Homo sapiens
aggtggatgttatgaacagctgt

SEQ ID NO: 5842301 - DNA, 17 bp, Homo sapiens
aggtggatttactgaga

SEQ ID NO: 5842302 - DNA, 19 bp, Homo sapiens
aggtggattttgtttaaaa

SEQ ID NO: 5842303 - DNA, 22 bp, Homo sapiens
aggtggcaatgcttaaactaaa

SEQ ID NO: 5842304 - DNA, 18 bp, Homo sapiens
aggtggcactagggatca

SEQ ID NO: 5842305 - DNA, 23 bp, Homo sapiens
aggtggcacttccacctccagcc

SEQ ID NO: 5842306 - DNA, 17 bp, Homo sapiens
aggtggcactttttcat

SEQ ID NO: 5842307 - DNA, 20 bp, Homo sapiens
aggtggcagggaagggtgcc

SEQ ID NO: 5842308 - DNA, 23 bp, Homo sapiens
aggtggcatcagtgtctttccac

SEQ ID NO: 5842309 - DNA, 15 bp, Homo sapiens
aggtggcatctctaa

SEQ ID NO: 5842310 - DNA, 14 bp, Homo sapiens
aggtggcatttgca

SEQ ID NO: 5842311 - DNA, 15 bp, Homo sapiens
aggtggcatttgcag

SEQ ID NO: 5842312 - DNA, 19 bp, Homo sapiens
aggtggccaagttcctcta

SEQ ID NO: 5842313 - DNA, 17 bp, Homo sapiens
aggtggccactccagac

SEQ ID NO: 5842314 - DNA, 22 bp, Homo sapiens
aggtggccaggcctgccagccc

SEQ ID NO: 5842315 - DNA, 15 bp, Homo sapiens
aggtggccagggctc

SEQ ID NO: 5842316 - DNA, 20 bp, Homo sapiens
aggtggccagggctccacgg

SEQ ID NO: 5842317 - DNA, 14 bp, Homo sapiens
aggtggccctccca

SEQ ID NO: 5842318 - DNA, 15 bp, Homo sapiens
aggtggccctcccag

SEQ ID NO: 5842319 - DNA, 18 bp, Homo sapiens
aggtggcccttcccggca

SEQ ID NO: 5842320 - DNA, 21 bp, Homo sapiens
aggtggcccttgtttacagtg

SEQ ID NO: 5842321 - DNA, 17 bp, Homo sapiens
aggtggccgcccctgag

SEQ ID NO: 5842322 - DNA, 18 bp, Homo sapiens
aggtggcctaaggctgct

SEQ ID NO: 5842323 - DNA, 13 bp, Homo sapiens
aggtggcctctgc

SEQ ID NO: 5842324 - DNA, 14 bp, Homo sapiens
aggtggcctgcgtc

SEQ ID NO: 5842325 - DNA, 20 bp, Homo sapiens
aggtggcgccccctggtggg

SEQ ID NO: 5842326 - DNA, 18 bp, Homo sapiens
aggtggcgtgagaggcaa

SEQ ID NO: 5842327 - DNA, 19 bp, Homo sapiens
aggtggctaagggggacca

SEQ ID NO: 5842328 - DNA, 15 bp, Homo sapiens
aggtggctctccagt

SEQ ID NO: 5842329 - DNA, 19 bp, Homo sapiens
aggtggctctccagttagt

SEQ ID NO: 5842330 - DNA, 21 bp, Homo sapiens
aggtggctgacccagtccctg

SEQ ID NO: 5842331 - DNA, 22 bp, Homo sapiens
aggtggctgacccagtccctgg

SEQ ID NO: 5842332 - DNA, 15 bp, Homo sapiens
aggtggctgagcccc

SEQ ID NO: 5842333 - DNA, 12 bp, Homo sapiens
aggtggctgcct

SEQ ID NO: 5842334 - DNA, 17 bp, Homo sapiens
aggtggctgcctggagc

SEQ ID NO: 5842335 - DNA, 13 bp, Homo sapiens
aggtggctgcgcc

SEQ ID NO: 5842336 - DNA, 19 bp, Homo sapiens
aggtggcttctcacggcct

SEQ ID NO: 5842337 - DNA, 16 bp, Homo sapiens
aggtggcttgagctag

SEQ ID NO: 5842338 - DNA, 23 bp, Homo sapiens
aggtgggaaatggtatgagctga

SEQ ID NO: 5842339 - DNA, 21 bp, Homo sapiens
aggtgggacttagcagtgagt

SEQ ID NO: 5842340 - DNA, 11 bp, Homo sapiens
aggtgggagag

SEQ ID NO: 5842341 - DNA, 11 bp, Homo sapiens
aggtgggagat

SEQ ID NO: 5842342 - DNA, 15 bp, Homo sapiens
aggtgggagatggag

SEQ ID NO: 5842343 - DNA, 16 bp, Homo sapiens
aggtgggagatggagg

SEQ ID NO: 5842344 - DNA, 19 bp, Homo sapiens
aggtgggagatttggaata

SEQ ID NO: 5842345 - DNA, 16 bp, Homo sapiens
aggtgggagcaggaga

SEQ ID NO: 5842346 - DNA, 23 bp, Homo sapiens
aggtgggaggaaagggcctggcc

SEQ ID NO: 5842347 - DNA, 12 bp, Homo sapiens
aggtgggaggat

SEQ ID NO: 5842348 - DNA, 14 bp, Homo sapiens
aggtgggaggccag

SEQ ID NO: 5842349 - DNA, 22 bp, Homo sapiens
aggtgggaggcccctggtggca

SEQ ID NO: 5842350 - DNA, 22 bp, Homo sapiens
aggtgggatatcacttccatga

SEQ ID NO: 5842351 - DNA, 16 bp, Homo sapiens
aggtgggatcctccag

SEQ ID NO: 5842352 - DNA, 18 bp, Homo sapiens
aggtgggatcctccaggt

SEQ ID NO: 5842353 - DNA, 17 bp, Homo sapiens
aggtgggattacaggtg

SEQ ID NO: 5842354 - DNA, 22 bp, Homo sapiens
aggttgccccttccccatctcc

SEQ ID NO: 5842355 - DNA, 17 bp, Homo sapiens
aggttgccgtgagccaa

SEQ ID NO: 5842356 - DNA, 18 bp, Homo sapiens
aggttgcctcaacagcag

SEQ ID NO: 5842357 - DNA, 20 bp, Homo sapiens
aggttgcctcaacagcagga

SEQ ID NO: 5842358 - DNA, 22 bp, Homo sapiens
aggttgcctcaacagcaggagg

SEQ ID NO: 5842359 - DNA, 24 bp, Homo sapiens
aggttgctggttgctgtgtggttt

SEQ ID NO: 5842360 - DNA, 12 bp, Homo sapiens
aggttgctgttg

SEQ ID NO: 5842361 - DNA, 14 bp, Homo sapiens
aggttgctgttgtg

SEQ ID NO: 5842362 - DNA, 21 bp, Homo sapiens
aggttgctttcccaccctggg

SEQ ID NO: 5842363 - DNA, 18 bp, Homo sapiens
aggttggaaaagaaatca

SEQ ID NO: 5842364 - DNA, 15 bp, Homo sapiens
aggttggaagagaat

SEQ ID NO: 5842365 - DNA, 17 bp, Homo sapiens
aggttggaagagaatca

SEQ ID NO: 5842366 - DNA, 19 bp, Homo sapiens
aggttggaagctagctccc

SEQ ID NO: 5842367 - DNA, 16 bp, Homo sapiens
aggttggacagccccc

SEQ ID NO: 5842368 - DNA, 18 bp, Homo sapiens
aggttggacagccccctt

SEQ ID NO: 5842369 - DNA, 20 bp, Homo sapiens
aggttggacagcccccttcg

SEQ ID NO: 5842370 - DNA, 22 bp, Homo sapiens
aggttggagatgacagaaatat

SEQ ID NO: 5842371 - DNA, 15 bp, Homo sapiens
aggttggagcccagg

SEQ ID NO: 5842372 - DNA, 16 bp, Homo sapiens
aggttggagcccaggg

SEQ ID NO: 5842373 - DNA, 15 bp, Homo sapiens
aggttggagctttgc

SEQ ID NO: 5842374 - DNA, 15 bp, Homo sapiens
aggttggatggatgg

SEQ ID NO: 5842375 - DNA, 20 bp, Homo sapiens
aggttggatgggagtgggca

SEQ ID NO: 5842376 - DNA, 15 bp, Homo sapiens
aggttggcgggggca

SEQ ID NO: 5842377 - DNA, 15 bp, Homo sapiens
aggttggctctgcca

SEQ ID NO: 5842378 - DNA, 19 bp, Homo sapiens
aggttggctctgccagtcc

SEQ ID NO: 5842379 - DNA, 21 bp, Homo sapiens
aggttggctctgccagtcctg

SEQ ID NO: 5842380 - DNA, 19 bp, Homo sapiens
aggttgggaacatgctgga

SEQ ID NO: 5842381 - DNA, 23 bp, Homo sapiens
aggttgggaaggcacctgctccc

SEQ ID NO: 5842382 - DNA, 16 bp, Homo sapiens
aggttgggaggctgtg

SEQ ID NO: 5842383 - DNA, 17 bp, Homo sapiens
aggttgggaggctgtgg

SEQ ID NO: 5842384 - DNA, 14 bp, Homo sapiens
aggttgggatggga

SEQ ID NO: 5842385 - DNA, 20 bp, Homo sapiens
aggttgggccatactggcct

SEQ ID NO: 5842386 - DNA, 22 bp, Homo sapiens
aggttgggtgctgctaattctt

SEQ ID NO: 5842387 - DNA, 20 bp, Homo sapiens
aggttgggttagcaatattt

SEQ ID NO: 5842388 - DNA, 13 bp, Homo sapiens
aggttggtgactg

SEQ ID NO: 5842389 - DNA, 20 bp, Homo sapiens
aggttggtgactgaaacatt

SEQ ID NO: 5842390 - DNA, 14 bp, Homo sapiens
aggttggtgggggg

SEQ ID NO: 5842391 - DNA, 21 bp, Homo sapiens
aggttggtgtggagttggggc

SEQ ID NO: 5842392 - DNA, 16 bp, Homo sapiens
aggttggttccttggg

SEQ ID NO: 5842393 - DNA, 22 bp, Homo sapiens
aggttggtttggggagacaggt

SEQ ID NO: 5842394 - DNA, 12 bp, Homo sapiens
aggttggttttg

SEQ ID NO: 5842395 - DNA, 17 bp, Homo sapiens
aggttgtagtaaagaaa

SEQ ID NO: 5842396 - DNA, 18 bp, Homo sapiens
aggttgtagtgagccaag

SEQ ID NO: 5842397 - DNA, 17 bp, Homo sapiens
aggttgtcactgagaag

SEQ ID NO: 5842398 - DNA, 21 bp, Homo sapiens
aggttgtgaaataatttttaa

SEQ ID NO: 5842399 - DNA, 23 bp, Homo sapiens
aggttgtggatgctccagggcag

SEQ ID NO: 5842400 - DNA, 24 bp, Homo sapiens
aggttgtggatgctccagggcagc

SEQ ID NO: 5842401 - DNA, 14 bp, Homo sapiens
aggttgtggggagg

SEQ ID NO: 5842402 - DNA, 15 bp, Homo sapiens
aggttgtggggaggc

SEQ ID NO: 5842403 - DNA, 24 bp, Homo sapiens
aggttgtggggaggctgcactgga

SEQ ID NO: 5842404 - DNA, 14 bp, Homo sapiens
aggttgtggggcct

SEQ ID NO: 5842405 - DNA, 16 bp, Homo sapiens
aggttgttagaaaaat

SEQ ID NO: 5842406 - DNA, 15 bp, Homo sapiens
aggttgttatttagg

SEQ ID NO: 5842407 - DNA, 23 bp, Homo sapiens
aggttgttctgtataaaatgcaa

SEQ ID NO: 5842408 - DNA, 20 bp, Homo sapiens
aggttgttttatagaggttc

SEQ ID NO: 5842409 - DNA, 18 bp, Homo sapiens
aggttgttttgttttata

SEQ ID NO: 5842410 - DNA, 14 bp, Homo sapiens
aggtttaaagagtc

SEQ ID NO: 5842411 - DNA, 20 bp, Homo sapiens
aggtttaaagagtctagatt

SEQ ID NO: 5842412 - DNA, 22 bp, Homo sapiens
aggtttaaatgaacaagagaag

SEQ ID NO: 5842413 - DNA, 17 bp, Homo sapiens
aggtttaacataaaggt

SEQ ID NO: 5842414 - DNA, 16 bp, Homo sapiens
aggtttaacatttgcc

SEQ ID NO: 5842415 - DNA, 17 bp, Homo sapiens
aggtttaaccttaaaat

SEQ ID NO: 5842416 - DNA, 15 bp, Homo sapiens
aggtttaactcagat

SEQ ID NO: 5842417 - DNA, 14 bp, Homo sapiens
aggtttaaggctga

SEQ ID NO: 5842418 - DNA, 17 bp, Homo sapiens
aggtttacaatttacaa

SEQ ID NO: 5842419 - DNA, 22 bp, Homo sapiens
aggtttacaatttacaaagtgt

SEQ ID NO: 5842420 - DNA, 23 bp, Homo sapiens
aggtttacaatttacaaagtgtg

SEQ ID NO: 5842421 - DNA, 15 bp, Homo sapiens
aggtttactgtgaag

SEQ ID NO: 5842422 - DNA, 20 bp, Homo sapiens
aggtttagaatcaagtctgt

SEQ ID NO: 5842423 - DNA, 17 bp, Homo sapiens
aggtttagcgttttaag

SEQ ID NO: 5842424 - DNA, 17 bp, Homo sapiens
aggtttagtgaaaaact

SEQ ID NO: 5842425 - DNA, 12 bp, Homo sapiens
aggtttatgaca

SEQ ID NO: 5842426 - DNA, 22 bp, Homo sapiens
aggtttatgacagtaattgtgt

SEQ ID NO: 5842427 - DNA, 22 bp, Homo sapiens
aggtttatttatctgagcaata

SEQ ID NO: 5842428 - DNA, 13 bp, Homo sapiens
aggtttcaaagat

SEQ ID NO: 5842429 - DNA, 12 bp, Homo sapiens
aggtttcaatgc

SEQ ID NO: 5842430 - DNA, 19 bp, Homo sapiens
aggtttcactattcctatg

SEQ ID NO: 5842431 - DNA, 17 bp, Homo sapiens
aggtttcactgttcatg

SEQ ID NO: 5842432 - DNA, 20 bp, Homo sapiens
aggtttcagatgaggtcaac

SEQ ID NO: 5842433 - DNA, 19 bp, Homo sapiens
aggtttcaggaagttgcca

SEQ ID NO: 5842434 - DNA, 12 bp, Homo sapiens
aggtttcatact

SEQ ID NO: 5842435 - DNA, 21 bp, Homo sapiens
aggtttcatactctagatttt

SEQ ID NO: 5842436 - DNA, 15 bp, Homo sapiens
aggtttcatttctta

SEQ ID NO: 5842437 - DNA, 16 bp, Homo sapiens
aggtttcgatatttat

SEQ ID NO: 5842438 - DNA, 22 bp, Homo sapiens
aggtttcgatatttattgatgt

SEQ ID NO: 5842439 - DNA, 17 bp, Homo sapiens
aggtttcgtttctgtat

SEQ ID NO: 5842440 - DNA, 19 bp, Homo sapiens
aggtttctccttgaagcaa

SEQ ID NO: 5842441 - DNA, 16 bp, Homo sapiens
aggtttctctccctcc

SEQ ID NO: 5842442 - DNA, 13 bp, Homo sapiens
aggtttctctctt

SEQ ID NO: 5842443 - DNA, 17 bp, Homo sapiens
aggtttctctcttccct

SEQ ID NO: 5842444 - DNA, 20 bp, Homo sapiens
aggtttctctcttcccttct

SEQ ID NO: 5842445 - DNA, 14 bp, Homo sapiens
aggtttctctgcct

SEQ ID NO: 5842446 - DNA, 20 bp, Homo sapiens
aggtttctggacaagaagag

SEQ ID NO: 5842447 - DNA, 22 bp, Homo sapiens
aggtttctggtctctaggctgg

SEQ ID NO: 5842448 - DNA, 13 bp, Homo sapiens
aggtttcttctct

SEQ ID NO: 5842449 - DNA, 14 bp, Homo sapiens
aggtttcttgcttc

SEQ ID NO: 5842450 - DNA, 12 bp, Homo sapiens
aggtttgaatct

SEQ ID NO: 5842451 - DNA, 15 bp, Homo sapiens
aggtttgaccaggaa

SEQ ID NO: 5842452 - DNA, 22 bp, Homo sapiens
aggtttgatgcctgtgaagaac

SEQ ID NO: 5842453 - DNA, 15 bp, Homo sapiens
aggtttgcagatatt

SEQ ID NO: 5842454 - DNA, 18 bp, Homo sapiens
aggtttgcagatattctc

SEQ ID NO: 5842455 - DNA, 16 bp, Homo sapiens
aggtttgccagtgaag

SEQ ID NO: 5842456 - DNA, 19 bp, Homo sapiens
aggtttgccagtgaagact

SEQ ID NO: 5842457 - DNA, 18 bp, Homo sapiens
aggtttgccctgcctgca

SEQ ID NO: 5842458 - DNA, 19 bp, Homo sapiens
aggtttgctcctagaactg

SEQ ID NO: 5842459 - DNA, 14 bp, Homo sapiens
aggtttgctgtgtc

SEQ ID NO: 5842460 - DNA, 18 bp, Homo sapiens
aggtttggaaaactaact

SEQ ID NO: 5842461 - DNA, 13 bp, Homo sapiens
aggtttggaagag

SEQ ID NO: 5842462 - DNA, 20 bp, Homo sapiens
aggtttggagccgggaaagc

SEQ ID NO: 5842463 - DNA, 20 bp, Homo sapiens
aggtttggctagttctctta

SEQ ID NO: 5842464 - DNA, 16 bp, Homo sapiens
aggtttggctcctgcc

SEQ ID NO: 5842465 - DNA, 20 bp, Homo sapiens
aggtttggctcctgcccact

SEQ ID NO: 5842466 - DNA, 16 bp, Homo sapiens
aggtttgggacccctg

SEQ ID NO: 5842467 - DNA, 21 bp, Homo sapiens
aggtttgggacccctggtggt

SEQ ID NO: 5842468 - DNA, 23 bp, Homo sapiens
aggtttggggagggggaagagaa

SEQ ID NO: 5842469 - DNA, 22 bp, Homo sapiens
aggtttggtgtgtggagatgca

SEQ ID NO: 5842470 - DNA, 20 bp, Homo sapiens
aggtttggtttttttgtaca

SEQ ID NO: 5842471 - DNA, 21 bp, Homo sapiens
aggtttgtcccagtcagaaat

SEQ ID NO: 5842472 - DNA, 10 bp, Homo sapiens
aggtttgtga

SEQ ID NO: 5842473 - DNA, 15 bp, Homo sapiens
aggtttgtgttttct

SEQ ID NO: 5842474 - DNA, 18 bp, Homo sapiens
aggtttgttcctttgaag

SEQ ID NO: 5842475 - DNA, 14 bp, Homo sapiens
aggtttgtttcttg

SEQ ID NO: 5842476 - DNA, 18 bp, Homo sapiens
aggttttaaaagccttgg

SEQ ID NO: 5842477 - DNA, 18 bp, Homo sapiens
aggttttaaatctgcttt

SEQ ID NO: 5842478 - DNA, 19 bp, Homo sapiens
aggttttaagctaaaatgt

SEQ ID NO: 5842479 - DNA, 21 bp, Homo sapiens
aggttttaagctaaaatgtta

SEQ ID NO: 5842480 - DNA, 17 bp, Homo sapiens
aggttttaatttagtaa

SEQ ID NO: 5842481 - DNA, 15 bp, Homo sapiens
aggttttagcattgt

SEQ ID NO: 5842482 - DNA, 15 bp, Homo sapiens
aggttttaggttcta

SEQ ID NO: 5842483 - DNA, 17 bp, Homo sapiens
aggttttaggttctaaa

SEQ ID NO: 5842484 - DNA, 20 bp, Homo sapiens
aggttttatgtgttcttcgt

SEQ ID NO: 5842485 - DNA, 20 bp, Homo sapiens
aggttttatttcatttttca

SEQ ID NO: 5842486 - DNA, 14 bp, Homo sapiens
aggttttattttgt

SEQ ID NO: 5842487 - DNA, 22 bp, Homo sapiens
aggttttcaaccggaaggaggc

SEQ ID NO: 5842488 - DNA, 15 bp, Homo sapiens
aggttttcagagaat

SEQ ID NO: 5842489 - DNA, 16 bp, Homo sapiens
aggttttcagagaatt

SEQ ID NO: 5842490 - DNA, 14 bp, Homo sapiens
aggttttctccact

SEQ ID NO: 5842491 - DNA, 20 bp, Homo sapiens
aggttttctgtgtttagcta

SEQ ID NO: 5842492 - DNA, 21 bp, Homo sapiens
aggttttgaataaaaagtgaa

SEQ ID NO: 5842493 - DNA, 16 bp, Homo sapiens
aggttttgagatttag

SEQ ID NO: 5842494 - DNA, 21 bp, Homo sapiens
aggttttgcactcttgtttct

SEQ ID NO: 5842495 - DNA, 12 bp, Homo sapiens
aggttttggtaa

SEQ ID NO: 5842496 - DNA, 12 bp, Homo sapiens
aggttttgttgt

SEQ ID NO: 5842497 - DNA, 16 bp, Homo sapiens
aggttttgtttgctat

SEQ ID NO: 5842498 - DNA, 18 bp, Homo sapiens
aggttttgtttgctatct

SEQ ID NO: 5842499 - DNA, 21 bp, Homo sapiens
aggttttgttttttttcagcc

SEQ ID NO: 5842500 - DNA, 14 bp, Homo sapiens
aggtttttaagcct

SEQ ID NO: 5842501 - DNA, 22 bp, Homo sapiens
aggtttttaggagtctgagcat

SEQ ID NO: 5842502 - DNA, 15 bp, Homo sapiens
aggtttttattagta

SEQ ID NO: 5842503 - DNA, 12 bp, Homo sapiens
aggtttttcaat

SEQ ID NO: 5842504 - DNA, 13 bp, Homo sapiens
aggtttttcaatt

SEQ ID NO: 5842505 - DNA, 14 bp, Homo sapiens
aggtttttcaatta

SEQ ID NO: 5842506 - DNA, 18 bp, Homo sapiens
aggtttttcaattaaacg

SEQ ID NO: 5842507 - DNA, 21 bp, Homo sapiens
aggtttttcaattaaacggat

SEQ ID NO: 5842508 - DNA, 22 bp, Homo sapiens
aggtttttcaattaaacggatt

SEQ ID NO: 5842509 - DNA, 19 bp, Homo sapiens
aggtttttcatctgaaaag

SEQ ID NO: 5842510 - DNA, 22 bp, Homo sapiens
aggtttttcctactgtcctcag

SEQ ID NO: 5842511 - DNA, 19 bp, Homo sapiens
aggtttttctcatgtatct

SEQ ID NO: 5842512 - DNA, 23 bp, Homo sapiens
aggtttttggctgagtactggaa

SEQ ID NO: 5842513 - DNA, 13 bp, Homo sapiens
aggtttttgtaaa

SEQ ID NO: 5842514 - DNA, 16 bp, Homo sapiens
aggtttttgtaaagat

SEQ ID NO: 5842515 - DNA, 15 bp, Homo sapiens
aggtttttgtttctt

SEQ ID NO: 5842516 - DNA, 14 bp, Homo sapiens
aggtttttttaatg

SEQ ID NO: 5842517 - DNA, 18 bp, Homo sapiens
aggtttttttgtttttgt

SEQ ID NO: 5842518 - DNA, 12 bp, Homo sapiens
agtaaaaacatt

SEQ ID NO: 5842519 - DNA, 21 bp, Homo sapiens
agtaaaaagccctatgtgaaa

SEQ ID NO: 5842520 - DNA, 12 bp, Homo sapiens
agtaaaaataaa

SEQ ID NO: 5842521 - DNA, 15 bp, Homo sapiens
agtaaaaataaaatt

SEQ ID NO: 5842522 - DNA, 16 bp, Homo sapiens
agtaaaaataaactgt

SEQ ID NO: 5842523 - DNA, 12 bp, Homo sapiens
agtaaaaataca

SEQ ID NO: 5842524 - DNA, 19 bp, Homo sapiens
agtaaaaatacaaaaatta

SEQ ID NO: 5842525 - DNA, 14 bp, Homo sapiens
agtaaaaatattaa

SEQ ID NO: 5842526 - DNA, 15 bp, Homo sapiens
agtaaaaatattaac

SEQ ID NO: 5842527 - DNA, 14 bp, Homo sapiens
agtaaaaattaaaa

SEQ ID NO: 5842528 - DNA, 13 bp, Homo sapiens
agtaaaaattcat

SEQ ID NO: 5842529 - DNA, 13 bp, Homo sapiens
agtaaaacaaatg

SEQ ID NO: 5842530 - DNA, 15 bp, Homo sapiens
agtaaaacacagagg

SEQ ID NO: 5842531 - DNA, 21 bp, Homo sapiens
agtaaaacagatttgttcatt

SEQ ID NO: 5842532 - DNA, 19 bp, Homo sapiens
agtacactgcctgccttaa

SEQ ID NO: 5842533 - DNA, 19 bp, Homo sapiens
agtacactgtgtctctatg

SEQ ID NO: 5842534 - DNA, 20 bp, Homo sapiens
agtacactgtgtctctatgt

SEQ ID NO: 5842535 - DNA, 19 bp, Homo sapiens
agtacagaacagtaaagtt

SEQ ID NO: 5842536 - DNA, 12 bp, Homo sapiens
agtacagaattt

SEQ ID NO: 5842537 - DNA, 16 bp, Homo sapiens
agtacagaatttgaat

SEQ ID NO: 5842538 - DNA, 12 bp, Homo sapiens
agtacagagaag

SEQ ID NO: 5842539 - DNA, 13 bp, Homo sapiens
agtacagcggctc

SEQ ID NO: 5842540 - DNA, 22 bp, Homo sapiens
agtacagcggctcccctctgct

SEQ ID NO: 5842541 - DNA, 14 bp, Homo sapiens
agtacagggcagaa

SEQ ID NO: 5842542 - DNA, 20 bp, Homo sapiens
agtacagggcaggagctgct

SEQ ID NO: 5842543 - DNA, 21 bp, Homo sapiens
agtacaggtaaggtgagggaa

SEQ ID NO: 5842544 - DNA, 16 bp, Homo sapiens
agtacaggtactttgt

SEQ ID NO: 5842545 - DNA, 18 bp, Homo sapiens
agtacaggttttgccctg

SEQ ID NO: 5842546 - DNA, 22 bp, Homo sapiens
agtacagtagcttaaataaatt

SEQ ID NO: 5842547 - DNA, 22 bp, Homo sapiens
agtacagtatattcttgtaaat

SEQ ID NO: 5842548 - DNA, 15 bp, Homo sapiens
agtacagtcccagca

SEQ ID NO: 5842549 - DNA, 17 bp, Homo sapiens
agtacagtcccagcaca

SEQ ID NO: 5842550 - DNA, 23 bp, Homo sapiens
agtacagtcccagcacatttcct

SEQ ID NO: 5842551 - DNA, 20 bp, Homo sapiens
agtacagtgaggagggtgga

SEQ ID NO: 5842552 - DNA, 21 bp, Homo sapiens
agtacagtggttctacaatct

SEQ ID NO: 5842553 - DNA, 15 bp, Homo sapiens
agtacataaaggtga

SEQ ID NO: 5842554 - DNA, 20 bp, Homo sapiens
agtacataaagtaataactg

SEQ ID NO: 5842555 - DNA, 13 bp, Homo sapiens
agtacataattga

SEQ ID NO: 5842556 - DNA, 17 bp, Homo sapiens
agtacataattgattaa

SEQ ID NO: 5842557 - DNA, 15 bp, Homo sapiens
agtacatcacccagt

SEQ ID NO: 5842558 - DNA, 16 bp, Homo sapiens
agtacatcacccagtg

SEQ ID NO: 5842559 - DNA, 16 bp, Homo sapiens
agtacatcttgtgcat

SEQ ID NO: 5842560 - DNA, 17 bp, Homo sapiens
agtacatgaagagcagc

SEQ ID NO: 5842561 - DNA, 21 bp, Homo sapiens
agtacatgacccggatgaact

SEQ ID NO: 5842562 - DNA, 22 bp, Homo sapiens
agtacatgataaatgatagaca

SEQ ID NO: 5842563 - DNA, 13 bp, Homo sapiens
agtacatgcagaa

SEQ ID NO: 5842564 - DNA, 22 bp, Homo sapiens
agtacatggaagaagtatattt

SEQ ID NO: 5842565 - DNA, 14 bp, Homo sapiens
agtacatggagctc

SEQ ID NO: 5842566 - DNA, 17 bp, Homo sapiens
agtacattactaaatat

SEQ ID NO: 5842567 - DNA, 19 bp, Homo sapiens
agtacattactaaatatat

SEQ ID NO: 5842568 - DNA, 18 bp, Homo sapiens
agtacattcatctggagg

SEQ ID NO: 5842569 - DNA, 18 bp, Homo sapiens
agtacattctaaagagag

SEQ ID NO: 5842570 - DNA, 20 bp, Homo sapiens
agtacattctcagtttttct

SEQ ID NO: 5842571 - DNA, 12 bp, Homo sapiens
agtacattgctt

SEQ ID NO: 5842572 - DNA, 19 bp, Homo sapiens
agtacattgcttaaaatat

SEQ ID NO: 5842573 - DNA, 22 bp, Homo sapiens
agtacattgcttaaaatatata

SEQ ID NO: 5842574 - DNA, 15 bp, Homo sapiens
agtacattgtgccct

SEQ ID NO: 5842575 - DNA, 17 bp, Homo sapiens
agtacattgtgcccttg

SEQ ID NO: 5842576 - DNA, 13 bp, Homo sapiens
agtacatttaaat

SEQ ID NO: 5842577 - DNA, 15 bp, Homo sapiens
agtacatttaaattt

SEQ ID NO: 5842578 - DNA, 21 bp, Homo sapiens
agtacatttaaattttttggc

SEQ ID NO: 5842579 - DNA, 21 bp, Homo sapiens
agtacatttaatacagcagtg

SEQ ID NO: 5842580 - DNA, 12 bp, Homo sapiens
agtacatttttg

SEQ ID NO: 5842581 - DNA, 13 bp, Homo sapiens
agtacattttttg

SEQ ID NO: 5842582 - DNA, 20 bp, Homo sapiens
agtacattttttgaaatgct

SEQ ID NO: 5842583 - DNA, 19 bp, Homo sapiens
agtaccaaagttttatcaa

SEQ ID NO: 5842584 - DNA, 16 bp, Homo sapiens
agtaccaactgagcca

SEQ ID NO: 5842585 - DNA, 17 bp, Homo sapiens
agtaccaatgctgttgt

SEQ ID NO: 5842586 - DNA, 22 bp, Homo sapiens
agtaccaatgggaagcagggaa

SEQ ID NO: 5842587 - DNA, 13 bp, Homo sapiens
agtaccacactga

SEQ ID NO: 5842588 - DNA, 22 bp, Homo sapiens
agtaccagaagccggcggagct

SEQ ID NO: 5842589 - DNA, 15 bp, Homo sapiens
agtaccagcatgtta

SEQ ID NO: 5842590 - DNA, 16 bp, Homo sapiens
agtaccagccccaccc

SEQ ID NO: 5842591 - DNA, 19 bp, Homo sapiens
agtaccaggccgtttgctt

SEQ ID NO: 5842592 - DNA, 20 bp, Homo sapiens
agtaccaggccgtttgcttt

SEQ ID NO: 5842593 - DNA, 23 bp, Homo sapiens
agtaccagtaggggcttataata

SEQ ID NO: 5842594 - DNA, 15 bp, Homo sapiens
agtaccatagaacag

SEQ ID NO: 5842595 - DNA, 23 bp, Homo sapiens
agtaccatagtaccatttataca

SEQ ID NO: 5842596 - DNA, 15 bp, Homo sapiens
agtaccatcccactg

SEQ ID NO: 5842597 - DNA, 21 bp, Homo sapiens
agtacccaaccaaagatgctt

SEQ ID NO: 5842598 - DNA, 22 bp, Homo sapiens
agtacccaccaccttcttctcc

SEQ ID NO: 5842599 - DNA, 17 bp, Homo sapiens
agtacccacctgagctt

SEQ ID NO: 5842600 - DNA, 14 bp, Homo sapiens
agtacccagcctat

SEQ ID NO: 5842601 - DNA, 22 bp, Homo sapiens
agtacccatgggaataatagac

SEQ ID NO: 5842602 - DNA, 16 bp, Homo sapiens
agtacccccctgagag

SEQ ID NO: 5842603 - DNA, 13 bp, Homo sapiens
agtacccctggta

SEQ ID NO: 5842604 - DNA, 23 bp, Homo sapiens
agtacccgctacaattctgcaga

SEQ ID NO: 5842605 - DNA, 19 bp, Homo sapiens
agtacccgttcacattttt

SEQ ID NO: 5842606 - DNA, 14 bp, Homo sapiens
agtaccctagcctc

SEQ ID NO: 5842607 - DNA, 16 bp, Homo sapiens
agtaccctctcagctc

SEQ ID NO: 5842608 - DNA, 19 bp, Homo sapiens
agtaccctctcagctccag

SEQ ID NO: 5842609 - DNA, 16 bp, Homo sapiens
agtaccctgcaggcca

SEQ ID NO: 5842610 - DNA, 20 bp, Homo sapiens
agtaccctgcaggccaggcc

SEQ ID NO: 5842611 - DNA, 15 bp, Homo sapiens
agtacctataaagta

SEQ ID NO: 5842612 - DNA, 23 bp, Homo sapiens
agtacctataaagtaaagctaaa

SEQ ID NO: 5842613 - DNA, 15 bp, Homo sapiens
agtacctcctgcccc

SEQ ID NO: 5842614 - DNA, 23 bp, Homo sapiens
agtacctctcaagctagtgtttc

SEQ ID NO: 5842615 - DNA, 23 bp, Homo sapiens
agtacctcttttcccatatacaa

SEQ ID NO: 5842616 - DNA, 13 bp, Homo sapiens
agtacctgagggt

SEQ ID NO: 5842617 - DNA, 15 bp, Homo sapiens
agtacctgcaaaaat

SEQ ID NO: 5842618 - DNA, 12 bp, Homo sapiens
agtacctggagg

SEQ ID NO: 5842619 - DNA, 18 bp, Homo sapiens
agtacctgggcaagctgg

SEQ ID NO: 5842620 - DNA, 22 bp, Homo sapiens
agtacctgggtccccagccctt

SEQ ID NO: 5842621 - DNA, 17 bp, Homo sapiens
agtacctgtagtgagaa

SEQ ID NO: 5842622 - DNA, 18 bp, Homo sapiens
agtacctgtagtgagaaa

SEQ ID NO: 5842623 - DNA, 19 bp, Homo sapiens
agtacctgtccaagacagg

SEQ ID NO: 5842624 - DNA, 23 bp, Homo sapiens
agtaccttgaactcttagtgatt

SEQ ID NO: 5842625 - DNA, 14 bp, Homo sapiens
agtaccttgcttct

SEQ ID NO: 5842626 - DNA, 20 bp, Homo sapiens
agtacctttcctacattttc

SEQ ID NO: 5842627 - DNA, 14 bp, Homo sapiens
agtacctttgtcac

SEQ ID NO: 5842628 - DNA, 15 bp, Homo sapiens
agtacctttgtcaca

SEQ ID NO: 5842629 - DNA, 21 bp, Homo sapiens
agtacgagccccacagagcag

SEQ ID NO: 5842630 - DNA, 19 bp, Homo sapiens
agtacggatttgtccaaat

SEQ ID NO: 5842631 - DNA, 15 bp, Homo sapiens
agtacggctgctgca

SEQ ID NO: 5842632 - DNA, 16 bp, Homo sapiens
agtacggctgctgcac

SEQ ID NO: 5842633 - DNA, 18 bp, Homo sapiens
agtacgtcctgcctggca

SEQ ID NO: 5842634 - DNA, 19 bp, Homo sapiens
agtacgtcctgcctggcac

SEQ ID NO: 5842635 - DNA, 18 bp, Homo sapiens
agtacgtgctaacaggct

SEQ ID NO: 5842636 - DNA, 13 bp, Homo sapiens
agtacgttattgt

SEQ ID NO: 5842637 - DNA, 16 bp, Homo sapiens
agtacgttgtgcattt

SEQ ID NO: 5842638 - DNA, 13 bp, Homo sapiens
agtactaaaatta

SEQ ID NO: 5842639 - DNA, 18 bp, Homo sapiens
agtactaacacaaggaca

SEQ ID NO: 5842640 - DNA, 16 bp, Homo sapiens
agtactaacatttatt

SEQ ID NO: 5842641 - DNA, 23 bp, Homo sapiens
agtactaactcctaggaaaatac

SEQ ID NO: 5842642 - DNA, 23 bp, Homo sapiens
agtactaagacccacaaactgcc

SEQ ID NO: 5842643 - DNA, 19 bp, Homo sapiens
agtactaaggtgactttct

SEQ ID NO: 5842644 - DNA, 21 bp, Homo sapiens
agtactaaggtgactttctga

SEQ ID NO: 5842645 - DNA, 23 bp, Homo sapiens
agtactacacatttttaaattgt

SEQ ID NO: 5842646 - DNA, 14 bp, Homo sapiens
agtactagaaactg

SEQ ID NO: 5842647 - DNA, 23 bp, Homo sapiens
agtactagatgcatcactgggtg

SEQ ID NO: 5842648 - DNA, 15 bp, Homo sapiens
agtactagcaataag

SEQ ID NO: 5842649 - DNA, 17 bp, Homo sapiens
agtactaggttgtccat

SEQ ID NO: 5842650 - DNA, 14 bp, Homo sapiens
agtactatatctgt

SEQ ID NO: 5842651 - DNA, 16 bp, Homo sapiens
agtactatatctgttt

SEQ ID NO: 5842652 - DNA, 22 bp, Homo sapiens
agtactatatctgttttactgc

SEQ ID NO: 5842653 - DNA, 18 bp, Homo sapiens
agtactatgtaaatttaa

SEQ ID NO: 5842654 - DNA, 16 bp, Homo sapiens
agtactattactagta

SEQ ID NO: 5842655 - DNA, 15 bp, Homo sapiens
agtactcagaggctg

SEQ ID NO: 5842656 - DNA, 13 bp, Homo sapiens
agtactccacact

SEQ ID NO: 5842657 - DNA, 18 bp, Homo sapiens
agtactccacactgcaca

SEQ ID NO: 5842658 - DNA, 20 bp, Homo sapiens
agtactcctcacttttcaat

SEQ ID NO: 5842659 - DNA, 19 bp, Homo sapiens
agtactcctccctgggggc

SEQ ID NO: 5842660 - DNA, 17 bp, Homo sapiens
agtactccttaagaaca

SEQ ID NO: 5842661 - DNA, 18 bp, Homo sapiens
agtactctaatatacagt

SEQ ID NO: 5842662 - DNA, 19 bp, Homo sapiens
agtactctctgctctagcc

SEQ ID NO: 5842663 - DNA, 23 bp, Homo sapiens
agtactctctgctctagccagga

SEQ ID NO: 5842664 - DNA, 12 bp, Homo sapiens
agtactctttaa

SEQ ID NO: 5842665 - DNA, 19 bp, Homo sapiens
agtactgaagccaaatgaa

SEQ ID NO: 5842666 - DNA, 18 bp, Homo sapiens
agtactgacagaaagcaa

SEQ ID NO: 5842667 - DNA, 17 bp, Homo sapiens
agtactgagcagtatta

SEQ ID NO: 5842668 - DNA, 23 bp, Homo sapiens
agtactgagcagtgatattcttt

SEQ ID NO: 5842669 - DNA, 14 bp, Homo sapiens
agtactgaggtggt

SEQ ID NO: 5842670 - DNA, 22 bp, Homo sapiens
agtactgcacccagcatcacca

SEQ ID NO: 5842671 - DNA, 17 bp, Homo sapiens
agtactgctcttgtttc

SEQ ID NO: 5842672 - DNA, 14 bp, Homo sapiens
agtactgctttact

SEQ ID NO: 5842673 - DNA, 16 bp, Homo sapiens
agtactgctttactgt

SEQ ID NO: 5842674 - DNA, 18 bp, Homo sapiens
agtactggaataaacagt

SEQ ID NO: 5842675 - DNA, 19 bp, Homo sapiens
agtactggaataaacagtg

SEQ ID NO: 5842676 - DNA, 16 bp, Homo sapiens
agtactgggattacag

SEQ ID NO: 5842677 - DNA, 19 bp, Homo sapiens
agtactggtaagattgtta

SEQ ID NO: 5842678 - DNA, 21 bp, Homo sapiens
agtactggtaagattgttatt

SEQ ID NO: 5842679 - DNA, 23 bp, Homo sapiens
agtactggttactttcaaaatga

SEQ ID NO: 5842680 - DNA, 18 bp, Homo sapiens
agtactgtaataatacct

SEQ ID NO: 5842681 - DNA, 23 bp, Homo sapiens
agtactgtaataatacctcaatg

SEQ ID NO: 5842682 - DNA, 20 bp, Homo sapiens
agtactgtactttcccaggt

SEQ ID NO: 5842683 - DNA, 13 bp, Homo sapiens
agtactgtgaatc

SEQ ID NO: 5842684 - DNA, 13 bp, Homo sapiens
agtactgtgggca

SEQ ID NO: 5842685 - DNA, 17 bp, Homo sapiens
agtactgtgggcaattt

SEQ ID NO: 5842686 - DNA, 16 bp, Homo sapiens
agtactgttaagaata

SEQ ID NO: 5842687 - DNA, 12 bp, Homo sapiens
agtacttaaaag

SEQ ID NO: 5842688 - DNA, 12 bp, Homo sapiens
agtacttaacat

SEQ ID NO: 5842689 - DNA, 15 bp, Homo sapiens
agtacttacattcca

SEQ ID NO: 5842690 - DNA, 22 bp, Homo sapiens
agtacttaccagtcaatgcatt

SEQ ID NO: 5842691 - DNA, 23 bp, Homo sapiens
agtacttagctagttttattctt

SEQ ID NO: 5842692 - DNA, 17 bp, Homo sapiens
agtacttcagcaagaga

SEQ ID NO: 5842693 - DNA, 22 bp, Homo sapiens
agtacttcagcaagagagaacc

SEQ ID NO: 5842694 - DNA, 19 bp, Homo sapiens
agtacttccagatggctgc

SEQ ID NO: 5842695 - DNA, 16 bp, Homo sapiens
agtacttccctcaggc

SEQ ID NO: 5842696 - DNA, 13 bp, Homo sapiens
agtacttctaaga

SEQ ID NO: 5842697 - DNA, 14 bp, Homo sapiens
agtacttctaagag

SEQ ID NO: 5842698 - DNA, 17 bp, Homo sapiens
agtacttctccaccctg

SEQ ID NO: 5842699 - DNA, 16 bp, Homo sapiens
agtacttcttctgtaa

SEQ ID NO: 5842700 - DNA, 18 bp, Homo sapiens
agtacttcttctgtaata

SEQ ID NO: 5842701 - DNA, 23 bp, Homo sapiens
agtacttcttctgtaatatttac

SEQ ID NO: 5842702 - DNA, 18 bp, Homo sapiens
agtacttgagtgtaatgt

SEQ ID NO: 5842703 - DNA, 22 bp, Homo sapiens
agtacttgagtgtaatgtttgt

SEQ ID NO: 5842704 - DNA, 14 bp, Homo sapiens
agtacttgatttca

SEQ ID NO: 5842705 - DNA, 14 bp, Homo sapiens
agtacttgctctct

SEQ ID NO: 5842706 - DNA, 21 bp, Homo sapiens
agtacttggcccccttcagga

SEQ ID NO: 5842707 - DNA, 23 bp, Homo sapiens
agtacttggcccccttcaggagc

SEQ ID NO: 5842708 - DNA, 17 bp, Homo sapiens
agtatcttgtgcttctt

SEQ ID NO: 5842709 - DNA, 15 bp, Homo sapiens
agtatcttgtttggc

SEQ ID NO: 5842710 - DNA, 18 bp, Homo sapiens
agtatcttgtttggcctc

SEQ ID NO: 5842711 - DNA, 14 bp, Homo sapiens
agtatcttttaaaa

SEQ ID NO: 5842712 - DNA, 20 bp, Homo sapiens
agtatgaaaagctatcttaa

SEQ ID NO: 5842713 - DNA, 17 bp, Homo sapiens
agtatgaaagctggggg

SEQ ID NO: 5842714 - DNA, 18 bp, Homo sapiens
agtatgaaagctgggggt

SEQ ID NO: 5842715 - DNA, 16 bp, Homo sapiens
agtatgaaataacgca

SEQ ID NO: 5842716 - DNA, 20 bp, Homo sapiens
agtatgaaccacatggaact

SEQ ID NO: 5842717 - DNA, 14 bp, Homo sapiens
agtatgaacttgag

SEQ ID NO: 5842718 - DNA, 18 bp, Homo sapiens
agtatgaacttgagatct

SEQ ID NO: 5842719 - DNA, 14 bp, Homo sapiens
agtatgaagacact

SEQ ID NO: 5842720 - DNA, 23 bp, Homo sapiens
agtatgaagacactgtcaatgag

SEQ ID NO: 5842721 - DNA, 12 bp, Homo sapiens
agtatgaatatt

SEQ ID NO: 5842722 - DNA, 20 bp, Homo sapiens
agtatgaatattactctcaa

SEQ ID NO: 5842723 - DNA, 16 bp, Homo sapiens
agtatgaatatttcat

SEQ ID NO: 5842724 - DNA, 16 bp, Homo sapiens
agtatgaatctatgcc

SEQ ID NO: 5842725 - DNA, 21 bp, Homo sapiens
agtatgaatgatgttttagaa

SEQ ID NO: 5842726 - DNA, 13 bp, Homo sapiens
agtatgacagagg

SEQ ID NO: 5842727 - DNA, 16 bp, Homo sapiens
agtatgagaaatacag

SEQ ID NO: 5842728 - DNA, 14 bp, Homo sapiens
agtatgagccctaa

SEQ ID NO: 5842729 - DNA, 15 bp, Homo sapiens
agtatgaggcatttg

SEQ ID NO: 5842730 - DNA, 21 bp, Homo sapiens
agtatgaggcatttgtttgaa

SEQ ID NO: 5842731 - DNA, 15 bp, Homo sapiens
agtatgatgaaaata

SEQ ID NO: 5842732 - DNA, 17 bp, Homo sapiens
agtatgatggcaggaga

SEQ ID NO: 5842733 - DNA, 12 bp, Homo sapiens
agtatgcaaaat

SEQ ID NO: 5842734 - DNA, 21 bp, Homo sapiens
agtatgcaaaataaagaatat

SEQ ID NO: 5842735 - DNA, 16 bp, Homo sapiens
agtatgcaagaagaat

SEQ ID NO: 5842736 - DNA, 19 bp, Homo sapiens
agtatgcaagaagaatata

SEQ ID NO: 5842737 - DNA, 14 bp, Homo sapiens
agtatgcaatgctt

SEQ ID NO: 5842738 - DNA, 22 bp, Homo sapiens
agtatgcactaatcaatacttt

SEQ ID NO: 5842739 - DNA, 19 bp, Homo sapiens
agtatgcattattaaattg

SEQ ID NO: 5842740 - DNA, 15 bp, Homo sapiens
agtatgccttaagca

SEQ ID NO: 5842741 - DNA, 20 bp, Homo sapiens
agtatgccttaagcagaaca

SEQ ID NO: 5842742 - DNA, 21 bp, Homo sapiens
agtatgccttcctgtttaaaa

SEQ ID NO: 5842743 - DNA, 14 bp, Homo sapiens
agtatgctggcttg

SEQ ID NO: 5842744 - DNA, 16 bp, Homo sapiens
agtatgctggcttgta

SEQ ID NO: 5842745 - DNA, 17 bp, Homo sapiens
agtatgcttaagctttg

SEQ ID NO: 5842746 - DNA, 18 bp, Homo sapiens
agtatgcttaagctttgg

SEQ ID NO: 5842747 - DNA, 20 bp, Homo sapiens
agtatgcttggactgaaggg

SEQ ID NO: 5842748 - DNA, 18 bp, Homo sapiens
agtatgcttgggccctgc

SEQ ID NO: 5842749 - DNA, 17 bp, Homo sapiens
agtatggaatattcatt

SEQ ID NO: 5842750 - DNA, 21 bp, Homo sapiens
agtatggcctgacagctctgt

SEQ ID NO: 5842751 - DNA, 11 bp, Homo sapiens
agtatgggcta

SEQ ID NO: 5842752 - DNA, 18 bp, Homo sapiens
agtatgggttagggaaaa

SEQ ID NO: 5842753 - DNA, 19 bp, Homo sapiens
agtatggtacatttttcaa

SEQ ID NO: 5842754 - DNA, 23 bp, Homo sapiens
agtatggtaggggagggcaggct

SEQ ID NO: 5842755 - DNA, 22 bp, Homo sapiens
agtatggtgagagaagcctgtg

SEQ ID NO: 5842756 - DNA, 14 bp, Homo sapiens
agtatggtggctgg

SEQ ID NO: 5842757 - DNA, 17 bp, Homo sapiens
agtatggtggctgggtt

SEQ ID NO: 5842758 - DNA, 18 bp, Homo sapiens
agtatggttcaagattgt

SEQ ID NO: 5842759 - DNA, 15 bp, Homo sapiens
agtatggttctcaga

SEQ ID NO: 5842760 - DNA, 16 bp, Homo sapiens
agtatgtaaagtatgt

SEQ ID NO: 5842761 - DNA, 23 bp, Homo sapiens
agtatgtatgccttcgggaaaat

SEQ ID NO: 5842762 - DNA, 22 bp, Homo sapiens
agtatgtcagtccaataaatta

SEQ ID NO: 5842763 - DNA, 13 bp, Homo sapiens
agtatgtctgttt

SEQ ID NO: 5842764 - DNA, 14 bp, Homo sapiens
agtatgtgaagata

SEQ ID NO: 5842765 - DNA, 20 bp, Homo sapiens
agtatgtgacttttctgatt

SEQ ID NO: 5842766 - DNA, 21 bp, Homo sapiens
agtatgtgacttttctgatta

SEQ ID NO: 5842767 - DNA, 22 bp, Homo sapiens
agtatgtgagtagtcttatgta

SEQ ID NO: 5842768 - DNA, 12 bp, Homo sapiens
agtatgtgcata

SEQ ID NO: 5842769 - DNA, 21 bp, Homo sapiens
agtatgtgccaggaaactctt

SEQ ID NO: 5842770 - DNA, 22 bp, Homo sapiens
agtatgtgctatacacacacac

SEQ ID NO: 5842771 - DNA, 15 bp, Homo sapiens
agtatgtggaagtgt

SEQ ID NO: 5842772 - DNA, 19 bp, Homo sapiens
agtatgtggaagtgtgggt

SEQ ID NO: 5842773 - DNA, 18 bp, Homo sapiens
agtatgtggcaaaacata

SEQ ID NO: 5842774 - DNA, 18 bp, Homo sapiens
agtatgtgggggcttcat

SEQ ID NO: 5842775 - DNA, 20 bp, Homo sapiens
agtatgtgggggcttcatct

SEQ ID NO: 5842776 - DNA, 22 bp, Homo sapiens
agtatgtgggggcttcatctct

SEQ ID NO: 5842777 - DNA, 21 bp, Homo sapiens
agtatgtggttttgtaatttg

SEQ ID NO: 5842778 - DNA, 11 bp, Homo sapiens
agtatgtgtat

SEQ ID NO: 5842779 - DNA, 13 bp, Homo sapiens
agtatgtgtatgt

SEQ ID NO: 5842780 - DNA, 21 bp, Homo sapiens
agtatgtgtatgtacttacat

SEQ ID NO: 5842781 - DNA, 22 bp, Homo sapiens
agtatgtgtatgtacttacatg

SEQ ID NO: 5842782 - DNA, 19 bp, Homo sapiens
agtatgtgtcaactgagag

SEQ ID NO: 5842783 - DNA, 20 bp, Homo sapiens
agtatgtgtctagcaaagcc

SEQ ID NO: 5842784 - DNA, 18 bp, Homo sapiens
agtatgtgtttgtgtgtg

SEQ ID NO: 5842785 - DNA, 16 bp, Homo sapiens
agtatgttaagctctt

SEQ ID NO: 5842786 - DNA, 12 bp, Homo sapiens
agtatgttacat

SEQ ID NO: 5842787 - DNA, 21 bp, Homo sapiens
agtatgttagtgcaaattgtc

SEQ ID NO: 5842788 - DNA, 15 bp, Homo sapiens
agtatgttattcctg

SEQ ID NO: 5842789 - DNA, 21 bp, Homo sapiens
agtatgttccaaaccctcctg

SEQ ID NO: 5842790 - DNA, 16 bp, Homo sapiens
agtatgttcttgaaga

SEQ ID NO: 5842791 - DNA, 14 bp, Homo sapiens
agtatgttgtacat

SEQ ID NO: 5842792 - DNA, 15 bp, Homo sapiens
agtatgttgtcaaag

SEQ ID NO: 5842793 - DNA, 17 bp, Homo sapiens
agtatgttgtcataaca

SEQ ID NO: 5842794 - DNA, 23 bp, Homo sapiens
agtatgttgtcataacatttaaa

SEQ ID NO: 5842795 - DNA, 18 bp, Homo sapiens
agtatgttttagcatgtg

SEQ ID NO: 5842796 - DNA, 19 bp, Homo sapiens
agtattaaaatgcatattt

SEQ ID NO: 5842797 - DNA, 13 bp, Homo sapiens
agtattaaaatgt

SEQ ID NO: 5842798 - DNA, 14 bp, Homo sapiens
agtattaaactgta

SEQ ID NO: 5842799 - DNA, 14 bp, Homo sapiens
agtattaacactaa

SEQ ID NO: 5842800 - DNA, 15 bp, Homo sapiens
agtattaacttacaa

SEQ ID NO: 5842801 - DNA, 17 bp, Homo sapiens
agtattaagcagttcat

SEQ ID NO: 5842802 - DNA, 11 bp, Homo sapiens
agtattaaggg

SEQ ID NO: 5842803 - DNA, 13 bp, Homo sapiens
agtattaagggta

SEQ ID NO: 5842804 - DNA, 13 bp, Homo sapiens
agtattaaggttt

SEQ ID NO: 5842805 - DNA, 19 bp, Homo sapiens
agtattaatactacccata

SEQ ID NO: 5842806 - DNA, 17 bp, Homo sapiens
agtattacaaccatata

SEQ ID NO: 5842807 - DNA, 16 bp, Homo sapiens
agtattactagtggac

SEQ ID NO: 5842808 - DNA, 17 bp, Homo sapiens
agtattactgctgctgt

SEQ ID NO: 5842809 - DNA, 14 bp, Homo sapiens
agtattactttctg

SEQ ID NO: 5842810 - DNA, 19 bp, Homo sapiens
agtattactttctgccgct

SEQ ID NO: 5842811 - DNA, 16 bp, Homo sapiens
agtattagacttctaa

SEQ ID NO: 5842812 - DNA, 13 bp, Homo sapiens
agtattataaatt

SEQ ID NO: 5842813 - DNA, 18 bp, Homo sapiens
agtattataaattatgtt

SEQ ID NO: 5842814 - DNA, 14 bp, Homo sapiens
agtattataaattg

SEQ ID NO: 5842815 - DNA, 14 bp, Homo sapiens
agtattataccttt

SEQ ID NO: 5842816 - DNA, 19 bp, Homo sapiens
agtattatagacaaaagaa

SEQ ID NO: 5842817 - DNA, 13 bp, Homo sapiens
agtattatatgta

SEQ ID NO: 5842818 - DNA, 18 bp, Homo sapiens
agtattatctaaatgaat

SEQ ID NO: 5842819 - DNA, 23 bp, Homo sapiens
agtattatcttgttcaggaaaag

SEQ ID NO: 5842820 - DNA, 13 bp, Homo sapiens
agtattatgcctg

SEQ ID NO: 5842821 - DNA, 14 bp, Homo sapiens
agtattatttagta

SEQ ID NO: 5842822 - DNA, 23 bp, Homo sapiens
agtattatttctccatcccctcc

SEQ ID NO: 5842823 - DNA, 14 bp, Homo sapiens
agtattattttcca

SEQ ID NO: 5842824 - DNA, 18 bp, Homo sapiens
agtattattttccaaaag

SEQ ID NO: 5842825 - DNA, 19 bp, Homo sapiens
agtattcaacaatttcaat

SEQ ID NO: 5842826 - DNA, 16 bp, Homo sapiens
agtattcacatcattt

SEQ ID NO: 5842827 - DNA, 21 bp, Homo sapiens
agtattcagaaattaaaatat

SEQ ID NO: 5842828 - DNA, 22 bp, Homo sapiens
agtattcagaaattaaaatatt

SEQ ID NO: 5842829 - DNA, 23 bp, Homo sapiens
agtattcagaaattaaaatatta

SEQ ID NO: 5842830 - DNA, 15 bp, Homo sapiens
agtattcagttccaa

SEQ ID NO: 5842831 - DNA, 21 bp, Homo sapiens
agtattccaccttaaattaaa

SEQ ID NO: 5842832 - DNA, 22 bp, Homo sapiens
agtattccatttttactaaagc

SEQ ID NO: 5842833 - DNA, 20 bp, Homo sapiens
agtattcctaacctgtcaga

SEQ ID NO: 5842834 - DNA, 17 bp, Homo sapiens
agtattccttggcccag

SEQ ID NO: 5842835 - DNA, 18 bp, Homo sapiens
agtattccttggcccagc

SEQ ID NO: 5842836 - DNA, 20 bp, Homo sapiens
agtattccttggcccagcag

SEQ ID NO: 5842837 - DNA, 18 bp, Homo sapiens
agtattctaaaaaaataa

SEQ ID NO: 5842838 - DNA, 21 bp, Homo sapiens
agtattctaaagttttgcaac

SEQ ID NO: 5842839 - DNA, 23 bp, Homo sapiens
agtattctaaagttttgcaacaa

SEQ ID NO: 5842840 - DNA, 23 bp, Homo sapiens
agtattctaataagctagttgaa

SEQ ID NO: 5842841 - DNA, 16 bp, Homo sapiens
agtattctatgtaaaa

SEQ ID NO: 5842842 - DNA, 19 bp, Homo sapiens
agtattctcaaagatgcat

SEQ ID NO: 5842843 - DNA, 23 bp, Homo sapiens
agtattctcagagcatgtgtcag

SEQ ID NO: 5842844 - DNA, 23 bp, Homo sapiens
agtattctcggatagttgctatt

SEQ ID NO: 5842845 - DNA, 17 bp, Homo sapiens
agtattctgacatgtaa

SEQ ID NO: 5842846 - DNA, 13 bp, Homo sapiens
agtattctgcctt

SEQ ID NO: 5842847 - DNA, 18 bp, Homo sapiens
agtattctgtaaagctta

SEQ ID NO: 5842848 - DNA, 22 bp, Homo sapiens
agtattctgtagccaacttaaa

SEQ ID NO: 5842849 - DNA, 19 bp, Homo sapiens
agtattcttatttaatgaa

SEQ ID NO: 5842850 - DNA, 12 bp, Homo sapiens
agtattcttctc

SEQ ID NO: 5842851 - DNA, 18 bp, Homo sapiens
agtattcttgtcaaaaaa

SEQ ID NO: 5842852 - DNA, 20 bp, Homo sapiens
agtattcttttcaattatat

SEQ ID NO: 5842853 - DNA, 14 bp, Homo sapiens
agtattgaaaactt

SEQ ID NO: 5842854 - DNA, 20 bp, Homo sapiens
agtattgaaaacttcaaagc

SEQ ID NO: 5842855 - DNA, 21 bp, Homo sapiens
agtattgaaaacttcaaagct

SEQ ID NO: 5842856 - DNA, 18 bp, Homo sapiens
agtattgaagcattttat

SEQ ID NO: 5842857 - DNA, 20 bp, Homo sapiens
agtattgaagcattttataa

SEQ ID NO: 5842858 - DNA, 21 bp, Homo sapiens
agtattgaagcattttataaa

SEQ ID NO: 5842859 - DNA, 14 bp, Homo sapiens
agtattgacaaaat

SEQ ID NO: 5842860 - DNA, 20 bp, Homo sapiens
agtattgacaaaatgttatt

SEQ ID NO: 5842861 - DNA, 23 bp, Homo sapiens
agtattgacaactgcacatgaaa

SEQ ID NO: 5842862 - DNA, 21 bp, Homo sapiens
agtattgagacactgtcaaga

SEQ ID NO: 5842863 - DNA, 15 bp, Homo sapiens
agtattgagtgttct

SEQ ID NO: 5842864 - DNA, 16 bp, Homo sapiens
agtattgattctgctt

SEQ ID NO: 5842865 - DNA, 20 bp, Homo sapiens
agtattgatttaacttcatt

SEQ ID NO: 5842866 - DNA, 19 bp, Homo sapiens
agtattgcagccaaagaat

SEQ ID NO: 5842867 - DNA, 20 bp, Homo sapiens
agtattgcatctgtataagt

SEQ ID NO: 5842868 - DNA, 15 bp, Homo sapiens
agtattgccaaacat

SEQ ID NO: 5842869 - DNA, 17 bp, Homo sapiens
agtattgccaaacatta

SEQ ID NO: 5842870 - DNA, 21 bp, Homo sapiens
agtattgccacaatgcctctc

SEQ ID NO: 5842871 - DNA, 16 bp, Homo sapiens
agtattgccacctctg

SEQ ID NO: 5842872 - DNA, 18 bp, Homo sapiens
agtattgccacctctggc

SEQ ID NO: 5842873 - DNA, 19 bp, Homo sapiens
agtattggaagacttgggt

SEQ ID NO: 5842874 - DNA, 24 bp, Homo sapiens
agtattggacggtttctagcctct

SEQ ID NO: 5842875 - DNA, 14 bp, Homo sapiens
agtattgggcagga

SEQ ID NO: 5842876 - DNA, 15 bp, Homo sapiens
agtattgggcaggag

SEQ ID NO: 5842877 - DNA, 18 bp, Homo sapiens
agtattggggtctgaccc

SEQ ID NO: 5842878 - DNA, 18 bp, Homo sapiens
agtattgtaaattatatt

SEQ ID NO: 5842879 - DNA, 15 bp, Homo sapiens
agtattgtacaaagt

SEQ ID NO: 5842880 - DNA, 18 bp, Homo sapiens
agtattgtagaaagctaa

SEQ ID NO: 5842881 - DNA, 19 bp, Homo sapiens
agtattgtagaaagctaat

SEQ ID NO: 5842882 - DNA, 20 bp, Homo sapiens
agtattgtagaaagctaata

SEQ ID NO: 5842883 - DNA, 23 bp, Homo sapiens
agtattgtagaaagctaatacaa

SEQ ID NO: 5842884 - DNA, 13 bp, Homo sapiens
agtcaggagccag

SEQ ID NO: 5842885 - DNA, 18 bp, Homo sapiens
agtcaggatgaggccccg

SEQ ID NO: 5842886 - DNA, 19 bp, Homo sapiens
agtcaggatgaggccccgc

SEQ ID NO: 5842887 - DNA, 13 bp, Homo sapiens
agtcaggccaggt

SEQ ID NO: 5842888 - DNA, 16 bp, Homo sapiens
agtcaggcccggccta

SEQ ID NO: 5842889 - DNA, 15 bp, Homo sapiens
agtcaggcctgggca

SEQ ID NO: 5842890 - DNA, 15 bp, Homo sapiens
agtcaggctagctgt

SEQ ID NO: 5842891 - DNA, 19 bp, Homo sapiens
agtcaggctagctgtgctg

SEQ ID NO: 5842892 - DNA, 20 bp, Homo sapiens
agtcaggctgttggcgtgtc

SEQ ID NO: 5842893 - DNA, 18 bp, Homo sapiens
agtcaggcttctcttgct

SEQ ID NO: 5842894 - DNA, 16 bp, Homo sapiens
agtcagggacccctgc

SEQ ID NO: 5842895 - DNA, 15 bp, Homo sapiens
agtcagggacctgct

SEQ ID NO: 5842896 - DNA, 15 bp, Homo sapiens
agtcagggcacagct

SEQ ID NO: 5842897 - DNA, 23 bp, Homo sapiens
agtcagggcacagctgccctgct

SEQ ID NO: 5842898 - DNA, 14 bp, Homo sapiens
agtcagggcccaga

SEQ ID NO: 5842899 - DNA, 15 bp, Homo sapiens
agtcagggcccagag

SEQ ID NO: 5842900 - DNA, 16 bp, Homo sapiens
agtcagggcccagagg

SEQ ID NO: 5842901 - DNA, 15 bp, Homo sapiens
agtcagggcggggct

SEQ ID NO: 5842902 - DNA, 14 bp, Homo sapiens
agtcaggggcagct

SEQ ID NO: 5842903 - DNA, 16 bp, Homo sapiens
agtcaggggctctgtg

SEQ ID NO: 5842904 - DNA, 17 bp, Homo sapiens
agtcaggggtcaggtgt

SEQ ID NO: 5842905 - DNA, 23 bp, Homo sapiens
agtcaggggtcaggtgtcaggcc

SEQ ID NO: 5842906 - DNA, 18 bp, Homo sapiens
agtcagggttcacttggg

SEQ ID NO: 5842907 - DNA, 14 bp, Homo sapiens
agtcaggtccaatt

SEQ ID NO: 5842908 - DNA, 21 bp, Homo sapiens
agtcaggtgtggcggtgcgtg

SEQ ID NO: 5842909 - DNA, 21 bp, Homo sapiens
agtcaggttcaggagttagtg

SEQ ID NO: 5842910 - DNA, 20 bp, Homo sapiens
agtcagtaaacatttgtaaa

SEQ ID NO: 5842911 - DNA, 15 bp, Homo sapiens
agtcagtacccctgg

SEQ ID NO: 5842912 - DNA, 15 bp, Homo sapiens
agtcagtagccagag

SEQ ID NO: 5842913 - DNA, 16 bp, Homo sapiens
agtcagtaggagagga

SEQ ID NO: 5842914 - DNA, 18 bp, Homo sapiens
agtcagtaggagaggatg

SEQ ID NO: 5842915 - DNA, 19 bp, Homo sapiens
agtcagtaggtccaagggc

SEQ ID NO: 5842916 - DNA, 21 bp, Homo sapiens
agtcagtaggtccaagggcca

SEQ ID NO: 5842917 - DNA, 17 bp, Homo sapiens
agtcagtattcccagcc

SEQ ID NO: 5842918 - DNA, 15 bp, Homo sapiens
agtcagtattgtttt

SEQ ID NO: 5842919 - DNA, 23 bp, Homo sapiens
agtcagtcacaaaccagcctggg

SEQ ID NO: 5842920 - DNA, 21 bp, Homo sapiens
agtcagtcatgatggcaccac

SEQ ID NO: 5842921 - DNA, 21 bp, Homo sapiens
agtcagtcattcagatatgat

SEQ ID NO: 5842922 - DNA, 22 bp, Homo sapiens
agtcagtccagctcatctgcca

SEQ ID NO: 5842923 - DNA, 23 bp, Homo sapiens
agtcagtcgcctttcagcaggca

SEQ ID NO: 5842924 - DNA, 17 bp, Homo sapiens
agtcagtctctctctcc

SEQ ID NO: 5842925 - DNA, 15 bp, Homo sapiens
agtcagtctctttct

SEQ ID NO: 5842926 - DNA, 16 bp, Homo sapiens
agtcagtctctttctg

SEQ ID NO: 5842927 - DNA, 14 bp, Homo sapiens
agtcagtgatgagg

SEQ ID NO: 5842928 - DNA, 23 bp, Homo sapiens
agtcagtgcaaatgtcagataca

SEQ ID NO: 5842929 - DNA, 20 bp, Homo sapiens
agtcagtgcatttcaaggaa

SEQ ID NO: 5842930 - DNA, 20 bp, Homo sapiens
agtcagtgcccaactgttat

SEQ ID NO: 5842931 - DNA, 19 bp, Homo sapiens
agtcagtgcccatgtgtat

SEQ ID NO: 5842932 - DNA, 15 bp, Homo sapiens
agtcagtgctctcag

SEQ ID NO: 5842933 - DNA, 17 bp, Homo sapiens
agtcagtgctctcagct

SEQ ID NO: 5842934 - DNA, 18 bp, Homo sapiens
agtcagtgctggagaaat

SEQ ID NO: 5842935 - DNA, 21 bp, Homo sapiens
agtcagtgctggagaaatctt

SEQ ID NO: 5842936 - DNA, 15 bp, Homo sapiens
agtcagtgtactctg

SEQ ID NO: 5842937 - DNA, 17 bp, Homo sapiens
agtcagtgtttctttta

SEQ ID NO: 5842938 - DNA, 15 bp, Homo sapiens
agtcagttcccggag

SEQ ID NO: 5842939 - DNA, 21 bp, Homo sapiens
agtcagttcccggagcacagc

SEQ ID NO: 5842940 - DNA, 15 bp, Homo sapiens
agtcagttctctttg

SEQ ID NO: 5842941 - DNA, 23 bp, Homo sapiens
agtcagttgctcaaaaagaaatc

SEQ ID NO: 5842942 - DNA, 14 bp, Homo sapiens
agtcagtttctaca

SEQ ID NO: 5842943 - DNA, 15 bp, Homo sapiens
agtcagtttctacac

SEQ ID NO: 5842944 - DNA, 20 bp, Homo sapiens
agtcagttttttatctgggt

SEQ ID NO: 5842945 - DNA, 13 bp, Homo sapiens
agtcataaaacac

SEQ ID NO: 5842946 - DNA, 14 bp, Homo sapiens
agtcataaacagca

SEQ ID NO: 5842947 - DNA, 14 bp, Homo sapiens
agtcataaatgcat

SEQ ID NO: 5842948 - DNA, 10 bp, Homo sapiens
agtcataata

SEQ ID NO: 5842949 - DNA, 13 bp, Homo sapiens
agtcataataaat

SEQ ID NO: 5842950 - DNA, 14 bp, Homo sapiens
agtcataatgaata

SEQ ID NO: 5842951 - DNA, 14 bp, Homo sapiens
agtcataccaatga

SEQ ID NO: 5842952 - DNA, 23 bp, Homo sapiens
agtcatacctgctcctcatctgc

SEQ ID NO: 5842953 - DNA, 16 bp, Homo sapiens
agtcatagaagaacta

SEQ ID NO: 5842954 - DNA, 14 bp, Homo sapiens
agtcatatgtgaag

SEQ ID NO: 5842955 - DNA, 15 bp, Homo sapiens
agtcatatgtgaaga

SEQ ID NO: 5842956 - DNA, 16 bp, Homo sapiens
agtcatatgtgaagac

SEQ ID NO: 5842957 - DNA, 15 bp, Homo sapiens
agtcatattcttatg

SEQ ID NO: 5842958 - DNA, 16 bp, Homo sapiens
agtcatatttttgtaa

SEQ ID NO: 5842959 - DNA, 19 bp, Homo sapiens
agtcatatttttgtaaata

SEQ ID NO: 5842960 - DNA, 16 bp, Homo sapiens
agtcatcaaaaagagt

SEQ ID NO: 5842961 - DNA, 19 bp, Homo sapiens
agtcatcaacaatgattaa

SEQ ID NO: 5842962 - DNA, 14 bp, Homo sapiens
agtcatcatcaggg

SEQ ID NO: 5842963 - DNA, 16 bp, Homo sapiens
agtcatcatctccaaa

SEQ ID NO: 5842964 - DNA, 17 bp, Homo sapiens
agtcatcatctccaaac

SEQ ID NO: 5842965 - DNA, 14 bp, Homo sapiens
agtcatcatctctt

SEQ ID NO: 5842966 - DNA, 21 bp, Homo sapiens
agtcatcatctttttgtgtgc

SEQ ID NO: 5842967 - DNA, 15 bp, Homo sapiens
agtcatcattacttg

SEQ ID NO: 5842968 - DNA, 16 bp, Homo sapiens
agtcatccaacaagaa

SEQ ID NO: 5842969 - DNA, 21 bp, Homo sapiens
agtcatccaacaagaagaaat

SEQ ID NO: 5842970 - DNA, 22 bp, Homo sapiens
agtcatccaacaagaagaaata

SEQ ID NO: 5842971 - DNA, 14 bp, Homo sapiens
agtcatcccctctc

SEQ ID NO: 5842972 - DNA, 17 bp, Homo sapiens
agtcatcccctctcagg

SEQ ID NO: 5842973 - DNA, 15 bp, Homo sapiens
agtcatcctgccctg

SEQ ID NO: 5842974 - DNA, 16 bp, Homo sapiens
agtcatcctgccctgc

SEQ ID NO: 5842975 - DNA, 17 bp, Homo sapiens
agtcatcctgccctgca

SEQ ID NO: 5842976 - DNA, 20 bp, Homo sapiens
agtcatcctgccctgcagca

SEQ ID NO: 5842977 - DNA, 17 bp, Homo sapiens
agtcatcgagtggccca

SEQ ID NO: 5842978 - DNA, 18 bp, Homo sapiens
agtcatcgtaggtgattt

SEQ ID NO: 5842979 - DNA, 22 bp, Homo sapiens
agtcatcgtaggtgatttgaag

SEQ ID NO: 5842980 - DNA, 13 bp, Homo sapiens
agtcatcgtttgt

SEQ ID NO: 5842981 - DNA, 19 bp, Homo sapiens
agtcatctagaattcactg

SEQ ID NO: 5842982 - DNA, 12 bp, Homo sapiens
agtcatctcaaa

SEQ ID NO: 5842983 - DNA, 14 bp, Homo sapiens
agtcatctcaacca

SEQ ID NO: 5842984 - DNA, 18 bp, Homo sapiens
agtcatctccatcagctg

SEQ ID NO: 5842985 - DNA, 20 bp, Homo sapiens
agtcatctccatcagctgta

SEQ ID NO: 5842986 - DNA, 19 bp, Homo sapiens
agtcatctgtaagagcttg

SEQ ID NO: 5842987 - DNA, 16 bp, Homo sapiens
agtcatcttgcacaca

SEQ ID NO: 5842988 - DNA, 19 bp, Homo sapiens
agtcatcttgctaccagta

SEQ ID NO: 5842989 - DNA, 13 bp, Homo sapiens
agtcatctttgag

SEQ ID NO: 5842990 - DNA, 22 bp, Homo sapiens
agtcatgaacacatcagctagc

SEQ ID NO: 5842991 - DNA, 13 bp, Homo sapiens
agtcatgagaatt

SEQ ID NO: 5842992 - DNA, 22 bp, Homo sapiens
agtcatgagctgagcagggaga

SEQ ID NO: 5842993 - DNA, 15 bp, Homo sapiens
agtcatgaggaaaga

SEQ ID NO: 5842994 - DNA, 16 bp, Homo sapiens
agtcatgatctccctg

SEQ ID NO: 5842995 - DNA, 18 bp, Homo sapiens
agtcatgatctccctgcc

SEQ ID NO: 5842996 - DNA, 20 bp, Homo sapiens
agtcatgatctccctgccgc

SEQ ID NO: 5842997 - DNA, 15 bp, Homo sapiens
agtcatgatgaatca

SEQ ID NO: 5842998 - DNA, 18 bp, Homo sapiens
agtcatgatgtttttaaa

SEQ ID NO: 5842999 - DNA, 22 bp, Homo sapiens
agtcatgatgtttttaaaatct

SEQ ID NO: 5843000 - DNA, 23 bp, Homo sapiens
agtcatgatgtttttaaaatctt

SEQ ID NO: 5843001 - DNA, 18 bp, Homo sapiens
agtcatgattctatgtaa

SEQ ID NO: 5843002 - DNA, 21 bp, Homo sapiens
agtcatgcataaatatgcagt

SEQ ID NO: 5843003 - DNA, 22 bp, Homo sapiens
agtcatgcataaatatgcagtg

SEQ ID NO: 5843004 - DNA, 19 bp, Homo sapiens
agtcatgcgtccactttcc

SEQ ID NO: 5843005 - DNA, 21 bp, Homo sapiens
agtcatgcgtccactttccct

SEQ ID NO: 5843006 - DNA, 14 bp, Homo sapiens
agtcatgctcccct

SEQ ID NO: 5843007 - DNA, 19 bp, Homo sapiens
agtcatgctcccctgtgcc

SEQ ID NO: 5843008 - DNA, 21 bp, Homo sapiens
agtcatgctcccctgtgccag

SEQ ID NO: 5843009 - DNA, 19 bp, Homo sapiens
agtcatgctgctagatctt

SEQ ID NO: 5843010 - DNA, 17 bp, Homo sapiens
agtcatgctgtgcattt

SEQ ID NO: 5843011 - DNA, 18 bp, Homo sapiens
agtcatggaatcttgctg

SEQ ID NO: 5843012 - DNA, 20 bp, Homo sapiens
agtcatggaatcttgctgca

SEQ ID NO: 5843013 - DNA, 19 bp, Homo sapiens
agtcatggagaaccaccta

SEQ ID NO: 5843014 - DNA, 16 bp, Homo sapiens
agtcatggataactac

SEQ ID NO: 5843015 - DNA, 19 bp, Homo sapiens
agtcatggcccaaatccag

SEQ ID NO: 5843016 - DNA, 19 bp, Homo sapiens
agtcatggcctgagatgca

SEQ ID NO: 5843017 - DNA, 16 bp, Homo sapiens
agtcatgggaacgcag

SEQ ID NO: 5843018 - DNA, 14 bp, Homo sapiens
agtcatggtcacag

SEQ ID NO: 5843019 - DNA, 16 bp, Homo sapiens
agtcatgtaaatactg

SEQ ID NO: 5843020 - DNA, 20 bp, Homo sapiens
agtcatgtaagctgaaaata

SEQ ID NO: 5843021 - DNA, 23 bp, Homo sapiens
agtcatgtactggagagtggcaa

SEQ ID NO: 5843022 - DNA, 11 bp, Homo sapiens
agtcatgtatg

SEQ ID NO: 5843023 - DNA, 15 bp, Homo sapiens
agtcatgtatgtttc

SEQ ID NO: 5843024 - DNA, 22 bp, Homo sapiens
agtcatgtatgtttctctttga

SEQ ID NO: 5843025 - DNA, 13 bp, Homo sapiens
agtcatgtcactg

SEQ ID NO: 5843026 - DNA, 13 bp, Homo sapiens
agtcatgtgctgg

SEQ ID NO: 5843027 - DNA, 13 bp, Homo sapiens
agtcatgttcctt

SEQ ID NO: 5843028 - DNA, 15 bp, Homo sapiens
agtcatgttccttca

SEQ ID NO: 5843029 - DNA, 22 bp, Homo sapiens
agtcatgttttaaatgtacagt

SEQ ID NO: 5843030 - DNA, 21 bp, Homo sapiens
agtcattaaaaacatagaaaa

SEQ ID NO: 5843031 - DNA, 18 bp, Homo sapiens
agtcattaaattactata

SEQ ID NO: 5843032 - DNA, 23 bp, Homo sapiens
agtcattaaattactatagcaaa

SEQ ID NO: 5843033 - DNA, 15 bp, Homo sapiens
agtcattaacaagaa

SEQ ID NO: 5843034 - DNA, 16 bp, Homo sapiens
agtcattagactcctc

SEQ ID NO: 5843035 - DNA, 19 bp, Homo sapiens
agtcattatagatccccca

SEQ ID NO: 5843036 - DNA, 13 bp, Homo sapiens
agtcattatgtag

SEQ ID NO: 5843037 - DNA, 12 bp, Homo sapiens
agtcattatgtt

SEQ ID NO: 5843038 - DNA, 18 bp, Homo sapiens
agtcattatgttaatatt

SEQ ID NO: 5843039 - DNA, 15 bp, Homo sapiens
agtcattcagatatg

SEQ ID NO: 5843040 - DNA, 23 bp, Homo sapiens
agtcattcagcagcaaattttca

SEQ ID NO: 5843041 - DNA, 12 bp, Homo sapiens
agtcattcttac

SEQ ID NO: 5843042 - DNA, 20 bp, Homo sapiens
agtcattgacttcattttat

SEQ ID NO: 5843043 - DNA, 19 bp, Homo sapiens
agtcattgctgacagagcc

SEQ ID NO: 5843044 - DNA, 16 bp, Homo sapiens
agtcattgctgtagga

SEQ ID NO: 5843045 - DNA, 13 bp, Homo sapiens
agtcattggcaaa

SEQ ID NO: 5843046 - DNA, 22 bp, Homo sapiens
agtcattggcaaagtgacaaag

SEQ ID NO: 5843047 - DNA, 15 bp, Homo sapiens
agtcattggctttat

SEQ ID NO: 5843048 - DNA, 18 bp, Homo sapiens
agtcattggctttatcct

SEQ ID NO: 5843049 - DNA, 13 bp, Homo sapiens
agtcattgtcata

SEQ ID NO: 5843050 - DNA, 15 bp, Homo sapiens
agtcattgtcataag

SEQ ID NO: 5843051 - DNA, 23 bp, Homo sapiens
agtcattgttacaggtgtactat

SEQ ID NO: 5843052 - DNA, 15 bp, Homo sapiens
agtcattgtttccca

SEQ ID NO: 5843053 - DNA, 17 bp, Homo sapiens
agtcatttaactgaaga

SEQ ID NO: 5843054 - DNA, 13 bp, Homo sapiens
agtcatttaagaa

SEQ ID NO: 5843055 - DNA, 15 bp, Homo sapiens
agtcatttaagaatt

SEQ ID NO: 5843056 - DNA, 17 bp, Homo sapiens
agtcatttactaaacat

SEQ ID NO: 5843057 - DNA, 16 bp, Homo sapiens
agtcatttattttaaa

SEQ ID NO: 5843058 - DNA, 20 bp, Homo sapiens
agtcatttccaaacttgaaa

SEQ ID NO: 5843059 - DNA, 19 bp, Homo sapiens
agtcatttccgtccccccc

SEQ ID NO: 5843060 - DNA, 15 bp, Homo sapiens
agtcatttctgattt

SEQ ID NO: 5843061 - DNA, 23 bp, Homo sapiens
agtcatttgtggttagaatcttg

SEQ ID NO: 5843062 - DNA, 13 bp, Homo sapiens
agtctagattctc

SEQ ID NO: 5843063 - DNA, 20 bp, Homo sapiens
agtctagattctctggctgt

SEQ ID NO: 5843064 - DNA, 20 bp, Homo sapiens
agtctagcactcattttcta

SEQ ID NO: 5843065 - DNA, 18 bp, Homo sapiens
agtctagggcacaaagac

SEQ ID NO: 5843066 - DNA, 19 bp, Homo sapiens
agtctagtccgtcctggca

SEQ ID NO: 5843067 - DNA, 14 bp, Homo sapiens
agtctagtcttctg

SEQ ID NO: 5843068 - DNA, 19 bp, Homo sapiens
agtctagttacctactttt

SEQ ID NO: 5843069 - DNA, 20 bp, Homo sapiens
agtctatcaaatgaaactct

SEQ ID NO: 5843070 - DNA, 15 bp, Homo sapiens
agtctatcaacattg

SEQ ID NO: 5843071 - DNA, 21 bp, Homo sapiens
agtctatcaacattgaatatc

SEQ ID NO: 5843072 - DNA, 14 bp, Homo sapiens
agtctatcattgtt

SEQ ID NO: 5843073 - DNA, 19 bp, Homo sapiens
agtctatctggtattaaat

SEQ ID NO: 5843074 - DNA, 14 bp, Homo sapiens
agtctatgctgtgt

SEQ ID NO: 5843075 - DNA, 19 bp, Homo sapiens
agtctatgctgtgtgcaga

SEQ ID NO: 5843076 - DNA, 16 bp, Homo sapiens
agtctatgttcaaaga

SEQ ID NO: 5843077 - DNA, 19 bp, Homo sapiens
agtctatgttcaaagactg

SEQ ID NO: 5843078 - DNA, 14 bp, Homo sapiens
agtctattagccac

SEQ ID NO: 5843079 - DNA, 17 bp, Homo sapiens
agtctattcattatatt

SEQ ID NO: 5843080 - DNA, 15 bp, Homo sapiens
agtctattgaataat

SEQ ID NO: 5843081 - DNA, 18 bp, Homo sapiens
agtctattgaataatgta

SEQ ID NO: 5843082 - DNA, 22 bp, Homo sapiens
agtctattgaataatgtagttt

SEQ ID NO: 5843083 - DNA, 11 bp, Homo sapiens
agtctatttta

SEQ ID NO: 5843084 - DNA, 13 bp, Homo sapiens
agtctatttttaa

SEQ ID NO: 5843085 - DNA, 17 bp, Homo sapiens
agtctatttttaatgca

SEQ ID NO: 5843086 - DNA, 19 bp, Homo sapiens
agtctcaaaaatacaaaat

SEQ ID NO: 5843087 - DNA, 20 bp, Homo sapiens
agtctcaaaaatacaaaata

SEQ ID NO: 5843088 - DNA, 16 bp, Homo sapiens
agtctcaaataataat

SEQ ID NO: 5843089 - DNA, 16 bp, Homo sapiens
agtctcaacatgtgtt

SEQ ID NO: 5843090 - DNA, 17 bp, Homo sapiens
agtctcaatgttccatt

SEQ ID NO: 5843091 - DNA, 13 bp, Homo sapiens
agtctcaattttg

SEQ ID NO: 5843092 - DNA, 14 bp, Homo sapiens
agtctcaattttgt

SEQ ID NO: 5843093 - DNA, 18 bp, Homo sapiens
agtctcaattttgtattt

SEQ ID NO: 5843094 - DNA, 19 bp, Homo sapiens
agtctcacaatagcgtgag

SEQ ID NO: 5843095 - DNA, 13 bp, Homo sapiens
agtctcacagaga

SEQ ID NO: 5843096 - DNA, 16 bp, Homo sapiens
agtctcacagagaagc

SEQ ID NO: 5843097 - DNA, 15 bp, Homo sapiens
agtctcacatattca

SEQ ID NO: 5843098 - DNA, 22 bp, Homo sapiens
agtctcacatgattccagccat

SEQ ID NO: 5843099 - DNA, 22 bp, Homo sapiens
agtctcaccatttccccagggc

SEQ ID NO: 5843100 - DNA, 23 bp, Homo sapiens
agtctcaccatttccccagggca

SEQ ID NO: 5843101 - DNA, 19 bp, Homo sapiens
agtctcacctgccggctct

SEQ ID NO: 5843102 - DNA, 20 bp, Homo sapiens
agtctcacctgccggctctg

SEQ ID NO: 5843103 - DNA, 14 bp, Homo sapiens
agtctcactcttgt

SEQ ID NO: 5843104 - DNA, 17 bp, Homo sapiens
agtctcactgacacagg

SEQ ID NO: 5843105 - DNA, 19 bp, Homo sapiens
agtctcactgtctgctggc

SEQ ID NO: 5843106 - DNA, 23 bp, Homo sapiens
agtctcactgttgcccaggctgg

SEQ ID NO: 5843107 - DNA, 21 bp, Homo sapiens
agtctcactttgacacccagg

SEQ ID NO: 5843108 - DNA, 13 bp, Homo sapiens
agtctcagaagag

SEQ ID NO: 5843109 - DNA, 15 bp, Homo sapiens
agtctcagagaccag

SEQ ID NO: 5843110 - DNA, 21 bp, Homo sapiens
agtctcagagaccagcactca

SEQ ID NO: 5843111 - DNA, 12 bp, Homo sapiens
agtctcagagca

SEQ ID NO: 5843112 - DNA, 15 bp, Homo sapiens
agtctcagcctgggc

SEQ ID NO: 5843113 - DNA, 18 bp, Homo sapiens
agtctcagcctgggcccc

SEQ ID NO: 5843114 - DNA, 15 bp, Homo sapiens
agtctcagctgctga

SEQ ID NO: 5843115 - DNA, 16 bp, Homo sapiens
agtctcaggaaatcaa

SEQ ID NO: 5843116 - DNA, 14 bp, Homo sapiens
agtctcaggaggag

SEQ ID NO: 5843117 - DNA, 16 bp, Homo sapiens
agtctcaggaggaggc

SEQ ID NO: 5843118 - DNA, 23 bp, Homo sapiens
agtctcaggaggagggcgcatgt

SEQ ID NO: 5843119 - DNA, 15 bp, Homo sapiens
agtctcagtccagat

SEQ ID NO: 5843120 - DNA, 16 bp, Homo sapiens
agtctcagtccagatg

SEQ ID NO: 5843121 - DNA, 19 bp, Homo sapiens
agtctcagtgaagactatg

SEQ ID NO: 5843122 - DNA, 19 bp, Homo sapiens
agtctcataggttaaaaaa

SEQ ID NO: 5843123 - DNA, 15 bp, Homo sapiens
agtctcatctcctga

SEQ ID NO: 5843124 - DNA, 17 bp, Homo sapiens
agtctcattacttttga

SEQ ID NO: 5843125 - DNA, 18 bp, Homo sapiens
agtctcattcctctgtcc

SEQ ID NO: 5843126 - DNA, 17 bp, Homo sapiens
agtctcattctgttgcc

SEQ ID NO: 5843127 - DNA, 19 bp, Homo sapiens
agtctcattctgttgccca

SEQ ID NO: 5843128 - DNA, 20 bp, Homo sapiens
agtctcattctgttgcccag

SEQ ID NO: 5843129 - DNA, 22 bp, Homo sapiens
agtctcattctgttgcccaggc

SEQ ID NO: 5843130 - DNA, 15 bp, Homo sapiens
agtctcattgccaag

SEQ ID NO: 5843131 - DNA, 14 bp, Homo sapiens
agtctcattgtcac

SEQ ID NO: 5843132 - DNA, 17 bp, Homo sapiens
agtctcattgtcacctc

SEQ ID NO: 5843133 - DNA, 19 bp, Homo sapiens
agtctccaaagtctctgga

SEQ ID NO: 5843134 - DNA, 16 bp, Homo sapiens
agtctccaccaggaac

SEQ ID NO: 5843135 - DNA, 11 bp, Homo sapiens
agtctccaccc

SEQ ID NO: 5843136 - DNA, 20 bp, Homo sapiens
agtctccacctgagaccctg

SEQ ID NO: 5843137 - DNA, 22 bp, Homo sapiens
agtctccacgtgtttcgggcca

SEQ ID NO: 5843138 - DNA, 16 bp, Homo sapiens
agtctccagaagaaaa

SEQ ID NO: 5843139 - DNA, 20 bp, Homo sapiens
agtctccagaagaaaatttg

SEQ ID NO: 5843140 - DNA, 21 bp, Homo sapiens
agtctccagaagaaaatttgc

SEQ ID NO: 5843141 - DNA, 12 bp, Homo sapiens
agtctccagccc

SEQ ID NO: 5843142 - DNA, 22 bp, Homo sapiens
agtctccagggacccttgcctg

SEQ ID NO: 5843143 - DNA, 22 bp, Homo sapiens
agtctccagggccccccaactg

SEQ ID NO: 5843144 - DNA, 23 bp, Homo sapiens
agtctcccaatatccaattttaa

SEQ ID NO: 5843145 - DNA, 18 bp, Homo sapiens
agtctcccactgcaactt

SEQ ID NO: 5843146 - DNA, 15 bp, Homo sapiens
agtctcccagggagc

SEQ ID NO: 5843147 - DNA, 20 bp, Homo sapiens
agtctccccactccaccctg

SEQ ID NO: 5843148 - DNA, 23 bp, Homo sapiens
agtctcccccacccttgttccag

SEQ ID NO: 5843149 - DNA, 18 bp, Homo sapiens
agtctccccgcagccctc

SEQ ID NO: 5843150 - DNA, 15 bp, Homo sapiens
agtctccccttcctg

SEQ ID NO: 5843151 - DNA, 18 bp, Homo sapiens
agtctccccttcctggca

SEQ ID NO: 5843152 - DNA, 15 bp, Homo sapiens
agtctccccttgcag

SEQ ID NO: 5843153 - DNA, 20 bp, Homo sapiens
agtctccccttgcagcctgg

SEQ ID NO: 5843154 - DNA, 15 bp, Homo sapiens
agtctccctcacagc

SEQ ID NO: 5843155 - DNA, 20 bp, Homo sapiens
agtctccctcacagcacaga

SEQ ID NO: 5843156 - DNA, 12 bp, Homo sapiens
agtctccctctg

SEQ ID NO: 5843157 - DNA, 20 bp, Homo sapiens
agtctccctgatggaccctc

SEQ ID NO: 5843158 - DNA, 17 bp, Homo sapiens
agtctccctgcacagcc

SEQ ID NO: 5843159 - DNA, 15 bp, Homo sapiens
agtctcccttcctat

SEQ ID NO: 5843160 - DNA, 14 bp, Homo sapiens
agtctcccttctcc

SEQ ID NO: 5843161 - DNA, 20 bp, Homo sapiens
agtctcctaataagttcctc

SEQ ID NO: 5843162 - DNA, 22 bp, Homo sapiens
agtctcctaataagttcctctg

SEQ ID NO: 5843163 - DNA, 13 bp, Homo sapiens
agtctcctcactc

SEQ ID NO: 5843164 - DNA, 17 bp, Homo sapiens
agtctcctcactgccac

SEQ ID NO: 5843165 - DNA, 18 bp, Homo sapiens
agtctcctcactgccact

SEQ ID NO: 5843166 - DNA, 20 bp, Homo sapiens
agtctcctcccctactctgc

SEQ ID NO: 5843167 - DNA, 14 bp, Homo sapiens
agtctcctctctga

SEQ ID NO: 5843168 - DNA, 16 bp, Homo sapiens
agtctcctctctgaga

SEQ ID NO: 5843169 - DNA, 16 bp, Homo sapiens
agtctcctctttaaaa

SEQ ID NO: 5843170 - DNA, 19 bp, Homo sapiens
agtctcctctttaaaacaa

SEQ ID NO: 5843171 - DNA, 20 bp, Homo sapiens
agtctcctctttaaaacaaa

SEQ ID NO: 5843172 - DNA, 22 bp, Homo sapiens
agtctcctctttaaaacaaaac

SEQ ID NO: 5843173 - DNA, 13 bp, Homo sapiens
agtctcctgacat

SEQ ID NO: 5843174 - DNA, 14 bp, Homo sapiens
agtctcctgtatca

SEQ ID NO: 5843175 - DNA, 13 bp, Homo sapiens
agtctccttctct

SEQ ID NO: 5843176 - DNA, 19 bp, Homo sapiens
agtctccttctcttctctt

SEQ ID NO: 5843177 - DNA, 12 bp, Homo sapiens
agtctcctttga

SEQ ID NO: 5843178 - DNA, 17 bp, Homo sapiens
agtctcctttgcactga

SEQ ID NO: 5843179 - DNA, 21 bp, Homo sapiens
agtctcctttgcactgagggc

SEQ ID NO: 5843180 - DNA, 15 bp, Homo sapiens
agtctcgaatgtaat

SEQ ID NO: 5843181 - DNA, 13 bp, Homo sapiens
agtctcgctctgc

SEQ ID NO: 5843182 - DNA, 15 bp, Homo sapiens
agtctcgctctgtca

SEQ ID NO: 5843183 - DNA, 22 bp, Homo sapiens
agtctcgctctgtcgcccaggc

SEQ ID NO: 5843184 - DNA, 18 bp, Homo sapiens
agtctctacccctttctg

SEQ ID NO: 5843185 - DNA, 18 bp, Homo sapiens
agtctctacctatagaaa

SEQ ID NO: 5843186 - DNA, 16 bp, Homo sapiens
agtctctactgttatt

SEQ ID NO: 5843187 - DNA, 18 bp, Homo sapiens
agtctctatattatgtct

SEQ ID NO: 5843188 - DNA, 19 bp, Homo sapiens
agtctctatattatgtctt

SEQ ID NO: 5843189 - DNA, 23 bp, Homo sapiens
agtctctatattatgtcttcttt

SEQ ID NO: 5843190 - DNA, 19 bp, Homo sapiens
agtctctatcattaaagtt

SEQ ID NO: 5843191 - DNA, 15 bp, Homo sapiens
agtctctatttaaat

SEQ ID NO: 5843192 - DNA, 23 bp, Homo sapiens
agtctctcaatgggtaaccatta

SEQ ID NO: 5843193 - DNA, 14 bp, Homo sapiens
agtctctccagcct

SEQ ID NO: 5843194 - DNA, 16 bp, Homo sapiens
agtctctccagcctca

SEQ ID NO: 5843195 - DNA, 21 bp, Homo sapiens
agtctctccagcctcacagat

SEQ ID NO: 5843196 - DNA, 11 bp, Homo sapiens
agtctctcctg

SEQ ID NO: 5843197 - DNA, 13 bp, Homo sapiens
agtctctctgtga

SEQ ID NO: 5843198 - DNA, 14 bp, Homo sapiens
agtctctctgtgaa

SEQ ID NO: 5843199 - DNA, 15 bp, Homo sapiens
agtctctctgtgaat

SEQ ID NO: 5843200 - DNA, 16 bp, Homo sapiens
agtctctctgtgaata

SEQ ID NO: 5843201 - DNA, 20 bp, Homo sapiens
agtctctctgtgaatacaat

SEQ ID NO: 5843202 - DNA, 17 bp, Homo sapiens
agtctctcttaaagttg

SEQ ID NO: 5843203 - DNA, 15 bp, Homo sapiens
agtctctcttaccct

SEQ ID NO: 5843204 - DNA, 23 bp, Homo sapiens
agtctctcttctctccagctgac

SEQ ID NO: 5843205 - DNA, 18 bp, Homo sapiens
agtctctgaagtgaaact

SEQ ID NO: 5843206 - DNA, 19 bp, Homo sapiens
agtctctgaagtgaaactg

SEQ ID NO: 5843207 - DNA, 19 bp, Homo sapiens
agtctctgaatacacagta

SEQ ID NO: 5843208 - DNA, 17 bp, Homo sapiens
agtctctgactcttgcc

SEQ ID NO: 5843209 - DNA, 11 bp, Homo sapiens
agtctctgagc

SEQ ID NO: 5843210 - DNA, 19 bp, Homo sapiens
agtctctgagggcttcctt

SEQ ID NO: 5843211 - DNA, 18 bp, Homo sapiens
agtctctgatacacagta

SEQ ID NO: 5843212 - DNA, 19 bp, Homo sapiens
agtctctgatttgcaaatg

SEQ ID NO: 5843213 - DNA, 14 bp, Homo sapiens
agtctctgcagtgt

SEQ ID NO: 5843214 - DNA, 15 bp, Homo sapiens
agtctctgccaccca

SEQ ID NO: 5843215 - DNA, 21 bp, Homo sapiens
agtctctgccacccactcagg

SEQ ID NO: 5843216 - DNA, 13 bp, Homo sapiens
agtctctggctca

SEQ ID NO: 5843217 - DNA, 14 bp, Homo sapiens
agtctctggctcag

SEQ ID NO: 5843218 - DNA, 16 bp, Homo sapiens
agtctctggctcagct

SEQ ID NO: 5843219 - DNA, 22 bp, Homo sapiens
agtctctgggtttacaacaaac

SEQ ID NO: 5843220 - DNA, 16 bp, Homo sapiens
agtctctgtgctttga

SEQ ID NO: 5843221 - DNA, 20 bp, Homo sapiens
agtctctgttcttcatctgc

SEQ ID NO: 5843222 - DNA, 11 bp, Homo sapiens
agtctcttcca

SEQ ID NO: 5843223 - DNA, 21 bp, Homo sapiens
agtctcttcctgcctcccaag

SEQ ID NO: 5843224 - DNA, 14 bp, Homo sapiens
agtctcttctccac

SEQ ID NO: 5843225 - DNA, 15 bp, Homo sapiens
agtctcttctccact

SEQ ID NO: 5843226 - DNA, 17 bp, Homo sapiens
agtctcttctccactgg

SEQ ID NO: 5843227 - DNA, 19 bp, Homo sapiens
agtctcttctccactggat

SEQ ID NO: 5843228 - DNA, 21 bp, Homo sapiens
agtctcttctccactggatgg

SEQ ID NO: 5843229 - DNA, 17 bp, Homo sapiens
agtctcttgattcataa

SEQ ID NO: 5843230 - DNA, 21 bp, Homo sapiens
agtctcttggactaagaagat

SEQ ID NO: 5843231 - DNA, 17 bp, Homo sapiens
agtctcttgtattaaac

SEQ ID NO: 5843232 - DNA, 13 bp, Homo sapiens
agtctcttgtttg

SEQ ID NO: 5843233 - DNA, 15 bp, Homo sapiens
agtctctttaatctt

SEQ ID NO: 5843234 - DNA, 17 bp, Homo sapiens
agtctctttaatcttca

SEQ ID NO: 5843235 - DNA, 23 bp, Homo sapiens
agtctctttaatcttcagtttta

SEQ ID NO: 5843236 - DNA, 16 bp, Homo sapiens
agtctctttattccta

SEQ ID NO: 5843237 - DNA, 17 bp, Homo sapiens
agtctctttattcctag

SEQ ID NO: 5843238 - DNA, 18 bp, Homo sapiens
agtctctttattcctagt

SEQ ID NO: 5843239 - DNA, 23 bp, Homo sapiens
agtctctttattcctagttggtg

SEQ ID NO: 5843240 - DNA, 18 bp, Homo sapiens
agtgaacagtttggatgt

SEQ ID NO: 5843241 - DNA, 13 bp, Homo sapiens
agtgaaccaaaga

SEQ ID NO: 5843242 - DNA, 13 bp, Homo sapiens
agtgaaccacagg

SEQ ID NO: 5843243 - DNA, 19 bp, Homo sapiens
agtgaaccacaggttttag

SEQ ID NO: 5843244 - DNA, 13 bp, Homo sapiens
agtgaaccatcat

SEQ ID NO: 5843245 - DNA, 19 bp, Homo sapiens
agtgaactatttctacaca

SEQ ID NO: 5843246 - DNA, 21 bp, Homo sapiens
agtgaactatttttaaggtct

SEQ ID NO: 5843247 - DNA, 17 bp, Homo sapiens
agtgaactcctgccagg

SEQ ID NO: 5843248 - DNA, 20 bp, Homo sapiens
agtgaactcctgccaggcac

SEQ ID NO: 5843249 - DNA, 23 bp, Homo sapiens
agtgaacttacacttggagcccg

SEQ ID NO: 5843250 - DNA, 18 bp, Homo sapiens
agtgaacttagtcctgtt

SEQ ID NO: 5843251 - DNA, 17 bp, Homo sapiens
agtgaacttgattttaa

SEQ ID NO: 5843252 - DNA, 14 bp, Homo sapiens
agtgaacttttgta

SEQ ID NO: 5843253 - DNA, 17 bp, Homo sapiens
agtgaacttttgtaatt

SEQ ID NO: 5843254 - DNA, 12 bp, Homo sapiens
agtgaagaatac

SEQ ID NO: 5843255 - DNA, 14 bp, Homo sapiens
agtgaagaatacat

SEQ ID NO: 5843256 - DNA, 19 bp, Homo sapiens
agtgaagaatacatcagaa

SEQ ID NO: 5843257 - DNA, 23 bp, Homo sapiens
agtgaagaataggtgcaaacaaa

SEQ ID NO: 5843258 - DNA, 18 bp, Homo sapiens
agtgaagaccagagcagt

SEQ ID NO: 5843259 - DNA, 16 bp, Homo sapiens
agtgaagactccagaa

SEQ ID NO: 5843260 - DNA, 16 bp, Homo sapiens
agtgaagaggggcagc

SEQ ID NO: 5843261 - DNA, 19 bp, Homo sapiens
agtgaagaggggcagccct

SEQ ID NO: 5843262 - DNA, 13 bp, Homo sapiens
agtgaagagtgaa

SEQ ID NO: 5843263 - DNA, 16 bp, Homo sapiens
agtgaagagtgaagag

SEQ ID NO: 5843264 - DNA, 18 bp, Homo sapiens
agtgaagagtgaagagca

SEQ ID NO: 5843265 - DNA, 20 bp, Homo sapiens
agtgaagagtgaagagcatt

SEQ ID NO: 5843266 - DNA, 15 bp, Homo sapiens
agtgaagatgctgta

SEQ ID NO: 5843267 - DNA, 16 bp, Homo sapiens
agtgaagatgctgtaa

SEQ ID NO: 5843268 - DNA, 23 bp, Homo sapiens
agtgaagatggtttcaattcaga

SEQ ID NO: 5843269 - DNA, 17 bp, Homo sapiens
agtgaagcccaggagga

SEQ ID NO: 5843270 - DNA, 12 bp, Homo sapiens
agtgaaggaaat

SEQ ID NO: 5843271 - DNA, 18 bp, Homo sapiens
agtgaaggaaataaaggt

SEQ ID NO: 5843272 - DNA, 15 bp, Homo sapiens
agtgaaggagaaagg

SEQ ID NO: 5843273 - DNA, 17 bp, Homo sapiens
agtgaaggagccacgtg

SEQ ID NO: 5843274 - DNA, 17 bp, Homo sapiens
agtgaaggccacagcaa

SEQ ID NO: 5843275 - DNA, 15 bp, Homo sapiens
agtgaaggcttctct

SEQ ID NO: 5843276 - DNA, 21 bp, Homo sapiens
agtgaaggcttctctctgtgg

SEQ ID NO: 5843277 - DNA, 19 bp, Homo sapiens
agtgaaggttcccaaggac

SEQ ID NO: 5843278 - DNA, 21 bp, Homo sapiens
agtgaaggttcccaaggacat

SEQ ID NO: 5843279 - DNA, 15 bp, Homo sapiens
agtgaaggtttacaa

SEQ ID NO: 5843280 - DNA, 20 bp, Homo sapiens
agtgaagtaaaagttaagat

SEQ ID NO: 5843281 - DNA, 18 bp, Homo sapiens
agtgaagtaaaattgagt

SEQ ID NO: 5843282 - DNA, 12 bp, Homo sapiens
agtgaagtaatt

SEQ ID NO: 5843283 - DNA, 20 bp, Homo sapiens
agtgaagtacacctgtgtgg

SEQ ID NO: 5843284 - DNA, 17 bp, Homo sapiens
agtgaagtattgctgaa

SEQ ID NO: 5843285 - DNA, 21 bp, Homo sapiens
agtgaagtattgctgaaaagt

SEQ ID NO: 5843286 - DNA, 17 bp, Homo sapiens
agtgaagtctagaatca

SEQ ID NO: 5843287 - DNA, 18 bp, Homo sapiens
agtgaagtgaatctgatt

SEQ ID NO: 5843288 - DNA, 15 bp, Homo sapiens
agtgaagtggcctct

SEQ ID NO: 5843289 - DNA, 21 bp, Homo sapiens
agtgaagttcttttactgtaa

SEQ ID NO: 5843290 - DNA, 16 bp, Homo sapiens
agtgaagttgctgctt

SEQ ID NO: 5843291 - DNA, 19 bp, Homo sapiens
agtgaataaacttcagcac

SEQ ID NO: 5843292 - DNA, 20 bp, Homo sapiens
agtgaataaacttcagcacc

SEQ ID NO: 5843293 - DNA, 21 bp, Homo sapiens
agtgaataaacttcagcacca

SEQ ID NO: 5843294 - DNA, 14 bp, Homo sapiens
agtgaataaatgtc

SEQ ID NO: 5843295 - DNA, 16 bp, Homo sapiens
agtgaatacatggtag

SEQ ID NO: 5843296 - DNA, 20 bp, Homo sapiens
agtgaatacattaacggtgc

SEQ ID NO: 5843297 - DNA, 20 bp, Homo sapiens
agtgaatacattttataatt

SEQ ID NO: 5843298 - DNA, 21 bp, Homo sapiens
agtgaatacattttataattt

SEQ ID NO: 5843299 - DNA, 15 bp, Homo sapiens
agtgaatcctctgtt

SEQ ID NO: 5843300 - DNA, 17 bp, Homo sapiens
agtgaatcctctgttta

SEQ ID NO: 5843301 - DNA, 16 bp, Homo sapiens
agtgaatctaaggata

SEQ ID NO: 5843302 - DNA, 21 bp, Homo sapiens
agtgaatctaaggataatgaa

SEQ ID NO: 5843303 - DNA, 17 bp, Homo sapiens
agtgaatcttatggtgg

SEQ ID NO: 5843304 - DNA, 20 bp, Homo sapiens
agtgaatctttctcctggtg

SEQ ID NO: 5843305 - DNA, 16 bp, Homo sapiens
agtgaatgattcagtg

SEQ ID NO: 5843306 - DNA, 17 bp, Homo sapiens
agtgaatgattcagtgt

SEQ ID NO: 5843307 - DNA, 19 bp, Homo sapiens
agtgaatgattcagtgtta

SEQ ID NO: 5843308 - DNA, 22 bp, Homo sapiens
agtgaatgccatttagaatcta

SEQ ID NO: 5843309 - DNA, 23 bp, Homo sapiens
agtgaatgccatttagaatctag

SEQ ID NO: 5843310 - DNA, 17 bp, Homo sapiens
agtgaatgctagacaga

SEQ ID NO: 5843311 - DNA, 16 bp, Homo sapiens
agtgaatgtaggctgg

SEQ ID NO: 5843312 - DNA, 20 bp, Homo sapiens
agtgaatgtgtctggacctc

SEQ ID NO: 5843313 - DNA, 17 bp, Homo sapiens
agtgaatgtgtgtatgt

SEQ ID NO: 5843314 - DNA, 15 bp, Homo sapiens
agtgaattacactca

SEQ ID NO: 5843315 - DNA, 17 bp, Homo sapiens
agtgaattacactcaag

SEQ ID NO: 5843316 - DNA, 22 bp, Homo sapiens
agtgaattgaatattgtaagtc

SEQ ID NO: 5843317 - DNA, 16 bp, Homo sapiens
agtgaattggcttcct

SEQ ID NO: 5843318 - DNA, 19 bp, Homo sapiens
agtgaattggcttccttga

SEQ ID NO: 5843319 - DNA, 22 bp, Homo sapiens
agtgaattgtacctatttctga

SEQ ID NO: 5843320 - DNA, 13 bp, Homo sapiens
agtgaattgtctt

SEQ ID NO: 5843321 - DNA, 21 bp, Homo sapiens
agtgaattgtgaccaagttat

SEQ ID NO: 5843322 - DNA, 13 bp, Homo sapiens
agtgaatttctga

SEQ ID NO: 5843323 - DNA, 14 bp, Homo sapiens
agtgaatttgaatg

SEQ ID NO: 5843324 - DNA, 12 bp, Homo sapiens
agtgaatttgtc

SEQ ID NO: 5843325 - DNA, 21 bp, Homo sapiens
agtgaatttgtccattgtaaa

SEQ ID NO: 5843326 - DNA, 22 bp, Homo sapiens
agtgaatttgtccattgtaaat

SEQ ID NO: 5843327 - DNA, 14 bp, Homo sapiens
agtgaattttgcac

SEQ ID NO: 5843328 - DNA, 20 bp, Homo sapiens
agtgaatttttaaagacaaa

SEQ ID NO: 5843329 - DNA, 15 bp, Homo sapiens
agtgaatttttctct

SEQ ID NO: 5843330 - DNA, 14 bp, Homo sapiens
agtgaatttttgca

SEQ ID NO: 5843331 - DNA, 22 bp, Homo sapiens
agtgaatttttgcaataatgca

SEQ ID NO: 5843332 - DNA, 18 bp, Homo sapiens
agtgacaaaaataaaaag

SEQ ID NO: 5843333 - DNA, 16 bp, Homo sapiens
agtgacaaaagcagca

SEQ ID NO: 5843334 - DNA, 17 bp, Homo sapiens
agtgacaaagcctctga

SEQ ID NO: 5843335 - DNA, 22 bp, Homo sapiens
agtgacaaattgtaactacact

SEQ ID NO: 5843336 - DNA, 16 bp, Homo sapiens
agtgacaagatgctct

SEQ ID NO: 5843337 - DNA, 18 bp, Homo sapiens
agtgacaaggccccagag

SEQ ID NO: 5843338 - DNA, 21 bp, Homo sapiens
agtgacaaggccccagagact

SEQ ID NO: 5843339 - DNA, 18 bp, Homo sapiens
agtgacaagtgaagaaca

SEQ ID NO: 5843340 - DNA, 20 bp, Homo sapiens
agtgacacaatctcagctca

SEQ ID NO: 5843341 - DNA, 23 bp, Homo sapiens
agtgacacaatctcagctcactg

SEQ ID NO: 5843342 - DNA, 16 bp, Homo sapiens
agtgacacagacattt

SEQ ID NO: 5843343 - DNA, 23 bp, Homo sapiens
agtgacacagcagcttcaccaga

SEQ ID NO: 5843344 - DNA, 20 bp, Homo sapiens
agtgacacccaagagggctg

SEQ ID NO: 5843345 - DNA, 21 bp, Homo sapiens
agtgacacccaagagggctgc

SEQ ID NO: 5843346 - DNA, 22 bp, Homo sapiens
agtgacacctcagtcatatttc

SEQ ID NO: 5843347 - DNA, 15 bp, Homo sapiens
agtgacacttcagag

SEQ ID NO: 5843348 - DNA, 20 bp, Homo sapiens
agtgacacttcagagagctg

SEQ ID NO: 5843349 - DNA, 23 bp, Homo sapiens
agtgacacttcagagagctggta

SEQ ID NO: 5843350 - DNA, 16 bp, Homo sapiens
agtgacagaaggcccg

SEQ ID NO: 5843351 - DNA, 14 bp, Homo sapiens
agtgacagactgga

SEQ ID NO: 5843352 - DNA, 13 bp, Homo sapiens
agtgacagagacc

SEQ ID NO: 5843353 - DNA, 18 bp, Homo sapiens
agtgacagagacccagat

SEQ ID NO: 5843354 - DNA, 21 bp, Homo sapiens
agtgacagagcccagcatccc

SEQ ID NO: 5843355 - DNA, 13 bp, Homo sapiens
agtgacagagcga

SEQ ID NO: 5843356 - DNA, 16 bp, Homo sapiens
agtgacagaggagaaa

SEQ ID NO: 5843357 - DNA, 15 bp, Homo sapiens
agtgacagagttcac

SEQ ID NO: 5843358 - DNA, 20 bp, Homo sapiens
agtgacagatcctccatttt

SEQ ID NO: 5843359 - DNA, 13 bp, Homo sapiens
agtgacagatgtt

SEQ ID NO: 5843360 - DNA, 19 bp, Homo sapiens
agtgacagggaagctacag

SEQ ID NO: 5843361 - DNA, 15 bp, Homo sapiens
agtgacagtattttg

SEQ ID NO: 5843362 - DNA, 16 bp, Homo sapiens
agtgacataattgtcc

SEQ ID NO: 5843363 - DNA, 16 bp, Homo sapiens
agtgacatagcctcat

SEQ ID NO: 5843364 - DNA, 18 bp, Homo sapiens
agtgacatcaaagcctgg

SEQ ID NO: 5843365 - DNA, 21 bp, Homo sapiens
agtgacatcaaagcctggcct

SEQ ID NO: 5843366 - DNA, 20 bp, Homo sapiens
agtgacatctgattggcaga

SEQ ID NO: 5843367 - DNA, 19 bp, Homo sapiens
agtgacatgattctgaact

SEQ ID NO: 5843368 - DNA, 14 bp, Homo sapiens
agtgacatgcggct

SEQ ID NO: 5843369 - DNA, 19 bp, Homo sapiens
agtgacatgggtgtgccag

SEQ ID NO: 5843370 - DNA, 17 bp, Homo sapiens
agtgacatttcaatcac

SEQ ID NO: 5843371 - DNA, 19 bp, Homo sapiens
agtgaccaaattgggagat

SEQ ID NO: 5843372 - DNA, 11 bp, Homo sapiens
agtgaccagca

SEQ ID NO: 5843373 - DNA, 13 bp, Homo sapiens
agtgaccagcaca

SEQ ID NO: 5843374 - DNA, 23 bp, Homo sapiens
agtgaccagcataccagttcttg

SEQ ID NO: 5843375 - DNA, 23 bp, Homo sapiens
agtgaccaggctcacaactgttt

SEQ ID NO: 5843376 - DNA, 13 bp, Homo sapiens
agtgaccagggaa

SEQ ID NO: 5843377 - DNA, 15 bp, Homo sapiens
agtgaccagggaagt

SEQ ID NO: 5843378 - DNA, 15 bp, Homo sapiens
agtgaccagtgcctg

SEQ ID NO: 5843379 - DNA, 16 bp, Homo sapiens
agtgaccagtgcctgt

SEQ ID NO: 5843380 - DNA, 17 bp, Homo sapiens
agtgacccacatgccat

SEQ ID NO: 5843381 - DNA, 15 bp, Homo sapiens
agtgacccagatatt

SEQ ID NO: 5843382 - DNA, 12 bp, Homo sapiens
agtgacccagct

SEQ ID NO: 5843383 - DNA, 13 bp, Homo sapiens
agtgacccagcta

SEQ ID NO: 5843384 - DNA, 17 bp, Homo sapiens
agtgaccccagctccag

SEQ ID NO: 5843385 - DNA, 23 bp, Homo sapiens
agtgaccccagctccaggcagga

SEQ ID NO: 5843386 - DNA, 21 bp, Homo sapiens
agtgaccccagggcctgtctc

SEQ ID NO: 5843387 - DNA, 14 bp, Homo sapiens
agtgacccctgcct

SEQ ID NO: 5843388 - DNA, 17 bp, Homo sapiens
agtgacccggaggccac

SEQ ID NO: 5843389 - DNA, 23 bp, Homo sapiens
agtgacccggaggccacatgagt

SEQ ID NO: 5843390 - DNA, 20 bp, Homo sapiens
agtgaccctcagctgtcacc

SEQ ID NO: 5843391 - DNA, 22 bp, Homo sapiens
agtgaccctcagctgtcacctg

SEQ ID NO: 5843392 - DNA, 14 bp, Homo sapiens
agtgaccctggagc

SEQ ID NO: 5843393 - DNA, 15 bp, Homo sapiens
agtgaccctggagct

SEQ ID NO: 5843394 - DNA, 20 bp, Homo sapiens
agtgaccctggagctagggt

SEQ ID NO: 5843395 - DNA, 21 bp, Homo sapiens
agtgaccctggagctagggtc

SEQ ID NO: 5843396 - DNA, 16 bp, Homo sapiens
agtgaccctggctcct

SEQ ID NO: 5843397 - DNA, 21 bp, Homo sapiens
agtgacccttcccaatcagca

SEQ ID NO: 5843398 - DNA, 20 bp, Homo sapiens
agtgaccgattatgctttct

SEQ ID NO: 5843399 - DNA, 15 bp, Homo sapiens
agtgaccgcttcccc

SEQ ID NO: 5843400 - DNA, 22 bp, Homo sapiens
agtgaccgggggaagctgagcc

SEQ ID NO: 5843401 - DNA, 20 bp, Homo sapiens
agtgacctcggacagagccc

SEQ ID NO: 5843402 - DNA, 17 bp, Homo sapiens
agtgacctgaggaagcg

SEQ ID NO: 5843403 - DNA, 22 bp, Homo sapiens
agtgacctgccctacatatcta

SEQ ID NO: 5843404 - DNA, 22 bp, Homo sapiens
agtgacctggcatcttggaaat

SEQ ID NO: 5843405 - DNA, 15 bp, Homo sapiens
agtgacggctggcat

SEQ ID NO: 5843406 - DNA, 14 bp, Homo sapiens
agtgacggttccta

SEQ ID NO: 5843407 - DNA, 20 bp, Homo sapiens
agtgacggttcctacacagg

SEQ ID NO: 5843408 - DNA, 18 bp, Homo sapiens
agtgacgtgactcagagc

SEQ ID NO: 5843409 - DNA, 14 bp, Homo sapiens
agtgacgtgcacct

SEQ ID NO: 5843410 - DNA, 17 bp, Homo sapiens
agtgactaaaccattgt

SEQ ID NO: 5843411 - DNA, 15 bp, Homo sapiens
agtgactaatggcat

SEQ ID NO: 5843412 - DNA, 16 bp, Homo sapiens
agtgactaatggcatg

SEQ ID NO: 5843413 - DNA, 22 bp, Homo sapiens
agtgactaccacttatttctaa

SEQ ID NO: 5843414 - DNA, 23 bp, Homo sapiens
agtgactaccacttatttctaaa

SEQ ID NO: 5843415 - DNA, 17 bp, Homo sapiens
agtgactagtacaaatt

SEQ ID NO: 5843416 - DNA, 12 bp, Homo sapiens
agtgcagccaaa

SEQ ID NO: 5843417 - DNA, 21 bp, Homo sapiens
agtgcagccaaaggggagcca

SEQ ID NO: 5843418 - DNA, 23 bp, Homo sapiens
agtgcagccaaaggggagccaga

SEQ ID NO: 5843419 - DNA, 22 bp, Homo sapiens
agtgcagccaagtagcctctcc

SEQ ID NO: 5843420 - DNA, 12 bp, Homo sapiens
agtgcagccact

SEQ ID NO: 5843421 - DNA, 17 bp, Homo sapiens
agtgcagccccctcctg

SEQ ID NO: 5843422 - DNA, 23 bp, Homo sapiens
agtgcagccccctcctgacccca

SEQ ID NO: 5843423 - DNA, 21 bp, Homo sapiens
agtgcagcccgtgtggcccct

SEQ ID NO: 5843424 - DNA, 23 bp, Homo sapiens
agtgcagcccgtgtggccccttc

SEQ ID NO: 5843425 - DNA, 15 bp, Homo sapiens
agtgcagcccttcct

SEQ ID NO: 5843426 - DNA, 18 bp, Homo sapiens
agtgcagcccttcctcct

SEQ ID NO: 5843427 - DNA, 21 bp, Homo sapiens
agtgcagcccttcctcctgaa

SEQ ID NO: 5843428 - DNA, 14 bp, Homo sapiens
agtgcagccttctc

SEQ ID NO: 5843429 - DNA, 15 bp, Homo sapiens
agtgcagcgggccag

SEQ ID NO: 5843430 - DNA, 18 bp, Homo sapiens
agtgcagctaacatgagt

SEQ ID NO: 5843431 - DNA, 14 bp, Homo sapiens
agtgcagctcagga

SEQ ID NO: 5843432 - DNA, 17 bp, Homo sapiens
agtgcagctgaaattga

SEQ ID NO: 5843433 - DNA, 15 bp, Homo sapiens
agtgcagctgatttt

SEQ ID NO: 5843434 - DNA, 15 bp, Homo sapiens
agtgcagcttgcagt

SEQ ID NO: 5843435 - DNA, 18 bp, Homo sapiens
agtgcagggacagcctgc

SEQ ID NO: 5843436 - DNA, 15 bp, Homo sapiens
agtgcagggaggaaa

SEQ ID NO: 5843437 - DNA, 21 bp, Homo sapiens
agtgcagggaggaaaagtgca

SEQ ID NO: 5843438 - DNA, 20 bp, Homo sapiens
agtgcagggattacaggcgt

SEQ ID NO: 5843439 - DNA, 14 bp, Homo sapiens
agtgcagtaatttc

SEQ ID NO: 5843440 - DNA, 17 bp, Homo sapiens
agtgcagtaatttctga

SEQ ID NO: 5843441 - DNA, 14 bp, Homo sapiens
agtgcagtatagaa

SEQ ID NO: 5843442 - DNA, 15 bp, Homo sapiens
agtgcagtcatttgt

SEQ ID NO: 5843443 - DNA, 17 bp, Homo sapiens
agtgcagtgagccgaga

SEQ ID NO: 5843444 - DNA, 24 bp, Homo sapiens
agtgcagtggcacaatcatggctc

SEQ ID NO: 5843445 - DNA, 18 bp, Homo sapiens
agtgcagtggtgcaatca

SEQ ID NO: 5843446 - DNA, 20 bp, Homo sapiens
agtgcagtggtgcaatcaca

SEQ ID NO: 5843447 - DNA, 23 bp, Homo sapiens
agtgcagtggtgcgatcatggct

SEQ ID NO: 5843448 - DNA, 13 bp, Homo sapiens
agtgcatagaatt

SEQ ID NO: 5843449 - DNA, 23 bp, Homo sapiens
agtgcatagctactaaaatcagt

SEQ ID NO: 5843450 - DNA, 15 bp, Homo sapiens
agtgcatcacatctg

SEQ ID NO: 5843451 - DNA, 19 bp, Homo sapiens
agtgcatcacatctgcaca

SEQ ID NO: 5843452 - DNA, 14 bp, Homo sapiens
agtgcatcattact

SEQ ID NO: 5843453 - DNA, 21 bp, Homo sapiens
agtgcatccaaaggtgctcag

SEQ ID NO: 5843454 - DNA, 18 bp, Homo sapiens
agtgcatccttgaactgt

SEQ ID NO: 5843455 - DNA, 14 bp, Homo sapiens
agtgcatctacttg

SEQ ID NO: 5843456 - DNA, 18 bp, Homo sapiens
agtgcatctttgcctctc

SEQ ID NO: 5843457 - DNA, 20 bp, Homo sapiens
agtgcatgaacagggtccct

SEQ ID NO: 5843458 - DNA, 16 bp, Homo sapiens
agtgcatgacgtttaa

SEQ ID NO: 5843459 - DNA, 19 bp, Homo sapiens
agtgcatgatggtgagagc

SEQ ID NO: 5843460 - DNA, 21 bp, Homo sapiens
agtgcatgcattgagctgcct

SEQ ID NO: 5843461 - DNA, 17 bp, Homo sapiens
agtgcatgctctctgca

SEQ ID NO: 5843462 - DNA, 20 bp, Homo sapiens
agtgcatgctctctgcagcc

SEQ ID NO: 5843463 - DNA, 20 bp, Homo sapiens
agtgcatggccacagccacc

SEQ ID NO: 5843464 - DNA, 23 bp, Homo sapiens
agtgcatggccacagccacctcc

SEQ ID NO: 5843465 - DNA, 16 bp, Homo sapiens
agtgcatggtggccag

SEQ ID NO: 5843466 - DNA, 15 bp, Homo sapiens
agtgcatgtgcatgc

SEQ ID NO: 5843467 - DNA, 16 bp, Homo sapiens
agtgcatgttaaaata

SEQ ID NO: 5843468 - DNA, 17 bp, Homo sapiens
agtgcattatgtacaca

SEQ ID NO: 5843469 - DNA, 18 bp, Homo sapiens
agtgcattattttattga

SEQ ID NO: 5843470 - DNA, 16 bp, Homo sapiens
agtgcattcaacctta

SEQ ID NO: 5843471 - DNA, 15 bp, Homo sapiens
agtgcattgtttctg

SEQ ID NO: 5843472 - DNA, 21 bp, Homo sapiens
agtgcattgtttctgtgggcg

SEQ ID NO: 5843473 - DNA, 23 bp, Homo sapiens
agtgcatttacaaggttaaagat

SEQ ID NO: 5843474 - DNA, 22 bp, Homo sapiens
agtgcatttatgagctcttcat

SEQ ID NO: 5843475 - DNA, 17 bp, Homo sapiens
agtgcatttcaaggaat

SEQ ID NO: 5843476 - DNA, 15 bp, Homo sapiens
agtgcatttctgaat

SEQ ID NO: 5843477 - DNA, 21 bp, Homo sapiens
agtgcatttctgaatagaaat

SEQ ID NO: 5843478 - DNA, 16 bp, Homo sapiens
agtgcatttgactcca

SEQ ID NO: 5843479 - DNA, 21 bp, Homo sapiens
agtgcatttgtgctagaaatt

SEQ ID NO: 5843480 - DNA, 20 bp, Homo sapiens
agtgcattttcaacattgat

SEQ ID NO: 5843481 - DNA, 15 bp, Homo sapiens
agtgcatttttaaac

SEQ ID NO: 5843482 - DNA, 22 bp, Homo sapiens
agtgcatttttaaacttgaaat

SEQ ID NO: 5843483 - DNA, 23 bp, Homo sapiens
agtgcatttttatctgtgagttc

SEQ ID NO: 5843484 - DNA, 13 bp, Homo sapiens
agtgcatttttct

SEQ ID NO: 5843485 - DNA, 16 bp, Homo sapiens
agtgccaaaaacaaca

SEQ ID NO: 5843486 - DNA, 16 bp, Homo sapiens
agtgccaaaaggcccc

SEQ ID NO: 5843487 - DNA, 20 bp, Homo sapiens
agtgccaaaaggccccttcc

SEQ ID NO: 5843488 - DNA, 12 bp, Homo sapiens
agtgccaaagaa

SEQ ID NO: 5843489 - DNA, 16 bp, Homo sapiens
agtgccaacaatccta

SEQ ID NO: 5843490 - DNA, 18 bp, Homo sapiens
agtgccaacaattttcta

SEQ ID NO: 5843491 - DNA, 13 bp, Homo sapiens
agtgccaagcagg

SEQ ID NO: 5843492 - DNA, 22 bp, Homo sapiens
agtgccaaggacctcctcttcc

SEQ ID NO: 5843493 - DNA, 17 bp, Homo sapiens
agtgccaatgacaggac

SEQ ID NO: 5843494 - DNA, 17 bp, Homo sapiens
agtgccaatgatgtgac

SEQ ID NO: 5843495 - DNA, 22 bp, Homo sapiens
agtgccaatgttgtgtgttgca

SEQ ID NO: 5843496 - DNA, 21 bp, Homo sapiens
agtgccaatttcttactagta

SEQ ID NO: 5843497 - DNA, 12 bp, Homo sapiens
agtgccacagag

SEQ ID NO: 5843498 - DNA, 14 bp, Homo sapiens
agtgccacagagaa

SEQ ID NO: 5843499 - DNA, 17 bp, Homo sapiens
agtgccacagcctgctg

SEQ ID NO: 5843500 - DNA, 18 bp, Homo sapiens
agtgccaccacactcagc

SEQ ID NO: 5843501 - DNA, 21 bp, Homo sapiens
agtgccacccacctttgccac

SEQ ID NO: 5843502 - DNA, 15 bp, Homo sapiens
agtgccacccgcaga

SEQ ID NO: 5843503 - DNA, 23 bp, Homo sapiens
agtgccacctatgcctgtggtga

SEQ ID NO: 5843504 - DNA, 19 bp, Homo sapiens
agtgccacgcacaggtgct

SEQ ID NO: 5843505 - DNA, 21 bp, Homo sapiens
agtgccacgcacaggtgctga

SEQ ID NO: 5843506 - DNA, 16 bp, Homo sapiens
agtgccacgtcatgag

SEQ ID NO: 5843507 - DNA, 17 bp, Homo sapiens
agtgccacgtggccgct

SEQ ID NO: 5843508 - DNA, 20 bp, Homo sapiens
agtgccacgttactcccctg

SEQ ID NO: 5843509 - DNA, 20 bp, Homo sapiens
agtgccacttgacattcctt

SEQ ID NO: 5843510 - DNA, 19 bp, Homo sapiens
agtgccagaggtgggcagg

SEQ ID NO: 5843511 - DNA, 20 bp, Homo sapiens
agtgccagaggtgggcaggt

SEQ ID NO: 5843512 - DNA, 21 bp, Homo sapiens
agtgccagaggtgggcaggtg

SEQ ID NO: 5843513 - DNA, 20 bp, Homo sapiens
agtgccagatgttgtctgaa

SEQ ID NO: 5843514 - DNA, 18 bp, Homo sapiens
agtgccagcacctgccca

SEQ ID NO: 5843515 - DNA, 12 bp, Homo sapiens
agtgccagcatt

SEQ ID NO: 5843516 - DNA, 13 bp, Homo sapiens
agtgccagcattc

SEQ ID NO: 5843517 - DNA, 15 bp, Homo sapiens
agtgccagcattcca

SEQ ID NO: 5843518 - DNA, 18 bp, Homo sapiens
agtgccagctccagtgcc

SEQ ID NO: 5843519 - DNA, 22 bp, Homo sapiens
agtgccagctccagtgccgctc

SEQ ID NO: 5843520 - DNA, 16 bp, Homo sapiens
agtgccagctggtgaa

SEQ ID NO: 5843521 - DNA, 22 bp, Homo sapiens
agtgccagctggtgaatccatg

SEQ ID NO: 5843522 - DNA, 14 bp, Homo sapiens
agtgccaggacagc

SEQ ID NO: 5843523 - DNA, 12 bp, Homo sapiens
agtgccaggacc

SEQ ID NO: 5843524 - DNA, 15 bp, Homo sapiens
agtgccaggaccagc

SEQ ID NO: 5843525 - DNA, 13 bp, Homo sapiens
agtgccaggactc

SEQ ID NO: 5843526 - DNA, 19 bp, Homo sapiens
agtgccaggactccccagg

SEQ ID NO: 5843527 - DNA, 21 bp, Homo sapiens
agtgccaggtggctcagtgcc

SEQ ID NO: 5843528 - DNA, 23 bp, Homo sapiens
agtgccagtattttaaaatagcg

SEQ ID NO: 5843529 - DNA, 20 bp, Homo sapiens
agtgccagtcttgtgtctgc

SEQ ID NO: 5843530 - DNA, 16 bp, Homo sapiens
agtgccataaccatga

SEQ ID NO: 5843531 - DNA, 19 bp, Homo sapiens
agtgccataccttctccca

SEQ ID NO: 5843532 - DNA, 20 bp, Homo sapiens
agtgccataccttctcccag

SEQ ID NO: 5843533 - DNA, 22 bp, Homo sapiens
agtgccataccttctcccaggc

SEQ ID NO: 5843534 - DNA, 13 bp, Homo sapiens
agtgccatatatt

SEQ ID NO: 5843535 - DNA, 13 bp, Homo sapiens
agtgccatctcaa

SEQ ID NO: 5843536 - DNA, 12 bp, Homo sapiens
agtgccatggct

SEQ ID NO: 5843537 - DNA, 15 bp, Homo sapiens
agtgccatggctggg

SEQ ID NO: 5843538 - DNA, 17 bp, Homo sapiens
agtgccattactactgt

SEQ ID NO: 5843539 - DNA, 20 bp, Homo sapiens
agtgccattactactgtaca

SEQ ID NO: 5843540 - DNA, 17 bp, Homo sapiens
agtgccattgtctttat

SEQ ID NO: 5843541 - DNA, 21 bp, Homo sapiens
agtgccattgtctttatatga

SEQ ID NO: 5843542 - DNA, 17 bp, Homo sapiens
agtgccatttcctgtct

SEQ ID NO: 5843543 - DNA, 19 bp, Homo sapiens
agtgccatttcctgtctgg

SEQ ID NO: 5843544 - DNA, 13 bp, Homo sapiens
agtgcccaaagtg

SEQ ID NO: 5843545 - DNA, 19 bp, Homo sapiens
agtgcccaaagtggggagg

SEQ ID NO: 5843546 - DNA, 17 bp, Homo sapiens
agtgcccaactgttata

SEQ ID NO: 5843547 - DNA, 22 bp, Homo sapiens
agtgcccaccctgggagacaga

SEQ ID NO: 5843548 - DNA, 23 bp, Homo sapiens
agtgcccaccctgggagacagac

SEQ ID NO: 5843549 - DNA, 19 bp, Homo sapiens
agtgcccaccgccctcctc

SEQ ID NO: 5843550 - DNA, 13 bp, Homo sapiens
agtgcccagcaga

SEQ ID NO: 5843551 - DNA, 15 bp, Homo sapiens
agtgcccagcagagg

SEQ ID NO: 5843552 - DNA, 14 bp, Homo sapiens
agtgcccagcccct

SEQ ID NO: 5843553 - DNA, 19 bp, Homo sapiens
agtgcccagcccctgcccc

SEQ ID NO: 5843554 - DNA, 23 bp, Homo sapiens
agtgcccagcccctgcccctacg

SEQ ID NO: 5843555 - DNA, 18 bp, Homo sapiens
agtgcccagtgatggcat

SEQ ID NO: 5843556 - DNA, 18 bp, Homo sapiens
agtgcccagtggagcctg

SEQ ID NO: 5843557 - DNA, 16 bp, Homo sapiens
agtgcccatgtgtatg

SEQ ID NO: 5843558 - DNA, 20 bp, Homo sapiens
agtgccccaccactccccaa

SEQ ID NO: 5843559 - DNA, 23 bp, Homo sapiens
agtgccccacctcccgccctcac

SEQ ID NO: 5843560 - DNA, 15 bp, Homo sapiens
agtgccccacctgcc

SEQ ID NO: 5843561 - DNA, 23 bp, Homo sapiens
agtgccccacctgccactaggct

SEQ ID NO: 5843562 - DNA, 20 bp, Homo sapiens
agtgccccagaaatgccgct

SEQ ID NO: 5843563 - DNA, 14 bp, Homo sapiens
agtgccccagactg

SEQ ID NO: 5843564 - DNA, 18 bp, Homo sapiens
agtgccccagactgagct

SEQ ID NO: 5843565 - DNA, 16 bp, Homo sapiens
agtgcccccacccagt

SEQ ID NO: 5843566 - DNA, 14 bp, Homo sapiens
agtgcccccactga

SEQ ID NO: 5843567 - DNA, 23 bp, Homo sapiens
agtgccccgtctacagctccccc

SEQ ID NO: 5843568 - DNA, 17 bp, Homo sapiens
agtgcccctcccatggc

SEQ ID NO: 5843569 - DNA, 20 bp, Homo sapiens
agtgcccctcccatggccca

SEQ ID NO: 5843570 - DNA, 23 bp, Homo sapiens
agtgcccctcccatggcccagca

SEQ ID NO: 5843571 - DNA, 14 bp, Homo sapiens
agtgcccctgctgc

SEQ ID NO: 5843572 - DNA, 15 bp, Homo sapiens
agtgcccgccctgcc

SEQ ID NO: 5843573 - DNA, 16 bp, Homo sapiens
agtgcccgccctgccc

SEQ ID NO: 5843574 - DNA, 19 bp, Homo sapiens
agtgcccggtgcagggcct

SEQ ID NO: 5843575 - DNA, 21 bp, Homo sapiens
agtgcccgtgaagcgtgtttt

SEQ ID NO: 5843576 - DNA, 23 bp, Homo sapiens
agtgcccgttttaccaataaact

SEQ ID NO: 5843577 - DNA, 14 bp, Homo sapiens
agtgccctagaagg

SEQ ID NO: 5843578 - DNA, 11 bp, Homo sapiens
agtgccctcat

SEQ ID NO: 5843579 - DNA, 14 bp, Homo sapiens
agtgccctccagcc

SEQ ID NO: 5843580 - DNA, 12 bp, Homo sapiens
agtgccctctcc

SEQ ID NO: 5843581 - DNA, 19 bp, Homo sapiens
agtgccctctcccaccctc

SEQ ID NO: 5843582 - DNA, 22 bp, Homo sapiens
agtgccctctcccaccctcttc

SEQ ID NO: 5843583 - DNA, 15 bp, Homo sapiens
agtgccctctcccct

SEQ ID NO: 5843584 - DNA, 13 bp, Homo sapiens
agtgccctgagcc

SEQ ID NO: 5843585 - DNA, 13 bp, Homo sapiens
agtgccctgcagg

SEQ ID NO: 5843586 - DNA, 12 bp, Homo sapiens
agtgccctgccc

SEQ ID NO: 5843587 - DNA, 20 bp, Homo sapiens
agtgccctgccccagtcagc

SEQ ID NO: 5843588 - DNA, 20 bp, Homo sapiens
agtgccctgccccctggctg

SEQ ID NO: 5843589 - DNA, 23 bp, Homo sapiens
agtgccctggggctgatctcagg

SEQ ID NO: 5843590 - DNA, 18 bp, Homo sapiens
agtgccgaatgactatgt

SEQ ID NO: 5843591 - DNA, 20 bp, Homo sapiens
agtgccgcaataaatgctca

SEQ ID NO: 5843592 - DNA, 12 bp, Homo sapiens
agtggctgctgc

SEQ ID NO: 5843593 - DNA, 16 bp, Homo sapiens
agtggctggaagaacc

SEQ ID NO: 5843594 - DNA, 21 bp, Homo sapiens
agtggctggaattaaaacaaa

SEQ ID NO: 5843595 - DNA, 16 bp, Homo sapiens
agtggctggatctgtg

SEQ ID NO: 5843596 - DNA, 21 bp, Homo sapiens
agtggctgggggactgctttc

SEQ ID NO: 5843597 - DNA, 20 bp, Homo sapiens
agtggctgggtgggcccaga

SEQ ID NO: 5843598 - DNA, 18 bp, Homo sapiens
agtggctggtagaaaaag

SEQ ID NO: 5843599 - DNA, 17 bp, Homo sapiens
agtggctggtccagggc

SEQ ID NO: 5843600 - DNA, 14 bp, Homo sapiens
agtggctggtgccc

SEQ ID NO: 5843601 - DNA, 17 bp, Homo sapiens
agtggctgtccagtgcc

SEQ ID NO: 5843602 - DNA, 16 bp, Homo sapiens
agtggctgtccctgtg

SEQ ID NO: 5843603 - DNA, 14 bp, Homo sapiens
agtggctgttcatg

SEQ ID NO: 5843604 - DNA, 22 bp, Homo sapiens
agtggctgttcatgctccaaga

SEQ ID NO: 5843605 - DNA, 15 bp, Homo sapiens
agtggcttcaaaata

SEQ ID NO: 5843606 - DNA, 21 bp, Homo sapiens
agtggcttcactcctgctgta

SEQ ID NO: 5843607 - DNA, 16 bp, Homo sapiens
agtggcttcagcccct

SEQ ID NO: 5843608 - DNA, 18 bp, Homo sapiens
agtggcttcagcccctgg

SEQ ID NO: 5843609 - DNA, 20 bp, Homo sapiens
agtggcttcattagagcagg

SEQ ID NO: 5843610 - DNA, 21 bp, Homo sapiens
agtggcttcattagagcaggc

SEQ ID NO: 5843611 - DNA, 22 bp, Homo sapiens
agtggcttcattagagcaggcg

SEQ ID NO: 5843612 - DNA, 15 bp, Homo sapiens
agtggcttcccagct

SEQ ID NO: 5843613 - DNA, 12 bp, Homo sapiens
agtggcttcctc

SEQ ID NO: 5843614 - DNA, 13 bp, Homo sapiens
agtggcttctcca

SEQ ID NO: 5843615 - DNA, 16 bp, Homo sapiens
agtggcttctccatcc

SEQ ID NO: 5843616 - DNA, 22 bp, Homo sapiens
agtggcttgtgattctgggatg

SEQ ID NO: 5843617 - DNA, 12 bp, Homo sapiens
agtggcttttca

SEQ ID NO: 5843618 - DNA, 20 bp, Homo sapiens
agtgggaaatatgccactga

SEQ ID NO: 5843619 - DNA, 13 bp, Homo sapiens
agtgggaagagct

SEQ ID NO: 5843620 - DNA, 15 bp, Homo sapiens
agtgggaagagctgg

SEQ ID NO: 5843621 - DNA, 17 bp, Homo sapiens
agtgggaagagctgggt

SEQ ID NO: 5843622 - DNA, 21 bp, Homo sapiens
agtgggaagcccatcctgacc

SEQ ID NO: 5843623 - DNA, 13 bp, Homo sapiens
agtgggaagggag

SEQ ID NO: 5843624 - DNA, 15 bp, Homo sapiens
agtgggacagacagc

SEQ ID NO: 5843625 - DNA, 21 bp, Homo sapiens
agtgggacagacagcagctgg

SEQ ID NO: 5843626 - DNA, 15 bp, Homo sapiens
agtgggacattagta

SEQ ID NO: 5843627 - DNA, 21 bp, Homo sapiens
agtgggacccatagatcttct

SEQ ID NO: 5843628 - DNA, 22 bp, Homo sapiens
agtgggacccatagatcttctg

SEQ ID NO: 5843629 - DNA, 24 bp, Homo sapiens
agtgggacttggagagcaaaggcc

SEQ ID NO: 5843630 - DNA, 13 bp, Homo sapiens
agtgggagaaaac

SEQ ID NO: 5843631 - DNA, 21 bp, Homo sapiens
agtgggagaaattagaaaaca

SEQ ID NO: 5843632 - DNA, 14 bp, Homo sapiens
agtgggagaaggca

SEQ ID NO: 5843633 - DNA, 15 bp, Homo sapiens
agtgggagaaggcag

SEQ ID NO: 5843634 - DNA, 18 bp, Homo sapiens
agtgggagaagtggcccc

SEQ ID NO: 5843635 - DNA, 11 bp, Homo sapiens
agtgggagagg

SEQ ID NO: 5843636 - DNA, 16 bp, Homo sapiens
agtgggagaggctggg

SEQ ID NO: 5843637 - DNA, 15 bp, Homo sapiens
agtgggagatgaaaa

SEQ ID NO: 5843638 - DNA, 14 bp, Homo sapiens
agtgggagcccagc

SEQ ID NO: 5843639 - DNA, 15 bp, Homo sapiens
agtgggagctgcctg

SEQ ID NO: 5843640 - DNA, 16 bp, Homo sapiens
agtgggaggcgtgccc

SEQ ID NO: 5843641 - DNA, 13 bp, Homo sapiens
agtgggaggggca

SEQ ID NO: 5843642 - DNA, 14 bp, Homo sapiens
agtgggaggggcag

SEQ ID NO: 5843643 - DNA, 15 bp, Homo sapiens
agtgggaggggcagg

SEQ ID NO: 5843644 - DNA, 18 bp, Homo sapiens
agtgggagtcaagtgtgc

SEQ ID NO: 5843645 - DNA, 17 bp, Homo sapiens
agtgggagtgggagagg

SEQ ID NO: 5843646 - DNA, 19 bp, Homo sapiens
agtgggagtgggagaggaa

SEQ ID NO: 5843647 - DNA, 22 bp, Homo sapiens
agtgggatcaaagctaggaaag

SEQ ID NO: 5843648 - DNA, 15 bp, Homo sapiens
agtgggatgaaccag

SEQ ID NO: 5843649 - DNA, 21 bp, Homo sapiens
agtgggatttggggcctcaag

SEQ ID NO: 5843650 - DNA, 14 bp, Homo sapiens
agtgggcaaaagct

SEQ ID NO: 5843651 - DNA, 24 bp, Homo sapiens
agtgggcaaaagcttacaaatact

SEQ ID NO: 5843652 - DNA, 14 bp, Homo sapiens
agtgggcacctcag

SEQ ID NO: 5843653 - DNA, 15 bp, Homo sapiens
agtgggcacctcaga

SEQ ID NO: 5843654 - DNA, 20 bp, Homo sapiens
agtgggcactaagggtggag

SEQ ID NO: 5843655 - DNA, 22 bp, Homo sapiens
agtgggcactaagggtggagag

SEQ ID NO: 5843656 - DNA, 20 bp, Homo sapiens
agtgggcagagcccccagga

SEQ ID NO: 5843657 - DNA, 14 bp, Homo sapiens
agtgggcaggtggc

SEQ ID NO: 5843658 - DNA, 17 bp, Homo sapiens
agtgggcaggtggccac

SEQ ID NO: 5843659 - DNA, 17 bp, Homo sapiens
agtgggcagtcaccacc

SEQ ID NO: 5843660 - DNA, 20 bp, Homo sapiens
agtgggcatcagcagcaggg

SEQ ID NO: 5843661 - DNA, 22 bp, Homo sapiens
agtgggcattttgacaacatgg

SEQ ID NO: 5843662 - DNA, 15 bp, Homo sapiens
agtgggccagggctg

SEQ ID NO: 5843663 - DNA, 15 bp, Homo sapiens
agtgggccagtcctg

SEQ ID NO: 5843664 - DNA, 20 bp, Homo sapiens
agtgggccagtcctggttgt

SEQ ID NO: 5843665 - DNA, 16 bp, Homo sapiens
agtgggccccctctct

SEQ ID NO: 5843666 - DNA, 18 bp, Homo sapiens
agtgggccccgggctgga

SEQ ID NO: 5843667 - DNA, 19 bp, Homo sapiens
agtgggccccgggctggag

SEQ ID NO: 5843668 - DNA, 19 bp, Homo sapiens
agtgggccctccgacagcc

SEQ ID NO: 5843669 - DNA, 20 bp, Homo sapiens
agtgggccggccccaggctc

SEQ ID NO: 5843670 - DNA, 18 bp, Homo sapiens
agtgggcctgctgaggcc

SEQ ID NO: 5843671 - DNA, 14 bp, Homo sapiens
agtgggcctgtgtg

SEQ ID NO: 5843672 - DNA, 19 bp, Homo sapiens
agtgggcggcttccctgcg

SEQ ID NO: 5843673 - DNA, 18 bp, Homo sapiens
agtgggcgttgggagcct

SEQ ID NO: 5843674 - DNA, 13 bp, Homo sapiens
agtgggctcctga

SEQ ID NO: 5843675 - DNA, 14 bp, Homo sapiens
agtgggctcctgac

SEQ ID NO: 5843676 - DNA, 16 bp, Homo sapiens
agtgggctcctgacaa

SEQ ID NO: 5843677 - DNA, 15 bp, Homo sapiens
agtgggctgcagcag

SEQ ID NO: 5843678 - DNA, 17 bp, Homo sapiens
agtgggctgcagcagcc

SEQ ID NO: 5843679 - DNA, 17 bp, Homo sapiens
agtgggctgcatctggg

SEQ ID NO: 5843680 - DNA, 18 bp, Homo sapiens
agtgggctgggccctctg

SEQ ID NO: 5843681 - DNA, 22 bp, Homo sapiens
agtgggcttgattctgcagtaa

SEQ ID NO: 5843682 - DNA, 19 bp, Homo sapiens
agtgggctttccagggtct

SEQ ID NO: 5843683 - DNA, 16 bp, Homo sapiens
agtgggctttgcaagc

SEQ ID NO: 5843684 - DNA, 21 bp, Homo sapiens
agtgggctttggtggccaggg

SEQ ID NO: 5843685 - DNA, 13 bp, Homo sapiens
agtgggctttgtg

SEQ ID NO: 5843686 - DNA, 23 bp, Homo sapiens
agtgggctttgtggaaacagctg

SEQ ID NO: 5843687 - DNA, 19 bp, Homo sapiens
agtggggaactgagggcaa

SEQ ID NO: 5843688 - DNA, 13 bp, Homo sapiens
agtggggaagagt

SEQ ID NO: 5843689 - DNA, 19 bp, Homo sapiens
agtggggacgggggctgct

SEQ ID NO: 5843690 - DNA, 22 bp, Homo sapiens
agtggggacgggggctgcttct

SEQ ID NO: 5843691 - DNA, 18 bp, Homo sapiens
agtggggagacacctcag

SEQ ID NO: 5843692 - DNA, 20 bp, Homo sapiens
agtggggagacacctcagag

SEQ ID NO: 5843693 - DNA, 16 bp, Homo sapiens
agtggggagcggagct

SEQ ID NO: 5843694 - DNA, 20 bp, Homo sapiens
agtggggaggagactcaggc

SEQ ID NO: 5843695 - DNA, 14 bp, Homo sapiens
agtggggagggaca

SEQ ID NO: 5843696 - DNA, 19 bp, Homo sapiens
agtggggagggacaaggga

SEQ ID NO: 5843697 - DNA, 18 bp, Homo sapiens
agtggggaggggcctggc

SEQ ID NO: 5843698 - DNA, 19 bp, Homo sapiens
agtggggaggggcctggcc

SEQ ID NO: 5843699 - DNA, 14 bp, Homo sapiens
agtggggaggggct

SEQ ID NO: 5843700 - DNA, 23 bp, Homo sapiens
agtggggcaggcttgagttttca

SEQ ID NO: 5843701 - DNA, 22 bp, Homo sapiens
agtggggcccatggccccagct

SEQ ID NO: 5843702 - DNA, 13 bp, Homo sapiens
agtggggcctgcc

SEQ ID NO: 5843703 - DNA, 14 bp, Homo sapiens
agtggggcctgccc

SEQ ID NO: 5843704 - DNA, 13 bp, Homo sapiens
agtggggcctgtg

SEQ ID NO: 5843705 - DNA, 14 bp, Homo sapiens
agtggggcctttgc

SEQ ID NO: 5843706 - DNA, 16 bp, Homo sapiens
agtggggcctttgcca

SEQ ID NO: 5843707 - DNA, 19 bp, Homo sapiens
agtggggcctttgccagca

SEQ ID NO: 5843708 - DNA, 20 bp, Homo sapiens
agtggggcctttgccagcag

SEQ ID NO: 5843709 - DNA, 22 bp, Homo sapiens
agtggggcctttgccagcagag

SEQ ID NO: 5843710 - DNA, 23 bp, Homo sapiens
agtggggcctttgccagcagagc

SEQ ID NO: 5843711 - DNA, 18 bp, Homo sapiens
agtggggctaaatgaagt

SEQ ID NO: 5843712 - DNA, 19 bp, Homo sapiens
agtggggctagactgggct

SEQ ID NO: 5843713 - DNA, 21 bp, Homo sapiens
agtggggctagactgggctgg

SEQ ID NO: 5843714 - DNA, 23 bp, Homo sapiens
agtggggctagactgggctggct

SEQ ID NO: 5843715 - DNA, 13 bp, Homo sapiens
agtggggctctgg

SEQ ID NO: 5843716 - DNA, 22 bp, Homo sapiens
agtggggctggaagcagaaaca

SEQ ID NO: 5843717 - DNA, 13 bp, Homo sapiens
agtggggctggca

SEQ ID NO: 5843718 - DNA, 14 bp, Homo sapiens
agtggggctggcat

SEQ ID NO: 5843719 - DNA, 12 bp, Homo sapiens
agtggggctggt

SEQ ID NO: 5843720 - DNA, 15 bp, Homo sapiens
agtggggcttcctgg

SEQ ID NO: 5843721 - DNA, 19 bp, Homo sapiens
agtgggggagagcaggctg

SEQ ID NO: 5843722 - DNA, 13 bp, Homo sapiens
agtgggggcaggt

SEQ ID NO: 5843723 - DNA, 15 bp, Homo sapiens
agtgggggctgtgcc

SEQ ID NO: 5843724 - DNA, 22 bp, Homo sapiens
agtggggggaacgcccacttcc

SEQ ID NO: 5843725 - DNA, 16 bp, Homo sapiens
agtggggggacagaga

SEQ ID NO: 5843726 - DNA, 18 bp, Homo sapiens
agtggggggaggaagcag

SEQ ID NO: 5843727 - DNA, 19 bp, Homo sapiens
agtggggggtggacacaga

SEQ ID NO: 5843728 - DNA, 22 bp, Homo sapiens
agtgggggtgatgatgaccaag

SEQ ID NO: 5843729 - DNA, 15 bp, Homo sapiens
agtgggggtggagga

SEQ ID NO: 5843730 - DNA, 16 bp, Homo sapiens
agtgggggtggaggac

SEQ ID NO: 5843731 - DNA, 12 bp, Homo sapiens
agtgggggtggg

SEQ ID NO: 5843732 - DNA, 19 bp, Homo sapiens
agtgggggtgggggtaggg

SEQ ID NO: 5843733 - DNA, 15 bp, Homo sapiens
agtggggtaattctg

SEQ ID NO: 5843734 - DNA, 17 bp, Homo sapiens
agtggggtagaggaaga

SEQ ID NO: 5843735 - DNA, 18 bp, Homo sapiens
agtggggtcaagctgagc

SEQ ID NO: 5843736 - DNA, 19 bp, Homo sapiens
agtggggtcaagctgagct

SEQ ID NO: 5843737 - DNA, 23 bp, Homo sapiens
agtggggtcccccctgagtgggc

SEQ ID NO: 5843738 - DNA, 17 bp, Homo sapiens
agtggggtcgtgaggca

SEQ ID NO: 5843739 - DNA, 20 bp, Homo sapiens
agtggggtctccctctcctg

SEQ ID NO: 5843740 - DNA, 22 bp, Homo sapiens
agtggggtctccctctcctgcc

SEQ ID NO: 5843741 - DNA, 18 bp, Homo sapiens
agtggggtgctgggagga

SEQ ID NO: 5843742 - DNA, 21 bp, Homo sapiens
agtggggtgctgggaggaggg

SEQ ID NO: 5843743 - DNA, 20 bp, Homo sapiens
agtggggtggtgtcagaccc

SEQ ID NO: 5843744 - DNA, 18 bp, Homo sapiens
agtggggttatctctgtg

SEQ ID NO: 5843745 - DNA, 20 bp, Homo sapiens
agtggggttatctctgtgtt

SEQ ID NO: 5843746 - DNA, 12 bp, Homo sapiens
agtggggttgat

SEQ ID NO: 5843747 - DNA, 22 bp, Homo sapiens
agtggggttgggggacagcctt

SEQ ID NO: 5843748 - DNA, 17 bp, Homo sapiens
agtggggtttttttgtc

SEQ ID NO: 5843749 - DNA, 15 bp, Homo sapiens
agtgggtacatcaag

SEQ ID NO: 5843750 - DNA, 17 bp, Homo sapiens
agtgggtactttctgaa

SEQ ID NO: 5843751 - DNA, 18 bp, Homo sapiens
agtgggtagaagccttat

SEQ ID NO: 5843752 - DNA, 13 bp, Homo sapiens
agtgggtcacctg

SEQ ID NO: 5843753 - DNA, 14 bp, Homo sapiens
agtgggtcccactt

SEQ ID NO: 5843754 - DNA, 16 bp, Homo sapiens
agtgggtcccacttcc

SEQ ID NO: 5843755 - DNA, 14 bp, Homo sapiens
agtgggtcccagat

SEQ ID NO: 5843756 - DNA, 21 bp, Homo sapiens
agtgggtcgcccacgggtgtg

SEQ ID NO: 5843757 - DNA, 23 bp, Homo sapiens
agtgggtctgggatatggctgcc

SEQ ID NO: 5843758 - DNA, 19 bp, Homo sapiens
agtgggtctggtggtgctg

SEQ ID NO: 5843759 - DNA, 16 bp, Homo sapiens
agtgggtgacaagagc

SEQ ID NO: 5843760 - DNA, 21 bp, Homo sapiens
agtgggtgacaagagcctgat

SEQ ID NO: 5843761 - DNA, 18 bp, Homo sapiens
agtgggtgagatgctgga

SEQ ID NO: 5843762 - DNA, 22 bp, Homo sapiens
agtgggtgatgcttttgctgct

SEQ ID NO: 5843763 - DNA, 23 bp, Homo sapiens
agtgggtgatgcttttgctgctg

SEQ ID NO: 5843764 - DNA, 20 bp, Homo sapiens
agtgggtgcgtggtatacat

SEQ ID NO: 5843765 - DNA, 11 bp, Homo sapiens
agtgggtgggg

SEQ ID NO: 5843766 - DNA, 15 bp, Homo sapiens
agtgggtggggacag

SEQ ID NO: 5843767 - DNA, 17 bp, Homo sapiens
agtgggtggggacagac

SEQ ID NO: 5843768 - DNA, 15 bp, Homo sapiens
agtgggtggggctgt

SEQ ID NO: 5843769 - DNA, 17 bp, Homo sapiens
agtgtgcaactggccag

SEQ ID NO: 5843770 - DNA, 18 bp, Homo sapiens
agtgtgcaactggccagc

SEQ ID NO: 5843771 - DNA, 18 bp, Homo sapiens
agtgtgcaagcaaagaac

SEQ ID NO: 5843772 - DNA, 13 bp, Homo sapiens
agtgtgcaaggca

SEQ ID NO: 5843773 - DNA, 22 bp, Homo sapiens
agtgtgcacccctccccattca

SEQ ID NO: 5843774 - DNA, 19 bp, Homo sapiens
agtgtgcacgagtgggaag

SEQ ID NO: 5843775 - DNA, 22 bp, Homo sapiens
agtgtgcacgagtgggaaggac

SEQ ID NO: 5843776 - DNA, 17 bp, Homo sapiens
agtgtgcacgcctgcag

SEQ ID NO: 5843777 - DNA, 22 bp, Homo sapiens
agtgtgcacgcctgcaggctgg

SEQ ID NO: 5843778 - DNA, 14 bp, Homo sapiens
agtgtgcagggtgg

SEQ ID NO: 5843779 - DNA, 18 bp, Homo sapiens
agtgtgccaccctctgca

SEQ ID NO: 5843780 - DNA, 15 bp, Homo sapiens
agtgtgccagagtta

SEQ ID NO: 5843781 - DNA, 19 bp, Homo sapiens
agtgtgcccaaaagccatg

SEQ ID NO: 5843782 - DNA, 13 bp, Homo sapiens
agtgtgcccatct

SEQ ID NO: 5843783 - DNA, 13 bp, Homo sapiens
agtgtgcccccca

SEQ ID NO: 5843784 - DNA, 17 bp, Homo sapiens
agtgtgccccccatcct

SEQ ID NO: 5843785 - DNA, 16 bp, Homo sapiens
agtgtgcccttctctt

SEQ ID NO: 5843786 - DNA, 20 bp, Homo sapiens
agtgtgcctgaagtcccaga

SEQ ID NO: 5843787 - DNA, 21 bp, Homo sapiens
agtgtgcctgaagtcccagat

SEQ ID NO: 5843788 - DNA, 16 bp, Homo sapiens
agtgtgcctgctatcc

SEQ ID NO: 5843789 - DNA, 15 bp, Homo sapiens
agtgtgcctgtcact

SEQ ID NO: 5843790 - DNA, 20 bp, Homo sapiens
agtgtgcctgtcactactgg

SEQ ID NO: 5843791 - DNA, 14 bp, Homo sapiens
agtgtgccttctct

SEQ ID NO: 5843792 - DNA, 15 bp, Homo sapiens
agtgtgcggagctga

SEQ ID NO: 5843793 - DNA, 20 bp, Homo sapiens
agtgtgcggatgataactac

SEQ ID NO: 5843794 - DNA, 20 bp, Homo sapiens
agtgtgcgtggtggtccctg

SEQ ID NO: 5843795 - DNA, 13 bp, Homo sapiens
agtgtgcgtgtgt

SEQ ID NO: 5843796 - DNA, 17 bp, Homo sapiens
agtgtgctcggacacag

SEQ ID NO: 5843797 - DNA, 19 bp, Homo sapiens
agtgtgctctttttttaaa

SEQ ID NO: 5843798 - DNA, 15 bp, Homo sapiens
agtgtgctgaacaca

SEQ ID NO: 5843799 - DNA, 15 bp, Homo sapiens
agtgtgctgactttt

SEQ ID NO: 5843800 - DNA, 19 bp, Homo sapiens
agtgtgctgaggtgggcct

SEQ ID NO: 5843801 - DNA, 20 bp, Homo sapiens
agtgtgctgctgtaagaaat

SEQ ID NO: 5843802 - DNA, 14 bp, Homo sapiens
agtgtgctgctgtt

SEQ ID NO: 5843803 - DNA, 13 bp, Homo sapiens
agtgtgctggagg

SEQ ID NO: 5843804 - DNA, 15 bp, Homo sapiens
agtgtgctggaggac

SEQ ID NO: 5843805 - DNA, 23 bp, Homo sapiens
agtgtgctgtatggcccaggcag

SEQ ID NO: 5843806 - DNA, 16 bp, Homo sapiens
agtgtgcttacctgtt

SEQ ID NO: 5843807 - DNA, 16 bp, Homo sapiens
agtgtgctttataaaa

SEQ ID NO: 5843808 - DNA, 21 bp, Homo sapiens
agtgtgctttgcattttctga

SEQ ID NO: 5843809 - DNA, 23 bp, Homo sapiens
agtgtggaaaaatagctctgtgt

SEQ ID NO: 5843810 - DNA, 21 bp, Homo sapiens
agtgtggaaagcaaaataaca

SEQ ID NO: 5843811 - DNA, 20 bp, Homo sapiens
agtgtggaagccggagggtg

SEQ ID NO: 5843812 - DNA, 19 bp, Homo sapiens
agtgtggactctggactgg

SEQ ID NO: 5843813 - DNA, 21 bp, Homo sapiens
agtgtggagaccctgccacag

SEQ ID NO: 5843814 - DNA, 19 bp, Homo sapiens
agtgtggagctgcttccag

SEQ ID NO: 5843815 - DNA, 18 bp, Homo sapiens
agtgtggagtcattctca

SEQ ID NO: 5843816 - DNA, 23 bp, Homo sapiens
agtgtggagtcattctcattgaa

SEQ ID NO: 5843817 - DNA, 17 bp, Homo sapiens
agtgtggagtgggtaat

SEQ ID NO: 5843818 - DNA, 23 bp, Homo sapiens
agtgtggagttcaccttggaagg

SEQ ID NO: 5843819 - DNA, 20 bp, Homo sapiens
agtgtggatgtaaattttat

SEQ ID NO: 5843820 - DNA, 15 bp, Homo sapiens
agtgtggcctggatc

SEQ ID NO: 5843821 - DNA, 20 bp, Homo sapiens
agtgtggcgggaagggtggg

SEQ ID NO: 5843822 - DNA, 14 bp, Homo sapiens
agtgtggctcccct

SEQ ID NO: 5843823 - DNA, 18 bp, Homo sapiens
agtgtggctggtgtcccc

SEQ ID NO: 5843824 - DNA, 22 bp, Homo sapiens
agtgtggctggtgtccccttcc

SEQ ID NO: 5843825 - DNA, 15 bp, Homo sapiens
agtgtggcttaaaca

SEQ ID NO: 5843826 - DNA, 18 bp, Homo sapiens
agtgtgggacaggctctt

SEQ ID NO: 5843827 - DNA, 21 bp, Homo sapiens
agtgtgggactccaggccagc

SEQ ID NO: 5843828 - DNA, 14 bp, Homo sapiens
agtgtgggaggctc

SEQ ID NO: 5843829 - DNA, 18 bp, Homo sapiens
agtgtgggaggctcctgt

SEQ ID NO: 5843830 - DNA, 20 bp, Homo sapiens
agtgtgggaggctcctgtta

SEQ ID NO: 5843831 - DNA, 18 bp, Homo sapiens
agtgtgggcgctctccct

SEQ ID NO: 5843832 - DNA, 17 bp, Homo sapiens
agtgtggggagggcagg

SEQ ID NO: 5843833 - DNA, 19 bp, Homo sapiens
agtgtggggggacagacag

SEQ ID NO: 5843834 - DNA, 17 bp, Homo sapiens
agtgtgggtctgtgtgt

SEQ ID NO: 5843835 - DNA, 15 bp, Homo sapiens
agtgtggtccctcca

SEQ ID NO: 5843836 - DNA, 17 bp, Homo sapiens
agtgtggtctgtaatat

SEQ ID NO: 5843837 - DNA, 16 bp, Homo sapiens
agtgtggtgtttcctg

SEQ ID NO: 5843838 - DNA, 23 bp, Homo sapiens
agtgtggtgtttcctgcaggcca

SEQ ID NO: 5843839 - DNA, 19 bp, Homo sapiens
agtgtggtgtttcctggca

SEQ ID NO: 5843840 - DNA, 22 bp, Homo sapiens
agtgtggtgtttcctggcactg

SEQ ID NO: 5843841 - DNA, 13 bp, Homo sapiens
agtgtggtttctt

SEQ ID NO: 5843842 - DNA, 20 bp, Homo sapiens
agtgtggttttgtaatttaa

SEQ ID NO: 5843843 - DNA, 11 bp, Homo sapiens
agtgtgtaaaa

SEQ ID NO: 5843844 - DNA, 13 bp, Homo sapiens
agtgtgtaaaatt

SEQ ID NO: 5843845 - DNA, 15 bp, Homo sapiens
agtgtgtaaaattaa

SEQ ID NO: 5843846 - DNA, 18 bp, Homo sapiens
agtgtgtaaaattaatgt

SEQ ID NO: 5843847 - DNA, 20 bp, Homo sapiens
agtgtgtaaaattaatgtaa

SEQ ID NO: 5843848 - DNA, 23 bp, Homo sapiens
agtgtgtaaataatttgcactga

SEQ ID NO: 5843849 - DNA, 19 bp, Homo sapiens
agtgtgtaaggtatatgtt

SEQ ID NO: 5843850 - DNA, 16 bp, Homo sapiens
agtgtgtataaaacat

SEQ ID NO: 5843851 - DNA, 18 bp, Homo sapiens
agtgtgtatatattttgt

SEQ ID NO: 5843852 - DNA, 16 bp, Homo sapiens
agtgtgtatgtgcgtg

SEQ ID NO: 5843853 - DNA, 20 bp, Homo sapiens
agtgtgtattaaaaaaaaca

SEQ ID NO: 5843854 - DNA, 18 bp, Homo sapiens
agtgtgtcagagcccagg

SEQ ID NO: 5843855 - DNA, 13 bp, Homo sapiens
agtgtgtcagagt

SEQ ID NO: 5843856 - DNA, 19 bp, Homo sapiens
agtgtgtccatcctgacct

SEQ ID NO: 5843857 - DNA, 20 bp, Homo sapiens
agtgtgtccttggggcacag

SEQ ID NO: 5843858 - DNA, 14 bp, Homo sapiens
agtgtgtctaaatt

SEQ ID NO: 5843859 - DNA, 14 bp, Homo sapiens
agtgtgtctcctgc

SEQ ID NO: 5843860 - DNA, 20 bp, Homo sapiens
agtgtgtcttagtgtgtgca

SEQ ID NO: 5843861 - DNA, 22 bp, Homo sapiens
agtgtgtgaactgctttcaagt

SEQ ID NO: 5843862 - DNA, 20 bp, Homo sapiens
agtgtgtgcacatgtgtgcg

SEQ ID NO: 5843863 - DNA, 16 bp, Homo sapiens
agtgtgtgcatgtgtg

SEQ ID NO: 5843864 - DNA, 14 bp, Homo sapiens
agtgtgtgctcagc

SEQ ID NO: 5843865 - DNA, 15 bp, Homo sapiens
agtgtgtggccccgc

SEQ ID NO: 5843866 - DNA, 16 bp, Homo sapiens
agtgtgtgggcagggt

SEQ ID NO: 5843867 - DNA, 21 bp, Homo sapiens
agtgtgtgggggtctgggagg

SEQ ID NO: 5843868 - DNA, 14 bp, Homo sapiens
agtgtgtgggtcta

SEQ ID NO: 5843869 - DNA, 19 bp, Homo sapiens
agtgtgtggtcaacatttc

SEQ ID NO: 5843870 - DNA, 23 bp, Homo sapiens
agtgtgtggtctctgccccagcc

SEQ ID NO: 5843871 - DNA, 14 bp, Homo sapiens
agtgtgtgtctttc

SEQ ID NO: 5843872 - DNA, 17 bp, Homo sapiens
agtgtgtgtgcagagtc

SEQ ID NO: 5843873 - DNA, 15 bp, Homo sapiens
agtgtgtgtgcatgt

SEQ ID NO: 5843874 - DNA, 12 bp, Homo sapiens
agtgtgtgtgct

SEQ ID NO: 5843875 - DNA, 13 bp, Homo sapiens
agtgtgtgtgggg

SEQ ID NO: 5843876 - DNA, 23 bp, Homo sapiens
agtgtgtgtgtctgttgagtgca

SEQ ID NO: 5843877 - DNA, 20 bp, Homo sapiens
agtgtgtgtgtgcatgtgtg

SEQ ID NO: 5843878 - DNA, 16 bp, Homo sapiens
agtgtgtgtgtgtcca

SEQ ID NO: 5843879 - DNA, 20 bp, Homo sapiens
agtgtgtgtgtgtggtccat

SEQ ID NO: 5843880 - DNA, 22 bp, Homo sapiens
agtgtgtgtgtgtgtctgtagg

SEQ ID NO: 5843881 - DNA, 16 bp, Homo sapiens
agtgtgtgttgcaaat

SEQ ID NO: 5843882 - DNA, 19 bp, Homo sapiens
agtgtgtgtttaacattca

SEQ ID NO: 5843883 - DNA, 23 bp, Homo sapiens
agtgtgtgtttaacattcacagc

SEQ ID NO: 5843884 - DNA, 22 bp, Homo sapiens
agtgtgtgtttgtgtgtttcaa

SEQ ID NO: 5843885 - DNA, 18 bp, Homo sapiens
agtgtgtgtttttcataa

SEQ ID NO: 5843886 - DNA, 18 bp, Homo sapiens
agtgtgttggtgctttag

SEQ ID NO: 5843887 - DNA, 16 bp, Homo sapiens
agtgtgttgtctgtgc

SEQ ID NO: 5843888 - DNA, 17 bp, Homo sapiens
agtgtgttgtctgtgca

SEQ ID NO: 5843889 - DNA, 15 bp, Homo sapiens
agtgtgttgttgctt

SEQ ID NO: 5843890 - DNA, 22 bp, Homo sapiens
agtgtgtttgtgagtatgtgtg

SEQ ID NO: 5843891 - DNA, 22 bp, Homo sapiens
agtgtgtttttgcactgtctgt

SEQ ID NO: 5843892 - DNA, 13 bp, Homo sapiens
agtgttaaagtga

SEQ ID NO: 5843893 - DNA, 20 bp, Homo sapiens
agtgttaaggcaacattcct

SEQ ID NO: 5843894 - DNA, 16 bp, Homo sapiens
agtgttaataaatgga

SEQ ID NO: 5843895 - DNA, 17 bp, Homo sapiens
agtgttaataaatggat

SEQ ID NO: 5843896 - DNA, 12 bp, Homo sapiens
agtgttaatcaa

SEQ ID NO: 5843897 - DNA, 14 bp, Homo sapiens
agtgttaatccaga

SEQ ID NO: 5843898 - DNA, 15 bp, Homo sapiens
agtgttacctgtgtg

SEQ ID NO: 5843899 - DNA, 22 bp, Homo sapiens
agtgttactacagccttaatat

SEQ ID NO: 5843900 - DNA, 20 bp, Homo sapiens
agtgttagcttaatcttaat

SEQ ID NO: 5843901 - DNA, 18 bp, Homo sapiens
agtgttagggaagggcct

SEQ ID NO: 5843902 - DNA, 19 bp, Homo sapiens
agtgttagggaagggcctg

SEQ ID NO: 5843903 - DNA, 18 bp, Homo sapiens
agtgttagttataaatag

SEQ ID NO: 5843904 - DNA, 17 bp, Homo sapiens
agtgttataaaatctgt

SEQ ID NO: 5843905 - DNA, 19 bp, Homo sapiens
agtgttataaaatctgtat

SEQ ID NO: 5843906 - DNA, 23 bp, Homo sapiens
agtgttataaaatctgtattgct

SEQ ID NO: 5843907 - DNA, 14 bp, Homo sapiens
agtgttatatgaac

SEQ ID NO: 5843908 - DNA, 14 bp, Homo sapiens
agtgttatgagcca

SEQ ID NO: 5843909 - DNA, 13 bp, Homo sapiens
agtgttatgtatt

SEQ ID NO: 5843910 - DNA, 18 bp, Homo sapiens
agtgttatttattcccca

SEQ ID NO: 5843911 - DNA, 21 bp, Homo sapiens
agtgttattttctttgaaatt

SEQ ID NO: 5843912 - DNA, 20 bp, Homo sapiens
agtgttatttttcaaggaag

SEQ ID NO: 5843913 - DNA, 23 bp, Homo sapiens
agtgttcaaaacaaaatgaaaca

SEQ ID NO: 5843914 - DNA, 22 bp, Homo sapiens
agtgttcaaactactgtacatt

SEQ ID NO: 5843915 - DNA, 18 bp, Homo sapiens
agtgttcaaataaactga

SEQ ID NO: 5843916 - DNA, 18 bp, Homo sapiens
agtgttcaaattctgatt

SEQ ID NO: 5843917 - DNA, 20 bp, Homo sapiens
agtgttcaaattctgattat

SEQ ID NO: 5843918 - DNA, 17 bp, Homo sapiens
agtgttcaagaaataaa

SEQ ID NO: 5843919 - DNA, 13 bp, Homo sapiens
agtgttcacaaac

SEQ ID NO: 5843920 - DNA, 19 bp, Homo sapiens
agtgttcacaaactgtgaa

SEQ ID NO: 5843921 - DNA, 20 bp, Homo sapiens
agtgttcacaaactgtgaaa

SEQ ID NO: 5843922 - DNA, 23 bp, Homo sapiens
agtgttcacaacctggaagtgct

SEQ ID NO: 5843923 - DNA, 19 bp, Homo sapiens
agtgttcagccaaacagta

SEQ ID NO: 5843924 - DNA, 21 bp, Homo sapiens
agtgttcattttagtgactgt

SEQ ID NO: 5843925 - DNA, 17 bp, Homo sapiens
agtgttccaagtctctg

SEQ ID NO: 5843926 - DNA, 20 bp, Homo sapiens
agtgttcccgtgcctgggag

SEQ ID NO: 5843927 - DNA, 18 bp, Homo sapiens
agtgttccctgagaaacc

SEQ ID NO: 5843928 - DNA, 18 bp, Homo sapiens
agtgttcccttctggctg

SEQ ID NO: 5843929 - DNA, 21 bp, Homo sapiens
agtgttccgtggttaaactcg

SEQ ID NO: 5843930 - DNA, 16 bp, Homo sapiens
agtgttcctatttggg

SEQ ID NO: 5843931 - DNA, 13 bp, Homo sapiens
agtgttcctgtct

SEQ ID NO: 5843932 - DNA, 14 bp, Homo sapiens
agtgttcctgtctc

SEQ ID NO: 5843933 - DNA, 15 bp, Homo sapiens
agtgttctaaaatga

SEQ ID NO: 5843934 - DNA, 22 bp, Homo sapiens
agtgttctcatgaagcaggagg

SEQ ID NO: 5843935 - DNA, 23 bp, Homo sapiens
agtgttctcatgaagcaggaggc

SEQ ID NO: 5843936 - DNA, 13 bp, Homo sapiens
agtgttctcctct

SEQ ID NO: 5843937 - DNA, 17 bp, Homo sapiens
agtgttctgcaaaaata

SEQ ID NO: 5843938 - DNA, 19 bp, Homo sapiens
agtgttctgcatggattca

SEQ ID NO: 5843939 - DNA, 17 bp, Homo sapiens
agtgttctgctcctgct

SEQ ID NO: 5843940 - DNA, 19 bp, Homo sapiens
agtgttctgctcctgcttt

SEQ ID NO: 5843941 - DNA, 20 bp, Homo sapiens
agtgttctgggatttctcta

SEQ ID NO: 5843942 - DNA, 13 bp, Homo sapiens
agtgttctgtatt

SEQ ID NO: 5843943 - DNA, 20 bp, Homo sapiens
agtgttctgttacaaaatgt

SEQ ID NO: 5843944 - DNA, 22 bp, Homo sapiens
agtgttctgtttgttattgttt

SEQ ID NO: 5843945 - DNA, 14 bp, Homo sapiens
agttcagtacctgg

SEQ ID NO: 5843946 - DNA, 16 bp, Homo sapiens
agttcagtacctggag

SEQ ID NO: 5843947 - DNA, 20 bp, Homo sapiens
agttcagtagaattaccatt

SEQ ID NO: 5843948 - DNA, 22 bp, Homo sapiens
agttcagtggcagggctcagga

SEQ ID NO: 5843949 - DNA, 23 bp, Homo sapiens
agttcagtgtatggcgttggttt

SEQ ID NO: 5843950 - DNA, 18 bp, Homo sapiens
agttcagtttgtctcttt

SEQ ID NO: 5843951 - DNA, 19 bp, Homo sapiens
agttcagttttaccagatg

SEQ ID NO: 5843952 - DNA, 18 bp, Homo sapiens
agttcataaatttatggt

SEQ ID NO: 5843953 - DNA, 16 bp, Homo sapiens
agttcataacagtgcc

SEQ ID NO: 5843954 - DNA, 17 bp, Homo sapiens
agttcataacagtgcca

SEQ ID NO: 5843955 - DNA, 19 bp, Homo sapiens
agttcataacagtgccatt

SEQ ID NO: 5843956 - DNA, 19 bp, Homo sapiens
agttcataatatatggaag

SEQ ID NO: 5843957 - DNA, 22 bp, Homo sapiens
agttcatacctaagtactgtaa

SEQ ID NO: 5843958 - DNA, 16 bp, Homo sapiens
agttcatactgaatga

SEQ ID NO: 5843959 - DNA, 19 bp, Homo sapiens
agttcatactgatgccctg

SEQ ID NO: 5843960 - DNA, 20 bp, Homo sapiens
agttcatactgatgccctga

SEQ ID NO: 5843961 - DNA, 13 bp, Homo sapiens
agttcatagaaat

SEQ ID NO: 5843962 - DNA, 17 bp, Homo sapiens
agttcatagtttctgta

SEQ ID NO: 5843963 - DNA, 16 bp, Homo sapiens
agttcatataatttaa

SEQ ID NO: 5843964 - DNA, 15 bp, Homo sapiens
agttcatatatacat

SEQ ID NO: 5843965 - DNA, 16 bp, Homo sapiens
agttcatatatcaaga

SEQ ID NO: 5843966 - DNA, 19 bp, Homo sapiens
agttcatatctggagcctg

SEQ ID NO: 5843967 - DNA, 20 bp, Homo sapiens
agttcatattccatatttat

SEQ ID NO: 5843968 - DNA, 19 bp, Homo sapiens
agttcatcaccatttcctc

SEQ ID NO: 5843969 - DNA, 19 bp, Homo sapiens
agttcatcagagttatggt

SEQ ID NO: 5843970 - DNA, 16 bp, Homo sapiens
agttcatccaatcctc

SEQ ID NO: 5843971 - DNA, 20 bp, Homo sapiens
agttcatccaatcctcactg

SEQ ID NO: 5843972 - DNA, 20 bp, Homo sapiens
agttcatcccagccccaatt

SEQ ID NO: 5843973 - DNA, 17 bp, Homo sapiens
agttcatcgattttcta

SEQ ID NO: 5843974 - DNA, 18 bp, Homo sapiens
agttcatctatggcagtc

SEQ ID NO: 5843975 - DNA, 20 bp, Homo sapiens
agttcatctatggcagtcca

SEQ ID NO: 5843976 - DNA, 16 bp, Homo sapiens
agttcatctcatttgt

SEQ ID NO: 5843977 - DNA, 19 bp, Homo sapiens
agttcatctctgctgaaca

SEQ ID NO: 5843978 - DNA, 19 bp, Homo sapiens
agttcatcttgaattgtaa

SEQ ID NO: 5843979 - DNA, 22 bp, Homo sapiens
agttcatcttgcagcatttact

SEQ ID NO: 5843980 - DNA, 21 bp, Homo sapiens
agttcatgagaatctatattt

SEQ ID NO: 5843981 - DNA, 19 bp, Homo sapiens
agttcatgagtattcctag

SEQ ID NO: 5843982 - DNA, 18 bp, Homo sapiens
agttcatggggatctggg

SEQ ID NO: 5843983 - DNA, 17 bp, Homo sapiens
agttcatgtaaataata

SEQ ID NO: 5843984 - DNA, 22 bp, Homo sapiens
agttcatgtatgttcagaagaa

SEQ ID NO: 5843985 - DNA, 22 bp, Homo sapiens
agttcatgtctgaaacagagaa

SEQ ID NO: 5843986 - DNA, 23 bp, Homo sapiens
agttcatgtctgaaacagagaac

SEQ ID NO: 5843987 - DNA, 14 bp, Homo sapiens
agttcattaaacag

SEQ ID NO: 5843988 - DNA, 16 bp, Homo sapiens
agttcattaaacagaa

SEQ ID NO: 5843989 - DNA, 17 bp, Homo sapiens
agttcattattttgtgg

SEQ ID NO: 5843990 - DNA, 16 bp, Homo sapiens
agttcattcatattac

SEQ ID NO: 5843991 - DNA, 17 bp, Homo sapiens
agttcattcatattaca

SEQ ID NO: 5843992 - DNA, 23 bp, Homo sapiens
agttcattcatattacaatattt

SEQ ID NO: 5843993 - DNA, 14 bp, Homo sapiens
agttcattcctgtc

SEQ ID NO: 5843994 - DNA, 22 bp, Homo sapiens
agttcattctaccaagctgtca

SEQ ID NO: 5843995 - DNA, 14 bp, Homo sapiens
agttcattgtaaat

SEQ ID NO: 5843996 - DNA, 18 bp, Homo sapiens
agttcattgtaaatgaac

SEQ ID NO: 5843997 - DNA, 19 bp, Homo sapiens
agttcattttaaatgaagg

SEQ ID NO: 5843998 - DNA, 19 bp, Homo sapiens
agttccaaacagacaaaac

SEQ ID NO: 5843999 - DNA, 21 bp, Homo sapiens
agttccaaagtcacaggaaga

SEQ ID NO: 5844000 - DNA, 18 bp, Homo sapiens
agttccaacatgcaatac

SEQ ID NO: 5844001 - DNA, 14 bp, Homo sapiens
agttccaagagtct

SEQ ID NO: 5844002 - DNA, 19 bp, Homo sapiens
agttccaagagtctaaaga

SEQ ID NO: 5844003 - DNA, 17 bp, Homo sapiens
agttccaatcagtagct

SEQ ID NO: 5844004 - DNA, 19 bp, Homo sapiens
agttccacaattttgtctc

SEQ ID NO: 5844005 - DNA, 21 bp, Homo sapiens
agttccacaattttgtctcta

SEQ ID NO: 5844006 - DNA, 18 bp, Homo sapiens
agttccacagattgtttc

SEQ ID NO: 5844007 - DNA, 17 bp, Homo sapiens
agttccacatctgtgga

SEQ ID NO: 5844008 - DNA, 18 bp, Homo sapiens
agttccaccatcaagcca

SEQ ID NO: 5844009 - DNA, 19 bp, Homo sapiens
agttccacggttgctaaat

SEQ ID NO: 5844010 - DNA, 15 bp, Homo sapiens
agttccactgagacc

SEQ ID NO: 5844011 - DNA, 14 bp, Homo sapiens
agttccactgagct

SEQ ID NO: 5844012 - DNA, 21 bp, Homo sapiens
agttccactgagctccatgtg

SEQ ID NO: 5844013 - DNA, 20 bp, Homo sapiens
agttccacttatagcctctg

SEQ ID NO: 5844014 - DNA, 22 bp, Homo sapiens
agttccacttccaggtctgcct

SEQ ID NO: 5844015 - DNA, 14 bp, Homo sapiens
agttccagaagtgt

SEQ ID NO: 5844016 - DNA, 21 bp, Homo sapiens
agttccagataaaaacaatat

SEQ ID NO: 5844017 - DNA, 22 bp, Homo sapiens
agttccagataaaaacaatata

SEQ ID NO: 5844018 - DNA, 13 bp, Homo sapiens
agttccagcagtt

SEQ ID NO: 5844019 - DNA, 19 bp, Homo sapiens
agttccagccttctctcaa

SEQ ID NO: 5844020 - DNA, 16 bp, Homo sapiens
agttccagcttttgta

SEQ ID NO: 5844021 - DNA, 12 bp, Homo sapiens
agttccaggaca

SEQ ID NO: 5844022 - DNA, 19 bp, Homo sapiens
agttccagtttagcccttc

SEQ ID NO: 5844023 - DNA, 13 bp, Homo sapiens
agttccagtttct

SEQ ID NO: 5844024 - DNA, 15 bp, Homo sapiens
agttccagtttctcc

SEQ ID NO: 5844025 - DNA, 18 bp, Homo sapiens
agttccagttttgttttg

SEQ ID NO: 5844026 - DNA, 18 bp, Homo sapiens
agttccattcttggtcaa

SEQ ID NO: 5844027 - DNA, 16 bp, Homo sapiens
agttcccaaagggagg

SEQ ID NO: 5844028 - DNA, 13 bp, Homo sapiens
agttcccaactga

SEQ ID NO: 5844029 - DNA, 14 bp, Homo sapiens
agttcccaagaaag

SEQ ID NO: 5844030 - DNA, 23 bp, Homo sapiens
agttcccaagaaaggaaaccttt

SEQ ID NO: 5844031 - DNA, 12 bp, Homo sapiens
agttcccagaat

SEQ ID NO: 5844032 - DNA, 14 bp, Homo sapiens
agttcccagaatca

SEQ ID NO: 5844033 - DNA, 18 bp, Homo sapiens
agttcccagacagctttt

SEQ ID NO: 5844034 - DNA, 13 bp, Homo sapiens
agttcccagagtg

SEQ ID NO: 5844035 - DNA, 18 bp, Homo sapiens
agttcccagagtgggctt

SEQ ID NO: 5844036 - DNA, 15 bp, Homo sapiens
agttcccatgttaaa

SEQ ID NO: 5844037 - DNA, 19 bp, Homo sapiens
agttcccattattatttct

SEQ ID NO: 5844038 - DNA, 22 bp, Homo sapiens
agttcccctggaagcagtgccc

SEQ ID NO: 5844039 - DNA, 19 bp, Homo sapiens
agttcccctgtttattcat

SEQ ID NO: 5844040 - DNA, 19 bp, Homo sapiens
agttcccgggagctgggcc

SEQ ID NO: 5844041 - DNA, 19 bp, Homo sapiens
agttcccgggccctcctgg

SEQ ID NO: 5844042 - DNA, 19 bp, Homo sapiens
agttccctaaacaaaagca

SEQ ID NO: 5844043 - DNA, 21 bp, Homo sapiens
agttccctcagtgtgaagcct

SEQ ID NO: 5844044 - DNA, 13 bp, Homo sapiens
agttccctcctgc

SEQ ID NO: 5844045 - DNA, 17 bp, Homo sapiens
agttccctcctgcccag

SEQ ID NO: 5844046 - DNA, 13 bp, Homo sapiens
agttccctctgcc

SEQ ID NO: 5844047 - DNA, 17 bp, Homo sapiens
agttccctctgcctggg

SEQ ID NO: 5844048 - DNA, 19 bp, Homo sapiens
agttccctcttctaaccca

SEQ ID NO: 5844049 - DNA, 14 bp, Homo sapiens
agttccctgaaaac

SEQ ID NO: 5844050 - DNA, 19 bp, Homo sapiens
agttccctgaaaacccaga

SEQ ID NO: 5844051 - DNA, 24 bp, Homo sapiens
agttccctgaaaacccagagagga

SEQ ID NO: 5844052 - DNA, 22 bp, Homo sapiens
agttccctgaacatctgtgtgt

SEQ ID NO: 5844053 - DNA, 23 bp, Homo sapiens
agttccctgaaccttcctgtctc

SEQ ID NO: 5844054 - DNA, 20 bp, Homo sapiens
agttccctgtctcttgaaaa

SEQ ID NO: 5844055 - DNA, 22 bp, Homo sapiens
agttcccttgaaactttgggaa

SEQ ID NO: 5844056 - DNA, 13 bp, Homo sapiens
agttcccttggcc

SEQ ID NO: 5844057 - DNA, 20 bp, Homo sapiens
agttccggcctgggcaccag

SEQ ID NO: 5844058 - DNA, 14 bp, Homo sapiens
agttccggggagaa

SEQ ID NO: 5844059 - DNA, 22 bp, Homo sapiens
agttccgtctcctctccagccc

SEQ ID NO: 5844060 - DNA, 13 bp, Homo sapiens
agttcctaagaag

SEQ ID NO: 5844061 - DNA, 17 bp, Homo sapiens
agttcctagagaactgt

SEQ ID NO: 5844062 - DNA, 15 bp, Homo sapiens
agttcctagcactgc

SEQ ID NO: 5844063 - DNA, 17 bp, Homo sapiens
agttcctagccaccgcc

SEQ ID NO: 5844064 - DNA, 17 bp, Homo sapiens
agttcctcgccctgggt

SEQ ID NO: 5844065 - DNA, 19 bp, Homo sapiens
agttcctctaacttggctc

SEQ ID NO: 5844066 - DNA, 19 bp, Homo sapiens
agttcctctcccttccctt

SEQ ID NO: 5844067 - DNA, 20 bp, Homo sapiens
agttcctctcccttcccttc

SEQ ID NO: 5844068 - DNA, 11 bp, Homo sapiens
agttcctctgc

SEQ ID NO: 5844069 - DNA, 12 bp, Homo sapiens
agttcctctgca

SEQ ID NO: 5844070 - DNA, 17 bp, Homo sapiens
agttcctctttgccctg

SEQ ID NO: 5844071 - DNA, 20 bp, Homo sapiens
agttcctctttgccctgagg

SEQ ID NO: 5844072 - DNA, 18 bp, Homo sapiens
agttcctgatgacccagg

SEQ ID NO: 5844073 - DNA, 19 bp, Homo sapiens
agttcctgatgacccaggc

SEQ ID NO: 5844074 - DNA, 17 bp, Homo sapiens
agttcctgcactccaga

SEQ ID NO: 5844075 - DNA, 20 bp, Homo sapiens
agttcctgcggagtgaagag

SEQ ID NO: 5844076 - DNA, 21 bp, Homo sapiens
agttcctgcggagtgaagagg

SEQ ID NO: 5844077 - DNA, 12 bp, Homo sapiens
agttcctgctcc

SEQ ID NO: 5844078 - DNA, 15 bp, Homo sapiens
agttcctgctctctg

SEQ ID NO: 5844079 - DNA, 20 bp, Homo sapiens
agttcctgctctctgctcat

SEQ ID NO: 5844080 - DNA, 15 bp, Homo sapiens
agttcctgctgcctg

SEQ ID NO: 5844081 - DNA, 13 bp, Homo sapiens
agttcctgggaac

SEQ ID NO: 5844082 - DNA, 23 bp, Homo sapiens
agttcctgggtttagctgtgaaa

SEQ ID NO: 5844083 - DNA, 16 bp, Homo sapiens
agttcctgtatgaaag

SEQ ID NO: 5844084 - DNA, 16 bp, Homo sapiens
agttcctgtcccacat

SEQ ID NO: 5844085 - DNA, 14 bp, Homo sapiens
agttcctgtccctg

SEQ ID NO: 5844086 - DNA, 14 bp, Homo sapiens
agttcctgtgcaca

SEQ ID NO: 5844087 - DNA, 16 bp, Homo sapiens
agttccttataagaat

SEQ ID NO: 5844088 - DNA, 19 bp, Homo sapiens
agttccttataagaattaa

SEQ ID NO: 5844089 - DNA, 18 bp, Homo sapiens
agttccttatccctctct

SEQ ID NO: 5844090 - DNA, 23 bp, Homo sapiens
agttccttatccctctcttcccc

SEQ ID NO: 5844091 - DNA, 18 bp, Homo sapiens
agttccttctcacttaga

SEQ ID NO: 5844092 - DNA, 20 bp, Homo sapiens
agttccttgatctgtatata

SEQ ID NO: 5844093 - DNA, 10 bp, Homo sapiens
agttccttgc

SEQ ID NO: 5844094 - DNA, 19 bp, Homo sapiens
agttcctttagaaagcagt

SEQ ID NO: 5844095 - DNA, 18 bp, Homo sapiens
agttcctttgtgtgtact

SEQ ID NO: 5844096 - DNA, 18 bp, Homo sapiens
agttcgagaccagcctcg

SEQ ID NO: 5844097 - DNA, 18 bp, Homo sapiens
agttcgagagcagcctgg

SEQ ID NO: 5844098 - DNA, 20 bp, Homo sapiens
agttcgagagcagcctggcc

SEQ ID NO: 5844099 - DNA, 19 bp, Homo sapiens
agttcgaggcgagcctggc

SEQ ID NO: 5844100 - DNA, 21 bp, Homo sapiens
agttcgatgggcccaattctt

SEQ ID NO: 5844101 - DNA, 13 bp, Homo sapiens
agttcgcagccac

SEQ ID NO: 5844102 - DNA, 18 bp, Homo sapiens
agttcgcagccaccctga

SEQ ID NO: 5844103 - DNA, 17 bp, Homo sapiens
agttcggctctgggtgg

SEQ ID NO: 5844104 - DNA, 15 bp, Homo sapiens
agttcgttggtagag

SEQ ID NO: 5844105 - DNA, 17 bp, Homo sapiens
agttctaacacatttcg

SEQ ID NO: 5844106 - DNA, 23 bp, Homo sapiens
agttctaacagtgaagttttact

SEQ ID NO: 5844107 - DNA, 19 bp, Homo sapiens
agttctaataatttctaat

SEQ ID NO: 5844108 - DNA, 18 bp, Homo sapiens
agttctacaagcatattt

SEQ ID NO: 5844109 - DNA, 19 bp, Homo sapiens
agttctacaagcatatttg

SEQ ID NO: 5844110 - DNA, 15 bp, Homo sapiens
agttctacataagta

SEQ ID NO: 5844111 - DNA, 14 bp, Homo sapiens
agttctaccggctt

SEQ ID NO: 5844112 - DNA, 23 bp, Homo sapiens
agttctacctcaggcagctcaag

SEQ ID NO: 5844113 - DNA, 16 bp, Homo sapiens
agttctactcaggctg

SEQ ID NO: 5844114 - DNA, 12 bp, Homo sapiens
agttctagaaaa

SEQ ID NO: 5844115 - DNA, 12 bp, Homo sapiens
agttctagcagt

SEQ ID NO: 5844116 - DNA, 19 bp, Homo sapiens
agttctagctctatttact

SEQ ID NO: 5844117 - DNA, 13 bp, Homo sapiens
agttctaggaaaa

SEQ ID NO: 5844118 - DNA, 19 bp, Homo sapiens
agttctaggaaattcttga

SEQ ID NO: 5844119 - DNA, 10 bp, Homo sapiens
agttctaggc

SEQ ID NO: 5844120 - DNA, 14 bp, Homo sapiens
agttctaggcactg

SEQ ID NO: 5844121 - DNA, 23 bp, Homo sapiens
agttctaggcatacttttcaaag

SEQ ID NO: 5844122 - DNA, 20 bp, Homo sapiens
agttgacaacctagaatgtc

SEQ ID NO: 5844123 - DNA, 16 bp, Homo sapiens
agttgacaattctgca

SEQ ID NO: 5844124 - DNA, 13 bp, Homo sapiens
agttgacagcagg

SEQ ID NO: 5844125 - DNA, 17 bp, Homo sapiens
agttgaccaactatatt

SEQ ID NO: 5844126 - DNA, 19 bp, Homo sapiens
agttgaccagggcagtgaa

SEQ ID NO: 5844127 - DNA, 16 bp, Homo sapiens
agttgacccctcctga

SEQ ID NO: 5844128 - DNA, 19 bp, Homo sapiens
agttgaccctattttttga

SEQ ID NO: 5844129 - DNA, 12 bp, Homo sapiens
agttgaccttta

SEQ ID NO: 5844130 - DNA, 15 bp, Homo sapiens
agttgacgcatcctg

SEQ ID NO: 5844131 - DNA, 18 bp, Homo sapiens
agttgactagaatcgaca

SEQ ID NO: 5844132 - DNA, 15 bp, Homo sapiens
agttgactcacaggc

SEQ ID NO: 5844133 - DNA, 17 bp, Homo sapiens
agttgactctgctcttg

SEQ ID NO: 5844134 - DNA, 22 bp, Homo sapiens
agttgacttactgtttcttacc

SEQ ID NO: 5844135 - DNA, 15 bp, Homo sapiens
agttgacttcaaatg

SEQ ID NO: 5844136 - DNA, 13 bp, Homo sapiens
agttgactttcaa

SEQ ID NO: 5844137 - DNA, 14 bp, Homo sapiens
agttgactttctcc

SEQ ID NO: 5844138 - DNA, 23 bp, Homo sapiens
agttgactttttttttgcccaga

SEQ ID NO: 5844139 - DNA, 15 bp, Homo sapiens
agttgagaaacagtt

SEQ ID NO: 5844140 - DNA, 13 bp, Homo sapiens
agttgagaaggtg

SEQ ID NO: 5844141 - DNA, 19 bp, Homo sapiens
agttgagaaggtgcctgcc

SEQ ID NO: 5844142 - DNA, 20 bp, Homo sapiens
agttgagaaggtgcctgcca

SEQ ID NO: 5844143 - DNA, 21 bp, Homo sapiens
agttgagaaggtgcctgccat

SEQ ID NO: 5844144 - DNA, 17 bp, Homo sapiens
agttgagacgctgttgc

SEQ ID NO: 5844145 - DNA, 21 bp, Homo sapiens
agttgagcacaggcaacatta

SEQ ID NO: 5844146 - DNA, 15 bp, Homo sapiens
agttgagccagcaga

SEQ ID NO: 5844147 - DNA, 12 bp, Homo sapiens
agttgagcccca

SEQ ID NO: 5844148 - DNA, 17 bp, Homo sapiens
agttgagcgtgcgcact

SEQ ID NO: 5844149 - DNA, 17 bp, Homo sapiens
agttgaggagtttccta

SEQ ID NO: 5844150 - DNA, 16 bp, Homo sapiens
agttgaggatgtggca

SEQ ID NO: 5844151 - DNA, 16 bp, Homo sapiens
agttgaggccaggagt

SEQ ID NO: 5844152 - DNA, 16 bp, Homo sapiens
agttgaggcttataag

SEQ ID NO: 5844153 - DNA, 23 bp, Homo sapiens
agttgagggaaagagcttataaa

SEQ ID NO: 5844154 - DNA, 13 bp, Homo sapiens
agttgaggggagc

SEQ ID NO: 5844155 - DNA, 21 bp, Homo sapiens
agttgaggggcttccctctgc

SEQ ID NO: 5844156 - DNA, 21 bp, Homo sapiens
agttgagtacagtgaggaggg

SEQ ID NO: 5844157 - DNA, 19 bp, Homo sapiens
agttgagtctcctctctga

SEQ ID NO: 5844158 - DNA, 23 bp, Homo sapiens
agttgagtctcctctctgagact

SEQ ID NO: 5844159 - DNA, 23 bp, Homo sapiens
agttgagtcttcacatttagaat

SEQ ID NO: 5844160 - DNA, 17 bp, Homo sapiens
agttgagtggaatgtgg

SEQ ID NO: 5844161 - DNA, 20 bp, Homo sapiens
agttgatagcacagaccctg

SEQ ID NO: 5844162 - DNA, 21 bp, Homo sapiens
agttgatagcacagaccctgc

SEQ ID NO: 5844163 - DNA, 14 bp, Homo sapiens
agttgatctcccca

SEQ ID NO: 5844164 - DNA, 13 bp, Homo sapiens
agttgatctggaa

SEQ ID NO: 5844165 - DNA, 19 bp, Homo sapiens
agttgatctggaacccaga

SEQ ID NO: 5844166 - DNA, 12 bp, Homo sapiens
agttgatcttct

SEQ ID NO: 5844167 - DNA, 15 bp, Homo sapiens
agttgatgaaatgga

SEQ ID NO: 5844168 - DNA, 16 bp, Homo sapiens
agttgatgtcgatgct

SEQ ID NO: 5844169 - DNA, 16 bp, Homo sapiens
agttgatgttttctaa

SEQ ID NO: 5844170 - DNA, 14 bp, Homo sapiens
agttgattcagctc

SEQ ID NO: 5844171 - DNA, 15 bp, Homo sapiens
agttgattcagctct

SEQ ID NO: 5844172 - DNA, 23 bp, Homo sapiens
agttgattcagctctgcaagaat

SEQ ID NO: 5844173 - DNA, 17 bp, Homo sapiens
agttgattcatgtgctt

SEQ ID NO: 5844174 - DNA, 20 bp, Homo sapiens
agttgattgcgagaattttc

SEQ ID NO: 5844175 - DNA, 23 bp, Homo sapiens
agttgattgtacgtagccacagg

SEQ ID NO: 5844176 - DNA, 16 bp, Homo sapiens
agttgattttctggat

SEQ ID NO: 5844177 - DNA, 17 bp, Homo sapiens
agttgcaaagagacatt

SEQ ID NO: 5844178 - DNA, 19 bp, Homo sapiens
agttgcaactttgtataaa

SEQ ID NO: 5844179 - DNA, 19 bp, Homo sapiens
agttgcaaggcaaatgttt

SEQ ID NO: 5844180 - DNA, 15 bp, Homo sapiens
agttgcaatagaaca

SEQ ID NO: 5844181 - DNA, 18 bp, Homo sapiens
agttgcaattgaattaaa

SEQ ID NO: 5844182 - DNA, 17 bp, Homo sapiens
agttgcacactcactgg

SEQ ID NO: 5844183 - DNA, 16 bp, Homo sapiens
agttgcacagctatga

SEQ ID NO: 5844184 - DNA, 18 bp, Homo sapiens
agttgcactaactgctgg

SEQ ID NO: 5844185 - DNA, 19 bp, Homo sapiens
agttgcactacataatctc

SEQ ID NO: 5844186 - DNA, 15 bp, Homo sapiens
agttgcactcaggtg

SEQ ID NO: 5844187 - DNA, 20 bp, Homo sapiens
agttgcacttggcctctgga

SEQ ID NO: 5844188 - DNA, 16 bp, Homo sapiens
agttgcagactcagtt

SEQ ID NO: 5844189 - DNA, 18 bp, Homo sapiens
agttgcagactcagtttg

SEQ ID NO: 5844190 - DNA, 23 bp, Homo sapiens
agttgcagactcagtttgtcaga

SEQ ID NO: 5844191 - DNA, 21 bp, Homo sapiens
agttgcagatgtattgactgt

SEQ ID NO: 5844192 - DNA, 22 bp, Homo sapiens
agttgcagatgtattgactgta

SEQ ID NO: 5844193 - DNA, 10 bp, Homo sapiens
agttgcagcc

SEQ ID NO: 5844194 - DNA, 12 bp, Homo sapiens
agttgcaggagc

SEQ ID NO: 5844195 - DNA, 17 bp, Homo sapiens
agttgcagtcagaagat

SEQ ID NO: 5844196 - DNA, 22 bp, Homo sapiens
agttgcagtgagcagggtgggg

SEQ ID NO: 5844197 - DNA, 10 bp, Homo sapiens
agttgcagtt

SEQ ID NO: 5844198 - DNA, 14 bp, Homo sapiens
agttgcatcagaaa

SEQ ID NO: 5844199 - DNA, 20 bp, Homo sapiens
agttgcatgaaattttgcct

SEQ ID NO: 5844200 - DNA, 22 bp, Homo sapiens
agttgcatgaccacatagaaca

SEQ ID NO: 5844201 - DNA, 20 bp, Homo sapiens
agttgcatggcatcacctcc

SEQ ID NO: 5844202 - DNA, 22 bp, Homo sapiens
agttgcatgtagtaacactaat

SEQ ID NO: 5844203 - DNA, 21 bp, Homo sapiens
agttgcattagtaactttgaa

SEQ ID NO: 5844204 - DNA, 11 bp, Homo sapiens
agttgcattta

SEQ ID NO: 5844205 - DNA, 16 bp, Homo sapiens
agttgccacattgctt

SEQ ID NO: 5844206 - DNA, 14 bp, Homo sapiens
agttgccacattta

SEQ ID NO: 5844207 - DNA, 15 bp, Homo sapiens
agttgccacatttag

SEQ ID NO: 5844208 - DNA, 14 bp, Homo sapiens
agttgccaccacct

SEQ ID NO: 5844209 - DNA, 22 bp, Homo sapiens
agttgccaccacctctgtggca

SEQ ID NO: 5844210 - DNA, 15 bp, Homo sapiens
agttgccattattct

SEQ ID NO: 5844211 - DNA, 19 bp, Homo sapiens
agttgcccagagcacttta

SEQ ID NO: 5844212 - DNA, 22 bp, Homo sapiens
agttgccccccatcaccagagt

SEQ ID NO: 5844213 - DNA, 16 bp, Homo sapiens
agttgccctccaggcc

SEQ ID NO: 5844214 - DNA, 18 bp, Homo sapiens
agttgccgtggcaactgt

SEQ ID NO: 5844215 - DNA, 17 bp, Homo sapiens
agttgcctaaatccatt

SEQ ID NO: 5844216 - DNA, 13 bp, Homo sapiens
agttgcctccagg

SEQ ID NO: 5844217 - DNA, 15 bp, Homo sapiens
agttgcctccagggc

SEQ ID NO: 5844218 - DNA, 19 bp, Homo sapiens
agttgcctttatttgctgt

SEQ ID NO: 5844219 - DNA, 14 bp, Homo sapiens
agttgccttttctt

SEQ ID NO: 5844220 - DNA, 16 bp, Homo sapiens
agttgccttttcttcc

SEQ ID NO: 5844221 - DNA, 19 bp, Homo sapiens
agttgcgtttaagttgtat

SEQ ID NO: 5844222 - DNA, 15 bp, Homo sapiens
agttgctaaacactg

SEQ ID NO: 5844223 - DNA, 16 bp, Homo sapiens
agttgctaaacactgc

SEQ ID NO: 5844224 - DNA, 15 bp, Homo sapiens
agttgctaacctcaa

SEQ ID NO: 5844225 - DNA, 20 bp, Homo sapiens
agttgctaactgggaagaac

SEQ ID NO: 5844226 - DNA, 23 bp, Homo sapiens
agttgctaacttaaaaaactgca

SEQ ID NO: 5844227 - DNA, 20 bp, Homo sapiens
agttgctagtactggggaga

SEQ ID NO: 5844228 - DNA, 19 bp, Homo sapiens
agttgctatttttgtaaag

SEQ ID NO: 5844229 - DNA, 11 bp, Homo sapiens
agttgctcacc

SEQ ID NO: 5844230 - DNA, 23 bp, Homo sapiens
agttgctcaccgactcacctgcg

SEQ ID NO: 5844231 - DNA, 14 bp, Homo sapiens
agttgctcactcag

SEQ ID NO: 5844232 - DNA, 17 bp, Homo sapiens
agttgctcactcaggac

SEQ ID NO: 5844233 - DNA, 15 bp, Homo sapiens
agttgctcattgtag

SEQ ID NO: 5844234 - DNA, 21 bp, Homo sapiens
agttgctcctacccctgtcct

SEQ ID NO: 5844235 - DNA, 14 bp, Homo sapiens
agttgctcctcagg

SEQ ID NO: 5844236 - DNA, 14 bp, Homo sapiens
agttgctctatgct

SEQ ID NO: 5844237 - DNA, 17 bp, Homo sapiens
agttgctctatgctttc

SEQ ID NO: 5844238 - DNA, 13 bp, Homo sapiens
agttgctcttcta

SEQ ID NO: 5844239 - DNA, 17 bp, Homo sapiens
agttgctgaatgttgca

SEQ ID NO: 5844240 - DNA, 18 bp, Homo sapiens
agttgctgagaaatgggg

SEQ ID NO: 5844241 - DNA, 12 bp, Homo sapiens
agttgctgatcc

SEQ ID NO: 5844242 - DNA, 18 bp, Homo sapiens
agttgctgcagcttggca

SEQ ID NO: 5844243 - DNA, 23 bp, Homo sapiens
agttgctgcttcaatttatacct

SEQ ID NO: 5844244 - DNA, 17 bp, Homo sapiens
agttgctggttttgaat

SEQ ID NO: 5844245 - DNA, 13 bp, Homo sapiens
agttgctgtaaaa

SEQ ID NO: 5844246 - DNA, 16 bp, Homo sapiens
agttgctgtcactgtt

SEQ ID NO: 5844247 - DNA, 21 bp, Homo sapiens
agttgctgttaatctgatgta

SEQ ID NO: 5844248 - DNA, 14 bp, Homo sapiens
agttgctgtttact

SEQ ID NO: 5844249 - DNA, 14 bp, Homo sapiens
agttgctgtttatt

SEQ ID NO: 5844250 - DNA, 18 bp, Homo sapiens
agttgctttgcggcatct

SEQ ID NO: 5844251 - DNA, 16 bp, Homo sapiens
agttgctttggattct

SEQ ID NO: 5844252 - DNA, 21 bp, Homo sapiens
agttggaaaacttgtgccctt

SEQ ID NO: 5844253 - DNA, 14 bp, Homo sapiens
agttggaaaattcc

SEQ ID NO: 5844254 - DNA, 23 bp, Homo sapiens
agttggaaaattcccaaatatta

SEQ ID NO: 5844255 - DNA, 19 bp, Homo sapiens
agttggaaacactaaatgt

SEQ ID NO: 5844256 - DNA, 20 bp, Homo sapiens
agttggaaacactaaatgtt

SEQ ID NO: 5844257 - DNA, 21 bp, Homo sapiens
agttggaaacactaaatgtta

SEQ ID NO: 5844258 - DNA, 21 bp, Homo sapiens
agttggaaccgtgtccagcac

SEQ ID NO: 5844259 - DNA, 22 bp, Homo sapiens
agttggaaccgtgtccagcaca

SEQ ID NO: 5844260 - DNA, 15 bp, Homo sapiens
agttggaatttacca

SEQ ID NO: 5844261 - DNA, 15 bp, Homo sapiens
agttggacacactgt

SEQ ID NO: 5844262 - DNA, 15 bp, Homo sapiens
agttggactctcagg

SEQ ID NO: 5844263 - DNA, 16 bp, Homo sapiens
agttggactctcaggg

SEQ ID NO: 5844264 - DNA, 17 bp, Homo sapiens
agttggactgggttgcg

SEQ ID NO: 5844265 - DNA, 18 bp, Homo sapiens
agttggactgtggcctca

SEQ ID NO: 5844266 - DNA, 20 bp, Homo sapiens
agttggagaaaatgaagaaa

SEQ ID NO: 5844267 - DNA, 15 bp, Homo sapiens
agttggagaccaggc

SEQ ID NO: 5844268 - DNA, 15 bp, Homo sapiens
agttggagccgcaca

SEQ ID NO: 5844269 - DNA, 19 bp, Homo sapiens
agttggagctagaaaatga

SEQ ID NO: 5844270 - DNA, 19 bp, Homo sapiens
agttggagctccagcctga

SEQ ID NO: 5844271 - DNA, 17 bp, Homo sapiens
agttggaggagactggg

SEQ ID NO: 5844272 - DNA, 20 bp, Homo sapiens
agttggaggagactgggcac

SEQ ID NO: 5844273 - DNA, 18 bp, Homo sapiens
agttggagggaaagccag

SEQ ID NO: 5844274 - DNA, 19 bp, Homo sapiens
agttggagggaaagccagc

SEQ ID NO: 5844275 - DNA, 20 bp, Homo sapiens
agttggagttttatttttaa

SEQ ID NO: 5844276 - DNA, 21 bp, Homo sapiens
agttggagttttatttttaag

SEQ ID NO: 5844277 - DNA, 19 bp, Homo sapiens
agttggagttttttgtacc

SEQ ID NO: 5844278 - DNA, 20 bp, Homo sapiens
agttggagttttttgtacca

SEQ ID NO: 5844279 - DNA, 18 bp, Homo sapiens
agttggattaaattctgg

SEQ ID NO: 5844280 - DNA, 22 bp, Homo sapiens
agttggattaaattctgggtga

SEQ ID NO: 5844281 - DNA, 16 bp, Homo sapiens
agttggcagagaaaat

SEQ ID NO: 5844282 - DNA, 23 bp, Homo sapiens
agttggcagagaaaatgctgcct

SEQ ID NO: 5844283 - DNA, 14 bp, Homo sapiens
agttggcagagaag

SEQ ID NO: 5844284 - DNA, 15 bp, Homo sapiens
agttggcatgaaagt

SEQ ID NO: 5844285 - DNA, 18 bp, Homo sapiens
agttggccaccttgcttg

SEQ ID NO: 5844286 - DNA, 16 bp, Homo sapiens
agttggccagagagcc

SEQ ID NO: 5844287 - DNA, 15 bp, Homo sapiens
agttggccaggctct

SEQ ID NO: 5844288 - DNA, 16 bp, Homo sapiens
agttggccaggctctt

SEQ ID NO: 5844289 - DNA, 22 bp, Homo sapiens
agttggccatatttacctcagc

SEQ ID NO: 5844290 - DNA, 17 bp, Homo sapiens
agttggccctttaatat

SEQ ID NO: 5844291 - DNA, 13 bp, Homo sapiens
agttggcctcagc

SEQ ID NO: 5844292 - DNA, 23 bp, Homo sapiens
agttggcctcagcagaaggcctt

SEQ ID NO: 5844293 - DNA, 14 bp, Homo sapiens
agttggctagaaga

SEQ ID NO: 5844294 - DNA, 16 bp, Homo sapiens
agttggctagaagaaa

SEQ ID NO: 5844295 - DNA, 16 bp, Homo sapiens
agttggctaggacccc

SEQ ID NO: 5844296 - DNA, 15 bp, Homo sapiens
agttggctcaggcag

SEQ ID NO: 5844297 - DNA, 16 bp, Homo sapiens
agttggctcaggcaga

SEQ ID NO: 5844298 - DNA, 20 bp, Homo sapiens
agttggctgtatgactgaag

SEQ ID NO: 5844299 - DNA, 17 bp, Homo sapiens
agttggcttacctggcc

SEQ ID NO: 5844300 - DNA, 16 bp, Homo sapiens
agtttggatgtctgta

SEQ ID NO: 5844301 - DNA, 17 bp, Homo sapiens
agtttggatgtctgtag

SEQ ID NO: 5844302 - DNA, 19 bp, Homo sapiens
agtttggatgtctgtagca

SEQ ID NO: 5844303 - DNA, 18 bp, Homo sapiens
agtttggattcttatgta

SEQ ID NO: 5844304 - DNA, 13 bp, Homo sapiens
agtttggccctgg

SEQ ID NO: 5844305 - DNA, 23 bp, Homo sapiens
agtttggccctggagccagggca

SEQ ID NO: 5844306 - DNA, 22 bp, Homo sapiens
agtttggccgggtgcggtggct

SEQ ID NO: 5844307 - DNA, 20 bp, Homo sapiens
agtttggctataagtgctca

SEQ ID NO: 5844308 - DNA, 21 bp, Homo sapiens
agtttgggatccctgtctttc

SEQ ID NO: 5844309 - DNA, 18 bp, Homo sapiens
agtttgggccactgcact

SEQ ID NO: 5844310 - DNA, 15 bp, Homo sapiens
agtttggggcagggg

SEQ ID NO: 5844311 - DNA, 12 bp, Homo sapiens
agtttggggtgc

SEQ ID NO: 5844312 - DNA, 20 bp, Homo sapiens
agtttgggtaaaatactttt

SEQ ID NO: 5844313 - DNA, 14 bp, Homo sapiens
agtttgggtatttt

SEQ ID NO: 5844314 - DNA, 16 bp, Homo sapiens
agtttggtatgaaaca

SEQ ID NO: 5844315 - DNA, 23 bp, Homo sapiens
agtttggtatgaaacaaatatac

SEQ ID NO: 5844316 - DNA, 15 bp, Homo sapiens
agtttggtatttgcg

SEQ ID NO: 5844317 - DNA, 14 bp, Homo sapiens
agtttggtctggac

SEQ ID NO: 5844318 - DNA, 15 bp, Homo sapiens
agtttggtctggact

SEQ ID NO: 5844319 - DNA, 20 bp, Homo sapiens
agtttggttcacttacagat

SEQ ID NO: 5844320 - DNA, 16 bp, Homo sapiens
agtttggtttctagca

SEQ ID NO: 5844321 - DNA, 16 bp, Homo sapiens
agtttggtttgacttg

SEQ ID NO: 5844322 - DNA, 21 bp, Homo sapiens
agtttggtttgacttgtttgt

SEQ ID NO: 5844323 - DNA, 16 bp, Homo sapiens
agtttggttttgacag

SEQ ID NO: 5844324 - DNA, 12 bp, Homo sapiens
agtttgtaaagt

SEQ ID NO: 5844325 - DNA, 20 bp, Homo sapiens
agtttgtaaatgttatttct

SEQ ID NO: 5844326 - DNA, 23 bp, Homo sapiens
agtttgtaacttgggctgtaaag

SEQ ID NO: 5844327 - DNA, 22 bp, Homo sapiens
agtttgtacagacgtatgctta

SEQ ID NO: 5844328 - DNA, 15 bp, Homo sapiens
agtttgtacatgcat

SEQ ID NO: 5844329 - DNA, 16 bp, Homo sapiens
agtttgtactcagtgg

SEQ ID NO: 5844330 - DNA, 18 bp, Homo sapiens
agtttgtagaactttatt

SEQ ID NO: 5844331 - DNA, 16 bp, Homo sapiens
agtttgtagcattttt

SEQ ID NO: 5844332 - DNA, 18 bp, Homo sapiens
agtttgtagcatttttct

SEQ ID NO: 5844333 - DNA, 21 bp, Homo sapiens
agtttgtaggtaaaatgtatt

SEQ ID NO: 5844334 - DNA, 22 bp, Homo sapiens
agtttgtaggtaaaatgtattt

SEQ ID NO: 5844335 - DNA, 19 bp, Homo sapiens
agtttgtagtaaaagtggt

SEQ ID NO: 5844336 - DNA, 19 bp, Homo sapiens
agtttgtattttgcatact

SEQ ID NO: 5844337 - DNA, 14 bp, Homo sapiens
agtttgtcattata

SEQ ID NO: 5844338 - DNA, 14 bp, Homo sapiens
agtttgtcccattt

SEQ ID NO: 5844339 - DNA, 16 bp, Homo sapiens
agtttgtcctgtagag

SEQ ID NO: 5844340 - DNA, 21 bp, Homo sapiens
agtttgtccttagtcacaaag

SEQ ID NO: 5844341 - DNA, 19 bp, Homo sapiens
agtttgtcgctcatgtgtg

SEQ ID NO: 5844342 - DNA, 21 bp, Homo sapiens
agtttgtcgctcatgtgtgca

SEQ ID NO: 5844343 - DNA, 21 bp, Homo sapiens
agtttgtctattttaaaataa

SEQ ID NO: 5844344 - DNA, 11 bp, Homo sapiens
agtttgtgaac

SEQ ID NO: 5844345 - DNA, 12 bp, Homo sapiens
agtttgtgaagt

SEQ ID NO: 5844346 - DNA, 16 bp, Homo sapiens
agtttgtgaagtgatt

SEQ ID NO: 5844347 - DNA, 20 bp, Homo sapiens
agtttgtgatatagcagagg

SEQ ID NO: 5844348 - DNA, 15 bp, Homo sapiens
agtttgtgcaagaca

SEQ ID NO: 5844349 - DNA, 19 bp, Homo sapiens
agtttgtgctggtgtatgt

SEQ ID NO: 5844350 - DNA, 17 bp, Homo sapiens
agtttgtggtaaaaaga

SEQ ID NO: 5844351 - DNA, 19 bp, Homo sapiens
agtttgtggtaaaaagatt

SEQ ID NO: 5844352 - DNA, 19 bp, Homo sapiens
agtttgtgtgtatttgtat

SEQ ID NO: 5844353 - DNA, 21 bp, Homo sapiens
agtttgtgtgtatttgtatta

SEQ ID NO: 5844354 - DNA, 15 bp, Homo sapiens
agtttgtgtgtctta

SEQ ID NO: 5844355 - DNA, 21 bp, Homo sapiens
agtttgtgtgttgtctcttga

SEQ ID NO: 5844356 - DNA, 18 bp, Homo sapiens
agtttgtgttagaaaagt

SEQ ID NO: 5844357 - DNA, 22 bp, Homo sapiens
agtttgtgttgttgttgctgct

SEQ ID NO: 5844358 - DNA, 18 bp, Homo sapiens
agtttgtgttttaaaaaa

SEQ ID NO: 5844359 - DNA, 23 bp, Homo sapiens
agtttgtgttttaaaaaaactga

SEQ ID NO: 5844360 - DNA, 16 bp, Homo sapiens
agtttgttactttaaa

SEQ ID NO: 5844361 - DNA, 18 bp, Homo sapiens
agtttgttactttgaata

SEQ ID NO: 5844362 - DNA, 20 bp, Homo sapiens
agtttgttatgtgtctggaa

SEQ ID NO: 5844363 - DNA, 21 bp, Homo sapiens
agtttgttatgtgtctggaag

SEQ ID NO: 5844364 - DNA, 22 bp, Homo sapiens
agtttgttcacttaaattcttt

SEQ ID NO: 5844365 - DNA, 12 bp, Homo sapiens
agtttgttcagt

SEQ ID NO: 5844366 - DNA, 14 bp, Homo sapiens
agtttgttcagtga

SEQ ID NO: 5844367 - DNA, 15 bp, Homo sapiens
agtttgttctccggg

SEQ ID NO: 5844368 - DNA, 14 bp, Homo sapiens
agtttgtttagtta

SEQ ID NO: 5844369 - DNA, 21 bp, Homo sapiens
agtttgtttcttgtgtgtttt

SEQ ID NO: 5844370 - DNA, 16 bp, Homo sapiens
agtttgtttctttgaa

SEQ ID NO: 5844371 - DNA, 18 bp, Homo sapiens
agtttgtttctttgaatt

SEQ ID NO: 5844372 - DNA, 22 bp, Homo sapiens
agtttgtttctttgaattttca

SEQ ID NO: 5844373 - DNA, 17 bp, Homo sapiens
agtttgttttactttgt

SEQ ID NO: 5844374 - DNA, 23 bp, Homo sapiens
agttttaaaaaaataaaacattt

SEQ ID NO: 5844375 - DNA, 12 bp, Homo sapiens
agttttaaaata

SEQ ID NO: 5844376 - DNA, 13 bp, Homo sapiens
agttttaaaatac

SEQ ID NO: 5844377 - DNA, 19 bp, Homo sapiens
agttttaaacccaaaatat

SEQ ID NO: 5844378 - DNA, 15 bp, Homo sapiens
agttttaaactcatt

SEQ ID NO: 5844379 - DNA, 22 bp, Homo sapiens
agttttaaagaaattttagtag

SEQ ID NO: 5844380 - DNA, 15 bp, Homo sapiens
agttttaaataaagt

SEQ ID NO: 5844381 - DNA, 19 bp, Homo sapiens
agttttaaatatgaacaaa

SEQ ID NO: 5844382 - DNA, 16 bp, Homo sapiens
agttttaacaaattaa

SEQ ID NO: 5844383 - DNA, 18 bp, Homo sapiens
agttttaacagaaccaga

SEQ ID NO: 5844384 - DNA, 19 bp, Homo sapiens
agttttaactttaatacag

SEQ ID NO: 5844385 - DNA, 16 bp, Homo sapiens
agttttaatccagaat

SEQ ID NO: 5844386 - DNA, 17 bp, Homo sapiens
agttttaatctcttaat

SEQ ID NO: 5844387 - DNA, 21 bp, Homo sapiens
agttttaatgttagaatttag

SEQ ID NO: 5844388 - DNA, 16 bp, Homo sapiens
agttttaattaaaaaa

SEQ ID NO: 5844389 - DNA, 20 bp, Homo sapiens
agttttacacgaactgaaat

SEQ ID NO: 5844390 - DNA, 23 bp, Homo sapiens
agttttacagagaggatacattt

SEQ ID NO: 5844391 - DNA, 15 bp, Homo sapiens
agttttacattttaa

SEQ ID NO: 5844392 - DNA, 17 bp, Homo sapiens
agttttaccctatatct

SEQ ID NO: 5844393 - DNA, 16 bp, Homo sapiens
agttttactaagatca

SEQ ID NO: 5844394 - DNA, 21 bp, Homo sapiens
agttttactgcattttcacaa

SEQ ID NO: 5844395 - DNA, 23 bp, Homo sapiens
agttttactgtctattaatattc

SEQ ID NO: 5844396 - DNA, 19 bp, Homo sapiens
agttttacttttaaactgt

SEQ ID NO: 5844397 - DNA, 17 bp, Homo sapiens
agttttagaataaggag

SEQ ID NO: 5844398 - DNA, 20 bp, Homo sapiens
agttttagggtacagtttgg

SEQ ID NO: 5844399 - DNA, 18 bp, Homo sapiens
agttttagggtacatgtg

SEQ ID NO: 5844400 - DNA, 21 bp, Homo sapiens
agttttagtctttagaactct

SEQ ID NO: 5844401 - DNA, 15 bp, Homo sapiens
agttttagttttctc

SEQ ID NO: 5844402 - DNA, 15 bp, Homo sapiens
agttttataaattaa

SEQ ID NO: 5844403 - DNA, 20 bp, Homo sapiens
agttttataaattaaaaggt

SEQ ID NO: 5844404 - DNA, 13 bp, Homo sapiens
agttttatatatt

SEQ ID NO: 5844405 - DNA, 14 bp, Homo sapiens
agttttatatatta

SEQ ID NO: 5844406 - DNA, 14 bp, Homo sapiens
agttttatatgctt

SEQ ID NO: 5844407 - DNA, 15 bp, Homo sapiens
agttttatatgcttt

SEQ ID NO: 5844408 - DNA, 13 bp, Homo sapiens
agttttatcattt

SEQ ID NO: 5844409 - DNA, 14 bp, Homo sapiens
agttttatcatttt

SEQ ID NO: 5844410 - DNA, 14 bp, Homo sapiens
agttttatcttaaa

SEQ ID NO: 5844411 - DNA, 18 bp, Homo sapiens
agttttatcttaaactgt

SEQ ID NO: 5844412 - DNA, 15 bp, Homo sapiens
agttttatcttgaca

SEQ ID NO: 5844413 - DNA, 16 bp, Homo sapiens
agttttatgccatgtt

SEQ ID NO: 5844414 - DNA, 22 bp, Homo sapiens
agttttatgcgacagctttact

SEQ ID NO: 5844415 - DNA, 15 bp, Homo sapiens
agttttatgctcttt

SEQ ID NO: 5844416 - DNA, 21 bp, Homo sapiens
agttttatgctcttttttact

SEQ ID NO: 5844417 - DNA, 19 bp, Homo sapiens
agttttatggcatgattta

SEQ ID NO: 5844418 - DNA, 16 bp, Homo sapiens
agttttatgtactttg

SEQ ID NO: 5844419 - DNA, 20 bp, Homo sapiens
agttttattgactcattcct

SEQ ID NO: 5844420 - DNA, 16 bp, Homo sapiens
agttttattgagaatt

SEQ ID NO: 5844421 - DNA, 22 bp, Homo sapiens
agttttatttatatttattgac

SEQ ID NO: 5844422 - DNA, 14 bp, Homo sapiens
agttttatttgaat

SEQ ID NO: 5844423 - DNA, 16 bp, Homo sapiens
agttttatttgtatta

SEQ ID NO: 5844424 - DNA, 18 bp, Homo sapiens
agttttatttgtattact

SEQ ID NO: 5844425 - DNA, 18 bp, Homo sapiens
agttttattttaaattat

SEQ ID NO: 5844426 - DNA, 17 bp, Homo sapiens
agttttattttctaaat

SEQ ID NO: 5844427 - DNA, 14 bp, Homo sapiens
agttttcaaattat

SEQ ID NO: 5844428 - DNA, 15 bp, Homo sapiens
agttttcaaattatt

SEQ ID NO: 5844429 - DNA, 15 bp, Homo sapiens
agttttcaaatttgt

SEQ ID NO: 5844430 - DNA, 13 bp, Homo sapiens
agttttcacagag

SEQ ID NO: 5844431 - DNA, 15 bp, Homo sapiens
agttttcacagaggc

SEQ ID NO: 5844432 - DNA, 17 bp, Homo sapiens
agttttcagaacctctt

SEQ ID NO: 5844433 - DNA, 23 bp, Homo sapiens
agttttcagctgctcagaattca

SEQ ID NO: 5844434 - DNA, 14 bp, Homo sapiens
agttttcaggctat

SEQ ID NO: 5844435 - DNA, 15 bp, Homo sapiens
agttttcagtttgta

SEQ ID NO: 5844436 - DNA, 20 bp, Homo sapiens
agttttcatccataactgaa

SEQ ID NO: 5844437 - DNA, 21 bp, Homo sapiens
agttttcatccataactgaac

SEQ ID NO: 5844438 - DNA, 17 bp, Homo sapiens
agttttcatgacagaat

SEQ ID NO: 5844439 - DNA, 15 bp, Homo sapiens
agttttcattaaatc

SEQ ID NO: 5844440 - DNA, 21 bp, Homo sapiens
agttttcatttagaaaataga

SEQ ID NO: 5844441 - DNA, 22 bp, Homo sapiens
agttttcatttcatatatctat

SEQ ID NO: 5844442 - DNA, 13 bp, Homo sapiens
agttttccagtat

SEQ ID NO: 5844443 - DNA, 16 bp, Homo sapiens
agttttcccacttttt

SEQ ID NO: 5844444 - DNA, 17 bp, Homo sapiens
agttttcccctggcctc

SEQ ID NO: 5844445 - DNA, 20 bp, Homo sapiens
agttttcccttgaggaaaca

SEQ ID NO: 5844446 - DNA, 10 bp, Homo sapiens
agttttccta

SEQ ID NO: 5844447 - DNA, 18 bp, Homo sapiens
agttttcctaaatgtata

SEQ ID NO: 5844448 - DNA, 22 bp, Homo sapiens
agttttcctaagtgattgtatg

SEQ ID NO: 5844449 - DNA, 16 bp, Homo sapiens
agttttcctatgcttt

SEQ ID NO: 5844450 - DNA, 16 bp, Homo sapiens
agttttccttatcaga

SEQ ID NO: 5844451 - DNA, 12 bp, Homo sapiens
agttttccttct

SEQ ID NO: 5844452 - DNA, 14 bp, Homo sapiens
agttttccttctgt

SEQ ID NO: 5844453 - DNA, 17 bp, Homo sapiens
agttttccttgaaaaaa

SEQ ID NO: 5844454 - DNA, 13 bp, Homo sapiens
agttttcctttgt

SEQ ID NO: 5844455 - DNA, 22 bp, Homo sapiens
agttttcgtattgcaaataaga

SEQ ID NO: 5844456 - DNA, 13 bp, Homo sapiens
agttttctaaatg

SEQ ID NO: 5844457 - DNA, 19 bp, Homo sapiens
agttttctaaatgtttctt

SEQ ID NO: 5844458 - DNA, 22 bp, Homo sapiens
agttttctagcaattttctttg

SEQ ID NO: 5844459 - DNA, 13 bp, Homo sapiens
agttttctccttt

SEQ ID NO: 5844460 - DNA, 21 bp, Homo sapiens
agttttctctttgtggggctt

SEQ ID NO: 5844461 - DNA, 14 bp, Homo sapiens
agttttctgagaaa

SEQ ID NO: 5844462 - DNA, 19 bp, Homo sapiens
agttttctgagaaagacta

SEQ ID NO: 5844463 - DNA, 12 bp, Homo sapiens
agttttcttgtt

SEQ ID NO: 5844464 - DNA, 19 bp, Homo sapiens
agttttcttgttgctttgt

SEQ ID NO: 5844465 - DNA, 23 bp, Homo sapiens
agttttcttgtttctgcatcttt

SEQ ID NO: 5844466 - DNA, 14 bp, Homo sapiens
agttttctttatga

SEQ ID NO: 5844467 - DNA, 16 bp, Homo sapiens
agttttcttttaattt

SEQ ID NO: 5844468 - DNA, 17 bp, Homo sapiens
agttttcttttaatttt

SEQ ID NO: 5844469 - DNA, 16 bp, Homo sapiens
agttttgaaaagctat

SEQ ID NO: 5844470 - DNA, 17 bp, Homo sapiens
agttttgaaaagctatt

SEQ ID NO: 5844471 - DNA, 18 bp, Homo sapiens
agttttgaatgttaagaa

SEQ ID NO: 5844472 - DNA, 15 bp, Homo sapiens
agttttgacaagctg

SEQ ID NO: 5844473 - DNA, 17 bp, Homo sapiens
agttttgacacttccca

SEQ ID NO: 5844474 - DNA, 17 bp, Homo sapiens
agttttgacagagttgg

SEQ ID NO: 5844475 - DNA, 18 bp, Homo sapiens
agttttgagataagtttt

SEQ ID NO: 5844476 - DNA, 22 bp, Homo sapiens
agttttgagtagatattacttt

SEQ ID NO: 5844477 - DNA, 20 bp, Homo sapiens
agttttgatacttgtaactt

SEQ ID NO: 5844478 - DNA, 22 bp, Homo sapiens
ataaactttaatataaagtagt

SEQ ID NO: 5844479 - DNA, 13 bp, Homo sapiens
ataaactttacct

SEQ ID NO: 5844480 - DNA, 14 bp, Homo sapiens
ataaactttgaata

SEQ ID NO: 5844481 - DNA, 15 bp, Homo sapiens
ataaactttgaataa

SEQ ID NO: 5844482 - DNA, 17 bp, Homo sapiens
ataaactttgaataaaa

SEQ ID NO: 5844483 - DNA, 15 bp, Homo sapiens
ataaacttttagaaa

SEQ ID NO: 5844484 - DNA, 16 bp, Homo sapiens
ataaactttttttaga

SEQ ID NO: 5844485 - DNA, 17 bp, Homo sapiens
ataaactttttttagat

SEQ ID NO: 5844486 - DNA, 18 bp, Homo sapiens
ataaactttttttcaatg

SEQ ID NO: 5844487 - DNA, 18 bp, Homo sapiens
ataaacttttttttatga

SEQ ID NO: 5844488 - DNA, 23 bp, Homo sapiens
ataaacttttttttgagaatggt

SEQ ID NO: 5844489 - DNA, 12 bp, Homo sapiens
ataaagaaaaac

SEQ ID NO: 5844490 - DNA, 13 bp, Homo sapiens
ataaagaaaattc

SEQ ID NO: 5844491 - DNA, 14 bp, Homo sapiens
ataaagaaaattct

SEQ ID NO: 5844492 - DNA, 19 bp, Homo sapiens
ataaagaaacggtatgact

SEQ ID NO: 5844493 - DNA, 19 bp, Homo sapiens
ataaagaaactgaggccca

SEQ ID NO: 5844494 - DNA, 13 bp, Homo sapiens
ataaagaaacttt

SEQ ID NO: 5844495 - DNA, 14 bp, Homo sapiens
ataaagaaactttt

SEQ ID NO: 5844496 - DNA, 20 bp, Homo sapiens
ataaagaaacttttgaaaaa

SEQ ID NO: 5844497 - DNA, 19 bp, Homo sapiens
ataaagaaagaaatattaa

SEQ ID NO: 5844498 - DNA, 16 bp, Homo sapiens
ataaagaaatatttac

SEQ ID NO: 5844499 - DNA, 18 bp, Homo sapiens
ataaagaaatatttacct

SEQ ID NO: 5844500 - DNA, 20 bp, Homo sapiens
ataaagaaattcaagaagta

SEQ ID NO: 5844501 - DNA, 16 bp, Homo sapiens
ataaagaaatttggta

SEQ ID NO: 5844502 - DNA, 18 bp, Homo sapiens
ataaagaaatttggtacc

SEQ ID NO: 5844503 - DNA, 19 bp, Homo sapiens
ataaagaaatttggtaccc

SEQ ID NO: 5844504 - DNA, 22 bp, Homo sapiens
ataaagaactccttattttgta

SEQ ID NO: 5844505 - DNA, 12 bp, Homo sapiens
ataaagaagaaa

SEQ ID NO: 5844506 - DNA, 15 bp, Homo sapiens
ataaagaagaaaata

SEQ ID NO: 5844507 - DNA, 17 bp, Homo sapiens
ataaagaagaaaataac

SEQ ID NO: 5844508 - DNA, 22 bp, Homo sapiens
ataaagaagctactattttgga

SEQ ID NO: 5844509 - DNA, 12 bp, Homo sapiens
ataaagaatact

SEQ ID NO: 5844510 - DNA, 16 bp, Homo sapiens
ataaagaatacttgaa

SEQ ID NO: 5844511 - DNA, 19 bp, Homo sapiens
ataaagaataggacttgtt

SEQ ID NO: 5844512 - DNA, 12 bp, Homo sapiens
ataaagaatata

SEQ ID NO: 5844513 - DNA, 15 bp, Homo sapiens
ataaagaatgaaagt

SEQ ID NO: 5844514 - DNA, 22 bp, Homo sapiens
ataaagaatgaaagtagctgta

SEQ ID NO: 5844515 - DNA, 11 bp, Homo sapiens
ataaagaatgg

SEQ ID NO: 5844516 - DNA, 14 bp, Homo sapiens
ataaagaatttaaa

SEQ ID NO: 5844517 - DNA, 16 bp, Homo sapiens
ataaagacccaggggg

SEQ ID NO: 5844518 - DNA, 20 bp, Homo sapiens
ataaagacgttttataagca

SEQ ID NO: 5844519 - DNA, 21 bp, Homo sapiens
ataaagactcctaatagcttt

SEQ ID NO: 5844520 - DNA, 13 bp, Homo sapiens
ataaagagaaaat

SEQ ID NO: 5844521 - DNA, 21 bp, Homo sapiens
ataaagagaaaattgaattta

SEQ ID NO: 5844522 - DNA, 15 bp, Homo sapiens
ataaagagagaaaaa

SEQ ID NO: 5844523 - DNA, 21 bp, Homo sapiens
ataaagagagaaaaacaaatt

SEQ ID NO: 5844524 - DNA, 19 bp, Homo sapiens
ataaagagcacgttttcca

SEQ ID NO: 5844525 - DNA, 15 bp, Homo sapiens
ataaagataaaatat

SEQ ID NO: 5844526 - DNA, 15 bp, Homo sapiens
ataaagatacaaaat

SEQ ID NO: 5844527 - DNA, 18 bp, Homo sapiens
ataaagatacaaaatgtt

SEQ ID NO: 5844528 - DNA, 14 bp, Homo sapiens
ataaagatacatga

SEQ ID NO: 5844529 - DNA, 14 bp, Homo sapiens
ataaagataggatt

SEQ ID NO: 5844530 - DNA, 16 bp, Homo sapiens
ataaagatatttccaa

SEQ ID NO: 5844531 - DNA, 22 bp, Homo sapiens
ataaagatcacaccaatttaga

SEQ ID NO: 5844532 - DNA, 14 bp, Homo sapiens
ataaagatcattta

SEQ ID NO: 5844533 - DNA, 18 bp, Homo sapiens
ataaagatcgcccccacc

SEQ ID NO: 5844534 - DNA, 19 bp, Homo sapiens
ataaagatgatattaagaa

SEQ ID NO: 5844535 - DNA, 19 bp, Homo sapiens
ataaagatgatctactcag

SEQ ID NO: 5844536 - DNA, 23 bp, Homo sapiens
ataaagatgatctactcagaaat

SEQ ID NO: 5844537 - DNA, 14 bp, Homo sapiens
ataaagatgattga

SEQ ID NO: 5844538 - DNA, 15 bp, Homo sapiens
ataaagatggctatt

SEQ ID NO: 5844539 - DNA, 21 bp, Homo sapiens
ataaagatgtcaaatatctca

SEQ ID NO: 5844540 - DNA, 17 bp, Homo sapiens
ataaagatgtgaaaact

SEQ ID NO: 5844541 - DNA, 15 bp, Homo sapiens
ataaagatgttaaaa

SEQ ID NO: 5844542 - DNA, 17 bp, Homo sapiens
ataaagattttttaata

SEQ ID NO: 5844543 - DNA, 18 bp, Homo sapiens
ataaagattttttaataa

SEQ ID NO: 5844544 - DNA, 14 bp, Homo sapiens
ataaagcaaataga

SEQ ID NO: 5844545 - DNA, 13 bp, Homo sapiens
ataaagcaaatat

SEQ ID NO: 5844546 - DNA, 15 bp, Homo sapiens
ataaagcaaattact

SEQ ID NO: 5844547 - DNA, 16 bp, Homo sapiens
ataaagcaagctcaac

SEQ ID NO: 5844548 - DNA, 18 bp, Homo sapiens
ataaagcaaggcaaaaat

SEQ ID NO: 5844549 - DNA, 15 bp, Homo sapiens
ataaagcaattttcc

SEQ ID NO: 5844550 - DNA, 18 bp, Homo sapiens
ataaagcaattttccttg

SEQ ID NO: 5844551 - DNA, 20 bp, Homo sapiens
ataaagcaattttccttgaa

SEQ ID NO: 5844552 - DNA, 23 bp, Homo sapiens
ataaagcaattttccttgaagcc

SEQ ID NO: 5844553 - DNA, 22 bp, Homo sapiens
ataaagcaccagcagtgtttaa

SEQ ID NO: 5844554 - DNA, 20 bp, Homo sapiens
ataaagcacgcagttatgtt

SEQ ID NO: 5844555 - DNA, 20 bp, Homo sapiens
ataaagcacgtgcaaggact

SEQ ID NO: 5844556 - DNA, 17 bp, Homo sapiens
ataaagcagacaggtgt

SEQ ID NO: 5844557 - DNA, 15 bp, Homo sapiens
ataaagcagagccaa

SEQ ID NO: 5844558 - DNA, 22 bp, Homo sapiens
ataaagcagagccaaggccacc

SEQ ID NO: 5844559 - DNA, 17 bp, Homo sapiens
ataaagcagattacctc

SEQ ID NO: 5844560 - DNA, 21 bp, Homo sapiens
ataaagcagcctcattctgag

SEQ ID NO: 5844561 - DNA, 23 bp, Homo sapiens
ataaagcagcctcattctgaggc

SEQ ID NO: 5844562 - DNA, 15 bp, Homo sapiens
ataaagcagcctgat

SEQ ID NO: 5844563 - DNA, 22 bp, Homo sapiens
ataaagcagcctgattgaaaag

SEQ ID NO: 5844564 - DNA, 13 bp, Homo sapiens
ataaagcagcgtt

SEQ ID NO: 5844565 - DNA, 15 bp, Homo sapiens
ataaagcagtcctgt

SEQ ID NO: 5844566 - DNA, 22 bp, Homo sapiens
ataaagcagtcctgttcaaatt

SEQ ID NO: 5844567 - DNA, 12 bp, Homo sapiens
ataaagcagtta

SEQ ID NO: 5844568 - DNA, 20 bp, Homo sapiens
ataaagcagttaatttatat

SEQ ID NO: 5844569 - DNA, 20 bp, Homo sapiens
ataaagcataagtatacagt

SEQ ID NO: 5844570 - DNA, 21 bp, Homo sapiens
ataaagcataagtatacagtt

SEQ ID NO: 5844571 - DNA, 15 bp, Homo sapiens
ataaagcatctaaac

SEQ ID NO: 5844572 - DNA, 15 bp, Homo sapiens
ataaagccaagaatt

SEQ ID NO: 5844573 - DNA, 20 bp, Homo sapiens
ataaagccacataaccagcg

SEQ ID NO: 5844574 - DNA, 12 bp, Homo sapiens
ataaagccactg

SEQ ID NO: 5844575 - DNA, 21 bp, Homo sapiens
ataaagccatttggtcttaat

SEQ ID NO: 5844576 - DNA, 14 bp, Homo sapiens
ataaagccctggga

SEQ ID NO: 5844577 - DNA, 20 bp, Homo sapiens
ataaagccctgggatcactg

SEQ ID NO: 5844578 - DNA, 18 bp, Homo sapiens
ataaagcctcaaggtttt

SEQ ID NO: 5844579 - DNA, 22 bp, Homo sapiens
ataaagcctcaaggttttaggt

SEQ ID NO: 5844580 - DNA, 14 bp, Homo sapiens
ataaagcctgactt

SEQ ID NO: 5844581 - DNA, 18 bp, Homo sapiens
ataaagcctgtattctca

SEQ ID NO: 5844582 - DNA, 20 bp, Homo sapiens
ataaagcctgttttgtcttt

SEQ ID NO: 5844583 - DNA, 22 bp, Homo sapiens
ataaagcctttgtatctttctt

SEQ ID NO: 5844584 - DNA, 20 bp, Homo sapiens
ataaagccttttaaatcatc

SEQ ID NO: 5844585 - DNA, 22 bp, Homo sapiens
ataaagctaccatgttaataca

SEQ ID NO: 5844586 - DNA, 21 bp, Homo sapiens
ataaagctactgaatttattg

SEQ ID NO: 5844587 - DNA, 11 bp, Homo sapiens
ataaagctgga

SEQ ID NO: 5844588 - DNA, 20 bp, Homo sapiens
ataaagctggacaagaagct

SEQ ID NO: 5844589 - DNA, 21 bp, Homo sapiens
ataaagctggacaagaagctg

SEQ ID NO: 5844590 - DNA, 22 bp, Homo sapiens
ataaagctggacaagaagctgc

SEQ ID NO: 5844591 - DNA, 23 bp, Homo sapiens
ataaagctggacaagaagctgct

SEQ ID NO: 5844592 - DNA, 16 bp, Homo sapiens
ataaagctgttattct

SEQ ID NO: 5844593 - DNA, 21 bp, Homo sapiens
ataaagctgttctcattcctg

SEQ ID NO: 5844594 - DNA, 13 bp, Homo sapiens
ataaagctttata

SEQ ID NO: 5844595 - DNA, 22 bp, Homo sapiens
ataaagcttttgcatagaataa

SEQ ID NO: 5844596 - DNA, 16 bp, Homo sapiens
ataaagcttttggaag

SEQ ID NO: 5844597 - DNA, 20 bp, Homo sapiens
ataaaggaaaaaagagaagt

SEQ ID NO: 5844598 - DNA, 12 bp, Homo sapiens
ataaaggaaaag

SEQ ID NO: 5844599 - DNA, 12 bp, Homo sapiens
ataaaggaaata

SEQ ID NO: 5844600 - DNA, 17 bp, Homo sapiens
ataaaggaacatggttt

SEQ ID NO: 5844601 - DNA, 18 bp, Homo sapiens
ataaaggaagtcaccaaa

SEQ ID NO: 5844602 - DNA, 19 bp, Homo sapiens
ataaaggaagtcaccaaaa

SEQ ID NO: 5844603 - DNA, 16 bp, Homo sapiens
ataaaggacactggat

SEQ ID NO: 5844604 - DNA, 17 bp, Homo sapiens
ataaaggacactggatc

SEQ ID NO: 5844605 - DNA, 14 bp, Homo sapiens
ataaaggactgtaa

SEQ ID NO: 5844606 - DNA, 14 bp, Homo sapiens
ataaaggaggaatc

SEQ ID NO: 5844607 - DNA, 19 bp, Homo sapiens
ataaaggataactctgtat

SEQ ID NO: 5844608 - DNA, 16 bp, Homo sapiens
ataaaggatatttcaa

SEQ ID NO: 5844609 - DNA, 17 bp, Homo sapiens
ataaaggatatttcaaa

SEQ ID NO: 5844610 - DNA, 18 bp, Homo sapiens
ataaaggatatttcaaat

SEQ ID NO: 5844611 - DNA, 14 bp, Homo sapiens
ataaaggatgtgat

SEQ ID NO: 5844612 - DNA, 21 bp, Homo sapiens
ataaaggattcaaaagataaa

SEQ ID NO: 5844613 - DNA, 22 bp, Homo sapiens
ataaaggcaaggaaattaagaa

SEQ ID NO: 5844614 - DNA, 13 bp, Homo sapiens
ataaaggcagctg

SEQ ID NO: 5844615 - DNA, 14 bp, Homo sapiens
ataaaggcagctgc

SEQ ID NO: 5844616 - DNA, 15 bp, Homo sapiens
ataaaggcagctgcc

SEQ ID NO: 5844617 - DNA, 17 bp, Homo sapiens
ataaaggcagctgcctc

SEQ ID NO: 5844618 - DNA, 20 bp, Homo sapiens
ataaaggcagctgcctctgc

SEQ ID NO: 5844619 - DNA, 23 bp, Homo sapiens
ataaaggcagctgcctctgctcc

SEQ ID NO: 5844620 - DNA, 17 bp, Homo sapiens
ataaaggcagttttcta

SEQ ID NO: 5844621 - DNA, 18 bp, Homo sapiens
ataaaggccacaggagac

SEQ ID NO: 5844622 - DNA, 19 bp, Homo sapiens
ataaaggccccaaatacca

SEQ ID NO: 5844623 - DNA, 12 bp, Homo sapiens
ataaaggctctg

SEQ ID NO: 5844624 - DNA, 17 bp, Homo sapiens
ataaaggctctggaagc

SEQ ID NO: 5844625 - DNA, 13 bp, Homo sapiens
ataaagggaacat

SEQ ID NO: 5844626 - DNA, 19 bp, Homo sapiens
ataaagggagaatggtgct

SEQ ID NO: 5844627 - DNA, 18 bp, Homo sapiens
ataaagggcccacacctg

SEQ ID NO: 5844628 - DNA, 11 bp, Homo sapiens
ataaagggtca

SEQ ID NO: 5844629 - DNA, 17 bp, Homo sapiens
ataaagggttgaaaatg

SEQ ID NO: 5844630 - DNA, 17 bp, Homo sapiens
ataaaggtaaaatcact

SEQ ID NO: 5844631 - DNA, 16 bp, Homo sapiens
ataaaggtacacatgg

SEQ ID NO: 5844632 - DNA, 16 bp, Homo sapiens
ataaaggtcacataaa

SEQ ID NO: 5844633 - DNA, 21 bp, Homo sapiens
ataaaggtctgcactccttta

SEQ ID NO: 5844634 - DNA, 15 bp, Homo sapiens
ataaaggtctttgca

SEQ ID NO: 5844635 - DNA, 21 bp, Homo sapiens
ataaaggttatgaaacatatc

SEQ ID NO: 5844636 - DNA, 16 bp, Homo sapiens
ataaaggttattttct

SEQ ID NO: 5844637 - DNA, 16 bp, Homo sapiens
ataaaggttctatgat

SEQ ID NO: 5844638 - DNA, 19 bp, Homo sapiens
ataaaggttctatgatata

SEQ ID NO: 5844639 - DNA, 15 bp, Homo sapiens
ataaaggttctgggg

SEQ ID NO: 5844640 - DNA, 16 bp, Homo sapiens
ataaaggttgacaata

SEQ ID NO: 5844641 - DNA, 22 bp, Homo sapiens
ataaaggttgacaataaatgtg

SEQ ID NO: 5844642 - DNA, 18 bp, Homo sapiens
ataaaggtttaaagctga

SEQ ID NO: 5844643 - DNA, 22 bp, Homo sapiens
ataaaggtttaaagctgaagag

SEQ ID NO: 5844644 - DNA, 13 bp, Homo sapiens
ataaaggtttcgt

SEQ ID NO: 5844645 - DNA, 22 bp, Homo sapiens
ataaagtaaaaaagttaaatgt

SEQ ID NO: 5844646 - DNA, 18 bp, Homo sapiens
ataaagtaaatacatgca

SEQ ID NO: 5844647 - DNA, 22 bp, Homo sapiens
ataaagtaaatgctacctctga

SEQ ID NO: 5844648 - DNA, 16 bp, Homo sapiens
ataaagtaaattgaaa

SEQ ID NO: 5844649 - DNA, 15 bp, Homo sapiens
ataaagtaataatgt

SEQ ID NO: 5844650 - DNA, 15 bp, Homo sapiens
ataaagtaattcata

SEQ ID NO: 5844651 - DNA, 17 bp, Homo sapiens
ataaagtaattcataca

SEQ ID NO: 5844652 - DNA, 16 bp, Homo sapiens
ataaagtaatttttat

SEQ ID NO: 5844653 - DNA, 14 bp, Homo sapiens
ataaagtacaaatg

SEQ ID NO: 5844654 - DNA, 22 bp, Homo sapiens
ataaagtacaaatgaagaaagt

SEQ ID NO: 5844655 - DNA, 23 bp, Homo sapiens
ataaagtacaaatgaagaaagtc

SEQ ID NO: 5844656 - DNA, 19 bp, Homo sapiens
ataaattttaaaaaggaat

SEQ ID NO: 5844657 - DNA, 16 bp, Homo sapiens
ataaattttaaaattg

SEQ ID NO: 5844658 - DNA, 13 bp, Homo sapiens
ataaattttaatt

SEQ ID NO: 5844659 - DNA, 17 bp, Homo sapiens
ataaattttcaaatcct

SEQ ID NO: 5844660 - DNA, 13 bp, Homo sapiens
ataaattttcaga

SEQ ID NO: 5844661 - DNA, 14 bp, Homo sapiens
ataaattttctaaa

SEQ ID NO: 5844662 - DNA, 22 bp, Homo sapiens
ataaattttgaaaagtaatatt

SEQ ID NO: 5844663 - DNA, 12 bp, Homo sapiens
ataaattttgga

SEQ ID NO: 5844664 - DNA, 22 bp, Homo sapiens
ataaattttggaagaattcatg

SEQ ID NO: 5844665 - DNA, 15 bp, Homo sapiens
ataaattttgtacat

SEQ ID NO: 5844666 - DNA, 13 bp, Homo sapiens
ataaatttttgtc

SEQ ID NO: 5844667 - DNA, 14 bp, Homo sapiens
ataaattttttgaa

SEQ ID NO: 5844668 - DNA, 20 bp, Homo sapiens
ataacaaaaaaagaaaagag

SEQ ID NO: 5844669 - DNA, 19 bp, Homo sapiens
ataacaaaaaagagaaacg

SEQ ID NO: 5844670 - DNA, 14 bp, Homo sapiens
ataacaaaaaataa

SEQ ID NO: 5844671 - DNA, 15 bp, Homo sapiens
ataacaaaactgtgc

SEQ ID NO: 5844672 - DNA, 11 bp, Homo sapiens
ataacaaaatc

SEQ ID NO: 5844673 - DNA, 13 bp, Homo sapiens
ataacaaaatcac

SEQ ID NO: 5844674 - DNA, 14 bp, Homo sapiens
ataacaaaatggac

SEQ ID NO: 5844675 - DNA, 21 bp, Homo sapiens
ataacaaaccatctggtgcct

SEQ ID NO: 5844676 - DNA, 17 bp, Homo sapiens
ataacaaagaagtgtat

SEQ ID NO: 5844677 - DNA, 15 bp, Homo sapiens
ataacaaagatatct

SEQ ID NO: 5844678 - DNA, 19 bp, Homo sapiens
ataacaaagatatcttttc

SEQ ID NO: 5844679 - DNA, 21 bp, Homo sapiens
ataacaaaggatacttattta

SEQ ID NO: 5844680 - DNA, 15 bp, Homo sapiens
ataacaaaggcaaga

SEQ ID NO: 5844681 - DNA, 18 bp, Homo sapiens
ataacaaatttttcaaat

SEQ ID NO: 5844682 - DNA, 15 bp, Homo sapiens
ataacaacaacagtt

SEQ ID NO: 5844683 - DNA, 16 bp, Homo sapiens
ataacaacaacttaat

SEQ ID NO: 5844684 - DNA, 19 bp, Homo sapiens
ataacaacaacttaatgtg

SEQ ID NO: 5844685 - DNA, 11 bp, Homo sapiens
ataacaacaat

SEQ ID NO: 5844686 - DNA, 12 bp, Homo sapiens
ataacaacaatg

SEQ ID NO: 5844687 - DNA, 15 bp, Homo sapiens
ataacaacctggaga

SEQ ID NO: 5844688 - DNA, 17 bp, Homo sapiens
ataacaaccttttacat

SEQ ID NO: 5844689 - DNA, 17 bp, Homo sapiens
ataacaacgtctttttg

SEQ ID NO: 5844690 - DNA, 21 bp, Homo sapiens
ataacaacgtctttttgtttg

SEQ ID NO: 5844691 - DNA, 22 bp, Homo sapiens
ataacaacgtctttttgtttgt

SEQ ID NO: 5844692 - DNA, 18 bp, Homo sapiens
ataacaactaacttgttt

SEQ ID NO: 5844693 - DNA, 21 bp, Homo sapiens
ataacaactaacttgtttgag

SEQ ID NO: 5844694 - DNA, 15 bp, Homo sapiens
ataacaactccctga

SEQ ID NO: 5844695 - DNA, 13 bp, Homo sapiens
ataacaactctat

SEQ ID NO: 5844696 - DNA, 18 bp, Homo sapiens
ataacaactgctgggaat

SEQ ID NO: 5844697 - DNA, 21 bp, Homo sapiens
ataacaactggatgcatcaag

SEQ ID NO: 5844698 - DNA, 12 bp, Homo sapiens
ataacaagaaaa

SEQ ID NO: 5844699 - DNA, 17 bp, Homo sapiens
ataacaagcatgcataa

SEQ ID NO: 5844700 - DNA, 21 bp, Homo sapiens
ataacaagcatgcataaatca

SEQ ID NO: 5844701 - DNA, 22 bp, Homo sapiens
ataacaaggaaaacagtaacta

SEQ ID NO: 5844702 - DNA, 18 bp, Homo sapiens
ataacaaggagatttctt

SEQ ID NO: 5844703 - DNA, 21 bp, Homo sapiens
ataacaaggagctcaccctgc

SEQ ID NO: 5844704 - DNA, 17 bp, Homo sapiens
ataacaaggtccaagat

SEQ ID NO: 5844705 - DNA, 15 bp, Homo sapiens
ataacaatatataga

SEQ ID NO: 5844706 - DNA, 14 bp, Homo sapiens
ataacaatatatga

SEQ ID NO: 5844707 - DNA, 19 bp, Homo sapiens
ataacaatgctgtatttta

SEQ ID NO: 5844708 - DNA, 20 bp, Homo sapiens
ataacaatgctgtattttaa

SEQ ID NO: 5844709 - DNA, 21 bp, Homo sapiens
ataacaatgctgtattttaaa

SEQ ID NO: 5844710 - DNA, 15 bp, Homo sapiens
ataacaattgtttgg

SEQ ID NO: 5844711 - DNA, 23 bp, Homo sapiens
ataacacacagctaacacacagc

SEQ ID NO: 5844712 - DNA, 11 bp, Homo sapiens
ataacacacat

SEQ ID NO: 5844713 - DNA, 22 bp, Homo sapiens
ataacacagagagacagacttg

SEQ ID NO: 5844714 - DNA, 23 bp, Homo sapiens
ataacacagatattgttataaat

SEQ ID NO: 5844715 - DNA, 19 bp, Homo sapiens
ataacaccaccattcacaa

SEQ ID NO: 5844716 - DNA, 23 bp, Homo sapiens
ataacactataaaggttgacaat

SEQ ID NO: 5844717 - DNA, 20 bp, Homo sapiens
ataacactcaagactatgtt

SEQ ID NO: 5844718 - DNA, 13 bp, Homo sapiens
ataacactgtatt

SEQ ID NO: 5844719 - DNA, 14 bp, Homo sapiens
ataacactgtattt

SEQ ID NO: 5844720 - DNA, 16 bp, Homo sapiens
ataacactgtgaagag

SEQ ID NO: 5844721 - DNA, 20 bp, Homo sapiens
ataacactgttggcacttat

SEQ ID NO: 5844722 - DNA, 22 bp, Homo sapiens
ataacacttaaaattgtaacct

SEQ ID NO: 5844723 - DNA, 18 bp, Homo sapiens
ataacacttcaccttctg

SEQ ID NO: 5844724 - DNA, 14 bp, Homo sapiens
ataacagagagaat

SEQ ID NO: 5844725 - DNA, 17 bp, Homo sapiens
ataacagagtagttttg

SEQ ID NO: 5844726 - DNA, 19 bp, Homo sapiens
ataacagagtgatttgtaa

SEQ ID NO: 5844727 - DNA, 12 bp, Homo sapiens
ataacagcactg

SEQ ID NO: 5844728 - DNA, 14 bp, Homo sapiens
ataacagcctcttg

SEQ ID NO: 5844729 - DNA, 17 bp, Homo sapiens
ataacagccttttcctt

SEQ ID NO: 5844730 - DNA, 13 bp, Homo sapiens
ataacagctcctt

SEQ ID NO: 5844731 - DNA, 21 bp, Homo sapiens
ataacagctgcaattccctgg

SEQ ID NO: 5844732 - DNA, 20 bp, Homo sapiens
ataacagcttgaaaactgga

SEQ ID NO: 5844733 - DNA, 19 bp, Homo sapiens
ataacaggcattgcactaa

SEQ ID NO: 5844734 - DNA, 18 bp, Homo sapiens
ataacaggcatttgttca

SEQ ID NO: 5844735 - DNA, 19 bp, Homo sapiens
ataacagggattgatttta

SEQ ID NO: 5844736 - DNA, 19 bp, Homo sapiens
ataacagggtaaattattc

SEQ ID NO: 5844737 - DNA, 14 bp, Homo sapiens
ataacaggttattt

SEQ ID NO: 5844738 - DNA, 18 bp, Homo sapiens
ataacagtgcagggcaaa

SEQ ID NO: 5844739 - DNA, 21 bp, Homo sapiens
ataacagtgccattgtcttta

SEQ ID NO: 5844740 - DNA, 18 bp, Homo sapiens
ataacagttatatttttg

SEQ ID NO: 5844741 - DNA, 16 bp, Homo sapiens
ataacagttttaagat

SEQ ID NO: 5844742 - DNA, 11 bp, Homo sapiens
ataacataaaa

SEQ ID NO: 5844743 - DNA, 18 bp, Homo sapiens
ataacataaaagtgctac

SEQ ID NO: 5844744 - DNA, 17 bp, Homo sapiens
ataacataaataaaaat

SEQ ID NO: 5844745 - DNA, 17 bp, Homo sapiens
ataacatagttgaaaaa

SEQ ID NO: 5844746 - DNA, 23 bp, Homo sapiens
ataacatagttgaaaaaagaagt

SEQ ID NO: 5844747 - DNA, 11 bp, Homo sapiens
ataacatatat

SEQ ID NO: 5844748 - DNA, 15 bp, Homo sapiens
ataacatattcttgc

SEQ ID NO: 5844749 - DNA, 20 bp, Homo sapiens
ataacatctttattgaaatt

SEQ ID NO: 5844750 - DNA, 23 bp, Homo sapiens
ataacatgaaatgatagatttga

SEQ ID NO: 5844751 - DNA, 15 bp, Homo sapiens
ataacatgtaaaatc

SEQ ID NO: 5844752 - DNA, 20 bp, Homo sapiens
ataacatgtatcactcactg

SEQ ID NO: 5844753 - DNA, 19 bp, Homo sapiens
ataacattaccttactgtg

SEQ ID NO: 5844754 - DNA, 16 bp, Homo sapiens
ataacattcagttccc

SEQ ID NO: 5844755 - DNA, 14 bp, Homo sapiens
ataacattctgaat

SEQ ID NO: 5844756 - DNA, 13 bp, Homo sapiens
ataacattctgac

SEQ ID NO: 5844757 - DNA, 14 bp, Homo sapiens
ataacattctgaca

SEQ ID NO: 5844758 - DNA, 13 bp, Homo sapiens
ataacattgtaaa

SEQ ID NO: 5844759 - DNA, 14 bp, Homo sapiens
ataacattgtatgt

SEQ ID NO: 5844760 - DNA, 14 bp, Homo sapiens
ataacatttaaaga

SEQ ID NO: 5844761 - DNA, 19 bp, Homo sapiens
ataacatttaatttagata

SEQ ID NO: 5844762 - DNA, 20 bp, Homo sapiens
ataacatttgagtatccgat

SEQ ID NO: 5844763 - DNA, 16 bp, Homo sapiens
ataacatttgctgaat

SEQ ID NO: 5844764 - DNA, 17 bp, Homo sapiens
ataacattttgtttatg

SEQ ID NO: 5844765 - DNA, 14 bp, Homo sapiens
ataaccaaaaaatg

SEQ ID NO: 5844766 - DNA, 18 bp, Homo sapiens
ataaccaaagcaattaaa

SEQ ID NO: 5844767 - DNA, 22 bp, Homo sapiens
ataaccaacattaaaactcata

SEQ ID NO: 5844768 - DNA, 20 bp, Homo sapiens
ataaccaagtttattcagta

SEQ ID NO: 5844769 - DNA, 23 bp, Homo sapiens
ataaccaagtttattcagtaaac

SEQ ID NO: 5844770 - DNA, 20 bp, Homo sapiens
ataaccaattcctcatttgt

SEQ ID NO: 5844771 - DNA, 14 bp, Homo sapiens
ataaccaatttgta

SEQ ID NO: 5844772 - DNA, 16 bp, Homo sapiens
ataaccaatttgtaat

SEQ ID NO: 5844773 - DNA, 14 bp, Homo sapiens
ataaccaattttca

SEQ ID NO: 5844774 - DNA, 19 bp, Homo sapiens
ataaccacaaccaggaaga

SEQ ID NO: 5844775 - DNA, 15 bp, Homo sapiens
ataaccacatttcta

SEQ ID NO: 5844776 - DNA, 16 bp, Homo sapiens
ataaccacatttctaa

SEQ ID NO: 5844777 - DNA, 20 bp, Homo sapiens
ataaccaccctagctttata

SEQ ID NO: 5844778 - DNA, 12 bp, Homo sapiens
ataaccactgct

SEQ ID NO: 5844779 - DNA, 14 bp, Homo sapiens
ataaccactgcttc

SEQ ID NO: 5844780 - DNA, 16 bp, Homo sapiens
ataaccagacacaaac

SEQ ID NO: 5844781 - DNA, 23 bp, Homo sapiens
ataaccagtttagctttttcctt

SEQ ID NO: 5844782 - DNA, 23 bp, Homo sapiens
ataaccatcagttactggtttca

SEQ ID NO: 5844783 - DNA, 22 bp, Homo sapiens
ataaccatttaaagaaagaatg

SEQ ID NO: 5844784 - DNA, 14 bp, Homo sapiens
ataacccagttact

SEQ ID NO: 5844785 - DNA, 12 bp, Homo sapiens
ataaccccaccc

SEQ ID NO: 5844786 - DNA, 20 bp, Homo sapiens
ataaccccagctccctagga

SEQ ID NO: 5844787 - DNA, 21 bp, Homo sapiens
ataaccccaggcactgtttgg

SEQ ID NO: 5844788 - DNA, 16 bp, Homo sapiens
ataaccccattctttg

SEQ ID NO: 5844789 - DNA, 18 bp, Homo sapiens
ataaccccattctttgct

SEQ ID NO: 5844790 - DNA, 20 bp, Homo sapiens
ataaccctgaatcagaggca

SEQ ID NO: 5844791 - DNA, 24 bp, Homo sapiens
ataaccctgaatcagaggcagaga

SEQ ID NO: 5844792 - DNA, 14 bp, Homo sapiens
ataaccctgccagt

SEQ ID NO: 5844793 - DNA, 17 bp, Homo sapiens
ataaccctgggctgtcc

SEQ ID NO: 5844794 - DNA, 23 bp, Homo sapiens
ataaccgtttcctttcatttact

SEQ ID NO: 5844795 - DNA, 19 bp, Homo sapiens
ataacctaataattgtatc

SEQ ID NO: 5844796 - DNA, 15 bp, Homo sapiens
ataacctagttaaag

SEQ ID NO: 5844797 - DNA, 17 bp, Homo sapiens
ataacctagttaaagaa

SEQ ID NO: 5844798 - DNA, 19 bp, Homo sapiens
ataacctagttaaagaaag

SEQ ID NO: 5844799 - DNA, 18 bp, Homo sapiens
ataacctctatatcttta

SEQ ID NO: 5844800 - DNA, 11 bp, Homo sapiens
ataacctctgg

SEQ ID NO: 5844801 - DNA, 17 bp, Homo sapiens
ataacctctggcccttg

SEQ ID NO: 5844802 - DNA, 20 bp, Homo sapiens
ataacctgcacaggcttgct

SEQ ID NO: 5844803 - DNA, 13 bp, Homo sapiens
ataacctggcaaa

SEQ ID NO: 5844804 - DNA, 14 bp, Homo sapiens
ataaccttaattta

SEQ ID NO: 5844805 - DNA, 15 bp, Homo sapiens
ataaccttcattttt

SEQ ID NO: 5844806 - DNA, 17 bp, Homo sapiens
ataacctttacactcct

SEQ ID NO: 5844807 - DNA, 18 bp, Homo sapiens
ataacgcaggagagagag

SEQ ID NO: 5844808 - DNA, 14 bp, Homo sapiens
ataacgtataaaag

SEQ ID NO: 5844809 - DNA, 13 bp, Homo sapiens
ataacgtttttcc

SEQ ID NO: 5844810 - DNA, 17 bp, Homo sapiens
ataacgtttttccttta

SEQ ID NO: 5844811 - DNA, 14 bp, Homo sapiens
ataactaaaattct

SEQ ID NO: 5844812 - DNA, 19 bp, Homo sapiens
ataactaaatttgatactt

SEQ ID NO: 5844813 - DNA, 21 bp, Homo sapiens
ataactaacaaccaaagacta

SEQ ID NO: 5844814 - DNA, 15 bp, Homo sapiens
ataactaacatgtcc

SEQ ID NO: 5844815 - DNA, 12 bp, Homo sapiens
ataactaaggaa

SEQ ID NO: 5844816 - DNA, 20 bp, Homo sapiens
ataactacattaaaagcttt

SEQ ID NO: 5844817 - DNA, 14 bp, Homo sapiens
ataactacctcctc

SEQ ID NO: 5844818 - DNA, 19 bp, Homo sapiens
ataactactccggagacag

SEQ ID NO: 5844819 - DNA, 15 bp, Homo sapiens
ataactactgtgttc

SEQ ID NO: 5844820 - DNA, 18 bp, Homo sapiens
ataactactgtgttcctg

SEQ ID NO: 5844821 - DNA, 17 bp, Homo sapiens
ataactacttagcactg

SEQ ID NO: 5844822 - DNA, 13 bp, Homo sapiens
ataactagacatc

SEQ ID NO: 5844823 - DNA, 19 bp, Homo sapiens
ataactagacatctgctgt

SEQ ID NO: 5844824 - DNA, 19 bp, Homo sapiens
ataactagagtatgtgtat

SEQ ID NO: 5844825 - DNA, 13 bp, Homo sapiens
ataactagatctc

SEQ ID NO: 5844826 - DNA, 19 bp, Homo sapiens
ataactagatctcctgtaa

SEQ ID NO: 5844827 - DNA, 22 bp, Homo sapiens
ataactagatctcctgtaattt

SEQ ID NO: 5844828 - DNA, 16 bp, Homo sapiens
ataactagccagacaa

SEQ ID NO: 5844829 - DNA, 23 bp, Homo sapiens
ataactagccagacaaaatttga

SEQ ID NO: 5844830 - DNA, 14 bp, Homo sapiens
ataactaggattat

SEQ ID NO: 5844831 - DNA, 13 bp, Homo sapiens
ataactatataaa

SEQ ID NO: 5844832 - DNA, 14 bp, Homo sapiens
ataactatataaat

SEQ ID NO: 5844833 - DNA, 15 bp, Homo sapiens
ataactatcaggcag

SEQ ID NO: 5844834 - DNA, 22 bp, Homo sapiens
ataactatcaggcagaagaatc

SEQ ID NO: 5844835 - DNA, 23 bp, Homo sapiens
ataagtgacaaataagattaata

SEQ ID NO: 5844836 - DNA, 13 bp, Homo sapiens
ataagtgctcagt

SEQ ID NO: 5844837 - DNA, 14 bp, Homo sapiens
ataagtgctgtata

SEQ ID NO: 5844838 - DNA, 15 bp, Homo sapiens
ataagtgctgtataa

SEQ ID NO: 5844839 - DNA, 17 bp, Homo sapiens
ataagtgctgtttgaga

SEQ ID NO: 5844840 - DNA, 11 bp, Homo sapiens
ataagtggaaa

SEQ ID NO: 5844841 - DNA, 23 bp, Homo sapiens
ataagtggagaaatgaaaagtaa

SEQ ID NO: 5844842 - DNA, 21 bp, Homo sapiens
ataagtggccttgacacatta

SEQ ID NO: 5844843 - DNA, 18 bp, Homo sapiens
ataagtggctgtttcatc

SEQ ID NO: 5844844 - DNA, 17 bp, Homo sapiens
ataagtgggagctaaat

SEQ ID NO: 5844845 - DNA, 16 bp, Homo sapiens
ataagtggttttcttc

SEQ ID NO: 5844846 - DNA, 14 bp, Homo sapiens
ataagtgtacatat

SEQ ID NO: 5844847 - DNA, 19 bp, Homo sapiens
ataagtgtacatatgtgct

SEQ ID NO: 5844848 - DNA, 16 bp, Homo sapiens
ataagtgtatttttca

SEQ ID NO: 5844849 - DNA, 20 bp, Homo sapiens
ataagtgtgaccagttttga

SEQ ID NO: 5844850 - DNA, 21 bp, Homo sapiens
ataagtgtgtggtcccaagtt

SEQ ID NO: 5844851 - DNA, 19 bp, Homo sapiens
ataagtgtgtgtttttcat

SEQ ID NO: 5844852 - DNA, 14 bp, Homo sapiens
ataagtgttcagtg

SEQ ID NO: 5844853 - DNA, 21 bp, Homo sapiens
ataagtgttcagtgttgacat

SEQ ID NO: 5844854 - DNA, 17 bp, Homo sapiens
ataagtgttctgtctga

SEQ ID NO: 5844855 - DNA, 12 bp, Homo sapiens
ataagtgttctt

SEQ ID NO: 5844856 - DNA, 19 bp, Homo sapiens
ataagtgttcttcagtgta

SEQ ID NO: 5844857 - DNA, 14 bp, Homo sapiens
ataagttaaagaga

SEQ ID NO: 5844858 - DNA, 14 bp, Homo sapiens
ataagttaaaggca

SEQ ID NO: 5844859 - DNA, 15 bp, Homo sapiens
ataagttaaaggcag

SEQ ID NO: 5844860 - DNA, 22 bp, Homo sapiens
ataagttaacttccaatttaca

SEQ ID NO: 5844861 - DNA, 18 bp, Homo sapiens
ataagttaatagaaagtt

SEQ ID NO: 5844862 - DNA, 14 bp, Homo sapiens
ataagttacttgaa

SEQ ID NO: 5844863 - DNA, 15 bp, Homo sapiens
ataagttacttgaaa

SEQ ID NO: 5844864 - DNA, 18 bp, Homo sapiens
ataagttatttttgtaca

SEQ ID NO: 5844865 - DNA, 19 bp, Homo sapiens
ataagttatttttgtacat

SEQ ID NO: 5844866 - DNA, 18 bp, Homo sapiens
ataagttcaaattcttct

SEQ ID NO: 5844867 - DNA, 21 bp, Homo sapiens
ataagttcatacattgtacga

SEQ ID NO: 5844868 - DNA, 15 bp, Homo sapiens
ataagttcattaaac

SEQ ID NO: 5844869 - DNA, 19 bp, Homo sapiens
ataagttcattaaacagaa

SEQ ID NO: 5844870 - DNA, 17 bp, Homo sapiens
ataagttcctctgaaga

SEQ ID NO: 5844871 - DNA, 23 bp, Homo sapiens
ataagttctagttgcttgtaaaa

SEQ ID NO: 5844872 - DNA, 13 bp, Homo sapiens
ataagttgaatga

SEQ ID NO: 5844873 - DNA, 15 bp, Homo sapiens
ataagttgaccttta

SEQ ID NO: 5844874 - DNA, 16 bp, Homo sapiens
ataagttgatgttttc

SEQ ID NO: 5844875 - DNA, 13 bp, Homo sapiens
ataagttgcattt

SEQ ID NO: 5844876 - DNA, 21 bp, Homo sapiens
ataagttgctgtaaaatttgt

SEQ ID NO: 5844877 - DNA, 17 bp, Homo sapiens
ataagttgtaccaaaac

SEQ ID NO: 5844878 - DNA, 19 bp, Homo sapiens
ataagttgtaccaaaacat

SEQ ID NO: 5844879 - DNA, 19 bp, Homo sapiens
ataagttgttttgttttat

SEQ ID NO: 5844880 - DNA, 20 bp, Homo sapiens
ataagtttacacctttatct

SEQ ID NO: 5844881 - DNA, 23 bp, Homo sapiens
ataagtttattgtaaaagtgaca

SEQ ID NO: 5844882 - DNA, 18 bp, Homo sapiens
ataagtttctttgcttca

SEQ ID NO: 5844883 - DNA, 15 bp, Homo sapiens
ataagtttgaaggaa

SEQ ID NO: 5844884 - DNA, 18 bp, Homo sapiens
ataagtttgcaatttggg

SEQ ID NO: 5844885 - DNA, 20 bp, Homo sapiens
ataagtttgtgttagaaaag

SEQ ID NO: 5844886 - DNA, 17 bp, Homo sapiens
ataagttttatacataa

SEQ ID NO: 5844887 - DNA, 19 bp, Homo sapiens
ataagttttatacataaac

SEQ ID NO: 5844888 - DNA, 13 bp, Homo sapiens
ataagttttctct

SEQ ID NO: 5844889 - DNA, 15 bp, Homo sapiens
ataagttttgatata

SEQ ID NO: 5844890 - DNA, 15 bp, Homo sapiens
ataagttttgtttca

SEQ ID NO: 5844891 - DNA, 17 bp, Homo sapiens
ataataaaaagaaagat

SEQ ID NO: 5844892 - DNA, 23 bp, Homo sapiens
ataataaaaagaaagatacttac

SEQ ID NO: 5844893 - DNA, 13 bp, Homo sapiens
ataataaaaagac

SEQ ID NO: 5844894 - DNA, 13 bp, Homo sapiens
ataataaaaatat

SEQ ID NO: 5844895 - DNA, 20 bp, Homo sapiens
ataataaaaatcatgcttat

SEQ ID NO: 5844896 - DNA, 15 bp, Homo sapiens
ataataaaaattgta

SEQ ID NO: 5844897 - DNA, 11 bp, Homo sapiens
ataataaaacc

SEQ ID NO: 5844898 - DNA, 19 bp, Homo sapiens
ataataaaaccaaagaata

SEQ ID NO: 5844899 - DNA, 12 bp, Homo sapiens
ataataaaagaa

SEQ ID NO: 5844900 - DNA, 13 bp, Homo sapiens
ataataaaagaat

SEQ ID NO: 5844901 - DNA, 12 bp, Homo sapiens
ataataaaatca

SEQ ID NO: 5844902 - DNA, 13 bp, Homo sapiens
ataataaaatgca

SEQ ID NO: 5844903 - DNA, 19 bp, Homo sapiens
ataataaaatgcaaatgaa

SEQ ID NO: 5844904 - DNA, 13 bp, Homo sapiens
ataataaaattca

SEQ ID NO: 5844905 - DNA, 12 bp, Homo sapiens
ataataaactgt

SEQ ID NO: 5844906 - DNA, 14 bp, Homo sapiens
ataataaactgtcc

SEQ ID NO: 5844907 - DNA, 13 bp, Homo sapiens
ataataaactgtt

SEQ ID NO: 5844908 - DNA, 12 bp, Homo sapiens
ataataaacttt

SEQ ID NO: 5844909 - DNA, 11 bp, Homo sapiens
ataataaagaa

SEQ ID NO: 5844910 - DNA, 17 bp, Homo sapiens
ataataaagaaaacctt

SEQ ID NO: 5844911 - DNA, 21 bp, Homo sapiens
ataataaagaaaacctttcta

SEQ ID NO: 5844912 - DNA, 12 bp, Homo sapiens
ataataaagaca

SEQ ID NO: 5844913 - DNA, 20 bp, Homo sapiens
ataataaagatgtgaaaact

SEQ ID NO: 5844914 - DNA, 15 bp, Homo sapiens
ataataaagcaatct

SEQ ID NO: 5844915 - DNA, 12 bp, Homo sapiens
ataataaaggaa

SEQ ID NO: 5844916 - DNA, 13 bp, Homo sapiens
ataataaaggaac

SEQ ID NO: 5844917 - DNA, 22 bp, Homo sapiens
ataataaaggttctatgatata

SEQ ID NO: 5844918 - DNA, 23 bp, Homo sapiens
ataataaaggttctatgatatac

SEQ ID NO: 5844919 - DNA, 18 bp, Homo sapiens
ataataaagtacttgact

SEQ ID NO: 5844920 - DNA, 13 bp, Homo sapiens
ataataaagtagc

SEQ ID NO: 5844921 - DNA, 23 bp, Homo sapiens
ataataaagtattccaccttaaa

SEQ ID NO: 5844922 - DNA, 14 bp, Homo sapiens
ataataaagttgtt

SEQ ID NO: 5844923 - DNA, 19 bp, Homo sapiens
ataataaatactcagtgat

SEQ ID NO: 5844924 - DNA, 11 bp, Homo sapiens
ataataaatag

SEQ ID NO: 5844925 - DNA, 13 bp, Homo sapiens
ataataaatatat

SEQ ID NO: 5844926 - DNA, 13 bp, Homo sapiens
ataataaatcaca

SEQ ID NO: 5844927 - DNA, 18 bp, Homo sapiens
ataataaatcacacattc

SEQ ID NO: 5844928 - DNA, 16 bp, Homo sapiens
ataataaatgtattta

SEQ ID NO: 5844929 - DNA, 22 bp, Homo sapiens
ataataaattaaacatgctgtt

SEQ ID NO: 5844930 - DNA, 16 bp, Homo sapiens
ataataaattaacatt

SEQ ID NO: 5844931 - DNA, 18 bp, Homo sapiens
ataataaattaacattat

SEQ ID NO: 5844932 - DNA, 14 bp, Homo sapiens
ataataaattgatt

SEQ ID NO: 5844933 - DNA, 23 bp, Homo sapiens
ataataaattgtttggcttcctc

SEQ ID NO: 5844934 - DNA, 18 bp, Homo sapiens
ataataaattttctaaaa

SEQ ID NO: 5844935 - DNA, 20 bp, Homo sapiens
ataataacaacaacttaatg

SEQ ID NO: 5844936 - DNA, 17 bp, Homo sapiens
ataataacagcacccca

SEQ ID NO: 5844937 - DNA, 23 bp, Homo sapiens
ataataaccctgccagtgccagg

SEQ ID NO: 5844938 - DNA, 15 bp, Homo sapiens
ataataactagatct

SEQ ID NO: 5844939 - DNA, 14 bp, Homo sapiens
ataataactgaact

SEQ ID NO: 5844940 - DNA, 17 bp, Homo sapiens
ataataactgaactgtt

SEQ ID NO: 5844941 - DNA, 20 bp, Homo sapiens
ataataactttattgcatat

SEQ ID NO: 5844942 - DNA, 21 bp, Homo sapiens
ataataactttattgcatata

SEQ ID NO: 5844943 - DNA, 20 bp, Homo sapiens
ataataagagaatgttccta

SEQ ID NO: 5844944 - DNA, 23 bp, Homo sapiens
ataataagcccaacaagttgaag

SEQ ID NO: 5844945 - DNA, 17 bp, Homo sapiens
ataataaggaaaagttt

SEQ ID NO: 5844946 - DNA, 18 bp, Homo sapiens
ataataaggaaaagttta

SEQ ID NO: 5844947 - DNA, 19 bp, Homo sapiens
ataataaggaaaagtttaa

SEQ ID NO: 5844948 - DNA, 15 bp, Homo sapiens
ataataagtttcata

SEQ ID NO: 5844949 - DNA, 13 bp, Homo sapiens
ataataagttttg

SEQ ID NO: 5844950 - DNA, 14 bp, Homo sapiens
ataataagttttga

SEQ ID NO: 5844951 - DNA, 17 bp, Homo sapiens
ataataagttttgatat

SEQ ID NO: 5844952 - DNA, 13 bp, Homo sapiens
ataataataaatt

SEQ ID NO: 5844953 - DNA, 14 bp, Homo sapiens
ataataataataaa

SEQ ID NO: 5844954 - DNA, 15 bp, Homo sapiens
ataataataataaca

SEQ ID NO: 5844955 - DNA, 13 bp, Homo sapiens
ataataatacaag

SEQ ID NO: 5844956 - DNA, 14 bp, Homo sapiens
ataataatagtact

SEQ ID NO: 5844957 - DNA, 12 bp, Homo sapiens
ataataatatat

SEQ ID NO: 5844958 - DNA, 18 bp, Homo sapiens
ataataatattgtttttc

SEQ ID NO: 5844959 - DNA, 13 bp, Homo sapiens
ataataatcatga

SEQ ID NO: 5844960 - DNA, 12 bp, Homo sapiens
ataataatgaat

SEQ ID NO: 5844961 - DNA, 16 bp, Homo sapiens
ataataatgactctaa

SEQ ID NO: 5844962 - DNA, 14 bp, Homo sapiens
ataataatgccaat

SEQ ID NO: 5844963 - DNA, 19 bp, Homo sapiens
ataataatgcccttaatgt

SEQ ID NO: 5844964 - DNA, 21 bp, Homo sapiens
ataataatgcctaccttgtga

SEQ ID NO: 5844965 - DNA, 14 bp, Homo sapiens
ataataattactta

SEQ ID NO: 5844966 - DNA, 14 bp, Homo sapiens
ataataatttttat

SEQ ID NO: 5844967 - DNA, 22 bp, Homo sapiens
ataataatttttatatttaatt

SEQ ID NO: 5844968 - DNA, 12 bp, Homo sapiens
ataatacaaaag

SEQ ID NO: 5844969 - DNA, 20 bp, Homo sapiens
ataatacaccactacattct

SEQ ID NO: 5844970 - DNA, 21 bp, Homo sapiens
ataatacactaattcctttct

SEQ ID NO: 5844971 - DNA, 19 bp, Homo sapiens
ataatacacttgccctgct

SEQ ID NO: 5844972 - DNA, 17 bp, Homo sapiens
ataatacagccaaagat

SEQ ID NO: 5844973 - DNA, 23 bp, Homo sapiens
ataatacaggtaacattataaat

SEQ ID NO: 5844974 - DNA, 15 bp, Homo sapiens
ataatacataaagtt

SEQ ID NO: 5844975 - DNA, 17 bp, Homo sapiens
ataatacataaagttct

SEQ ID NO: 5844976 - DNA, 17 bp, Homo sapiens
ataatacataaatgata

SEQ ID NO: 5844977 - DNA, 19 bp, Homo sapiens
ataatacataacattcaat

SEQ ID NO: 5844978 - DNA, 22 bp, Homo sapiens
ataatacatctttatcattaaa

SEQ ID NO: 5844979 - DNA, 16 bp, Homo sapiens
ataatacattacatgt

SEQ ID NO: 5844980 - DNA, 17 bp, Homo sapiens
ataatacattacatgta

SEQ ID NO: 5844981 - DNA, 19 bp, Homo sapiens
ataatacctcaatgtttga

SEQ ID NO: 5844982 - DNA, 14 bp, Homo sapiens
ataatactaaaact

SEQ ID NO: 5844983 - DNA, 15 bp, Homo sapiens
ataatactaaaactc

SEQ ID NO: 5844984 - DNA, 17 bp, Homo sapiens
ataatactaaagtgtct

SEQ ID NO: 5844985 - DNA, 15 bp, Homo sapiens
ataatactaatttat

SEQ ID NO: 5844986 - DNA, 19 bp, Homo sapiens
ataatactactactgttat

SEQ ID NO: 5844987 - DNA, 22 bp, Homo sapiens
ataatactgaaatgctttagca

SEQ ID NO: 5844988 - DNA, 13 bp, Homo sapiens
ataatactgaacc

SEQ ID NO: 5844989 - DNA, 16 bp, Homo sapiens
ataatactgaaccact

SEQ ID NO: 5844990 - DNA, 20 bp, Homo sapiens
ataatactgaaccacttgta

SEQ ID NO: 5844991 - DNA, 21 bp, Homo sapiens
ataatactgctgagatacata

SEQ ID NO: 5844992 - DNA, 13 bp, Homo sapiens
ataatactgtttt

SEQ ID NO: 5844993 - DNA, 22 bp, Homo sapiens
ataatactgttttaaaatgtga

SEQ ID NO: 5844994 - DNA, 21 bp, Homo sapiens
ataatacttcatacaacatat

SEQ ID NO: 5844995 - DNA, 12 bp, Homo sapiens
ataatacttgac

SEQ ID NO: 5844996 - DNA, 17 bp, Homo sapiens
ataatacttgacctctg

SEQ ID NO: 5844997 - DNA, 19 bp, Homo sapiens
ataatactttgtatacaag

SEQ ID NO: 5844998 - DNA, 13 bp, Homo sapiens
ataatagaaatgt

SEQ ID NO: 5844999 - DNA, 13 bp, Homo sapiens
ataatagaagaac

SEQ ID NO: 5845000 - DNA, 13 bp, Homo sapiens
ataatagactgta

SEQ ID NO: 5845001 - DNA, 22 bp, Homo sapiens
ataatagacttatatgcaggct

SEQ ID NO: 5845002 - DNA, 14 bp, Homo sapiens
ataatagatgtgaa

SEQ ID NO: 5845003 - DNA, 12 bp, Homo sapiens
ataatagattct

SEQ ID NO: 5845004 - DNA, 21 bp, Homo sapiens
ataatagcatttttgtaactt

SEQ ID NO: 5845005 - DNA, 18 bp, Homo sapiens
ataatagctaataataaa

SEQ ID NO: 5845006 - DNA, 19 bp, Homo sapiens
ataatagctcacagcacat

SEQ ID NO: 5845007 - DNA, 20 bp, Homo sapiens
ataatagctcacagcacatt

SEQ ID NO: 5845008 - DNA, 22 bp, Homo sapiens
ataatagctcacagcacatttg

SEQ ID NO: 5845009 - DNA, 13 bp, Homo sapiens
ataataggaattc

SEQ ID NO: 5845010 - DNA, 15 bp, Homo sapiens
ataataggaattcaa

SEQ ID NO: 5845011 - DNA, 20 bp, Homo sapiens
ataataggaatttgtataaa

SEQ ID NO: 5845012 - DNA, 17 bp, Homo sapiens
ataataggggattttaa

SEQ ID NO: 5845013 - DNA, 12 bp, Homo sapiens
ataataggtcat

SEQ ID NO: 5845014 - DNA, 18 bp, Homo sapiens
ataatagtaatggttcta

SEQ ID NO: 5845015 - DNA, 20 bp, Homo sapiens
ataattgtatcgtatagctg

SEQ ID NO: 5845016 - DNA, 16 bp, Homo sapiens
ataattgtcatgactt

SEQ ID NO: 5845017 - DNA, 21 bp, Homo sapiens
ataattgtgattagacagaac

SEQ ID NO: 5845018 - DNA, 15 bp, Homo sapiens
ataattgtggagagg

SEQ ID NO: 5845019 - DNA, 17 bp, Homo sapiens
ataattgtgtacaaagt

SEQ ID NO: 5845020 - DNA, 19 bp, Homo sapiens
ataattgtgtacaaagtag

SEQ ID NO: 5845021 - DNA, 17 bp, Homo sapiens
ataattgtgtattttct

SEQ ID NO: 5845022 - DNA, 19 bp, Homo sapiens
ataattgtgtgatatttca

SEQ ID NO: 5845023 - DNA, 21 bp, Homo sapiens
ataattgtgtgatatttcaga

SEQ ID NO: 5845024 - DNA, 23 bp, Homo sapiens
ataattgtgtgatatttcagaaa

SEQ ID NO: 5845025 - DNA, 12 bp, Homo sapiens
ataattgttgaa

SEQ ID NO: 5845026 - DNA, 12 bp, Homo sapiens
ataattgttgat

SEQ ID NO: 5845027 - DNA, 15 bp, Homo sapiens
ataattgttgatatt

SEQ ID NO: 5845028 - DNA, 21 bp, Homo sapiens
ataattgttgattaatttgag

SEQ ID NO: 5845029 - DNA, 22 bp, Homo sapiens
ataattgttgattaatttgaga

SEQ ID NO: 5845030 - DNA, 17 bp, Homo sapiens
ataattgttgttctgtt

SEQ ID NO: 5845031 - DNA, 23 bp, Homo sapiens
ataattgttgttctgttaactga

SEQ ID NO: 5845032 - DNA, 12 bp, Homo sapiens
ataattgtttcc

SEQ ID NO: 5845033 - DNA, 15 bp, Homo sapiens
ataattgttttgcta

SEQ ID NO: 5845034 - DNA, 18 bp, Homo sapiens
ataattgttttttatctt

SEQ ID NO: 5845035 - DNA, 21 bp, Homo sapiens
ataattgttttttatcttttc

SEQ ID NO: 5845036 - DNA, 21 bp, Homo sapiens
ataatttaaaaatatatttat

SEQ ID NO: 5845037 - DNA, 22 bp, Homo sapiens
ataatttaaagaaacactaaat

SEQ ID NO: 5845038 - DNA, 20 bp, Homo sapiens
ataatttaaatgatatttag

SEQ ID NO: 5845039 - DNA, 15 bp, Homo sapiens
ataatttaactaatt

SEQ ID NO: 5845040 - DNA, 17 bp, Homo sapiens
ataatttaactaattta

SEQ ID NO: 5845041 - DNA, 20 bp, Homo sapiens
ataatttaactaatttaaac

SEQ ID NO: 5845042 - DNA, 23 bp, Homo sapiens
ataatttaactacccttaattac

SEQ ID NO: 5845043 - DNA, 12 bp, Homo sapiens
ataatttaagag

SEQ ID NO: 5845044 - DNA, 16 bp, Homo sapiens
ataatttaatgtaaat

SEQ ID NO: 5845045 - DNA, 18 bp, Homo sapiens
ataatttaatgtaaataa

SEQ ID NO: 5845046 - DNA, 19 bp, Homo sapiens
ataatttaatgtaaataaa

SEQ ID NO: 5845047 - DNA, 20 bp, Homo sapiens
ataatttaatgtaaataaaa

SEQ ID NO: 5845048 - DNA, 17 bp, Homo sapiens
ataatttacaagatatt

SEQ ID NO: 5845049 - DNA, 16 bp, Homo sapiens
ataatttacctaagat

SEQ ID NO: 5845050 - DNA, 18 bp, Homo sapiens
ataatttacctgaagtct

SEQ ID NO: 5845051 - DNA, 13 bp, Homo sapiens
ataatttactgtg

SEQ ID NO: 5845052 - DNA, 21 bp, Homo sapiens
ataatttactgtgactttatt

SEQ ID NO: 5845053 - DNA, 13 bp, Homo sapiens
ataatttagaaat

SEQ ID NO: 5845054 - DNA, 15 bp, Homo sapiens
ataatttagaaataa

SEQ ID NO: 5845055 - DNA, 20 bp, Homo sapiens
ataatttagaaataaaagat

SEQ ID NO: 5845056 - DNA, 15 bp, Homo sapiens
ataatttataagcat

SEQ ID NO: 5845057 - DNA, 16 bp, Homo sapiens
ataatttataagcatt

SEQ ID NO: 5845058 - DNA, 21 bp, Homo sapiens
ataatttatacaggtcatatt

SEQ ID NO: 5845059 - DNA, 17 bp, Homo sapiens
ataatttatggtattgt

SEQ ID NO: 5845060 - DNA, 14 bp, Homo sapiens
ataatttattatta

SEQ ID NO: 5845061 - DNA, 15 bp, Homo sapiens
ataatttatttcaat

SEQ ID NO: 5845062 - DNA, 20 bp, Homo sapiens
ataatttatttccactaaaa

SEQ ID NO: 5845063 - DNA, 15 bp, Homo sapiens
ataatttattttgct

SEQ ID NO: 5845064 - DNA, 16 bp, Homo sapiens
ataatttattttgctc

SEQ ID NO: 5845065 - DNA, 12 bp, Homo sapiens
ataatttcacag

SEQ ID NO: 5845066 - DNA, 18 bp, Homo sapiens
ataatttcagggaaatta

SEQ ID NO: 5845067 - DNA, 21 bp, Homo sapiens
ataatttcagggaaattaatc

SEQ ID NO: 5845068 - DNA, 14 bp, Homo sapiens
ataatttcagggtg

SEQ ID NO: 5845069 - DNA, 16 bp, Homo sapiens
ataatttccttcaggc

SEQ ID NO: 5845070 - DNA, 12 bp, Homo sapiens
ataatttctaat

SEQ ID NO: 5845071 - DNA, 15 bp, Homo sapiens
ataatttctacccat

SEQ ID NO: 5845072 - DNA, 18 bp, Homo sapiens
ataatttcttactaaaca

SEQ ID NO: 5845073 - DNA, 21 bp, Homo sapiens
ataatttcttttggaatgtaa

SEQ ID NO: 5845074 - DNA, 13 bp, Homo sapiens
ataatttgaaaaa

SEQ ID NO: 5845075 - DNA, 14 bp, Homo sapiens
ataatttgaacttt

SEQ ID NO: 5845076 - DNA, 19 bp, Homo sapiens
ataatttgaactttggaac

SEQ ID NO: 5845077 - DNA, 13 bp, Homo sapiens
ataatttgacaaa

SEQ ID NO: 5845078 - DNA, 17 bp, Homo sapiens
ataatttgagtgtatat

SEQ ID NO: 5845079 - DNA, 21 bp, Homo sapiens
ataatttgagtgtatatatat

SEQ ID NO: 5845080 - DNA, 22 bp, Homo sapiens
ataatttgatagatgtttgact

SEQ ID NO: 5845081 - DNA, 12 bp, Homo sapiens
ataatttgcaat

SEQ ID NO: 5845082 - DNA, 15 bp, Homo sapiens
ataatttgcataaag

SEQ ID NO: 5845083 - DNA, 16 bp, Homo sapiens
ataatttgcatattct

SEQ ID NO: 5845084 - DNA, 14 bp, Homo sapiens
ataatttggtcatt

SEQ ID NO: 5845085 - DNA, 21 bp, Homo sapiens
ataatttgtaaatgattttaa

SEQ ID NO: 5845086 - DNA, 22 bp, Homo sapiens
ataatttgtaaatgattttaat

SEQ ID NO: 5845087 - DNA, 20 bp, Homo sapiens
ataatttgtaaattgaataa

SEQ ID NO: 5845088 - DNA, 21 bp, Homo sapiens
ataatttgtacaatggtttat

SEQ ID NO: 5845089 - DNA, 15 bp, Homo sapiens
ataatttgtcttagt

SEQ ID NO: 5845090 - DNA, 12 bp, Homo sapiens
ataatttgttgt

SEQ ID NO: 5845091 - DNA, 16 bp, Homo sapiens
ataattttaaaaatgg

SEQ ID NO: 5845092 - DNA, 15 bp, Homo sapiens
ataattttaaagtaa

SEQ ID NO: 5845093 - DNA, 16 bp, Homo sapiens
ataattttaaagtaat

SEQ ID NO: 5845094 - DNA, 12 bp, Homo sapiens
ataattttaaat

SEQ ID NO: 5845095 - DNA, 15 bp, Homo sapiens
ataattttaagaaat

SEQ ID NO: 5845096 - DNA, 21 bp, Homo sapiens
ataattttaagaaatcaaaga

SEQ ID NO: 5845097 - DNA, 18 bp, Homo sapiens
ataattttaatattcttt

SEQ ID NO: 5845098 - DNA, 15 bp, Homo sapiens
ataattttagtttat

SEQ ID NO: 5845099 - DNA, 22 bp, Homo sapiens
ataattttagtttatattaatt

SEQ ID NO: 5845100 - DNA, 11 bp, Homo sapiens
ataattttatc

SEQ ID NO: 5845101 - DNA, 14 bp, Homo sapiens
ataattttatctgt

SEQ ID NO: 5845102 - DNA, 12 bp, Homo sapiens
ataattttatga

SEQ ID NO: 5845103 - DNA, 13 bp, Homo sapiens
ataattttatgtg

SEQ ID NO: 5845104 - DNA, 13 bp, Homo sapiens
ataattttcaaaa

SEQ ID NO: 5845105 - DNA, 23 bp, Homo sapiens
ataattttcaagagaagaaaaaa

SEQ ID NO: 5845106 - DNA, 14 bp, Homo sapiens
ataattttcctcct

SEQ ID NO: 5845107 - DNA, 21 bp, Homo sapiens
ataattttcctcctaaacaaa

SEQ ID NO: 5845108 - DNA, 22 bp, Homo sapiens
ataattttcctttaatatgaaa

SEQ ID NO: 5845109 - DNA, 15 bp, Homo sapiens
ataattttgaccata

SEQ ID NO: 5845110 - DNA, 12 bp, Homo sapiens
ataattttgcct

SEQ ID NO: 5845111 - DNA, 17 bp, Homo sapiens
ataattttggaataatt

SEQ ID NO: 5845112 - DNA, 13 bp, Homo sapiens
ataattttgtaat

SEQ ID NO: 5845113 - DNA, 20 bp, Homo sapiens
ataattttgtgttgtacaat

SEQ ID NO: 5845114 - DNA, 21 bp, Homo sapiens
ataattttgtgttgtacaatt

SEQ ID NO: 5845115 - DNA, 21 bp, Homo sapiens
ataatttttaaagtatatatt

SEQ ID NO: 5845116 - DNA, 23 bp, Homo sapiens
ataatttttaatttggcttttct

SEQ ID NO: 5845117 - DNA, 19 bp, Homo sapiens
ataatttttacctaatctc

SEQ ID NO: 5845118 - DNA, 23 bp, Homo sapiens
ataatttttacctaatctccact

SEQ ID NO: 5845119 - DNA, 19 bp, Homo sapiens
ataatttttatatttaatt

SEQ ID NO: 5845120 - DNA, 19 bp, Homo sapiens
ataatttttccttttgcca

SEQ ID NO: 5845121 - DNA, 16 bp, Homo sapiens
ataatttttgtacatc

SEQ ID NO: 5845122 - DNA, 22 bp, Homo sapiens
ataatttttgtggcatgttgta

SEQ ID NO: 5845123 - DNA, 21 bp, Homo sapiens
ataattttttaaaaaaaattt

SEQ ID NO: 5845124 - DNA, 20 bp, Homo sapiens
ataattttttagttaaaatc

SEQ ID NO: 5845125 - DNA, 15 bp, Homo sapiens
ataattttttattca

SEQ ID NO: 5845126 - DNA, 14 bp, Homo sapiens
ataattttttctta

SEQ ID NO: 5845127 - DNA, 22 bp, Homo sapiens
ataattttttgcagtcttttgc

SEQ ID NO: 5845128 - DNA, 22 bp, Homo sapiens
ataatttttttaaaaaagaaaa

SEQ ID NO: 5845129 - DNA, 19 bp, Homo sapiens
ataattttttttaaagaag

SEQ ID NO: 5845130 - DNA, 21 bp, Homo sapiens
ataattttttttttttaggaa

SEQ ID NO: 5845131 - DNA, 15 bp, Homo sapiens
atacaaaaaaaagtg

SEQ ID NO: 5845132 - DNA, 16 bp, Homo sapiens
atacaaaaaaaatctt

SEQ ID NO: 5845133 - DNA, 14 bp, Homo sapiens
atacaaaaaattag

SEQ ID NO: 5845134 - DNA, 14 bp, Homo sapiens
atacaaaaagccaa

SEQ ID NO: 5845135 - DNA, 23 bp, Homo sapiens
atacaaaaatcagccagacatgg

SEQ ID NO: 5845136 - DNA, 23 bp, Homo sapiens
atacaaaactatcctatgccttc

SEQ ID NO: 5845137 - DNA, 23 bp, Homo sapiens
atacaaaagagcatggatgcatt

SEQ ID NO: 5845138 - DNA, 22 bp, Homo sapiens
atacaaaaggtttgagattcct

SEQ ID NO: 5845139 - DNA, 14 bp, Homo sapiens
atacaaaataattt

SEQ ID NO: 5845140 - DNA, 19 bp, Homo sapiens
atacaaaataatttaacta

SEQ ID NO: 5845141 - DNA, 20 bp, Homo sapiens
atacaaaataatttaactaa

SEQ ID NO: 5845142 - DNA, 20 bp, Homo sapiens
atacaaaatgattgtctttt

SEQ ID NO: 5845143 - DNA, 16 bp, Homo sapiens
atacaaacaagcatat

SEQ ID NO: 5845144 - DNA, 18 bp, Homo sapiens
atacaaacaatggaaact

SEQ ID NO: 5845145 - DNA, 19 bp, Homo sapiens
atacaaacatatttgttaa

SEQ ID NO: 5845146 - DNA, 16 bp, Homo sapiens
atacaaaccactgtga

SEQ ID NO: 5845147 - DNA, 17 bp, Homo sapiens
atacaaaccactgtgaa

SEQ ID NO: 5845148 - DNA, 21 bp, Homo sapiens
atacaaaccactgtgaacatt

SEQ ID NO: 5845149 - DNA, 16 bp, Homo sapiens
atacaaactctcacca

SEQ ID NO: 5845150 - DNA, 17 bp, Homo sapiens
atacaaactggtattct

SEQ ID NO: 5845151 - DNA, 14 bp, Homo sapiens
atacaaactttgtt

SEQ ID NO: 5845152 - DNA, 15 bp, Homo sapiens
atacaaactttgttt

SEQ ID NO: 5845153 - DNA, 20 bp, Homo sapiens
atacaaagctgtcactcaca

SEQ ID NO: 5845154 - DNA, 14 bp, Homo sapiens
atacaaagtaaata

SEQ ID NO: 5845155 - DNA, 18 bp, Homo sapiens
atacaaataaggacacaa

SEQ ID NO: 5845156 - DNA, 16 bp, Homo sapiens
atacaaatatattgtt

SEQ ID NO: 5845157 - DNA, 14 bp, Homo sapiens
atacaaatctgtat

SEQ ID NO: 5845158 - DNA, 21 bp, Homo sapiens
atacaaatgcatctttgatgt

SEQ ID NO: 5845159 - DNA, 13 bp, Homo sapiens
atacaaatggatt

SEQ ID NO: 5845160 - DNA, 22 bp, Homo sapiens
atacaaatgggggcggctggaa

SEQ ID NO: 5845161 - DNA, 21 bp, Homo sapiens
atacaaatgggttaatcctga

SEQ ID NO: 5845162 - DNA, 14 bp, Homo sapiens
atacaaatgtttat

SEQ ID NO: 5845163 - DNA, 16 bp, Homo sapiens
atacaaattaaaaaga

SEQ ID NO: 5845164 - DNA, 18 bp, Homo sapiens
atacaaattagaaaatgt

SEQ ID NO: 5845165 - DNA, 16 bp, Homo sapiens
atacaaatttaacttt

SEQ ID NO: 5845166 - DNA, 13 bp, Homo sapiens
atacaaatttata

SEQ ID NO: 5845167 - DNA, 16 bp, Homo sapiens
atacaaatttataaag

SEQ ID NO: 5845168 - DNA, 21 bp, Homo sapiens
atacaaattttgtataacttt

SEQ ID NO: 5845169 - DNA, 13 bp, Homo sapiens
atacaacaagaac

SEQ ID NO: 5845170 - DNA, 16 bp, Homo sapiens
atacaacaagaacaac

SEQ ID NO: 5845171 - DNA, 17 bp, Homo sapiens
atacaacaagaacaaca

SEQ ID NO: 5845172 - DNA, 17 bp, Homo sapiens
atacaacaatcccagca

SEQ ID NO: 5845173 - DNA, 18 bp, Homo sapiens
atacaacaggattttcaa

SEQ ID NO: 5845174 - DNA, 14 bp, Homo sapiens
atacaacagtgcta

SEQ ID NO: 5845175 - DNA, 20 bp, Homo sapiens
atacaacagtgctaaaaatg

SEQ ID NO: 5845176 - DNA, 17 bp, Homo sapiens
atacaacatgattttat

SEQ ID NO: 5845177 - DNA, 16 bp, Homo sapiens
atacaacatgcatgtt

SEQ ID NO: 5845178 - DNA, 22 bp, Homo sapiens
atacaaccctggcattatgtcc

SEQ ID NO: 5845179 - DNA, 18 bp, Homo sapiens
atacaacctatgtaattt

SEQ ID NO: 5845180 - DNA, 17 bp, Homo sapiens
atacaacctccctcttg

SEQ ID NO: 5845181 - DNA, 18 bp, Homo sapiens
atacaacctccctcttgt

SEQ ID NO: 5845182 - DNA, 21 bp, Homo sapiens
atacaacctccctcttgtttt

SEQ ID NO: 5845183 - DNA, 16 bp, Homo sapiens
atacaaccttcattta

SEQ ID NO: 5845184 - DNA, 19 bp, Homo sapiens
atacaaccttcatttaaaa

SEQ ID NO: 5845185 - DNA, 14 bp, Homo sapiens
atacaactgcctgg

SEQ ID NO: 5845186 - DNA, 15 bp, Homo sapiens
atacaactgcctggg

SEQ ID NO: 5845187 - DNA, 16 bp, Homo sapiens
atacaacttaaataat

SEQ ID NO: 5845188 - DNA, 16 bp, Homo sapiens
atacaactttaccata

SEQ ID NO: 5845189 - DNA, 21 bp, Homo sapiens
atacaactttggaatttgaag

SEQ ID NO: 5845190 - DNA, 16 bp, Homo sapiens
atacaagaaaatgtat

SEQ ID NO: 5845191 - DNA, 17 bp, Homo sapiens
atacaagaaaatgtatc

SEQ ID NO: 5845192 - DNA, 19 bp, Homo sapiens
atacaagactgttgtgatc

SEQ ID NO: 5845193 - DNA, 17 bp, Homo sapiens
atacctttggaaaaatc

SEQ ID NO: 5845194 - DNA, 17 bp, Homo sapiens
atacctttttcttaaaa

SEQ ID NO: 5845195 - DNA, 20 bp, Homo sapiens
ataccttttttgttccactt

SEQ ID NO: 5845196 - DNA, 13 bp, Homo sapiens
atacgaaaagcca

SEQ ID NO: 5845197 - DNA, 18 bp, Homo sapiens
atacgaaataattgttgt

SEQ ID NO: 5845198 - DNA, 16 bp, Homo sapiens
atacgacagtacactg

SEQ ID NO: 5845199 - DNA, 22 bp, Homo sapiens
atacgagaaaatctgcatgttt

SEQ ID NO: 5845200 - DNA, 19 bp, Homo sapiens
atacgagagcagaggtctc

SEQ ID NO: 5845201 - DNA, 13 bp, Homo sapiens
atacgataaataa

SEQ ID NO: 5845202 - DNA, 13 bp, Homo sapiens
atacgatttaagg

SEQ ID NO: 5845203 - DNA, 17 bp, Homo sapiens
atacgatttaaggtatt

SEQ ID NO: 5845204 - DNA, 19 bp, Homo sapiens
atacgcaaaaacttccttt

SEQ ID NO: 5845205 - DNA, 21 bp, Homo sapiens
atacgcacgcacccacaccct

SEQ ID NO: 5845206 - DNA, 17 bp, Homo sapiens
atacgcatcccatctct

SEQ ID NO: 5845207 - DNA, 20 bp, Homo sapiens
atacgctactataaagagaa

SEQ ID NO: 5845208 - DNA, 21 bp, Homo sapiens
atacgctcagctcatccatgc

SEQ ID NO: 5845209 - DNA, 23 bp, Homo sapiens
atacgctcagctcatccatgcct

SEQ ID NO: 5845210 - DNA, 21 bp, Homo sapiens
atacgctggcaacacagaggc

SEQ ID NO: 5845211 - DNA, 22 bp, Homo sapiens
atacgcttttaatgaaaaggaa

SEQ ID NO: 5845212 - DNA, 21 bp, Homo sapiens
atacggaaaaaattgtattga

SEQ ID NO: 5845213 - DNA, 15 bp, Homo sapiens
atacggctccccagt

SEQ ID NO: 5845214 - DNA, 19 bp, Homo sapiens
atacgggagtgacccagct

SEQ ID NO: 5845215 - DNA, 23 bp, Homo sapiens
atacgggagtgacccagctactg

SEQ ID NO: 5845216 - DNA, 14 bp, Homo sapiens
atacggggtcttgc

SEQ ID NO: 5845217 - DNA, 13 bp, Homo sapiens
atacggtgggggt

SEQ ID NO: 5845218 - DNA, 14 bp, Homo sapiens
atacgtacacattt

SEQ ID NO: 5845219 - DNA, 16 bp, Homo sapiens
atacgtataaatatca

SEQ ID NO: 5845220 - DNA, 15 bp, Homo sapiens
atacgtatacaataa

SEQ ID NO: 5845221 - DNA, 19 bp, Homo sapiens
atacgtatatttttaactg

SEQ ID NO: 5845222 - DNA, 20 bp, Homo sapiens
atacgtattgttaaatgata

SEQ ID NO: 5845223 - DNA, 20 bp, Homo sapiens
atacgtgccagatataactg

SEQ ID NO: 5845224 - DNA, 21 bp, Homo sapiens
atacgtgccagatataactgt

SEQ ID NO: 5845225 - DNA, 20 bp, Homo sapiens
atacgtgcccatttcacaca

SEQ ID NO: 5845226 - DNA, 19 bp, Homo sapiens
atacgtgggcattcaaatg

SEQ ID NO: 5845227 - DNA, 18 bp, Homo sapiens
atacgtgtcaatgtgtgc

SEQ ID NO: 5845228 - DNA, 15 bp, Homo sapiens
atacgtgtgtgaagt

SEQ ID NO: 5845229 - DNA, 16 bp, Homo sapiens
atacgtgttcaaaaat

SEQ ID NO: 5845230 - DNA, 22 bp, Homo sapiens
atacgtgttcctataaaatcaa

SEQ ID NO: 5845231 - DNA, 21 bp, Homo sapiens
atacgtttcaaaaacaccccc

SEQ ID NO: 5845232 - DNA, 14 bp, Homo sapiens
atacgttttctgca

SEQ ID NO: 5845233 - DNA, 17 bp, Homo sapiens
atacgttttgtgtatat

SEQ ID NO: 5845234 - DNA, 18 bp, Homo sapiens
atacgtttttcagtttca

SEQ ID NO: 5845235 - DNA, 17 bp, Homo sapiens
atactaaaaagaagtgc

SEQ ID NO: 5845236 - DNA, 18 bp, Homo sapiens
atactaaaaatcatgaga

SEQ ID NO: 5845237 - DNA, 22 bp, Homo sapiens
atactaaaagcaaatctacaga

SEQ ID NO: 5845238 - DNA, 13 bp, Homo sapiens
atactaaaatatg

SEQ ID NO: 5845239 - DNA, 19 bp, Homo sapiens
atactaaaccaactctaat

SEQ ID NO: 5845240 - DNA, 21 bp, Homo sapiens
atactaaaccaactctaatat

SEQ ID NO: 5845241 - DNA, 12 bp, Homo sapiens
atactaaagtgt

SEQ ID NO: 5845242 - DNA, 18 bp, Homo sapiens
atactaaagtgtctatta

SEQ ID NO: 5845243 - DNA, 12 bp, Homo sapiens
atactaaataaa

SEQ ID NO: 5845244 - DNA, 14 bp, Homo sapiens
atactaaataaaca

SEQ ID NO: 5845245 - DNA, 17 bp, Homo sapiens
atactaaataaacatct

SEQ ID NO: 5845246 - DNA, 20 bp, Homo sapiens
atactaaatatgaaatttta

SEQ ID NO: 5845247 - DNA, 23 bp, Homo sapiens
atactaagagatttgctttttct

SEQ ID NO: 5845248 - DNA, 19 bp, Homo sapiens
atactaagagtaaagcaac

SEQ ID NO: 5845249 - DNA, 20 bp, Homo sapiens
atactaagatgttcactgtg

SEQ ID NO: 5845250 - DNA, 21 bp, Homo sapiens
atactaagcattgaatggcta

SEQ ID NO: 5845251 - DNA, 17 bp, Homo sapiens
atactaataaaaaggtt

SEQ ID NO: 5845252 - DNA, 14 bp, Homo sapiens
atactaataaaata

SEQ ID NO: 5845253 - DNA, 17 bp, Homo sapiens
atactaataaaatacat

SEQ ID NO: 5845254 - DNA, 22 bp, Homo sapiens
atactaataaaatacatactat

SEQ ID NO: 5845255 - DNA, 17 bp, Homo sapiens
atactaataaatataat

SEQ ID NO: 5845256 - DNA, 21 bp, Homo sapiens
atactaataaatataatttat

SEQ ID NO: 5845257 - DNA, 20 bp, Homo sapiens
atactaatagagtacttaat

SEQ ID NO: 5845258 - DNA, 12 bp, Homo sapiens
atactaatgatg

SEQ ID NO: 5845259 - DNA, 13 bp, Homo sapiens
atactaatgatga

SEQ ID NO: 5845260 - DNA, 16 bp, Homo sapiens
atactaatgtaaagat

SEQ ID NO: 5845261 - DNA, 21 bp, Homo sapiens
atactaatgttatttcttaaa

SEQ ID NO: 5845262 - DNA, 16 bp, Homo sapiens
atactaattctatgtc

SEQ ID NO: 5845263 - DNA, 13 bp, Homo sapiens
atactaatttatt

SEQ ID NO: 5845264 - DNA, 19 bp, Homo sapiens
atactaatttttgcttaac

SEQ ID NO: 5845265 - DNA, 12 bp, Homo sapiens
atactacaatag

SEQ ID NO: 5845266 - DNA, 20 bp, Homo sapiens
atactacagtttgttagtat

SEQ ID NO: 5845267 - DNA, 12 bp, Homo sapiens
atactacatctt

SEQ ID NO: 5845268 - DNA, 15 bp, Homo sapiens
atactacatctttaa

SEQ ID NO: 5845269 - DNA, 12 bp, Homo sapiens
atactaccaggg

SEQ ID NO: 5845270 - DNA, 20 bp, Homo sapiens
atactaccggctacatcaaa

SEQ ID NO: 5845271 - DNA, 23 bp, Homo sapiens
atactacctagaagtaagaagag

SEQ ID NO: 5845272 - DNA, 19 bp, Homo sapiens
atactacctataggaaagt

SEQ ID NO: 5845273 - DNA, 14 bp, Homo sapiens
atactactactgtt

SEQ ID NO: 5845274 - DNA, 15 bp, Homo sapiens
atactactactgtta

SEQ ID NO: 5845275 - DNA, 18 bp, Homo sapiens
atactactactgttatca

SEQ ID NO: 5845276 - DNA, 19 bp, Homo sapiens
atactacttatgaaatgtg

SEQ ID NO: 5845277 - DNA, 17 bp, Homo sapiens
atactagaatcagatac

SEQ ID NO: 5845278 - DNA, 15 bp, Homo sapiens
atactagatttggga

SEQ ID NO: 5845279 - DNA, 19 bp, Homo sapiens
atactaggaagtaaagtga

SEQ ID NO: 5845280 - DNA, 23 bp, Homo sapiens
atactaggatacagaaatgcaaa

SEQ ID NO: 5845281 - DNA, 22 bp, Homo sapiens
atactagtacaagtggtaattt

SEQ ID NO: 5845282 - DNA, 16 bp, Homo sapiens
atactagttgtgacct

SEQ ID NO: 5845283 - DNA, 15 bp, Homo sapiens
atactataaatatat

SEQ ID NO: 5845284 - DNA, 18 bp, Homo sapiens
atactataattgtaaata

SEQ ID NO: 5845285 - DNA, 17 bp, Homo sapiens
atactatacaacaatgt

SEQ ID NO: 5845286 - DNA, 18 bp, Homo sapiens
atactatagattctttat

SEQ ID NO: 5845287 - DNA, 14 bp, Homo sapiens
atactatagtacca

SEQ ID NO: 5845288 - DNA, 20 bp, Homo sapiens
atactatattaaattctgaa

SEQ ID NO: 5845289 - DNA, 15 bp, Homo sapiens
atactatattttagg

SEQ ID NO: 5845290 - DNA, 22 bp, Homo sapiens
atactatatttttctcaatgtt

SEQ ID NO: 5845291 - DNA, 21 bp, Homo sapiens
atactatccaaataaaaataa

SEQ ID NO: 5845292 - DNA, 12 bp, Homo sapiens
atactatgtaag

SEQ ID NO: 5845293 - DNA, 19 bp, Homo sapiens
atactatgtggatgtgaca

SEQ ID NO: 5845294 - DNA, 15 bp, Homo sapiens
atactattcaatgca

SEQ ID NO: 5845295 - DNA, 16 bp, Homo sapiens
atactattcaatgcaa

SEQ ID NO: 5845296 - DNA, 18 bp, Homo sapiens
atactattcaatgcaatg

SEQ ID NO: 5845297 - DNA, 19 bp, Homo sapiens
atactattcaatgcaatgc

SEQ ID NO: 5845298 - DNA, 17 bp, Homo sapiens
atactattggacagaca

SEQ ID NO: 5845299 - DNA, 22 bp, Homo sapiens
atactatttaaagcctcctcat

SEQ ID NO: 5845300 - DNA, 18 bp, Homo sapiens
atactatttaagatgtga

SEQ ID NO: 5845301 - DNA, 16 bp, Homo sapiens
atactatttagatttt

SEQ ID NO: 5845302 - DNA, 18 bp, Homo sapiens
atactatttagattttct

SEQ ID NO: 5845303 - DNA, 20 bp, Homo sapiens
atactatttagtttttgtaa

SEQ ID NO: 5845304 - DNA, 19 bp, Homo sapiens
atactatttatatacaagt

SEQ ID NO: 5845305 - DNA, 17 bp, Homo sapiens
atactatttattaaaac

SEQ ID NO: 5845306 - DNA, 19 bp, Homo sapiens
atactatttattaaaacca

SEQ ID NO: 5845307 - DNA, 15 bp, Homo sapiens
atactatttttactg

SEQ ID NO: 5845308 - DNA, 20 bp, Homo sapiens
atactcaaatgagtaacatt

SEQ ID NO: 5845309 - DNA, 12 bp, Homo sapiens
atactcaaggtg

SEQ ID NO: 5845310 - DNA, 12 bp, Homo sapiens
atactcaagttt

SEQ ID NO: 5845311 - DNA, 16 bp, Homo sapiens
atactcaatcaagcaa

SEQ ID NO: 5845312 - DNA, 18 bp, Homo sapiens
atactcaatcaagcaaaa

SEQ ID NO: 5845313 - DNA, 16 bp, Homo sapiens
atactcacattttgtt

SEQ ID NO: 5845314 - DNA, 13 bp, Homo sapiens
atactcacctcct

SEQ ID NO: 5845315 - DNA, 22 bp, Homo sapiens
atactcacctcctcccagactt

SEQ ID NO: 5845316 - DNA, 17 bp, Homo sapiens
atactcagaactgtccc

SEQ ID NO: 5845317 - DNA, 18 bp, Homo sapiens
atactcagaactgtccca

SEQ ID NO: 5845318 - DNA, 16 bp, Homo sapiens
atactcagcctgctgc

SEQ ID NO: 5845319 - DNA, 17 bp, Homo sapiens
atactcagcctgctgcc

SEQ ID NO: 5845320 - DNA, 17 bp, Homo sapiens
atactcataatgtgaag

SEQ ID NO: 5845321 - DNA, 19 bp, Homo sapiens
atactcatcagagcagcta

SEQ ID NO: 5845322 - DNA, 15 bp, Homo sapiens
atactcatccttgta

SEQ ID NO: 5845323 - DNA, 13 bp, Homo sapiens
atactcatgaatg

SEQ ID NO: 5845324 - DNA, 13 bp, Homo sapiens
atactcatgtgta

SEQ ID NO: 5845325 - DNA, 15 bp, Homo sapiens
atactcatgtgtatg

SEQ ID NO: 5845326 - DNA, 13 bp, Homo sapiens
atactcattagaa

SEQ ID NO: 5845327 - DNA, 21 bp, Homo sapiens
atactcatttctaaaagaata

SEQ ID NO: 5845328 - DNA, 22 bp, Homo sapiens
atactccaaccatatggatatt

SEQ ID NO: 5845329 - DNA, 13 bp, Homo sapiens
atactccagcacc

SEQ ID NO: 5845330 - DNA, 13 bp, Homo sapiens
atactccagtgta

SEQ ID NO: 5845331 - DNA, 16 bp, Homo sapiens
atactccagtgtacat

SEQ ID NO: 5845332 - DNA, 17 bp, Homo sapiens
atactccagtgtacata

SEQ ID NO: 5845333 - DNA, 16 bp, Homo sapiens
atactccatagaaact

SEQ ID NO: 5845334 - DNA, 14 bp, Homo sapiens
atactcccatctgt

SEQ ID NO: 5845335 - DNA, 17 bp, Homo sapiens
atactccctttaaagag

SEQ ID NO: 5845336 - DNA, 12 bp, Homo sapiens
atactccttccc

SEQ ID NO: 5845337 - DNA, 20 bp, Homo sapiens
atactcgttattcatacaaa

SEQ ID NO: 5845338 - DNA, 22 bp, Homo sapiens
atactctaaaatggacattttc

SEQ ID NO: 5845339 - DNA, 13 bp, Homo sapiens
atactctaattct

SEQ ID NO: 5845340 - DNA, 14 bp, Homo sapiens
atactctaattcta

SEQ ID NO: 5845341 - DNA, 18 bp, Homo sapiens
atactctaattctaacca

SEQ ID NO: 5845342 - DNA, 22 bp, Homo sapiens
atactctagaacatgcacattt

SEQ ID NO: 5845343 - DNA, 13 bp, Homo sapiens
atactctccagga

SEQ ID NO: 5845344 - DNA, 16 bp, Homo sapiens
atactctctgagtaca

SEQ ID NO: 5845345 - DNA, 15 bp, Homo sapiens
atactctcttccctt

SEQ ID NO: 5845346 - DNA, 16 bp, Homo sapiens
atactctgcttagaat

SEQ ID NO: 5845347 - DNA, 20 bp, Homo sapiens
atactctgtagtctcagttc

SEQ ID NO: 5845348 - DNA, 21 bp, Homo sapiens
atactctgtagtctcagttcg

SEQ ID NO: 5845349 - DNA, 16 bp, Homo sapiens
atactctgtcagatgg

SEQ ID NO: 5845350 - DNA, 22 bp, Homo sapiens
atactctgtgtaatctctgatt

SEQ ID NO: 5845351 - DNA, 12 bp, Homo sapiens
atactctgttgc

SEQ ID NO: 5845352 - DNA, 13 bp, Homo sapiens
atactctgttgcc

SEQ ID NO: 5845353 - DNA, 14 bp, Homo sapiens
atactctgttgcct

SEQ ID NO: 5845354 - DNA, 15 bp, Homo sapiens
atactctgttgcctc

SEQ ID NO: 5845355 - DNA, 19 bp, Homo sapiens
atactctgttgcctcctct

SEQ ID NO: 5845356 - DNA, 20 bp, Homo sapiens
atactctgttgcctcctctc

SEQ ID NO: 5845357 - DNA, 15 bp, Homo sapiens
atactctgtttttca

SEQ ID NO: 5845358 - DNA, 21 bp, Homo sapiens
atactcttaagtgtaaataat

SEQ ID NO: 5845359 - DNA, 18 bp, Homo sapiens
atactcttatatctatat

SEQ ID NO: 5845360 - DNA, 14 bp, Homo sapiens
atactcttgaaagg

SEQ ID NO: 5845361 - DNA, 20 bp, Homo sapiens
atactcttgaaatgtagaat

SEQ ID NO: 5845362 - DNA, 14 bp, Homo sapiens
atactcttggtcac

SEQ ID NO: 5845363 - DNA, 17 bp, Homo sapiens
atactctttctgtatat

SEQ ID NO: 5845364 - DNA, 23 bp, Homo sapiens
atactctttctgtatatactttt

SEQ ID NO: 5845365 - DNA, 14 bp, Homo sapiens
atactgaaacattt

SEQ ID NO: 5845366 - DNA, 16 bp, Homo sapiens
atactgaaatgcttta

SEQ ID NO: 5845367 - DNA, 14 bp, Homo sapiens
atactgaaattatt

SEQ ID NO: 5845368 - DNA, 15 bp, Homo sapiens
atactgaacatctga

SEQ ID NO: 5845369 - DNA, 12 bp, Homo sapiens
atactgaaccac

SEQ ID NO: 5845370 - DNA, 19 bp, Homo sapiens
atactgaaccacttgtaga

SEQ ID NO: 5845371 - DNA, 16 bp, Homo sapiens
atagaagaagaggaag

SEQ ID NO: 5845372 - DNA, 22 bp, Homo sapiens
atagaagaatatcgatataaat

SEQ ID NO: 5845373 - DNA, 12 bp, Homo sapiens
atagaagaatgc

SEQ ID NO: 5845374 - DNA, 23 bp, Homo sapiens
atagaagaatgcatgctttccat

SEQ ID NO: 5845375 - DNA, 16 bp, Homo sapiens
atagaagataatgact

SEQ ID NO: 5845376 - DNA, 16 bp, Homo sapiens
atagaagccacatcgt

SEQ ID NO: 5845377 - DNA, 20 bp, Homo sapiens
atagaagcccaaattcatat

SEQ ID NO: 5845378 - DNA, 20 bp, Homo sapiens
atagaagctataaagaaaag

SEQ ID NO: 5845379 - DNA, 19 bp, Homo sapiens
atagaagcttaaaataaag

SEQ ID NO: 5845380 - DNA, 14 bp, Homo sapiens
atagaagcttcagc

SEQ ID NO: 5845381 - DNA, 17 bp, Homo sapiens
atagaaggaaactagct

SEQ ID NO: 5845382 - DNA, 21 bp, Homo sapiens
atagaaggaatttgtacttct

SEQ ID NO: 5845383 - DNA, 17 bp, Homo sapiens
atagaaggactgcagcc

SEQ ID NO: 5845384 - DNA, 18 bp, Homo sapiens
atagaagtataaagaatt

SEQ ID NO: 5845385 - DNA, 18 bp, Homo sapiens
atagaagtcttcatgaaa

SEQ ID NO: 5845386 - DNA, 23 bp, Homo sapiens
atagaagtcttcatgaaatgcta

SEQ ID NO: 5845387 - DNA, 11 bp, Homo sapiens
atagaagtggt

SEQ ID NO: 5845388 - DNA, 21 bp, Homo sapiens
atagaagtttgtccatttgta

SEQ ID NO: 5845389 - DNA, 11 bp, Homo sapiens
atagaataaaa

SEQ ID NO: 5845390 - DNA, 17 bp, Homo sapiens
atagaataaaggcagtt

SEQ ID NO: 5845391 - DNA, 18 bp, Homo sapiens
atagaataaaggcagttt

SEQ ID NO: 5845392 - DNA, 17 bp, Homo sapiens
atagaataaaggcctgc

SEQ ID NO: 5845393 - DNA, 18 bp, Homo sapiens
atagaataatgaagatct

SEQ ID NO: 5845394 - DNA, 20 bp, Homo sapiens
atagaataatgaagatcttt

SEQ ID NO: 5845395 - DNA, 14 bp, Homo sapiens
atagaataattctt

SEQ ID NO: 5845396 - DNA, 16 bp, Homo sapiens
atagaataatttctcc

SEQ ID NO: 5845397 - DNA, 15 bp, Homo sapiens
atagaatacattttg

SEQ ID NO: 5845398 - DNA, 21 bp, Homo sapiens
atagaatacattttgtatatt

SEQ ID NO: 5845399 - DNA, 14 bp, Homo sapiens
atagaatagcacag

SEQ ID NO: 5845400 - DNA, 16 bp, Homo sapiens
atagaatatactgtct

SEQ ID NO: 5845401 - DNA, 18 bp, Homo sapiens
atagaatatagcatcttt

SEQ ID NO: 5845402 - DNA, 19 bp, Homo sapiens
atagaatatagcatctttc

SEQ ID NO: 5845403 - DNA, 21 bp, Homo sapiens
atagaatatagcatctttcat

SEQ ID NO: 5845404 - DNA, 14 bp, Homo sapiens
atagaatatataaa

SEQ ID NO: 5845405 - DNA, 22 bp, Homo sapiens
atagaatatataaacgatatat

SEQ ID NO: 5845406 - DNA, 13 bp, Homo sapiens
atagaatatttat

SEQ ID NO: 5845407 - DNA, 17 bp, Homo sapiens
atagaatgaactgtcta

SEQ ID NO: 5845408 - DNA, 19 bp, Homo sapiens
atagaatgatatcttgtaa

SEQ ID NO: 5845409 - DNA, 19 bp, Homo sapiens
atagaatgatgttttaaaa

SEQ ID NO: 5845410 - DNA, 18 bp, Homo sapiens
atagaatggtatcaataa

SEQ ID NO: 5845411 - DNA, 19 bp, Homo sapiens
atagaatgtaaatgtctca

SEQ ID NO: 5845412 - DNA, 20 bp, Homo sapiens
atagaatgtaaatgtctcac

SEQ ID NO: 5845413 - DNA, 23 bp, Homo sapiens
atagaatgtggccacttatttca

SEQ ID NO: 5845414 - DNA, 17 bp, Homo sapiens
atagaattaacacatga

SEQ ID NO: 5845415 - DNA, 18 bp, Homo sapiens
atagaattctagcttttt

SEQ ID NO: 5845416 - DNA, 18 bp, Homo sapiens
atagaattgacattgaaa

SEQ ID NO: 5845417 - DNA, 14 bp, Homo sapiens
atagaatttccaat

SEQ ID NO: 5845418 - DNA, 16 bp, Homo sapiens
atagaatttggcccag

SEQ ID NO: 5845419 - DNA, 18 bp, Homo sapiens
atagaatttggcccagag

SEQ ID NO: 5845420 - DNA, 19 bp, Homo sapiens
atagaatttggcccagaga

SEQ ID NO: 5845421 - DNA, 20 bp, Homo sapiens
atagaatttggcccagagag

SEQ ID NO: 5845422 - DNA, 14 bp, Homo sapiens
atagacaaaagaat

SEQ ID NO: 5845423 - DNA, 16 bp, Homo sapiens
atagacaaatagaaaa

SEQ ID NO: 5845424 - DNA, 17 bp, Homo sapiens
atagacaaatagaaaat

SEQ ID NO: 5845425 - DNA, 16 bp, Homo sapiens
atagacaattcctcca

SEQ ID NO: 5845426 - DNA, 14 bp, Homo sapiens
atagacaattgagg

SEQ ID NO: 5845427 - DNA, 20 bp, Homo sapiens
atagacaatttgcacatctt

SEQ ID NO: 5845428 - DNA, 14 bp, Homo sapiens
atagacacacatac

SEQ ID NO: 5845429 - DNA, 11 bp, Homo sapiens
atagacacagt

SEQ ID NO: 5845430 - DNA, 19 bp, Homo sapiens
atagacacagtattgactt

SEQ ID NO: 5845431 - DNA, 12 bp, Homo sapiens
atagacactgga

SEQ ID NO: 5845432 - DNA, 13 bp, Homo sapiens
atagacactggac

SEQ ID NO: 5845433 - DNA, 14 bp, Homo sapiens
atagacactggaca

SEQ ID NO: 5845434 - DNA, 15 bp, Homo sapiens
atagacactggacat

SEQ ID NO: 5845435 - DNA, 21 bp, Homo sapiens
atagacacttgagttaacttt

SEQ ID NO: 5845436 - DNA, 23 bp, Homo sapiens
atagacagaggtttcattttcat

SEQ ID NO: 5845437 - DNA, 12 bp, Homo sapiens
atagacagatgt

SEQ ID NO: 5845438 - DNA, 17 bp, Homo sapiens
atagacagatgtggaca

SEQ ID NO: 5845439 - DNA, 13 bp, Homo sapiens
atagacaggtcct

SEQ ID NO: 5845440 - DNA, 20 bp, Homo sapiens
atagacagtaacggtgttta

SEQ ID NO: 5845441 - DNA, 21 bp, Homo sapiens
atagacagtaacggtgtttag

SEQ ID NO: 5845442 - DNA, 16 bp, Homo sapiens
atagacagtttgtaaa

SEQ ID NO: 5845443 - DNA, 15 bp, Homo sapiens
atagacataaattgt

SEQ ID NO: 5845444 - DNA, 17 bp, Homo sapiens
atagacataaattgtaa

SEQ ID NO: 5845445 - DNA, 14 bp, Homo sapiens
atagacatcagtat

SEQ ID NO: 5845446 - DNA, 18 bp, Homo sapiens
atagacattttggggttt

SEQ ID NO: 5845447 - DNA, 13 bp, Homo sapiens
atagaccaaagca

SEQ ID NO: 5845448 - DNA, 14 bp, Homo sapiens
atagaccaattgaa

SEQ ID NO: 5845449 - DNA, 15 bp, Homo sapiens
atagaccaattgaag

SEQ ID NO: 5845450 - DNA, 21 bp, Homo sapiens
atagacccatctggaggctcc

SEQ ID NO: 5845451 - DNA, 15 bp, Homo sapiens
atagaccctctcaag

SEQ ID NO: 5845452 - DNA, 16 bp, Homo sapiens
atagaccctctttctt

SEQ ID NO: 5845453 - DNA, 19 bp, Homo sapiens
atagaccctctttcttgtt

SEQ ID NO: 5845454 - DNA, 21 bp, Homo sapiens
atagaccctctttcttgtttg

SEQ ID NO: 5845455 - DNA, 23 bp, Homo sapiens
atagaccctctttcttgtttgtc

SEQ ID NO: 5845456 - DNA, 16 bp, Homo sapiens
atagacctacagacct

SEQ ID NO: 5845457 - DNA, 20 bp, Homo sapiens
atagacctacagacctggct

SEQ ID NO: 5845458 - DNA, 21 bp, Homo sapiens
atagacctacagacctggctc

SEQ ID NO: 5845459 - DNA, 22 bp, Homo sapiens
atagaccttttttttttttcca

SEQ ID NO: 5845460 - DNA, 16 bp, Homo sapiens
atagacgggttgaaag

SEQ ID NO: 5845461 - DNA, 20 bp, Homo sapiens
atagacgggttgaaagacat

SEQ ID NO: 5845462 - DNA, 19 bp, Homo sapiens
atagactgaggtataaaga

SEQ ID NO: 5845463 - DNA, 21 bp, Homo sapiens
atagactgtacattatgaaga

SEQ ID NO: 5845464 - DNA, 19 bp, Homo sapiens
atagacttactaataaaat

SEQ ID NO: 5845465 - DNA, 21 bp, Homo sapiens
atagacttactaataaaatgt

SEQ ID NO: 5845466 - DNA, 15 bp, Homo sapiens
atagacttattcttt

SEQ ID NO: 5845467 - DNA, 13 bp, Homo sapiens
atagacttcgaaa

SEQ ID NO: 5845468 - DNA, 21 bp, Homo sapiens
atagacttctcttacattttc

SEQ ID NO: 5845469 - DNA, 22 bp, Homo sapiens
atagacttggagaatactgcca

SEQ ID NO: 5845470 - DNA, 13 bp, Homo sapiens
atagacttgggat

SEQ ID NO: 5845471 - DNA, 18 bp, Homo sapiens
atagactttatgcaataa

SEQ ID NO: 5845472 - DNA, 20 bp, Homo sapiens
atagactttatgcaataaat

SEQ ID NO: 5845473 - DNA, 16 bp, Homo sapiens
atagactttgcctttt

SEQ ID NO: 5845474 - DNA, 14 bp, Homo sapiens
atagactttgtgaa

SEQ ID NO: 5845475 - DNA, 10 bp, Homo sapiens
atagagaaaa

SEQ ID NO: 5845476 - DNA, 14 bp, Homo sapiens
atagagaaaaactt

SEQ ID NO: 5845477 - DNA, 19 bp, Homo sapiens
atagagaaaaactttcatt

SEQ ID NO: 5845478 - DNA, 23 bp, Homo sapiens
atagagaactgtcaccctgaggt

SEQ ID NO: 5845479 - DNA, 14 bp, Homo sapiens
atagagaataaggc

SEQ ID NO: 5845480 - DNA, 15 bp, Homo sapiens
atagagaatacacat

SEQ ID NO: 5845481 - DNA, 12 bp, Homo sapiens
atagagaatgtt

SEQ ID NO: 5845482 - DNA, 17 bp, Homo sapiens
atagagacttctaaatc

SEQ ID NO: 5845483 - DNA, 17 bp, Homo sapiens
atagagagttgttgtgt

SEQ ID NO: 5845484 - DNA, 20 bp, Homo sapiens
atagagatatttttgtacgt

SEQ ID NO: 5845485 - DNA, 14 bp, Homo sapiens
atagagatcatcct

SEQ ID NO: 5845486 - DNA, 15 bp, Homo sapiens
atagagatgagccca

SEQ ID NO: 5845487 - DNA, 17 bp, Homo sapiens
atagagatgagctttct

SEQ ID NO: 5845488 - DNA, 14 bp, Homo sapiens
atagagattgtaca

SEQ ID NO: 5845489 - DNA, 15 bp, Homo sapiens
atagagattgtacat

SEQ ID NO: 5845490 - DNA, 17 bp, Homo sapiens
atagagattgtacattt

SEQ ID NO: 5845491 - DNA, 22 bp, Homo sapiens
atagagatttgtctaattgcat

SEQ ID NO: 5845492 - DNA, 13 bp, Homo sapiens
atagagcaaaatc

SEQ ID NO: 5845493 - DNA, 17 bp, Homo sapiens
atagagcaaaattgatg

SEQ ID NO: 5845494 - DNA, 22 bp, Homo sapiens
atagagcaaaattgatgtgttt

SEQ ID NO: 5845495 - DNA, 14 bp, Homo sapiens
atagagcagaaatt

SEQ ID NO: 5845496 - DNA, 15 bp, Homo sapiens
atagagcagaaattc

SEQ ID NO: 5845497 - DNA, 21 bp, Homo sapiens
atagagccaactgattttgta

SEQ ID NO: 5845498 - DNA, 15 bp, Homo sapiens
atagagcccctcctg

SEQ ID NO: 5845499 - DNA, 13 bp, Homo sapiens
atagagccctggc

SEQ ID NO: 5845500 - DNA, 14 bp, Homo sapiens
atagagccctggcc

SEQ ID NO: 5845501 - DNA, 19 bp, Homo sapiens
atagagccctggccagccc

SEQ ID NO: 5845502 - DNA, 19 bp, Homo sapiens
atagagccgggtgtcccca

SEQ ID NO: 5845503 - DNA, 20 bp, Homo sapiens
atagagccgggtgtccccaa

SEQ ID NO: 5845504 - DNA, 11 bp, Homo sapiens
atagagcctcg

SEQ ID NO: 5845505 - DNA, 23 bp, Homo sapiens
atagagctcttgggtatgtagaa

SEQ ID NO: 5845506 - DNA, 12 bp, Homo sapiens
atagagctttta

SEQ ID NO: 5845507 - DNA, 12 bp, Homo sapiens
atagaggaagaa

SEQ ID NO: 5845508 - DNA, 21 bp, Homo sapiens
atagaggaagcctgattaaag

SEQ ID NO: 5845509 - DNA, 23 bp, Homo sapiens
atagaggatagggagaatattta

SEQ ID NO: 5845510 - DNA, 12 bp, Homo sapiens
atagaggcccag

SEQ ID NO: 5845511 - DNA, 15 bp, Homo sapiens
atagaggcccaggca

SEQ ID NO: 5845512 - DNA, 16 bp, Homo sapiens
atagaggcccaggcac

SEQ ID NO: 5845513 - DNA, 19 bp, Homo sapiens
atagaggctagcttctgct

SEQ ID NO: 5845514 - DNA, 18 bp, Homo sapiens
atagaggcttctccgcca

SEQ ID NO: 5845515 - DNA, 23 bp, Homo sapiens
atagaggcttctccgccagcctc

SEQ ID NO: 5845516 - DNA, 22 bp, Homo sapiens
atagaggctttgagcaactaac

SEQ ID NO: 5845517 - DNA, 19 bp, Homo sapiens
atagagggagaggaagcac

SEQ ID NO: 5845518 - DNA, 15 bp, Homo sapiens
atagaggttttgtat

SEQ ID NO: 5845519 - DNA, 23 bp, Homo sapiens
atagagtaaaaagaaaacaaaac

SEQ ID NO: 5845520 - DNA, 17 bp, Homo sapiens
atagagtaatgatgtaa

SEQ ID NO: 5845521 - DNA, 14 bp, Homo sapiens
atagagtacactgc

SEQ ID NO: 5845522 - DNA, 21 bp, Homo sapiens
atagagtacttaatatactca

SEQ ID NO: 5845523 - DNA, 14 bp, Homo sapiens
atagagtatatgca

SEQ ID NO: 5845524 - DNA, 15 bp, Homo sapiens
atagagtatatgcac

SEQ ID NO: 5845525 - DNA, 14 bp, Homo sapiens
atagagtctggaat

SEQ ID NO: 5845526 - DNA, 12 bp, Homo sapiens
atagagtgaatt

SEQ ID NO: 5845527 - DNA, 22 bp, Homo sapiens
atagagtgactccaagaacaat

SEQ ID NO: 5845528 - DNA, 15 bp, Homo sapiens
atagagtgcataaat

SEQ ID NO: 5845529 - DNA, 17 bp, Homo sapiens
atagagtgcataaataa

SEQ ID NO: 5845530 - DNA, 16 bp, Homo sapiens
atagagtgtagtttac

SEQ ID NO: 5845531 - DNA, 22 bp, Homo sapiens
atagagtgtgatgtatgtgtaa

SEQ ID NO: 5845532 - DNA, 14 bp, Homo sapiens
atagagttcataga

SEQ ID NO: 5845533 - DNA, 19 bp, Homo sapiens
atagagttcatagaaatac

SEQ ID NO: 5845534 - DNA, 13 bp, Homo sapiens
atagagttcatcc

SEQ ID NO: 5845535 - DNA, 16 bp, Homo sapiens
atagagttgattgtct

SEQ ID NO: 5845536 - DNA, 22 bp, Homo sapiens
atagagttggagttttattttt

SEQ ID NO: 5845537 - DNA, 19 bp, Homo sapiens
atagagtttggtgtcaact

SEQ ID NO: 5845538 - DNA, 20 bp, Homo sapiens
atagataaaacatctttgaa

SEQ ID NO: 5845539 - DNA, 15 bp, Homo sapiens
atagataaattttga

SEQ ID NO: 5845540 - DNA, 15 bp, Homo sapiens
atagataactctttg

SEQ ID NO: 5845541 - DNA, 16 bp, Homo sapiens
atagataatattgttt

SEQ ID NO: 5845542 - DNA, 16 bp, Homo sapiens
atagatacaaaacctt

SEQ ID NO: 5845543 - DNA, 18 bp, Homo sapiens
atagataccattttgaaa

SEQ ID NO: 5845544 - DNA, 15 bp, Homo sapiens
atagatacttttgat

SEQ ID NO: 5845545 - DNA, 18 bp, Homo sapiens
atagataggcccctgggg

SEQ ID NO: 5845546 - DNA, 20 bp, Homo sapiens
atagataggcccctggggct

SEQ ID NO: 5845547 - DNA, 18 bp, Homo sapiens
atagatagtaaaaagctt

SEQ ID NO: 5845548 - DNA, 19 bp, Homo sapiens
atagatataaagccatttg

SEQ ID NO: 5845549 - DNA, 18 bp, Homo sapiens
atagatataaatttttaa

SEQ ID NO: 5845550 - DNA, 22 bp, Homo sapiens
ataggactcaaagtttcagaga

SEQ ID NO: 5845551 - DNA, 14 bp, Homo sapiens
ataggactgtggca

SEQ ID NO: 5845552 - DNA, 20 bp, Homo sapiens
ataggactgtggcaaacaaa

SEQ ID NO: 5845553 - DNA, 17 bp, Homo sapiens
ataggactttcttctaa

SEQ ID NO: 5845554 - DNA, 18 bp, Homo sapiens
ataggactttcttctaaa

SEQ ID NO: 5845555 - DNA, 15 bp, Homo sapiens
ataggagaagaggca

SEQ ID NO: 5845556 - DNA, 12 bp, Homo sapiens
ataggagactgc

SEQ ID NO: 5845557 - DNA, 15 bp, Homo sapiens
ataggagacttgtag

SEQ ID NO: 5845558 - DNA, 23 bp, Homo sapiens
ataggagagattgggagaaatca

SEQ ID NO: 5845559 - DNA, 15 bp, Homo sapiens
ataggagaggagggt

SEQ ID NO: 5845560 - DNA, 20 bp, Homo sapiens
ataggagaggatgagagccc

SEQ ID NO: 5845561 - DNA, 17 bp, Homo sapiens
ataggagccccaggcag

SEQ ID NO: 5845562 - DNA, 18 bp, Homo sapiens
ataggagccccaggcagg

SEQ ID NO: 5845563 - DNA, 21 bp, Homo sapiens
ataggagccgactctttgata

SEQ ID NO: 5845564 - DNA, 21 bp, Homo sapiens
ataggagggggcggcagggct

SEQ ID NO: 5845565 - DNA, 14 bp, Homo sapiens
ataggagggtgccc

SEQ ID NO: 5845566 - DNA, 18 bp, Homo sapiens
ataggagggtgcccctgg

SEQ ID NO: 5845567 - DNA, 20 bp, Homo sapiens
ataggagtatgtgctgtgaa

SEQ ID NO: 5845568 - DNA, 15 bp, Homo sapiens
ataggagttctctga

SEQ ID NO: 5845569 - DNA, 17 bp, Homo sapiens
ataggagttctctgatg

SEQ ID NO: 5845570 - DNA, 22 bp, Homo sapiens
ataggagttctctgatgcagaa

SEQ ID NO: 5845571 - DNA, 22 bp, Homo sapiens
ataggataatatacttccaatg

SEQ ID NO: 5845572 - DNA, 15 bp, Homo sapiens
ataggatagacactg

SEQ ID NO: 5845573 - DNA, 19 bp, Homo sapiens
ataggatataaaacacatc

SEQ ID NO: 5845574 - DNA, 23 bp, Homo sapiens
ataggatattgctaattgtgtat

SEQ ID NO: 5845575 - DNA, 23 bp, Homo sapiens
ataggatcatttgttggaatgaa

SEQ ID NO: 5845576 - DNA, 22 bp, Homo sapiens
ataggatgtactgttgaaaaag

SEQ ID NO: 5845577 - DNA, 19 bp, Homo sapiens
ataggatgtcagacaatac

SEQ ID NO: 5845578 - DNA, 19 bp, Homo sapiens
ataggattaaacacacaca

SEQ ID NO: 5845579 - DNA, 22 bp, Homo sapiens
ataggattgcttcaattaaaat

SEQ ID NO: 5845580 - DNA, 16 bp, Homo sapiens
ataggatttcttaaat

SEQ ID NO: 5845581 - DNA, 22 bp, Homo sapiens
ataggattttcacacattcacg

SEQ ID NO: 5845582 - DNA, 16 bp, Homo sapiens
ataggatttttagaat

SEQ ID NO: 5845583 - DNA, 22 bp, Homo sapiens
ataggcacctaccaccacgccc

SEQ ID NO: 5845584 - DNA, 20 bp, Homo sapiens
ataggcaccttttactgtga

SEQ ID NO: 5845585 - DNA, 14 bp, Homo sapiens
ataggcagaatgga

SEQ ID NO: 5845586 - DNA, 17 bp, Homo sapiens
ataggcagactgggttt

SEQ ID NO: 5845587 - DNA, 20 bp, Homo sapiens
ataggcagactgggtttcta

SEQ ID NO: 5845588 - DNA, 15 bp, Homo sapiens
ataggcagatcttta

SEQ ID NO: 5845589 - DNA, 23 bp, Homo sapiens
ataggcagatctttaaatacagt

SEQ ID NO: 5845590 - DNA, 20 bp, Homo sapiens
ataggcagcactgaaatatc

SEQ ID NO: 5845591 - DNA, 20 bp, Homo sapiens
ataggcagggggccctgccc

SEQ ID NO: 5845592 - DNA, 16 bp, Homo sapiens
ataggccaaggcccaa

SEQ ID NO: 5845593 - DNA, 21 bp, Homo sapiens
ataggccagggcatgtgtatg

SEQ ID NO: 5845594 - DNA, 13 bp, Homo sapiens
ataggccatctgt

SEQ ID NO: 5845595 - DNA, 17 bp, Homo sapiens
ataggccatctgtaaat

SEQ ID NO: 5845596 - DNA, 20 bp, Homo sapiens
ataggcccaaggtcccctcc

SEQ ID NO: 5845597 - DNA, 21 bp, Homo sapiens
ataggcccaaggtcccctcca

SEQ ID NO: 5845598 - DNA, 23 bp, Homo sapiens
ataggcccaaggtcccctccaca

SEQ ID NO: 5845599 - DNA, 15 bp, Homo sapiens
ataggcccacacaca

SEQ ID NO: 5845600 - DNA, 15 bp, Homo sapiens
ataggcccagccagg

SEQ ID NO: 5845601 - DNA, 18 bp, Homo sapiens
ataggccgagctgtggac

SEQ ID NO: 5845602 - DNA, 23 bp, Homo sapiens
ataggcctgtcccttgcctctgc

SEQ ID NO: 5845603 - DNA, 21 bp, Homo sapiens
ataggcgatcacaacgtgcat

SEQ ID NO: 5845604 - DNA, 16 bp, Homo sapiens
ataggcggtcatgtgt

SEQ ID NO: 5845605 - DNA, 19 bp, Homo sapiens
ataggcggtcatgtgtgca

SEQ ID NO: 5845606 - DNA, 15 bp, Homo sapiens
ataggctaaatgttg

SEQ ID NO: 5845607 - DNA, 17 bp, Homo sapiens
ataggctagacttagat

SEQ ID NO: 5845608 - DNA, 18 bp, Homo sapiens
ataggctattaaaaaagt

SEQ ID NO: 5845609 - DNA, 18 bp, Homo sapiens
ataggctattttctaaag

SEQ ID NO: 5845610 - DNA, 11 bp, Homo sapiens
ataggctcctt

SEQ ID NO: 5845611 - DNA, 11 bp, Homo sapiens
ataggctctgc

SEQ ID NO: 5845612 - DNA, 12 bp, Homo sapiens
ataggctctgca

SEQ ID NO: 5845613 - DNA, 14 bp, Homo sapiens
ataggctctgcaca

SEQ ID NO: 5845614 - DNA, 16 bp, Homo sapiens
ataggctggagaagct

SEQ ID NO: 5845615 - DNA, 12 bp, Homo sapiens
ataggctgggga

SEQ ID NO: 5845616 - DNA, 17 bp, Homo sapiens
ataggctggtggccttg

SEQ ID NO: 5845617 - DNA, 18 bp, Homo sapiens
ataggcttctattaccta

SEQ ID NO: 5845618 - DNA, 22 bp, Homo sapiens
ataggcttctattacctattag

SEQ ID NO: 5845619 - DNA, 18 bp, Homo sapiens
ataggctttagaagagat

SEQ ID NO: 5845620 - DNA, 19 bp, Homo sapiens
atagggaaaggttttgtat

SEQ ID NO: 5845621 - DNA, 15 bp, Homo sapiens
atagggaattttcat

SEQ ID NO: 5845622 - DNA, 18 bp, Homo sapiens
atagggaattttcatttt

SEQ ID NO: 5845623 - DNA, 20 bp, Homo sapiens
atagggagaatatttactaa

SEQ ID NO: 5845624 - DNA, 15 bp, Homo sapiens
atagggatggcagtg

SEQ ID NO: 5845625 - DNA, 22 bp, Homo sapiens
atagggcccatgggagggagct

SEQ ID NO: 5845626 - DNA, 19 bp, Homo sapiens
atagggcccttagctctcc

SEQ ID NO: 5845627 - DNA, 22 bp, Homo sapiens
atagggcctggtccctgggagg

SEQ ID NO: 5845628 - DNA, 14 bp, Homo sapiens
atagggctgagctc

SEQ ID NO: 5845629 - DNA, 17 bp, Homo sapiens
atagggcttttaaataa

SEQ ID NO: 5845630 - DNA, 16 bp, Homo sapiens
ataggggaaagaaatt

SEQ ID NO: 5845631 - DNA, 18 bp, Homo sapiens
ataggggcaaaaatttga

SEQ ID NO: 5845632 - DNA, 16 bp, Homo sapiens
ataggggctttgctga

SEQ ID NO: 5845633 - DNA, 13 bp, Homo sapiens
ataggggtcctgg

SEQ ID NO: 5845634 - DNA, 20 bp, Homo sapiens
atagggtctaccaatacaaa

SEQ ID NO: 5845635 - DNA, 16 bp, Homo sapiens
atagggtctcttcagg

SEQ ID NO: 5845636 - DNA, 21 bp, Homo sapiens
atagggtctcttcaggttctt

SEQ ID NO: 5845637 - DNA, 15 bp, Homo sapiens
atagggtttggaaga

SEQ ID NO: 5845638 - DNA, 20 bp, Homo sapiens
atagggtttgtgacagggcg

SEQ ID NO: 5845639 - DNA, 17 bp, Homo sapiens
atagggttttttttaat

SEQ ID NO: 5845640 - DNA, 22 bp, Homo sapiens
atagggttttttttaatgtgaa

SEQ ID NO: 5845641 - DNA, 15 bp, Homo sapiens
ataggtaaattttta

SEQ ID NO: 5845642 - DNA, 15 bp, Homo sapiens
ataggtaacgtgatt

SEQ ID NO: 5845643 - DNA, 20 bp, Homo sapiens
ataggtaacgtgattgattc

SEQ ID NO: 5845644 - DNA, 16 bp, Homo sapiens
ataggtaatcaatgaa

SEQ ID NO: 5845645 - DNA, 13 bp, Homo sapiens
ataggtagaaaca

SEQ ID NO: 5845646 - DNA, 23 bp, Homo sapiens
ataggtagaatgtaaagcttgtc

SEQ ID NO: 5845647 - DNA, 22 bp, Homo sapiens
ataggtagcttgtccaaggtct

SEQ ID NO: 5845648 - DNA, 20 bp, Homo sapiens
ataggtaggagacctcttct

SEQ ID NO: 5845649 - DNA, 13 bp, Homo sapiens
ataggtatgctta

SEQ ID NO: 5845650 - DNA, 17 bp, Homo sapiens
ataggtatgcttactat

SEQ ID NO: 5845651 - DNA, 22 bp, Homo sapiens
ataggtcacatatgtctgtatc

SEQ ID NO: 5845652 - DNA, 15 bp, Homo sapiens
ataggtcactcctgg

SEQ ID NO: 5845653 - DNA, 17 bp, Homo sapiens
ataggtcactggctctc

SEQ ID NO: 5845654 - DNA, 19 bp, Homo sapiens
ataggtcactggctctcca

SEQ ID NO: 5845655 - DNA, 21 bp, Homo sapiens
ataggtcactggctctccaag

SEQ ID NO: 5845656 - DNA, 22 bp, Homo sapiens
ataggtcactggctctccaagt

SEQ ID NO: 5845657 - DNA, 14 bp, Homo sapiens
ataggtcagagatg

SEQ ID NO: 5845658 - DNA, 23 bp, Homo sapiens
ataggtcagtgaggcccagggag

SEQ ID NO: 5845659 - DNA, 19 bp, Homo sapiens
ataggtctcatctcttcag

SEQ ID NO: 5845660 - DNA, 14 bp, Homo sapiens
ataggtctgaaatt

SEQ ID NO: 5845661 - DNA, 17 bp, Homo sapiens
ataggtctgtatggctg

SEQ ID NO: 5845662 - DNA, 16 bp, Homo sapiens
ataggtctttctctca

SEQ ID NO: 5845663 - DNA, 17 bp, Homo sapiens
ataggtctttctctcag

SEQ ID NO: 5845664 - DNA, 18 bp, Homo sapiens
ataggtgagaaaaaaaca

SEQ ID NO: 5845665 - DNA, 13 bp, Homo sapiens
ataggtgatgggc

SEQ ID NO: 5845666 - DNA, 16 bp, Homo sapiens
ataggtgatgggcaga

SEQ ID NO: 5845667 - DNA, 19 bp, Homo sapiens
ataggtgatgtttgctctt

SEQ ID NO: 5845668 - DNA, 17 bp, Homo sapiens
ataggtgcaaaaataaa

SEQ ID NO: 5845669 - DNA, 23 bp, Homo sapiens
ataggtgctacaaaaacacagca

SEQ ID NO: 5845670 - DNA, 22 bp, Homo sapiens
ataggtgcttattctcaaagca

SEQ ID NO: 5845671 - DNA, 22 bp, Homo sapiens
ataggtggaaagagaaatgatg

SEQ ID NO: 5845672 - DNA, 16 bp, Homo sapiens
ataggtgtaaatgaga

SEQ ID NO: 5845673 - DNA, 19 bp, Homo sapiens
ataggttaaactgaagcaa

SEQ ID NO: 5845674 - DNA, 17 bp, Homo sapiens
ataggttagatatagag

SEQ ID NO: 5845675 - DNA, 16 bp, Homo sapiens
ataggttagattctca

SEQ ID NO: 5845676 - DNA, 13 bp, Homo sapiens
ataggttctgctt

SEQ ID NO: 5845677 - DNA, 14 bp, Homo sapiens
ataggttctgcttt

SEQ ID NO: 5845678 - DNA, 22 bp, Homo sapiens
ataggttcttcttgttctgaga

SEQ ID NO: 5845679 - DNA, 13 bp, Homo sapiens
ataggttgagcaa

SEQ ID NO: 5845680 - DNA, 16 bp, Homo sapiens
ataggttgagcaattt

SEQ ID NO: 5845681 - DNA, 14 bp, Homo sapiens
ataggtttctctcc

SEQ ID NO: 5845682 - DNA, 18 bp, Homo sapiens
ataggtttctctccctcc

SEQ ID NO: 5845683 - DNA, 18 bp, Homo sapiens
ataggtttggacaaaatg

SEQ ID NO: 5845684 - DNA, 17 bp, Homo sapiens
ataggttttaaatctgc

SEQ ID NO: 5845685 - DNA, 22 bp, Homo sapiens
ataggtttttctcatgtatctt

SEQ ID NO: 5845686 - DNA, 17 bp, Homo sapiens
atagtaaaaagattctc

SEQ ID NO: 5845687 - DNA, 13 bp, Homo sapiens
atagtaaaaataa

SEQ ID NO: 5845688 - DNA, 12 bp, Homo sapiens
atagtaaagtat

SEQ ID NO: 5845689 - DNA, 13 bp, Homo sapiens
atagtaaatggta

SEQ ID NO: 5845690 - DNA, 18 bp, Homo sapiens
atagtaacatcaaagatt

SEQ ID NO: 5845691 - DNA, 16 bp, Homo sapiens
atagtaaccattttcc

SEQ ID NO: 5845692 - DNA, 20 bp, Homo sapiens
atagtaactgacatgattag

SEQ ID NO: 5845693 - DNA, 19 bp, Homo sapiens
atagtaacttcttatggaa

SEQ ID NO: 5845694 - DNA, 13 bp, Homo sapiens
atagtaagcatag

SEQ ID NO: 5845695 - DNA, 15 bp, Homo sapiens
atagtaagcctccct

SEQ ID NO: 5845696 - DNA, 18 bp, Homo sapiens
atagtaagcctccctcct

SEQ ID NO: 5845697 - DNA, 23 bp, Homo sapiens
atagtaagttactgggcattctc

SEQ ID NO: 5845698 - DNA, 17 bp, Homo sapiens
atagtaagttcagcact

SEQ ID NO: 5845699 - DNA, 12 bp, Homo sapiens
atagtaatcatt

SEQ ID NO: 5845700 - DNA, 14 bp, Homo sapiens
atagtaattctcag

SEQ ID NO: 5845701 - DNA, 13 bp, Homo sapiens
atagtaatttgta

SEQ ID NO: 5845702 - DNA, 19 bp, Homo sapiens
atagtaatttgtaaagttg

SEQ ID NO: 5845703 - DNA, 23 bp, Homo sapiens
atagtacatgtcaccttaggtag

SEQ ID NO: 5845704 - DNA, 17 bp, Homo sapiens
atagtaccaatcatttt

SEQ ID NO: 5845705 - DNA, 15 bp, Homo sapiens
atagtactaagcatt

SEQ ID NO: 5845706 - DNA, 17 bp, Homo sapiens
atagtactgctttactg

SEQ ID NO: 5845707 - DNA, 13 bp, Homo sapiens
atagtagaaaaat

SEQ ID NO: 5845708 - DNA, 14 bp, Homo sapiens
atagtagattgaca

SEQ ID NO: 5845709 - DNA, 16 bp, Homo sapiens
atagtagcatacattt

SEQ ID NO: 5845710 - DNA, 17 bp, Homo sapiens
atagtaggcatgttatg

SEQ ID NO: 5845711 - DNA, 20 bp, Homo sapiens
atagtaggctaaaaacattt

SEQ ID NO: 5845712 - DNA, 16 bp, Homo sapiens
atagtagggttggggt

SEQ ID NO: 5845713 - DNA, 13 bp, Homo sapiens
atagtagtatgat

SEQ ID NO: 5845714 - DNA, 14 bp, Homo sapiens
atagtagtcaatta

SEQ ID NO: 5845715 - DNA, 18 bp, Homo sapiens
atagtagtcaattagtac

SEQ ID NO: 5845716 - DNA, 23 bp, Homo sapiens
atagtagtctgtgtttaaagtga

SEQ ID NO: 5845717 - DNA, 16 bp, Homo sapiens
atagtataaaaaatgg

SEQ ID NO: 5845718 - DNA, 13 bp, Homo sapiens
atagtatacattg

SEQ ID NO: 5845719 - DNA, 17 bp, Homo sapiens
atagtatacattgtctt

SEQ ID NO: 5845720 - DNA, 15 bp, Homo sapiens
atagtatagaagtct

SEQ ID NO: 5845721 - DNA, 18 bp, Homo sapiens
atagtatagaatgaactg

SEQ ID NO: 5845722 - DNA, 19 bp, Homo sapiens
atagtatagacaataagga

SEQ ID NO: 5845723 - DNA, 12 bp, Homo sapiens
atagtatatcta

SEQ ID NO: 5845724 - DNA, 17 bp, Homo sapiens
atagtatatctggacaa

SEQ ID NO: 5845725 - DNA, 22 bp, Homo sapiens
atagtatatgattataatgcta

SEQ ID NO: 5845726 - DNA, 22 bp, Homo sapiens
atagtatatgattgtatttaaa

SEQ ID NO: 5845727 - DNA, 12 bp, Homo sapiens
atagttctagac

SEQ ID NO: 5845728 - DNA, 13 bp, Homo sapiens
atagttctagaca

SEQ ID NO: 5845729 - DNA, 21 bp, Homo sapiens
atagttctatcaggaaaacaa

SEQ ID NO: 5845730 - DNA, 15 bp, Homo sapiens
atagttctatttcta

SEQ ID NO: 5845731 - DNA, 19 bp, Homo sapiens
atagttctgagctgccagt

SEQ ID NO: 5845732 - DNA, 12 bp, Homo sapiens
atagttctgcaa

SEQ ID NO: 5845733 - DNA, 22 bp, Homo sapiens
atagttctgcaataacagtttt

SEQ ID NO: 5845734 - DNA, 17 bp, Homo sapiens
atagttctgtaataaaa

SEQ ID NO: 5845735 - DNA, 12 bp, Homo sapiens
atagttctgtat

SEQ ID NO: 5845736 - DNA, 22 bp, Homo sapiens
atagttctgtgtagagaatgtc

SEQ ID NO: 5845737 - DNA, 12 bp, Homo sapiens
atagttctgtta

SEQ ID NO: 5845738 - DNA, 14 bp, Homo sapiens
atagttctgttaaa

SEQ ID NO: 5845739 - DNA, 20 bp, Homo sapiens
atagttctgttaaatatttt

SEQ ID NO: 5845740 - DNA, 14 bp, Homo sapiens
atagttcttaaaat

SEQ ID NO: 5845741 - DNA, 17 bp, Homo sapiens
atagttgaaagtaaaaa

SEQ ID NO: 5845742 - DNA, 23 bp, Homo sapiens
atagttgagccagcagacattgt

SEQ ID NO: 5845743 - DNA, 14 bp, Homo sapiens
atagttgatatgta

SEQ ID NO: 5845744 - DNA, 18 bp, Homo sapiens
atagttgcatagcagtat

SEQ ID NO: 5845745 - DNA, 21 bp, Homo sapiens
atagttgccaatctaaaatgg

SEQ ID NO: 5845746 - DNA, 23 bp, Homo sapiens
atagttgccaatctaaaatggca

SEQ ID NO: 5845747 - DNA, 22 bp, Homo sapiens
atagttgctccaactgaattgc

SEQ ID NO: 5845748 - DNA, 12 bp, Homo sapiens
atagttgctttt

SEQ ID NO: 5845749 - DNA, 23 bp, Homo sapiens
atagttggaggtgattccagtga

SEQ ID NO: 5845750 - DNA, 16 bp, Homo sapiens
atagttggtcatctag

SEQ ID NO: 5845751 - DNA, 21 bp, Homo sapiens
atagttgtaaagatattgtat

SEQ ID NO: 5845752 - DNA, 19 bp, Homo sapiens
atagttgtagacaaagtac

SEQ ID NO: 5845753 - DNA, 19 bp, Homo sapiens
atagttgtattttgtacat

SEQ ID NO: 5845754 - DNA, 15 bp, Homo sapiens
atagttgtctgtgct

SEQ ID NO: 5845755 - DNA, 18 bp, Homo sapiens
atagttgtctttctttgc

SEQ ID NO: 5845756 - DNA, 18 bp, Homo sapiens
atagttgtgggtgggaga

SEQ ID NO: 5845757 - DNA, 15 bp, Homo sapiens
atagtttaaaaatat

SEQ ID NO: 5845758 - DNA, 20 bp, Homo sapiens
atagtttaaaaatctgccac

SEQ ID NO: 5845759 - DNA, 15 bp, Homo sapiens
atagtttacaatatt

SEQ ID NO: 5845760 - DNA, 23 bp, Homo sapiens
atagtttacttcactttcatctg

SEQ ID NO: 5845761 - DNA, 22 bp, Homo sapiens
atagtttattattattaaagtc

SEQ ID NO: 5845762 - DNA, 14 bp, Homo sapiens
atagtttatttctg

SEQ ID NO: 5845763 - DNA, 15 bp, Homo sapiens
atagtttatttctgt

SEQ ID NO: 5845764 - DNA, 15 bp, Homo sapiens
atagtttatttttgt

SEQ ID NO: 5845765 - DNA, 19 bp, Homo sapiens
atagtttcaaatctgtaat

SEQ ID NO: 5845766 - DNA, 18 bp, Homo sapiens
atagtttcaccactcctc

SEQ ID NO: 5845767 - DNA, 21 bp, Homo sapiens
atagtttcagatatatatcat

SEQ ID NO: 5845768 - DNA, 16 bp, Homo sapiens
atagtttccaagaaat

SEQ ID NO: 5845769 - DNA, 12 bp, Homo sapiens
atagtttcctga

SEQ ID NO: 5845770 - DNA, 12 bp, Homo sapiens
atagtttctgta

SEQ ID NO: 5845771 - DNA, 13 bp, Homo sapiens
atagtttctgtaa

SEQ ID NO: 5845772 - DNA, 16 bp, Homo sapiens
atagtttgaattcatg

SEQ ID NO: 5845773 - DNA, 18 bp, Homo sapiens
atagtttggatatgtaaa

SEQ ID NO: 5845774 - DNA, 17 bp, Homo sapiens
atagtttggcatttgca

SEQ ID NO: 5845775 - DNA, 18 bp, Homo sapiens
atagtttggcatttgcac

SEQ ID NO: 5845776 - DNA, 13 bp, Homo sapiens
atagtttgtctat

SEQ ID NO: 5845777 - DNA, 13 bp, Homo sapiens
atagtttgttttc

SEQ ID NO: 5845778 - DNA, 14 bp, Homo sapiens
atagtttgttttct

SEQ ID NO: 5845779 - DNA, 22 bp, Homo sapiens
atagtttgttttctttttctgt

SEQ ID NO: 5845780 - DNA, 20 bp, Homo sapiens
atagttttaaactcattttt

SEQ ID NO: 5845781 - DNA, 13 bp, Homo sapiens
atagttttaaata

SEQ ID NO: 5845782 - DNA, 16 bp, Homo sapiens
atagttttaaatatga

SEQ ID NO: 5845783 - DNA, 17 bp, Homo sapiens
atagttttaaatatgaa

SEQ ID NO: 5845784 - DNA, 17 bp, Homo sapiens
atagttttaattctgct

SEQ ID NO: 5845785 - DNA, 23 bp, Homo sapiens
atagttttacccataagtaatat

SEQ ID NO: 5845786 - DNA, 15 bp, Homo sapiens
atagttttagattat

SEQ ID NO: 5845787 - DNA, 14 bp, Homo sapiens
atagttttcatttt

SEQ ID NO: 5845788 - DNA, 13 bp, Homo sapiens
atagttttgatga

SEQ ID NO: 5845789 - DNA, 20 bp, Homo sapiens
atagttttgatgactggcat

SEQ ID NO: 5845790 - DNA, 18 bp, Homo sapiens
atagtttttaaggttatt

SEQ ID NO: 5845791 - DNA, 19 bp, Homo sapiens
atagtttttaaggttattt

SEQ ID NO: 5845792 - DNA, 20 bp, Homo sapiens
atagtttttaaggttattta

SEQ ID NO: 5845793 - DNA, 21 bp, Homo sapiens
atagtttttaccttttatgta

SEQ ID NO: 5845794 - DNA, 19 bp, Homo sapiens
atagttttttacttctctt

SEQ ID NO: 5845795 - DNA, 17 bp, Homo sapiens
atagttttttcttttta

SEQ ID NO: 5845796 - DNA, 18 bp, Homo sapiens
atataaaaaatatatgta

SEQ ID NO: 5845797 - DNA, 16 bp, Homo sapiens
atataaaaaatcatgc

SEQ ID NO: 5845798 - DNA, 16 bp, Homo sapiens
atataaaaacaacaaa

SEQ ID NO: 5845799 - DNA, 17 bp, Homo sapiens
atataaaaacaatatat

SEQ ID NO: 5845800 - DNA, 18 bp, Homo sapiens
atataaaaacaatatatt

SEQ ID NO: 5845801 - DNA, 16 bp, Homo sapiens
atataaaaacatcagt

SEQ ID NO: 5845802 - DNA, 13 bp, Homo sapiens
atataaaaacatt

SEQ ID NO: 5845803 - DNA, 12 bp, Homo sapiens
atataaaaagaa

SEQ ID NO: 5845804 - DNA, 17 bp, Homo sapiens
atataaaaagaaaagat

SEQ ID NO: 5845805 - DNA, 12 bp, Homo sapiens
atataaaaataa

SEQ ID NO: 5845806 - DNA, 13 bp, Homo sapiens
atataaaaataat

SEQ ID NO: 5845807 - DNA, 16 bp, Homo sapiens
atataaaaatatatgt

SEQ ID NO: 5845808 - DNA, 14 bp, Homo sapiens
atataaaaatgtga

SEQ ID NO: 5845809 - DNA, 13 bp, Homo sapiens
atataaaacacat

SEQ ID NO: 5845810 - DNA, 13 bp, Homo sapiens
atataaaactgaa

SEQ ID NO: 5845811 - DNA, 14 bp, Homo sapiens
atataaaactgaaa

SEQ ID NO: 5845812 - DNA, 17 bp, Homo sapiens
atataaaagaaatatat

SEQ ID NO: 5845813 - DNA, 18 bp, Homo sapiens
atataaaagaaatatatc

SEQ ID NO: 5845814 - DNA, 11 bp, Homo sapiens
atataaaagga

SEQ ID NO: 5845815 - DNA, 20 bp, Homo sapiens
atataaaaggcaaatgtgta

SEQ ID NO: 5845816 - DNA, 20 bp, Homo sapiens
atataaaagttaaactactt

SEQ ID NO: 5845817 - DNA, 13 bp, Homo sapiens
atataaaataaat

SEQ ID NO: 5845818 - DNA, 16 bp, Homo sapiens
atataaaataaatata

SEQ ID NO: 5845819 - DNA, 18 bp, Homo sapiens
atataaaataaatatact

SEQ ID NO: 5845820 - DNA, 19 bp, Homo sapiens
atataaaataaatatacta

SEQ ID NO: 5845821 - DNA, 21 bp, Homo sapiens
atataaaataaatatactaat

SEQ ID NO: 5845822 - DNA, 18 bp, Homo sapiens
atataaaataaatatata

SEQ ID NO: 5845823 - DNA, 13 bp, Homo sapiens
atataaaataatg

SEQ ID NO: 5845824 - DNA, 14 bp, Homo sapiens
atataaaatacacg

SEQ ID NO: 5845825 - DNA, 15 bp, Homo sapiens
atataaaatacacgt

SEQ ID NO: 5845826 - DNA, 13 bp, Homo sapiens
atataaaatacat

SEQ ID NO: 5845827 - DNA, 14 bp, Homo sapiens
atataaaatacata

SEQ ID NO: 5845828 - DNA, 16 bp, Homo sapiens
atataaaatacataaa

SEQ ID NO: 5845829 - DNA, 14 bp, Homo sapiens
atataaaatagttg

SEQ ID NO: 5845830 - DNA, 22 bp, Homo sapiens
atataaaatatatttatgataa

SEQ ID NO: 5845831 - DNA, 14 bp, Homo sapiens
atataaaatattca

SEQ ID NO: 5845832 - DNA, 14 bp, Homo sapiens
atataaaatatttt

SEQ ID NO: 5845833 - DNA, 12 bp, Homo sapiens
atataaaatgaa

SEQ ID NO: 5845834 - DNA, 17 bp, Homo sapiens
atataaaatgaaagatt

SEQ ID NO: 5845835 - DNA, 17 bp, Homo sapiens
atataaaatgtattcaa

SEQ ID NO: 5845836 - DNA, 13 bp, Homo sapiens
atataaaatgtgc

SEQ ID NO: 5845837 - DNA, 12 bp, Homo sapiens
atataaaatttc

SEQ ID NO: 5845838 - DNA, 20 bp, Homo sapiens
atataaaatttcagggaaaa

SEQ ID NO: 5845839 - DNA, 14 bp, Homo sapiens
atataaacaaacaa

SEQ ID NO: 5845840 - DNA, 13 bp, Homo sapiens
atataaacacata

SEQ ID NO: 5845841 - DNA, 22 bp, Homo sapiens
atataaacactccacagtgttt

SEQ ID NO: 5845842 - DNA, 13 bp, Homo sapiens
atataaacagctt

SEQ ID NO: 5845843 - DNA, 14 bp, Homo sapiens
atataaacatattt

SEQ ID NO: 5845844 - DNA, 21 bp, Homo sapiens
atataaacattttatttatag

SEQ ID NO: 5845845 - DNA, 15 bp, Homo sapiens
atataaagaaaatca

SEQ ID NO: 5845846 - DNA, 18 bp, Homo sapiens
atataaagaatatatata

SEQ ID NO: 5845847 - DNA, 13 bp, Homo sapiens
atataaagagaaa

SEQ ID NO: 5845848 - DNA, 14 bp, Homo sapiens
atataaagatgtta

SEQ ID NO: 5845849 - DNA, 22 bp, Homo sapiens
atataaaggaccctgtttctgt

SEQ ID NO: 5845850 - DNA, 17 bp, Homo sapiens
atataaaggcaaggaaa

SEQ ID NO: 5845851 - DNA, 18 bp, Homo sapiens
atataaaggcaaggaaat

SEQ ID NO: 5845852 - DNA, 20 bp, Homo sapiens
atataaagggggagggaaat

SEQ ID NO: 5845853 - DNA, 18 bp, Homo sapiens
atataaagtactactgta

SEQ ID NO: 5845854 - DNA, 13 bp, Homo sapiens
atataaagtatag

SEQ ID NO: 5845855 - DNA, 17 bp, Homo sapiens
atataaagtatatgttc

SEQ ID NO: 5845856 - DNA, 17 bp, Homo sapiens
atataaagtattctttt

SEQ ID NO: 5845857 - DNA, 14 bp, Homo sapiens
atataaagtatttt

SEQ ID NO: 5845858 - DNA, 12 bp, Homo sapiens
atataaagtttt

SEQ ID NO: 5845859 - DNA, 13 bp, Homo sapiens
atataaagttttg

SEQ ID NO: 5845860 - DNA, 23 bp, Homo sapiens
atataaagtttttttatttcttt

SEQ ID NO: 5845861 - DNA, 15 bp, Homo sapiens
atataaataaaacat

SEQ ID NO: 5845862 - DNA, 18 bp, Homo sapiens
atataaataaaacatttt

SEQ ID NO: 5845863 - DNA, 19 bp, Homo sapiens
atataaatagaatgtaaat

SEQ ID NO: 5845864 - DNA, 21 bp, Homo sapiens
atataaatagaatgtaaatgt

SEQ ID NO: 5845865 - DNA, 22 bp, Homo sapiens
atataaatagaatgtaaatgtc

SEQ ID NO: 5845866 - DNA, 16 bp, Homo sapiens
atataaatagctaatg

SEQ ID NO: 5845867 - DNA, 21 bp, Homo sapiens
atataaatagctgaaaactaa

SEQ ID NO: 5845868 - DNA, 13 bp, Homo sapiens
atataaatataaa

SEQ ID NO: 5845869 - DNA, 13 bp, Homo sapiens
atataaatatata

SEQ ID NO: 5845870 - DNA, 20 bp, Homo sapiens
atataaatatatataaatat

SEQ ID NO: 5845871 - DNA, 15 bp, Homo sapiens
atataaatatatatt

SEQ ID NO: 5845872 - DNA, 22 bp, Homo sapiens
atataaatatatatttttcaaa

SEQ ID NO: 5845873 - DNA, 23 bp, Homo sapiens
atataaatatattttctttctag

SEQ ID NO: 5845874 - DNA, 14 bp, Homo sapiens
atataaatgcaaat

SEQ ID NO: 5845875 - DNA, 15 bp, Homo sapiens
atataaatgcaaata

SEQ ID NO: 5845876 - DNA, 23 bp, Homo sapiens
atataaatgcaaataacaaatgc

SEQ ID NO: 5845877 - DNA, 12 bp, Homo sapiens
atataaatgcat

SEQ ID NO: 5845878 - DNA, 13 bp, Homo sapiens
atataaatgcatg

SEQ ID NO: 5845879 - DNA, 17 bp, Homo sapiens
atataaatgcatgattt

SEQ ID NO: 5845880 - DNA, 17 bp, Homo sapiens
atataaatggaatcaca

SEQ ID NO: 5845881 - DNA, 15 bp, Homo sapiens
atataaatggctggt

SEQ ID NO: 5845882 - DNA, 18 bp, Homo sapiens
atataaatggctggtttt

SEQ ID NO: 5845883 - DNA, 18 bp, Homo sapiens
atataaatgggaacattt

SEQ ID NO: 5845884 - DNA, 19 bp, Homo sapiens
atataaatgggaacattta

SEQ ID NO: 5845885 - DNA, 17 bp, Homo sapiens
atataaatggttaaaag

SEQ ID NO: 5845886 - DNA, 11 bp, Homo sapiens
atataaatgtg

SEQ ID NO: 5845887 - DNA, 14 bp, Homo sapiens
atataaatgtttat

SEQ ID NO: 5845888 - DNA, 16 bp, Homo sapiens
atataaattaagactt

SEQ ID NO: 5845889 - DNA, 12 bp, Homo sapiens
atataaattaat

SEQ ID NO: 5845890 - DNA, 16 bp, Homo sapiens
atataaattaatacat

SEQ ID NO: 5845891 - DNA, 15 bp, Homo sapiens
atataaattatctga

SEQ ID NO: 5845892 - DNA, 16 bp, Homo sapiens
atataaattatctgaa

SEQ ID NO: 5845893 - DNA, 19 bp, Homo sapiens
atataaattatctgaatat

SEQ ID NO: 5845894 - DNA, 15 bp, Homo sapiens
atataaattattact

SEQ ID NO: 5845895 - DNA, 22 bp, Homo sapiens
atataaattcactttcattttt

SEQ ID NO: 5845896 - DNA, 13 bp, Homo sapiens
atataaattctgt

SEQ ID NO: 5845897 - DNA, 14 bp, Homo sapiens
atataaattctgtg

SEQ ID NO: 5845898 - DNA, 15 bp, Homo sapiens
atataaattctgtgg

SEQ ID NO: 5845899 - DNA, 20 bp, Homo sapiens
atataaattgggataaacat

SEQ ID NO: 5845900 - DNA, 13 bp, Homo sapiens
atataaattgtac

SEQ ID NO: 5845901 - DNA, 19 bp, Homo sapiens
atataaattgtacattttg

SEQ ID NO: 5845902 - DNA, 16 bp, Homo sapiens
atataaattgtcttaa

SEQ ID NO: 5845903 - DNA, 17 bp, Homo sapiens
atataaattttttttgt

SEQ ID NO: 5845904 - DNA, 22 bp, Homo sapiens
atataaattttttttgtttcat

SEQ ID NO: 5845905 - DNA, 13 bp, Homo sapiens
atataacaaaaaa

SEQ ID NO: 5845906 - DNA, 17 bp, Homo sapiens
atataacaatgctgtat

SEQ ID NO: 5845907 - DNA, 18 bp, Homo sapiens
atataacatgaaagtcaa

SEQ ID NO: 5845908 - DNA, 14 bp, Homo sapiens
atatatacattgct

SEQ ID NO: 5845909 - DNA, 17 bp, Homo sapiens
atatataccaagcccct

SEQ ID NO: 5845910 - DNA, 18 bp, Homo sapiens
atatatacttaagaatat

SEQ ID NO: 5845911 - DNA, 18 bp, Homo sapiens
atatatagaaatatatac

SEQ ID NO: 5845912 - DNA, 19 bp, Homo sapiens
atatatagacagctttgac

SEQ ID NO: 5845913 - DNA, 16 bp, Homo sapiens
atatatagcatttatg

SEQ ID NO: 5845914 - DNA, 22 bp, Homo sapiens
atatatagtatttaattgtttc

SEQ ID NO: 5845915 - DNA, 16 bp, Homo sapiens
atatatagtgctatat

SEQ ID NO: 5845916 - DNA, 22 bp, Homo sapiens
atatatagttagctttattgaa

SEQ ID NO: 5845917 - DNA, 12 bp, Homo sapiens
atatatataaaa

SEQ ID NO: 5845918 - DNA, 12 bp, Homo sapiens
atatatataaac

SEQ ID NO: 5845919 - DNA, 14 bp, Homo sapiens
atatatataaacct

SEQ ID NO: 5845920 - DNA, 16 bp, Homo sapiens
atatatataacatata

SEQ ID NO: 5845921 - DNA, 15 bp, Homo sapiens
atatatatacacaca

SEQ ID NO: 5845922 - DNA, 16 bp, Homo sapiens
atatatatacatatgt

SEQ ID NO: 5845923 - DNA, 15 bp, Homo sapiens
atatatatagtaact

SEQ ID NO: 5845924 - DNA, 14 bp, Homo sapiens
atatatatataaag

SEQ ID NO: 5845925 - DNA, 15 bp, Homo sapiens
atatatatatacaca

SEQ ID NO: 5845926 - DNA, 15 bp, Homo sapiens
atatatatatatatt

SEQ ID NO: 5845927 - DNA, 13 bp, Homo sapiens
atatatatatatc

SEQ ID NO: 5845928 - DNA, 15 bp, Homo sapiens
atatatatatatgta

SEQ ID NO: 5845929 - DNA, 16 bp, Homo sapiens
atatatatatctgtat

SEQ ID NO: 5845930 - DNA, 16 bp, Homo sapiens
atatatatatgtatat

SEQ ID NO: 5845931 - DNA, 14 bp, Homo sapiens
atatatatcagttt

SEQ ID NO: 5845932 - DNA, 14 bp, Homo sapiens
atatatatctatat

SEQ ID NO: 5845933 - DNA, 12 bp, Homo sapiens
atatatatctga

SEQ ID NO: 5845934 - DNA, 22 bp, Homo sapiens
atatatatctgataaaattgtg

SEQ ID NO: 5845935 - DNA, 21 bp, Homo sapiens
atatatatggaataagtgtac

SEQ ID NO: 5845936 - DNA, 15 bp, Homo sapiens
atatatatgtacagt

SEQ ID NO: 5845937 - DNA, 23 bp, Homo sapiens
atatatatgtagccagacagttt

SEQ ID NO: 5845938 - DNA, 17 bp, Homo sapiens
atatatatgtgcagtat

SEQ ID NO: 5845939 - DNA, 12 bp, Homo sapiens
atatatatgtgt

SEQ ID NO: 5845940 - DNA, 19 bp, Homo sapiens
atatatattataaatatat

SEQ ID NO: 5845941 - DNA, 19 bp, Homo sapiens
atatatattatatatatct

SEQ ID NO: 5845942 - DNA, 16 bp, Homo sapiens
atatatattatctttt

SEQ ID NO: 5845943 - DNA, 17 bp, Homo sapiens
atatatattattctcat

SEQ ID NO: 5845944 - DNA, 18 bp, Homo sapiens
atatatattcatatacaa

SEQ ID NO: 5845945 - DNA, 15 bp, Homo sapiens
atatatatttaaagg

SEQ ID NO: 5845946 - DNA, 13 bp, Homo sapiens
atatatatttcta

SEQ ID NO: 5845947 - DNA, 18 bp, Homo sapiens
atatatatttttcaaata

SEQ ID NO: 5845948 - DNA, 14 bp, Homo sapiens
atatatatttttct

SEQ ID NO: 5845949 - DNA, 23 bp, Homo sapiens
atatatattttttgcttttgtat

SEQ ID NO: 5845950 - DNA, 21 bp, Homo sapiens
atatatatttttttctgaaat

SEQ ID NO: 5845951 - DNA, 12 bp, Homo sapiens
atatatcagtgt

SEQ ID NO: 5845952 - DNA, 14 bp, Homo sapiens
atatatcagtttga

SEQ ID NO: 5845953 - DNA, 15 bp, Homo sapiens
atatatcataaagga

SEQ ID NO: 5845954 - DNA, 17 bp, Homo sapiens
atatatcataaaggata

SEQ ID NO: 5845955 - DNA, 18 bp, Homo sapiens
atatatcataaaggatat

SEQ ID NO: 5845956 - DNA, 16 bp, Homo sapiens
atatatcataacttaa

SEQ ID NO: 5845957 - DNA, 15 bp, Homo sapiens
atatatcatgagtga

SEQ ID NO: 5845958 - DNA, 16 bp, Homo sapiens
atatatcccagaaatt

SEQ ID NO: 5845959 - DNA, 17 bp, Homo sapiens
atatatcctgaaagcat

SEQ ID NO: 5845960 - DNA, 21 bp, Homo sapiens
atatatccttttcttctatgt

SEQ ID NO: 5845961 - DNA, 18 bp, Homo sapiens
atatatctaaattgaata

SEQ ID NO: 5845962 - DNA, 19 bp, Homo sapiens
atatatctaagttcacagt

SEQ ID NO: 5845963 - DNA, 16 bp, Homo sapiens
atatatctatatcata

SEQ ID NO: 5845964 - DNA, 20 bp, Homo sapiens
atatatctatctatttgagg

SEQ ID NO: 5845965 - DNA, 19 bp, Homo sapiens
atatatctcaaattgtaat

SEQ ID NO: 5845966 - DNA, 12 bp, Homo sapiens
atatatctgtaa

SEQ ID NO: 5845967 - DNA, 17 bp, Homo sapiens
atatatcttataactgt

SEQ ID NO: 5845968 - DNA, 14 bp, Homo sapiens
atatatctttgtaa

SEQ ID NO: 5845969 - DNA, 18 bp, Homo sapiens
atatatctttgtaaatta

SEQ ID NO: 5845970 - DNA, 20 bp, Homo sapiens
atatatctttgtaaattatt

SEQ ID NO: 5845971 - DNA, 13 bp, Homo sapiens
atatatgaaaact

SEQ ID NO: 5845972 - DNA, 17 bp, Homo sapiens
atatatgaaaactatac

SEQ ID NO: 5845973 - DNA, 12 bp, Homo sapiens
atatatgaataa

SEQ ID NO: 5845974 - DNA, 18 bp, Homo sapiens
atatatgaataattatgt

SEQ ID NO: 5845975 - DNA, 13 bp, Homo sapiens
atatatgaatatt

SEQ ID NO: 5845976 - DNA, 15 bp, Homo sapiens
atatatgaatattac

SEQ ID NO: 5845977 - DNA, 18 bp, Homo sapiens
atatatgaccagaagcct

SEQ ID NO: 5845978 - DNA, 13 bp, Homo sapiens
atatatgaggact

SEQ ID NO: 5845979 - DNA, 15 bp, Homo sapiens
atatatgcactatgt

SEQ ID NO: 5845980 - DNA, 15 bp, Homo sapiens
atatatgctgtattt

SEQ ID NO: 5845981 - DNA, 16 bp, Homo sapiens
atatatgctgtatttc

SEQ ID NO: 5845982 - DNA, 18 bp, Homo sapiens
atatatgctgtatttctt

SEQ ID NO: 5845983 - DNA, 14 bp, Homo sapiens
atatatgcttacat

SEQ ID NO: 5845984 - DNA, 21 bp, Homo sapiens
atatatgcttttttgcaataa

SEQ ID NO: 5845985 - DNA, 19 bp, Homo sapiens
atatatggaagataatttt

SEQ ID NO: 5845986 - DNA, 20 bp, Homo sapiens
atatatggaagataatttta

SEQ ID NO: 5845987 - DNA, 21 bp, Homo sapiens
atatatggaagataattttat

SEQ ID NO: 5845988 - DNA, 14 bp, Homo sapiens
atatatggatattt

SEQ ID NO: 5845989 - DNA, 14 bp, Homo sapiens
atatatggcagagt

SEQ ID NO: 5845990 - DNA, 22 bp, Homo sapiens
atatatggcagagttgtaaata

SEQ ID NO: 5845991 - DNA, 16 bp, Homo sapiens
atatatggcatattta

SEQ ID NO: 5845992 - DNA, 21 bp, Homo sapiens
atatatggggatggtagtttt

SEQ ID NO: 5845993 - DNA, 19 bp, Homo sapiens
atatatggtctaatgttta

SEQ ID NO: 5845994 - DNA, 21 bp, Homo sapiens
atatatggtctgtgtgtctga

SEQ ID NO: 5845995 - DNA, 15 bp, Homo sapiens
atatatgtaaatata

SEQ ID NO: 5845996 - DNA, 16 bp, Homo sapiens
atatatgtaaatatac

SEQ ID NO: 5845997 - DNA, 12 bp, Homo sapiens
atatatgtacag

SEQ ID NO: 5845998 - DNA, 17 bp, Homo sapiens
atatatgtactagcatt

SEQ ID NO: 5845999 - DNA, 18 bp, Homo sapiens
atatatgtactagcattt

SEQ ID NO: 5846000 - DNA, 20 bp, Homo sapiens
atatatgtagccagacagtt

SEQ ID NO: 5846001 - DNA, 10 bp, Homo sapiens
atatatgtat

SEQ ID NO: 5846002 - DNA, 16 bp, Homo sapiens
atatatgtatatctgt

SEQ ID NO: 5846003 - DNA, 17 bp, Homo sapiens
atatatgtatatgtata

SEQ ID NO: 5846004 - DNA, 23 bp, Homo sapiens
atatatgtatatgtatatctata

SEQ ID NO: 5846005 - DNA, 22 bp, Homo sapiens
atatatgtatctacaatacata

SEQ ID NO: 5846006 - DNA, 17 bp, Homo sapiens
atatatgtcaatattta

SEQ ID NO: 5846007 - DNA, 19 bp, Homo sapiens
atatatgtgcagtatttta

SEQ ID NO: 5846008 - DNA, 21 bp, Homo sapiens
atatatgtgcagtattttatt

SEQ ID NO: 5846009 - DNA, 22 bp, Homo sapiens
atatatgtgtatacatacatgt

SEQ ID NO: 5846010 - DNA, 18 bp, Homo sapiens
atatatgtgtatatatac

SEQ ID NO: 5846011 - DNA, 23 bp, Homo sapiens
atatatgtgtatatatacataca

SEQ ID NO: 5846012 - DNA, 13 bp, Homo sapiens
atatatgtgtgcc

SEQ ID NO: 5846013 - DNA, 21 bp, Homo sapiens
atatatgtgtgccctggactg

SEQ ID NO: 5846014 - DNA, 13 bp, Homo sapiens
atatatgtgtgtg

SEQ ID NO: 5846015 - DNA, 16 bp, Homo sapiens
atatatgtgtgtttaa

SEQ ID NO: 5846016 - DNA, 20 bp, Homo sapiens
atatatgtgtgtttaaataa

SEQ ID NO: 5846017 - DNA, 15 bp, Homo sapiens
atatatgttctgcaa

SEQ ID NO: 5846018 - DNA, 10 bp, Homo sapiens
atatatgttt

SEQ ID NO: 5846019 - DNA, 17 bp, Homo sapiens
atatatgtttacctttt

SEQ ID NO: 5846020 - DNA, 20 bp, Homo sapiens
atatatgtttaccttttaat

SEQ ID NO: 5846021 - DNA, 15 bp, Homo sapiens
atatatgtttgtgga

SEQ ID NO: 5846022 - DNA, 11 bp, Homo sapiens
atatatgtttt

SEQ ID NO: 5846023 - DNA, 21 bp, Homo sapiens
atatatgttttaagaggcagg

SEQ ID NO: 5846024 - DNA, 16 bp, Homo sapiens
atatatgttttgagaa

SEQ ID NO: 5846025 - DNA, 18 bp, Homo sapiens
atatatgttttgagaaaa

SEQ ID NO: 5846026 - DNA, 15 bp, Homo sapiens
atatatgttttgtct

SEQ ID NO: 5846027 - DNA, 21 bp, Homo sapiens
atatattaaaaatataaacaa

SEQ ID NO: 5846028 - DNA, 15 bp, Homo sapiens
atatattaaaacaat

SEQ ID NO: 5846029 - DNA, 20 bp, Homo sapiens
atatattaccccttcatgtc

SEQ ID NO: 5846030 - DNA, 20 bp, Homo sapiens
atatattacggaggaacaga

SEQ ID NO: 5846031 - DNA, 12 bp, Homo sapiens
atatattactga

SEQ ID NO: 5846032 - DNA, 15 bp, Homo sapiens
atatattataagatt

SEQ ID NO: 5846033 - DNA, 14 bp, Homo sapiens
atatattatacttg

SEQ ID NO: 5846034 - DNA, 13 bp, Homo sapiens
atatattatatat

SEQ ID NO: 5846035 - DNA, 16 bp, Homo sapiens
atatattatatatatc

SEQ ID NO: 5846036 - DNA, 13 bp, Homo sapiens
atatattatcttt

SEQ ID NO: 5846037 - DNA, 14 bp, Homo sapiens
atatattatctttt

SEQ ID NO: 5846038 - DNA, 16 bp, Homo sapiens
atatattatcttttca

SEQ ID NO: 5846039 - DNA, 14 bp, Homo sapiens
atatattatgtgaa

SEQ ID NO: 5846040 - DNA, 15 bp, Homo sapiens
atatattatgtgaag

SEQ ID NO: 5846041 - DNA, 18 bp, Homo sapiens
atatattatgtgaagaat

SEQ ID NO: 5846042 - DNA, 13 bp, Homo sapiens
atatattattata

SEQ ID NO: 5846043 - DNA, 14 bp, Homo sapiens
atatattattataa

SEQ ID NO: 5846044 - DNA, 16 bp, Homo sapiens
atatattattataatc

SEQ ID NO: 5846045 - DNA, 16 bp, Homo sapiens
atatattattcatctt

SEQ ID NO: 5846046 - DNA, 16 bp, Homo sapiens
atatattattctcatt

SEQ ID NO: 5846047 - DNA, 16 bp, Homo sapiens
atatattattgtaagt

SEQ ID NO: 5846048 - DNA, 17 bp, Homo sapiens
atatattcaccaatgtt

SEQ ID NO: 5846049 - DNA, 14 bp, Homo sapiens
atatattcactttc

SEQ ID NO: 5846050 - DNA, 21 bp, Homo sapiens
atatattcactttcatttttg

SEQ ID NO: 5846051 - DNA, 17 bp, Homo sapiens
atatattcatacctgtt

SEQ ID NO: 5846052 - DNA, 21 bp, Homo sapiens
atatattcatgtaataaatct

SEQ ID NO: 5846053 - DNA, 15 bp, Homo sapiens
atatattcccaagct

SEQ ID NO: 5846054 - DNA, 20 bp, Homo sapiens
atatattcccctaagatttg

SEQ ID NO: 5846055 - DNA, 14 bp, Homo sapiens
atatattctctttg

SEQ ID NO: 5846056 - DNA, 23 bp, Homo sapiens
atatattctctttggtgtacaaa

SEQ ID NO: 5846057 - DNA, 20 bp, Homo sapiens
atatattctggctgataaaa

SEQ ID NO: 5846058 - DNA, 22 bp, Homo sapiens
atatattctggctgataaaaga

SEQ ID NO: 5846059 - DNA, 17 bp, Homo sapiens
atatattcttataaaaa

SEQ ID NO: 5846060 - DNA, 11 bp, Homo sapiens
atatattcttt

SEQ ID NO: 5846061 - DNA, 17 bp, Homo sapiens
atatattgaacttttgt

SEQ ID NO: 5846062 - DNA, 18 bp, Homo sapiens
atatattgaacttttgta

SEQ ID NO: 5846063 - DNA, 15 bp, Homo sapiens
atatattgaatattt

SEQ ID NO: 5846064 - DNA, 17 bp, Homo sapiens
atatattgacttgttac

SEQ ID NO: 5846065 - DNA, 21 bp, Homo sapiens
atatattgccagtatataagc

SEQ ID NO: 5846066 - DNA, 14 bp, Homo sapiens
atatattgctaaaa

SEQ ID NO: 5846067 - DNA, 12 bp, Homo sapiens
atatattgctgc

SEQ ID NO: 5846068 - DNA, 14 bp, Homo sapiens
atatattgctttat

SEQ ID NO: 5846069 - DNA, 13 bp, Homo sapiens
atatattgtatta

SEQ ID NO: 5846070 - DNA, 16 bp, Homo sapiens
atatattgtgttgact

SEQ ID NO: 5846071 - DNA, 19 bp, Homo sapiens
atatattgtgttttaacac

SEQ ID NO: 5846072 - DNA, 23 bp, Homo sapiens
atatattgtgttttaacaccaac

SEQ ID NO: 5846073 - DNA, 16 bp, Homo sapiens
atatatttaaaaataa

SEQ ID NO: 5846074 - DNA, 12 bp, Homo sapiens
atatatttaaag

SEQ ID NO: 5846075 - DNA, 14 bp, Homo sapiens
atatatttaaaggg

SEQ ID NO: 5846076 - DNA, 18 bp, Homo sapiens
atatatttaacatgtgga

SEQ ID NO: 5846077 - DNA, 23 bp, Homo sapiens
atatatttaacatgtggaagaaa

SEQ ID NO: 5846078 - DNA, 13 bp, Homo sapiens
atatatttaagca

SEQ ID NO: 5846079 - DNA, 20 bp, Homo sapiens
atatatttaagcaacatctt

SEQ ID NO: 5846080 - DNA, 14 bp, Homo sapiens
atatatttaagcct

SEQ ID NO: 5846081 - DNA, 18 bp, Homo sapiens
atatatttaatacctttg

SEQ ID NO: 5846082 - DNA, 15 bp, Homo sapiens
atatatttaatatgt

SEQ ID NO: 5846083 - DNA, 16 bp, Homo sapiens
atatatttaatgataa

SEQ ID NO: 5846084 - DNA, 16 bp, Homo sapiens
atatatttaattgtgt

SEQ ID NO: 5846085 - DNA, 14 bp, Homo sapiens
atatatttataact

SEQ ID NO: 5846086 - DNA, 20 bp, Homo sapiens
atatatttatagcaaagtta

SEQ ID NO: 5846087 - DNA, 22 bp, Homo sapiens
atatatttatatactttttcat

SEQ ID NO: 5846088 - DNA, 14 bp, Homo sapiens
atatatttatatca

SEQ ID NO: 5846089 - DNA, 14 bp, Homo sapiens
atatgccactgacc

SEQ ID NO: 5846090 - DNA, 20 bp, Homo sapiens
atatgccagtgactgctgcg

SEQ ID NO: 5846091 - DNA, 22 bp, Homo sapiens
atatgccagtgactgctgcgct

SEQ ID NO: 5846092 - DNA, 22 bp, Homo sapiens
atatgcccacatttagtctctt

SEQ ID NO: 5846093 - DNA, 16 bp, Homo sapiens
atatgcccctccccag

SEQ ID NO: 5846094 - DNA, 22 bp, Homo sapiens
atatgccctcaagtaaaagaaa

SEQ ID NO: 5846095 - DNA, 17 bp, Homo sapiens
atatgcctatatttata

SEQ ID NO: 5846096 - DNA, 16 bp, Homo sapiens
atatgcctgattcata

SEQ ID NO: 5846097 - DNA, 22 bp, Homo sapiens
atatgcctgggcagaaggaaga

SEQ ID NO: 5846098 - DNA, 21 bp, Homo sapiens
atatgcctgtaattcagtgta

SEQ ID NO: 5846099 - DNA, 18 bp, Homo sapiens
atatgccttaatttagaa

SEQ ID NO: 5846100 - DNA, 20 bp, Homo sapiens
atatgccttaatttagaaac

SEQ ID NO: 5846101 - DNA, 23 bp, Homo sapiens
atatgccttaatttagaaactga

SEQ ID NO: 5846102 - DNA, 14 bp, Homo sapiens
atatgccttactat

SEQ ID NO: 5846103 - DNA, 18 bp, Homo sapiens
atatgccttactattgta

SEQ ID NO: 5846104 - DNA, 15 bp, Homo sapiens
atatgcgtattatac

SEQ ID NO: 5846105 - DNA, 17 bp, Homo sapiens
atatgctaatttgggga

SEQ ID NO: 5846106 - DNA, 14 bp, Homo sapiens
atatgctacacata

SEQ ID NO: 5846107 - DNA, 17 bp, Homo sapiens
atatgctaccaccagct

SEQ ID NO: 5846108 - DNA, 21 bp, Homo sapiens
atatgctaccaccagctgtgt

SEQ ID NO: 5846109 - DNA, 19 bp, Homo sapiens
atatgctatttctatattt

SEQ ID NO: 5846110 - DNA, 21 bp, Homo sapiens
atatgctatttctatattttc

SEQ ID NO: 5846111 - DNA, 22 bp, Homo sapiens
atatgctatttctatattttca

SEQ ID NO: 5846112 - DNA, 12 bp, Homo sapiens
atatgctctcat

SEQ ID NO: 5846113 - DNA, 20 bp, Homo sapiens
atatgctctgatttatctga

SEQ ID NO: 5846114 - DNA, 20 bp, Homo sapiens
atatgctctgcatgttacat

SEQ ID NO: 5846115 - DNA, 23 bp, Homo sapiens
atatgctctgcttttagttcata

SEQ ID NO: 5846116 - DNA, 23 bp, Homo sapiens
atatgctgtacatgacatcaaaa

SEQ ID NO: 5846117 - DNA, 22 bp, Homo sapiens
atatgctgtatagcctttgtca

SEQ ID NO: 5846118 - DNA, 13 bp, Homo sapiens
atatgctgtattt

SEQ ID NO: 5846119 - DNA, 14 bp, Homo sapiens
atatgctgtatttc

SEQ ID NO: 5846120 - DNA, 18 bp, Homo sapiens
atatgctgtattttaaag

SEQ ID NO: 5846121 - DNA, 19 bp, Homo sapiens
atatgctgttatgtccaga

SEQ ID NO: 5846122 - DNA, 20 bp, Homo sapiens
atatgctgttatgtccagaa

SEQ ID NO: 5846123 - DNA, 14 bp, Homo sapiens
atatgcttactgat

SEQ ID NO: 5846124 - DNA, 21 bp, Homo sapiens
atatgcttatacacttacact

SEQ ID NO: 5846125 - DNA, 18 bp, Homo sapiens
atatgcttccagaatggg

SEQ ID NO: 5846126 - DNA, 22 bp, Homo sapiens
atatgcttctgttttataattt

SEQ ID NO: 5846127 - DNA, 23 bp, Homo sapiens
atatgcttctgttttataatttt

SEQ ID NO: 5846128 - DNA, 18 bp, Homo sapiens
atatgctttaagacagaa

SEQ ID NO: 5846129 - DNA, 20 bp, Homo sapiens
atatgctttattaatgtttt

SEQ ID NO: 5846130 - DNA, 18 bp, Homo sapiens
atatgctttttctcagat

SEQ ID NO: 5846131 - DNA, 15 bp, Homo sapiens
atatggaaaagattg

SEQ ID NO: 5846132 - DNA, 18 bp, Homo sapiens
atatggaaatatatatta

SEQ ID NO: 5846133 - DNA, 14 bp, Homo sapiens
atatggaaatcttt

SEQ ID NO: 5846134 - DNA, 16 bp, Homo sapiens
atatggaaccttccct

SEQ ID NO: 5846135 - DNA, 19 bp, Homo sapiens
atatggaacttacattgtt

SEQ ID NO: 5846136 - DNA, 18 bp, Homo sapiens
atatggaagataatttta

SEQ ID NO: 5846137 - DNA, 16 bp, Homo sapiens
atatggaagtaaaggc

SEQ ID NO: 5846138 - DNA, 15 bp, Homo sapiens
atatggaataagtgt

SEQ ID NO: 5846139 - DNA, 22 bp, Homo sapiens
atatggacaaaacaagaaagac

SEQ ID NO: 5846140 - DNA, 16 bp, Homo sapiens
atatggacaagaggta

SEQ ID NO: 5846141 - DNA, 21 bp, Homo sapiens
atatggacactgtgacaatga

SEQ ID NO: 5846142 - DNA, 15 bp, Homo sapiens
atatggacacttaat

SEQ ID NO: 5846143 - DNA, 14 bp, Homo sapiens
atatggactcagcc

SEQ ID NO: 5846144 - DNA, 18 bp, Homo sapiens
atatggactcagttttct

SEQ ID NO: 5846145 - DNA, 15 bp, Homo sapiens
atatggactctgcac

SEQ ID NO: 5846146 - DNA, 17 bp, Homo sapiens
atatggacttaaatgtt

SEQ ID NO: 5846147 - DNA, 20 bp, Homo sapiens
atatggacttaaatgttaat

SEQ ID NO: 5846148 - DNA, 18 bp, Homo sapiens
atatggagaattgctgaa

SEQ ID NO: 5846149 - DNA, 17 bp, Homo sapiens
atatggagcatttttca

SEQ ID NO: 5846150 - DNA, 23 bp, Homo sapiens
atatggagtgagtcacctgctcc

SEQ ID NO: 5846151 - DNA, 19 bp, Homo sapiens
atatggataatctgagcag

SEQ ID NO: 5846152 - DNA, 23 bp, Homo sapiens
atatggataatctgagcaggtac

SEQ ID NO: 5846153 - DNA, 18 bp, Homo sapiens
atatggatgattcagaaa

SEQ ID NO: 5846154 - DNA, 17 bp, Homo sapiens
atatggatttgttacag

SEQ ID NO: 5846155 - DNA, 23 bp, Homo sapiens
atatggattttctattgttactc

SEQ ID NO: 5846156 - DNA, 19 bp, Homo sapiens
atatggcaaatagccacaa

SEQ ID NO: 5846157 - DNA, 19 bp, Homo sapiens
atatggcaacgttcatgtt

SEQ ID NO: 5846158 - DNA, 17 bp, Homo sapiens
atatggcaagaaagctg

SEQ ID NO: 5846159 - DNA, 17 bp, Homo sapiens
atatggcagaagacacc

SEQ ID NO: 5846160 - DNA, 19 bp, Homo sapiens
atatggcagagttgtaaat

SEQ ID NO: 5846161 - DNA, 22 bp, Homo sapiens
atatggcagagttgtaaatata

SEQ ID NO: 5846162 - DNA, 19 bp, Homo sapiens
atatggcaggactcctggc

SEQ ID NO: 5846163 - DNA, 22 bp, Homo sapiens
atatggcaggactcctggcagg

SEQ ID NO: 5846164 - DNA, 16 bp, Homo sapiens
atatggcagggaagct

SEQ ID NO: 5846165 - DNA, 13 bp, Homo sapiens
atatggccacagt

SEQ ID NO: 5846166 - DNA, 16 bp, Homo sapiens
atatggcccagccttg

SEQ ID NO: 5846167 - DNA, 16 bp, Homo sapiens
atatggcggcctgcag

SEQ ID NO: 5846168 - DNA, 18 bp, Homo sapiens
atatggcgttttgtctgt

SEQ ID NO: 5846169 - DNA, 15 bp, Homo sapiens
atatggctataaata

SEQ ID NO: 5846170 - DNA, 22 bp, Homo sapiens
atatggctcttcataattctaa

SEQ ID NO: 5846171 - DNA, 15 bp, Homo sapiens
atatggctgcccagg

SEQ ID NO: 5846172 - DNA, 17 bp, Homo sapiens
atatggctgcccaggag

SEQ ID NO: 5846173 - DNA, 14 bp, Homo sapiens
atatggcttcaagt

SEQ ID NO: 5846174 - DNA, 19 bp, Homo sapiens
atatggcttcaagttgtaa

SEQ ID NO: 5846175 - DNA, 23 bp, Homo sapiens
atatgggaacactggcagactgt

SEQ ID NO: 5846176 - DNA, 22 bp, Homo sapiens
atatgggaatgtctaacttaaa

SEQ ID NO: 5846177 - DNA, 15 bp, Homo sapiens
atatgggagaaatag

SEQ ID NO: 5846178 - DNA, 17 bp, Homo sapiens
atatgggcgggcagtcg

SEQ ID NO: 5846179 - DNA, 16 bp, Homo sapiens
atatggggaatatatt

SEQ ID NO: 5846180 - DNA, 21 bp, Homo sapiens
atatggggatagtctgggtca

SEQ ID NO: 5846181 - DNA, 21 bp, Homo sapiens
atatgggggcatctcttcccc

SEQ ID NO: 5846182 - DNA, 20 bp, Homo sapiens
atatgggggcctggattcat

SEQ ID NO: 5846183 - DNA, 17 bp, Homo sapiens
atatggggggccaacac

SEQ ID NO: 5846184 - DNA, 14 bp, Homo sapiens
atatgggtgctggc

SEQ ID NO: 5846185 - DNA, 17 bp, Homo sapiens
atatgggttcttttttg

SEQ ID NO: 5846186 - DNA, 20 bp, Homo sapiens
atatgggtttataattttct

SEQ ID NO: 5846187 - DNA, 15 bp, Homo sapiens
atatgggtttgaact

SEQ ID NO: 5846188 - DNA, 19 bp, Homo sapiens
atatggtatatatacatat

SEQ ID NO: 5846189 - DNA, 16 bp, Homo sapiens
atatggtccactggtt

SEQ ID NO: 5846190 - DNA, 17 bp, Homo sapiens
atatggtctaatgttta

SEQ ID NO: 5846191 - DNA, 22 bp, Homo sapiens
atatggtctaccagtttgctga

SEQ ID NO: 5846192 - DNA, 17 bp, Homo sapiens
atatggtgaagggaagt

SEQ ID NO: 5846193 - DNA, 24 bp, Homo sapiens
atatggtgaagggaagtggggagt

SEQ ID NO: 5846194 - DNA, 21 bp, Homo sapiens
atatggtgcagagaagctgga

SEQ ID NO: 5846195 - DNA, 24 bp, Homo sapiens
atatggtgtctattatagtgaaac

SEQ ID NO: 5846196 - DNA, 17 bp, Homo sapiens
atatggttctccaagaa

SEQ ID NO: 5846197 - DNA, 20 bp, Homo sapiens
atatggttctccaagaaact

SEQ ID NO: 5846198 - DNA, 22 bp, Homo sapiens
atatggttctccaagaaactga

SEQ ID NO: 5846199 - DNA, 12 bp, Homo sapiens
atatgtaaaaca

SEQ ID NO: 5846200 - DNA, 13 bp, Homo sapiens
atatgtaaaacat

SEQ ID NO: 5846201 - DNA, 16 bp, Homo sapiens
atatgtaaaacattta

SEQ ID NO: 5846202 - DNA, 24 bp, Homo sapiens
atatgtaaaacatttattttgaca

SEQ ID NO: 5846203 - DNA, 16 bp, Homo sapiens
atatgtaaaataaaat

SEQ ID NO: 5846204 - DNA, 14 bp, Homo sapiens
atatgtaaaattac

SEQ ID NO: 5846205 - DNA, 15 bp, Homo sapiens
atatgtaaactttaa

SEQ ID NO: 5846206 - DNA, 13 bp, Homo sapiens
atatgtaaatagc

SEQ ID NO: 5846207 - DNA, 15 bp, Homo sapiens
atatgtaaatataca

SEQ ID NO: 5846208 - DNA, 22 bp, Homo sapiens
atatgtaaatggtatgtcattc

SEQ ID NO: 5846209 - DNA, 14 bp, Homo sapiens
atatgtaaatgtgt

SEQ ID NO: 5846210 - DNA, 16 bp, Homo sapiens
atatgtaaatgtgtta

SEQ ID NO: 5846211 - DNA, 19 bp, Homo sapiens
atatgtaaattataagtaa

SEQ ID NO: 5846212 - DNA, 16 bp, Homo sapiens
atatgtaacaagccac

SEQ ID NO: 5846213 - DNA, 18 bp, Homo sapiens
atatgtaatataaattta

SEQ ID NO: 5846214 - DNA, 17 bp, Homo sapiens
atatgtaatatatacat

SEQ ID NO: 5846215 - DNA, 18 bp, Homo sapiens
atatgtaatatatacata

SEQ ID NO: 5846216 - DNA, 22 bp, Homo sapiens
atatgtaatatatacatattca

SEQ ID NO: 5846217 - DNA, 20 bp, Homo sapiens
atatgtaatttcaaaataca

SEQ ID NO: 5846218 - DNA, 14 bp, Homo sapiens
atatgtacaaataa

SEQ ID NO: 5846219 - DNA, 16 bp, Homo sapiens
atatgtacaaataata

SEQ ID NO: 5846220 - DNA, 12 bp, Homo sapiens
atatgtacagtt

SEQ ID NO: 5846221 - DNA, 19 bp, Homo sapiens
atatgtacagttatacata

SEQ ID NO: 5846222 - DNA, 16 bp, Homo sapiens
atatgtacagtttatt

SEQ ID NO: 5846223 - DNA, 20 bp, Homo sapiens
atatgtacagtttattgata

SEQ ID NO: 5846224 - DNA, 16 bp, Homo sapiens
atatgtacatttctca

SEQ ID NO: 5846225 - DNA, 19 bp, Homo sapiens
atatgtacatttctcaggc

SEQ ID NO: 5846226 - DNA, 17 bp, Homo sapiens
atatgtaccctctgaaa

SEQ ID NO: 5846227 - DNA, 19 bp, Homo sapiens
atatgtaccctctgaaata

SEQ ID NO: 5846228 - DNA, 20 bp, Homo sapiens
atatgtaccctctgaaatac

SEQ ID NO: 5846229 - DNA, 13 bp, Homo sapiens
atatgtactaaga

SEQ ID NO: 5846230 - DNA, 17 bp, Homo sapiens
atatgtactaagaatgt

SEQ ID NO: 5846231 - DNA, 17 bp, Homo sapiens
atatgtacttgtcaaag

SEQ ID NO: 5846232 - DNA, 19 bp, Homo sapiens
atatgtacttgtcaaagaa

SEQ ID NO: 5846233 - DNA, 20 bp, Homo sapiens
atatgtacttgtcaaagaag

SEQ ID NO: 5846234 - DNA, 18 bp, Homo sapiens
atatgtacttgtttgcta

SEQ ID NO: 5846235 - DNA, 20 bp, Homo sapiens
atatgtacttttccatttat

SEQ ID NO: 5846236 - DNA, 12 bp, Homo sapiens
atatgtagaaac

SEQ ID NO: 5846237 - DNA, 18 bp, Homo sapiens
atatgtagaaacatttag

SEQ ID NO: 5846238 - DNA, 16 bp, Homo sapiens
atatgtagactatata

SEQ ID NO: 5846239 - DNA, 21 bp, Homo sapiens
atatgtagactatatacatgt

SEQ ID NO: 5846240 - DNA, 16 bp, Homo sapiens
atatgtagagaaagat

SEQ ID NO: 5846241 - DNA, 20 bp, Homo sapiens
atatgtagatattgttttct

SEQ ID NO: 5846242 - DNA, 23 bp, Homo sapiens
atatgtagatgtatgcacacaca

SEQ ID NO: 5846243 - DNA, 22 bp, Homo sapiens
atatgtagcattaaatataaaa

SEQ ID NO: 5846244 - DNA, 18 bp, Homo sapiens
atatgtagccagacagtt

SEQ ID NO: 5846245 - DNA, 17 bp, Homo sapiens
atatgtagccctcatga

SEQ ID NO: 5846246 - DNA, 22 bp, Homo sapiens
atatgtagccttgccttttaaa

SEQ ID NO: 5846247 - DNA, 23 bp, Homo sapiens
atatgtaggaaaattttcttctt

SEQ ID NO: 5846248 - DNA, 23 bp, Homo sapiens
atatgtagtgcatttttaaactt

SEQ ID NO: 5846249 - DNA, 16 bp, Homo sapiens
atatgtataactttaa

SEQ ID NO: 5846250 - DNA, 19 bp, Homo sapiens
atatgtataatatatatct

SEQ ID NO: 5846251 - DNA, 15 bp, Homo sapiens
atatgtataatttca

SEQ ID NO: 5846252 - DNA, 22 bp, Homo sapiens
atatgtatacacaaatatatac

SEQ ID NO: 5846253 - DNA, 16 bp, Homo sapiens
atatgtatacgcacgc

SEQ ID NO: 5846254 - DNA, 14 bp, Homo sapiens
atatgtatacttat

SEQ ID NO: 5846255 - DNA, 14 bp, Homo sapiens
atatgtatataaaa

SEQ ID NO: 5846256 - DNA, 15 bp, Homo sapiens
atatgtatataaaat

SEQ ID NO: 5846257 - DNA, 19 bp, Homo sapiens
atatgtatatatattctca

SEQ ID NO: 5846258 - DNA, 13 bp, Homo sapiens
atatgtatatctg

SEQ ID NO: 5846259 - DNA, 17 bp, Homo sapiens
atatgtatatgacattt

SEQ ID NO: 5846260 - DNA, 12 bp, Homo sapiens
atatgtatatgt

SEQ ID NO: 5846261 - DNA, 13 bp, Homo sapiens
atatgtatatgta

SEQ ID NO: 5846262 - DNA, 15 bp, Homo sapiens
atatgtatatgtata

SEQ ID NO: 5846263 - DNA, 13 bp, Homo sapiens
atatgtatatttt

SEQ ID NO: 5846264 - DNA, 18 bp, Homo sapiens
atattcagccagcttaaa

SEQ ID NO: 5846265 - DNA, 13 bp, Homo sapiens
atattcaggaagc

SEQ ID NO: 5846266 - DNA, 19 bp, Homo sapiens
atattcaggaagctcaggg

SEQ ID NO: 5846267 - DNA, 19 bp, Homo sapiens
atattcaggagttggaatg

SEQ ID NO: 5846268 - DNA, 22 bp, Homo sapiens
atattcaggctactcattcagt

SEQ ID NO: 5846269 - DNA, 20 bp, Homo sapiens
atattcagggtaaataggaa

SEQ ID NO: 5846270 - DNA, 17 bp, Homo sapiens
atattcaggtggccaga

SEQ ID NO: 5846271 - DNA, 11 bp, Homo sapiens
atattcataaa

SEQ ID NO: 5846272 - DNA, 14 bp, Homo sapiens
atattcatacaaca

SEQ ID NO: 5846273 - DNA, 15 bp, Homo sapiens
atattcatacaacaa

SEQ ID NO: 5846274 - DNA, 17 bp, Homo sapiens
atattcatacaacaaag

SEQ ID NO: 5846275 - DNA, 19 bp, Homo sapiens
atattcatacaacaaagag

SEQ ID NO: 5846276 - DNA, 16 bp, Homo sapiens
atattcatactttcca

SEQ ID NO: 5846277 - DNA, 20 bp, Homo sapiens
atattcatactttccaacat

SEQ ID NO: 5846278 - DNA, 19 bp, Homo sapiens
atattcatagtagaacttt

SEQ ID NO: 5846279 - DNA, 17 bp, Homo sapiens
atattcatatattatca

SEQ ID NO: 5846280 - DNA, 16 bp, Homo sapiens
atattcatcagcagga

SEQ ID NO: 5846281 - DNA, 23 bp, Homo sapiens
atattcatctaataaatcagtga

SEQ ID NO: 5846282 - DNA, 23 bp, Homo sapiens
atattcatctgttgacaatttgc

SEQ ID NO: 5846283 - DNA, 22 bp, Homo sapiens
atattcatgaaagctgaaagaa

SEQ ID NO: 5846284 - DNA, 19 bp, Homo sapiens
atattcattaataggaaag

SEQ ID NO: 5846285 - DNA, 13 bp, Homo sapiens
atattcattcaga

SEQ ID NO: 5846286 - DNA, 17 bp, Homo sapiens
atattcattcatggacc

SEQ ID NO: 5846287 - DNA, 17 bp, Homo sapiens
atattcattctttttga

SEQ ID NO: 5846288 - DNA, 14 bp, Homo sapiens
atattcattgtata

SEQ ID NO: 5846289 - DNA, 15 bp, Homo sapiens
atattcattgtataa

SEQ ID NO: 5846290 - DNA, 15 bp, Homo sapiens
atattcatttggaaa

SEQ ID NO: 5846291 - DNA, 14 bp, Homo sapiens
atattccaaaataa

SEQ ID NO: 5846292 - DNA, 16 bp, Homo sapiens
atattccaactcaaaa

SEQ ID NO: 5846293 - DNA, 11 bp, Homo sapiens
atattccaagg

SEQ ID NO: 5846294 - DNA, 14 bp, Homo sapiens
atattccaaggaaa

SEQ ID NO: 5846295 - DNA, 16 bp, Homo sapiens
atattccaaggaaaat

SEQ ID NO: 5846296 - DNA, 18 bp, Homo sapiens
atattccaccattcacat

SEQ ID NO: 5846297 - DNA, 19 bp, Homo sapiens
atattccaccattcacatt

SEQ ID NO: 5846298 - DNA, 17 bp, Homo sapiens
atattccactatttgca

SEQ ID NO: 5846299 - DNA, 14 bp, Homo sapiens
atattccagaagaa

SEQ ID NO: 5846300 - DNA, 21 bp, Homo sapiens
atattccagatctttcagaaa

SEQ ID NO: 5846301 - DNA, 20 bp, Homo sapiens
atattccagcagtgaaactt

SEQ ID NO: 5846302 - DNA, 20 bp, Homo sapiens
atattccaggtttaagtaga

SEQ ID NO: 5846303 - DNA, 12 bp, Homo sapiens
atattccatagt

SEQ ID NO: 5846304 - DNA, 16 bp, Homo sapiens
atattccatagtatat

SEQ ID NO: 5846305 - DNA, 15 bp, Homo sapiens
atattccatgaatgt

SEQ ID NO: 5846306 - DNA, 21 bp, Homo sapiens
atattccgggtgccattccca

SEQ ID NO: 5846307 - DNA, 23 bp, Homo sapiens
atattcctattgtgcaatgtaaa

SEQ ID NO: 5846308 - DNA, 13 bp, Homo sapiens
atattcctccaaa

SEQ ID NO: 5846309 - DNA, 15 bp, Homo sapiens
atattcctgaatgaa

SEQ ID NO: 5846310 - DNA, 21 bp, Homo sapiens
atattcctgcatttgtgaaat

SEQ ID NO: 5846311 - DNA, 21 bp, Homo sapiens
atattccttactagaaatata

SEQ ID NO: 5846312 - DNA, 16 bp, Homo sapiens
atattcctttctatca

SEQ ID NO: 5846313 - DNA, 12 bp, Homo sapiens
atattcctttga

SEQ ID NO: 5846314 - DNA, 15 bp, Homo sapiens
atattcctttgacca

SEQ ID NO: 5846315 - DNA, 23 bp, Homo sapiens
atattccttttaaagaagcttta

SEQ ID NO: 5846316 - DNA, 16 bp, Homo sapiens
atattcctttttctat

SEQ ID NO: 5846317 - DNA, 21 bp, Homo sapiens
atattcctttttctatgaaat

SEQ ID NO: 5846318 - DNA, 23 bp, Homo sapiens
atattcctttttctatgaaataa

SEQ ID NO: 5846319 - DNA, 21 bp, Homo sapiens
atattctaacttattaaattt

SEQ ID NO: 5846320 - DNA, 23 bp, Homo sapiens
atattctaagacttactctaaga

SEQ ID NO: 5846321 - DNA, 13 bp, Homo sapiens
atattctaagcca

SEQ ID NO: 5846322 - DNA, 19 bp, Homo sapiens
atattctaatagtttttca

SEQ ID NO: 5846323 - DNA, 18 bp, Homo sapiens
atattctaattaaaattg

SEQ ID NO: 5846324 - DNA, 19 bp, Homo sapiens
atattctacacatatcttg

SEQ ID NO: 5846325 - DNA, 23 bp, Homo sapiens
atattctactggcctgtaatcta

SEQ ID NO: 5846326 - DNA, 19 bp, Homo sapiens
atattctactgtacttttt

SEQ ID NO: 5846327 - DNA, 15 bp, Homo sapiens
atattctatgaccac

SEQ ID NO: 5846328 - DNA, 14 bp, Homo sapiens
atattctattttac

SEQ ID NO: 5846329 - DNA, 23 bp, Homo sapiens
atattctattttcattttctgca

SEQ ID NO: 5846330 - DNA, 15 bp, Homo sapiens
atattctcagcagag

SEQ ID NO: 5846331 - DNA, 16 bp, Homo sapiens
atattctcagcagagt

SEQ ID NO: 5846332 - DNA, 17 bp, Homo sapiens
atattctcagcagagtg

SEQ ID NO: 5846333 - DNA, 17 bp, Homo sapiens
atattctcatttttcta

SEQ ID NO: 5846334 - DNA, 13 bp, Homo sapiens
atattctccctga

SEQ ID NO: 5846335 - DNA, 17 bp, Homo sapiens
atattctctaataaaat

SEQ ID NO: 5846336 - DNA, 14 bp, Homo sapiens
atattctctgtaca

SEQ ID NO: 5846337 - DNA, 15 bp, Homo sapiens
atattctctgtacat

SEQ ID NO: 5846338 - DNA, 22 bp, Homo sapiens
atattctctttggtgtacaaaa

SEQ ID NO: 5846339 - DNA, 24 bp, Homo sapiens
atattctgaagcaacattttagct

SEQ ID NO: 5846340 - DNA, 20 bp, Homo sapiens
atattctgataatgtattgc

SEQ ID NO: 5846341 - DNA, 24 bp, Homo sapiens
atattctgataatgtattgcagtg

SEQ ID NO: 5846342 - DNA, 16 bp, Homo sapiens
atattctgcagaaaat

SEQ ID NO: 5846343 - DNA, 16 bp, Homo sapiens
atattctgctctatta

SEQ ID NO: 5846344 - DNA, 21 bp, Homo sapiens
atattctgctctattatataa

SEQ ID NO: 5846345 - DNA, 11 bp, Homo sapiens
atattctggaa

SEQ ID NO: 5846346 - DNA, 15 bp, Homo sapiens
atattctggaaaaaa

SEQ ID NO: 5846347 - DNA, 22 bp, Homo sapiens
atattctggaaaaaaaatatat

SEQ ID NO: 5846348 - DNA, 23 bp, Homo sapiens
atattctggagtcatcattccct

SEQ ID NO: 5846349 - DNA, 22 bp, Homo sapiens
atattctggattataaaaatga

SEQ ID NO: 5846350 - DNA, 18 bp, Homo sapiens
atattctggttcttgaaa

SEQ ID NO: 5846351 - DNA, 19 bp, Homo sapiens
atattctggttcttgaaaa

SEQ ID NO: 5846352 - DNA, 13 bp, Homo sapiens
atattctgtacat

SEQ ID NO: 5846353 - DNA, 10 bp, Homo sapiens
atattctgtc

SEQ ID NO: 5846354 - DNA, 23 bp, Homo sapiens
atattctgtggaaaaataaagga

SEQ ID NO: 5846355 - DNA, 14 bp, Homo sapiens
atattcttatgtat

SEQ ID NO: 5846356 - DNA, 23 bp, Homo sapiens
atattcttcacgcagagattttc

SEQ ID NO: 5846357 - DNA, 21 bp, Homo sapiens
atattcttctcttgctttata

SEQ ID NO: 5846358 - DNA, 19 bp, Homo sapiens
atattcttgctttcacaaa

SEQ ID NO: 5846359 - DNA, 23 bp, Homo sapiens
atattcttgctttcacaaatata

SEQ ID NO: 5846360 - DNA, 13 bp, Homo sapiens
atattcttgtaaa

SEQ ID NO: 5846361 - DNA, 20 bp, Homo sapiens
atattcttgtccacattcta

SEQ ID NO: 5846362 - DNA, 13 bp, Homo sapiens
atattctttacaa

SEQ ID NO: 5846363 - DNA, 14 bp, Homo sapiens
atattctttacaaa

SEQ ID NO: 5846364 - DNA, 23 bp, Homo sapiens
atattctttagcttacctgggca

SEQ ID NO: 5846365 - DNA, 23 bp, Homo sapiens
atattctttattctcagtaactt

SEQ ID NO: 5846366 - DNA, 14 bp, Homo sapiens
atattctttcacaa

SEQ ID NO: 5846367 - DNA, 13 bp, Homo sapiens
atattctttccat

SEQ ID NO: 5846368 - DNA, 14 bp, Homo sapiens
atattctttgttaa

SEQ ID NO: 5846369 - DNA, 20 bp, Homo sapiens
atattctttgttaatttgga

SEQ ID NO: 5846370 - DNA, 21 bp, Homo sapiens
atattcttttctgcaaaatag

SEQ ID NO: 5846371 - DNA, 14 bp, Homo sapiens
atattgaaaatgtc

SEQ ID NO: 5846372 - DNA, 18 bp, Homo sapiens
atattgaaaatgtcactg

SEQ ID NO: 5846373 - DNA, 19 bp, Homo sapiens
atattgaaaatgtcactgt

SEQ ID NO: 5846374 - DNA, 20 bp, Homo sapiens
atattgaaaatgtcactgtt

SEQ ID NO: 5846375 - DNA, 22 bp, Homo sapiens
atattgaaaatgtcactgttat

SEQ ID NO: 5846376 - DNA, 20 bp, Homo sapiens
atattgaaaattgaaaagta

SEQ ID NO: 5846377 - DNA, 19 bp, Homo sapiens
atattgaaagttgctttta

SEQ ID NO: 5846378 - DNA, 18 bp, Homo sapiens
atattgaagaatttgttt

SEQ ID NO: 5846379 - DNA, 14 bp, Homo sapiens
atattgaagacaat

SEQ ID NO: 5846380 - DNA, 15 bp, Homo sapiens
atattgaagacaatt

SEQ ID NO: 5846381 - DNA, 13 bp, Homo sapiens
atattgaatatat

SEQ ID NO: 5846382 - DNA, 12 bp, Homo sapiens
atattgaatgtg

SEQ ID NO: 5846383 - DNA, 14 bp, Homo sapiens
atattgaatgtgaa

SEQ ID NO: 5846384 - DNA, 12 bp, Homo sapiens
atattgaatgtt

SEQ ID NO: 5846385 - DNA, 18 bp, Homo sapiens
atattgaatgtttccaac

SEQ ID NO: 5846386 - DNA, 19 bp, Homo sapiens
atattgacaagtgtctttt

SEQ ID NO: 5846387 - DNA, 12 bp, Homo sapiens
atattgacattt

SEQ ID NO: 5846388 - DNA, 14 bp, Homo sapiens
atattgacatttgt

SEQ ID NO: 5846389 - DNA, 14 bp, Homo sapiens
atattgaccatgtg

SEQ ID NO: 5846390 - DNA, 23 bp, Homo sapiens
atattgacccaaatgtgtaatat

SEQ ID NO: 5846391 - DNA, 16 bp, Homo sapiens
atattgacttgtatat

SEQ ID NO: 5846392 - DNA, 16 bp, Homo sapiens
atattgagaataatta

SEQ ID NO: 5846393 - DNA, 21 bp, Homo sapiens
atattgagaatcccttaaaat

SEQ ID NO: 5846394 - DNA, 20 bp, Homo sapiens
atattgagacaaaaattatc

SEQ ID NO: 5846395 - DNA, 16 bp, Homo sapiens
atattgagacattaat

SEQ ID NO: 5846396 - DNA, 13 bp, Homo sapiens
atattgagcagaa

SEQ ID NO: 5846397 - DNA, 22 bp, Homo sapiens
atattgaggccaagaatattgc

SEQ ID NO: 5846398 - DNA, 19 bp, Homo sapiens
atattgaggcctgtcctct

SEQ ID NO: 5846399 - DNA, 14 bp, Homo sapiens
atattgaggctgca

SEQ ID NO: 5846400 - DNA, 18 bp, Homo sapiens
atattgaggctttgtgtt

SEQ ID NO: 5846401 - DNA, 14 bp, Homo sapiens
atattgataaattt

SEQ ID NO: 5846402 - DNA, 18 bp, Homo sapiens
atattgataagatctttt

SEQ ID NO: 5846403 - DNA, 13 bp, Homo sapiens
atattgataataa

SEQ ID NO: 5846404 - DNA, 14 bp, Homo sapiens
atattgataataaa

SEQ ID NO: 5846405 - DNA, 16 bp, Homo sapiens
atattgataataaaat

SEQ ID NO: 5846406 - DNA, 17 bp, Homo sapiens
atattgataataaaatt

SEQ ID NO: 5846407 - DNA, 19 bp, Homo sapiens
atattgataataaaattca

SEQ ID NO: 5846408 - DNA, 14 bp, Homo sapiens
atattgatcaaata

SEQ ID NO: 5846409 - DNA, 22 bp, Homo sapiens
atattgatccagaaagaaaact

SEQ ID NO: 5846410 - DNA, 15 bp, Homo sapiens
atattgatctgtatt

SEQ ID NO: 5846411 - DNA, 13 bp, Homo sapiens
atattgatgaaaa

SEQ ID NO: 5846412 - DNA, 15 bp, Homo sapiens
atattgatgataaca

SEQ ID NO: 5846413 - DNA, 15 bp, Homo sapiens
atattgatgttaaca

SEQ ID NO: 5846414 - DNA, 17 bp, Homo sapiens
atattgatttaaaagtg

SEQ ID NO: 5846415 - DNA, 22 bp, Homo sapiens
atattgatttctgccttccttg

SEQ ID NO: 5846416 - DNA, 16 bp, Homo sapiens
atattgcaaaatacat

SEQ ID NO: 5846417 - DNA, 18 bp, Homo sapiens
atattgcaaaatacatga

SEQ ID NO: 5846418 - DNA, 23 bp, Homo sapiens
atattgcaaaatacatgaagctt

SEQ ID NO: 5846419 - DNA, 12 bp, Homo sapiens
atattgcaatga

SEQ ID NO: 5846420 - DNA, 19 bp, Homo sapiens
atattgcaattgatgtgat

SEQ ID NO: 5846421 - DNA, 19 bp, Homo sapiens
atattgcacatgtcttaat

SEQ ID NO: 5846422 - DNA, 21 bp, Homo sapiens
atattgcacatgtcttaatga

SEQ ID NO: 5846423 - DNA, 16 bp, Homo sapiens
atattgcactaggtca

SEQ ID NO: 5846424 - DNA, 22 bp, Homo sapiens
atattgcagtgtgaatgctggg

SEQ ID NO: 5846425 - DNA, 20 bp, Homo sapiens
atattgcatactattaaaca

SEQ ID NO: 5846426 - DNA, 12 bp, Homo sapiens
atattgcatttc

SEQ ID NO: 5846427 - DNA, 16 bp, Homo sapiens
atattgcatttctgta

SEQ ID NO: 5846428 - DNA, 16 bp, Homo sapiens
atattgccaaatatta

SEQ ID NO: 5846429 - DNA, 17 bp, Homo sapiens
atattgccattatgctt

SEQ ID NO: 5846430 - DNA, 16 bp, Homo sapiens
atattgcccaggctgg

SEQ ID NO: 5846431 - DNA, 17 bp, Homo sapiens
atattgccctaattaaa

SEQ ID NO: 5846432 - DNA, 17 bp, Homo sapiens
atattgcctgtgcttct

SEQ ID NO: 5846433 - DNA, 14 bp, Homo sapiens
atattgccttattt

SEQ ID NO: 5846434 - DNA, 19 bp, Homo sapiens
atattgccttatttgtctg

SEQ ID NO: 5846435 - DNA, 16 bp, Homo sapiens
atattgccttgatgtt

SEQ ID NO: 5846436 - DNA, 17 bp, Homo sapiens
atattgccttgatgttt

SEQ ID NO: 5846437 - DNA, 11 bp, Homo sapiens
atattgctaaa

SEQ ID NO: 5846438 - DNA, 12 bp, Homo sapiens
atattgctaaaa

SEQ ID NO: 5846439 - DNA, 21 bp, Homo sapiens
atattgctaaaatattttaga

SEQ ID NO: 5846440 - DNA, 16 bp, Homo sapiens
atattgctaattgtgt

SEQ ID NO: 5846441 - DNA, 16 bp, Homo sapiens
atattgctaccaaaaa

SEQ ID NO: 5846442 - DNA, 12 bp, Homo sapiens
atcaaaagtgat

SEQ ID NO: 5846443 - DNA, 18 bp, Homo sapiens
atcaaaagtgatcagcaa

SEQ ID NO: 5846444 - DNA, 13 bp, Homo sapiens
atcaaaagtgcct

SEQ ID NO: 5846445 - DNA, 17 bp, Homo sapiens
atcaaaagttgatttct

SEQ ID NO: 5846446 - DNA, 15 bp, Homo sapiens
atcaaaataaaaagt

SEQ ID NO: 5846447 - DNA, 21 bp, Homo sapiens
atcaaaataaaaattaaatgt

SEQ ID NO: 5846448 - DNA, 15 bp, Homo sapiens
atcaaaataaaagaa

SEQ ID NO: 5846449 - DNA, 19 bp, Homo sapiens
atcaaaataggatttctta

SEQ ID NO: 5846450 - DNA, 12 bp, Homo sapiens
atcaaaatcaaa

SEQ ID NO: 5846451 - DNA, 13 bp, Homo sapiens
atcaaaatcaaaa

SEQ ID NO: 5846452 - DNA, 17 bp, Homo sapiens
atcaaaatcctacagat

SEQ ID NO: 5846453 - DNA, 17 bp, Homo sapiens
atcaaaatctctccact

SEQ ID NO: 5846454 - DNA, 23 bp, Homo sapiens
atcaaaatctctccactttcagc

SEQ ID NO: 5846455 - DNA, 18 bp, Homo sapiens
atcaaaatcttaatcatt

SEQ ID NO: 5846456 - DNA, 23 bp, Homo sapiens
atcaaaatgacctcaccattttt

SEQ ID NO: 5846457 - DNA, 16 bp, Homo sapiens
atcaaaatgcctttca

SEQ ID NO: 5846458 - DNA, 23 bp, Homo sapiens
atcaaaatgctcttatttcatca

SEQ ID NO: 5846459 - DNA, 12 bp, Homo sapiens
atcaaaattaca

SEQ ID NO: 5846460 - DNA, 15 bp, Homo sapiens
atcaaacacaacaca

SEQ ID NO: 5846461 - DNA, 20 bp, Homo sapiens
atcaaacacaacacaagaaa

SEQ ID NO: 5846462 - DNA, 23 bp, Homo sapiens
atcaaacaccaacataaaaatga

SEQ ID NO: 5846463 - DNA, 17 bp, Homo sapiens
atcaaacacggacccat

SEQ ID NO: 5846464 - DNA, 23 bp, Homo sapiens
atcaaacagccccagtcttcctt

SEQ ID NO: 5846465 - DNA, 19 bp, Homo sapiens
atcaaacagtaatctaggt

SEQ ID NO: 5846466 - DNA, 13 bp, Homo sapiens
atcaaacatgaaa

SEQ ID NO: 5846467 - DNA, 15 bp, Homo sapiens
atcaaacatgaaaac

SEQ ID NO: 5846468 - DNA, 18 bp, Homo sapiens
atcaaacatgggtttagt

SEQ ID NO: 5846469 - DNA, 15 bp, Homo sapiens
atcaaacattttctg

SEQ ID NO: 5846470 - DNA, 16 bp, Homo sapiens
atcaaacattttctgg

SEQ ID NO: 5846471 - DNA, 14 bp, Homo sapiens
atcaaacattttga

SEQ ID NO: 5846472 - DNA, 15 bp, Homo sapiens
atcaaaccaaagagt

SEQ ID NO: 5846473 - DNA, 16 bp, Homo sapiens
atcaaaccaaagagta

SEQ ID NO: 5846474 - DNA, 17 bp, Homo sapiens
atcaaaccctagccttg

SEQ ID NO: 5846475 - DNA, 21 bp, Homo sapiens
atcaaaccctagccttgcttg

SEQ ID NO: 5846476 - DNA, 20 bp, Homo sapiens
atcaaactcgtctgatgttt

SEQ ID NO: 5846477 - DNA, 13 bp, Homo sapiens
atcaaactgaaac

SEQ ID NO: 5846478 - DNA, 14 bp, Homo sapiens
atcaaactgaagcc

SEQ ID NO: 5846479 - DNA, 16 bp, Homo sapiens
atcaaactgaagccag

SEQ ID NO: 5846480 - DNA, 13 bp, Homo sapiens
atcaaactgcttt

SEQ ID NO: 5846481 - DNA, 13 bp, Homo sapiens
atcaaacttatgg

SEQ ID NO: 5846482 - DNA, 18 bp, Homo sapiens
atcaaagaaattcagaac

SEQ ID NO: 5846483 - DNA, 17 bp, Homo sapiens
atcaaagaataagaaaa

SEQ ID NO: 5846484 - DNA, 19 bp, Homo sapiens
atcaaagaattacagtaca

SEQ ID NO: 5846485 - DNA, 15 bp, Homo sapiens
atcaaagacacacag

SEQ ID NO: 5846486 - DNA, 23 bp, Homo sapiens
atcaaagaggttttaaaaaaatc

SEQ ID NO: 5846487 - DNA, 16 bp, Homo sapiens
atcaaagcagaagtct

SEQ ID NO: 5846488 - DNA, 15 bp, Homo sapiens
atcaaagcagcacat

SEQ ID NO: 5846489 - DNA, 24 bp, Homo sapiens
atcaaagccggcctgagaaacact

SEQ ID NO: 5846490 - DNA, 16 bp, Homo sapiens
atcaaagctaggaaag

SEQ ID NO: 5846491 - DNA, 14 bp, Homo sapiens
atcaaagctcataa

SEQ ID NO: 5846492 - DNA, 17 bp, Homo sapiens
atcaaaggaatataaga

SEQ ID NO: 5846493 - DNA, 20 bp, Homo sapiens
atcaaaggaatataagaaaa

SEQ ID NO: 5846494 - DNA, 19 bp, Homo sapiens
atcaaaggcagaaaggaga

SEQ ID NO: 5846495 - DNA, 23 bp, Homo sapiens
atcaaagtaaaaaattaaagccc

SEQ ID NO: 5846496 - DNA, 18 bp, Homo sapiens
atcaaagtaggcaggacc

SEQ ID NO: 5846497 - DNA, 13 bp, Homo sapiens
atcaaagtatttg

SEQ ID NO: 5846498 - DNA, 16 bp, Homo sapiens
atcaaagtggtaaata

SEQ ID NO: 5846499 - DNA, 18 bp, Homo sapiens
atcaaagtggtaaatact

SEQ ID NO: 5846500 - DNA, 21 bp, Homo sapiens
atcaaagtggtaaatactgtg

SEQ ID NO: 5846501 - DNA, 23 bp, Homo sapiens
atcaaagtggtaaatactgtgaa

SEQ ID NO: 5846502 - DNA, 13 bp, Homo sapiens
atcaaagtgttta

SEQ ID NO: 5846503 - DNA, 20 bp, Homo sapiens
atcaaagttctgctttctcc

SEQ ID NO: 5846504 - DNA, 20 bp, Homo sapiens
atcaaataataccttagaag

SEQ ID NO: 5846505 - DNA, 14 bp, Homo sapiens
atcaaataatattc

SEQ ID NO: 5846506 - DNA, 22 bp, Homo sapiens
atcaaatactttaaaggaaaaa

SEQ ID NO: 5846507 - DNA, 14 bp, Homo sapiens
atcaaatagcgatg

SEQ ID NO: 5846508 - DNA, 18 bp, Homo sapiens
atcaaatagcgatgtgca

SEQ ID NO: 5846509 - DNA, 18 bp, Homo sapiens
atcaaatatattatttag

SEQ ID NO: 5846510 - DNA, 16 bp, Homo sapiens
atcaaatatgcaaagc

SEQ ID NO: 5846511 - DNA, 20 bp, Homo sapiens
atcaaatatgcaaagcactg

SEQ ID NO: 5846512 - DNA, 14 bp, Homo sapiens
atcaaatattagat

SEQ ID NO: 5846513 - DNA, 21 bp, Homo sapiens
atcaaatattagatgtgattt

SEQ ID NO: 5846514 - DNA, 22 bp, Homo sapiens
atcaaatcatcattaatgactt

SEQ ID NO: 5846515 - DNA, 14 bp, Homo sapiens
atcaaatcattcaa

SEQ ID NO: 5846516 - DNA, 17 bp, Homo sapiens
atcaaatcattcaaaac

SEQ ID NO: 5846517 - DNA, 20 bp, Homo sapiens
atcaaatctaccactgtatg

SEQ ID NO: 5846518 - DNA, 14 bp, Homo sapiens
atcaaatctgagcc

SEQ ID NO: 5846519 - DNA, 15 bp, Homo sapiens
atcaaatctgagcct

SEQ ID NO: 5846520 - DNA, 17 bp, Homo sapiens
atcaaatcttacaaaat

SEQ ID NO: 5846521 - DNA, 15 bp, Homo sapiens
atcaaatgaaaagta

SEQ ID NO: 5846522 - DNA, 17 bp, Homo sapiens
atcaaatgatttcatat

SEQ ID NO: 5846523 - DNA, 19 bp, Homo sapiens
atcaaatgcagtatatttc

SEQ ID NO: 5846524 - DNA, 23 bp, Homo sapiens
atcaaatgccttcatgaatcttt

SEQ ID NO: 5846525 - DNA, 20 bp, Homo sapiens
atcaaatgctgtagaatgct

SEQ ID NO: 5846526 - DNA, 20 bp, Homo sapiens
atcaaatggtagctgaaaaa

SEQ ID NO: 5846527 - DNA, 18 bp, Homo sapiens
atcaaatggtatcttttg

SEQ ID NO: 5846528 - DNA, 15 bp, Homo sapiens
atcaaatgtaaatca

SEQ ID NO: 5846529 - DNA, 13 bp, Homo sapiens
atcaaatgtacat

SEQ ID NO: 5846530 - DNA, 16 bp, Homo sapiens
atcaaatgtatgtatc

SEQ ID NO: 5846531 - DNA, 18 bp, Homo sapiens
atcaaatgttacagttta

SEQ ID NO: 5846532 - DNA, 15 bp, Homo sapiens
atcaaatgtttaatc

SEQ ID NO: 5846533 - DNA, 22 bp, Homo sapiens
atcaaatgtttaatcatataaa

SEQ ID NO: 5846534 - DNA, 18 bp, Homo sapiens
atcaaattctacaacttt

SEQ ID NO: 5846535 - DNA, 22 bp, Homo sapiens
atcaaatttcacgtcgtcttct

SEQ ID NO: 5846536 - DNA, 21 bp, Homo sapiens
atcaaatttgtagggtttcta

SEQ ID NO: 5846537 - DNA, 23 bp, Homo sapiens
atcaaattttgccagagaaacta

SEQ ID NO: 5846538 - DNA, 14 bp, Homo sapiens
atcaacaacaagtt

SEQ ID NO: 5846539 - DNA, 18 bp, Homo sapiens
atcaacaagagttgtctt

SEQ ID NO: 5846540 - DNA, 22 bp, Homo sapiens
atcaacaataaaatttttttaa

SEQ ID NO: 5846541 - DNA, 18 bp, Homo sapiens
atcaacaatgattaatca

SEQ ID NO: 5846542 - DNA, 19 bp, Homo sapiens
atcaacaccttaatatgct

SEQ ID NO: 5846543 - DNA, 17 bp, Homo sapiens
atcaacagaagcatttg

SEQ ID NO: 5846544 - DNA, 22 bp, Homo sapiens
atcaacagaagcatttgtattt

SEQ ID NO: 5846545 - DNA, 21 bp, Homo sapiens
atcaacagcatgtctactgct

SEQ ID NO: 5846546 - DNA, 15 bp, Homo sapiens
atcaacagcttccct

SEQ ID NO: 5846547 - DNA, 12 bp, Homo sapiens
atcaacagggca

SEQ ID NO: 5846548 - DNA, 21 bp, Homo sapiens
atcaacatctttttcctccct

SEQ ID NO: 5846549 - DNA, 18 bp, Homo sapiens
atcaacatgttattcaat

SEQ ID NO: 5846550 - DNA, 20 bp, Homo sapiens
atcaacattaggagtaactt

SEQ ID NO: 5846551 - DNA, 21 bp, Homo sapiens
atcaacattaggagtaacttt

SEQ ID NO: 5846552 - DNA, 19 bp, Homo sapiens
atcaacattccagggatga

SEQ ID NO: 5846553 - DNA, 16 bp, Homo sapiens
atcaacattgaatatc

SEQ ID NO: 5846554 - DNA, 14 bp, Homo sapiens
atcaacatttctca

SEQ ID NO: 5846555 - DNA, 21 bp, Homo sapiens
atcaaccaaagttagttcagt

SEQ ID NO: 5846556 - DNA, 23 bp, Homo sapiens
atcaaccaactgcacaatcagtt

SEQ ID NO: 5846557 - DNA, 15 bp, Homo sapiens
atcaaccaagttaca

SEQ ID NO: 5846558 - DNA, 23 bp, Homo sapiens
atcaaccaccatggatttttaca

SEQ ID NO: 5846559 - DNA, 14 bp, Homo sapiens
atcaaccaggaaga

SEQ ID NO: 5846560 - DNA, 19 bp, Homo sapiens
atcaaccccttcgctcctg

SEQ ID NO: 5846561 - DNA, 16 bp, Homo sapiens
atcaaccctctcctgt

SEQ ID NO: 5846562 - DNA, 21 bp, Homo sapiens
atcaacctgcacttcatatct

SEQ ID NO: 5846563 - DNA, 18 bp, Homo sapiens
atcaactaaagttgtact

SEQ ID NO: 5846564 - DNA, 20 bp, Homo sapiens
atcaactaaagttgtacttt

SEQ ID NO: 5846565 - DNA, 15 bp, Homo sapiens
atcaactactattca

SEQ ID NO: 5846566 - DNA, 17 bp, Homo sapiens
atcaactactattcaaa

SEQ ID NO: 5846567 - DNA, 15 bp, Homo sapiens
atcaactccagctcc

SEQ ID NO: 5846568 - DNA, 14 bp, Homo sapiens
atcaactcccaact

SEQ ID NO: 5846569 - DNA, 18 bp, Homo sapiens
atcaactcccaacttctt

SEQ ID NO: 5846570 - DNA, 12 bp, Homo sapiens
atcaactctgaa

SEQ ID NO: 5846571 - DNA, 13 bp, Homo sapiens
atcaactctgaag

SEQ ID NO: 5846572 - DNA, 21 bp, Homo sapiens
atcaactctgaagctaattgt

SEQ ID NO: 5846573 - DNA, 21 bp, Homo sapiens
atcaactggagtctatgctta

SEQ ID NO: 5846574 - DNA, 19 bp, Homo sapiens
atcaactgggctgaacact

SEQ ID NO: 5846575 - DNA, 20 bp, Homo sapiens
atcaactggggggaccaaat

SEQ ID NO: 5846576 - DNA, 21 bp, Homo sapiens
atcaactggggggaccaaata

SEQ ID NO: 5846577 - DNA, 18 bp, Homo sapiens
atcaactgtcaaatatgt

SEQ ID NO: 5846578 - DNA, 16 bp, Homo sapiens
atcaacttgtcacaaa

SEQ ID NO: 5846579 - DNA, 16 bp, Homo sapiens
atcaacttgtgtactg

SEQ ID NO: 5846580 - DNA, 21 bp, Homo sapiens
atcaactttaatcaagttgta

SEQ ID NO: 5846581 - DNA, 14 bp, Homo sapiens
atcaactttactgt

SEQ ID NO: 5846582 - DNA, 15 bp, Homo sapiens
atcaacttttgaaat

SEQ ID NO: 5846583 - DNA, 23 bp, Homo sapiens
atcaacttttgaaatttaaaaat

SEQ ID NO: 5846584 - DNA, 20 bp, Homo sapiens
atcaactttttattgccttc

SEQ ID NO: 5846585 - DNA, 16 bp, Homo sapiens
atcaagaaaacagcaa

SEQ ID NO: 5846586 - DNA, 16 bp, Homo sapiens
atcaagaaatactttc

SEQ ID NO: 5846587 - DNA, 14 bp, Homo sapiens
atcaagaagggctg

SEQ ID NO: 5846588 - DNA, 16 bp, Homo sapiens
atcaagaagggctgca

SEQ ID NO: 5846589 - DNA, 19 bp, Homo sapiens
atcaagaagggctgcatga

SEQ ID NO: 5846590 - DNA, 20 bp, Homo sapiens
atcaagaagggctgcatgat

SEQ ID NO: 5846591 - DNA, 17 bp, Homo sapiens
atcaagaatagttgtca

SEQ ID NO: 5846592 - DNA, 13 bp, Homo sapiens
atcaagaatcttt

SEQ ID NO: 5846593 - DNA, 22 bp, Homo sapiens
atcaagaattagaagtctttca

SEQ ID NO: 5846594 - DNA, 15 bp, Homo sapiens
atcaagaccaaagag

SEQ ID NO: 5846595 - DNA, 21 bp, Homo sapiens
atcaagagaatcaacagatga

SEQ ID NO: 5846596 - DNA, 18 bp, Homo sapiens
atcaagagactcctgaag

SEQ ID NO: 5846597 - DNA, 15 bp, Homo sapiens
atcaagagagacaaa

SEQ ID NO: 5846598 - DNA, 21 bp, Homo sapiens
atcaagagcattgcttttgtt

SEQ ID NO: 5846599 - DNA, 15 bp, Homo sapiens
atcaagagccttaaa

SEQ ID NO: 5846600 - DNA, 16 bp, Homo sapiens
atcaagagccttaaaa

SEQ ID NO: 5846601 - DNA, 21 bp, Homo sapiens
atcaagagccttaaaacatca

SEQ ID NO: 5846602 - DNA, 17 bp, Homo sapiens
atcaagagctgccctcc

SEQ ID NO: 5846603 - DNA, 23 bp, Homo sapiens
atcaagaggacaatctagctctc

SEQ ID NO: 5846604 - DNA, 19 bp, Homo sapiens
atcaagagtccggatttct

SEQ ID NO: 5846605 - DNA, 12 bp, Homo sapiens
atcaagagtctc

SEQ ID NO: 5846606 - DNA, 17 bp, Homo sapiens
atcaagagtctctccag

SEQ ID NO: 5846607 - DNA, 22 bp, Homo sapiens
atcaagagtctctccagcctca

SEQ ID NO: 5846608 - DNA, 16 bp, Homo sapiens
atcaagataaaggaca

SEQ ID NO: 5846609 - DNA, 13 bp, Homo sapiens
atcaagatacctt

SEQ ID NO: 5846610 - DNA, 22 bp, Homo sapiens
atcaagatgggtgattatgaaa

SEQ ID NO: 5846611 - DNA, 17 bp, Homo sapiens
atcaagatttggcagga

SEQ ID NO: 5846612 - DNA, 17 bp, Homo sapiens
atcaagatttttttcct

SEQ ID NO: 5846613 - DNA, 19 bp, Homo sapiens
atcaagcaaaatttctgta

SEQ ID NO: 5846614 - DNA, 15 bp, Homo sapiens
atcaagcacactgta

SEQ ID NO: 5846615 - DNA, 18 bp, Homo sapiens
atcaagcacttcccagga

SEQ ID NO: 5846616 - DNA, 19 bp, Homo sapiens
atcaagcacttcccaggat

SEQ ID NO: 5846617 - DNA, 13 bp, Homo sapiens
atcaagcagaaaa

SEQ ID NO: 5846618 - DNA, 14 bp, Homo sapiens
atcaagcagccaag

SEQ ID NO: 5846619 - DNA, 15 bp, Homo sapiens
atcactatccatgca

SEQ ID NO: 5846620 - DNA, 14 bp, Homo sapiens
atcactattcttaa

SEQ ID NO: 5846621 - DNA, 20 bp, Homo sapiens
atcactattgggcccccagg

SEQ ID NO: 5846622 - DNA, 15 bp, Homo sapiens
atcactcactcactc

SEQ ID NO: 5846623 - DNA, 16 bp, Homo sapiens
atcactcactcactcc

SEQ ID NO: 5846624 - DNA, 18 bp, Homo sapiens
atcactcactcactcccc

SEQ ID NO: 5846625 - DNA, 19 bp, Homo sapiens
atcactcactcactcccca

SEQ ID NO: 5846626 - DNA, 15 bp, Homo sapiens
atcactcagccccta

SEQ ID NO: 5846627 - DNA, 18 bp, Homo sapiens
atcactcatttatttcca

SEQ ID NO: 5846628 - DNA, 12 bp, Homo sapiens
atcactcccagc

SEQ ID NO: 5846629 - DNA, 18 bp, Homo sapiens
atcactccccaaggaaga

SEQ ID NO: 5846630 - DNA, 12 bp, Homo sapiens
atcactcccctc

SEQ ID NO: 5846631 - DNA, 12 bp, Homo sapiens
atcactccctgg

SEQ ID NO: 5846632 - DNA, 11 bp, Homo sapiens
atcactcctgg

SEQ ID NO: 5846633 - DNA, 16 bp, Homo sapiens
atcactcgcaggacca

SEQ ID NO: 5846634 - DNA, 15 bp, Homo sapiens
atcactctaaaaaac

SEQ ID NO: 5846635 - DNA, 17 bp, Homo sapiens
atcactctaaaaaacat

SEQ ID NO: 5846636 - DNA, 18 bp, Homo sapiens
atcactctaaaaaacatt

SEQ ID NO: 5846637 - DNA, 14 bp, Homo sapiens
atcactctagaaaa

SEQ ID NO: 5846638 - DNA, 18 bp, Homo sapiens
atcactctaggttttaca

SEQ ID NO: 5846639 - DNA, 15 bp, Homo sapiens
atcactctctgctgg

SEQ ID NO: 5846640 - DNA, 19 bp, Homo sapiens
atcactctgttcattcctc

SEQ ID NO: 5846641 - DNA, 12 bp, Homo sapiens
atcactgaaaaa

SEQ ID NO: 5846642 - DNA, 18 bp, Homo sapiens
atcactgaaatccctcta

SEQ ID NO: 5846643 - DNA, 14 bp, Homo sapiens
atcactgaactttg

SEQ ID NO: 5846644 - DNA, 15 bp, Homo sapiens
atcactgaacttttc

SEQ ID NO: 5846645 - DNA, 18 bp, Homo sapiens
atcactgaacttttcaaa

SEQ ID NO: 5846646 - DNA, 22 bp, Homo sapiens
atcactgaacttttcaaaataa

SEQ ID NO: 5846647 - DNA, 19 bp, Homo sapiens
atcactgacacatcagcat

SEQ ID NO: 5846648 - DNA, 17 bp, Homo sapiens
atcactgagagtcagga

SEQ ID NO: 5846649 - DNA, 20 bp, Homo sapiens
atcactgagccatcatttcc

SEQ ID NO: 5846650 - DNA, 23 bp, Homo sapiens
atcactgagccatcatttcctgg

SEQ ID NO: 5846651 - DNA, 14 bp, Homo sapiens
atcactgagtttgt

SEQ ID NO: 5846652 - DNA, 20 bp, Homo sapiens
atcactgatcattagagaaa

SEQ ID NO: 5846653 - DNA, 18 bp, Homo sapiens
atcactgattccctctcc

SEQ ID NO: 5846654 - DNA, 15 bp, Homo sapiens
atcactgattgggtg

SEQ ID NO: 5846655 - DNA, 14 bp, Homo sapiens
atcactgcagccca

SEQ ID NO: 5846656 - DNA, 21 bp, Homo sapiens
atcactgcagtcacctcttct

SEQ ID NO: 5846657 - DNA, 21 bp, Homo sapiens
atcactgcattcattctgagc

SEQ ID NO: 5846658 - DNA, 18 bp, Homo sapiens
atcactgccacactctcc

SEQ ID NO: 5846659 - DNA, 19 bp, Homo sapiens
atcactgccacactctcca

SEQ ID NO: 5846660 - DNA, 20 bp, Homo sapiens
atcactgccacactctccat

SEQ ID NO: 5846661 - DNA, 20 bp, Homo sapiens
atcactgccttggcccctcc

SEQ ID NO: 5846662 - DNA, 22 bp, Homo sapiens
atcactgccttggcccctccct

SEQ ID NO: 5846663 - DNA, 15 bp, Homo sapiens
atcactgctccaggc

SEQ ID NO: 5846664 - DNA, 18 bp, Homo sapiens
atcactgctgctgggact

SEQ ID NO: 5846665 - DNA, 17 bp, Homo sapiens
atcactgctttttcctt

SEQ ID NO: 5846666 - DNA, 14 bp, Homo sapiens
atcactggagccca

SEQ ID NO: 5846667 - DNA, 22 bp, Homo sapiens
atcactggcaatgaaaaattct

SEQ ID NO: 5846668 - DNA, 14 bp, Homo sapiens
atcactgggcccag

SEQ ID NO: 5846669 - DNA, 17 bp, Homo sapiens
atcactgggcccagagg

SEQ ID NO: 5846670 - DNA, 24 bp, Homo sapiens
atcactggggatggtggcacaggc

SEQ ID NO: 5846671 - DNA, 18 bp, Homo sapiens
atcactggtatacacact

SEQ ID NO: 5846672 - DNA, 21 bp, Homo sapiens
atcactggtatgatgtatatt

SEQ ID NO: 5846673 - DNA, 22 bp, Homo sapiens
atcactggttgcacttatgatt

SEQ ID NO: 5846674 - DNA, 15 bp, Homo sapiens
atcactgtaacctga

SEQ ID NO: 5846675 - DNA, 17 bp, Homo sapiens
atcactgtaacctgatt

SEQ ID NO: 5846676 - DNA, 18 bp, Homo sapiens
atcactgtatcattttct

SEQ ID NO: 5846677 - DNA, 12 bp, Homo sapiens
atcactgtatcc

SEQ ID NO: 5846678 - DNA, 13 bp, Homo sapiens
atcactgtatttt

SEQ ID NO: 5846679 - DNA, 14 bp, Homo sapiens
atcactgtctttcc

SEQ ID NO: 5846680 - DNA, 16 bp, Homo sapiens
atcactgtctttccta

SEQ ID NO: 5846681 - DNA, 15 bp, Homo sapiens
atcactgtgaaattt

SEQ ID NO: 5846682 - DNA, 16 bp, Homo sapiens
atcactgtgaaatttc

SEQ ID NO: 5846683 - DNA, 15 bp, Homo sapiens
atcactgtggctgtc

SEQ ID NO: 5846684 - DNA, 15 bp, Homo sapiens
atcactgtgtatatt

SEQ ID NO: 5846685 - DNA, 10 bp, Homo sapiens
atcactgttt

SEQ ID NO: 5846686 - DNA, 18 bp, Homo sapiens
atcactgtttagaacaca

SEQ ID NO: 5846687 - DNA, 16 bp, Homo sapiens
atcactgtttagattt

SEQ ID NO: 5846688 - DNA, 23 bp, Homo sapiens
atcactgtttgtttttaaaaagc

SEQ ID NO: 5846689 - DNA, 15 bp, Homo sapiens
atcactgtttttaga

SEQ ID NO: 5846690 - DNA, 14 bp, Homo sapiens
atcacttaaaacac

SEQ ID NO: 5846691 - DNA, 14 bp, Homo sapiens
atcacttaaacttg

SEQ ID NO: 5846692 - DNA, 14 bp, Homo sapiens
atcacttaaaggca

SEQ ID NO: 5846693 - DNA, 13 bp, Homo sapiens
atcacttaaatcg

SEQ ID NO: 5846694 - DNA, 23 bp, Homo sapiens
atcacttaacattcctaaaatgc

SEQ ID NO: 5846695 - DNA, 17 bp, Homo sapiens
atcacttaagcccagga

SEQ ID NO: 5846696 - DNA, 14 bp, Homo sapiens
atcacttaatgaac

SEQ ID NO: 5846697 - DNA, 18 bp, Homo sapiens
atcacttaatttgaaatc

SEQ ID NO: 5846698 - DNA, 14 bp, Homo sapiens
atcacttacatttt

SEQ ID NO: 5846699 - DNA, 20 bp, Homo sapiens
atcacttaggagaagtcttc

SEQ ID NO: 5846700 - DNA, 14 bp, Homo sapiens
atcacttcagatct

SEQ ID NO: 5846701 - DNA, 15 bp, Homo sapiens
atcacttcagatctc

SEQ ID NO: 5846702 - DNA, 14 bp, Homo sapiens
atcacttcttccac

SEQ ID NO: 5846703 - DNA, 16 bp, Homo sapiens
atcacttcttccactg

SEQ ID NO: 5846704 - DNA, 19 bp, Homo sapiens
atcacttcttccactgtgt

SEQ ID NO: 5846705 - DNA, 23 bp, Homo sapiens
atcacttgaatccattgaaagtg

SEQ ID NO: 5846706 - DNA, 17 bp, Homo sapiens
atcacttgagcccagga

SEQ ID NO: 5846707 - DNA, 19 bp, Homo sapiens
atcacttgaggtcaggagt

SEQ ID NO: 5846708 - DNA, 15 bp, Homo sapiens
atcacttgattcata

SEQ ID NO: 5846709 - DNA, 18 bp, Homo sapiens
atcacttgattcataaag

SEQ ID NO: 5846710 - DNA, 11 bp, Homo sapiens
atcacttgtaa

SEQ ID NO: 5846711 - DNA, 12 bp, Homo sapiens
atcacttgtaaa

SEQ ID NO: 5846712 - DNA, 13 bp, Homo sapiens
atcacttgtaaat

SEQ ID NO: 5846713 - DNA, 22 bp, Homo sapiens
atcacttgtaaataaatagatt

SEQ ID NO: 5846714 - DNA, 17 bp, Homo sapiens
atcacttgtacaaaata

SEQ ID NO: 5846715 - DNA, 22 bp, Homo sapiens
atcacttgtcctcttgccagct

SEQ ID NO: 5846716 - DNA, 17 bp, Homo sapiens
atcacttgttgttttac

SEQ ID NO: 5846717 - DNA, 20 bp, Homo sapiens
atcacttgttttattgactg

SEQ ID NO: 5846718 - DNA, 23 bp, Homo sapiens
atcactttaactcaggaggcaga

SEQ ID NO: 5846719 - DNA, 17 bp, Homo sapiens
atcactttacctgcagg

SEQ ID NO: 5846720 - DNA, 12 bp, Homo sapiens
atcactttcata

SEQ ID NO: 5846721 - DNA, 21 bp, Homo sapiens
atcactttgtctaactcagaa

SEQ ID NO: 5846722 - DNA, 13 bp, Homo sapiens
atcacttttcagt

SEQ ID NO: 5846723 - DNA, 15 bp, Homo sapiens
atcacttttcagtga

SEQ ID NO: 5846724 - DNA, 14 bp, Homo sapiens
atcacttttctgta

SEQ ID NO: 5846725 - DNA, 16 bp, Homo sapiens
atcactttttgaacta

SEQ ID NO: 5846726 - DNA, 21 bp, Homo sapiens
atcactttttggaattgtctt

SEQ ID NO: 5846727 - DNA, 15 bp, Homo sapiens
atcagaaaaagcata

SEQ ID NO: 5846728 - DNA, 22 bp, Homo sapiens
atcagaaaacagggtccaggaa

SEQ ID NO: 5846729 - DNA, 15 bp, Homo sapiens
atcagaaaaccaaag

SEQ ID NO: 5846730 - DNA, 14 bp, Homo sapiens
atcagaaaagctat

SEQ ID NO: 5846731 - DNA, 16 bp, Homo sapiens
atcagaaaagctatta

SEQ ID NO: 5846732 - DNA, 18 bp, Homo sapiens
atcagaaaagtaattttg

SEQ ID NO: 5846733 - DNA, 16 bp, Homo sapiens
atcagaaaagtagaat

SEQ ID NO: 5846734 - DNA, 18 bp, Homo sapiens
atcagaaaagtagaatta

SEQ ID NO: 5846735 - DNA, 18 bp, Homo sapiens
atcagaaaataaaatatt

SEQ ID NO: 5846736 - DNA, 20 bp, Homo sapiens
atcagaaaataaaatattca

SEQ ID NO: 5846737 - DNA, 16 bp, Homo sapiens
atcagaaacaccctca

SEQ ID NO: 5846738 - DNA, 18 bp, Homo sapiens
atcagaaagaaaaaattt

SEQ ID NO: 5846739 - DNA, 19 bp, Homo sapiens
atcagaaagacattcttag

SEQ ID NO: 5846740 - DNA, 16 bp, Homo sapiens
atcagaaataataaaa

SEQ ID NO: 5846741 - DNA, 19 bp, Homo sapiens
atcagaaatacagattttg

SEQ ID NO: 5846742 - DNA, 15 bp, Homo sapiens
atcagaaataggaag

SEQ ID NO: 5846743 - DNA, 17 bp, Homo sapiens
atcagaaataggaagat

SEQ ID NO: 5846744 - DNA, 17 bp, Homo sapiens
atcagaaatcctctgtt

SEQ ID NO: 5846745 - DNA, 22 bp, Homo sapiens
atcagaaatcctctgttaatgt

SEQ ID NO: 5846746 - DNA, 15 bp, Homo sapiens
atcagaacaaaactt

SEQ ID NO: 5846747 - DNA, 14 bp, Homo sapiens
atcagaacagctgt

SEQ ID NO: 5846748 - DNA, 18 bp, Homo sapiens
atcagaacattcagctct

SEQ ID NO: 5846749 - DNA, 23 bp, Homo sapiens
atcagaactcaaatggggccaga

SEQ ID NO: 5846750 - DNA, 20 bp, Homo sapiens
atcagaactcttcctcctcc

SEQ ID NO: 5846751 - DNA, 23 bp, Homo sapiens
atcagaagaccacaaaaattgac

SEQ ID NO: 5846752 - DNA, 13 bp, Homo sapiens
atcagaagataac

SEQ ID NO: 5846753 - DNA, 17 bp, Homo sapiens
atcagaagataacttga

SEQ ID NO: 5846754 - DNA, 13 bp, Homo sapiens
atcagaagcacaa

SEQ ID NO: 5846755 - DNA, 12 bp, Homo sapiens
atcagaaggaga

SEQ ID NO: 5846756 - DNA, 21 bp, Homo sapiens
atcagaagtaactcccactcc

SEQ ID NO: 5846757 - DNA, 16 bp, Homo sapiens
atcagaagtaggaagg

SEQ ID NO: 5846758 - DNA, 12 bp, Homo sapiens
atcagaagtttg

SEQ ID NO: 5846759 - DNA, 18 bp, Homo sapiens
atcagaataaagttgtat

SEQ ID NO: 5846760 - DNA, 19 bp, Homo sapiens
atcagaatacttgcactct

SEQ ID NO: 5846761 - DNA, 20 bp, Homo sapiens
atcagaatacttgcactctt

SEQ ID NO: 5846762 - DNA, 22 bp, Homo sapiens
atcagaatagccacatttggaa

SEQ ID NO: 5846763 - DNA, 15 bp, Homo sapiens
atcagaataggaaga

SEQ ID NO: 5846764 - DNA, 19 bp, Homo sapiens
atcagaatatcacagaaaa

SEQ ID NO: 5846765 - DNA, 20 bp, Homo sapiens
atcagaatatgattcactat

SEQ ID NO: 5846766 - DNA, 16 bp, Homo sapiens
atcagaatatgttgct

SEQ ID NO: 5846767 - DNA, 15 bp, Homo sapiens
atcagaatctgaaaa

SEQ ID NO: 5846768 - DNA, 13 bp, Homo sapiens
atcagaatcttgt

SEQ ID NO: 5846769 - DNA, 17 bp, Homo sapiens
atcagaatctttaaaga

SEQ ID NO: 5846770 - DNA, 21 bp, Homo sapiens
atcagaatgaaccctcctcct

SEQ ID NO: 5846771 - DNA, 23 bp, Homo sapiens
atcagaatgaaccctcctccttt

SEQ ID NO: 5846772 - DNA, 20 bp, Homo sapiens
atcagaatggaagagagaaa

SEQ ID NO: 5846773 - DNA, 23 bp, Homo sapiens
atcagaatgttaatttattttgc

SEQ ID NO: 5846774 - DNA, 11 bp, Homo sapiens
atcagaattct

SEQ ID NO: 5846775 - DNA, 12 bp, Homo sapiens
atcagaattctc

SEQ ID NO: 5846776 - DNA, 14 bp, Homo sapiens
atcagaattttacc

SEQ ID NO: 5846777 - DNA, 15 bp, Homo sapiens
atcagacaagcttga

SEQ ID NO: 5846778 - DNA, 13 bp, Homo sapiens
atcagacacaatt

SEQ ID NO: 5846779 - DNA, 15 bp, Homo sapiens
atcagacacaattag

SEQ ID NO: 5846780 - DNA, 17 bp, Homo sapiens
atcagacaccagatttt

SEQ ID NO: 5846781 - DNA, 14 bp, Homo sapiens
atcagacagcagga

SEQ ID NO: 5846782 - DNA, 20 bp, Homo sapiens
atcagacagtggatgagaca

SEQ ID NO: 5846783 - DNA, 17 bp, Homo sapiens
atcagacatacagctgc

SEQ ID NO: 5846784 - DNA, 20 bp, Homo sapiens
atcagacccaacccatgaag

SEQ ID NO: 5846785 - DNA, 18 bp, Homo sapiens
atcagaccctaccccacc

SEQ ID NO: 5846786 - DNA, 20 bp, Homo sapiens
atcagaccctaccccaccac

SEQ ID NO: 5846787 - DNA, 20 bp, Homo sapiens
atcagacctgggtggaactc

SEQ ID NO: 5846788 - DNA, 12 bp, Homo sapiens
atcagacctgtc

SEQ ID NO: 5846789 - DNA, 22 bp, Homo sapiens
atcagaccttggatcagatgaa

SEQ ID NO: 5846790 - DNA, 17 bp, Homo sapiens
atcagactaagccagca

SEQ ID NO: 5846791 - DNA, 13 bp, Homo sapiens
atcagacttgatt

SEQ ID NO: 5846792 - DNA, 17 bp, Homo sapiens
atcagagaagcagcatc

SEQ ID NO: 5846793 - DNA, 15 bp, Homo sapiens
atcagagaataaaca

SEQ ID NO: 5846794 - DNA, 19 bp, Homo sapiens
atcagagaataaacatcat

SEQ ID NO: 5846795 - DNA, 14 bp, Homo sapiens
atcagagagcctag

SEQ ID NO: 5846796 - DNA, 17 bp, Homo sapiens
atcagagataaagctta

SEQ ID NO: 5846797 - DNA, 23 bp, Homo sapiens
atcagagataaagcttaggtcaa

SEQ ID NO: 5846798 - DNA, 22 bp, Homo sapiens
atcagagatgcaccaccaagcc

SEQ ID NO: 5846799 - DNA, 17 bp, Homo sapiens
atcataagatatttttc

SEQ ID NO: 5846800 - DNA, 17 bp, Homo sapiens
atcataaggaagttatt

SEQ ID NO: 5846801 - DNA, 21 bp, Homo sapiens
atcataaggagttggtgtaat

SEQ ID NO: 5846802 - DNA, 24 bp, Homo sapiens
atcataaggagttggtgtaatcat

SEQ ID NO: 5846803 - DNA, 13 bp, Homo sapiens
atcataaggcttc

SEQ ID NO: 5846804 - DNA, 19 bp, Homo sapiens
atcataagtatttggaatt

SEQ ID NO: 5846805 - DNA, 23 bp, Homo sapiens
atcataagtatttggaattagaa

SEQ ID NO: 5846806 - DNA, 18 bp, Homo sapiens
atcataagtgaatttata

SEQ ID NO: 5846807 - DNA, 23 bp, Homo sapiens
atcataatgtaactgaagcataa

SEQ ID NO: 5846808 - DNA, 20 bp, Homo sapiens
atcataatgtattatttaaa

SEQ ID NO: 5846809 - DNA, 14 bp, Homo sapiens
atcataattacatt

SEQ ID NO: 5846810 - DNA, 16 bp, Homo sapiens
atcataattacattcc

SEQ ID NO: 5846811 - DNA, 13 bp, Homo sapiens
atcataatttctt

SEQ ID NO: 5846812 - DNA, 15 bp, Homo sapiens
atcatacaaactctc

SEQ ID NO: 5846813 - DNA, 17 bp, Homo sapiens
atcatacacttccttct

SEQ ID NO: 5846814 - DNA, 12 bp, Homo sapiens
atcatacagttt

SEQ ID NO: 5846815 - DNA, 18 bp, Homo sapiens
atcatactcctatgcttt

SEQ ID NO: 5846816 - DNA, 19 bp, Homo sapiens
atcatactcctatgcttta

SEQ ID NO: 5846817 - DNA, 14 bp, Homo sapiens
atcatactcttcta

SEQ ID NO: 5846818 - DNA, 21 bp, Homo sapiens
atcatactgttttgaataaat

SEQ ID NO: 5846819 - DNA, 19 bp, Homo sapiens
atcatacttaacatttcat

SEQ ID NO: 5846820 - DNA, 21 bp, Homo sapiens
atcatagaattgcagtcattt

SEQ ID NO: 5846821 - DNA, 17 bp, Homo sapiens
atcatagacccatctgg

SEQ ID NO: 5846822 - DNA, 14 bp, Homo sapiens
atcatagagaaacc

SEQ ID NO: 5846823 - DNA, 18 bp, Homo sapiens
atcatagcaagacctcat

SEQ ID NO: 5846824 - DNA, 20 bp, Homo sapiens
atcatagctcactgcagcct

SEQ ID NO: 5846825 - DNA, 15 bp, Homo sapiens
atcatagcttgtttt

SEQ ID NO: 5846826 - DNA, 22 bp, Homo sapiens
atcataggaagggaccaaggca

SEQ ID NO: 5846827 - DNA, 19 bp, Homo sapiens
atcataggaagtggctggt

SEQ ID NO: 5846828 - DNA, 22 bp, Homo sapiens
atcataggcaccttttactgtg

SEQ ID NO: 5846829 - DNA, 23 bp, Homo sapiens
atcataggcaccttttactgtga

SEQ ID NO: 5846830 - DNA, 15 bp, Homo sapiens
atcataggctgacac

SEQ ID NO: 5846831 - DNA, 19 bp, Homo sapiens
atcataggggcatagccag

SEQ ID NO: 5846832 - DNA, 18 bp, Homo sapiens
atcataggtacaatcttt

SEQ ID NO: 5846833 - DNA, 19 bp, Homo sapiens
atcatagttactgtgtaaa

SEQ ID NO: 5846834 - DNA, 14 bp, Homo sapiens
atcatagttgcaaa

SEQ ID NO: 5846835 - DNA, 14 bp, Homo sapiens
atcatagttttatt

SEQ ID NO: 5846836 - DNA, 23 bp, Homo sapiens
atcatagttttatttatatttat

SEQ ID NO: 5846837 - DNA, 14 bp, Homo sapiens
atcatataaataga

SEQ ID NO: 5846838 - DNA, 19 bp, Homo sapiens
atcatataaatagaatgta

SEQ ID NO: 5846839 - DNA, 21 bp, Homo sapiens
atcatataaatagaatgtaaa

SEQ ID NO: 5846840 - DNA, 22 bp, Homo sapiens
atcatataaatagaatgtaaat

SEQ ID NO: 5846841 - DNA, 13 bp, Homo sapiens
atcatataaatat

SEQ ID NO: 5846842 - DNA, 18 bp, Homo sapiens
atcatatacaaatgtttt

SEQ ID NO: 5846843 - DNA, 19 bp, Homo sapiens
atcatatagaccaattgaa

SEQ ID NO: 5846844 - DNA, 15 bp, Homo sapiens
atcatatataaaagt

SEQ ID NO: 5846845 - DNA, 20 bp, Homo sapiens
atcatatatatacatacatg

SEQ ID NO: 5846846 - DNA, 14 bp, Homo sapiens
atcatatatcataa

SEQ ID NO: 5846847 - DNA, 12 bp, Homo sapiens
atcatatatgct

SEQ ID NO: 5846848 - DNA, 21 bp, Homo sapiens
atcatatatttaacaatgaca

SEQ ID NO: 5846849 - DNA, 17 bp, Homo sapiens
atcatatcataggtaca

SEQ ID NO: 5846850 - DNA, 18 bp, Homo sapiens
atcatatcataggtacaa

SEQ ID NO: 5846851 - DNA, 16 bp, Homo sapiens
atcatatccttgccct

SEQ ID NO: 5846852 - DNA, 22 bp, Homo sapiens
atcatatcctttgccccaaggc

SEQ ID NO: 5846853 - DNA, 16 bp, Homo sapiens
atcatatctgtatgcc

SEQ ID NO: 5846854 - DNA, 19 bp, Homo sapiens
atcatatgaattgctgtct

SEQ ID NO: 5846855 - DNA, 20 bp, Homo sapiens
atcatatgaattgctgtcta

SEQ ID NO: 5846856 - DNA, 23 bp, Homo sapiens
atcatatgacatgccaccctctc

SEQ ID NO: 5846857 - DNA, 21 bp, Homo sapiens
atcatatgaccattgaaaaag

SEQ ID NO: 5846858 - DNA, 21 bp, Homo sapiens
atcatatgaggacctttatat

SEQ ID NO: 5846859 - DNA, 19 bp, Homo sapiens
atcatatgattctgctttt

SEQ ID NO: 5846860 - DNA, 14 bp, Homo sapiens
atcatatgcctgac

SEQ ID NO: 5846861 - DNA, 19 bp, Homo sapiens
atcatatggtaggaccctc

SEQ ID NO: 5846862 - DNA, 20 bp, Homo sapiens
atcatatgtatctaaatgaa

SEQ ID NO: 5846863 - DNA, 13 bp, Homo sapiens
atcatatgtgatc

SEQ ID NO: 5846864 - DNA, 18 bp, Homo sapiens
atcatatgtgatctgtct

SEQ ID NO: 5846865 - DNA, 21 bp, Homo sapiens
atcatatgttagatacacaaa

SEQ ID NO: 5846866 - DNA, 21 bp, Homo sapiens
atcatattaaaattacagatg

SEQ ID NO: 5846867 - DNA, 15 bp, Homo sapiens
atcatattatacaga

SEQ ID NO: 5846868 - DNA, 14 bp, Homo sapiens
atcatattattatc

SEQ ID NO: 5846869 - DNA, 20 bp, Homo sapiens
atcatattctaaaagtaata

SEQ ID NO: 5846870 - DNA, 15 bp, Homo sapiens
atcatattctattgt

SEQ ID NO: 5846871 - DNA, 17 bp, Homo sapiens
atcatattctattgttt

SEQ ID NO: 5846872 - DNA, 17 bp, Homo sapiens
atcatattgagaataat

SEQ ID NO: 5846873 - DNA, 18 bp, Homo sapiens
atcatattgatgaaaaga

SEQ ID NO: 5846874 - DNA, 21 bp, Homo sapiens
atcatattggtattcactaat

SEQ ID NO: 5846875 - DNA, 16 bp, Homo sapiens
atcatattgtatgtaa

SEQ ID NO: 5846876 - DNA, 14 bp, Homo sapiens
atcatatttgaaaa

SEQ ID NO: 5846877 - DNA, 15 bp, Homo sapiens
atcatcaaaaagaaa

SEQ ID NO: 5846878 - DNA, 13 bp, Homo sapiens
atcatcaaaaagt

SEQ ID NO: 5846879 - DNA, 15 bp, Homo sapiens
atcatcaaagtgttt

SEQ ID NO: 5846880 - DNA, 16 bp, Homo sapiens
atcatcaaagtgttta

SEQ ID NO: 5846881 - DNA, 20 bp, Homo sapiens
atcatcaacaagatttcctt

SEQ ID NO: 5846882 - DNA, 16 bp, Homo sapiens
atcatcaagaagggct

SEQ ID NO: 5846883 - DNA, 17 bp, Homo sapiens
atcatcaagaagggctg

SEQ ID NO: 5846884 - DNA, 22 bp, Homo sapiens
atcatcaagaagggctgcatga

SEQ ID NO: 5846885 - DNA, 13 bp, Homo sapiens
atcatcaaggcac

SEQ ID NO: 5846886 - DNA, 17 bp, Homo sapiens
atcatcaatctttatgt

SEQ ID NO: 5846887 - DNA, 20 bp, Homo sapiens
atcatcacaacctaaatgga

SEQ ID NO: 5846888 - DNA, 19 bp, Homo sapiens
atcatcaccgattcttcct

SEQ ID NO: 5846889 - DNA, 22 bp, Homo sapiens
atcatcaccgattcttccttgc

SEQ ID NO: 5846890 - DNA, 22 bp, Homo sapiens
atcatcacgtatgttatacaac

SEQ ID NO: 5846891 - DNA, 14 bp, Homo sapiens
atcatcactgtaaa

SEQ ID NO: 5846892 - DNA, 16 bp, Homo sapiens
atcatcactgtaaaga

SEQ ID NO: 5846893 - DNA, 14 bp, Homo sapiens
atcatcagggcctg

SEQ ID NO: 5846894 - DNA, 19 bp, Homo sapiens
atcatcaggtttactcagt

SEQ ID NO: 5846895 - DNA, 17 bp, Homo sapiens
atcatcagtattgaagc

SEQ ID NO: 5846896 - DNA, 18 bp, Homo sapiens
atcatcagtggagccatg

SEQ ID NO: 5846897 - DNA, 15 bp, Homo sapiens
atcatcagtgtagaa

SEQ ID NO: 5846898 - DNA, 22 bp, Homo sapiens
atcatcatcgttgttattaaag

SEQ ID NO: 5846899 - DNA, 13 bp, Homo sapiens
atcatcatggcca

SEQ ID NO: 5846900 - DNA, 20 bp, Homo sapiens
atcatcatttaaaaaaaaag

SEQ ID NO: 5846901 - DNA, 13 bp, Homo sapiens
atcatccacacat

SEQ ID NO: 5846902 - DNA, 14 bp, Homo sapiens
atcatccacacatg

SEQ ID NO: 5846903 - DNA, 16 bp, Homo sapiens
atcatccacacatgaa

SEQ ID NO: 5846904 - DNA, 15 bp, Homo sapiens
atcatccacgccaag

SEQ ID NO: 5846905 - DNA, 21 bp, Homo sapiens
atcatccattctctctgccca

SEQ ID NO: 5846906 - DNA, 15 bp, Homo sapiens
atcatcccaacagcc

SEQ ID NO: 5846907 - DNA, 18 bp, Homo sapiens
atcatcccaacagccaag

SEQ ID NO: 5846908 - DNA, 23 bp, Homo sapiens
atcatcccatctaagctgcagct

SEQ ID NO: 5846909 - DNA, 14 bp, Homo sapiens
atcatccctattct

SEQ ID NO: 5846910 - DNA, 12 bp, Homo sapiens
atcatccctccc

SEQ ID NO: 5846911 - DNA, 13 bp, Homo sapiens
atcatccctccct

SEQ ID NO: 5846912 - DNA, 14 bp, Homo sapiens
atcatccctccctg

SEQ ID NO: 5846913 - DNA, 12 bp, Homo sapiens
atcatccctttc

SEQ ID NO: 5846914 - DNA, 14 bp, Homo sapiens
atcatccctttctc

SEQ ID NO: 5846915 - DNA, 15 bp, Homo sapiens
atcatcctaagctat

SEQ ID NO: 5846916 - DNA, 16 bp, Homo sapiens
atcatcctcagcagca

SEQ ID NO: 5846917 - DNA, 23 bp, Homo sapiens
atcatcctcagcagcatcgagga

SEQ ID NO: 5846918 - DNA, 20 bp, Homo sapiens
atcatcctcccttttttgta

SEQ ID NO: 5846919 - DNA, 15 bp, Homo sapiens
atcatcctctggctt

SEQ ID NO: 5846920 - DNA, 20 bp, Homo sapiens
atcatcctgaatctgatctt

SEQ ID NO: 5846921 - DNA, 23 bp, Homo sapiens
atcatcctggaggggtgttgtat

SEQ ID NO: 5846922 - DNA, 21 bp, Homo sapiens
atcatcctgttttctctgtga

SEQ ID NO: 5846923 - DNA, 13 bp, Homo sapiens
atcatcctttcca

SEQ ID NO: 5846924 - DNA, 20 bp, Homo sapiens
atcatcctttgttctgagca

SEQ ID NO: 5846925 - DNA, 22 bp, Homo sapiens
atcatcctttgttctgagcatt

SEQ ID NO: 5846926 - DNA, 22 bp, Homo sapiens
atcatcggagttgacagtgaaa

SEQ ID NO: 5846927 - DNA, 19 bp, Homo sapiens
atcatctaattctctgtgg

SEQ ID NO: 5846928 - DNA, 21 bp, Homo sapiens
atcatctattgctggcaaaga

SEQ ID NO: 5846929 - DNA, 21 bp, Homo sapiens
atcatctattttgatgcagca

SEQ ID NO: 5846930 - DNA, 20 bp, Homo sapiens
atcatctcaattttttcaaa

SEQ ID NO: 5846931 - DNA, 13 bp, Homo sapiens
atcatctcagctc

SEQ ID NO: 5846932 - DNA, 19 bp, Homo sapiens
atcatctcagctcactgca

SEQ ID NO: 5846933 - DNA, 14 bp, Homo sapiens
atcatctccaaatc

SEQ ID NO: 5846934 - DNA, 23 bp, Homo sapiens
atcatctccaatggaaagctttt

SEQ ID NO: 5846935 - DNA, 20 bp, Homo sapiens
atcatctcctgccttcctcc

SEQ ID NO: 5846936 - DNA, 16 bp, Homo sapiens
atcatctctgcctttg

SEQ ID NO: 5846937 - DNA, 20 bp, Homo sapiens
atcatctcttaaattttgtt

SEQ ID NO: 5846938 - DNA, 21 bp, Homo sapiens
atcatctcttcctcacaccca

SEQ ID NO: 5846939 - DNA, 16 bp, Homo sapiens
atcatctcttgataaa

SEQ ID NO: 5846940 - DNA, 21 bp, Homo sapiens
atcatctcttttcccactccc

SEQ ID NO: 5846941 - DNA, 23 bp, Homo sapiens
atcatctgaaggggcaaattctt

SEQ ID NO: 5846942 - DNA, 15 bp, Homo sapiens
atcatctgatttact

SEQ ID NO: 5846943 - DNA, 21 bp, Homo sapiens
atcatctgatttactctttgg

SEQ ID NO: 5846944 - DNA, 17 bp, Homo sapiens
atcatctgcagttcttt

SEQ ID NO: 5846945 - DNA, 12 bp, Homo sapiens
atcatctgctgc

SEQ ID NO: 5846946 - DNA, 22 bp, Homo sapiens
atcatctgctgcacatagcaga

SEQ ID NO: 5846947 - DNA, 13 bp, Homo sapiens
atcatctgctgtg

SEQ ID NO: 5846948 - DNA, 14 bp, Homo sapiens
atcatctgtaagct

SEQ ID NO: 5846949 - DNA, 16 bp, Homo sapiens
atcatctgtaagctgt

SEQ ID NO: 5846950 - DNA, 20 bp, Homo sapiens
atcatctgtcattatattct

SEQ ID NO: 5846951 - DNA, 18 bp, Homo sapiens
atcatctgtggaacccat

SEQ ID NO: 5846952 - DNA, 13 bp, Homo sapiens
atcatcttctctt

SEQ ID NO: 5846953 - DNA, 11 bp, Homo sapiens
atcatcttgaa

SEQ ID NO: 5846954 - DNA, 15 bp, Homo sapiens
atcatcttgaacatt

SEQ ID NO: 5846955 - DNA, 17 bp, Homo sapiens
atcatctttatctcctg

SEQ ID NO: 5846956 - DNA, 13 bp, Homo sapiens
atcatctttgctg

SEQ ID NO: 5846957 - DNA, 22 bp, Homo sapiens
atcatctttgctgaatgtcatt

SEQ ID NO: 5846958 - DNA, 15 bp, Homo sapiens
atcatgaaaagtgct

SEQ ID NO: 5846959 - DNA, 13 bp, Homo sapiens
atcatgaaacact

SEQ ID NO: 5846960 - DNA, 14 bp, Homo sapiens
atcatgaaatatgc

SEQ ID NO: 5846961 - DNA, 16 bp, Homo sapiens
atcatgaaatatgcat

SEQ ID NO: 5846962 - DNA, 13 bp, Homo sapiens
atcatgaactggc

SEQ ID NO: 5846963 - DNA, 20 bp, Homo sapiens
atcatgaatatttcaaaata

SEQ ID NO: 5846964 - DNA, 19 bp, Homo sapiens
atcatgaattcccttttaa

SEQ ID NO: 5846965 - DNA, 19 bp, Homo sapiens
atcatgaatttattgcaca

SEQ ID NO: 5846966 - DNA, 14 bp, Homo sapiens
atcatgaattttaa

SEQ ID NO: 5846967 - DNA, 18 bp, Homo sapiens
atcatgacttctttacta

SEQ ID NO: 5846968 - DNA, 15 bp, Homo sapiens
atcatgagattgatg

SEQ ID NO: 5846969 - DNA, 13 bp, Homo sapiens
atcatgagcctgc

SEQ ID NO: 5846970 - DNA, 20 bp, Homo sapiens
atcatgagcctgtttattgc

SEQ ID NO: 5846971 - DNA, 18 bp, Homo sapiens
atcatgagccttcagtca

SEQ ID NO: 5846972 - DNA, 20 bp, Homo sapiens
atcatgaggccggatgaaac

SEQ ID NO: 5846973 - DNA, 18 bp, Homo sapiens
atcatgaggtcaggagtt

SEQ ID NO: 5846974 - DNA, 14 bp, Homo sapiens
atcatgatttccct

SEQ ID NO: 5846975 - DNA, 12 bp, Homo sapiens
atcatgcaaaat

SEQ ID NO: 5846976 - DNA, 23 bp, Homo sapiens
atccaccccagccccactgccct

SEQ ID NO: 5846977 - DNA, 16 bp, Homo sapiens
atccaccccctgccca

SEQ ID NO: 5846978 - DNA, 21 bp, Homo sapiens
atccacccctctggcacctgg

SEQ ID NO: 5846979 - DNA, 21 bp, Homo sapiens
atccacccctgcgtcgagctg

SEQ ID NO: 5846980 - DNA, 20 bp, Homo sapiens
atccacccgccttcagcctc

SEQ ID NO: 5846981 - DNA, 19 bp, Homo sapiens
atccacccgctgcccctcc

SEQ ID NO: 5846982 - DNA, 21 bp, Homo sapiens
atccacccgggggagcccagt

SEQ ID NO: 5846983 - DNA, 22 bp, Homo sapiens
atccaccctcatttttccttta

SEQ ID NO: 5846984 - DNA, 18 bp, Homo sapiens
atccacctatccaccacc

SEQ ID NO: 5846985 - DNA, 22 bp, Homo sapiens
atccacctccatcttctttgca

SEQ ID NO: 5846986 - DNA, 14 bp, Homo sapiens
atccacctccttct

SEQ ID NO: 5846987 - DNA, 15 bp, Homo sapiens
atccacctccttctc

SEQ ID NO: 5846988 - DNA, 14 bp, Homo sapiens
atccacctcggagc

SEQ ID NO: 5846989 - DNA, 18 bp, Homo sapiens
atccacctcggagcatgg

SEQ ID NO: 5846990 - DNA, 17 bp, Homo sapiens
atccacctgcacaaaca

SEQ ID NO: 5846991 - DNA, 18 bp, Homo sapiens
atccacctgcacaaacat

SEQ ID NO: 5846992 - DNA, 22 bp, Homo sapiens
atccacctgcagcccttttagt

SEQ ID NO: 5846993 - DNA, 15 bp, Homo sapiens
atccacctgcagtta

SEQ ID NO: 5846994 - DNA, 17 bp, Homo sapiens
atccacctgccttggct

SEQ ID NO: 5846995 - DNA, 11 bp, Homo sapiens
atccacctggt

SEQ ID NO: 5846996 - DNA, 11 bp, Homo sapiens
atccaccttca

SEQ ID NO: 5846997 - DNA, 16 bp, Homo sapiens
atccaccttcctgccc

SEQ ID NO: 5846998 - DNA, 20 bp, Homo sapiens
atccacgctgggcctaggat

SEQ ID NO: 5846999 - DNA, 21 bp, Homo sapiens
atccacgtattccccttccca

SEQ ID NO: 5847000 - DNA, 16 bp, Homo sapiens
atccactaggtgccca

SEQ ID NO: 5847001 - DNA, 23 bp, Homo sapiens
atccactaggtgcccagtcttga

SEQ ID NO: 5847002 - DNA, 19 bp, Homo sapiens
atccactctaccctcccac

SEQ ID NO: 5847003 - DNA, 16 bp, Homo sapiens
atccactggcattttt

SEQ ID NO: 5847004 - DNA, 21 bp, Homo sapiens
atccactgggtgtaaacacat

SEQ ID NO: 5847005 - DNA, 16 bp, Homo sapiens
atccacttaagttctt

SEQ ID NO: 5847006 - DNA, 20 bp, Homo sapiens
atccacttaagttctttgat

SEQ ID NO: 5847007 - DNA, 22 bp, Homo sapiens
atccacttcttggttcctggga

SEQ ID NO: 5847008 - DNA, 23 bp, Homo sapiens
atccacttcttggttcctgggat

SEQ ID NO: 5847009 - DNA, 14 bp, Homo sapiens
atccacttctttca

SEQ ID NO: 5847010 - DNA, 22 bp, Homo sapiens
atccacttctttcagcagactg

SEQ ID NO: 5847011 - DNA, 23 bp, Homo sapiens
atccactttatcttgaataatgt

SEQ ID NO: 5847012 - DNA, 15 bp, Homo sapiens
atccacttttcttct

SEQ ID NO: 5847013 - DNA, 18 bp, Homo sapiens
atccagaaaactgtgatt

SEQ ID NO: 5847014 - DNA, 22 bp, Homo sapiens
atccagaaaatgtgtcagcatg

SEQ ID NO: 5847015 - DNA, 10 bp, Homo sapiens
atccagaaac

SEQ ID NO: 5847016 - DNA, 19 bp, Homo sapiens
atccagaaacttgttcttc

SEQ ID NO: 5847017 - DNA, 16 bp, Homo sapiens
atccagaaagaaaact

SEQ ID NO: 5847018 - DNA, 18 bp, Homo sapiens
atccagaaagaaaacttg

SEQ ID NO: 5847019 - DNA, 23 bp, Homo sapiens
atccagaaataaaacaactctga

SEQ ID NO: 5847020 - DNA, 21 bp, Homo sapiens
atccagaaataaagtctaaga

SEQ ID NO: 5847021 - DNA, 16 bp, Homo sapiens
atccagaacagtggct

SEQ ID NO: 5847022 - DNA, 18 bp, Homo sapiens
atccagaacagtggctcg

SEQ ID NO: 5847023 - DNA, 15 bp, Homo sapiens
atccagaaggggagc

SEQ ID NO: 5847024 - DNA, 13 bp, Homo sapiens
atccagaagtgta

SEQ ID NO: 5847025 - DNA, 22 bp, Homo sapiens
atccagaagttttaacttccag

SEQ ID NO: 5847026 - DNA, 20 bp, Homo sapiens
atccagaattgaccttttga

SEQ ID NO: 5847027 - DNA, 22 bp, Homo sapiens
atccagaatttattagtttaaa

SEQ ID NO: 5847028 - DNA, 23 bp, Homo sapiens
atccagaatttattagtttaaaa

SEQ ID NO: 5847029 - DNA, 21 bp, Homo sapiens
atccagacatcatgaatttta

SEQ ID NO: 5847030 - DNA, 19 bp, Homo sapiens
atccagacccggctgcgtg

SEQ ID NO: 5847031 - DNA, 16 bp, Homo sapiens
atccagactcagagct

SEQ ID NO: 5847032 - DNA, 13 bp, Homo sapiens
atccagactgtaa

SEQ ID NO: 5847033 - DNA, 15 bp, Homo sapiens
atccagagacctgct

SEQ ID NO: 5847034 - DNA, 22 bp, Homo sapiens
atccagagacctgctccagatc

SEQ ID NO: 5847035 - DNA, 24 bp, Homo sapiens
atccagagacctgctccagatcct

SEQ ID NO: 5847036 - DNA, 21 bp, Homo sapiens
atccagagagaagcaccccac

SEQ ID NO: 5847037 - DNA, 22 bp, Homo sapiens
atccagagagcttaaattgtca

SEQ ID NO: 5847038 - DNA, 14 bp, Homo sapiens
atccagagatgact

SEQ ID NO: 5847039 - DNA, 14 bp, Homo sapiens
atccagagcagagt

SEQ ID NO: 5847040 - DNA, 22 bp, Homo sapiens
atccagaggaacaagcatgtct

SEQ ID NO: 5847041 - DNA, 12 bp, Homo sapiens
atccagaggaat

SEQ ID NO: 5847042 - DNA, 22 bp, Homo sapiens
atccagaggcaaacggaggcaa

SEQ ID NO: 5847043 - DNA, 22 bp, Homo sapiens
atccagaggtgagggaggcctg

SEQ ID NO: 5847044 - DNA, 21 bp, Homo sapiens
atccagagtcatgggagagta

SEQ ID NO: 5847045 - DNA, 19 bp, Homo sapiens
atccagagtccctgcctgg

SEQ ID NO: 5847046 - DNA, 17 bp, Homo sapiens
atccagagtgattctag

SEQ ID NO: 5847047 - DNA, 15 bp, Homo sapiens
atccagatagcctag

SEQ ID NO: 5847048 - DNA, 14 bp, Homo sapiens
atccagatggtggg

SEQ ID NO: 5847049 - DNA, 19 bp, Homo sapiens
atccagattcccaggccag

SEQ ID NO: 5847050 - DNA, 21 bp, Homo sapiens
atccagattcccaggccaggc

SEQ ID NO: 5847051 - DNA, 20 bp, Homo sapiens
atccagcacaactcagtctg

SEQ ID NO: 5847052 - DNA, 21 bp, Homo sapiens
atccagcacaactcagtctgt

SEQ ID NO: 5847053 - DNA, 18 bp, Homo sapiens
atccagcagtacaataaa

SEQ ID NO: 5847054 - DNA, 19 bp, Homo sapiens
atccagcagtctctgcctt

SEQ ID NO: 5847055 - DNA, 21 bp, Homo sapiens
atccagcagtgttgctcagct

SEQ ID NO: 5847056 - DNA, 15 bp, Homo sapiens
atccagcatgtgtgt

SEQ ID NO: 5847057 - DNA, 19 bp, Homo sapiens
atccagcatgtgtgtgtct

SEQ ID NO: 5847058 - DNA, 10 bp, Homo sapiens
atccagccac

SEQ ID NO: 5847059 - DNA, 21 bp, Homo sapiens
atccagccacggagggaggca

SEQ ID NO: 5847060 - DNA, 12 bp, Homo sapiens
atccagccactt

SEQ ID NO: 5847061 - DNA, 15 bp, Homo sapiens
atccagccaggggtg

SEQ ID NO: 5847062 - DNA, 11 bp, Homo sapiens
atccagccctg

SEQ ID NO: 5847063 - DNA, 19 bp, Homo sapiens
atccagccggaggccagag

SEQ ID NO: 5847064 - DNA, 16 bp, Homo sapiens
atccagcctcagagat

SEQ ID NO: 5847065 - DNA, 16 bp, Homo sapiens
atccagcctccagggc

SEQ ID NO: 5847066 - DNA, 16 bp, Homo sapiens
atccagcctctcccct

SEQ ID NO: 5847067 - DNA, 12 bp, Homo sapiens
atccagcctggg

SEQ ID NO: 5847068 - DNA, 19 bp, Homo sapiens
atccagcctggggctgagg

SEQ ID NO: 5847069 - DNA, 21 bp, Homo sapiens
atccagcgagagagtttcaaa

SEQ ID NO: 5847070 - DNA, 22 bp, Homo sapiens
atccagcgagagagtttcaaaa

SEQ ID NO: 5847071 - DNA, 17 bp, Homo sapiens
atccagctacaggagag

SEQ ID NO: 5847072 - DNA, 19 bp, Homo sapiens
atccagctacaggagagat

SEQ ID NO: 5847073 - DNA, 19 bp, Homo sapiens
atccagctacttagctggc

SEQ ID NO: 5847074 - DNA, 20 bp, Homo sapiens
atccagctacttagctggcc

SEQ ID NO: 5847075 - DNA, 22 bp, Homo sapiens
atccagctccccttctgaatca

SEQ ID NO: 5847076 - DNA, 15 bp, Homo sapiens
atccagctcctctag

SEQ ID NO: 5847077 - DNA, 22 bp, Homo sapiens
atccagctctaagtctcaactg

SEQ ID NO: 5847078 - DNA, 22 bp, Homo sapiens
atccagctctttattacatagc

SEQ ID NO: 5847079 - DNA, 14 bp, Homo sapiens
atccagctgagtga

SEQ ID NO: 5847080 - DNA, 17 bp, Homo sapiens
atccagctgcctattga

SEQ ID NO: 5847081 - DNA, 19 bp, Homo sapiens
atccagcttgccagatgct

SEQ ID NO: 5847082 - DNA, 22 bp, Homo sapiens
atccaggaaagatgtcccacag

SEQ ID NO: 5847083 - DNA, 13 bp, Homo sapiens
atccaggaacaca

SEQ ID NO: 5847084 - DNA, 15 bp, Homo sapiens
atccaggaacacatg

SEQ ID NO: 5847085 - DNA, 15 bp, Homo sapiens
atccaggactctgtc

SEQ ID NO: 5847086 - DNA, 14 bp, Homo sapiens
atccaggagctcca

SEQ ID NO: 5847087 - DNA, 16 bp, Homo sapiens
atccaggagctccagt

SEQ ID NO: 5847088 - DNA, 21 bp, Homo sapiens
atccaggagtctttcaactgt

SEQ ID NO: 5847089 - DNA, 23 bp, Homo sapiens
atccaggcaatcgttctgctggc

SEQ ID NO: 5847090 - DNA, 15 bp, Homo sapiens
atccaggcacagctg

SEQ ID NO: 5847091 - DNA, 15 bp, Homo sapiens
atccaggcaccagga

SEQ ID NO: 5847092 - DNA, 21 bp, Homo sapiens
atccaggcacccaaaccccgg

SEQ ID NO: 5847093 - DNA, 19 bp, Homo sapiens
atccaggccactcttagcc

SEQ ID NO: 5847094 - DNA, 14 bp, Homo sapiens
atccaggccggctt

SEQ ID NO: 5847095 - DNA, 18 bp, Homo sapiens
atccaggctggccagtgc

SEQ ID NO: 5847096 - DNA, 22 bp, Homo sapiens
atccaggctggtgttctgtctg

SEQ ID NO: 5847097 - DNA, 17 bp, Homo sapiens
atccaggctgttctcag

SEQ ID NO: 5847098 - DNA, 18 bp, Homo sapiens
atccaggctgttctcagc

SEQ ID NO: 5847099 - DNA, 22 bp, Homo sapiens
atccaggcttctcccggacctg

SEQ ID NO: 5847100 - DNA, 17 bp, Homo sapiens
atccaggctttatgtac

SEQ ID NO: 5847101 - DNA, 14 bp, Homo sapiens
atccagggacagag

SEQ ID NO: 5847102 - DNA, 21 bp, Homo sapiens
atccagggacagaggccccag

SEQ ID NO: 5847103 - DNA, 14 bp, Homo sapiens
atccagggcagcag

SEQ ID NO: 5847104 - DNA, 18 bp, Homo sapiens
atccaggggaagccagtg

SEQ ID NO: 5847105 - DNA, 17 bp, Homo sapiens
atccaggggcttcaccc

SEQ ID NO: 5847106 - DNA, 13 bp, Homo sapiens
atccagggtctgg

SEQ ID NO: 5847107 - DNA, 21 bp, Homo sapiens
atccaggtacgcacagacagg

SEQ ID NO: 5847108 - DNA, 14 bp, Homo sapiens
atccaggtcaacag

SEQ ID NO: 5847109 - DNA, 16 bp, Homo sapiens
atccaggtcaacagaa

SEQ ID NO: 5847110 - DNA, 19 bp, Homo sapiens
atccaggtcaacagaatga

SEQ ID NO: 5847111 - DNA, 21 bp, Homo sapiens
atccaggtcaacagaatgaaa

SEQ ID NO: 5847112 - DNA, 21 bp, Homo sapiens
atccaggtcatgcagttcctg

SEQ ID NO: 5847113 - DNA, 17 bp, Homo sapiens
atccaggtgtgcccctc

SEQ ID NO: 5847114 - DNA, 15 bp, Homo sapiens
atccaggttccctcc

SEQ ID NO: 5847115 - DNA, 18 bp, Homo sapiens
atccagtaacctcggaga

SEQ ID NO: 5847116 - DNA, 17 bp, Homo sapiens
atccagtaagcacatgt

SEQ ID NO: 5847117 - DNA, 16 bp, Homo sapiens
atccagtacatttaat

SEQ ID NO: 5847118 - DNA, 14 bp, Homo sapiens
atccagtagggaaa

SEQ ID NO: 5847119 - DNA, 16 bp, Homo sapiens
atccagtagggaaaat

SEQ ID NO: 5847120 - DNA, 22 bp, Homo sapiens
atccagtcattttattttgtaa

SEQ ID NO: 5847121 - DNA, 12 bp, Homo sapiens
atccagtctgaa

SEQ ID NO: 5847122 - DNA, 21 bp, Homo sapiens
atccagtgacatgattctgaa

SEQ ID NO: 5847123 - DNA, 19 bp, Homo sapiens
atccagtgacctctctctc

SEQ ID NO: 5847124 - DNA, 16 bp, Homo sapiens
atccagtgatccttac

SEQ ID NO: 5847125 - DNA, 18 bp, Homo sapiens
atccagtgatgtgctgga

SEQ ID NO: 5847126 - DNA, 19 bp, Homo sapiens
atccagtgatgtgctggag

SEQ ID NO: 5847127 - DNA, 18 bp, Homo sapiens
atccagtgcttccacaga

SEQ ID NO: 5847128 - DNA, 17 bp, Homo sapiens
atccagtggtgggtaat

SEQ ID NO: 5847129 - DNA, 18 bp, Homo sapiens
atccagtggtgggtaatt

SEQ ID NO: 5847130 - DNA, 12 bp, Homo sapiens
atccagtgtata

SEQ ID NO: 5847131 - DNA, 15 bp, Homo sapiens
atccagtgtgagata

SEQ ID NO: 5847132 - DNA, 20 bp, Homo sapiens
atccagtgtgagatactgtg

SEQ ID NO: 5847133 - DNA, 17 bp, Homo sapiens
atccagtgtggctccca

SEQ ID NO: 5847134 - DNA, 12 bp, Homo sapiens
atccagtgtgta

SEQ ID NO: 5847135 - DNA, 18 bp, Homo sapiens
atccagttagcaacaaat

SEQ ID NO: 5847136 - DNA, 17 bp, Homo sapiens
atccagttccagttccc

SEQ ID NO: 5847137 - DNA, 13 bp, Homo sapiens
atccagttcctgc

SEQ ID NO: 5847138 - DNA, 16 bp, Homo sapiens
atccagttcctgctct

SEQ ID NO: 5847139 - DNA, 21 bp, Homo sapiens
atccagttcctgctctctgct

SEQ ID NO: 5847140 - DNA, 14 bp, Homo sapiens
atccagttgcaata

SEQ ID NO: 5847141 - DNA, 18 bp, Homo sapiens
atccagttgcaataaaat

SEQ ID NO: 5847142 - DNA, 19 bp, Homo sapiens
atccagttgcaataaaata

SEQ ID NO: 5847143 - DNA, 14 bp, Homo sapiens
atccagttgtctaa

SEQ ID NO: 5847144 - DNA, 16 bp, Homo sapiens
atccagtttctttccc

SEQ ID NO: 5847145 - DNA, 15 bp, Homo sapiens
atccagtttgttctc

SEQ ID NO: 5847146 - DNA, 18 bp, Homo sapiens
atccagttttgtcaatgc

SEQ ID NO: 5847147 - DNA, 13 bp, Homo sapiens
atccataaaaaaa

SEQ ID NO: 5847148 - DNA, 21 bp, Homo sapiens
atccataaaattggattacag

SEQ ID NO: 5847149 - DNA, 23 bp, Homo sapiens
atccataaaattggattacagta

SEQ ID NO: 5847150 - DNA, 17 bp, Homo sapiens
atccataaactaagaga

SEQ ID NO: 5847151 - DNA, 19 bp, Homo sapiens
atccataaactaagagaaa

SEQ ID NO: 5847152 - DNA, 20 bp, Homo sapiens
atccgcctgaaagtgttttg

SEQ ID NO: 5847153 - DNA, 17 bp, Homo sapiens
atccgcctgcagaggac

SEQ ID NO: 5847154 - DNA, 22 bp, Homo sapiens
atccgcctgtgggcgcatacta

SEQ ID NO: 5847155 - DNA, 15 bp, Homo sapiens
atccgctctcttcct

SEQ ID NO: 5847156 - DNA, 16 bp, Homo sapiens
atccgctctcttcctg

SEQ ID NO: 5847157 - DNA, 19 bp, Homo sapiens
atccgctctcttcctgccc

SEQ ID NO: 5847158 - DNA, 23 bp, Homo sapiens
atccggaacagccaaagaaactc

SEQ ID NO: 5847159 - DNA, 24 bp, Homo sapiens
atccggcatgagggctgagatgcg

SEQ ID NO: 5847160 - DNA, 22 bp, Homo sapiens
atccgggacgcttccagaccac

SEQ ID NO: 5847161 - DNA, 16 bp, Homo sapiens
atccggggccagctcc

SEQ ID NO: 5847162 - DNA, 17 bp, Homo sapiens
atccggggccagctccg

SEQ ID NO: 5847163 - DNA, 12 bp, Homo sapiens
atccgggtgctc

SEQ ID NO: 5847164 - DNA, 19 bp, Homo sapiens
atccgggtgctcaataaac

SEQ ID NO: 5847165 - DNA, 15 bp, Homo sapiens
atccggtcagccaag

SEQ ID NO: 5847166 - DNA, 22 bp, Homo sapiens
atccggtttagtcatccaacaa

SEQ ID NO: 5847167 - DNA, 17 bp, Homo sapiens
atccgtaggacaagttt

SEQ ID NO: 5847168 - DNA, 19 bp, Homo sapiens
atccgtaggacaagtttta

SEQ ID NO: 5847169 - DNA, 16 bp, Homo sapiens
atccgtagttccctga

SEQ ID NO: 5847170 - DNA, 17 bp, Homo sapiens
atccgtagttccctgaa

SEQ ID NO: 5847171 - DNA, 13 bp, Homo sapiens
atccgtccagcca

SEQ ID NO: 5847172 - DNA, 20 bp, Homo sapiens
atccgtgcctctttttaaag

SEQ ID NO: 5847173 - DNA, 12 bp, Homo sapiens
atccgtgctgca

SEQ ID NO: 5847174 - DNA, 22 bp, Homo sapiens
atccgtgtatttggctgggcta

SEQ ID NO: 5847175 - DNA, 23 bp, Homo sapiens
atccgtgttgcaggttcatggat

SEQ ID NO: 5847176 - DNA, 18 bp, Homo sapiens
atccgttcattcattcag

SEQ ID NO: 5847177 - DNA, 19 bp, Homo sapiens
atccgttcccttctgccac

SEQ ID NO: 5847178 - DNA, 23 bp, Homo sapiens
atccgtttcagctgacagctgct

SEQ ID NO: 5847179 - DNA, 23 bp, Homo sapiens
atcctaaaacaaaagctcatcca

SEQ ID NO: 5847180 - DNA, 22 bp, Homo sapiens
atcctaaaagagatctgggcat

SEQ ID NO: 5847181 - DNA, 14 bp, Homo sapiens
atcctaaaatatgt

SEQ ID NO: 5847182 - DNA, 14 bp, Homo sapiens
atcctaaacatcat

SEQ ID NO: 5847183 - DNA, 11 bp, Homo sapiens
atcctaaactc

SEQ ID NO: 5847184 - DNA, 15 bp, Homo sapiens
atcctaaagattatt

SEQ ID NO: 5847185 - DNA, 17 bp, Homo sapiens
atcctaaagattattac

SEQ ID NO: 5847186 - DNA, 21 bp, Homo sapiens
atcctaaccccctaagctcca

SEQ ID NO: 5847187 - DNA, 18 bp, Homo sapiens
atcctaaccctgggctcc

SEQ ID NO: 5847188 - DNA, 23 bp, Homo sapiens
atcctaaccctgggctccctgga

SEQ ID NO: 5847189 - DNA, 12 bp, Homo sapiens
atcctaagaaat

SEQ ID NO: 5847190 - DNA, 22 bp, Homo sapiens
atcctaagaaatatgtgagatt

SEQ ID NO: 5847191 - DNA, 23 bp, Homo sapiens
atcctaagactaacaaaggcagc

SEQ ID NO: 5847192 - DNA, 17 bp, Homo sapiens
atcctaagcatctaagt

SEQ ID NO: 5847193 - DNA, 14 bp, Homo sapiens
atcctaagggaaga

SEQ ID NO: 5847194 - DNA, 22 bp, Homo sapiens
atcctaagggtcgaaagctcta

SEQ ID NO: 5847195 - DNA, 19 bp, Homo sapiens
atcctaaggttcttgcttt

SEQ ID NO: 5847196 - DNA, 21 bp, Homo sapiens
atcctaaggttcttgctttct

SEQ ID NO: 5847197 - DNA, 22 bp, Homo sapiens
atcctaagtgggaagtgaagcc

SEQ ID NO: 5847198 - DNA, 13 bp, Homo sapiens
atcctaatgaatg

SEQ ID NO: 5847199 - DNA, 15 bp, Homo sapiens
atcctaatttctcct

SEQ ID NO: 5847200 - DNA, 18 bp, Homo sapiens
atcctaatttctcctccc

SEQ ID NO: 5847201 - DNA, 14 bp, Homo sapiens
atcctacaagacac

SEQ ID NO: 5847202 - DNA, 21 bp, Homo sapiens
atcctacaaggcctatgagta

SEQ ID NO: 5847203 - DNA, 15 bp, Homo sapiens
atcctacaatatttt

SEQ ID NO: 5847204 - DNA, 13 bp, Homo sapiens
atcctacccagcg

SEQ ID NO: 5847205 - DNA, 22 bp, Homo sapiens
atcctaccccctcttcaaagca

SEQ ID NO: 5847206 - DNA, 14 bp, Homo sapiens
atcctaccccctgt

SEQ ID NO: 5847207 - DNA, 16 bp, Homo sapiens
atcctaccccctgtgc

SEQ ID NO: 5847208 - DNA, 14 bp, Homo sapiens
atcctaccttttga

SEQ ID NO: 5847209 - DNA, 17 bp, Homo sapiens
atcctactcctacctgg

SEQ ID NO: 5847210 - DNA, 16 bp, Homo sapiens
atcctactgagcattt

SEQ ID NO: 5847211 - DNA, 19 bp, Homo sapiens
atcctagactgctcctggg

SEQ ID NO: 5847212 - DNA, 20 bp, Homo sapiens
atcctagactgctcctgggc

SEQ ID NO: 5847213 - DNA, 20 bp, Homo sapiens
atcctagacttgaaagtttt

SEQ ID NO: 5847214 - DNA, 19 bp, Homo sapiens
atcctagagtcttaaagca

SEQ ID NO: 5847215 - DNA, 13 bp, Homo sapiens
atcctagattata

SEQ ID NO: 5847216 - DNA, 19 bp, Homo sapiens
atcctagcacatgcttcaa

SEQ ID NO: 5847217 - DNA, 20 bp, Homo sapiens
atcctagccccacccagagg

SEQ ID NO: 5847218 - DNA, 21 bp, Homo sapiens
atcctagccccacccagaggt

SEQ ID NO: 5847219 - DNA, 21 bp, Homo sapiens
atcctagccctcattttaatt

SEQ ID NO: 5847220 - DNA, 22 bp, Homo sapiens
atcctagccttatcctctgatc

SEQ ID NO: 5847221 - DNA, 13 bp, Homo sapiens
atcctagctgtgt

SEQ ID NO: 5847222 - DNA, 14 bp, Homo sapiens
atcctaggctcctg

SEQ ID NO: 5847223 - DNA, 16 bp, Homo sapiens
atcctaggctgacacc

SEQ ID NO: 5847224 - DNA, 19 bp, Homo sapiens
atcctagggcacttctagt

SEQ ID NO: 5847225 - DNA, 20 bp, Homo sapiens
atcctaggtagggtttaatc

SEQ ID NO: 5847226 - DNA, 16 bp, Homo sapiens
atcctaggtgctggat

SEQ ID NO: 5847227 - DNA, 20 bp, Homo sapiens
atcctagtcactaccttcat

SEQ ID NO: 5847228 - DNA, 20 bp, Homo sapiens
atcctagtctctatcattaa

SEQ ID NO: 5847229 - DNA, 17 bp, Homo sapiens
atcctagtcttcacaac

SEQ ID NO: 5847230 - DNA, 20 bp, Homo sapiens
atcctagtggtaggtcagaa

SEQ ID NO: 5847231 - DNA, 13 bp, Homo sapiens
atcctagttccac

SEQ ID NO: 5847232 - DNA, 19 bp, Homo sapiens
atcctagttccaccatcaa

SEQ ID NO: 5847233 - DNA, 20 bp, Homo sapiens
atcctagttccattcttggt

SEQ ID NO: 5847234 - DNA, 20 bp, Homo sapiens
atcctagtttgctgtggcct

SEQ ID NO: 5847235 - DNA, 14 bp, Homo sapiens
atcctataaagaaa

SEQ ID NO: 5847236 - DNA, 15 bp, Homo sapiens
atcctataaagaaac

SEQ ID NO: 5847237 - DNA, 14 bp, Homo sapiens
atcctataaatgtg

SEQ ID NO: 5847238 - DNA, 19 bp, Homo sapiens
atcctataagcttaaatag

SEQ ID NO: 5847239 - DNA, 12 bp, Homo sapiens
atcctatatctg

SEQ ID NO: 5847240 - DNA, 15 bp, Homo sapiens
atcctatatctgttt

SEQ ID NO: 5847241 - DNA, 23 bp, Homo sapiens
atcctatatctgtttgtatattt

SEQ ID NO: 5847242 - DNA, 23 bp, Homo sapiens
atcctatcagcctgtctcttcca

SEQ ID NO: 5847243 - DNA, 20 bp, Homo sapiens
atcctatcgatctggaaaga

SEQ ID NO: 5847244 - DNA, 16 bp, Homo sapiens
atcctatctctccaac

SEQ ID NO: 5847245 - DNA, 23 bp, Homo sapiens
atcctatctggggagctcctggc

SEQ ID NO: 5847246 - DNA, 21 bp, Homo sapiens
atcctatgccttcaaatagta

SEQ ID NO: 5847247 - DNA, 16 bp, Homo sapiens
atcctatgtcatttct

SEQ ID NO: 5847248 - DNA, 12 bp, Homo sapiens
atcctatgtgat

SEQ ID NO: 5847249 - DNA, 14 bp, Homo sapiens
atcctatgtgattt

SEQ ID NO: 5847250 - DNA, 17 bp, Homo sapiens
atcctatgtgattttaa

SEQ ID NO: 5847251 - DNA, 20 bp, Homo sapiens
atcctattaaaacacagctt

SEQ ID NO: 5847252 - DNA, 19 bp, Homo sapiens
atcctattacttttcatct

SEQ ID NO: 5847253 - DNA, 13 bp, Homo sapiens
atcctattctttc

SEQ ID NO: 5847254 - DNA, 14 bp, Homo sapiens
atcctatttaaaga

SEQ ID NO: 5847255 - DNA, 17 bp, Homo sapiens
atcctatttaaagacct

SEQ ID NO: 5847256 - DNA, 20 bp, Homo sapiens
atcctatttaaagacctgac

SEQ ID NO: 5847257 - DNA, 21 bp, Homo sapiens
atcctattttcataatttttc

SEQ ID NO: 5847258 - DNA, 14 bp, Homo sapiens
atcctatttttaaa

SEQ ID NO: 5847259 - DNA, 13 bp, Homo sapiens
atcctcaaaagaa

SEQ ID NO: 5847260 - DNA, 15 bp, Homo sapiens
atcctcaaacactgc

SEQ ID NO: 5847261 - DNA, 17 bp, Homo sapiens
atcctcaaacactgcag

SEQ ID NO: 5847262 - DNA, 19 bp, Homo sapiens
atcctcaaacactgcaggc

SEQ ID NO: 5847263 - DNA, 20 bp, Homo sapiens
atcctcaaacgacagaggag

SEQ ID NO: 5847264 - DNA, 16 bp, Homo sapiens
atcctcaaagaaagtg

SEQ ID NO: 5847265 - DNA, 20 bp, Homo sapiens
atcctcaaagaaagtgtatt

SEQ ID NO: 5847266 - DNA, 17 bp, Homo sapiens
atcctcaaagcccccac

SEQ ID NO: 5847267 - DNA, 23 bp, Homo sapiens
atcctcaaatcagtcttccttgt

SEQ ID NO: 5847268 - DNA, 18 bp, Homo sapiens
atcctcaaatgcggggtg

SEQ ID NO: 5847269 - DNA, 21 bp, Homo sapiens
atcctcaagttgtgtgctatt

SEQ ID NO: 5847270 - DNA, 20 bp, Homo sapiens
atcctcaattatcttggaaa

SEQ ID NO: 5847271 - DNA, 14 bp, Homo sapiens
atcctcacacagat

SEQ ID NO: 5847272 - DNA, 21 bp, Homo sapiens
atcctcacccagatcaggaac

SEQ ID NO: 5847273 - DNA, 15 bp, Homo sapiens
atcctcactgggctc

SEQ ID NO: 5847274 - DNA, 16 bp, Homo sapiens
atcctcactgggctca

SEQ ID NO: 5847275 - DNA, 18 bp, Homo sapiens
atcctcagaaagtgcagc

SEQ ID NO: 5847276 - DNA, 21 bp, Homo sapiens
atcctcagaggctgagccctg

SEQ ID NO: 5847277 - DNA, 22 bp, Homo sapiens
atcctcagaggctgagccctgt

SEQ ID NO: 5847278 - DNA, 23 bp, Homo sapiens
atcctcagaggctgagccctgta

SEQ ID NO: 5847279 - DNA, 14 bp, Homo sapiens
atcctcagatgctc

SEQ ID NO: 5847280 - DNA, 10 bp, Homo sapiens
atcctcagcc

SEQ ID NO: 5847281 - DNA, 13 bp, Homo sapiens
atcctcagcccca

SEQ ID NO: 5847282 - DNA, 23 bp, Homo sapiens
atcctcagccccagggccctgct

SEQ ID NO: 5847283 - DNA, 19 bp, Homo sapiens
atcctcagcccctccagtc

SEQ ID NO: 5847284 - DNA, 17 bp, Homo sapiens
atcctcaggatttcatt

SEQ ID NO: 5847285 - DNA, 19 bp, Homo sapiens
atcctcagttcctgcagca

SEQ ID NO: 5847286 - DNA, 23 bp, Homo sapiens
atcctcagttctcaaatgtgtgt

SEQ ID NO: 5847287 - DNA, 19 bp, Homo sapiens
atcctcagttggaatcatt

SEQ ID NO: 5847288 - DNA, 19 bp, Homo sapiens
atcctcagtttttgtgaaa

SEQ ID NO: 5847289 - DNA, 19 bp, Homo sapiens
atcctcatacccaccccca

SEQ ID NO: 5847290 - DNA, 23 bp, Homo sapiens
atcctcatacccacccccaccca

SEQ ID NO: 5847291 - DNA, 16 bp, Homo sapiens
atcctcatatggccca

SEQ ID NO: 5847292 - DNA, 14 bp, Homo sapiens
atcctcatccctga

SEQ ID NO: 5847293 - DNA, 12 bp, Homo sapiens
atcctcatctct

SEQ ID NO: 5847294 - DNA, 14 bp, Homo sapiens
atcctcatggccca

SEQ ID NO: 5847295 - DNA, 17 bp, Homo sapiens
atcctcattgcctcctg

SEQ ID NO: 5847296 - DNA, 22 bp, Homo sapiens
atcctcatttgcaaacctcaga

SEQ ID NO: 5847297 - DNA, 17 bp, Homo sapiens
atcctccaatgtctaat

SEQ ID NO: 5847298 - DNA, 14 bp, Homo sapiens
atcctccacagaga

SEQ ID NO: 5847299 - DNA, 16 bp, Homo sapiens
atcctccacagagagg

SEQ ID NO: 5847300 - DNA, 13 bp, Homo sapiens
atcctccacgggc

SEQ ID NO: 5847301 - DNA, 13 bp, Homo sapiens
atcctccagagaa

SEQ ID NO: 5847302 - DNA, 22 bp, Homo sapiens
atcctccagagaaacccaggga

SEQ ID NO: 5847303 - DNA, 14 bp, Homo sapiens
atcctccaggtgca

SEQ ID NO: 5847304 - DNA, 12 bp, Homo sapiens
atcctccaggtt

SEQ ID NO: 5847305 - DNA, 20 bp, Homo sapiens
atcctccagtaccttgcttc

SEQ ID NO: 5847306 - DNA, 23 bp, Homo sapiens
atcctccatgggggctcagccag

SEQ ID NO: 5847307 - DNA, 14 bp, Homo sapiens
atcctccattgctc

SEQ ID NO: 5847308 - DNA, 22 bp, Homo sapiens
atcctcccaaccaaccagcagg

SEQ ID NO: 5847309 - DNA, 23 bp, Homo sapiens
atcctcccaaccaaccagcaggg

SEQ ID NO: 5847310 - DNA, 20 bp, Homo sapiens
atcctcccacctcagcctcc

SEQ ID NO: 5847311 - DNA, 12 bp, Homo sapiens
atcctcccaggc

SEQ ID NO: 5847312 - DNA, 13 bp, Homo sapiens
atcctcccattgc

SEQ ID NO: 5847313 - DNA, 19 bp, Homo sapiens
atcctcccattgcccagtg

SEQ ID NO: 5847314 - DNA, 22 bp, Homo sapiens
atcctcccattgcccagtgagc

SEQ ID NO: 5847315 - DNA, 16 bp, Homo sapiens
atcctccccagcgcca

SEQ ID NO: 5847316 - DNA, 15 bp, Homo sapiens
atcctccccttccct

SEQ ID NO: 5847317 - DNA, 19 bp, Homo sapiens
atcctccccttccctgcaa

SEQ ID NO: 5847318 - DNA, 21 bp, Homo sapiens
atcctcccgccaggagcttct

SEQ ID NO: 5847319 - DNA, 22 bp, Homo sapiens
atcctcccgccaggagcttctt

SEQ ID NO: 5847320 - DNA, 23 bp, Homo sapiens
atcctcccgccaggagcttcttc

SEQ ID NO: 5847321 - DNA, 12 bp, Homo sapiens
atcctccctcca

SEQ ID NO: 5847322 - DNA, 17 bp, Homo sapiens
atcctccctccacctca

SEQ ID NO: 5847323 - DNA, 20 bp, Homo sapiens
atcctccctccacctcaaga

SEQ ID NO: 5847324 - DNA, 18 bp, Homo sapiens
atcctccctgaccctgct

SEQ ID NO: 5847325 - DNA, 14 bp, Homo sapiens
atcctccctggaga

SEQ ID NO: 5847326 - DNA, 19 bp, Homo sapiens
atcctccctggcagacaca

SEQ ID NO: 5847327 - DNA, 21 bp, Homo sapiens
atcctccctgttccccacagg

SEQ ID NO: 5847328 - DNA, 16 bp, Homo sapiens
atcctttgcagggcag

SEQ ID NO: 5847329 - DNA, 20 bp, Homo sapiens
atcctttgcagggcagcccc

SEQ ID NO: 5847330 - DNA, 13 bp, Homo sapiens
atcctttgcattt

SEQ ID NO: 5847331 - DNA, 14 bp, Homo sapiens
atcctttgcatttc

SEQ ID NO: 5847332 - DNA, 13 bp, Homo sapiens
atcctttgcccca

SEQ ID NO: 5847333 - DNA, 18 bp, Homo sapiens
atcctttgcctgcctggt

SEQ ID NO: 5847334 - DNA, 18 bp, Homo sapiens
atcctttggggcttctgt

SEQ ID NO: 5847335 - DNA, 19 bp, Homo sapiens
atcctttggtcctggtgct

SEQ ID NO: 5847336 - DNA, 14 bp, Homo sapiens
atcctttgtcttgg

SEQ ID NO: 5847337 - DNA, 15 bp, Homo sapiens
atcctttgtgaaaaa

SEQ ID NO: 5847338 - DNA, 20 bp, Homo sapiens
atcctttgtgagcctatgat

SEQ ID NO: 5847339 - DNA, 14 bp, Homo sapiens
atcctttgttctga

SEQ ID NO: 5847340 - DNA, 19 bp, Homo sapiens
atcctttgttctgagcatt

SEQ ID NO: 5847341 - DNA, 21 bp, Homo sapiens
atcctttgttttctgactaat

SEQ ID NO: 5847342 - DNA, 17 bp, Homo sapiens
atccttttagtctgcat

SEQ ID NO: 5847343 - DNA, 18 bp, Homo sapiens
atccttttatgttattta

SEQ ID NO: 5847344 - DNA, 16 bp, Homo sapiens
atccttttccatccca

SEQ ID NO: 5847345 - DNA, 23 bp, Homo sapiens
atccttttccatcccactccact

SEQ ID NO: 5847346 - DNA, 13 bp, Homo sapiens
atccttttcctta

SEQ ID NO: 5847347 - DNA, 22 bp, Homo sapiens
atccttttccttatttgccttc

SEQ ID NO: 5847348 - DNA, 12 bp, Homo sapiens
atccttttctgt

SEQ ID NO: 5847349 - DNA, 15 bp, Homo sapiens
atccttttcttctat

SEQ ID NO: 5847350 - DNA, 18 bp, Homo sapiens
atccttttcttctatgta

SEQ ID NO: 5847351 - DNA, 23 bp, Homo sapiens
atccttttgcttcatctggagtc

SEQ ID NO: 5847352 - DNA, 23 bp, Homo sapiens
atccttttggcgtgatatccata

SEQ ID NO: 5847353 - DNA, 18 bp, Homo sapiens
atccttttgtagaatgaa

SEQ ID NO: 5847354 - DNA, 17 bp, Homo sapiens
atccttttgttttgaag

SEQ ID NO: 5847355 - DNA, 18 bp, Homo sapiens
atccttttgttttgaagc

SEQ ID NO: 5847356 - DNA, 13 bp, Homo sapiens
atcctttttccat

SEQ ID NO: 5847357 - DNA, 19 bp, Homo sapiens
atcctttttccatcatttt

SEQ ID NO: 5847358 - DNA, 15 bp, Homo sapiens
atcctttttctttat

SEQ ID NO: 5847359 - DNA, 19 bp, Homo sapiens
atccttttttctcttctgt

SEQ ID NO: 5847360 - DNA, 15 bp, Homo sapiens
atccttttttgtcat

SEQ ID NO: 5847361 - DNA, 20 bp, Homo sapiens
atccttttttgtcattttat

SEQ ID NO: 5847362 - DNA, 13 bp, Homo sapiens
atcgaaaagaagg

SEQ ID NO: 5847363 - DNA, 16 bp, Homo sapiens
atcgaaaattcatttc

SEQ ID NO: 5847364 - DNA, 13 bp, Homo sapiens
atcgaaataacaa

SEQ ID NO: 5847365 - DNA, 18 bp, Homo sapiens
atcgaaataacaatgtta

SEQ ID NO: 5847366 - DNA, 17 bp, Homo sapiens
atcgaacaaactgatgc

SEQ ID NO: 5847367 - DNA, 15 bp, Homo sapiens
atcgaaccgttttga

SEQ ID NO: 5847368 - DNA, 18 bp, Homo sapiens
atcgaagggattgtgtat

SEQ ID NO: 5847369 - DNA, 21 bp, Homo sapiens
atcgaagggtttttagagaat

SEQ ID NO: 5847370 - DNA, 16 bp, Homo sapiens
atcgaatatagttctg

SEQ ID NO: 5847371 - DNA, 17 bp, Homo sapiens
atcgaatatagttctgt

SEQ ID NO: 5847372 - DNA, 18 bp, Homo sapiens
atcgaatctactaattcc

SEQ ID NO: 5847373 - DNA, 14 bp, Homo sapiens
atcgaatgaaatta

SEQ ID NO: 5847374 - DNA, 13 bp, Homo sapiens
atcgacagacagc

SEQ ID NO: 5847375 - DNA, 21 bp, Homo sapiens
atcgacatcctagccccaccc

SEQ ID NO: 5847376 - DNA, 18 bp, Homo sapiens
atcgaccacaccagcctc

SEQ ID NO: 5847377 - DNA, 15 bp, Homo sapiens
atcgacctcactgtc

SEQ ID NO: 5847378 - DNA, 16 bp, Homo sapiens
atcgacttagcctgag

SEQ ID NO: 5847379 - DNA, 17 bp, Homo sapiens
atcgacttgttcttgat

SEQ ID NO: 5847380 - DNA, 19 bp, Homo sapiens
atcgactttatacagaact

SEQ ID NO: 5847381 - DNA, 15 bp, Homo sapiens
atcgagaccatcctg

SEQ ID NO: 5847382 - DNA, 20 bp, Homo sapiens
atcgagcatgttgttttttc

SEQ ID NO: 5847383 - DNA, 20 bp, Homo sapiens
atcgagtgtagctgtgaaat

SEQ ID NO: 5847384 - DNA, 17 bp, Homo sapiens
atcgagttggcaaaatg

SEQ ID NO: 5847385 - DNA, 13 bp, Homo sapiens
atcgatgaatgta

SEQ ID NO: 5847386 - DNA, 18 bp, Homo sapiens
atcgatgagcgccacctc

SEQ ID NO: 5847387 - DNA, 16 bp, Homo sapiens
atcgatggcctggcct

SEQ ID NO: 5847388 - DNA, 13 bp, Homo sapiens
atcgatggccttg

SEQ ID NO: 5847389 - DNA, 23 bp, Homo sapiens
atcgatgggggagtctgaagcag

SEQ ID NO: 5847390 - DNA, 20 bp, Homo sapiens
atcgatgggggatgcttcat

SEQ ID NO: 5847391 - DNA, 12 bp, Homo sapiens
atcgatgtgctc

SEQ ID NO: 5847392 - DNA, 22 bp, Homo sapiens
atcgattcccaagctcccttcc

SEQ ID NO: 5847393 - DNA, 23 bp, Homo sapiens
atcgattgtgtacttttcctttg

SEQ ID NO: 5847394 - DNA, 20 bp, Homo sapiens
atcgatttgtattaatgtag

SEQ ID NO: 5847395 - DNA, 15 bp, Homo sapiens
atcgcaagtcacaga

SEQ ID NO: 5847396 - DNA, 20 bp, Homo sapiens
atcgcaagtcacagaaaatg

SEQ ID NO: 5847397 - DNA, 20 bp, Homo sapiens
atcgcaccactgtgtattta

SEQ ID NO: 5847398 - DNA, 18 bp, Homo sapiens
atcgcaccttttatacca

SEQ ID NO: 5847399 - DNA, 16 bp, Homo sapiens
atcgcagacgcaagag

SEQ ID NO: 5847400 - DNA, 21 bp, Homo sapiens
atcgcaggagtctctgccacc

SEQ ID NO: 5847401 - DNA, 23 bp, Homo sapiens
atcgcaggagtctctgccaccca

SEQ ID NO: 5847402 - DNA, 22 bp, Homo sapiens
atcgcagggctcatgatttttt

SEQ ID NO: 5847403 - DNA, 17 bp, Homo sapiens
atcgcagtctcttagaa

SEQ ID NO: 5847404 - DNA, 17 bp, Homo sapiens
atcgcattaatgaaata

SEQ ID NO: 5847405 - DNA, 14 bp, Homo sapiens
atcgccagccctgg

SEQ ID NO: 5847406 - DNA, 17 bp, Homo sapiens
atcgccataggccaagg

SEQ ID NO: 5847407 - DNA, 21 bp, Homo sapiens
atcgccccaccgcagctactc

SEQ ID NO: 5847408 - DNA, 14 bp, Homo sapiens
atcgccccagactc

SEQ ID NO: 5847409 - DNA, 17 bp, Homo sapiens
atcgccctcctttccct

SEQ ID NO: 5847410 - DNA, 18 bp, Homo sapiens
atcgccctggcaggcagg

SEQ ID NO: 5847411 - DNA, 19 bp, Homo sapiens
atcgcctctttgacatttt

SEQ ID NO: 5847412 - DNA, 17 bp, Homo sapiens
atcgcctgagcccagga

SEQ ID NO: 5847413 - DNA, 18 bp, Homo sapiens
atcgccttatttatattc

SEQ ID NO: 5847414 - DNA, 12 bp, Homo sapiens
atcgcctttccc

SEQ ID NO: 5847415 - DNA, 18 bp, Homo sapiens
atcgcgccagcgacctct

SEQ ID NO: 5847416 - DNA, 22 bp, Homo sapiens
atcgctaaagggaccatctgct

SEQ ID NO: 5847417 - DNA, 23 bp, Homo sapiens
atcgctaaagggaccatctgctg

SEQ ID NO: 5847418 - DNA, 16 bp, Homo sapiens
atcgctcactgttgtg

SEQ ID NO: 5847419 - DNA, 17 bp, Homo sapiens
atcgctccaccttgcag

SEQ ID NO: 5847420 - DNA, 22 bp, Homo sapiens
atcgctcctgcagccccagccc

SEQ ID NO: 5847421 - DNA, 16 bp, Homo sapiens
atcgctcgtgtgttct

SEQ ID NO: 5847422 - DNA, 23 bp, Homo sapiens
atcgctcgtgtgttctatccaaa

SEQ ID NO: 5847423 - DNA, 16 bp, Homo sapiens
atcgctcttttccact

SEQ ID NO: 5847424 - DNA, 19 bp, Homo sapiens
atcgctcttttccactcca

SEQ ID NO: 5847425 - DNA, 15 bp, Homo sapiens
atcgctgcacatggc

SEQ ID NO: 5847426 - DNA, 21 bp, Homo sapiens
atcgctgctacatcagactct

SEQ ID NO: 5847427 - DNA, 22 bp, Homo sapiens
atcgctgtgaaaatgaggagga

SEQ ID NO: 5847428 - DNA, 18 bp, Homo sapiens
atcgctgttctgggcatg

SEQ ID NO: 5847429 - DNA, 17 bp, Homo sapiens
atcgcttatatgtcctt

SEQ ID NO: 5847430 - DNA, 16 bp, Homo sapiens
atcgcttctttttcaa

SEQ ID NO: 5847431 - DNA, 19 bp, Homo sapiens
atcgcttgaaccggggagg

SEQ ID NO: 5847432 - DNA, 16 bp, Homo sapiens
atcgcttgaacctggg

SEQ ID NO: 5847433 - DNA, 16 bp, Homo sapiens
atcgctttccttcctc

SEQ ID NO: 5847434 - DNA, 21 bp, Homo sapiens
atcgctttccttcctcccctt

SEQ ID NO: 5847435 - DNA, 17 bp, Homo sapiens
atcgcttttaataaact

SEQ ID NO: 5847436 - DNA, 18 bp, Homo sapiens
atcgcttttaataaactg

SEQ ID NO: 5847437 - DNA, 15 bp, Homo sapiens
atcggaaaaataatc

SEQ ID NO: 5847438 - DNA, 15 bp, Homo sapiens
atcggaacagctcct

SEQ ID NO: 5847439 - DNA, 14 bp, Homo sapiens
atcggaagaacatg

SEQ ID NO: 5847440 - DNA, 20 bp, Homo sapiens
atcggaagagagggctgagc

SEQ ID NO: 5847441 - DNA, 15 bp, Homo sapiens
atcggacaggaggat

SEQ ID NO: 5847442 - DNA, 17 bp, Homo sapiens
atcggacatagagttgg

SEQ ID NO: 5847443 - DNA, 21 bp, Homo sapiens
atcggactaaactatctgtat

SEQ ID NO: 5847444 - DNA, 23 bp, Homo sapiens
atcggactaaactatctgtattt

SEQ ID NO: 5847445 - DNA, 13 bp, Homo sapiens
atcggagacagtg

SEQ ID NO: 5847446 - DNA, 16 bp, Homo sapiens
atcggagcctcctctc

SEQ ID NO: 5847447 - DNA, 17 bp, Homo sapiens
atcggagcgaagcagag

SEQ ID NO: 5847448 - DNA, 22 bp, Homo sapiens
atcggaggcttgtcagagctgg

SEQ ID NO: 5847449 - DNA, 23 bp, Homo sapiens
atcggaggcttgtcagagctggg

SEQ ID NO: 5847450 - DNA, 18 bp, Homo sapiens
atcggagtcagccaggag

SEQ ID NO: 5847451 - DNA, 14 bp, Homo sapiens
atcggccacagggc

SEQ ID NO: 5847452 - DNA, 16 bp, Homo sapiens
atcggccacagggcgg

SEQ ID NO: 5847453 - DNA, 13 bp, Homo sapiens
atcggccctgtcc

SEQ ID NO: 5847454 - DNA, 22 bp, Homo sapiens
atcggcctagggcccccacagt

SEQ ID NO: 5847455 - DNA, 23 bp, Homo sapiens
atcggctcccgcttgctctcctg

SEQ ID NO: 5847456 - DNA, 22 bp, Homo sapiens
atcggctttcatgtaattatct

SEQ ID NO: 5847457 - DNA, 15 bp, Homo sapiens
atcgggaaagaagaa

SEQ ID NO: 5847458 - DNA, 15 bp, Homo sapiens
atcgggaaggatggg

SEQ ID NO: 5847459 - DNA, 17 bp, Homo sapiens
atcgggaaggatgggaa

SEQ ID NO: 5847460 - DNA, 19 bp, Homo sapiens
atcgggagcacccagagca

SEQ ID NO: 5847461 - DNA, 13 bp, Homo sapiens
atcgggagtagca

SEQ ID NO: 5847462 - DNA, 14 bp, Homo sapiens
atcgggagtagcaa

SEQ ID NO: 5847463 - DNA, 19 bp, Homo sapiens
atcgggagtagcaaggaag

SEQ ID NO: 5847464 - DNA, 21 bp, Homo sapiens
atcgggctaaggtccctgggg

SEQ ID NO: 5847465 - DNA, 18 bp, Homo sapiens
atcggggagccgggagcc

SEQ ID NO: 5847466 - DNA, 13 bp, Homo sapiens
atcggggggtgga

SEQ ID NO: 5847467 - DNA, 22 bp, Homo sapiens
atcgggggtgagcgaagccccc

SEQ ID NO: 5847468 - DNA, 15 bp, Homo sapiens
atcggtcagcggggc

SEQ ID NO: 5847469 - DNA, 19 bp, Homo sapiens
atcggtcttgcccagagga

SEQ ID NO: 5847470 - DNA, 18 bp, Homo sapiens
atcggtgaaactaacaga

SEQ ID NO: 5847471 - DNA, 16 bp, Homo sapiens
atcggttaacaaataa

SEQ ID NO: 5847472 - DNA, 17 bp, Homo sapiens
atcggttcaagttgatg

SEQ ID NO: 5847473 - DNA, 13 bp, Homo sapiens
atcggtttttaaa

SEQ ID NO: 5847474 - DNA, 23 bp, Homo sapiens
atcggtttttaaaggtgatgtaa

SEQ ID NO: 5847475 - DNA, 16 bp, Homo sapiens
atcgtaaaaaaataga

SEQ ID NO: 5847476 - DNA, 20 bp, Homo sapiens
atcgtaaaaaaatagaaaaa

SEQ ID NO: 5847477 - DNA, 15 bp, Homo sapiens
atcgtaaccagccag

SEQ ID NO: 5847478 - DNA, 16 bp, Homo sapiens
atcgtaaccagccaga

SEQ ID NO: 5847479 - DNA, 19 bp, Homo sapiens
atcgtaatgggtatattga

SEQ ID NO: 5847480 - DNA, 16 bp, Homo sapiens
atcgtaatgtacagat

SEQ ID NO: 5847481 - DNA, 11 bp, Homo sapiens
atcgtaattgt

SEQ ID NO: 5847482 - DNA, 13 bp, Homo sapiens
atcgtagaaaatt

SEQ ID NO: 5847483 - DNA, 18 bp, Homo sapiens
atcgtaggcagccacggc

SEQ ID NO: 5847484 - DNA, 15 bp, Homo sapiens
atcgtataaggaaat

SEQ ID NO: 5847485 - DNA, 16 bp, Homo sapiens
atcgtatagctgtatt

SEQ ID NO: 5847486 - DNA, 18 bp, Homo sapiens
atcgtatagctgtattga

SEQ ID NO: 5847487 - DNA, 16 bp, Homo sapiens
atcgtattaaaaaaca

SEQ ID NO: 5847488 - DNA, 19 bp, Homo sapiens
atcgtattaaaaaacaatt

SEQ ID NO: 5847489 - DNA, 14 bp, Homo sapiens
atcgtattaattat

SEQ ID NO: 5847490 - DNA, 13 bp, Homo sapiens
atcgtattacata

SEQ ID NO: 5847491 - DNA, 20 bp, Homo sapiens
atcgtattctaattcttcat

SEQ ID NO: 5847492 - DNA, 21 bp, Homo sapiens
atcgtattctaattcttcatt

SEQ ID NO: 5847493 - DNA, 16 bp, Homo sapiens
atcgtcataggcttct

SEQ ID NO: 5847494 - DNA, 13 bp, Homo sapiens
atcgtccagggag

SEQ ID NO: 5847495 - DNA, 21 bp, Homo sapiens
atcgtccctatatcagggcct

SEQ ID NO: 5847496 - DNA, 13 bp, Homo sapiens
atcgtctaaactt

SEQ ID NO: 5847497 - DNA, 15 bp, Homo sapiens
atcgtctcatcctcc

SEQ ID NO: 5847498 - DNA, 17 bp, Homo sapiens
atcgtctcatcctcctt

SEQ ID NO: 5847499 - DNA, 20 bp, Homo sapiens
atcgtctcatgtaaaataag

SEQ ID NO: 5847500 - DNA, 23 bp, Homo sapiens
atcgtctcctttgacatttcctt

SEQ ID NO: 5847501 - DNA, 12 bp, Homo sapiens
atcgtgaaaccc

SEQ ID NO: 5847502 - DNA, 15 bp, Homo sapiens
atcgtgacaacactt

SEQ ID NO: 5847503 - DNA, 21 bp, Homo sapiens
atcgtgacgctgaataaatgt

SEQ ID NO: 5847504 - DNA, 22 bp, Homo sapiens
atcgtgacgctgaataaatgtc

SEQ ID NO: 5847505 - DNA, 19 bp, Homo sapiens
atcgtgccattacactcca

SEQ ID NO: 5847506 - DNA, 22 bp, Homo sapiens
atctactcttaaatatacaact

SEQ ID NO: 5847507 - DNA, 13 bp, Homo sapiens
atctactcttttg

SEQ ID NO: 5847508 - DNA, 16 bp, Homo sapiens
atctactgactatatt

SEQ ID NO: 5847509 - DNA, 15 bp, Homo sapiens
atctactgactgaaa

SEQ ID NO: 5847510 - DNA, 10 bp, Homo sapiens
atctactgca

SEQ ID NO: 5847511 - DNA, 14 bp, Homo sapiens
atctactgcattta

SEQ ID NO: 5847512 - DNA, 17 bp, Homo sapiens
atctactggaaatgtag

SEQ ID NO: 5847513 - DNA, 19 bp, Homo sapiens
atctacttctgtaattgtg

SEQ ID NO: 5847514 - DNA, 20 bp, Homo sapiens
atctacttctgtaattgtgt

SEQ ID NO: 5847515 - DNA, 23 bp, Homo sapiens
atctacttctgtaattgtgtgga

SEQ ID NO: 5847516 - DNA, 13 bp, Homo sapiens
atctacttgcctc

SEQ ID NO: 5847517 - DNA, 15 bp, Homo sapiens
atctacttggcaagg

SEQ ID NO: 5847518 - DNA, 19 bp, Homo sapiens
atctactttttgtatttag

SEQ ID NO: 5847519 - DNA, 13 bp, Homo sapiens
atctagaaaatga

SEQ ID NO: 5847520 - DNA, 16 bp, Homo sapiens
atctagaaaatgaaaa

SEQ ID NO: 5847521 - DNA, 12 bp, Homo sapiens
atctagaagact

SEQ ID NO: 5847522 - DNA, 15 bp, Homo sapiens
atctagaagggacca

SEQ ID NO: 5847523 - DNA, 19 bp, Homo sapiens
atctagacattcttttaat

SEQ ID NO: 5847524 - DNA, 18 bp, Homo sapiens
atctagagctatgcacac

SEQ ID NO: 5847525 - DNA, 20 bp, Homo sapiens
atctagagctatgcacacca

SEQ ID NO: 5847526 - DNA, 19 bp, Homo sapiens
atctagaggcttccttcat

SEQ ID NO: 5847527 - DNA, 23 bp, Homo sapiens
atctagatacaggactggttcct

SEQ ID NO: 5847528 - DNA, 23 bp, Homo sapiens
atctagataggtaagtgggggcg

SEQ ID NO: 5847529 - DNA, 16 bp, Homo sapiens
atctagatatcgactt

SEQ ID NO: 5847530 - DNA, 19 bp, Homo sapiens
atctagatcaattaattct

SEQ ID NO: 5847531 - DNA, 21 bp, Homo sapiens
atctagatcaattaattctta

SEQ ID NO: 5847532 - DNA, 15 bp, Homo sapiens
atctagatgtaaatt

SEQ ID NO: 5847533 - DNA, 19 bp, Homo sapiens
atctagattatggagcttt

SEQ ID NO: 5847534 - DNA, 15 bp, Homo sapiens
atctagcaagaagat

SEQ ID NO: 5847535 - DNA, 20 bp, Homo sapiens
atctagcaagaagattctaa

SEQ ID NO: 5847536 - DNA, 16 bp, Homo sapiens
atctagcactcctcaa

SEQ ID NO: 5847537 - DNA, 15 bp, Homo sapiens
atctagcagctggcc

SEQ ID NO: 5847538 - DNA, 17 bp, Homo sapiens
atctagccaaagagctc

SEQ ID NO: 5847539 - DNA, 18 bp, Homo sapiens
atctagccaaagagctct

SEQ ID NO: 5847540 - DNA, 12 bp, Homo sapiens
atctagccagcc

SEQ ID NO: 5847541 - DNA, 17 bp, Homo sapiens
atctagccgatggaaaa

SEQ ID NO: 5847542 - DNA, 17 bp, Homo sapiens
atctagcgcaattgaag

SEQ ID NO: 5847543 - DNA, 13 bp, Homo sapiens
atctagctctcca

SEQ ID NO: 5847544 - DNA, 21 bp, Homo sapiens
atctagctctccatactttga

SEQ ID NO: 5847545 - DNA, 18 bp, Homo sapiens
atctagcttcatgcctca

SEQ ID NO: 5847546 - DNA, 21 bp, Homo sapiens
atctagcttcatgcctcagtt

SEQ ID NO: 5847547 - DNA, 18 bp, Homo sapiens
atctagcttcttcagaga

SEQ ID NO: 5847548 - DNA, 17 bp, Homo sapiens
atctaggaaaatatttt

SEQ ID NO: 5847549 - DNA, 20 bp, Homo sapiens
atctaggaaaatattttgat

SEQ ID NO: 5847550 - DNA, 16 bp, Homo sapiens
atctaggaaaattatt

SEQ ID NO: 5847551 - DNA, 17 bp, Homo sapiens
atctaggaagactttgg

SEQ ID NO: 5847552 - DNA, 18 bp, Homo sapiens
atctaggaagactttgga

SEQ ID NO: 5847553 - DNA, 22 bp, Homo sapiens
atctaggaagactttggaaaga

SEQ ID NO: 5847554 - DNA, 23 bp, Homo sapiens
atctaggaagactttggaaagag

SEQ ID NO: 5847555 - DNA, 22 bp, Homo sapiens
atctaggagcaaggtgagaaat

SEQ ID NO: 5847556 - DNA, 23 bp, Homo sapiens
atctaggatgggaacaaggaagg

SEQ ID NO: 5847557 - DNA, 16 bp, Homo sapiens
atctaggatgtgatga

SEQ ID NO: 5847558 - DNA, 17 bp, Homo sapiens
atctaggatgtgatgat

SEQ ID NO: 5847559 - DNA, 11 bp, Homo sapiens
atctaggattt

SEQ ID NO: 5847560 - DNA, 14 bp, Homo sapiens
atctaggcatgaag

SEQ ID NO: 5847561 - DNA, 15 bp, Homo sapiens
atctaggtcctggct

SEQ ID NO: 5847562 - DNA, 20 bp, Homo sapiens
atctaggtgaggattgatta

SEQ ID NO: 5847563 - DNA, 15 bp, Homo sapiens
atctaggtgtggctg

SEQ ID NO: 5847564 - DNA, 17 bp, Homo sapiens
atctaggtgtggctgtg

SEQ ID NO: 5847565 - DNA, 21 bp, Homo sapiens
atctaggtgtggctgtgaagg

SEQ ID NO: 5847566 - DNA, 12 bp, Homo sapiens
atctaggtttaa

SEQ ID NO: 5847567 - DNA, 17 bp, Homo sapiens
atctaggtttaactcag

SEQ ID NO: 5847568 - DNA, 18 bp, Homo sapiens
atctaggtttaactcaga

SEQ ID NO: 5847569 - DNA, 18 bp, Homo sapiens
atctaggtttatgacagt

SEQ ID NO: 5847570 - DNA, 22 bp, Homo sapiens
atctaggtttatgacagtaatt

SEQ ID NO: 5847571 - DNA, 19 bp, Homo sapiens
atctagtaatatatttaaa

SEQ ID NO: 5847572 - DNA, 21 bp, Homo sapiens
atctagtctgaagtctggaac

SEQ ID NO: 5847573 - DNA, 20 bp, Homo sapiens
atctagtgacacctcagtca

SEQ ID NO: 5847574 - DNA, 18 bp, Homo sapiens
atctagtgacagaggaga

SEQ ID NO: 5847575 - DNA, 13 bp, Homo sapiens
atctagtgcagct

SEQ ID NO: 5847576 - DNA, 15 bp, Homo sapiens
atctagtgcagctga

SEQ ID NO: 5847577 - DNA, 21 bp, Homo sapiens
atctagtgccattatttctac

SEQ ID NO: 5847578 - DNA, 22 bp, Homo sapiens
atctagtgctaaacctatctgt

SEQ ID NO: 5847579 - DNA, 23 bp, Homo sapiens
atctagtgggttgacctttaaat

SEQ ID NO: 5847580 - DNA, 16 bp, Homo sapiens
atctagtggtctgatt

SEQ ID NO: 5847581 - DNA, 17 bp, Homo sapiens
atctagtggtctgattt

SEQ ID NO: 5847582 - DNA, 13 bp, Homo sapiens
atctagtgtctaa

SEQ ID NO: 5847583 - DNA, 12 bp, Homo sapiens
atctagtgtttg

SEQ ID NO: 5847584 - DNA, 18 bp, Homo sapiens
atctagttaagtcgctga

SEQ ID NO: 5847585 - DNA, 22 bp, Homo sapiens
atctagttcccctgtttattca

SEQ ID NO: 5847586 - DNA, 17 bp, Homo sapiens
atctagttgtcaataaa

SEQ ID NO: 5847587 - DNA, 16 bp, Homo sapiens
atctagtttacagaaa

SEQ ID NO: 5847588 - DNA, 20 bp, Homo sapiens
atctagtttccctggtgccc

SEQ ID NO: 5847589 - DNA, 15 bp, Homo sapiens
atctataaacactgt

SEQ ID NO: 5847590 - DNA, 15 bp, Homo sapiens
atctataaactataa

SEQ ID NO: 5847591 - DNA, 13 bp, Homo sapiens
atctataaagaag

SEQ ID NO: 5847592 - DNA, 17 bp, Homo sapiens
atctataacataaagaa

SEQ ID NO: 5847593 - DNA, 17 bp, Homo sapiens
atctataactacatatt

SEQ ID NO: 5847594 - DNA, 16 bp, Homo sapiens
atctatacatatcttt

SEQ ID NO: 5847595 - DNA, 15 bp, Homo sapiens
atctatacgtaattt

SEQ ID NO: 5847596 - DNA, 14 bp, Homo sapiens
atctatagaaagtg

SEQ ID NO: 5847597 - DNA, 17 bp, Homo sapiens
atctatagaaagtgttc

SEQ ID NO: 5847598 - DNA, 22 bp, Homo sapiens
atctatagaaagtgttctgtta

SEQ ID NO: 5847599 - DNA, 16 bp, Homo sapiens
atctatagaactgaat

SEQ ID NO: 5847600 - DNA, 21 bp, Homo sapiens
atctataggaagattgaacct

SEQ ID NO: 5847601 - DNA, 17 bp, Homo sapiens
atctataggcagcttct

SEQ ID NO: 5847602 - DNA, 21 bp, Homo sapiens
atctataggcagcttctaaga

SEQ ID NO: 5847603 - DNA, 23 bp, Homo sapiens
atctatagtagtcaattagtaca

SEQ ID NO: 5847604 - DNA, 20 bp, Homo sapiens
atctatagtatagaatgaac

SEQ ID NO: 5847605 - DNA, 11 bp, Homo sapiens
atctatataaa

SEQ ID NO: 5847606 - DNA, 13 bp, Homo sapiens
atctatataaaat

SEQ ID NO: 5847607 - DNA, 14 bp, Homo sapiens
atctatataaaata

SEQ ID NO: 5847608 - DNA, 20 bp, Homo sapiens
atctatatagtacctttgct

SEQ ID NO: 5847609 - DNA, 13 bp, Homo sapiens
atctatatataat

SEQ ID NO: 5847610 - DNA, 15 bp, Homo sapiens
atctatatataattc

SEQ ID NO: 5847611 - DNA, 15 bp, Homo sapiens
atctatatatacata

SEQ ID NO: 5847612 - DNA, 16 bp, Homo sapiens
atctatatatacatat

SEQ ID NO: 5847613 - DNA, 18 bp, Homo sapiens
atctatatatgtgtatgt

SEQ ID NO: 5847614 - DNA, 18 bp, Homo sapiens
atctatatcatatttctg

SEQ ID NO: 5847615 - DNA, 20 bp, Homo sapiens
atctatatcatatttctgtg

SEQ ID NO: 5847616 - DNA, 16 bp, Homo sapiens
atctatattaaagtgt

SEQ ID NO: 5847617 - DNA, 16 bp, Homo sapiens
atctatattaaatgag

SEQ ID NO: 5847618 - DNA, 15 bp, Homo sapiens
atctatatttaacaa

SEQ ID NO: 5847619 - DNA, 20 bp, Homo sapiens
atctatatttgtcttccgat

SEQ ID NO: 5847620 - DNA, 14 bp, Homo sapiens
atctatattttaca

SEQ ID NO: 5847621 - DNA, 17 bp, Homo sapiens
atctatattttacataa

SEQ ID NO: 5847622 - DNA, 21 bp, Homo sapiens
atctatattttacataaattt

SEQ ID NO: 5847623 - DNA, 19 bp, Homo sapiens
atctatatttttgtactga

SEQ ID NO: 5847624 - DNA, 17 bp, Homo sapiens
atctatcaatagtcaag

SEQ ID NO: 5847625 - DNA, 15 bp, Homo sapiens
atctatcacctgtca

SEQ ID NO: 5847626 - DNA, 17 bp, Homo sapiens
atctatcagtagtatag

SEQ ID NO: 5847627 - DNA, 15 bp, Homo sapiens
atctatctacaaaga

SEQ ID NO: 5847628 - DNA, 23 bp, Homo sapiens
atctatctacaaagaaaaattaa

SEQ ID NO: 5847629 - DNA, 17 bp, Homo sapiens
atctatctctatataaa

SEQ ID NO: 5847630 - DNA, 14 bp, Homo sapiens
atctatctgccttt

SEQ ID NO: 5847631 - DNA, 16 bp, Homo sapiens
atctatctggtgattt

SEQ ID NO: 5847632 - DNA, 19 bp, Homo sapiens
atctatctggtgatttcta

SEQ ID NO: 5847633 - DNA, 21 bp, Homo sapiens
atctatctggtgatttctagc

SEQ ID NO: 5847634 - DNA, 22 bp, Homo sapiens
atctatcttaatactaaggaac

SEQ ID NO: 5847635 - DNA, 21 bp, Homo sapiens
atctatgaacaacagtagttt

SEQ ID NO: 5847636 - DNA, 19 bp, Homo sapiens
atctatgaacctgaaaagg

SEQ ID NO: 5847637 - DNA, 13 bp, Homo sapiens
atctatgactgtg

SEQ ID NO: 5847638 - DNA, 13 bp, Homo sapiens
atctatgaggaaa

SEQ ID NO: 5847639 - DNA, 18 bp, Homo sapiens
atctatgagggtgtttcc

SEQ ID NO: 5847640 - DNA, 13 bp, Homo sapiens
atctatgatataa

SEQ ID NO: 5847641 - DNA, 18 bp, Homo sapiens
atctatgatatatttata

SEQ ID NO: 5847642 - DNA, 23 bp, Homo sapiens
atctatgatatatttatatcata

SEQ ID NO: 5847643 - DNA, 22 bp, Homo sapiens
atctatgatgaaggtaattaaa

SEQ ID NO: 5847644 - DNA, 15 bp, Homo sapiens
atctatgatgtttct

SEQ ID NO: 5847645 - DNA, 21 bp, Homo sapiens
atctatgcaatttttaaacta

SEQ ID NO: 5847646 - DNA, 23 bp, Homo sapiens
atctatgcaatttttaaactagt

SEQ ID NO: 5847647 - DNA, 16 bp, Homo sapiens
atctatgcattttctg

SEQ ID NO: 5847648 - DNA, 19 bp, Homo sapiens
atctatgccaaagatcact

SEQ ID NO: 5847649 - DNA, 21 bp, Homo sapiens
atctatgccaaagatcacttg

SEQ ID NO: 5847650 - DNA, 13 bp, Homo sapiens
atctatggagggc

SEQ ID NO: 5847651 - DNA, 14 bp, Homo sapiens
atctatggagggca

SEQ ID NO: 5847652 - DNA, 19 bp, Homo sapiens
atctatggcttatttctat

SEQ ID NO: 5847653 - DNA, 21 bp, Homo sapiens
atctatgggagattaaaacca

SEQ ID NO: 5847654 - DNA, 18 bp, Homo sapiens
atctatgggcatttggtg

SEQ ID NO: 5847655 - DNA, 14 bp, Homo sapiens
atctatggttctaa

SEQ ID NO: 5847656 - DNA, 15 bp, Homo sapiens
atctatgtcatattt

SEQ ID NO: 5847657 - DNA, 20 bp, Homo sapiens
atctatgtcgtgttttcaag

SEQ ID NO: 5847658 - DNA, 23 bp, Homo sapiens
atctatgtcgtgttttcaaggaa

SEQ ID NO: 5847659 - DNA, 18 bp, Homo sapiens
atctatgtgtttctgtaa

SEQ ID NO: 5847660 - DNA, 22 bp, Homo sapiens
atctatgtttgtgtgatttcct

SEQ ID NO: 5847661 - DNA, 19 bp, Homo sapiens
atctattaaaattgccatt

SEQ ID NO: 5847662 - DNA, 14 bp, Homo sapiens
atctattaaagtga

SEQ ID NO: 5847663 - DNA, 15 bp, Homo sapiens
atctattaaagtgac

SEQ ID NO: 5847664 - DNA, 18 bp, Homo sapiens
atctattaaagtgacttt

SEQ ID NO: 5847665 - DNA, 23 bp, Homo sapiens
atctattaagggattagtatttt

SEQ ID NO: 5847666 - DNA, 14 bp, Homo sapiens
atctattaatatat

SEQ ID NO: 5847667 - DNA, 16 bp, Homo sapiens
atctattactctgaca

SEQ ID NO: 5847668 - DNA, 17 bp, Homo sapiens
atctattatactgtatt

SEQ ID NO: 5847669 - DNA, 17 bp, Homo sapiens
atctattcagacaagca

SEQ ID NO: 5847670 - DNA, 19 bp, Homo sapiens
atctattctcaaagttaaa

SEQ ID NO: 5847671 - DNA, 23 bp, Homo sapiens
atctattctctccaaaaatgcac

SEQ ID NO: 5847672 - DNA, 17 bp, Homo sapiens
atctattctgagaaaac

SEQ ID NO: 5847673 - DNA, 22 bp, Homo sapiens
atctattctgagaaaacaagca

SEQ ID NO: 5847674 - DNA, 13 bp, Homo sapiens
atctattctgtgt

SEQ ID NO: 5847675 - DNA, 18 bp, Homo sapiens
atctattgaaaatatata

SEQ ID NO: 5847676 - DNA, 20 bp, Homo sapiens
atctattgaaaatatatatt

SEQ ID NO: 5847677 - DNA, 12 bp, Homo sapiens
atctattgctca

SEQ ID NO: 5847678 - DNA, 23 bp, Homo sapiens
atctattgctggcaaagacagaa

SEQ ID NO: 5847679 - DNA, 15 bp, Homo sapiens
atctattgggatttt

SEQ ID NO: 5847680 - DNA, 13 bp, Homo sapiens
atctattgtaaga

SEQ ID NO: 5847681 - DNA, 14 bp, Homo sapiens
atctattgtaagat

SEQ ID NO: 5847682 - DNA, 19 bp, Homo sapiens
atctattgtctacttgcga

SEQ ID NO: 5847683 - DNA, 22 bp, Homo sapiens
atctgagccctccctcttccca

SEQ ID NO: 5847684 - DNA, 17 bp, Homo sapiens
atctgagcctaaatcta

SEQ ID NO: 5847685 - DNA, 19 bp, Homo sapiens
atctgagcctaaatctaat

SEQ ID NO: 5847686 - DNA, 20 bp, Homo sapiens
atctgagcgtttaaagtact

SEQ ID NO: 5847687 - DNA, 15 bp, Homo sapiens
atctgagctcccacc

SEQ ID NO: 5847688 - DNA, 23 bp, Homo sapiens
atctgagctcccacctcccttcc

SEQ ID NO: 5847689 - DNA, 18 bp, Homo sapiens
atctgagctctttgcact

SEQ ID NO: 5847690 - DNA, 16 bp, Homo sapiens
atctgagctgagccag

SEQ ID NO: 5847691 - DNA, 17 bp, Homo sapiens
atctgagctgcagcctg

SEQ ID NO: 5847692 - DNA, 17 bp, Homo sapiens
atctgaggaattctgta

SEQ ID NO: 5847693 - DNA, 14 bp, Homo sapiens
atctgaggagtcca

SEQ ID NO: 5847694 - DNA, 15 bp, Homo sapiens
atctgaggagtccaa

SEQ ID NO: 5847695 - DNA, 16 bp, Homo sapiens
atctgaggagtccaaa

SEQ ID NO: 5847696 - DNA, 18 bp, Homo sapiens
atctgaggatgaccagaa

SEQ ID NO: 5847697 - DNA, 23 bp, Homo sapiens
atctgaggcatccagcagtctct

SEQ ID NO: 5847698 - DNA, 15 bp, Homo sapiens
atctgaggcatcctc

SEQ ID NO: 5847699 - DNA, 14 bp, Homo sapiens
atctgagggaaatg

SEQ ID NO: 5847700 - DNA, 15 bp, Homo sapiens
atctgagggaaatgt

SEQ ID NO: 5847701 - DNA, 21 bp, Homo sapiens
atctgagggaaatgttttgta

SEQ ID NO: 5847702 - DNA, 23 bp, Homo sapiens
atctgagggaaatgttttgtaaa

SEQ ID NO: 5847703 - DNA, 19 bp, Homo sapiens
atctgagggaggaggccac

SEQ ID NO: 5847704 - DNA, 20 bp, Homo sapiens
atctgagggaggaggccacc

SEQ ID NO: 5847705 - DNA, 20 bp, Homo sapiens
atctgagggcactctctgcc

SEQ ID NO: 5847706 - DNA, 19 bp, Homo sapiens
atctgagggttaatttcta

SEQ ID NO: 5847707 - DNA, 16 bp, Homo sapiens
atctgaggttggattt

SEQ ID NO: 5847708 - DNA, 21 bp, Homo sapiens
atctgaggttggatttgctca

SEQ ID NO: 5847709 - DNA, 19 bp, Homo sapiens
atctgagtaggtctgggat

SEQ ID NO: 5847710 - DNA, 14 bp, Homo sapiens
atctgagtcctgga

SEQ ID NO: 5847711 - DNA, 12 bp, Homo sapiens
atctgagttgca

SEQ ID NO: 5847712 - DNA, 13 bp, Homo sapiens
atctgagttgcat

SEQ ID NO: 5847713 - DNA, 14 bp, Homo sapiens
atctgagttgccaa

SEQ ID NO: 5847714 - DNA, 16 bp, Homo sapiens
atctgagttgccaaga

SEQ ID NO: 5847715 - DNA, 20 bp, Homo sapiens
atctgagttgccaagacaaa

SEQ ID NO: 5847716 - DNA, 16 bp, Homo sapiens
atctgagttgtgcctc

SEQ ID NO: 5847717 - DNA, 23 bp, Homo sapiens
atctgagttgtgcctcatttatt

SEQ ID NO: 5847718 - DNA, 15 bp, Homo sapiens
atctgataaaattgt

SEQ ID NO: 5847719 - DNA, 22 bp, Homo sapiens
atctgataaaattgtgatgttt

SEQ ID NO: 5847720 - DNA, 13 bp, Homo sapiens
atctgataagcaa

SEQ ID NO: 5847721 - DNA, 16 bp, Homo sapiens
atctgataccaaagag

SEQ ID NO: 5847722 - DNA, 20 bp, Homo sapiens
atctgatagaatgatgtttt

SEQ ID NO: 5847723 - DNA, 22 bp, Homo sapiens
atctgatagggtttgtgacagg

SEQ ID NO: 5847724 - DNA, 19 bp, Homo sapiens
atctgatatcagcactgga

SEQ ID NO: 5847725 - DNA, 13 bp, Homo sapiens
atctgatatcagg

SEQ ID NO: 5847726 - DNA, 20 bp, Homo sapiens
atctgatattcaaacacaca

SEQ ID NO: 5847727 - DNA, 20 bp, Homo sapiens
atctgatcacccccctgctt

SEQ ID NO: 5847728 - DNA, 19 bp, Homo sapiens
atctgatcagaacaaatgt

SEQ ID NO: 5847729 - DNA, 18 bp, Homo sapiens
atctgatcgttctttcta

SEQ ID NO: 5847730 - DNA, 13 bp, Homo sapiens
atctgatctgtga

SEQ ID NO: 5847731 - DNA, 22 bp, Homo sapiens
atctgatctttttatacacaat

SEQ ID NO: 5847732 - DNA, 16 bp, Homo sapiens
atctgatgatgttctg

SEQ ID NO: 5847733 - DNA, 19 bp, Homo sapiens
atctgatgatgttctgaaa

SEQ ID NO: 5847734 - DNA, 23 bp, Homo sapiens
atctgatggccttaatttccttt

SEQ ID NO: 5847735 - DNA, 14 bp, Homo sapiens
atctgatggcttct

SEQ ID NO: 5847736 - DNA, 16 bp, Homo sapiens
atctgatgggcctggc

SEQ ID NO: 5847737 - DNA, 18 bp, Homo sapiens
atctgatgggcctggctg

SEQ ID NO: 5847738 - DNA, 16 bp, Homo sapiens
atctgatggtgagctg

SEQ ID NO: 5847739 - DNA, 18 bp, Homo sapiens
atctgatgtttgttttcg

SEQ ID NO: 5847740 - DNA, 14 bp, Homo sapiens
atctgattgcactg

SEQ ID NO: 5847741 - DNA, 14 bp, Homo sapiens
atctgattggcaga

SEQ ID NO: 5847742 - DNA, 17 bp, Homo sapiens
atctgattgtgatgtga

SEQ ID NO: 5847743 - DNA, 16 bp, Homo sapiens
atctgatttaatgttt

SEQ ID NO: 5847744 - DNA, 14 bp, Homo sapiens
atctgatttactta

SEQ ID NO: 5847745 - DNA, 21 bp, Homo sapiens
atctgatttgcatattcattc

SEQ ID NO: 5847746 - DNA, 19 bp, Homo sapiens
atctgatttgttttcctct

SEQ ID NO: 5847747 - DNA, 14 bp, Homo sapiens
atctgattttcaaa

SEQ ID NO: 5847748 - DNA, 17 bp, Homo sapiens
atctgattttttttgta

SEQ ID NO: 5847749 - DNA, 22 bp, Homo sapiens
atctgcaaaaggcctcttgtaa

SEQ ID NO: 5847750 - DNA, 13 bp, Homo sapiens
atctgcaaagcat

SEQ ID NO: 5847751 - DNA, 11 bp, Homo sapiens
atctgcaaagg

SEQ ID NO: 5847752 - DNA, 15 bp, Homo sapiens
atctgcaaatagttt

SEQ ID NO: 5847753 - DNA, 21 bp, Homo sapiens
atctgcaatgtttttgtgtag

SEQ ID NO: 5847754 - DNA, 13 bp, Homo sapiens
atctgcacactcc

SEQ ID NO: 5847755 - DNA, 15 bp, Homo sapiens
atctgcacactccag

SEQ ID NO: 5847756 - DNA, 16 bp, Homo sapiens
atctgcacactccagg

SEQ ID NO: 5847757 - DNA, 15 bp, Homo sapiens
atctgcacagtcaga

SEQ ID NO: 5847758 - DNA, 21 bp, Homo sapiens
atctgcacccccctgggctga

SEQ ID NO: 5847759 - DNA, 18 bp, Homo sapiens
atctgcaccccttctctc

SEQ ID NO: 5847760 - DNA, 20 bp, Homo sapiens
atctgcaccccttctctcct

SEQ ID NO: 5847761 - DNA, 21 bp, Homo sapiens
atctgcaccctcgatgaagcc

SEQ ID NO: 5847762 - DNA, 20 bp, Homo sapiens
atctgcacccttcttttctc

SEQ ID NO: 5847763 - DNA, 22 bp, Homo sapiens
atctgcacccttcttttctcat

SEQ ID NO: 5847764 - DNA, 22 bp, Homo sapiens
atctgcactcctgtctcttggg

SEQ ID NO: 5847765 - DNA, 19 bp, Homo sapiens
atctgcactctaaactgca

SEQ ID NO: 5847766 - DNA, 21 bp, Homo sapiens
atctgcactctaaactgcaaa

SEQ ID NO: 5847767 - DNA, 14 bp, Homo sapiens
atctgcagaaggaa

SEQ ID NO: 5847768 - DNA, 22 bp, Homo sapiens
atctgcagaaggaaaaatgtgt

SEQ ID NO: 5847769 - DNA, 23 bp, Homo sapiens
atctgcagaaggaaaaatgtgta

SEQ ID NO: 5847770 - DNA, 19 bp, Homo sapiens
atctgcaggcagacacgga

SEQ ID NO: 5847771 - DNA, 12 bp, Homo sapiens
atctgcaggctg

SEQ ID NO: 5847772 - DNA, 13 bp, Homo sapiens
atctgcaggctgc

SEQ ID NO: 5847773 - DNA, 13 bp, Homo sapiens
atctgcagtcact

SEQ ID NO: 5847774 - DNA, 15 bp, Homo sapiens
atctgcagtgttctg

SEQ ID NO: 5847775 - DNA, 17 bp, Homo sapiens
atctgcagtgttctgtg

SEQ ID NO: 5847776 - DNA, 18 bp, Homo sapiens
atctgcagtgttctgtga

SEQ ID NO: 5847777 - DNA, 20 bp, Homo sapiens
atctgcagtgttctgtgaat

SEQ ID NO: 5847778 - DNA, 16 bp, Homo sapiens
atctgcagtttgtgaa

SEQ ID NO: 5847779 - DNA, 13 bp, Homo sapiens
atctgcatatgtt

SEQ ID NO: 5847780 - DNA, 15 bp, Homo sapiens
atctgcattatctat

SEQ ID NO: 5847781 - DNA, 14 bp, Homo sapiens
atctgcattcccag

SEQ ID NO: 5847782 - DNA, 14 bp, Homo sapiens
atctgcattcctga

SEQ ID NO: 5847783 - DNA, 17 bp, Homo sapiens
atctgcattgcccagtc

SEQ ID NO: 5847784 - DNA, 15 bp, Homo sapiens
atctgcatttagcac

SEQ ID NO: 5847785 - DNA, 19 bp, Homo sapiens
atctgcatttataaatgtg

SEQ ID NO: 5847786 - DNA, 24 bp, Homo sapiens
atctgcatttataaatgtgtggtg

SEQ ID NO: 5847787 - DNA, 22 bp, Homo sapiens
atctgcatttatcttttttcct

SEQ ID NO: 5847788 - DNA, 22 bp, Homo sapiens
atctgcattttcaccccaccct

SEQ ID NO: 5847789 - DNA, 23 bp, Homo sapiens
atctgcattttctgggttctggg

SEQ ID NO: 5847790 - DNA, 16 bp, Homo sapiens
atctgccaaattgaga

SEQ ID NO: 5847791 - DNA, 14 bp, Homo sapiens
atctgccaccgtgg

SEQ ID NO: 5847792 - DNA, 13 bp, Homo sapiens
atctgccacctgc

SEQ ID NO: 5847793 - DNA, 16 bp, Homo sapiens
atctgccacctgcaca

SEQ ID NO: 5847794 - DNA, 17 bp, Homo sapiens
atctgccacctgcacag

SEQ ID NO: 5847795 - DNA, 13 bp, Homo sapiens
atctgccagacct

SEQ ID NO: 5847796 - DNA, 14 bp, Homo sapiens
atctgccagacctg

SEQ ID NO: 5847797 - DNA, 15 bp, Homo sapiens
atctgccagacctgc

SEQ ID NO: 5847798 - DNA, 16 bp, Homo sapiens
atctgccagaccttaa

SEQ ID NO: 5847799 - DNA, 17 bp, Homo sapiens
atctgccagacttaaaa

SEQ ID NO: 5847800 - DNA, 22 bp, Homo sapiens
atctgccatctaatggcttcag

SEQ ID NO: 5847801 - DNA, 17 bp, Homo sapiens
atctgccattactctgc

SEQ ID NO: 5847802 - DNA, 14 bp, Homo sapiens
atctgcccaactgt

SEQ ID NO: 5847803 - DNA, 21 bp, Homo sapiens
atctgcccacctcggcctccc

SEQ ID NO: 5847804 - DNA, 13 bp, Homo sapiens
atctgcccagggg

SEQ ID NO: 5847805 - DNA, 22 bp, Homo sapiens
atctgccccaggtacacctccc

SEQ ID NO: 5847806 - DNA, 16 bp, Homo sapiens
atctgccccctagttc

SEQ ID NO: 5847807 - DNA, 13 bp, Homo sapiens
atctgcccctccc

SEQ ID NO: 5847808 - DNA, 15 bp, Homo sapiens
atctgcccctccccc

SEQ ID NO: 5847809 - DNA, 16 bp, Homo sapiens
atctgcccctccccca

SEQ ID NO: 5847810 - DNA, 17 bp, Homo sapiens
atctgcccctcccccaa

SEQ ID NO: 5847811 - DNA, 18 bp, Homo sapiens
atctgcccctcccccact

SEQ ID NO: 5847812 - DNA, 13 bp, Homo sapiens
atctgcccgcctg

SEQ ID NO: 5847813 - DNA, 15 bp, Homo sapiens
atctgcccgcctgcc

SEQ ID NO: 5847814 - DNA, 22 bp, Homo sapiens
atctgcccgcctgcccacctgc

SEQ ID NO: 5847815 - DNA, 22 bp, Homo sapiens
atctgccctcagatgaaaataa

SEQ ID NO: 5847816 - DNA, 19 bp, Homo sapiens
atctgccgcctggggctcc

SEQ ID NO: 5847817 - DNA, 19 bp, Homo sapiens
atctgcctaaggacttctt

SEQ ID NO: 5847818 - DNA, 20 bp, Homo sapiens
atctgcctaaggacttcttt

SEQ ID NO: 5847819 - DNA, 15 bp, Homo sapiens
atctgcctagaaaac

SEQ ID NO: 5847820 - DNA, 21 bp, Homo sapiens
atctgcctcccctgtggaaat

SEQ ID NO: 5847821 - DNA, 16 bp, Homo sapiens
atctgcctctattcaa

SEQ ID NO: 5847822 - DNA, 18 bp, Homo sapiens
atctgcctctcttgtaat

SEQ ID NO: 5847823 - DNA, 18 bp, Homo sapiens
atctgcctgaccccttca

SEQ ID NO: 5847824 - DNA, 15 bp, Homo sapiens
atctgcctgcagtgt

SEQ ID NO: 5847825 - DNA, 12 bp, Homo sapiens
atctgcctggag

SEQ ID NO: 5847826 - DNA, 16 bp, Homo sapiens
atctgcctggagcctg

SEQ ID NO: 5847827 - DNA, 19 bp, Homo sapiens
atctgcctggagcctgggc

SEQ ID NO: 5847828 - DNA, 20 bp, Homo sapiens
atctgcctggagcctgggca

SEQ ID NO: 5847829 - DNA, 14 bp, Homo sapiens
atctgcctggaggc

SEQ ID NO: 5847830 - DNA, 11 bp, Homo sapiens
atctgcctggc

SEQ ID NO: 5847831 - DNA, 13 bp, Homo sapiens
atctgcctggcct

SEQ ID NO: 5847832 - DNA, 17 bp, Homo sapiens
atctgcctggcctggct

SEQ ID NO: 5847833 - DNA, 19 bp, Homo sapiens
atctgcctggcctggctcc

SEQ ID NO: 5847834 - DNA, 23 bp, Homo sapiens
atctgcctggcctggctccccac

SEQ ID NO: 5847835 - DNA, 13 bp, Homo sapiens
atctgcctgggcc

SEQ ID NO: 5847836 - DNA, 12 bp, Homo sapiens
atctgcctgggt

SEQ ID NO: 5847837 - DNA, 17 bp, Homo sapiens
atctgccttaaaaccaa

SEQ ID NO: 5847838 - DNA, 14 bp, Homo sapiens
atctgccttgctgc

SEQ ID NO: 5847839 - DNA, 14 bp, Homo sapiens
atctgcctttgttt

SEQ ID NO: 5847840 - DNA, 23 bp, Homo sapiens
atctgcgagtagatgaacctgca

SEQ ID NO: 5847841 - DNA, 23 bp, Homo sapiens
atctgcggatctcagctttgaga

SEQ ID NO: 5847842 - DNA, 16 bp, Homo sapiens
atctgcggggcttctg

SEQ ID NO: 5847843 - DNA, 22 bp, Homo sapiens
atctgcggggcttctgggtggc

SEQ ID NO: 5847844 - DNA, 21 bp, Homo sapiens
atctgcgggggcagtgctcac

SEQ ID NO: 5847845 - DNA, 23 bp, Homo sapiens
atctgcgggggcagtgctcaccc

SEQ ID NO: 5847846 - DNA, 17 bp, Homo sapiens
atctgcgtgacaataaa

SEQ ID NO: 5847847 - DNA, 21 bp, Homo sapiens
atctgcgtgacaataaaacat

SEQ ID NO: 5847848 - DNA, 20 bp, Homo sapiens
atctgcgtgcacttcccaga

SEQ ID NO: 5847849 - DNA, 17 bp, Homo sapiens
atctgctagtgctgtaa

SEQ ID NO: 5847850 - DNA, 14 bp, Homo sapiens
atctgctataaact

SEQ ID NO: 5847851 - DNA, 13 bp, Homo sapiens
atctgctcacttt

SEQ ID NO: 5847852 - DNA, 14 bp, Homo sapiens
atctgctcacttta

SEQ ID NO: 5847853 - DNA, 15 bp, Homo sapiens
atctgctcagcagct

SEQ ID NO: 5847854 - DNA, 18 bp, Homo sapiens
atctgctcagcaggccct

SEQ ID NO: 5847855 - DNA, 15 bp, Homo sapiens
atctgctcagccctg

SEQ ID NO: 5847856 - DNA, 18 bp, Homo sapiens
atctgctcattttgacaa

SEQ ID NO: 5847857 - DNA, 15 bp, Homo sapiens
atctgctccaacaga

SEQ ID NO: 5847858 - DNA, 21 bp, Homo sapiens
atctgctcctagcccagcaga

SEQ ID NO: 5847859 - DNA, 16 bp, Homo sapiens
atctgctccttcctgt

SEQ ID NO: 5847860 - DNA, 19 bp, Homo sapiens
atctgctctagattcataa

SEQ ID NO: 5847861 - DNA, 18 bp, Homo sapiens
atcttcagttgtctctga

SEQ ID NO: 5847862 - DNA, 19 bp, Homo sapiens
atcttcagtttaatgcaag

SEQ ID NO: 5847863 - DNA, 22 bp, Homo sapiens
atcttcatatctatcagagtat

SEQ ID NO: 5847864 - DNA, 20 bp, Homo sapiens
atcttcatcccaacagccca

SEQ ID NO: 5847865 - DNA, 23 bp, Homo sapiens
atcttcatggaattcacaaagta

SEQ ID NO: 5847866 - DNA, 14 bp, Homo sapiens
atcttcatgtaaat

SEQ ID NO: 5847867 - DNA, 15 bp, Homo sapiens
atcttcattaccaat

SEQ ID NO: 5847868 - DNA, 19 bp, Homo sapiens
atcttccaactcaaactct

SEQ ID NO: 5847869 - DNA, 22 bp, Homo sapiens
atcttccaatttagttgttgta

SEQ ID NO: 5847870 - DNA, 17 bp, Homo sapiens
atcttccagaagtgtga

SEQ ID NO: 5847871 - DNA, 19 bp, Homo sapiens
atcttccagaagtgtgatt

SEQ ID NO: 5847872 - DNA, 18 bp, Homo sapiens
atcttccaggtggggtga

SEQ ID NO: 5847873 - DNA, 16 bp, Homo sapiens
atcttccatatccggg

SEQ ID NO: 5847874 - DNA, 20 bp, Homo sapiens
atcttccatatccgggtgct

SEQ ID NO: 5847875 - DNA, 17 bp, Homo sapiens
atcttccatatttggaa

SEQ ID NO: 5847876 - DNA, 19 bp, Homo sapiens
atcttccatatttggaaga

SEQ ID NO: 5847877 - DNA, 20 bp, Homo sapiens
atcttcccagcagggccact

SEQ ID NO: 5847878 - DNA, 23 bp, Homo sapiens
atcttcccagcagggccactccc

SEQ ID NO: 5847879 - DNA, 15 bp, Homo sapiens
atcttcccataataa

SEQ ID NO: 5847880 - DNA, 19 bp, Homo sapiens
atcttcccataataaagca

SEQ ID NO: 5847881 - DNA, 14 bp, Homo sapiens
atcttcccatgcat

SEQ ID NO: 5847882 - DNA, 21 bp, Homo sapiens
atcttccccaacgaaaagcac

SEQ ID NO: 5847883 - DNA, 23 bp, Homo sapiens
atcttccccaagggccaaaccca

SEQ ID NO: 5847884 - DNA, 13 bp, Homo sapiens
atcttccccagcc

SEQ ID NO: 5847885 - DNA, 23 bp, Homo sapiens
atcttcccccttcccgccttcag

SEQ ID NO: 5847886 - DNA, 20 bp, Homo sapiens
atcttcccgcctcagcctct

SEQ ID NO: 5847887 - DNA, 19 bp, Homo sapiens
atcttccctacccttcctg

SEQ ID NO: 5847888 - DNA, 13 bp, Homo sapiens
atcttccctgccc

SEQ ID NO: 5847889 - DNA, 18 bp, Homo sapiens
atcttccctgcccctgtg

SEQ ID NO: 5847890 - DNA, 22 bp, Homo sapiens
atcttccctgcccctgtgcctc

SEQ ID NO: 5847891 - DNA, 23 bp, Homo sapiens
atcttccgtggtcagagtgccac

SEQ ID NO: 5847892 - DNA, 13 bp, Homo sapiens
atcttcctcatca

SEQ ID NO: 5847893 - DNA, 12 bp, Homo sapiens
atcttcctctgc

SEQ ID NO: 5847894 - DNA, 16 bp, Homo sapiens
atcttcctctgctaaa

SEQ ID NO: 5847895 - DNA, 15 bp, Homo sapiens
atcttcctctggagc

SEQ ID NO: 5847896 - DNA, 13 bp, Homo sapiens
atcttcctgctgc

SEQ ID NO: 5847897 - DNA, 14 bp, Homo sapiens
atcttcctgctgct

SEQ ID NO: 5847898 - DNA, 15 bp, Homo sapiens
atcttcctgctgctg

SEQ ID NO: 5847899 - DNA, 12 bp, Homo sapiens
atcttcctggca

SEQ ID NO: 5847900 - DNA, 19 bp, Homo sapiens
atcttcctggtcgaaagtt

SEQ ID NO: 5847901 - DNA, 22 bp, Homo sapiens
atcttcctggtcgaaagttagt

SEQ ID NO: 5847902 - DNA, 13 bp, Homo sapiens
atcttcctgtgtc

SEQ ID NO: 5847903 - DNA, 14 bp, Homo sapiens
atcttcctgtgtcc

SEQ ID NO: 5847904 - DNA, 23 bp, Homo sapiens
atcttccttaatcctattttcat

SEQ ID NO: 5847905 - DNA, 16 bp, Homo sapiens
atcttccttctcagcc

SEQ ID NO: 5847906 - DNA, 15 bp, Homo sapiens
atcttccttgtgagg

SEQ ID NO: 5847907 - DNA, 12 bp, Homo sapiens
atcttcctttct

SEQ ID NO: 5847908 - DNA, 17 bp, Homo sapiens
atcttcctttcttgtct

SEQ ID NO: 5847909 - DNA, 22 bp, Homo sapiens
atcttcctttcttgtctttcct

SEQ ID NO: 5847910 - DNA, 18 bp, Homo sapiens
atcttcgacagctgggct

SEQ ID NO: 5847911 - DNA, 18 bp, Homo sapiens
atcttcgatgaacctgac

SEQ ID NO: 5847912 - DNA, 15 bp, Homo sapiens
atcttcgggaccagg

SEQ ID NO: 5847913 - DNA, 19 bp, Homo sapiens
atcttcggggtgtgatgaa

SEQ ID NO: 5847914 - DNA, 15 bp, Homo sapiens
atcttcgtcctgccc

SEQ ID NO: 5847915 - DNA, 15 bp, Homo sapiens
atcttcgtcttcact

SEQ ID NO: 5847916 - DNA, 21 bp, Homo sapiens
atcttcgttagtaatctgtat

SEQ ID NO: 5847917 - DNA, 13 bp, Homo sapiens
atcttctaaatgg

SEQ ID NO: 5847918 - DNA, 15 bp, Homo sapiens
atcttctacttttaa

SEQ ID NO: 5847919 - DNA, 14 bp, Homo sapiens
atcttctagccaca

SEQ ID NO: 5847920 - DNA, 21 bp, Homo sapiens
atcttctatatgtttaaaagt

SEQ ID NO: 5847921 - DNA, 19 bp, Homo sapiens
atcttctcaaccttatcaa

SEQ ID NO: 5847922 - DNA, 22 bp, Homo sapiens
atcttctcaaccttatcaagga

SEQ ID NO: 5847923 - DNA, 16 bp, Homo sapiens
atcttctcactccctt

SEQ ID NO: 5847924 - DNA, 15 bp, Homo sapiens
atcttctcagctccc

SEQ ID NO: 5847925 - DNA, 20 bp, Homo sapiens
atcttctcatcttttatcta

SEQ ID NO: 5847926 - DNA, 13 bp, Homo sapiens
atcttctccagat

SEQ ID NO: 5847927 - DNA, 18 bp, Homo sapiens
atcttctccattctagat

SEQ ID NO: 5847928 - DNA, 19 bp, Homo sapiens
atcttctccccgaggctgc

SEQ ID NO: 5847929 - DNA, 20 bp, Homo sapiens
atcttctccccgaggctgcc

SEQ ID NO: 5847930 - DNA, 21 bp, Homo sapiens
atcttctccccgaggctgccc

SEQ ID NO: 5847931 - DNA, 22 bp, Homo sapiens
atcttctccccgaggctgcccc

SEQ ID NO: 5847932 - DNA, 13 bp, Homo sapiens
atcttctccctcc

SEQ ID NO: 5847933 - DNA, 15 bp, Homo sapiens
atcttctctatattt

SEQ ID NO: 5847934 - DNA, 12 bp, Homo sapiens
atcttctctctt

SEQ ID NO: 5847935 - DNA, 14 bp, Homo sapiens
atcttctctcttga

SEQ ID NO: 5847936 - DNA, 21 bp, Homo sapiens
atcttctctcttgattgattt

SEQ ID NO: 5847937 - DNA, 14 bp, Homo sapiens
atcttctgaagagg

SEQ ID NO: 5847938 - DNA, 18 bp, Homo sapiens
atcttctgaagaggaaaa

SEQ ID NO: 5847939 - DNA, 13 bp, Homo sapiens
atcttctgcagaa

SEQ ID NO: 5847940 - DNA, 14 bp, Homo sapiens
atcttctgccttct

SEQ ID NO: 5847941 - DNA, 12 bp, Homo sapiens
atcttctggaat

SEQ ID NO: 5847942 - DNA, 19 bp, Homo sapiens
atcttctggactatagctg

SEQ ID NO: 5847943 - DNA, 20 bp, Homo sapiens
atcttctggagaaaaaggtg

SEQ ID NO: 5847944 - DNA, 12 bp, Homo sapiens
atcttctggatt

SEQ ID NO: 5847945 - DNA, 14 bp, Homo sapiens
atcttctgtaccaa

SEQ ID NO: 5847946 - DNA, 15 bp, Homo sapiens
atcttctgtgaaata

SEQ ID NO: 5847947 - DNA, 20 bp, Homo sapiens
atcttctgttgtagaataat

SEQ ID NO: 5847948 - DNA, 12 bp, Homo sapiens
atcttctgtttt

SEQ ID NO: 5847949 - DNA, 17 bp, Homo sapiens
atcttctgtttttctca

SEQ ID NO: 5847950 - DNA, 11 bp, Homo sapiens
atcttcttaac

SEQ ID NO: 5847951 - DNA, 12 bp, Homo sapiens
atcttcttcaaa

SEQ ID NO: 5847952 - DNA, 21 bp, Homo sapiens
atcttcttcaaatacaaagta

SEQ ID NO: 5847953 - DNA, 22 bp, Homo sapiens
atcttcttcaaatacaaagtaa

SEQ ID NO: 5847954 - DNA, 23 bp, Homo sapiens
atcttcttcatccaacttccaag

SEQ ID NO: 5847955 - DNA, 12 bp, Homo sapiens
atcttcttgcat

SEQ ID NO: 5847956 - DNA, 15 bp, Homo sapiens
atcttctttcctcaa

SEQ ID NO: 5847957 - DNA, 18 bp, Homo sapiens
atcttctttcttccaccc

SEQ ID NO: 5847958 - DNA, 14 bp, Homo sapiens
atcttctttgcagc

SEQ ID NO: 5847959 - DNA, 21 bp, Homo sapiens
atcttctttgcagcctgggtg

SEQ ID NO: 5847960 - DNA, 21 bp, Homo sapiens
atcttcttttgggaggatttg

SEQ ID NO: 5847961 - DNA, 23 bp, Homo sapiens
atcttcttttgggaggatttgat

SEQ ID NO: 5847962 - DNA, 12 bp, Homo sapiens
atcttgaaaaga

SEQ ID NO: 5847963 - DNA, 11 bp, Homo sapiens
atcttgaaaat

SEQ ID NO: 5847964 - DNA, 23 bp, Homo sapiens
atcttgaaattaagaaggcaaaa

SEQ ID NO: 5847965 - DNA, 12 bp, Homo sapiens
atcttgaagaat

SEQ ID NO: 5847966 - DNA, 18 bp, Homo sapiens
atcttgaagacttttctt

SEQ ID NO: 5847967 - DNA, 17 bp, Homo sapiens
atcttgaagggcccagg

SEQ ID NO: 5847968 - DNA, 21 bp, Homo sapiens
atcttgaagtcagccacactg

SEQ ID NO: 5847969 - DNA, 22 bp, Homo sapiens
atcttgaagtcagccacactgg

SEQ ID NO: 5847970 - DNA, 21 bp, Homo sapiens
atcttgaagtgatgttgttta

SEQ ID NO: 5847971 - DNA, 20 bp, Homo sapiens
atcttgaatccttccattcc

SEQ ID NO: 5847972 - DNA, 12 bp, Homo sapiens
atcttgaatgtg

SEQ ID NO: 5847973 - DNA, 14 bp, Homo sapiens
atcttgaatgtggt

SEQ ID NO: 5847974 - DNA, 19 bp, Homo sapiens
atcttgaatgtggtctcag

SEQ ID NO: 5847975 - DNA, 15 bp, Homo sapiens
atcttgaatttctgc

SEQ ID NO: 5847976 - DNA, 22 bp, Homo sapiens
atcttgacaggcgccgcctcgc

SEQ ID NO: 5847977 - DNA, 17 bp, Homo sapiens
atcttgacatgtaatga

SEQ ID NO: 5847978 - DNA, 17 bp, Homo sapiens
atcttgaccaagcagga

SEQ ID NO: 5847979 - DNA, 20 bp, Homo sapiens
atcttgaccatactaataaa

SEQ ID NO: 5847980 - DNA, 21 bp, Homo sapiens
atcttgaccatactaataaat

SEQ ID NO: 5847981 - DNA, 17 bp, Homo sapiens
atcttgactacagtcag

SEQ ID NO: 5847982 - DNA, 17 bp, Homo sapiens
atcttgagagagaaatg

SEQ ID NO: 5847983 - DNA, 22 bp, Homo sapiens
atcttgagagagaaatgctgtt

SEQ ID NO: 5847984 - DNA, 17 bp, Homo sapiens
atcttgagagctgctga

SEQ ID NO: 5847985 - DNA, 14 bp, Homo sapiens
atcttgagcaaggc

SEQ ID NO: 5847986 - DNA, 22 bp, Homo sapiens
atcttgagccacagtcactgga

SEQ ID NO: 5847987 - DNA, 22 bp, Homo sapiens
atcttgagtataagaaatgcat

SEQ ID NO: 5847988 - DNA, 13 bp, Homo sapiens
atcttgatacatt

SEQ ID NO: 5847989 - DNA, 20 bp, Homo sapiens
atcttgatacattcaaattt

SEQ ID NO: 5847990 - DNA, 20 bp, Homo sapiens
atcttgatctgctcagccct

SEQ ID NO: 5847991 - DNA, 23 bp, Homo sapiens
atcttgatctgctcagccctgga

SEQ ID NO: 5847992 - DNA, 18 bp, Homo sapiens
atcttgatctttgagccc

SEQ ID NO: 5847993 - DNA, 19 bp, Homo sapiens
atcttgatctttgagccca

SEQ ID NO: 5847994 - DNA, 14 bp, Homo sapiens
atcttgatggtgtt

SEQ ID NO: 5847995 - DNA, 17 bp, Homo sapiens
atcttgatggtgtttct

SEQ ID NO: 5847996 - DNA, 16 bp, Homo sapiens
atcttgatttcccaaa

SEQ ID NO: 5847997 - DNA, 13 bp, Homo sapiens
atcttgcaaagcg

SEQ ID NO: 5847998 - DNA, 16 bp, Homo sapiens
atcttgcacacacttt

SEQ ID NO: 5847999 - DNA, 18 bp, Homo sapiens
atcttgcacacactttca

SEQ ID NO: 5848000 - DNA, 17 bp, Homo sapiens
atcttgcagcatttact

SEQ ID NO: 5848001 - DNA, 15 bp, Homo sapiens
atcttgcagttttgt

SEQ ID NO: 5848002 - DNA, 11 bp, Homo sapiens
atcttgcatgg

SEQ ID NO: 5848003 - DNA, 11 bp, Homo sapiens
atcttgcattc

SEQ ID NO: 5848004 - DNA, 14 bp, Homo sapiens
atcttgcattcatt

SEQ ID NO: 5848005 - DNA, 18 bp, Homo sapiens
atcttgcattcattttct

SEQ ID NO: 5848006 - DNA, 11 bp, Homo sapiens
atcttgccaca

SEQ ID NO: 5848007 - DNA, 16 bp, Homo sapiens
atcttgccacatttct

SEQ ID NO: 5848008 - DNA, 18 bp, Homo sapiens
atcttgccacatttctga

SEQ ID NO: 5848009 - DNA, 13 bp, Homo sapiens
atcttgccccctc

SEQ ID NO: 5848010 - DNA, 17 bp, Homo sapiens
atcttgccccctcatct

SEQ ID NO: 5848011 - DNA, 17 bp, Homo sapiens
atcttgccggtcatttt

SEQ ID NO: 5848012 - DNA, 14 bp, Homo sapiens
atcttgcctccagg

SEQ ID NO: 5848013 - DNA, 21 bp, Homo sapiens
atcttgcgaatccaagctccc

SEQ ID NO: 5848014 - DNA, 14 bp, Homo sapiens
atcttgctaataaa

SEQ ID NO: 5848015 - DNA, 14 bp, Homo sapiens
atcttgctaccagt

SEQ ID NO: 5848016 - DNA, 21 bp, Homo sapiens
atcttgctctatctcacagca

SEQ ID NO: 5848017 - DNA, 15 bp, Homo sapiens
atcttgctctgcttg

SEQ ID NO: 5848018 - DNA, 20 bp, Homo sapiens
atcttgctgcaggccctccc

SEQ ID NO: 5848019 - DNA, 21 bp, Homo sapiens
atcttgctgcaggccctccct

SEQ ID NO: 5848020 - DNA, 13 bp, Homo sapiens
atcttgctgctaa

SEQ ID NO: 5848021 - DNA, 13 bp, Homo sapiens
atcttgctgctta

SEQ ID NO: 5848022 - DNA, 12 bp, Homo sapiens
atcttgctggct

SEQ ID NO: 5848023 - DNA, 14 bp, Homo sapiens
atcttgcttcagac

SEQ ID NO: 5848024 - DNA, 16 bp, Homo sapiens
atcttgcttcattgtt

SEQ ID NO: 5848025 - DNA, 17 bp, Homo sapiens
atcttgcttccaagacc

SEQ ID NO: 5848026 - DNA, 18 bp, Homo sapiens
atcttgcttccaagacca

SEQ ID NO: 5848027 - DNA, 13 bp, Homo sapiens
atcttgctttctt

SEQ ID NO: 5848028 - DNA, 14 bp, Homo sapiens
atcttgctttcttt

SEQ ID NO: 5848029 - DNA, 17 bp, Homo sapiens
atcttgctttgtgtatc

SEQ ID NO: 5848030 - DNA, 17 bp, Homo sapiens
atcttggaaatcattgt

SEQ ID NO: 5848031 - DNA, 21 bp, Homo sapiens
atcttggactcatgaggaggg

SEQ ID NO: 5848032 - DNA, 21 bp, Homo sapiens
atcttggactgacatttagcg

SEQ ID NO: 5848033 - DNA, 17 bp, Homo sapiens
atcttggagaccctgca

SEQ ID NO: 5848034 - DNA, 21 bp, Homo sapiens
atcttggatagctaataatga

SEQ ID NO: 5848035 - DNA, 20 bp, Homo sapiens
atcttggcaggtaggaatat

SEQ ID NO: 5848036 - DNA, 19 bp, Homo sapiens
atcttggccctcctcagct

SEQ ID NO: 5848037 - DNA, 22 bp, Homo sapiens
atcttggccctcctcagctccc

SEQ ID NO: 5848038 - DNA, 19 bp, Homo sapiens
atcttggccctgttaaggc

SEQ ID NO: 5848039 - DNA, 20 bp, Homo sapiens
atcttggcctaaacctcagt

SEQ ID NO: 5848040 - DNA, 12 bp, Homo sapiens
atgaaaattaag

SEQ ID NO: 5848041 - DNA, 18 bp, Homo sapiens
atgaaaattatctccctt

SEQ ID NO: 5848042 - DNA, 23 bp, Homo sapiens
atgaaaattatctcccttagtaa

SEQ ID NO: 5848043 - DNA, 14 bp, Homo sapiens
atgaaaattgtatg

SEQ ID NO: 5848044 - DNA, 14 bp, Homo sapiens
atgaaaattgtatt

SEQ ID NO: 5848045 - DNA, 13 bp, Homo sapiens
atgaaacaaaaaa

SEQ ID NO: 5848046 - DNA, 12 bp, Homo sapiens
atgaaacaagca

SEQ ID NO: 5848047 - DNA, 19 bp, Homo sapiens
atgaaacaccttctctgga

SEQ ID NO: 5848048 - DNA, 16 bp, Homo sapiens
atgaaacacttctcat

SEQ ID NO: 5848049 - DNA, 17 bp, Homo sapiens
atgaaacagatgataaa

SEQ ID NO: 5848050 - DNA, 15 bp, Homo sapiens
atgaaacagcagctg

SEQ ID NO: 5848051 - DNA, 22 bp, Homo sapiens
atgaaacagcagctgaagccag

SEQ ID NO: 5848052 - DNA, 14 bp, Homo sapiens
atgaaacatatcat

SEQ ID NO: 5848053 - DNA, 15 bp, Homo sapiens
atgaaacatatcatg

SEQ ID NO: 5848054 - DNA, 21 bp, Homo sapiens
atgaaacatgggctgtgatta

SEQ ID NO: 5848055 - DNA, 22 bp, Homo sapiens
atgaaacatgtggagtgtatta

SEQ ID NO: 5848056 - DNA, 16 bp, Homo sapiens
atgaaaccaaaattat

SEQ ID NO: 5848057 - DNA, 13 bp, Homo sapiens
atgaaaccaaagc

SEQ ID NO: 5848058 - DNA, 14 bp, Homo sapiens
atgaaaccaaagcc

SEQ ID NO: 5848059 - DNA, 18 bp, Homo sapiens
atgaaacccccacacaca

SEQ ID NO: 5848060 - DNA, 22 bp, Homo sapiens
atgaaaccttattttttcccaa

SEQ ID NO: 5848061 - DNA, 15 bp, Homo sapiens
atgaaaccttgaagt

SEQ ID NO: 5848062 - DNA, 14 bp, Homo sapiens
atgaaacgaatata

SEQ ID NO: 5848063 - DNA, 16 bp, Homo sapiens
atgaaactaaagcaat

SEQ ID NO: 5848064 - DNA, 17 bp, Homo sapiens
atgaaactagaaagcag

SEQ ID NO: 5848065 - DNA, 16 bp, Homo sapiens
atgaaactcacaaatg

SEQ ID NO: 5848066 - DNA, 17 bp, Homo sapiens
atgaaactcctgatttt

SEQ ID NO: 5848067 - DNA, 19 bp, Homo sapiens
atgaaactcctgattttgt

SEQ ID NO: 5848068 - DNA, 18 bp, Homo sapiens
atgaaactctttcattct

SEQ ID NO: 5848069 - DNA, 23 bp, Homo sapiens
atgaaactctttcattcttctca

SEQ ID NO: 5848070 - DNA, 14 bp, Homo sapiens
atgaaactggttta

SEQ ID NO: 5848071 - DNA, 22 bp, Homo sapiens
atgaaactggtttataataaac

SEQ ID NO: 5848072 - DNA, 22 bp, Homo sapiens
atgaaacttaagaattgaattg

SEQ ID NO: 5848073 - DNA, 15 bp, Homo sapiens
atgaaacttggccag

SEQ ID NO: 5848074 - DNA, 18 bp, Homo sapiens
atgaaacttgtgtaaata

SEQ ID NO: 5848075 - DNA, 14 bp, Homo sapiens
atgaaagaaaggcc

SEQ ID NO: 5848076 - DNA, 15 bp, Homo sapiens
atgaaagacaaagaa

SEQ ID NO: 5848077 - DNA, 20 bp, Homo sapiens
atgaaagactgtacaaagta

SEQ ID NO: 5848078 - DNA, 12 bp, Homo sapiens
atgaaagagaaa

SEQ ID NO: 5848079 - DNA, 18 bp, Homo sapiens
atgaaagagtaaaggaaa

SEQ ID NO: 5848080 - DNA, 19 bp, Homo sapiens
atgaaagatggctgtgcct

SEQ ID NO: 5848081 - DNA, 19 bp, Homo sapiens
atgaaagattaaacagatg

SEQ ID NO: 5848082 - DNA, 20 bp, Homo sapiens
atgaaagcagggaatttcta

SEQ ID NO: 5848083 - DNA, 21 bp, Homo sapiens
atgaaagcagtgaagcaattt

SEQ ID NO: 5848084 - DNA, 12 bp, Homo sapiens
atgaaagcatgt

SEQ ID NO: 5848085 - DNA, 11 bp, Homo sapiens
atgaaagcatt

SEQ ID NO: 5848086 - DNA, 19 bp, Homo sapiens
atgaaagccaaatttatat

SEQ ID NO: 5848087 - DNA, 19 bp, Homo sapiens
atgaaagcgacttcaggtc

SEQ ID NO: 5848088 - DNA, 18 bp, Homo sapiens
atgaaagctatgaatgtt

SEQ ID NO: 5848089 - DNA, 22 bp, Homo sapiens
atgaaagctcctcgagggcagg

SEQ ID NO: 5848090 - DNA, 16 bp, Homo sapiens
atgaaagctgttcctt

SEQ ID NO: 5848091 - DNA, 18 bp, Homo sapiens
atgaaagctgttccttgg

SEQ ID NO: 5848092 - DNA, 16 bp, Homo sapiens
atgaaagctgtttcat

SEQ ID NO: 5848093 - DNA, 18 bp, Homo sapiens
atgaaagctgtttcattt

SEQ ID NO: 5848094 - DNA, 17 bp, Homo sapiens
atgaaagggaaactggg

SEQ ID NO: 5848095 - DNA, 21 bp, Homo sapiens
atgaaagggaaactgggaaac

SEQ ID NO: 5848096 - DNA, 18 bp, Homo sapiens
atgaaagggtttgtaata

SEQ ID NO: 5848097 - DNA, 18 bp, Homo sapiens
atgaaaggtaatctgaaa

SEQ ID NO: 5848098 - DNA, 20 bp, Homo sapiens
atgaaaggtactatatttgc

SEQ ID NO: 5848099 - DNA, 21 bp, Homo sapiens
atgaaaggtactatatttgct

SEQ ID NO: 5848100 - DNA, 21 bp, Homo sapiens
atgaaaggttaaaaaagcgag

SEQ ID NO: 5848101 - DNA, 16 bp, Homo sapiens
atgaaagtattaaaat

SEQ ID NO: 5848102 - DNA, 19 bp, Homo sapiens
atgaaagtcttgtgactag

SEQ ID NO: 5848103 - DNA, 15 bp, Homo sapiens
atgaaagtgacttta

SEQ ID NO: 5848104 - DNA, 18 bp, Homo sapiens
atgaaagttaatttgaat

SEQ ID NO: 5848105 - DNA, 18 bp, Homo sapiens
atgaaataaaatttgaaa

SEQ ID NO: 5848106 - DNA, 17 bp, Homo sapiens
atgaaataaatgcccca

SEQ ID NO: 5848107 - DNA, 20 bp, Homo sapiens
atgaaataaattggtgataa

SEQ ID NO: 5848108 - DNA, 18 bp, Homo sapiens
atgaaataacacagcagt

SEQ ID NO: 5848109 - DNA, 14 bp, Homo sapiens
atgaaataataaag

SEQ ID NO: 5848110 - DNA, 19 bp, Homo sapiens
atgaaatacacaagtaaac

SEQ ID NO: 5848111 - DNA, 17 bp, Homo sapiens
atgaaataccaactatg

SEQ ID NO: 5848112 - DNA, 17 bp, Homo sapiens
atgaaatactatttaaa

SEQ ID NO: 5848113 - DNA, 22 bp, Homo sapiens
atgaaatagttattttaatacc

SEQ ID NO: 5848114 - DNA, 20 bp, Homo sapiens
atgaaatataaattatctga

SEQ ID NO: 5848115 - DNA, 13 bp, Homo sapiens
atgaaatattatg

SEQ ID NO: 5848116 - DNA, 17 bp, Homo sapiens
atgaaatattatgttaa

SEQ ID NO: 5848117 - DNA, 18 bp, Homo sapiens
atgaaatattatgttaaa

SEQ ID NO: 5848118 - DNA, 15 bp, Homo sapiens
atgaaatatttgctt

SEQ ID NO: 5848119 - DNA, 17 bp, Homo sapiens
atgaaatatttgcttat

SEQ ID NO: 5848120 - DNA, 13 bp, Homo sapiens
atgaaatcaaatg

SEQ ID NO: 5848121 - DNA, 14 bp, Homo sapiens
atgaaatcaaatgt

SEQ ID NO: 5848122 - DNA, 21 bp, Homo sapiens
atgaaatcatagtatatgatt

SEQ ID NO: 5848123 - DNA, 20 bp, Homo sapiens
atgaaatccgtgaagtcaca

SEQ ID NO: 5848124 - DNA, 21 bp, Homo sapiens
atgaaatctgctagaaagtta

SEQ ID NO: 5848125 - DNA, 13 bp, Homo sapiens
atgaaatctgttt

SEQ ID NO: 5848126 - DNA, 18 bp, Homo sapiens
atgaaatcttacagctgg

SEQ ID NO: 5848127 - DNA, 14 bp, Homo sapiens
atgaaatctttctt

SEQ ID NO: 5848128 - DNA, 12 bp, Homo sapiens
atgaaatgaatg

SEQ ID NO: 5848129 - DNA, 13 bp, Homo sapiens
atgaaatgaattt

SEQ ID NO: 5848130 - DNA, 14 bp, Homo sapiens
atgaaatgaggtca

SEQ ID NO: 5848131 - DNA, 17 bp, Homo sapiens
atgaaatgataaagact

SEQ ID NO: 5848132 - DNA, 19 bp, Homo sapiens
atgaaatgataaagacttt

SEQ ID NO: 5848133 - DNA, 21 bp, Homo sapiens
atgaaatgataaagatgtcaa

SEQ ID NO: 5848134 - DNA, 15 bp, Homo sapiens
atgaaatgcactgta

SEQ ID NO: 5848135 - DNA, 18 bp, Homo sapiens
atgaaatgcatatttgca

SEQ ID NO: 5848136 - DNA, 12 bp, Homo sapiens
atgaaatgcatt

SEQ ID NO: 5848137 - DNA, 16 bp, Homo sapiens
atgaaatgcattttgc

SEQ ID NO: 5848138 - DNA, 14 bp, Homo sapiens
atgaaatgccaaag

SEQ ID NO: 5848139 - DNA, 13 bp, Homo sapiens
atgaaatgccaag

SEQ ID NO: 5848140 - DNA, 22 bp, Homo sapiens
atgaaatgctatgtcatttcat

SEQ ID NO: 5848141 - DNA, 18 bp, Homo sapiens
atgaaatgggctttaaca

SEQ ID NO: 5848142 - DNA, 23 bp, Homo sapiens
atgaaatgtcccctcaaactcat

SEQ ID NO: 5848143 - DNA, 12 bp, Homo sapiens
atgaaatgtctt

SEQ ID NO: 5848144 - DNA, 18 bp, Homo sapiens
atgaaatgtggaagtcag

SEQ ID NO: 5848145 - DNA, 13 bp, Homo sapiens
atgaaatgttctg

SEQ ID NO: 5848146 - DNA, 18 bp, Homo sapiens
atgaaattaccagatata

SEQ ID NO: 5848147 - DNA, 13 bp, Homo sapiens
atgaaattcctcc

SEQ ID NO: 5848148 - DNA, 17 bp, Homo sapiens
atgaaattcctccttcc

SEQ ID NO: 5848149 - DNA, 15 bp, Homo sapiens
atgaaattcttccta

SEQ ID NO: 5848150 - DNA, 18 bp, Homo sapiens
atgaaattcttgaagttc

SEQ ID NO: 5848151 - DNA, 16 bp, Homo sapiens
atgaaattgaacctgg

SEQ ID NO: 5848152 - DNA, 14 bp, Homo sapiens
atgaaattgagaag

SEQ ID NO: 5848153 - DNA, 16 bp, Homo sapiens
atgaaatttaaacatt

SEQ ID NO: 5848154 - DNA, 16 bp, Homo sapiens
atgaaatttaagcaca

SEQ ID NO: 5848155 - DNA, 18 bp, Homo sapiens
atgaaatttaagcacaaa

SEQ ID NO: 5848156 - DNA, 21 bp, Homo sapiens
atgaaatttaatatagctatt

SEQ ID NO: 5848157 - DNA, 20 bp, Homo sapiens
atgaaatttaattacaaaca

SEQ ID NO: 5848158 - DNA, 12 bp, Homo sapiens
atgaaatttcac

SEQ ID NO: 5848159 - DNA, 15 bp, Homo sapiens
atgaaatttgataaa

SEQ ID NO: 5848160 - DNA, 13 bp, Homo sapiens
atgaaatttgcaa

SEQ ID NO: 5848161 - DNA, 18 bp, Homo sapiens
atgaaatttgcaaaatca

SEQ ID NO: 5848162 - DNA, 15 bp, Homo sapiens
atgaaattttaccaa

SEQ ID NO: 5848163 - DNA, 20 bp, Homo sapiens
atgaaattttaccaagttat

SEQ ID NO: 5848164 - DNA, 22 bp, Homo sapiens
atgaaattttaccattttgcga

SEQ ID NO: 5848165 - DNA, 23 bp, Homo sapiens
atgaaattttaccattttgcgat

SEQ ID NO: 5848166 - DNA, 19 bp, Homo sapiens
atgaaattttctagacttt

SEQ ID NO: 5848167 - DNA, 23 bp, Homo sapiens
atgaaattttctagactttctgt

SEQ ID NO: 5848168 - DNA, 15 bp, Homo sapiens
atgaacaaaatgaag

SEQ ID NO: 5848169 - DNA, 15 bp, Homo sapiens
atgaacaaacctgtg

SEQ ID NO: 5848170 - DNA, 21 bp, Homo sapiens
atgaacaaagaaaaaaatata

SEQ ID NO: 5848171 - DNA, 22 bp, Homo sapiens
atgaacaaagaaaaaaatatat

SEQ ID NO: 5848172 - DNA, 17 bp, Homo sapiens
atgaacaaatatgcttt

SEQ ID NO: 5848173 - DNA, 13 bp, Homo sapiens
atgaacaaattct

SEQ ID NO: 5848174 - DNA, 18 bp, Homo sapiens
atgaacaaattgaactct

SEQ ID NO: 5848175 - DNA, 15 bp, Homo sapiens
atgaacaagttttaa

SEQ ID NO: 5848176 - DNA, 16 bp, Homo sapiens
atgaacacaaattatg

SEQ ID NO: 5848177 - DNA, 15 bp, Homo sapiens
atgaacacaatcacg

SEQ ID NO: 5848178 - DNA, 16 bp, Homo sapiens
atgaacacaatcacgt

SEQ ID NO: 5848179 - DNA, 18 bp, Homo sapiens
atgaacacatcagctagc

SEQ ID NO: 5848180 - DNA, 13 bp, Homo sapiens
atgaacacttata

SEQ ID NO: 5848181 - DNA, 16 bp, Homo sapiens
atgaacagaacataga

SEQ ID NO: 5848182 - DNA, 21 bp, Homo sapiens
atgaacagaacatagacagaa

SEQ ID NO: 5848183 - DNA, 16 bp, Homo sapiens
atgaacagcagaaaga

SEQ ID NO: 5848184 - DNA, 13 bp, Homo sapiens
atgaacagctctg

SEQ ID NO: 5848185 - DNA, 23 bp, Homo sapiens
atgaacagctctgagatcctgga

SEQ ID NO: 5848186 - DNA, 19 bp, Homo sapiens
atgaacagcttgccaggga

SEQ ID NO: 5848187 - DNA, 21 bp, Homo sapiens
atgaacagggcccaggcctgg

SEQ ID NO: 5848188 - DNA, 13 bp, Homo sapiens
atgaacagtgcac

SEQ ID NO: 5848189 - DNA, 20 bp, Homo sapiens
atgaacagtttggggactca

SEQ ID NO: 5848190 - DNA, 21 bp, Homo sapiens
atgaacatagactagagaaac

SEQ ID NO: 5848191 - DNA, 14 bp, Homo sapiens
atgaacatcccttt

SEQ ID NO: 5848192 - DNA, 19 bp, Homo sapiens
atgaacatctcttgaaacc

SEQ ID NO: 5848193 - DNA, 17 bp, Homo sapiens
atgaacatggtcagaac

SEQ ID NO: 5848194 - DNA, 18 bp, Homo sapiens
atgaacatgtactgttct

SEQ ID NO: 5848195 - DNA, 10 bp, Homo sapiens
atgaacattc

SEQ ID NO: 5848196 - DNA, 13 bp, Homo sapiens
atgaacattgtac

SEQ ID NO: 5848197 - DNA, 17 bp, Homo sapiens
atgaacattgtactgtt

SEQ ID NO: 5848198 - DNA, 18 bp, Homo sapiens
atgaacattgtactgttg

SEQ ID NO: 5848199 - DNA, 23 bp, Homo sapiens
atgaacattgtactgttgcttta

SEQ ID NO: 5848200 - DNA, 18 bp, Homo sapiens
atgaacattttgtggagt

SEQ ID NO: 5848201 - DNA, 23 bp, Homo sapiens
atgaacattttgtggagtttgta

SEQ ID NO: 5848202 - DNA, 20 bp, Homo sapiens
atgaaccacatcttgctctg

SEQ ID NO: 5848203 - DNA, 15 bp, Homo sapiens
atgaaccataaattc

SEQ ID NO: 5848204 - DNA, 13 bp, Homo sapiens
atgaaccatcctt

SEQ ID NO: 5848205 - DNA, 18 bp, Homo sapiens
atgaacccaaaaagagac

SEQ ID NO: 5848206 - DNA, 20 bp, Homo sapiens
atgaacccatagggagctga

SEQ ID NO: 5848207 - DNA, 15 bp, Homo sapiens
atgaaccctcctcct

SEQ ID NO: 5848208 - DNA, 22 bp, Homo sapiens
atgaaccctcctcctttttaag

SEQ ID NO: 5848209 - DNA, 20 bp, Homo sapiens
atgaaccctccttttctctg

SEQ ID NO: 5848210 - DNA, 15 bp, Homo sapiens
atgaaccctcttgcc

SEQ ID NO: 5848211 - DNA, 16 bp, Homo sapiens
atgaaccctgccccac

SEQ ID NO: 5848212 - DNA, 14 bp, Homo sapiens
atgaaccctgccct

SEQ ID NO: 5848213 - DNA, 14 bp, Homo sapiens
atgaacctattttc

SEQ ID NO: 5848214 - DNA, 14 bp, Homo sapiens
atgaacctgaaaag

SEQ ID NO: 5848215 - DNA, 13 bp, Homo sapiens
atgaacctggagg

SEQ ID NO: 5848216 - DNA, 16 bp, Homo sapiens
atgaacggtgagcatt

SEQ ID NO: 5848217 - DNA, 18 bp, Homo sapiens
atgaacgtggattgtatt

SEQ ID NO: 5848218 - DNA, 17 bp, Homo sapiens
atgaactaactgccatg

SEQ ID NO: 5848219 - DNA, 17 bp, Homo sapiens
atgacaactacagaaaa

SEQ ID NO: 5848220 - DNA, 18 bp, Homo sapiens
atgacaactggaatagtt

SEQ ID NO: 5848221 - DNA, 19 bp, Homo sapiens
atgacaacttctaattgcc

SEQ ID NO: 5848222 - DNA, 15 bp, Homo sapiens
atgacaactttgcca

SEQ ID NO: 5848223 - DNA, 21 bp, Homo sapiens
atgacaagaaaggctgctgta

SEQ ID NO: 5848224 - DNA, 16 bp, Homo sapiens
atgacaagatgggaca

SEQ ID NO: 5848225 - DNA, 17 bp, Homo sapiens
atgacaagatggtacaa

SEQ ID NO: 5848226 - DNA, 13 bp, Homo sapiens
atgacaagatgtt

SEQ ID NO: 5848227 - DNA, 14 bp, Homo sapiens
atgacaaggtgtgc

SEQ ID NO: 5848228 - DNA, 14 bp, Homo sapiens
atgacaagtgactt

SEQ ID NO: 5848229 - DNA, 19 bp, Homo sapiens
atgacaagtgagacaaaaa

SEQ ID NO: 5848230 - DNA, 21 bp, Homo sapiens
atgacaatcctgaagaaacca

SEQ ID NO: 5848231 - DNA, 17 bp, Homo sapiens
atgacaatgtgaaacca

SEQ ID NO: 5848232 - DNA, 15 bp, Homo sapiens
atgacaatttcaaaa

SEQ ID NO: 5848233 - DNA, 21 bp, Homo sapiens
atgacacaaaggtggaataaa

SEQ ID NO: 5848234 - DNA, 14 bp, Homo sapiens
atgacacaatgaca

SEQ ID NO: 5848235 - DNA, 15 bp, Homo sapiens
atgacacaccttgga

SEQ ID NO: 5848236 - DNA, 19 bp, Homo sapiens
atgacacagcttgtgaatg

SEQ ID NO: 5848237 - DNA, 19 bp, Homo sapiens
atgacaccatcagacatta

SEQ ID NO: 5848238 - DNA, 23 bp, Homo sapiens
atgacaccatcttttattctttt

SEQ ID NO: 5848239 - DNA, 16 bp, Homo sapiens
atgacacccatgccag

SEQ ID NO: 5848240 - DNA, 21 bp, Homo sapiens
atgacacccatgccagagagg

SEQ ID NO: 5848241 - DNA, 14 bp, Homo sapiens
atgacaccctggcc

SEQ ID NO: 5848242 - DNA, 19 bp, Homo sapiens
atgacacgaatattgctga

SEQ ID NO: 5848243 - DNA, 22 bp, Homo sapiens
atgacacggtaggccaagctga

SEQ ID NO: 5848244 - DNA, 16 bp, Homo sapiens
atgacactagaaaact

SEQ ID NO: 5848245 - DNA, 19 bp, Homo sapiens
atgacactcgtataagcat

SEQ ID NO: 5848246 - DNA, 22 bp, Homo sapiens
atgacactctagtgacttcctg

SEQ ID NO: 5848247 - DNA, 15 bp, Homo sapiens
atgacactgaaatgc

SEQ ID NO: 5848248 - DNA, 17 bp, Homo sapiens
atgacactgtttcctga

SEQ ID NO: 5848249 - DNA, 18 bp, Homo sapiens
atgacactgtttcctgat

SEQ ID NO: 5848250 - DNA, 20 bp, Homo sapiens
atgacacttttaaaataaat

SEQ ID NO: 5848251 - DNA, 18 bp, Homo sapiens
atgacagaaaatatgtat

SEQ ID NO: 5848252 - DNA, 20 bp, Homo sapiens
atgacagaaatgacaacaag

SEQ ID NO: 5848253 - DNA, 16 bp, Homo sapiens
atgacagaacacagat

SEQ ID NO: 5848254 - DNA, 12 bp, Homo sapiens
atgacagagagt

SEQ ID NO: 5848255 - DNA, 22 bp, Homo sapiens
atgacagatatatttaagcctt

SEQ ID NO: 5848256 - DNA, 12 bp, Homo sapiens
atgacagatgaa

SEQ ID NO: 5848257 - DNA, 16 bp, Homo sapiens
atgacagatgttgaat

SEQ ID NO: 5848258 - DNA, 15 bp, Homo sapiens
atgacagattctgac

SEQ ID NO: 5848259 - DNA, 13 bp, Homo sapiens
atgacagatttct

SEQ ID NO: 5848260 - DNA, 14 bp, Homo sapiens
atgacagatttctg

SEQ ID NO: 5848261 - DNA, 12 bp, Homo sapiens
atgacagccaga

SEQ ID NO: 5848262 - DNA, 16 bp, Homo sapiens
atgacagcctgcagca

SEQ ID NO: 5848263 - DNA, 13 bp, Homo sapiens
atgacagccttgc

SEQ ID NO: 5848264 - DNA, 20 bp, Homo sapiens
atgacagccttttttcctgg

SEQ ID NO: 5848265 - DNA, 22 bp, Homo sapiens
atgacagctactaacctggaga

SEQ ID NO: 5848266 - DNA, 18 bp, Homo sapiens
atgacagctcttctaagg

SEQ ID NO: 5848267 - DNA, 12 bp, Homo sapiens
atgacagctggc

SEQ ID NO: 5848268 - DNA, 13 bp, Homo sapiens
atgacagctggct

SEQ ID NO: 5848269 - DNA, 16 bp, Homo sapiens
atgacagctgtccctg

SEQ ID NO: 5848270 - DNA, 21 bp, Homo sapiens
atgacagctgtccctgtcacc

SEQ ID NO: 5848271 - DNA, 21 bp, Homo sapiens
atgacaggaacccatcactgt

SEQ ID NO: 5848272 - DNA, 17 bp, Homo sapiens
atgacaggatgtttgct

SEQ ID NO: 5848273 - DNA, 17 bp, Homo sapiens
atgacaggcctgaagat

SEQ ID NO: 5848274 - DNA, 22 bp, Homo sapiens
atgacaggcctgaagatattac

SEQ ID NO: 5848275 - DNA, 12 bp, Homo sapiens
atgacagggagc

SEQ ID NO: 5848276 - DNA, 16 bp, Homo sapiens
atgacagggagctggg

SEQ ID NO: 5848277 - DNA, 20 bp, Homo sapiens
atgacaggtgtgagccactg

SEQ ID NO: 5848278 - DNA, 23 bp, Homo sapiens
atgacagtagtaccaaatgcttt

SEQ ID NO: 5848279 - DNA, 12 bp, Homo sapiens
atgacagtgaat

SEQ ID NO: 5848280 - DNA, 18 bp, Homo sapiens
atgacataacagtgcagg

SEQ ID NO: 5848281 - DNA, 20 bp, Homo sapiens
atgacataaccaatttgtaa

SEQ ID NO: 5848282 - DNA, 16 bp, Homo sapiens
atgacataataaagta

SEQ ID NO: 5848283 - DNA, 17 bp, Homo sapiens
atgacataataaagtat

SEQ ID NO: 5848284 - DNA, 19 bp, Homo sapiens
atgacatatcacatgtcag

SEQ ID NO: 5848285 - DNA, 15 bp, Homo sapiens
atgacatcaaaatga

SEQ ID NO: 5848286 - DNA, 16 bp, Homo sapiens
atgacatcaaaatgag

SEQ ID NO: 5848287 - DNA, 19 bp, Homo sapiens
atgacatcacttgtacaaa

SEQ ID NO: 5848288 - DNA, 22 bp, Homo sapiens
atgacatccagaaagctgagga

SEQ ID NO: 5848289 - DNA, 18 bp, Homo sapiens
atgacatctcaggggcca

SEQ ID NO: 5848290 - DNA, 13 bp, Homo sapiens
atgacatcttttt

SEQ ID NO: 5848291 - DNA, 19 bp, Homo sapiens
atgacatctttttaaagct

SEQ ID NO: 5848292 - DNA, 18 bp, Homo sapiens
atgacatgaaaagttatt

SEQ ID NO: 5848293 - DNA, 15 bp, Homo sapiens
atgacatgaaatgaa

SEQ ID NO: 5848294 - DNA, 16 bp, Homo sapiens
atgacatgcactgacc

SEQ ID NO: 5848295 - DNA, 19 bp, Homo sapiens
atgacatgcactgaccctt

SEQ ID NO: 5848296 - DNA, 22 bp, Homo sapiens
atgacatgcactgacccttcca

SEQ ID NO: 5848297 - DNA, 16 bp, Homo sapiens
atgacatgccaccctc

SEQ ID NO: 5848298 - DNA, 17 bp, Homo sapiens
atgacatggaggcactg

SEQ ID NO: 5848299 - DNA, 13 bp, Homo sapiens
atgacatgtgtca

SEQ ID NO: 5848300 - DNA, 22 bp, Homo sapiens
atgacattaaatgcaataattt

SEQ ID NO: 5848301 - DNA, 21 bp, Homo sapiens
atgacattacaatcctgcatt

SEQ ID NO: 5848302 - DNA, 17 bp, Homo sapiens
atgacattcatgcctgg

SEQ ID NO: 5848303 - DNA, 19 bp, Homo sapiens
atgacattgactatttttg

SEQ ID NO: 5848304 - DNA, 20 bp, Homo sapiens
atgacattggatagaacatg

SEQ ID NO: 5848305 - DNA, 19 bp, Homo sapiens
atgacattgttaaaataaa

SEQ ID NO: 5848306 - DNA, 13 bp, Homo sapiens
atgacatttcact

SEQ ID NO: 5848307 - DNA, 14 bp, Homo sapiens
atgacatttcatct

SEQ ID NO: 5848308 - DNA, 21 bp, Homo sapiens
atgacatttcttaaaacttta

SEQ ID NO: 5848309 - DNA, 22 bp, Homo sapiens
atgacatttgtcctgcagagct

SEQ ID NO: 5848310 - DNA, 19 bp, Homo sapiens
atgacatttttgataaatt

SEQ ID NO: 5848311 - DNA, 19 bp, Homo sapiens
atgaccaaaccagccttcg

SEQ ID NO: 5848312 - DNA, 15 bp, Homo sapiens
atgaccaagaaaaag

SEQ ID NO: 5848313 - DNA, 17 bp, Homo sapiens
atgaccaagaaaaagaa

SEQ ID NO: 5848314 - DNA, 14 bp, Homo sapiens
atgaccaagaatta

SEQ ID NO: 5848315 - DNA, 16 bp, Homo sapiens
atgaccaatctctgtg

SEQ ID NO: 5848316 - DNA, 23 bp, Homo sapiens
atgaccacgcacctccacgccac

SEQ ID NO: 5848317 - DNA, 18 bp, Homo sapiens
atgaccacgggcctcagt

SEQ ID NO: 5848318 - DNA, 22 bp, Homo sapiens
atgaccactcttggctattgaa

SEQ ID NO: 5848319 - DNA, 17 bp, Homo sapiens
atgaccactgggcctgc

SEQ ID NO: 5848320 - DNA, 18 bp, Homo sapiens
atgaccactgggcctgct

SEQ ID NO: 5848321 - DNA, 19 bp, Homo sapiens
atgaccactttttagaaag

SEQ ID NO: 5848322 - DNA, 13 bp, Homo sapiens
atgaccagaaaat

SEQ ID NO: 5848323 - DNA, 19 bp, Homo sapiens
atgaccagaaacagggaca

SEQ ID NO: 5848324 - DNA, 14 bp, Homo sapiens
atgaccagagcaaa

SEQ ID NO: 5848325 - DNA, 15 bp, Homo sapiens
atgaccagagcaaaa

SEQ ID NO: 5848326 - DNA, 19 bp, Homo sapiens
atgaccagagcaaaaatgt

SEQ ID NO: 5848327 - DNA, 21 bp, Homo sapiens
atgaccagatgcgtcccaaga

SEQ ID NO: 5848328 - DNA, 17 bp, Homo sapiens
atgaccagcaggaggga

SEQ ID NO: 5848329 - DNA, 14 bp, Homo sapiens
atgaccaggccacc

SEQ ID NO: 5848330 - DNA, 14 bp, Homo sapiens
atgaccagggatgc

SEQ ID NO: 5848331 - DNA, 23 bp, Homo sapiens
atgaccagggatgctgggctggg

SEQ ID NO: 5848332 - DNA, 17 bp, Homo sapiens
atgaccagtcaagggca

SEQ ID NO: 5848333 - DNA, 14 bp, Homo sapiens
atgaccagtttacc

SEQ ID NO: 5848334 - DNA, 16 bp, Homo sapiens
atgaccagtttacctg

SEQ ID NO: 5848335 - DNA, 19 bp, Homo sapiens
atgaccatgttatattgct

SEQ ID NO: 5848336 - DNA, 13 bp, Homo sapiens
atgacccaaagac

SEQ ID NO: 5848337 - DNA, 14 bp, Homo sapiens
atgacccacactgc

SEQ ID NO: 5848338 - DNA, 16 bp, Homo sapiens
atgacccacactgcca

SEQ ID NO: 5848339 - DNA, 21 bp, Homo sapiens
atgacccacactgccagaaga

SEQ ID NO: 5848340 - DNA, 14 bp, Homo sapiens
atgacccagaccca

SEQ ID NO: 5848341 - DNA, 14 bp, Homo sapiens
atgacccagcctga

SEQ ID NO: 5848342 - DNA, 13 bp, Homo sapiens
atgacccccccag

SEQ ID NO: 5848343 - DNA, 19 bp, Homo sapiens
atgacccctaccccctcat

SEQ ID NO: 5848344 - DNA, 11 bp, Homo sapiens
atgacccctcc

SEQ ID NO: 5848345 - DNA, 14 bp, Homo sapiens
atgacccctgggca

SEQ ID NO: 5848346 - DNA, 15 bp, Homo sapiens
atgaccccttctctc

SEQ ID NO: 5848347 - DNA, 22 bp, Homo sapiens
atgaccccttctctctccagaa

SEQ ID NO: 5848348 - DNA, 23 bp, Homo sapiens
atgacccggcccccgccctctgc

SEQ ID NO: 5848349 - DNA, 18 bp, Homo sapiens
atgaccctctgtccccag

SEQ ID NO: 5848350 - DNA, 18 bp, Homo sapiens
atgaccctgcctctccca

SEQ ID NO: 5848351 - DNA, 12 bp, Homo sapiens
atgaccctgggc

SEQ ID NO: 5848352 - DNA, 23 bp, Homo sapiens
atgaccctgtgcctgtgtttcat

SEQ ID NO: 5848353 - DNA, 14 bp, Homo sapiens
atgaccgagccctg

SEQ ID NO: 5848354 - DNA, 22 bp, Homo sapiens
atgacctaagtcaggtaatata

SEQ ID NO: 5848355 - DNA, 16 bp, Homo sapiens
atgacctacagtgctg

SEQ ID NO: 5848356 - DNA, 12 bp, Homo sapiens
atgacctaccag

SEQ ID NO: 5848357 - DNA, 14 bp, Homo sapiens
atgacctcaaggaa

SEQ ID NO: 5848358 - DNA, 19 bp, Homo sapiens
atgacctcaagtagcactg

SEQ ID NO: 5848359 - DNA, 17 bp, Homo sapiens
atgacctcacccctcct

SEQ ID NO: 5848360 - DNA, 16 bp, Homo sapiens
atgacctcagatcttt

SEQ ID NO: 5848361 - DNA, 18 bp, Homo sapiens
atgacctcagcaaatcct

SEQ ID NO: 5848362 - DNA, 11 bp, Homo sapiens
atgacctccag

SEQ ID NO: 5848363 - DNA, 12 bp, Homo sapiens
atgacctccaga

SEQ ID NO: 5848364 - DNA, 14 bp, Homo sapiens
atgacctccagaag

SEQ ID NO: 5848365 - DNA, 13 bp, Homo sapiens
atgacctccagct

SEQ ID NO: 5848366 - DNA, 23 bp, Homo sapiens
atgacctccagggaatcagaaag

SEQ ID NO: 5848367 - DNA, 19 bp, Homo sapiens
atgacctcccctccccagc

SEQ ID NO: 5848368 - DNA, 19 bp, Homo sapiens
atgacctccttagaaaaga

SEQ ID NO: 5848369 - DNA, 17 bp, Homo sapiens
atgacctcgtactcagg

SEQ ID NO: 5848370 - DNA, 20 bp, Homo sapiens
atgacctcgtactcaggagc

SEQ ID NO: 5848371 - DNA, 13 bp, Homo sapiens
atgacctgaattg

SEQ ID NO: 5848372 - DNA, 17 bp, Homo sapiens
atgacctgaggaaagga

SEQ ID NO: 5848373 - DNA, 13 bp, Homo sapiens
atgacctgccctg

SEQ ID NO: 5848374 - DNA, 18 bp, Homo sapiens
atgaccttagtccgcaag

SEQ ID NO: 5848375 - DNA, 18 bp, Homo sapiens
atgaccttccaagtttga

SEQ ID NO: 5848376 - DNA, 23 bp, Homo sapiens
atgaccttcccagggagaaaccc

SEQ ID NO: 5848377 - DNA, 17 bp, Homo sapiens
atgaccttctaggaagc

SEQ ID NO: 5848378 - DNA, 18 bp, Homo sapiens
atgaccttgtaatgtaac

SEQ ID NO: 5848379 - DNA, 18 bp, Homo sapiens
atgacctttcaataggaa

SEQ ID NO: 5848380 - DNA, 22 bp, Homo sapiens
atgacctttcaataggaaaaac

SEQ ID NO: 5848381 - DNA, 23 bp, Homo sapiens
atgacctttcaataggaaaaact

SEQ ID NO: 5848382 - DNA, 23 bp, Homo sapiens
atgacgacaaagctgctaaatct

SEQ ID NO: 5848383 - DNA, 18 bp, Homo sapiens
atgacgcaccagttacag

SEQ ID NO: 5848384 - DNA, 15 bp, Homo sapiens
atgacggaagaacat

SEQ ID NO: 5848385 - DNA, 21 bp, Homo sapiens
atgacggaagaacatagaact

SEQ ID NO: 5848386 - DNA, 18 bp, Homo sapiens
atgacggcctgcctgcaa

SEQ ID NO: 5848387 - DNA, 17 bp, Homo sapiens
atgacggggtgttgcca

SEQ ID NO: 5848388 - DNA, 20 bp, Homo sapiens
atgacggtactggtcaagat

SEQ ID NO: 5848389 - DNA, 16 bp, Homo sapiens
atgacggtattatgct

SEQ ID NO: 5848390 - DNA, 24 bp, Homo sapiens
atgacgtacaagtagttctgtatt

SEQ ID NO: 5848391 - DNA, 17 bp, Homo sapiens
atgacgtattgtgaaat

SEQ ID NO: 5848392 - DNA, 19 bp, Homo sapiens
atgacgtattgtgaaattt

SEQ ID NO: 5848393 - DNA, 21 bp, Homo sapiens
atgacgtcaatagcagcccag

SEQ ID NO: 5848394 - DNA, 20 bp, Homo sapiens
atgacgtgctccgtagctct

SEQ ID NO: 5848395 - DNA, 23 bp, Homo sapiens
atgacgtgggtttgatttctaag

SEQ ID NO: 5848396 - DNA, 23 bp, Homo sapiens
atgacgtggtaaaatgtgaaaaa

SEQ ID NO: 5848397 - DNA, 17 bp, Homo sapiens
atgagggatgggcctgg

SEQ ID NO: 5848398 - DNA, 17 bp, Homo sapiens
atgagggcagcagccag

SEQ ID NO: 5848399 - DNA, 18 bp, Homo sapiens
atgagggcagcagccagc

SEQ ID NO: 5848400 - DNA, 22 bp, Homo sapiens
atgagggcagcagccagccctg

SEQ ID NO: 5848401 - DNA, 20 bp, Homo sapiens
atgagggcgtgaaacacaat

SEQ ID NO: 5848402 - DNA, 19 bp, Homo sapiens
atgagggctgagttatgaa

SEQ ID NO: 5848403 - DNA, 12 bp, Homo sapiens
atgagggctgga

SEQ ID NO: 5848404 - DNA, 14 bp, Homo sapiens
atgaggggaaaaaa

SEQ ID NO: 5848405 - DNA, 22 bp, Homo sapiens
atgaggggaaagggagaagggt

SEQ ID NO: 5848406 - DNA, 14 bp, Homo sapiens
atgaggggaagcca

SEQ ID NO: 5848407 - DNA, 23 bp, Homo sapiens
atgaggggaagccattttccagt

SEQ ID NO: 5848408 - DNA, 13 bp, Homo sapiens
atgaggggaccca

SEQ ID NO: 5848409 - DNA, 15 bp, Homo sapiens
atgaggggactgcat

SEQ ID NO: 5848410 - DNA, 11 bp, Homo sapiens
atgaggggaga

SEQ ID NO: 5848411 - DNA, 14 bp, Homo sapiens
atgaggggccactg

SEQ ID NO: 5848412 - DNA, 14 bp, Homo sapiens
atgagggggctcag

SEQ ID NO: 5848413 - DNA, 15 bp, Homo sapiens
atgagggggctcagt

SEQ ID NO: 5848414 - DNA, 17 bp, Homo sapiens
atgaggggttcctcccc

SEQ ID NO: 5848415 - DNA, 20 bp, Homo sapiens
atgagggtatcaaataaaat

SEQ ID NO: 5848416 - DNA, 20 bp, Homo sapiens
atgagggtcttggttccagc

SEQ ID NO: 5848417 - DNA, 14 bp, Homo sapiens
atgaggtaaaagag

SEQ ID NO: 5848418 - DNA, 17 bp, Homo sapiens
atgaggtaaaagagcca

SEQ ID NO: 5848419 - DNA, 13 bp, Homo sapiens
atgaggtaattct

SEQ ID NO: 5848420 - DNA, 17 bp, Homo sapiens
atgaggtactgagagtg

SEQ ID NO: 5848421 - DNA, 17 bp, Homo sapiens
atgaggtcaacacaggt

SEQ ID NO: 5848422 - DNA, 15 bp, Homo sapiens
atgaggtcagagcct

SEQ ID NO: 5848423 - DNA, 19 bp, Homo sapiens
atgaggtcagagcctgcag

SEQ ID NO: 5848424 - DNA, 12 bp, Homo sapiens
atgaggtcagga

SEQ ID NO: 5848425 - DNA, 14 bp, Homo sapiens
atgaggtcccaggc

SEQ ID NO: 5848426 - DNA, 14 bp, Homo sapiens
atgaggtcctcagg

SEQ ID NO: 5848427 - DNA, 15 bp, Homo sapiens
atgaggtcctcaggt

SEQ ID NO: 5848428 - DNA, 17 bp, Homo sapiens
atgaggtctcgaccctg

SEQ ID NO: 5848429 - DNA, 16 bp, Homo sapiens
atgaggtctgggctag

SEQ ID NO: 5848430 - DNA, 17 bp, Homo sapiens
atgaggtgctgggaggg

SEQ ID NO: 5848431 - DNA, 19 bp, Homo sapiens
atgaggtgctgggagggat

SEQ ID NO: 5848432 - DNA, 20 bp, Homo sapiens
atgaggtggtactatgatta

SEQ ID NO: 5848433 - DNA, 20 bp, Homo sapiens
atgaggtgttgtgcatttgt

SEQ ID NO: 5848434 - DNA, 19 bp, Homo sapiens
atgaggttatgagaaaaaa

SEQ ID NO: 5848435 - DNA, 21 bp, Homo sapiens
atgaggttctgagaccagtgt

SEQ ID NO: 5848436 - DNA, 18 bp, Homo sapiens
atgaggttgcttactaag

SEQ ID NO: 5848437 - DNA, 17 bp, Homo sapiens
atgagtaaactgtttct

SEQ ID NO: 5848438 - DNA, 18 bp, Homo sapiens
atgagtaaataaactctt

SEQ ID NO: 5848439 - DNA, 18 bp, Homo sapiens
atgagtaactattattat

SEQ ID NO: 5848440 - DNA, 14 bp, Homo sapiens
atgagtacaaatgc

SEQ ID NO: 5848441 - DNA, 22 bp, Homo sapiens
atgagtagataatttcagggtg

SEQ ID NO: 5848442 - DNA, 13 bp, Homo sapiens
atgagtagccagg

SEQ ID NO: 5848443 - DNA, 23 bp, Homo sapiens
atgagtaggatgtctcttggaaa

SEQ ID NO: 5848444 - DNA, 23 bp, Homo sapiens
atgagtatacaatatataaaaat

SEQ ID NO: 5848445 - DNA, 14 bp, Homo sapiens
atgagtatatgtaa

SEQ ID NO: 5848446 - DNA, 23 bp, Homo sapiens
atgagtatttggtccaaaaaaag

SEQ ID NO: 5848447 - DNA, 15 bp, Homo sapiens
atgagtcaaaacaaa

SEQ ID NO: 5848448 - DNA, 13 bp, Homo sapiens
atgagtcaatcag

SEQ ID NO: 5848449 - DNA, 22 bp, Homo sapiens
atgagtcactatgggatgagaa

SEQ ID NO: 5848450 - DNA, 15 bp, Homo sapiens
atgagtcacttactt

SEQ ID NO: 5848451 - DNA, 22 bp, Homo sapiens
atgagtcatttgtttaaacaat

SEQ ID NO: 5848452 - DNA, 15 bp, Homo sapiens
atgagtcccagtggg

SEQ ID NO: 5848453 - DNA, 13 bp, Homo sapiens
atgagtcccctgt

SEQ ID NO: 5848454 - DNA, 16 bp, Homo sapiens
atgagtccttgaaaat

SEQ ID NO: 5848455 - DNA, 18 bp, Homo sapiens
atgagtccttgaaaatat

SEQ ID NO: 5848456 - DNA, 20 bp, Homo sapiens
atgagtccttgaaaatattt

SEQ ID NO: 5848457 - DNA, 22 bp, Homo sapiens
atgagtctaagtatagccactg

SEQ ID NO: 5848458 - DNA, 22 bp, Homo sapiens
atgagtctacctgagcattcag

SEQ ID NO: 5848459 - DNA, 13 bp, Homo sapiens
atgagtctagatg

SEQ ID NO: 5848460 - DNA, 19 bp, Homo sapiens
atgagtctcactagcacat

SEQ ID NO: 5848461 - DNA, 21 bp, Homo sapiens
atgagtctgcataaacttcat

SEQ ID NO: 5848462 - DNA, 14 bp, Homo sapiens
atgagtctgctttc

SEQ ID NO: 5848463 - DNA, 18 bp, Homo sapiens
atgagtctgtaattttac

SEQ ID NO: 5848464 - DNA, 19 bp, Homo sapiens
atgagtctgttgtgtgtca

SEQ ID NO: 5848465 - DNA, 22 bp, Homo sapiens
atgagtcttctgtaattcattg

SEQ ID NO: 5848466 - DNA, 18 bp, Homo sapiens
atgagtgaagtattgctg

SEQ ID NO: 5848467 - DNA, 19 bp, Homo sapiens
atgagtgattgacacacag

SEQ ID NO: 5848468 - DNA, 20 bp, Homo sapiens
atgagtgcaggtttctattg

SEQ ID NO: 5848469 - DNA, 21 bp, Homo sapiens
atgagtgctaagagcctctgg

SEQ ID NO: 5848470 - DNA, 15 bp, Homo sapiens
atgagtggaaaaagc

SEQ ID NO: 5848471 - DNA, 15 bp, Homo sapiens
atgagtggaaataca

SEQ ID NO: 5848472 - DNA, 21 bp, Homo sapiens
atgagtggaaattaagacttt

SEQ ID NO: 5848473 - DNA, 12 bp, Homo sapiens
atgagtggatgg

SEQ ID NO: 5848474 - DNA, 15 bp, Homo sapiens
atgagtggatggatg

SEQ ID NO: 5848475 - DNA, 19 bp, Homo sapiens
atgagtggatggatggaca

SEQ ID NO: 5848476 - DNA, 22 bp, Homo sapiens
atgagtggatggatggacagaa

SEQ ID NO: 5848477 - DNA, 12 bp, Homo sapiens
atgagtggccag

SEQ ID NO: 5848478 - DNA, 16 bp, Homo sapiens
atgagtggccagcgcc

SEQ ID NO: 5848479 - DNA, 12 bp, Homo sapiens
atgagtgggaat

SEQ ID NO: 5848480 - DNA, 18 bp, Homo sapiens
atgagtgggctgtagttg

SEQ ID NO: 5848481 - DNA, 21 bp, Homo sapiens
atgagtgtcaactccaggact

SEQ ID NO: 5848482 - DNA, 13 bp, Homo sapiens
atgagtgtgaagg

SEQ ID NO: 5848483 - DNA, 13 bp, Homo sapiens
atgagtgtgcatg

SEQ ID NO: 5848484 - DNA, 12 bp, Homo sapiens
atgagtgtgtgt

SEQ ID NO: 5848485 - DNA, 17 bp, Homo sapiens
atgagttaactgtgaaa

SEQ ID NO: 5848486 - DNA, 18 bp, Homo sapiens
atgagttaactgtgaaat

SEQ ID NO: 5848487 - DNA, 16 bp, Homo sapiens
atgagttactgtgcat

SEQ ID NO: 5848488 - DNA, 17 bp, Homo sapiens
atgagttactgtgcatt

SEQ ID NO: 5848489 - DNA, 19 bp, Homo sapiens
atgagttagaataataaat

SEQ ID NO: 5848490 - DNA, 16 bp, Homo sapiens
atgagttatctaagaa

SEQ ID NO: 5848491 - DNA, 15 bp, Homo sapiens
atgagttattatcta

SEQ ID NO: 5848492 - DNA, 21 bp, Homo sapiens
atgagttattatctatggaaa

SEQ ID NO: 5848493 - DNA, 22 bp, Homo sapiens
atgagttattatctatggaaat

SEQ ID NO: 5848494 - DNA, 16 bp, Homo sapiens
atgagttctgcacata

SEQ ID NO: 5848495 - DNA, 22 bp, Homo sapiens
atgagttctgtcccgtaaatca

SEQ ID NO: 5848496 - DNA, 23 bp, Homo sapiens
atgagttctgtcccgtaaatcat

SEQ ID NO: 5848497 - DNA, 12 bp, Homo sapiens
atgagttgcagt

SEQ ID NO: 5848498 - DNA, 14 bp, Homo sapiens
atgagttgcagttt

SEQ ID NO: 5848499 - DNA, 18 bp, Homo sapiens
atgagttggacttcagtc

SEQ ID NO: 5848500 - DNA, 18 bp, Homo sapiens
atgagttggctgggaata

SEQ ID NO: 5848501 - DNA, 15 bp, Homo sapiens
atgagttgtgaaagt

SEQ ID NO: 5848502 - DNA, 20 bp, Homo sapiens
atgagttgtgaaagttttga

SEQ ID NO: 5848503 - DNA, 20 bp, Homo sapiens
atgagttgtgaaatttaatg

SEQ ID NO: 5848504 - DNA, 14 bp, Homo sapiens
atgagttgtgatga

SEQ ID NO: 5848505 - DNA, 12 bp, Homo sapiens
atgagtttaaaa

SEQ ID NO: 5848506 - DNA, 17 bp, Homo sapiens
atgagtttaaaaaaata

SEQ ID NO: 5848507 - DNA, 15 bp, Homo sapiens
atgagtttaaaaatc

SEQ ID NO: 5848508 - DNA, 13 bp, Homo sapiens
atgagtttatggg

SEQ ID NO: 5848509 - DNA, 15 bp, Homo sapiens
atgagtttcacagtg

SEQ ID NO: 5848510 - DNA, 17 bp, Homo sapiens
atgagtttcactgtact

SEQ ID NO: 5848511 - DNA, 22 bp, Homo sapiens
atgagtttgccctggtttcact

SEQ ID NO: 5848512 - DNA, 20 bp, Homo sapiens
atgagttttgggaagttaaa

SEQ ID NO: 5848513 - DNA, 21 bp, Homo sapiens
atgagtttttatggttccaat

SEQ ID NO: 5848514 - DNA, 13 bp, Homo sapiens
atgagtttttgat

SEQ ID NO: 5848515 - DNA, 19 bp, Homo sapiens
atgagtttttgatagcttt

SEQ ID NO: 5848516 - DNA, 17 bp, Homo sapiens
atgataaaaaattttgt

SEQ ID NO: 5848517 - DNA, 15 bp, Homo sapiens
atgataaaacacaaa

SEQ ID NO: 5848518 - DNA, 12 bp, Homo sapiens
atgataaaagga

SEQ ID NO: 5848519 - DNA, 12 bp, Homo sapiens
atgataaaataa

SEQ ID NO: 5848520 - DNA, 17 bp, Homo sapiens
atgataaaataaataat

SEQ ID NO: 5848521 - DNA, 19 bp, Homo sapiens
atgataaaataaataattt

SEQ ID NO: 5848522 - DNA, 14 bp, Homo sapiens
atgataaaatagcc

SEQ ID NO: 5848523 - DNA, 21 bp, Homo sapiens
atgataaaatcccattgtatt

SEQ ID NO: 5848524 - DNA, 12 bp, Homo sapiens
atgataaagact

SEQ ID NO: 5848525 - DNA, 14 bp, Homo sapiens
atgataaagagaca

SEQ ID NO: 5848526 - DNA, 20 bp, Homo sapiens
atgataaagagacagtgata

SEQ ID NO: 5848527 - DNA, 15 bp, Homo sapiens
atgataaagatgtca

SEQ ID NO: 5848528 - DNA, 17 bp, Homo sapiens
atgataaagttgtaaat

SEQ ID NO: 5848529 - DNA, 12 bp, Homo sapiens
atgataaattat

SEQ ID NO: 5848530 - DNA, 15 bp, Homo sapiens
atgataacactattt

SEQ ID NO: 5848531 - DNA, 18 bp, Homo sapiens
atgataactatttacata

SEQ ID NO: 5848532 - DNA, 15 bp, Homo sapiens
atgataactggaaac

SEQ ID NO: 5848533 - DNA, 18 bp, Homo sapiens
atgataagaacagagtgc

SEQ ID NO: 5848534 - DNA, 14 bp, Homo sapiens
atgataagacattt

SEQ ID NO: 5848535 - DNA, 15 bp, Homo sapiens
atgataagattgaaa

SEQ ID NO: 5848536 - DNA, 16 bp, Homo sapiens
atgataagattgaaat

SEQ ID NO: 5848537 - DNA, 17 bp, Homo sapiens
atgataagtaaatgcta

SEQ ID NO: 5848538 - DNA, 22 bp, Homo sapiens
atgataatagctcacagcacat

SEQ ID NO: 5848539 - DNA, 13 bp, Homo sapiens
atgataatgataa

SEQ ID NO: 5848540 - DNA, 22 bp, Homo sapiens
atgataatgctaattttattat

SEQ ID NO: 5848541 - DNA, 20 bp, Homo sapiens
atgataattacaatacaaag

SEQ ID NO: 5848542 - DNA, 11 bp, Homo sapiens
atgatacaaag

SEQ ID NO: 5848543 - DNA, 19 bp, Homo sapiens
atgatacagtgttaaaaga

SEQ ID NO: 5848544 - DNA, 14 bp, Homo sapiens
atgatacagtgttt

SEQ ID NO: 5848545 - DNA, 18 bp, Homo sapiens
atgataccacctttactg

SEQ ID NO: 5848546 - DNA, 19 bp, Homo sapiens
atgataccacctttactgt

SEQ ID NO: 5848547 - DNA, 20 bp, Homo sapiens
atgataccaggcccaggaga

SEQ ID NO: 5848548 - DNA, 19 bp, Homo sapiens
atgatacctattaaaggaa

SEQ ID NO: 5848549 - DNA, 19 bp, Homo sapiens
atgatacgcttaaggtgga

SEQ ID NO: 5848550 - DNA, 20 bp, Homo sapiens
atgatactctcagattttaa

SEQ ID NO: 5848551 - DNA, 13 bp, Homo sapiens
atgatactgatgc

SEQ ID NO: 5848552 - DNA, 16 bp, Homo sapiens
atgatactgatgccat

SEQ ID NO: 5848553 - DNA, 19 bp, Homo sapiens
atgatactgattatgaaat

SEQ ID NO: 5848554 - DNA, 21 bp, Homo sapiens
atgatactgctgcttgtcaaa

SEQ ID NO: 5848555 - DNA, 22 bp, Homo sapiens
atgatactgtctctccagtgaa

SEQ ID NO: 5848556 - DNA, 17 bp, Homo sapiens
atgatacttgaaaatta

SEQ ID NO: 5848557 - DNA, 15 bp, Homo sapiens
atgatacttgaattt

SEQ ID NO: 5848558 - DNA, 13 bp, Homo sapiens
atgatactttaat

SEQ ID NO: 5848559 - DNA, 18 bp, Homo sapiens
atgatactttaattttta

SEQ ID NO: 5848560 - DNA, 16 bp, Homo sapiens
atgatagaactgtact

SEQ ID NO: 5848561 - DNA, 14 bp, Homo sapiens
atgatagacttcga

SEQ ID NO: 5848562 - DNA, 21 bp, Homo sapiens
atgatagacttcgaaaacaga

SEQ ID NO: 5848563 - DNA, 22 bp, Homo sapiens
atgatagacttcgaaaacagat

SEQ ID NO: 5848564 - DNA, 14 bp, Homo sapiens
atgatagatttgac

SEQ ID NO: 5848565 - DNA, 23 bp, Homo sapiens
atgatagcacctaaacttacatt

SEQ ID NO: 5848566 - DNA, 21 bp, Homo sapiens
atgatagcagacattgttaca

SEQ ID NO: 5848567 - DNA, 22 bp, Homo sapiens
atgatagcccagaacaaaaaga

SEQ ID NO: 5848568 - DNA, 20 bp, Homo sapiens
atgatagcgggaaaaggaga

SEQ ID NO: 5848569 - DNA, 19 bp, Homo sapiens
atgatagcgtgcagtagag

SEQ ID NO: 5848570 - DNA, 14 bp, Homo sapiens
atgataggcagcac

SEQ ID NO: 5848571 - DNA, 16 bp, Homo sapiens
atgataggcagcactg

SEQ ID NO: 5848572 - DNA, 19 bp, Homo sapiens
atgataggcagcactgaaa

SEQ ID NO: 5848573 - DNA, 19 bp, Homo sapiens
atgatagtataaaaaatgg

SEQ ID NO: 5848574 - DNA, 15 bp, Homo sapiens
atgatagtgtgattt

SEQ ID NO: 5848575 - DNA, 15 bp, Homo sapiens
atgatagttgaatgt

SEQ ID NO: 5848576 - DNA, 17 bp, Homo sapiens
atgcaaactgctttatt

SEQ ID NO: 5848577 - DNA, 21 bp, Homo sapiens
atgcaaactgctttattttcc

SEQ ID NO: 5848578 - DNA, 21 bp, Homo sapiens
atgcaaactgtgcttctctat

SEQ ID NO: 5848579 - DNA, 22 bp, Homo sapiens
atgcaaactgtggcaactgaga

SEQ ID NO: 5848580 - DNA, 14 bp, Homo sapiens
atgcaaagaggcaa

SEQ ID NO: 5848581 - DNA, 16 bp, Homo sapiens
atgcaaagctgaagac

SEQ ID NO: 5848582 - DNA, 13 bp, Homo sapiens
atgcaaaggctgg

SEQ ID NO: 5848583 - DNA, 14 bp, Homo sapiens
atgcaaagtacaat

SEQ ID NO: 5848584 - DNA, 15 bp, Homo sapiens
atgcaaagtacaatg

SEQ ID NO: 5848585 - DNA, 17 bp, Homo sapiens
atgcaaagtacaatgtg

SEQ ID NO: 5848586 - DNA, 14 bp, Homo sapiens
atgcaaagttctgt

SEQ ID NO: 5848587 - DNA, 17 bp, Homo sapiens
atgcaaagttctgtgtt

SEQ ID NO: 5848588 - DNA, 15 bp, Homo sapiens
atgcaaataaagcct

SEQ ID NO: 5848589 - DNA, 19 bp, Homo sapiens
atgcaaataaagcctgctc

SEQ ID NO: 5848590 - DNA, 12 bp, Homo sapiens
atgcaaatacaa

SEQ ID NO: 5848591 - DNA, 21 bp, Homo sapiens
atgcaaatagattcagagaaa

SEQ ID NO: 5848592 - DNA, 15 bp, Homo sapiens
atgcaaatctggctt

SEQ ID NO: 5848593 - DNA, 21 bp, Homo sapiens
atgcaaatgaaggaatgcaat

SEQ ID NO: 5848594 - DNA, 16 bp, Homo sapiens
atgcaaatgaatcatt

SEQ ID NO: 5848595 - DNA, 17 bp, Homo sapiens
atgcaaatgaatcattg

SEQ ID NO: 5848596 - DNA, 17 bp, Homo sapiens
atgcaaatgagatttct

SEQ ID NO: 5848597 - DNA, 22 bp, Homo sapiens
atgcaaatgagatttctttgaa

SEQ ID NO: 5848598 - DNA, 20 bp, Homo sapiens
atgcaaatgagctctgaaat

SEQ ID NO: 5848599 - DNA, 21 bp, Homo sapiens
atgcaaatgagctctgaaatc

SEQ ID NO: 5848600 - DNA, 23 bp, Homo sapiens
atgcaaatgagctctgaaatctt

SEQ ID NO: 5848601 - DNA, 17 bp, Homo sapiens
atgcaaatgtctaattg

SEQ ID NO: 5848602 - DNA, 15 bp, Homo sapiens
atgcaaatgttttga

SEQ ID NO: 5848603 - DNA, 18 bp, Homo sapiens
atgcaaattaaaacatat

SEQ ID NO: 5848604 - DNA, 18 bp, Homo sapiens
atgcaaattaaagggcag

SEQ ID NO: 5848605 - DNA, 15 bp, Homo sapiens
atgcaaattgtgaaa

SEQ ID NO: 5848606 - DNA, 16 bp, Homo sapiens
atgcaaattgtgaaat

SEQ ID NO: 5848607 - DNA, 16 bp, Homo sapiens
atgcaacaaaaatgtg

SEQ ID NO: 5848608 - DNA, 13 bp, Homo sapiens
atgcaacaaatga

SEQ ID NO: 5848609 - DNA, 15 bp, Homo sapiens
atgcaacaaatgaat

SEQ ID NO: 5848610 - DNA, 23 bp, Homo sapiens
atgcaacaaatgaattttccacg

SEQ ID NO: 5848611 - DNA, 16 bp, Homo sapiens
atgcaacaacatgtat

SEQ ID NO: 5848612 - DNA, 17 bp, Homo sapiens
atgcaacaatgtgtgta

SEQ ID NO: 5848613 - DNA, 22 bp, Homo sapiens
atgcaacaatgtgtgtatgtta

SEQ ID NO: 5848614 - DNA, 20 bp, Homo sapiens
atgcaacacgcatggtcaac

SEQ ID NO: 5848615 - DNA, 16 bp, Homo sapiens
atgcaacaggcactca

SEQ ID NO: 5848616 - DNA, 16 bp, Homo sapiens
atgcaacatggatatg

SEQ ID NO: 5848617 - DNA, 12 bp, Homo sapiens
atgcaaccaaaa

SEQ ID NO: 5848618 - DNA, 16 bp, Homo sapiens
atgcaaccaagtcaca

SEQ ID NO: 5848619 - DNA, 14 bp, Homo sapiens
atgcaacctctgcc

SEQ ID NO: 5848620 - DNA, 15 bp, Homo sapiens
atgcaacctgtgcaa

SEQ ID NO: 5848621 - DNA, 20 bp, Homo sapiens
atgcaacctgtgcaaaataa

SEQ ID NO: 5848622 - DNA, 23 bp, Homo sapiens
atgcaacgggattgaagggtcct

SEQ ID NO: 5848623 - DNA, 22 bp, Homo sapiens
atgcaactccatgcctatttac

SEQ ID NO: 5848624 - DNA, 23 bp, Homo sapiens
atgcaactcgccctgtttggcat

SEQ ID NO: 5848625 - DNA, 23 bp, Homo sapiens
atgcaactggagttccttatccc

SEQ ID NO: 5848626 - DNA, 17 bp, Homo sapiens
atgcaacttttaattac

SEQ ID NO: 5848627 - DNA, 13 bp, Homo sapiens
atgcaagaaggag

SEQ ID NO: 5848628 - DNA, 15 bp, Homo sapiens
atgcaagaatttctg

SEQ ID NO: 5848629 - DNA, 22 bp, Homo sapiens
atgcaagaatttctggaagaaa

SEQ ID NO: 5848630 - DNA, 17 bp, Homo sapiens
atgcaagacgccctcta

SEQ ID NO: 5848631 - DNA, 16 bp, Homo sapiens
atgcaagagaacattt

SEQ ID NO: 5848632 - DNA, 18 bp, Homo sapiens
atgcaagagaacatttta

SEQ ID NO: 5848633 - DNA, 13 bp, Homo sapiens
atgcaagagaagg

SEQ ID NO: 5848634 - DNA, 16 bp, Homo sapiens
atgcaagagtttcttg

SEQ ID NO: 5848635 - DNA, 22 bp, Homo sapiens
atgcaagcagaggaccagggcc

SEQ ID NO: 5848636 - DNA, 23 bp, Homo sapiens
atgcaagcagaggaccagggcct

SEQ ID NO: 5848637 - DNA, 16 bp, Homo sapiens
atgcaagcagtttcaa

SEQ ID NO: 5848638 - DNA, 22 bp, Homo sapiens
atgcaagcagtttcaataaagt

SEQ ID NO: 5848639 - DNA, 22 bp, Homo sapiens
atgcaagcttggtcaaactttt

SEQ ID NO: 5848640 - DNA, 16 bp, Homo sapiens
atgcaaggaaggaaag

SEQ ID NO: 5848641 - DNA, 20 bp, Homo sapiens
atgcaaggaaggaaagaaag

SEQ ID NO: 5848642 - DNA, 19 bp, Homo sapiens
atgcaaggacaagcaatta

SEQ ID NO: 5848643 - DNA, 15 bp, Homo sapiens
atgcaagggtgacat

SEQ ID NO: 5848644 - DNA, 16 bp, Homo sapiens
atgcaagggtgacatc

SEQ ID NO: 5848645 - DNA, 21 bp, Homo sapiens
atgcaaggtagcatgggtcca

SEQ ID NO: 5848646 - DNA, 16 bp, Homo sapiens
atgcaaggtcattttt

SEQ ID NO: 5848647 - DNA, 22 bp, Homo sapiens
atgcaaggtcattttttttaag

SEQ ID NO: 5848648 - DNA, 14 bp, Homo sapiens
atgcaaggtgctgg

SEQ ID NO: 5848649 - DNA, 17 bp, Homo sapiens
atgcaagtgaacaaagt

SEQ ID NO: 5848650 - DNA, 14 bp, Homo sapiens
atgcaagtgagaaa

SEQ ID NO: 5848651 - DNA, 15 bp, Homo sapiens
atgcaagtgagaaag

SEQ ID NO: 5848652 - DNA, 13 bp, Homo sapiens
atgcaagtgctgt

SEQ ID NO: 5848653 - DNA, 15 bp, Homo sapiens
atgcaagtgtttctg

SEQ ID NO: 5848654 - DNA, 22 bp, Homo sapiens
atgcaagttattttatttgctt

SEQ ID NO: 5848655 - DNA, 15 bp, Homo sapiens
atgcaataaaattat

SEQ ID NO: 5848656 - DNA, 21 bp, Homo sapiens
atgcaataaaattatttgcag

SEQ ID NO: 5848657 - DNA, 18 bp, Homo sapiens
atgcaataaaatttaaaa

SEQ ID NO: 5848658 - DNA, 15 bp, Homo sapiens
atgcaataaagagta

SEQ ID NO: 5848659 - DNA, 15 bp, Homo sapiens
atgcaataaatatta

SEQ ID NO: 5848660 - DNA, 21 bp, Homo sapiens
atgcaataaatattatttgat

SEQ ID NO: 5848661 - DNA, 21 bp, Homo sapiens
atgcaataacaagcatgcata

SEQ ID NO: 5848662 - DNA, 13 bp, Homo sapiens
atgcaataactct

SEQ ID NO: 5848663 - DNA, 16 bp, Homo sapiens
atgcaataatccaccc

SEQ ID NO: 5848664 - DNA, 16 bp, Homo sapiens
atgcaataatgtgcaa

SEQ ID NO: 5848665 - DNA, 15 bp, Homo sapiens
atgcaatataagcat

SEQ ID NO: 5848666 - DNA, 21 bp, Homo sapiens
atgcaatatactggaaagctt

SEQ ID NO: 5848667 - DNA, 17 bp, Homo sapiens
atgcaatatatgttcat

SEQ ID NO: 5848668 - DNA, 15 bp, Homo sapiens
atgcaatatttgtaa

SEQ ID NO: 5848669 - DNA, 15 bp, Homo sapiens
atgcaatccttccct

SEQ ID NO: 5848670 - DNA, 21 bp, Homo sapiens
atgcaatcttggctcactgca

SEQ ID NO: 5848671 - DNA, 18 bp, Homo sapiens
atgcaatgataaataaag

SEQ ID NO: 5848672 - DNA, 14 bp, Homo sapiens
atgcaatgcatctg

SEQ ID NO: 5848673 - DNA, 17 bp, Homo sapiens
atgcaatgtgctactga

SEQ ID NO: 5848674 - DNA, 15 bp, Homo sapiens
atgcaattagaattt

SEQ ID NO: 5848675 - DNA, 19 bp, Homo sapiens
atgcaattagcctcatagt

SEQ ID NO: 5848676 - DNA, 22 bp, Homo sapiens
atgcaattcaatgcaatgaaaa

SEQ ID NO: 5848677 - DNA, 19 bp, Homo sapiens
atgcaattcagtgttccaa

SEQ ID NO: 5848678 - DNA, 15 bp, Homo sapiens
atgcaattgtacaaa

SEQ ID NO: 5848679 - DNA, 16 bp, Homo sapiens
atgcaattgtacaaaa

SEQ ID NO: 5848680 - DNA, 16 bp, Homo sapiens
atgcaatttaaaatta

SEQ ID NO: 5848681 - DNA, 18 bp, Homo sapiens
atgcaatttaaaattatt

SEQ ID NO: 5848682 - DNA, 23 bp, Homo sapiens
atgcaatttaatggatatttctc

SEQ ID NO: 5848683 - DNA, 19 bp, Homo sapiens
atgcaatttattaaaatga

SEQ ID NO: 5848684 - DNA, 17 bp, Homo sapiens
atgcaatttcctttttt

SEQ ID NO: 5848685 - DNA, 12 bp, Homo sapiens
atgcaatttgat

SEQ ID NO: 5848686 - DNA, 20 bp, Homo sapiens
atgcaatttgataatcagtt

SEQ ID NO: 5848687 - DNA, 15 bp, Homo sapiens
atgcaatttgggatt

SEQ ID NO: 5848688 - DNA, 19 bp, Homo sapiens
atgcaatttttaaactagt

SEQ ID NO: 5848689 - DNA, 13 bp, Homo sapiens
atgcaatttttat

SEQ ID NO: 5848690 - DNA, 15 bp, Homo sapiens
atgcacaaaactact

SEQ ID NO: 5848691 - DNA, 17 bp, Homo sapiens
atgcacaaattgaaaac

SEQ ID NO: 5848692 - DNA, 18 bp, Homo sapiens
atgcacaaattgaaaaca

SEQ ID NO: 5848693 - DNA, 16 bp, Homo sapiens
atgcacaacagagtaa

SEQ ID NO: 5848694 - DNA, 15 bp, Homo sapiens
atgcacaatttagaa

SEQ ID NO: 5848695 - DNA, 16 bp, Homo sapiens
atgcacaatttagaaa

SEQ ID NO: 5848696 - DNA, 14 bp, Homo sapiens
atgcacacaaaaca

SEQ ID NO: 5848697 - DNA, 14 bp, Homo sapiens
atgcacacacacag

SEQ ID NO: 5848698 - DNA, 19 bp, Homo sapiens
atgcacacacacagagata

SEQ ID NO: 5848699 - DNA, 12 bp, Homo sapiens
atgcacacacag

SEQ ID NO: 5848700 - DNA, 20 bp, Homo sapiens
atgcacacagcggctgcctc

SEQ ID NO: 5848701 - DNA, 19 bp, Homo sapiens
atgcacacatatataggca

SEQ ID NO: 5848702 - DNA, 14 bp, Homo sapiens
atgcacacattttt

SEQ ID NO: 5848703 - DNA, 17 bp, Homo sapiens
atgcacacattttttaa

SEQ ID NO: 5848704 - DNA, 18 bp, Homo sapiens
atgcacacggctggtcac

SEQ ID NO: 5848705 - DNA, 19 bp, Homo sapiens
atgcacacggctggtcact

SEQ ID NO: 5848706 - DNA, 21 bp, Homo sapiens
atgcacacggctggtcactct

SEQ ID NO: 5848707 - DNA, 22 bp, Homo sapiens
atgcacactcatgcacacagat

SEQ ID NO: 5848708 - DNA, 18 bp, Homo sapiens
atgcacactgagaatgct

SEQ ID NO: 5848709 - DNA, 20 bp, Homo sapiens
atgcacactgttggaatgta

SEQ ID NO: 5848710 - DNA, 21 bp, Homo sapiens
atgcacacttttaattttgtc

SEQ ID NO: 5848711 - DNA, 23 bp, Homo sapiens
atgcacacttttaattttgtcag

SEQ ID NO: 5848712 - DNA, 17 bp, Homo sapiens
atgcacagagcccaatg

SEQ ID NO: 5848713 - DNA, 14 bp, Homo sapiens
atgcacagagtcct

SEQ ID NO: 5848714 - DNA, 21 bp, Homo sapiens
atgcacagagttgttacattt

SEQ ID NO: 5848715 - DNA, 23 bp, Homo sapiens
atgcacagagttgttacattttt

SEQ ID NO: 5848716 - DNA, 18 bp, Homo sapiens
atgcacagatatactttg

SEQ ID NO: 5848717 - DNA, 18 bp, Homo sapiens
atgcacagattaaacttc

SEQ ID NO: 5848718 - DNA, 19 bp, Homo sapiens
atgcacagattaaacttca

SEQ ID NO: 5848719 - DNA, 11 bp, Homo sapiens
atgcacagcct

SEQ ID NO: 5848720 - DNA, 20 bp, Homo sapiens
atgcacagcctagttatcaa

SEQ ID NO: 5848721 - DNA, 20 bp, Homo sapiens
atgcacagctgcttgtcctg

SEQ ID NO: 5848722 - DNA, 22 bp, Homo sapiens
atgcacagctgcttgtcctgct

SEQ ID NO: 5848723 - DNA, 13 bp, Homo sapiens
atgcacagtacaa

SEQ ID NO: 5848724 - DNA, 17 bp, Homo sapiens
atgcacagtacaataat

SEQ ID NO: 5848725 - DNA, 18 bp, Homo sapiens
atgcacagtacaataatg

SEQ ID NO: 5848726 - DNA, 19 bp, Homo sapiens
atgcacagtacaataatgt

SEQ ID NO: 5848727 - DNA, 16 bp, Homo sapiens
atgcacagtatctgct

SEQ ID NO: 5848728 - DNA, 20 bp, Homo sapiens
atgcacagtatctgctgttc

SEQ ID NO: 5848729 - DNA, 23 bp, Homo sapiens
atgcacagtatctgctgttcttc

SEQ ID NO: 5848730 - DNA, 15 bp, Homo sapiens
atgcacagtatcttt

SEQ ID NO: 5848731 - DNA, 19 bp, Homo sapiens
atgcacagtatcttttctt

SEQ ID NO: 5848732 - DNA, 19 bp, Homo sapiens
atgcacagttctatttgct

SEQ ID NO: 5848733 - DNA, 20 bp, Homo sapiens
atgcacagttctatttgcta

SEQ ID NO: 5848734 - DNA, 19 bp, Homo sapiens
atgcacagttgccacattt

SEQ ID NO: 5848735 - DNA, 21 bp, Homo sapiens
atgcacagtttgctatttgct

SEQ ID NO: 5848736 - DNA, 21 bp, Homo sapiens
atgcacatccattcccaagaa

SEQ ID NO: 5848737 - DNA, 17 bp, Homo sapiens
atgcacatcctcattca

SEQ ID NO: 5848738 - DNA, 21 bp, Homo sapiens
atgcacatgctgtctggccct

SEQ ID NO: 5848739 - DNA, 21 bp, Homo sapiens
atgcacatgttggaggagaga

SEQ ID NO: 5848740 - DNA, 17 bp, Homo sapiens
atgcacattcatcctca

SEQ ID NO: 5848741 - DNA, 13 bp, Homo sapiens
atgcacatttata

SEQ ID NO: 5848742 - DNA, 14 bp, Homo sapiens
atgcacatttatat

SEQ ID NO: 5848743 - DNA, 16 bp, Homo sapiens
atgcacatttatatat

SEQ ID NO: 5848744 - DNA, 15 bp, Homo sapiens
atgcacatttcagaa

SEQ ID NO: 5848745 - DNA, 12 bp, Homo sapiens
atgcacatttct

SEQ ID NO: 5848746 - DNA, 13 bp, Homo sapiens
atgcacatttctg

SEQ ID NO: 5848747 - DNA, 13 bp, Homo sapiens
atgcacattttgt

SEQ ID NO: 5848748 - DNA, 13 bp, Homo sapiens
atgcaccaaatag

SEQ ID NO: 5848749 - DNA, 15 bp, Homo sapiens
atgcaccaagtacag

SEQ ID NO: 5848750 - DNA, 18 bp, Homo sapiens
atgcaccaatcttgttta

SEQ ID NO: 5848751 - DNA, 21 bp, Homo sapiens
atgcaccacccatggagaggt

SEQ ID NO: 5848752 - DNA, 18 bp, Homo sapiens
atgcaccagtgccgcctg

SEQ ID NO: 5848753 - DNA, 15 bp, Homo sapiens
atgccaaagcagaca

SEQ ID NO: 5848754 - DNA, 11 bp, Homo sapiens
atgccaaagct

SEQ ID NO: 5848755 - DNA, 16 bp, Homo sapiens
atgccaaagctgcttt

SEQ ID NO: 5848756 - DNA, 14 bp, Homo sapiens
atgccaaattaaaa

SEQ ID NO: 5848757 - DNA, 15 bp, Homo sapiens
atgccaaattaaaaa

SEQ ID NO: 5848758 - DNA, 18 bp, Homo sapiens
atgccaacaccttcttgg

SEQ ID NO: 5848759 - DNA, 19 bp, Homo sapiens
atgccaacacttaatcatt

SEQ ID NO: 5848760 - DNA, 23 bp, Homo sapiens
atgccaacacttaatcattttat

SEQ ID NO: 5848761 - DNA, 19 bp, Homo sapiens
atgccaacagacactacat

SEQ ID NO: 5848762 - DNA, 13 bp, Homo sapiens
atgccaacatacc

SEQ ID NO: 5848763 - DNA, 13 bp, Homo sapiens
atgccaacttccc

SEQ ID NO: 5848764 - DNA, 15 bp, Homo sapiens
atgccaacttcccac

SEQ ID NO: 5848765 - DNA, 17 bp, Homo sapiens
atgccaagcactgtgct

SEQ ID NO: 5848766 - DNA, 21 bp, Homo sapiens
atgccaaggaggtcccaggaa

SEQ ID NO: 5848767 - DNA, 19 bp, Homo sapiens
atgccaaggggctgagtga

SEQ ID NO: 5848768 - DNA, 19 bp, Homo sapiens
atgccaagggggtgactgg

SEQ ID NO: 5848769 - DNA, 16 bp, Homo sapiens
atgccaagtgcctgct

SEQ ID NO: 5848770 - DNA, 23 bp, Homo sapiens
atgccaagtggacttggagctgc

SEQ ID NO: 5848771 - DNA, 16 bp, Homo sapiens
atgccaagtggccctc

SEQ ID NO: 5848772 - DNA, 18 bp, Homo sapiens
atgccaagtggccctcag

SEQ ID NO: 5848773 - DNA, 16 bp, Homo sapiens
atgccaatatgacaca

SEQ ID NO: 5848774 - DNA, 17 bp, Homo sapiens
atgccaatgaacatctc

SEQ ID NO: 5848775 - DNA, 21 bp, Homo sapiens
atgccaatgagtctgtaattt

SEQ ID NO: 5848776 - DNA, 16 bp, Homo sapiens
atgccaattattgtta

SEQ ID NO: 5848777 - DNA, 21 bp, Homo sapiens
atgccacaaccacggtcacac

SEQ ID NO: 5848778 - DNA, 18 bp, Homo sapiens
atgccacacagagtggtc

SEQ ID NO: 5848779 - DNA, 20 bp, Homo sapiens
atgccacaccaagctgtgcc

SEQ ID NO: 5848780 - DNA, 19 bp, Homo sapiens
atgccacagccaagcccac

SEQ ID NO: 5848781 - DNA, 14 bp, Homo sapiens
atgccacagccctg

SEQ ID NO: 5848782 - DNA, 22 bp, Homo sapiens
atgccacagtggtactctgtgt

SEQ ID NO: 5848783 - DNA, 17 bp, Homo sapiens
atgccaccaaaggagac

SEQ ID NO: 5848784 - DNA, 19 bp, Homo sapiens
atgccaccaacttacaaaa

SEQ ID NO: 5848785 - DNA, 15 bp, Homo sapiens
atgccacccacatct

SEQ ID NO: 5848786 - DNA, 20 bp, Homo sapiens
atgccacccccgctggagga

SEQ ID NO: 5848787 - DNA, 22 bp, Homo sapiens
atgccaccctcacacacacagc

SEQ ID NO: 5848788 - DNA, 21 bp, Homo sapiens
atgccaccctctccatgccca

SEQ ID NO: 5848789 - DNA, 19 bp, Homo sapiens
atgccacctagactctccc

SEQ ID NO: 5848790 - DNA, 20 bp, Homo sapiens
atgccacctagactctccct

SEQ ID NO: 5848791 - DNA, 16 bp, Homo sapiens
atgccacctcctctgt

SEQ ID NO: 5848792 - DNA, 21 bp, Homo sapiens
atgccacctggcaaaggaccc

SEQ ID NO: 5848793 - DNA, 22 bp, Homo sapiens
atgccacgcggtacaaaggaaa

SEQ ID NO: 5848794 - DNA, 21 bp, Homo sapiens
atgccacggcagccaccctgc

SEQ ID NO: 5848795 - DNA, 22 bp, Homo sapiens
atgccacggcagccaccctgcc

SEQ ID NO: 5848796 - DNA, 21 bp, Homo sapiens
atgccacgtggtcactgtgca

SEQ ID NO: 5848797 - DNA, 23 bp, Homo sapiens
atgccacgtggtcactgtgcact

SEQ ID NO: 5848798 - DNA, 17 bp, Homo sapiens
atgccactaaattgaca

SEQ ID NO: 5848799 - DNA, 17 bp, Homo sapiens
atgccactaggccctgg

SEQ ID NO: 5848800 - DNA, 12 bp, Homo sapiens
atgccactccct

SEQ ID NO: 5848801 - DNA, 16 bp, Homo sapiens
atgccactctgggcag

SEQ ID NO: 5848802 - DNA, 17 bp, Homo sapiens
atgccactctgggcagt

SEQ ID NO: 5848803 - DNA, 15 bp, Homo sapiens
atgccactgccaggc

SEQ ID NO: 5848804 - DNA, 18 bp, Homo sapiens
atgccactgccaggcacc

SEQ ID NO: 5848805 - DNA, 17 bp, Homo sapiens
atgccactgccttcgct

SEQ ID NO: 5848806 - DNA, 12 bp, Homo sapiens
atgccacttcct

SEQ ID NO: 5848807 - DNA, 20 bp, Homo sapiens
atgccacttccttttaactg

SEQ ID NO: 5848808 - DNA, 19 bp, Homo sapiens
atgccacttctcactcacc

SEQ ID NO: 5848809 - DNA, 21 bp, Homo sapiens
atgccagaaggaatcttctca

SEQ ID NO: 5848810 - DNA, 18 bp, Homo sapiens
atgccagaagttggggga

SEQ ID NO: 5848811 - DNA, 22 bp, Homo sapiens
atgccagacttctaaaataaat

SEQ ID NO: 5848812 - DNA, 12 bp, Homo sapiens
atgccagagagg

SEQ ID NO: 5848813 - DNA, 11 bp, Homo sapiens
atgccagagcc

SEQ ID NO: 5848814 - DNA, 13 bp, Homo sapiens
atgccagagggcc

SEQ ID NO: 5848815 - DNA, 17 bp, Homo sapiens
atgccagattctgcctc

SEQ ID NO: 5848816 - DNA, 21 bp, Homo sapiens
atgccagccaagctctgcagt

SEQ ID NO: 5848817 - DNA, 13 bp, Homo sapiens
atgccagcccctg

SEQ ID NO: 5848818 - DNA, 14 bp, Homo sapiens
atgccagcccctgc

SEQ ID NO: 5848819 - DNA, 16 bp, Homo sapiens
atgccagcccctgcct

SEQ ID NO: 5848820 - DNA, 12 bp, Homo sapiens
atgccagccctt

SEQ ID NO: 5848821 - DNA, 14 bp, Homo sapiens
atgccagctgtgtc

SEQ ID NO: 5848822 - DNA, 16 bp, Homo sapiens
atgccagctgtgtcct

SEQ ID NO: 5848823 - DNA, 20 bp, Homo sapiens
atgccagcttcctgtgggcc

SEQ ID NO: 5848824 - DNA, 16 bp, Homo sapiens
atgccagcttctctct

SEQ ID NO: 5848825 - DNA, 17 bp, Homo sapiens
atgccagcttctctctc

SEQ ID NO: 5848826 - DNA, 19 bp, Homo sapiens
atgccagcttctctctcca

SEQ ID NO: 5848827 - DNA, 12 bp, Homo sapiens
atgccaggacac

SEQ ID NO: 5848828 - DNA, 16 bp, Homo sapiens
atgccaggacagctgc

SEQ ID NO: 5848829 - DNA, 23 bp, Homo sapiens
atgccaggacagctgcaggtgcc

SEQ ID NO: 5848830 - DNA, 13 bp, Homo sapiens
atgccagggacat

SEQ ID NO: 5848831 - DNA, 21 bp, Homo sapiens
atgccaggttctatttggaat

SEQ ID NO: 5848832 - DNA, 22 bp, Homo sapiens
atgccagtaacgcgtcttcctg

SEQ ID NO: 5848833 - DNA, 21 bp, Homo sapiens
atgccagtctcattgtcacct

SEQ ID NO: 5848834 - DNA, 21 bp, Homo sapiens
atgccagtgccttattaccca

SEQ ID NO: 5848835 - DNA, 20 bp, Homo sapiens
atgccagtgtgctgatgggc

SEQ ID NO: 5848836 - DNA, 18 bp, Homo sapiens
atgccagtttttaaaatg

SEQ ID NO: 5848837 - DNA, 14 bp, Homo sapiens
atgccatagcataa

SEQ ID NO: 5848838 - DNA, 15 bp, Homo sapiens
atgccatcatctcct

SEQ ID NO: 5848839 - DNA, 21 bp, Homo sapiens
atgccatcctcaaacactgca

SEQ ID NO: 5848840 - DNA, 17 bp, Homo sapiens
atgccatctccaccctg

SEQ ID NO: 5848841 - DNA, 13 bp, Homo sapiens
atgccatgaacaa

SEQ ID NO: 5848842 - DNA, 15 bp, Homo sapiens
atgccatgaacaaat

SEQ ID NO: 5848843 - DNA, 17 bp, Homo sapiens
atgccatgaacaaattc

SEQ ID NO: 5848844 - DNA, 13 bp, Homo sapiens
atgccatgaatga

SEQ ID NO: 5848845 - DNA, 21 bp, Homo sapiens
atgccatgactgctcaggcct

SEQ ID NO: 5848846 - DNA, 13 bp, Homo sapiens
atgccatgatatc

SEQ ID NO: 5848847 - DNA, 14 bp, Homo sapiens
atgccatgatatca

SEQ ID NO: 5848848 - DNA, 23 bp, Homo sapiens
atgccatgatttttggtatttat

SEQ ID NO: 5848849 - DNA, 15 bp, Homo sapiens
atgccatggaatgac

SEQ ID NO: 5848850 - DNA, 18 bp, Homo sapiens
atgccatggacagaagaa

SEQ ID NO: 5848851 - DNA, 21 bp, Homo sapiens
atgccatggcctgtgctgggc

SEQ ID NO: 5848852 - DNA, 23 bp, Homo sapiens
atgccatgtgcggaattcaagtt

SEQ ID NO: 5848853 - DNA, 22 bp, Homo sapiens
atgccattccgaccttcaccaa

SEQ ID NO: 5848854 - DNA, 23 bp, Homo sapiens
atgccattctgcctcagcctcct

SEQ ID NO: 5848855 - DNA, 16 bp, Homo sapiens
atgccatttagaatct

SEQ ID NO: 5848856 - DNA, 17 bp, Homo sapiens
atgccatttagaatcta

SEQ ID NO: 5848857 - DNA, 18 bp, Homo sapiens
atgccatttagaatctag

SEQ ID NO: 5848858 - DNA, 14 bp, Homo sapiens
atgccatttctcac

SEQ ID NO: 5848859 - DNA, 23 bp, Homo sapiens
atgccatttgcacttacacaaga

SEQ ID NO: 5848860 - DNA, 13 bp, Homo sapiens
atgccatttgtct

SEQ ID NO: 5848861 - DNA, 14 bp, Homo sapiens
atgcccaaaactta

SEQ ID NO: 5848862 - DNA, 15 bp, Homo sapiens
atgcccaaggcctag

SEQ ID NO: 5848863 - DNA, 23 bp, Homo sapiens
atgcccacatttagtctctttat

SEQ ID NO: 5848864 - DNA, 15 bp, Homo sapiens
atgcccaccccctgc

SEQ ID NO: 5848865 - DNA, 17 bp, Homo sapiens
atgcccaccccctgccc

SEQ ID NO: 5848866 - DNA, 18 bp, Homo sapiens
atgcccaccccctgccct

SEQ ID NO: 5848867 - DNA, 12 bp, Homo sapiens
atgcccacccct

SEQ ID NO: 5848868 - DNA, 14 bp, Homo sapiens
atgcccaccgagga

SEQ ID NO: 5848869 - DNA, 22 bp, Homo sapiens
atgcccaccgcccctggacagg

SEQ ID NO: 5848870 - DNA, 19 bp, Homo sapiens
atgcccacctgcccatcac

SEQ ID NO: 5848871 - DNA, 21 bp, Homo sapiens
atgcccacctgcccatcacag

SEQ ID NO: 5848872 - DNA, 23 bp, Homo sapiens
atgcccactgctggtgccagggt

SEQ ID NO: 5848873 - DNA, 22 bp, Homo sapiens
atgcccagacatttttttccct

SEQ ID NO: 5848874 - DNA, 11 bp, Homo sapiens
atgcccagaga

SEQ ID NO: 5848875 - DNA, 20 bp, Homo sapiens
atgcccagagggcccaggca

SEQ ID NO: 5848876 - DNA, 14 bp, Homo sapiens
atgcccagataata

SEQ ID NO: 5848877 - DNA, 13 bp, Homo sapiens
atgcccagatgaa

SEQ ID NO: 5848878 - DNA, 19 bp, Homo sapiens
atgcccagatgaactgact

SEQ ID NO: 5848879 - DNA, 20 bp, Homo sapiens
atgcccagccagccacccct

SEQ ID NO: 5848880 - DNA, 11 bp, Homo sapiens
atgcccagccc

SEQ ID NO: 5848881 - DNA, 14 bp, Homo sapiens
atgcccagcccctt

SEQ ID NO: 5848882 - DNA, 15 bp, Homo sapiens
atgcccagctaattt

SEQ ID NO: 5848883 - DNA, 21 bp, Homo sapiens
atgcccagctaatttttgtat

SEQ ID NO: 5848884 - DNA, 16 bp, Homo sapiens
atgcccagctcagagg

SEQ ID NO: 5848885 - DNA, 17 bp, Homo sapiens
atgcccagctcagtgcc

SEQ ID NO: 5848886 - DNA, 15 bp, Homo sapiens
atgcccagctctctg

SEQ ID NO: 5848887 - DNA, 17 bp, Homo sapiens
atgcccagctctctgac

SEQ ID NO: 5848888 - DNA, 20 bp, Homo sapiens
atgcccagctgtgctgggag

SEQ ID NO: 5848889 - DNA, 19 bp, Homo sapiens
atgcccagcttggagtgcc

SEQ ID NO: 5848890 - DNA, 19 bp, Homo sapiens
atgcccaggaaaataacag

SEQ ID NO: 5848891 - DNA, 16 bp, Homo sapiens
atgcccaggtcaccgg

SEQ ID NO: 5848892 - DNA, 20 bp, Homo sapiens
atgcccagtaaaatttcagg

SEQ ID NO: 5848893 - DNA, 12 bp, Homo sapiens
atgcccatcccg

SEQ ID NO: 5848894 - DNA, 14 bp, Homo sapiens
atgcccatgaacaa

SEQ ID NO: 5848895 - DNA, 19 bp, Homo sapiens
atgcccattcctgcctggt

SEQ ID NO: 5848896 - DNA, 14 bp, Homo sapiens
atgcccattctttt

SEQ ID NO: 5848897 - DNA, 17 bp, Homo sapiens
atgcccatttttgctaa

SEQ ID NO: 5848898 - DNA, 22 bp, Homo sapiens
atgccccacccccctcctcccc

SEQ ID NO: 5848899 - DNA, 14 bp, Homo sapiens
atgccccagctctg

SEQ ID NO: 5848900 - DNA, 20 bp, Homo sapiens
atgccccagggatgggaggt

SEQ ID NO: 5848901 - DNA, 18 bp, Homo sapiens
atgccccatcccatgctg

SEQ ID NO: 5848902 - DNA, 16 bp, Homo sapiens
atgccccattccttgc

SEQ ID NO: 5848903 - DNA, 23 bp, Homo sapiens
atgccccattccttgcgcctcag

SEQ ID NO: 5848904 - DNA, 14 bp, Homo sapiens
atgcccccagctgg

SEQ ID NO: 5848905 - DNA, 15 bp, Homo sapiens
atgcccccagctggc

SEQ ID NO: 5848906 - DNA, 14 bp, Homo sapiens
atgcccccaggcag

SEQ ID NO: 5848907 - DNA, 20 bp, Homo sapiens
atgcccccattctcccagtc

SEQ ID NO: 5848908 - DNA, 22 bp, Homo sapiens
atgcccccccatcctgctcagc

SEQ ID NO: 5848909 - DNA, 21 bp, Homo sapiens
atgcccccctcaaacctcctc

SEQ ID NO: 5848910 - DNA, 17 bp, Homo sapiens
atgcccccgccacctcc

SEQ ID NO: 5848911 - DNA, 23 bp, Homo sapiens
atgcccccgccacctccccactc

SEQ ID NO: 5848912 - DNA, 24 bp, Homo sapiens
atgccccctccaggagagagccag

SEQ ID NO: 5848913 - DNA, 14 bp, Homo sapiens
atgccccctcccct

SEQ ID NO: 5848914 - DNA, 14 bp, Homo sapiens
atgccccctccctt

SEQ ID NO: 5848915 - DNA, 20 bp, Homo sapiens
atgccccctcccttcacagg

SEQ ID NO: 5848916 - DNA, 14 bp, Homo sapiens
atgccccctgctta

SEQ ID NO: 5848917 - DNA, 22 bp, Homo sapiens
atgcccccttcgctcctcctct

SEQ ID NO: 5848918 - DNA, 23 bp, Homo sapiens
atgcccccttcgctcctcctctc

SEQ ID NO: 5848919 - DNA, 13 bp, Homo sapiens
atgccccctttca

SEQ ID NO: 5848920 - DNA, 18 bp, Homo sapiens
atgccccctttcagatgt

SEQ ID NO: 5848921 - DNA, 21 bp, Homo sapiens
atgccccgccatggtcaccct

SEQ ID NO: 5848922 - DNA, 17 bp, Homo sapiens
atgccccggccacctct

SEQ ID NO: 5848923 - DNA, 14 bp, Homo sapiens
atgcccctccccag

SEQ ID NO: 5848924 - DNA, 13 bp, Homo sapiens
atgcccctccccc

SEQ ID NO: 5848925 - DNA, 20 bp, Homo sapiens
atgcccctgaatttaaatag

SEQ ID NO: 5848926 - DNA, 14 bp, Homo sapiens
atgcccctgagtgt

SEQ ID NO: 5848927 - DNA, 14 bp, Homo sapiens
atgcccctgctccc

SEQ ID NO: 5848928 - DNA, 12 bp, Homo sapiens
atgcccctggcc

SEQ ID NO: 5848929 - DNA, 18 bp, Homo sapiens
atgcccctggccctgcct

SEQ ID NO: 5848930 - DNA, 20 bp, Homo sapiens
atgcctgtaatcccagcact

SEQ ID NO: 5848931 - DNA, 21 bp, Homo sapiens
atgcctgtaatcccagcactt

SEQ ID NO: 5848932 - DNA, 21 bp, Homo sapiens
atgcctgtagctttcctggtc

SEQ ID NO: 5848933 - DNA, 15 bp, Homo sapiens
atgcctgtatttcca

SEQ ID NO: 5848934 - DNA, 20 bp, Homo sapiens
atgcctgtatttccaacaaa

SEQ ID NO: 5848935 - DNA, 18 bp, Homo sapiens
atgcctgtcctgaaagcg

SEQ ID NO: 5848936 - DNA, 20 bp, Homo sapiens
atgcctgtcctgaaagcggc

SEQ ID NO: 5848937 - DNA, 21 bp, Homo sapiens
atgcctgtcctgaaagcggct

SEQ ID NO: 5848938 - DNA, 22 bp, Homo sapiens
atgcctgtctctagctgttctg

SEQ ID NO: 5848939 - DNA, 23 bp, Homo sapiens
atgcctgtctctgttcagatgtg

SEQ ID NO: 5848940 - DNA, 14 bp, Homo sapiens
atgcctgtggtgaa

SEQ ID NO: 5848941 - DNA, 19 bp, Homo sapiens
atgcctgtggtgaagtgtg

SEQ ID NO: 5848942 - DNA, 22 bp, Homo sapiens
atgcctgtggtgaagtgtggct

SEQ ID NO: 5848943 - DNA, 16 bp, Homo sapiens
atgcctgttaatttat

SEQ ID NO: 5848944 - DNA, 23 bp, Homo sapiens
atgcctgttaatttataatgtat

SEQ ID NO: 5848945 - DNA, 21 bp, Homo sapiens
atgcctgttgatctatgggaa

SEQ ID NO: 5848946 - DNA, 15 bp, Homo sapiens
atgcctgttgcaggc

SEQ ID NO: 5848947 - DNA, 16 bp, Homo sapiens
atgccttaaaatggaa

SEQ ID NO: 5848948 - DNA, 18 bp, Homo sapiens
atgccttaaaatggaatt

SEQ ID NO: 5848949 - DNA, 20 bp, Homo sapiens
atgccttaagcagaacaaat

SEQ ID NO: 5848950 - DNA, 23 bp, Homo sapiens
atgccttaagcagaacaaatgtg

SEQ ID NO: 5848951 - DNA, 15 bp, Homo sapiens
atgccttaatttaga

SEQ ID NO: 5848952 - DNA, 18 bp, Homo sapiens
atgccttaatttagaaac

SEQ ID NO: 5848953 - DNA, 18 bp, Homo sapiens
atgccttacctaagagaa

SEQ ID NO: 5848954 - DNA, 16 bp, Homo sapiens
atgccttactttgtat

SEQ ID NO: 5848955 - DNA, 15 bp, Homo sapiens
atgccttagcatgtg

SEQ ID NO: 5848956 - DNA, 17 bp, Homo sapiens
atgccttatctcttctc

SEQ ID NO: 5848957 - DNA, 19 bp, Homo sapiens
atgccttcaaatagtatag

SEQ ID NO: 5848958 - DNA, 16 bp, Homo sapiens
atgccttcatgaatct

SEQ ID NO: 5848959 - DNA, 18 bp, Homo sapiens
atgccttccagcaccctg

SEQ ID NO: 5848960 - DNA, 19 bp, Homo sapiens
atgccttccagcaccctgc

SEQ ID NO: 5848961 - DNA, 16 bp, Homo sapiens
atgccttccgacacca

SEQ ID NO: 5848962 - DNA, 22 bp, Homo sapiens
atgccttccgacaccactggga

SEQ ID NO: 5848963 - DNA, 16 bp, Homo sapiens
atgccttctgtggcca

SEQ ID NO: 5848964 - DNA, 23 bp, Homo sapiens
atgccttgaactgttgtctggga

SEQ ID NO: 5848965 - DNA, 23 bp, Homo sapiens
atgccttgaataataagcaggat

SEQ ID NO: 5848966 - DNA, 21 bp, Homo sapiens
atgccttggaggaaatgtgct

SEQ ID NO: 5848967 - DNA, 21 bp, Homo sapiens
atgccttggtgccggtcacac

SEQ ID NO: 5848968 - DNA, 23 bp, Homo sapiens
atgccttgtataaaatccaaaat

SEQ ID NO: 5848969 - DNA, 12 bp, Homo sapiens
atgccttgtgct

SEQ ID NO: 5848970 - DNA, 17 bp, Homo sapiens
atgcctttaaagtatga

SEQ ID NO: 5848971 - DNA, 18 bp, Homo sapiens
atgcctttaatgttgccc

SEQ ID NO: 5848972 - DNA, 14 bp, Homo sapiens
atgcctttagatgt

SEQ ID NO: 5848973 - DNA, 17 bp, Homo sapiens
atgcctttagatgtgag

SEQ ID NO: 5848974 - DNA, 16 bp, Homo sapiens
atgcctttatactttg

SEQ ID NO: 5848975 - DNA, 15 bp, Homo sapiens
atgcctttcaaacat

SEQ ID NO: 5848976 - DNA, 13 bp, Homo sapiens
atgcctttctagt

SEQ ID NO: 5848977 - DNA, 21 bp, Homo sapiens
atgcctttctagtcctattct

SEQ ID NO: 5848978 - DNA, 14 bp, Homo sapiens
atgcctttctctcc

SEQ ID NO: 5848979 - DNA, 18 bp, Homo sapiens
atgcctttctctcctagt

SEQ ID NO: 5848980 - DNA, 15 bp, Homo sapiens
atgcctttgagacag

SEQ ID NO: 5848981 - DNA, 16 bp, Homo sapiens
atgcctttgagacagt

SEQ ID NO: 5848982 - DNA, 19 bp, Homo sapiens
atgcctttgagacagtttc

SEQ ID NO: 5848983 - DNA, 20 bp, Homo sapiens
atgcctttgagacagtttct

SEQ ID NO: 5848984 - DNA, 22 bp, Homo sapiens
atgcctttgagacagtttctta

SEQ ID NO: 5848985 - DNA, 13 bp, Homo sapiens
atgcctttgtaag

SEQ ID NO: 5848986 - DNA, 14 bp, Homo sapiens
atgccttttcccaa

SEQ ID NO: 5848987 - DNA, 23 bp, Homo sapiens
atgccttttcccaaaatgttgaa

SEQ ID NO: 5848988 - DNA, 13 bp, Homo sapiens
atgccttttctgt

SEQ ID NO: 5848989 - DNA, 15 bp, Homo sapiens
atgccttttgaatac

SEQ ID NO: 5848990 - DNA, 12 bp, Homo sapiens
atgccttttgta

SEQ ID NO: 5848991 - DNA, 21 bp, Homo sapiens
atgccttttgtagctgtcatg

SEQ ID NO: 5848992 - DNA, 22 bp, Homo sapiens
atgccttttgtagctgtcatgg

SEQ ID NO: 5848993 - DNA, 21 bp, Homo sapiens
atgcgaaccacccaaaacacg

SEQ ID NO: 5848994 - DNA, 15 bp, Homo sapiens
atgcgaatgagctgg

SEQ ID NO: 5848995 - DNA, 16 bp, Homo sapiens
atgcgaatgagctggg

SEQ ID NO: 5848996 - DNA, 18 bp, Homo sapiens
atgcgacttgttttgctg

SEQ ID NO: 5848997 - DNA, 14 bp, Homo sapiens
atgcgaggctcgga

SEQ ID NO: 5848998 - DNA, 12 bp, Homo sapiens
atgcgaggggcc

SEQ ID NO: 5848999 - DNA, 20 bp, Homo sapiens
atgcgaggggccagcagagg

SEQ ID NO: 5849000 - DNA, 21 bp, Homo sapiens
atgcgaggggccagcagaggg

SEQ ID NO: 5849001 - DNA, 21 bp, Homo sapiens
atgcgattcagttcaccgcta

SEQ ID NO: 5849002 - DNA, 20 bp, Homo sapiens
atgcgattttattactggcg

SEQ ID NO: 5849003 - DNA, 17 bp, Homo sapiens
atgcgcagatgaggggc

SEQ ID NO: 5849004 - DNA, 20 bp, Homo sapiens
atgcgcaggctggccctgcc

SEQ ID NO: 5849005 - DNA, 23 bp, Homo sapiens
atgcgcaggctggccctgccctg

SEQ ID NO: 5849006 - DNA, 22 bp, Homo sapiens
atgcgcattctaacctggaggt

SEQ ID NO: 5849007 - DNA, 16 bp, Homo sapiens
atgcgccaataaacca

SEQ ID NO: 5849008 - DNA, 21 bp, Homo sapiens
atgcgccctggtatgtgcctg

SEQ ID NO: 5849009 - DNA, 21 bp, Homo sapiens
atgcgccttcgtgcctgagac

SEQ ID NO: 5849010 - DNA, 20 bp, Homo sapiens
atgcgccttgctgatggctt

SEQ ID NO: 5849011 - DNA, 15 bp, Homo sapiens
atgcgctcagggcca

SEQ ID NO: 5849012 - DNA, 15 bp, Homo sapiens
atgcgctcctggctt

SEQ ID NO: 5849013 - DNA, 16 bp, Homo sapiens
atgcgctcttcaccag

SEQ ID NO: 5849014 - DNA, 19 bp, Homo sapiens
atgcgctcttcaccaggaa

SEQ ID NO: 5849015 - DNA, 17 bp, Homo sapiens
atgcgctttattgccca

SEQ ID NO: 5849016 - DNA, 13 bp, Homo sapiens
atgcggagccagc

SEQ ID NO: 5849017 - DNA, 14 bp, Homo sapiens
atgcggatcctgct

SEQ ID NO: 5849018 - DNA, 15 bp, Homo sapiens
atgcggatcctgctg

SEQ ID NO: 5849019 - DNA, 22 bp, Homo sapiens
atgcggcccactttcctgagct

SEQ ID NO: 5849020 - DNA, 23 bp, Homo sapiens
atgcggcccagccatgggccctc

SEQ ID NO: 5849021 - DNA, 21 bp, Homo sapiens
atgcggcccagcccggctccc

SEQ ID NO: 5849022 - DNA, 21 bp, Homo sapiens
atgcggctttctctgcctctg

SEQ ID NO: 5849023 - DNA, 21 bp, Homo sapiens
atgcgggccagtgctccagcc

SEQ ID NO: 5849024 - DNA, 18 bp, Homo sapiens
atgcgggctgggcagctg

SEQ ID NO: 5849025 - DNA, 15 bp, Homo sapiens
atgcggggacaggct

SEQ ID NO: 5849026 - DNA, 14 bp, Homo sapiens
atgcgggggagcag

SEQ ID NO: 5849027 - DNA, 17 bp, Homo sapiens
atgcgggggagcaggca

SEQ ID NO: 5849028 - DNA, 15 bp, Homo sapiens
atgcggtagccagca

SEQ ID NO: 5849029 - DNA, 15 bp, Homo sapiens
atgcggtctggtctc

SEQ ID NO: 5849030 - DNA, 15 bp, Homo sapiens
atgcgtaatttaatg

SEQ ID NO: 5849031 - DNA, 15 bp, Homo sapiens
atgcgtattctgtgg

SEQ ID NO: 5849032 - DNA, 16 bp, Homo sapiens
atgcgtattctgtggc

SEQ ID NO: 5849033 - DNA, 18 bp, Homo sapiens
atgcgtattctgtggccg

SEQ ID NO: 5849034 - DNA, 15 bp, Homo sapiens
atgcgtccactttcc

SEQ ID NO: 5849035 - DNA, 16 bp, Homo sapiens
atgcgtcttgtgaaat

SEQ ID NO: 5849036 - DNA, 17 bp, Homo sapiens
atgcgtcttgtgaaatt

SEQ ID NO: 5849037 - DNA, 18 bp, Homo sapiens
atgcgtcttgtgaaattg

SEQ ID NO: 5849038 - DNA, 19 bp, Homo sapiens
atgcgtcttgtgaaattgt

SEQ ID NO: 5849039 - DNA, 20 bp, Homo sapiens
atgcgtcttgtgaaattgtg

SEQ ID NO: 5849040 - DNA, 21 bp, Homo sapiens
atgcgtgcagttcctgctgcc

SEQ ID NO: 5849041 - DNA, 15 bp, Homo sapiens
atgcgtgggcagagg

SEQ ID NO: 5849042 - DNA, 17 bp, Homo sapiens
atgcgtgggcagaggaa

SEQ ID NO: 5849043 - DNA, 17 bp, Homo sapiens
atgcgtgtttctgactc

SEQ ID NO: 5849044 - DNA, 14 bp, Homo sapiens
atgcgttcactcca

SEQ ID NO: 5849045 - DNA, 15 bp, Homo sapiens
atgctaaactgtgaa

SEQ ID NO: 5849046 - DNA, 21 bp, Homo sapiens
atgctaaacttggctgtatgt

SEQ ID NO: 5849047 - DNA, 23 bp, Homo sapiens
atgctaaaggttgtattgcatat

SEQ ID NO: 5849048 - DNA, 19 bp, Homo sapiens
atgctaaattattatttag

SEQ ID NO: 5849049 - DNA, 21 bp, Homo sapiens
atgctaaattattatttagct

SEQ ID NO: 5849050 - DNA, 22 bp, Homo sapiens
atgctaacagttcacttgcagt

SEQ ID NO: 5849051 - DNA, 19 bp, Homo sapiens
atgctaacatctaaaaata

SEQ ID NO: 5849052 - DNA, 16 bp, Homo sapiens
atgctaacctctctga

SEQ ID NO: 5849053 - DNA, 14 bp, Homo sapiens
atgctaacctgtgg

SEQ ID NO: 5849054 - DNA, 19 bp, Homo sapiens
atgctaacctgtggaaagt

SEQ ID NO: 5849055 - DNA, 13 bp, Homo sapiens
atgctaaccttgt

SEQ ID NO: 5849056 - DNA, 14 bp, Homo sapiens
atgctaacgtgtca

SEQ ID NO: 5849057 - DNA, 16 bp, Homo sapiens
atgctaagaaagcaaa

SEQ ID NO: 5849058 - DNA, 13 bp, Homo sapiens
atgctaagaattt

SEQ ID NO: 5849059 - DNA, 16 bp, Homo sapiens
atgctaagactcagtg

SEQ ID NO: 5849060 - DNA, 15 bp, Homo sapiens
atgctaagagaagta

SEQ ID NO: 5849061 - DNA, 16 bp, Homo sapiens
atgctaagagaagtag

SEQ ID NO: 5849062 - DNA, 22 bp, Homo sapiens
atgctaagagaagtagaaatca

SEQ ID NO: 5849063 - DNA, 23 bp, Homo sapiens
atgctaagctgatattatttctt

SEQ ID NO: 5849064 - DNA, 20 bp, Homo sapiens
atgctaagggcaggcccaaa

SEQ ID NO: 5849065 - DNA, 13 bp, Homo sapiens
atgctaagtgaaa

SEQ ID NO: 5849066 - DNA, 22 bp, Homo sapiens
atgctaatagtgatcaagaaga

SEQ ID NO: 5849067 - DNA, 20 bp, Homo sapiens
atgctaatatttttaacaag

SEQ ID NO: 5849068 - DNA, 21 bp, Homo sapiens
atgctaattaaataatacaac

SEQ ID NO: 5849069 - DNA, 16 bp, Homo sapiens
atgctaatttaaagag

SEQ ID NO: 5849070 - DNA, 13 bp, Homo sapiens
atgctaatttatt

SEQ ID NO: 5849071 - DNA, 20 bp, Homo sapiens
atgctacaatggaaaccatt

SEQ ID NO: 5849072 - DNA, 18 bp, Homo sapiens
atgctacacactgcatgt

SEQ ID NO: 5849073 - DNA, 17 bp, Homo sapiens
atgctacacagacatta

SEQ ID NO: 5849074 - DNA, 17 bp, Homo sapiens
atgctacacatatgtgc

SEQ ID NO: 5849075 - DNA, 18 bp, Homo sapiens
atgctacaggatttgaaa

SEQ ID NO: 5849076 - DNA, 17 bp, Homo sapiens
atgctaccaccagctgt

SEQ ID NO: 5849077 - DNA, 19 bp, Homo sapiens
atgctaccaggatgctaaa

SEQ ID NO: 5849078 - DNA, 19 bp, Homo sapiens
atgctaccatgcctctcca

SEQ ID NO: 5849079 - DNA, 15 bp, Homo sapiens
atgctacccacagcg

SEQ ID NO: 5849080 - DNA, 13 bp, Homo sapiens
atgctacctctga

SEQ ID NO: 5849081 - DNA, 21 bp, Homo sapiens
atgctacctctgatcaaagca

SEQ ID NO: 5849082 - DNA, 17 bp, Homo sapiens
atgctacgtgtgatttt

SEQ ID NO: 5849083 - DNA, 19 bp, Homo sapiens
atgctacgtgtgatttttc

SEQ ID NO: 5849084 - DNA, 20 bp, Homo sapiens
atgctacgtgtgatttttct

SEQ ID NO: 5849085 - DNA, 18 bp, Homo sapiens
atgctactactgcagtct

SEQ ID NO: 5849086 - DNA, 12 bp, Homo sapiens
atgctactgaaa

SEQ ID NO: 5849087 - DNA, 14 bp, Homo sapiens
atgctactgtctca

SEQ ID NO: 5849088 - DNA, 19 bp, Homo sapiens
atgctacttcccactgtat

SEQ ID NO: 5849089 - DNA, 22 bp, Homo sapiens
atgctactttatttatacactg

SEQ ID NO: 5849090 - DNA, 19 bp, Homo sapiens
atgctagaactccctttca

SEQ ID NO: 5849091 - DNA, 17 bp, Homo sapiens
atgctagagcctctgcc

SEQ ID NO: 5849092 - DNA, 15 bp, Homo sapiens
atgctagaggctttt

SEQ ID NO: 5849093 - DNA, 16 bp, Homo sapiens
atgctagcacaatatt

SEQ ID NO: 5849094 - DNA, 15 bp, Homo sapiens
atgctagccccagag

SEQ ID NO: 5849095 - DNA, 16 bp, Homo sapiens
atgctagctctgagcc

SEQ ID NO: 5849096 - DNA, 18 bp, Homo sapiens
atgctatatatcttttgt

SEQ ID NO: 5849097 - DNA, 21 bp, Homo sapiens
atgctatctcgctagccatat

SEQ ID NO: 5849098 - DNA, 13 bp, Homo sapiens
atgctatctctgt

SEQ ID NO: 5849099 - DNA, 16 bp, Homo sapiens
atgctatggaaataca

SEQ ID NO: 5849100 - DNA, 17 bp, Homo sapiens
atgctatggaaatacat

SEQ ID NO: 5849101 - DNA, 18 bp, Homo sapiens
atgctatggaaatacatt

SEQ ID NO: 5849102 - DNA, 21 bp, Homo sapiens
atgctatggaaatacatttag

SEQ ID NO: 5849103 - DNA, 21 bp, Homo sapiens
atgctatggaacataaagttg

SEQ ID NO: 5849104 - DNA, 14 bp, Homo sapiens
atgctatgtcattt

SEQ ID NO: 5849105 - DNA, 15 bp, Homo sapiens
atgctattgaaaatg

SEQ ID NO: 5849106 - DNA, 16 bp, Homo sapiens
atgcttaatttctaaa

SEQ ID NO: 5849107 - DNA, 19 bp, Homo sapiens
atgcttaatttctaaagat

SEQ ID NO: 5849108 - DNA, 20 bp, Homo sapiens
atgcttacatctggaatctg

SEQ ID NO: 5849109 - DNA, 20 bp, Homo sapiens
atgcttacctaatttcattt

SEQ ID NO: 5849110 - DNA, 13 bp, Homo sapiens
atgcttacgtctc

SEQ ID NO: 5849111 - DNA, 22 bp, Homo sapiens
atgcttactgatatattttaca

SEQ ID NO: 5849112 - DNA, 20 bp, Homo sapiens
atgcttagagggatttcttt

SEQ ID NO: 5849113 - DNA, 15 bp, Homo sapiens
atgcttagaggggtg

SEQ ID NO: 5849114 - DNA, 11 bp, Homo sapiens
atgcttagctt

SEQ ID NO: 5849115 - DNA, 15 bp, Homo sapiens
atgcttagcttatct

SEQ ID NO: 5849116 - DNA, 17 bp, Homo sapiens
atgcttagcttatcttt

SEQ ID NO: 5849117 - DNA, 21 bp, Homo sapiens
atgcttagtccctcatgcaaa

SEQ ID NO: 5849118 - DNA, 23 bp, Homo sapiens
atgcttagtccctcatgcaaatc

SEQ ID NO: 5849119 - DNA, 22 bp, Homo sapiens
atgcttagtgaagcataaagtt

SEQ ID NO: 5849120 - DNA, 22 bp, Homo sapiens
atgcttatgcttgtgtatatgt

SEQ ID NO: 5849121 - DNA, 14 bp, Homo sapiens
atgcttatggaaag

SEQ ID NO: 5849122 - DNA, 18 bp, Homo sapiens
atgcttattagcagctgg

SEQ ID NO: 5849123 - DNA, 15 bp, Homo sapiens
atgcttattccatga

SEQ ID NO: 5849124 - DNA, 17 bp, Homo sapiens
atgcttattccatgact

SEQ ID NO: 5849125 - DNA, 19 bp, Homo sapiens
atgcttcaagtgttgctct

SEQ ID NO: 5849126 - DNA, 16 bp, Homo sapiens
atgcttcatacaggga

SEQ ID NO: 5849127 - DNA, 23 bp, Homo sapiens
atgcttcatacagggatggtgtt

SEQ ID NO: 5849128 - DNA, 19 bp, Homo sapiens
atgcttcatatgaggagga

SEQ ID NO: 5849129 - DNA, 22 bp, Homo sapiens
atgcttcatcattccctctcat

SEQ ID NO: 5849130 - DNA, 15 bp, Homo sapiens
atgcttcatgaaaat

SEQ ID NO: 5849131 - DNA, 21 bp, Homo sapiens
atgcttcatgaaaatcctacc

SEQ ID NO: 5849132 - DNA, 20 bp, Homo sapiens
atgcttcattattcaagaat

SEQ ID NO: 5849133 - DNA, 20 bp, Homo sapiens
atgcttcattcaatattgac

SEQ ID NO: 5849134 - DNA, 16 bp, Homo sapiens
atgcttcatttgtatg

SEQ ID NO: 5849135 - DNA, 14 bp, Homo sapiens
atgcttccaatctt

SEQ ID NO: 5849136 - DNA, 16 bp, Homo sapiens
atgcttccaatcttgc

SEQ ID NO: 5849137 - DNA, 22 bp, Homo sapiens
atgcttccactaccaaaagaca

SEQ ID NO: 5849138 - DNA, 18 bp, Homo sapiens
atgcttcccagagaagct

SEQ ID NO: 5849139 - DNA, 14 bp, Homo sapiens
atgcttcccagagg

SEQ ID NO: 5849140 - DNA, 19 bp, Homo sapiens
atgcttcccagagggagca

SEQ ID NO: 5849141 - DNA, 23 bp, Homo sapiens
atgcttcctagaagttactgaat

SEQ ID NO: 5849142 - DNA, 15 bp, Homo sapiens
atgcttcctcccagc

SEQ ID NO: 5849143 - DNA, 22 bp, Homo sapiens
atgcttcctgacaatcaactct

SEQ ID NO: 5849144 - DNA, 16 bp, Homo sapiens
atgcttccttgcctga

SEQ ID NO: 5849145 - DNA, 13 bp, Homo sapiens
atgcttcctttct

SEQ ID NO: 5849146 - DNA, 16 bp, Homo sapiens
atgcttcctttctctc

SEQ ID NO: 5849147 - DNA, 18 bp, Homo sapiens
atgcttcctttctctcct

SEQ ID NO: 5849148 - DNA, 15 bp, Homo sapiens
atgcttctaagtaaa

SEQ ID NO: 5849149 - DNA, 19 bp, Homo sapiens
atgcttctactgtgacact

SEQ ID NO: 5849150 - DNA, 19 bp, Homo sapiens
atgcttctataattttgcc

SEQ ID NO: 5849151 - DNA, 20 bp, Homo sapiens
atgcttctataattttgcct

SEQ ID NO: 5849152 - DNA, 23 bp, Homo sapiens
atgcttctataattttgccttta

SEQ ID NO: 5849153 - DNA, 22 bp, Homo sapiens
atgcttctatcagactcagttt

SEQ ID NO: 5849154 - DNA, 20 bp, Homo sapiens
atgcttctcatcttgtgaaa

SEQ ID NO: 5849155 - DNA, 21 bp, Homo sapiens
atgcttctcatcttgtgaaat

SEQ ID NO: 5849156 - DNA, 13 bp, Homo sapiens
atgcttctctcct

SEQ ID NO: 5849157 - DNA, 14 bp, Homo sapiens
atgcttctgttgta

SEQ ID NO: 5849158 - DNA, 14 bp, Homo sapiens
atgcttcttcagag

SEQ ID NO: 5849159 - DNA, 22 bp, Homo sapiens
atgcttcttcagagactcctgc

SEQ ID NO: 5849160 - DNA, 15 bp, Homo sapiens
atgcttcttccttac

SEQ ID NO: 5849161 - DNA, 19 bp, Homo sapiens
atgcttcttgccccttggg

SEQ ID NO: 5849162 - DNA, 22 bp, Homo sapiens
atgcttcttgccccttgggcct

SEQ ID NO: 5849163 - DNA, 12 bp, Homo sapiens
atgcttcttgga

SEQ ID NO: 5849164 - DNA, 23 bp, Homo sapiens
atgcttcttttagtcagaaatga

SEQ ID NO: 5849165 - DNA, 12 bp, Homo sapiens
atgcttgaaaaa

SEQ ID NO: 5849166 - DNA, 16 bp, Homo sapiens
atgcttgaatgccacg

SEQ ID NO: 5849167 - DNA, 21 bp, Homo sapiens
atgcttgacaaatattttcat

SEQ ID NO: 5849168 - DNA, 22 bp, Homo sapiens
atgcttgacaaatattttcatg

SEQ ID NO: 5849169 - DNA, 17 bp, Homo sapiens
atgcttgacatacctac

SEQ ID NO: 5849170 - DNA, 18 bp, Homo sapiens
atgcttgatttgaccact

SEQ ID NO: 5849171 - DNA, 11 bp, Homo sapiens
atgcttgccta

SEQ ID NO: 5849172 - DNA, 20 bp, Homo sapiens
atgcttgcctagggcctggt

SEQ ID NO: 5849173 - DNA, 23 bp, Homo sapiens
atgcttgcggcaaaaggaaagct

SEQ ID NO: 5849174 - DNA, 16 bp, Homo sapiens
atgcttgctgctgatt

SEQ ID NO: 5849175 - DNA, 22 bp, Homo sapiens
atgcttgctgctgatttaaaca

SEQ ID NO: 5849176 - DNA, 23 bp, Homo sapiens
atgcttgctgctgatttaaacac

SEQ ID NO: 5849177 - DNA, 16 bp, Homo sapiens
atgcttgcttggggaa

SEQ ID NO: 5849178 - DNA, 12 bp, Homo sapiens
atgcttgggaag

SEQ ID NO: 5849179 - DNA, 12 bp, Homo sapiens
atgcttgtacat

SEQ ID NO: 5849180 - DNA, 12 bp, Homo sapiens
atgcttgtttat

SEQ ID NO: 5849181 - DNA, 16 bp, Homo sapiens
atgctttaattgtgtg

SEQ ID NO: 5849182 - DNA, 14 bp, Homo sapiens
atgctttacagtca

SEQ ID NO: 5849183 - DNA, 18 bp, Homo sapiens
atgctttaccaaacagca

SEQ ID NO: 5849184 - DNA, 15 bp, Homo sapiens
atgctttagcttatt

SEQ ID NO: 5849185 - DNA, 23 bp, Homo sapiens
atgctttaggttgcttcagctga

SEQ ID NO: 5849186 - DNA, 18 bp, Homo sapiens
atgctttattaatgtttt

SEQ ID NO: 5849187 - DNA, 17 bp, Homo sapiens
atgctttatttgtaaat

SEQ ID NO: 5849188 - DNA, 20 bp, Homo sapiens
atgctttccaaaccttatct

SEQ ID NO: 5849189 - DNA, 17 bp, Homo sapiens
atgctttccctgaggaa

SEQ ID NO: 5849190 - DNA, 20 bp, Homo sapiens
atgctttccctgaggaatga

SEQ ID NO: 5849191 - DNA, 19 bp, Homo sapiens
atgctttcctccctggcat

SEQ ID NO: 5849192 - DNA, 14 bp, Homo sapiens
atgctttctccttt

SEQ ID NO: 5849193 - DNA, 22 bp, Homo sapiens
atgctttctgaactcgcttctc

SEQ ID NO: 5849194 - DNA, 22 bp, Homo sapiens
atgctttctttggcctacattc

SEQ ID NO: 5849195 - DNA, 17 bp, Homo sapiens
atgctttgaaacagaaa

SEQ ID NO: 5849196 - DNA, 18 bp, Homo sapiens
atgctttgaaacagaaaa

SEQ ID NO: 5849197 - DNA, 23 bp, Homo sapiens
atgctttgaatgcaaaagaaatt

SEQ ID NO: 5849198 - DNA, 22 bp, Homo sapiens
atgctttgagaagaatgtttaa

SEQ ID NO: 5849199 - DNA, 11 bp, Homo sapiens
atgctttgagt

SEQ ID NO: 5849200 - DNA, 19 bp, Homo sapiens
atgctttgagtccacgccc

SEQ ID NO: 5849201 - DNA, 13 bp, Homo sapiens
atgctttgataaa

SEQ ID NO: 5849202 - DNA, 18 bp, Homo sapiens
atgctttgataaaatatt

SEQ ID NO: 5849203 - DNA, 14 bp, Homo sapiens
atgctttgctgcta

SEQ ID NO: 5849204 - DNA, 14 bp, Homo sapiens
atgctttgctttgt

SEQ ID NO: 5849205 - DNA, 22 bp, Homo sapiens
atgctttgtcttcagcctctcc

SEQ ID NO: 5849206 - DNA, 15 bp, Homo sapiens
atgcttttaaatgct

SEQ ID NO: 5849207 - DNA, 20 bp, Homo sapiens
atgcttttagttttaaaagt

SEQ ID NO: 5849208 - DNA, 22 bp, Homo sapiens
atgcttttatatggcccagcct

SEQ ID NO: 5849209 - DNA, 21 bp, Homo sapiens
atgcttttctagcaactgttg

SEQ ID NO: 5849210 - DNA, 12 bp, Homo sapiens
atgcttttctct

SEQ ID NO: 5849211 - DNA, 13 bp, Homo sapiens
atgcttttctctc

SEQ ID NO: 5849212 - DNA, 14 bp, Homo sapiens
atgcttttctctca

SEQ ID NO: 5849213 - DNA, 21 bp, Homo sapiens
atgcttttctgaaagtatgag

SEQ ID NO: 5849214 - DNA, 19 bp, Homo sapiens
atgcttttctgtctctgcc

SEQ ID NO: 5849215 - DNA, 17 bp, Homo sapiens
atgcttttgctgctgct

SEQ ID NO: 5849216 - DNA, 18 bp, Homo sapiens
atgcttttgctgctgctt

SEQ ID NO: 5849217 - DNA, 17 bp, Homo sapiens
atgcttttggaagttaa

SEQ ID NO: 5849218 - DNA, 20 bp, Homo sapiens
atgcttttggaagttaaaat

SEQ ID NO: 5849219 - DNA, 22 bp, Homo sapiens
atgctttttattattattattt

SEQ ID NO: 5849220 - DNA, 16 bp, Homo sapiens
atgctttttatttctg

SEQ ID NO: 5849221 - DNA, 15 bp, Homo sapiens
atgctttttctcaga

SEQ ID NO: 5849222 - DNA, 16 bp, Homo sapiens
atgctttttgaatgtt

SEQ ID NO: 5849223 - DNA, 22 bp, Homo sapiens
atgctttttgaatgttatttgt

SEQ ID NO: 5849224 - DNA, 12 bp, Homo sapiens
atgcttttttgc

SEQ ID NO: 5849225 - DNA, 14 bp, Homo sapiens
atgcttttttgcaa

SEQ ID NO: 5849226 - DNA, 17 bp, Homo sapiens
atgcttttttgcaataa

SEQ ID NO: 5849227 - DNA, 15 bp, Homo sapiens
atggaaaaagcgctg

SEQ ID NO: 5849228 - DNA, 20 bp, Homo sapiens
atggaaaaagcgctgtttcc

SEQ ID NO: 5849229 - DNA, 14 bp, Homo sapiens
atggaaaaataaca

SEQ ID NO: 5849230 - DNA, 14 bp, Homo sapiens
atggaaaaatagta

SEQ ID NO: 5849231 - DNA, 14 bp, Homo sapiens
atggaaaaatcctt

SEQ ID NO: 5849232 - DNA, 14 bp, Homo sapiens
atggaaaaatgtga

SEQ ID NO: 5849233 - DNA, 23 bp, Homo sapiens
atggaaaacatttacatcaaatc

SEQ ID NO: 5849234 - DNA, 13 bp, Homo sapiens
atggaaaactgtt

SEQ ID NO: 5849235 - DNA, 14 bp, Homo sapiens
atggaaaactgtta

SEQ ID NO: 5849236 - DNA, 21 bp, Homo sapiens
atggaaaacttagtttgtgaa

SEQ ID NO: 5849237 - DNA, 14 bp, Homo sapiens
atggaaaagagata

SEQ ID NO: 5849238 - DNA, 19 bp, Homo sapiens
atggaaaagattgaaaatg

SEQ ID NO: 5849239 - DNA, 14 bp, Homo sapiens
atggaaaagcccag

SEQ ID NO: 5849240 - DNA, 15 bp, Homo sapiens
atggaaaagcccagt

SEQ ID NO: 5849241 - DNA, 19 bp, Homo sapiens
atggaaaagcccagtgacc

SEQ ID NO: 5849242 - DNA, 14 bp, Homo sapiens
atggaaaaggaaga

SEQ ID NO: 5849243 - DNA, 16 bp, Homo sapiens
atggaaaagggtcttc

SEQ ID NO: 5849244 - DNA, 22 bp, Homo sapiens
atggaaaagtcttcaagggctg

SEQ ID NO: 5849245 - DNA, 14 bp, Homo sapiens
atggaaaatataca

SEQ ID NO: 5849246 - DNA, 15 bp, Homo sapiens
atggaaaatatacaa

SEQ ID NO: 5849247 - DNA, 22 bp, Homo sapiens
atggaaaatcagtgacatctga

SEQ ID NO: 5849248 - DNA, 19 bp, Homo sapiens
atggaaaattaattctaaa

SEQ ID NO: 5849249 - DNA, 15 bp, Homo sapiens
atggaaaattttctc

SEQ ID NO: 5849250 - DNA, 20 bp, Homo sapiens
atggaaaattttctccttgg

SEQ ID NO: 5849251 - DNA, 22 bp, Homo sapiens
atggaaacaaagtggaaggaaa

SEQ ID NO: 5849252 - DNA, 13 bp, Homo sapiens
atggaaacacaca

SEQ ID NO: 5849253 - DNA, 16 bp, Homo sapiens
atggaaacaccactgc

SEQ ID NO: 5849254 - DNA, 22 bp, Homo sapiens
atggaaacacgagatcagtagt

SEQ ID NO: 5849255 - DNA, 20 bp, Homo sapiens
atggaaacactgattttgta

SEQ ID NO: 5849256 - DNA, 18 bp, Homo sapiens
atggaaacagaggaccag

SEQ ID NO: 5849257 - DNA, 13 bp, Homo sapiens
atggaaacatttt

SEQ ID NO: 5849258 - DNA, 20 bp, Homo sapiens
atggaaacattttatactgt

SEQ ID NO: 5849259 - DNA, 23 bp, Homo sapiens
atggaaacattttatactgtaca

SEQ ID NO: 5849260 - DNA, 17 bp, Homo sapiens
atggaaaccatttctgg

SEQ ID NO: 5849261 - DNA, 20 bp, Homo sapiens
atggaaacgcacttacaagt

SEQ ID NO: 5849262 - DNA, 15 bp, Homo sapiens
atggaaactgaatgc

SEQ ID NO: 5849263 - DNA, 20 bp, Homo sapiens
atggaaactggccaggggtc

SEQ ID NO: 5849264 - DNA, 22 bp, Homo sapiens
atggaaactgttgccagagatg

SEQ ID NO: 5849265 - DNA, 17 bp, Homo sapiens
atggaaagaaatatgat

SEQ ID NO: 5849266 - DNA, 12 bp, Homo sapiens
atggaaagaagg

SEQ ID NO: 5849267 - DNA, 16 bp, Homo sapiens
atggaaagaaggaaaa

SEQ ID NO: 5849268 - DNA, 19 bp, Homo sapiens
atggaaagaaggaaaaaag

SEQ ID NO: 5849269 - DNA, 20 bp, Homo sapiens
atggaaagaggtgaaaatga

SEQ ID NO: 5849270 - DNA, 12 bp, Homo sapiens
atggaaagccag

SEQ ID NO: 5849271 - DNA, 12 bp, Homo sapiens
atggaaagcttt

SEQ ID NO: 5849272 - DNA, 23 bp, Homo sapiens
atggaaagcttttcagtgttccc

SEQ ID NO: 5849273 - DNA, 22 bp, Homo sapiens
atggaaaggagaggaaagaact

SEQ ID NO: 5849274 - DNA, 16 bp, Homo sapiens
atggaaagggtgtggc

SEQ ID NO: 5849275 - DNA, 18 bp, Homo sapiens
atggaaatacagttattt

SEQ ID NO: 5849276 - DNA, 17 bp, Homo sapiens
atggaaatacatttaga

SEQ ID NO: 5849277 - DNA, 20 bp, Homo sapiens
atggaaatagccatttggaa

SEQ ID NO: 5849278 - DNA, 17 bp, Homo sapiens
atggaaatataggctat

SEQ ID NO: 5849279 - DNA, 15 bp, Homo sapiens
atggaaatatatatt

SEQ ID NO: 5849280 - DNA, 16 bp, Homo sapiens
atggaaatatatatta

SEQ ID NO: 5849281 - DNA, 13 bp, Homo sapiens
atggaaatatgtt

SEQ ID NO: 5849282 - DNA, 15 bp, Homo sapiens
atggaaatattatgc

SEQ ID NO: 5849283 - DNA, 13 bp, Homo sapiens
atggatgctgggg

SEQ ID NO: 5849284 - DNA, 15 bp, Homo sapiens
atggatggcacaatg

SEQ ID NO: 5849285 - DNA, 21 bp, Homo sapiens
atggatggcacaatgaatgta

SEQ ID NO: 5849286 - DNA, 14 bp, Homo sapiens
atggatggcaccct

SEQ ID NO: 5849287 - DNA, 16 bp, Homo sapiens
atggatggcagactct

SEQ ID NO: 5849288 - DNA, 13 bp, Homo sapiens
atggatggggaga

SEQ ID NO: 5849289 - DNA, 15 bp, Homo sapiens
atggatggggcccag

SEQ ID NO: 5849290 - DNA, 20 bp, Homo sapiens
atggatggggcccaggggct

SEQ ID NO: 5849291 - DNA, 19 bp, Homo sapiens
atggatgggggaactcaga

SEQ ID NO: 5849292 - DNA, 23 bp, Homo sapiens
atggatgggggttacctagccct

SEQ ID NO: 5849293 - DNA, 22 bp, Homo sapiens
atggatggtggaccctactatt

SEQ ID NO: 5849294 - DNA, 14 bp, Homo sapiens
atggatgtaattct

SEQ ID NO: 5849295 - DNA, 20 bp, Homo sapiens
atggatgtggggtccccatc

SEQ ID NO: 5849296 - DNA, 12 bp, Homo sapiens
atggatgttact

SEQ ID NO: 5849297 - DNA, 19 bp, Homo sapiens
atggattaaaaactgctta

SEQ ID NO: 5849298 - DNA, 15 bp, Homo sapiens
atggattaaactcag

SEQ ID NO: 5849299 - DNA, 16 bp, Homo sapiens
atggattaaactcagt

SEQ ID NO: 5849300 - DNA, 16 bp, Homo sapiens
atggattaaagactta

SEQ ID NO: 5849301 - DNA, 20 bp, Homo sapiens
atggattaaatttaattctt

SEQ ID NO: 5849302 - DNA, 19 bp, Homo sapiens
atggattacttctctataa

SEQ ID NO: 5849303 - DNA, 12 bp, Homo sapiens
atggattattta

SEQ ID NO: 5849304 - DNA, 12 bp, Homo sapiens
atggattcactt

SEQ ID NO: 5849305 - DNA, 18 bp, Homo sapiens
atggattcacttctattt

SEQ ID NO: 5849306 - DNA, 20 bp, Homo sapiens
atggattccaaccttccttt

SEQ ID NO: 5849307 - DNA, 18 bp, Homo sapiens
atggattcccctggacat

SEQ ID NO: 5849308 - DNA, 12 bp, Homo sapiens
atggattctaaa

SEQ ID NO: 5849309 - DNA, 18 bp, Homo sapiens
atggattgataattgcat

SEQ ID NO: 5849310 - DNA, 23 bp, Homo sapiens
atggattgattcagtcttctgga

SEQ ID NO: 5849311 - DNA, 16 bp, Homo sapiens
atggattgccacagct

SEQ ID NO: 5849312 - DNA, 19 bp, Homo sapiens
atggattggcctccagggc

SEQ ID NO: 5849313 - DNA, 16 bp, Homo sapiens
atggattgttaatttc

SEQ ID NO: 5849314 - DNA, 20 bp, Homo sapiens
atggatttaatccattttta

SEQ ID NO: 5849315 - DNA, 21 bp, Homo sapiens
atggatttattttttgtaact

SEQ ID NO: 5849316 - DNA, 16 bp, Homo sapiens
atggatttccactgct

SEQ ID NO: 5849317 - DNA, 15 bp, Homo sapiens
atggatttccagcca

SEQ ID NO: 5849318 - DNA, 19 bp, Homo sapiens
atggatttcgtttttcttg

SEQ ID NO: 5849319 - DNA, 20 bp, Homo sapiens
atggatttgaagtttgccaa

SEQ ID NO: 5849320 - DNA, 19 bp, Homo sapiens
atggatttgatgctgtttg

SEQ ID NO: 5849321 - DNA, 12 bp, Homo sapiens
atggattttcct

SEQ ID NO: 5849322 - DNA, 22 bp, Homo sapiens
atggatttttaaattatactgt

SEQ ID NO: 5849323 - DNA, 15 bp, Homo sapiens
atggatttttcttta

SEQ ID NO: 5849324 - DNA, 19 bp, Homo sapiens
atggatttttctttaactg

SEQ ID NO: 5849325 - DNA, 21 bp, Homo sapiens
atggattttttttttcaggtt

SEQ ID NO: 5849326 - DNA, 19 bp, Homo sapiens
atggcaaacgattttacta

SEQ ID NO: 5849327 - DNA, 19 bp, Homo sapiens
atggcaaatcaggggccag

SEQ ID NO: 5849328 - DNA, 22 bp, Homo sapiens
atggcaaatcaggggccagaga

SEQ ID NO: 5849329 - DNA, 12 bp, Homo sapiens
atggcaaatgca

SEQ ID NO: 5849330 - DNA, 14 bp, Homo sapiens
atggcaaatgggca

SEQ ID NO: 5849331 - DNA, 16 bp, Homo sapiens
atggcaaatgggcagc

SEQ ID NO: 5849332 - DNA, 17 bp, Homo sapiens
atggcaacaaactgcac

SEQ ID NO: 5849333 - DNA, 17 bp, Homo sapiens
atggcaacacgtggagg

SEQ ID NO: 5849334 - DNA, 20 bp, Homo sapiens
atggcaacagaaaccaagag

SEQ ID NO: 5849335 - DNA, 14 bp, Homo sapiens
atggcaacagatct

SEQ ID NO: 5849336 - DNA, 17 bp, Homo sapiens
atggcaacagatctgga

SEQ ID NO: 5849337 - DNA, 20 bp, Homo sapiens
atggcaacattggacagaaa

SEQ ID NO: 5849338 - DNA, 16 bp, Homo sapiens
atggcaaccattataa

SEQ ID NO: 5849339 - DNA, 16 bp, Homo sapiens
atggcaacgttcatgt

SEQ ID NO: 5849340 - DNA, 22 bp, Homo sapiens
atggcaactgtattaaagaaaa

SEQ ID NO: 5849341 - DNA, 14 bp, Homo sapiens
atggcaagagatca

SEQ ID NO: 5849342 - DNA, 19 bp, Homo sapiens
atggcaaggactgcaggga

SEQ ID NO: 5849343 - DNA, 21 bp, Homo sapiens
atggcaaggcagccctgtctg

SEQ ID NO: 5849344 - DNA, 17 bp, Homo sapiens
atggcaagtggggctgg

SEQ ID NO: 5849345 - DNA, 14 bp, Homo sapiens
atggcaataggaca

SEQ ID NO: 5849346 - DNA, 15 bp, Homo sapiens
atggcaatattaaga

SEQ ID NO: 5849347 - DNA, 14 bp, Homo sapiens
atggcaatgaaaat

SEQ ID NO: 5849348 - DNA, 18 bp, Homo sapiens
atggcaatgaaaatttta

SEQ ID NO: 5849349 - DNA, 20 bp, Homo sapiens
atggcaatgttttgcttttg

SEQ ID NO: 5849350 - DNA, 13 bp, Homo sapiens
atggcaattctgg

SEQ ID NO: 5849351 - DNA, 22 bp, Homo sapiens
atggcacaatctcggctcactg

SEQ ID NO: 5849352 - DNA, 12 bp, Homo sapiens
atggcacaatga

SEQ ID NO: 5849353 - DNA, 18 bp, Homo sapiens
atggcacaatgaatgtat

SEQ ID NO: 5849354 - DNA, 15 bp, Homo sapiens
atggcacagggcatg

SEQ ID NO: 5849355 - DNA, 21 bp, Homo sapiens
atggcacagggcatgaaatga

SEQ ID NO: 5849356 - DNA, 23 bp, Homo sapiens
atggcacatcagcacgatttctg

SEQ ID NO: 5849357 - DNA, 14 bp, Homo sapiens
atggcaccagaggc

SEQ ID NO: 5849358 - DNA, 18 bp, Homo sapiens
atggcaccagccccctgg

SEQ ID NO: 5849359 - DNA, 23 bp, Homo sapiens
atggcaccatccaccctgcaggc

SEQ ID NO: 5849360 - DNA, 21 bp, Homo sapiens
atggcacccacacagaggacc

SEQ ID NO: 5849361 - DNA, 15 bp, Homo sapiens
atggcacctaagcat

SEQ ID NO: 5849362 - DNA, 13 bp, Homo sapiens
atggcacctgtat

SEQ ID NO: 5849363 - DNA, 16 bp, Homo sapiens
atggcacctgtatacc

SEQ ID NO: 5849364 - DNA, 16 bp, Homo sapiens
atggcacctgtggcca

SEQ ID NO: 5849365 - DNA, 15 bp, Homo sapiens
atggcacctttgaga

SEQ ID NO: 5849366 - DNA, 19 bp, Homo sapiens
atggcacgttgctgccagt

SEQ ID NO: 5849367 - DNA, 23 bp, Homo sapiens
atggcactaaaccacttctctgc

SEQ ID NO: 5849368 - DNA, 19 bp, Homo sapiens
atggcactgtccagggccc

SEQ ID NO: 5849369 - DNA, 20 bp, Homo sapiens
atggcactgtccagggccca

SEQ ID NO: 5849370 - DNA, 19 bp, Homo sapiens
atggcactgttgtcatttc

SEQ ID NO: 5849371 - DNA, 22 bp, Homo sapiens
atggcacttagctatcagaaga

SEQ ID NO: 5849372 - DNA, 21 bp, Homo sapiens
atggcacttctccaaccccgg

SEQ ID NO: 5849373 - DNA, 16 bp, Homo sapiens
atggcacttttgagct

SEQ ID NO: 5849374 - DNA, 21 bp, Homo sapiens
atggcagaaaaaatgtctgta

SEQ ID NO: 5849375 - DNA, 23 bp, Homo sapiens
atggcagaacgatgcctgcaggc

SEQ ID NO: 5849376 - DNA, 16 bp, Homo sapiens
atggcagaagacacca

SEQ ID NO: 5849377 - DNA, 17 bp, Homo sapiens
atggcagaagacaccag

SEQ ID NO: 5849378 - DNA, 24 bp, Homo sapiens
atggcagaagacaccagagcagat

SEQ ID NO: 5849379 - DNA, 19 bp, Homo sapiens
atggcagaagcgtctccct

SEQ ID NO: 5849380 - DNA, 15 bp, Homo sapiens
atggcagaaggcaaa

SEQ ID NO: 5849381 - DNA, 21 bp, Homo sapiens
atggcagaaggcaaacccatc

SEQ ID NO: 5849382 - DNA, 16 bp, Homo sapiens
atggcagaagggaatt

SEQ ID NO: 5849383 - DNA, 22 bp, Homo sapiens
atggcagacagtcaaggagatg

SEQ ID NO: 5849384 - DNA, 13 bp, Homo sapiens
atggcagactctt

SEQ ID NO: 5849385 - DNA, 12 bp, Homo sapiens
atggcagagcca

SEQ ID NO: 5849386 - DNA, 18 bp, Homo sapiens
atggcagagccatccacc

SEQ ID NO: 5849387 - DNA, 17 bp, Homo sapiens
atggcagagttgtaaat

SEQ ID NO: 5849388 - DNA, 21 bp, Homo sapiens
atggcagagttgtaaatatat

SEQ ID NO: 5849389 - DNA, 21 bp, Homo sapiens
atggcagatgtaggagggact

SEQ ID NO: 5849390 - DNA, 19 bp, Homo sapiens
atggcagcaatggcgctgt

SEQ ID NO: 5849391 - DNA, 14 bp, Homo sapiens
atggcagcagccag

SEQ ID NO: 5849392 - DNA, 11 bp, Homo sapiens
atggcagcagg

SEQ ID NO: 5849393 - DNA, 22 bp, Homo sapiens
atggcagcatgaattccaactc

SEQ ID NO: 5849394 - DNA, 15 bp, Homo sapiens
atggcagcatgcaaa

SEQ ID NO: 5849395 - DNA, 16 bp, Homo sapiens
atggcagcattcccac

SEQ ID NO: 5849396 - DNA, 20 bp, Homo sapiens
atggcagcccggctgctgct

SEQ ID NO: 5849397 - DNA, 22 bp, Homo sapiens
atggcagcccggctgctgcttg

SEQ ID NO: 5849398 - DNA, 17 bp, Homo sapiens
atggcagcctcagggct

SEQ ID NO: 5849399 - DNA, 22 bp, Homo sapiens
atggcagcctcagggcttcctt

SEQ ID NO: 5849400 - DNA, 15 bp, Homo sapiens
atggcagctagtgcc

SEQ ID NO: 5849401 - DNA, 11 bp, Homo sapiens
atggcagctgg

SEQ ID NO: 5849402 - DNA, 18 bp, Homo sapiens
atggcagctgggcccaca

SEQ ID NO: 5849403 - DNA, 21 bp, Homo sapiens
atggcagctgtttctcatgaa

SEQ ID NO: 5849404 - DNA, 13 bp, Homo sapiens
atggcaggaaggc

SEQ ID NO: 5849405 - DNA, 17 bp, Homo sapiens
atggcaggaaggcttgt

SEQ ID NO: 5849406 - DNA, 14 bp, Homo sapiens
atggcaggactcct

SEQ ID NO: 5849407 - DNA, 19 bp, Homo sapiens
atggcaggactcctggcag

SEQ ID NO: 5849408 - DNA, 20 bp, Homo sapiens
atggcaggactcctggcagg

SEQ ID NO: 5849409 - DNA, 17 bp, Homo sapiens
atggcaggcctgaccca

SEQ ID NO: 5849410 - DNA, 14 bp, Homo sapiens
atggcagggaagct

SEQ ID NO: 5849411 - DNA, 17 bp, Homo sapiens
atggcagggccaggcct

SEQ ID NO: 5849412 - DNA, 19 bp, Homo sapiens
atggcagggcctcatctca

SEQ ID NO: 5849413 - DNA, 21 bp, Homo sapiens
atggcagggcctcatctcacc

SEQ ID NO: 5849414 - DNA, 13 bp, Homo sapiens
atggcagggctga

SEQ ID NO: 5849415 - DNA, 15 bp, Homo sapiens
atggcaggggaagcc

SEQ ID NO: 5849416 - DNA, 16 bp, Homo sapiens
atggcagtccagccag

SEQ ID NO: 5849417 - DNA, 20 bp, Homo sapiens
atggcagtccagccagctcc

SEQ ID NO: 5849418 - DNA, 17 bp, Homo sapiens
atggcagtgactcccca

SEQ ID NO: 5849419 - DNA, 22 bp, Homo sapiens
atggcagtgactccccagccca

SEQ ID NO: 5849420 - DNA, 12 bp, Homo sapiens
atggcagtgaga

SEQ ID NO: 5849421 - DNA, 16 bp, Homo sapiens
atggcagtggctgtga

SEQ ID NO: 5849422 - DNA, 17 bp, Homo sapiens
atggcagtggctgtgaa

SEQ ID NO: 5849423 - DNA, 18 bp, Homo sapiens
atggcagtggctgtgaag

SEQ ID NO: 5849424 - DNA, 14 bp, Homo sapiens
atggcagtgggaga

SEQ ID NO: 5849425 - DNA, 24 bp, Homo sapiens
atggcatatttatattgtatattc

SEQ ID NO: 5849426 - DNA, 20 bp, Homo sapiens
atggcatcaaccaccatgga

SEQ ID NO: 5849427 - DNA, 19 bp, Homo sapiens
atggcatccagggctgcca

SEQ ID NO: 5849428 - DNA, 16 bp, Homo sapiens
atggcatcctgtgaag

SEQ ID NO: 5849429 - DNA, 17 bp, Homo sapiens
atggcatcgttgcattt

SEQ ID NO: 5849430 - DNA, 15 bp, Homo sapiens
atggcatctagccag

SEQ ID NO: 5849431 - DNA, 15 bp, Homo sapiens
atggcatcttcaata

SEQ ID NO: 5849432 - DNA, 20 bp, Homo sapiens
atggcatgatttatatatgg

SEQ ID NO: 5849433 - DNA, 18 bp, Homo sapiens
atggcatgcaaaagcaat

SEQ ID NO: 5849434 - DNA, 22 bp, Homo sapiens
atggcatgtcatcttccgagcc

SEQ ID NO: 5849435 - DNA, 22 bp, Homo sapiens
atggcattaattgttccttgct

SEQ ID NO: 5849436 - DNA, 16 bp, Homo sapiens
atggcattactctgca

SEQ ID NO: 5849437 - DNA, 23 bp, Homo sapiens
atggcatttagtaccttcaaata

SEQ ID NO: 5849438 - DNA, 15 bp, Homo sapiens
atggcatttgctggt

SEQ ID NO: 5849439 - DNA, 14 bp, Homo sapiens
atggccaaatgttc

SEQ ID NO: 5849440 - DNA, 22 bp, Homo sapiens
atggccaaggctctctctgtcc

SEQ ID NO: 5849441 - DNA, 20 bp, Homo sapiens
atggccaaggggccagctgc

SEQ ID NO: 5849442 - DNA, 21 bp, Homo sapiens
atggccaatagtcatatgtga

SEQ ID NO: 5849443 - DNA, 18 bp, Homo sapiens
atggccacaaacctgccc

SEQ ID NO: 5849444 - DNA, 19 bp, Homo sapiens
atggccacatcctcatggc

SEQ ID NO: 5849445 - DNA, 22 bp, Homo sapiens
atggccacatcctcatggccca

SEQ ID NO: 5849446 - DNA, 15 bp, Homo sapiens
atggccacatttaat

SEQ ID NO: 5849447 - DNA, 21 bp, Homo sapiens
atggccaccccgtgccacccg

SEQ ID NO: 5849448 - DNA, 15 bp, Homo sapiens
atggccagagcctct

SEQ ID NO: 5849449 - DNA, 18 bp, Homo sapiens
atggccagagcctctggc

SEQ ID NO: 5849450 - DNA, 12 bp, Homo sapiens
atggccagagga

SEQ ID NO: 5849451 - DNA, 18 bp, Homo sapiens
atggccagcccagatggc

SEQ ID NO: 5849452 - DNA, 13 bp, Homo sapiens
atggccagcccct

SEQ ID NO: 5849453 - DNA, 14 bp, Homo sapiens
atggccagcccctg

SEQ ID NO: 5849454 - DNA, 22 bp, Homo sapiens
atggccagcccctggggcccag

SEQ ID NO: 5849455 - DNA, 16 bp, Homo sapiens
atggccagcgattatt

SEQ ID NO: 5849456 - DNA, 18 bp, Homo sapiens
atggccagcgcccctcag

SEQ ID NO: 5849457 - DNA, 22 bp, Homo sapiens
atggccagcgcccctcagcctc

SEQ ID NO: 5849458 - DNA, 14 bp, Homo sapiens
atggccagctggag

SEQ ID NO: 5849459 - DNA, 22 bp, Homo sapiens
atggccaggaagtagcacaggc

SEQ ID NO: 5849460 - DNA, 15 bp, Homo sapiens
atggtgcaatttgtc

SEQ ID NO: 5849461 - DNA, 22 bp, Homo sapiens
atggtgcagaaaaaaaaaaaga

SEQ ID NO: 5849462 - DNA, 18 bp, Homo sapiens
atggtgcagagaagctgg

SEQ ID NO: 5849463 - DNA, 20 bp, Homo sapiens
atggtgcagagaagctggac

SEQ ID NO: 5849464 - DNA, 17 bp, Homo sapiens
atggtgcagtgaagaaa

SEQ ID NO: 5849465 - DNA, 19 bp, Homo sapiens
atggtgcattacgtgggca

SEQ ID NO: 5849466 - DNA, 14 bp, Homo sapiens
atggtgccccagga

SEQ ID NO: 5849467 - DNA, 15 bp, Homo sapiens
atggtgccccaggac

SEQ ID NO: 5849468 - DNA, 14 bp, Homo sapiens
atggtgcccttgga

SEQ ID NO: 5849469 - DNA, 15 bp, Homo sapiens
atggtgcgtgaaggc

SEQ ID NO: 5849470 - DNA, 16 bp, Homo sapiens
atggtgctaatatttt

SEQ ID NO: 5849471 - DNA, 18 bp, Homo sapiens
atggtgctaatattttat

SEQ ID NO: 5849472 - DNA, 22 bp, Homo sapiens
atggtgctaatattttatttga

SEQ ID NO: 5849473 - DNA, 14 bp, Homo sapiens
atggtgctaatgtg

SEQ ID NO: 5849474 - DNA, 20 bp, Homo sapiens
atggtgctcacgactcttcc

SEQ ID NO: 5849475 - DNA, 13 bp, Homo sapiens
atggtgctcccct

SEQ ID NO: 5849476 - DNA, 14 bp, Homo sapiens
atggtgctgcaccc

SEQ ID NO: 5849477 - DNA, 17 bp, Homo sapiens
atggtgctgcagatttg

SEQ ID NO: 5849478 - DNA, 19 bp, Homo sapiens
atggtgctgcccaggcctc

SEQ ID NO: 5849479 - DNA, 13 bp, Homo sapiens
atggtgcttcctt

SEQ ID NO: 5849480 - DNA, 16 bp, Homo sapiens
atggtgcttggagggg

SEQ ID NO: 5849481 - DNA, 17 bp, Homo sapiens
atggtgcttggaggggg

SEQ ID NO: 5849482 - DNA, 16 bp, Homo sapiens
atggtgcttggcagga

SEQ ID NO: 5849483 - DNA, 23 bp, Homo sapiens
atggtgcttgttaatgctttctg

SEQ ID NO: 5849484 - DNA, 19 bp, Homo sapiens
atggtggaaaacgaagctc

SEQ ID NO: 5849485 - DNA, 21 bp, Homo sapiens
atggtggaagaggttctcagc

SEQ ID NO: 5849486 - DNA, 16 bp, Homo sapiens
atggtggacccagcgg

SEQ ID NO: 5849487 - DNA, 19 bp, Homo sapiens
atggtggaggattgctgcc

SEQ ID NO: 5849488 - DNA, 15 bp, Homo sapiens
atggtggagggcact

SEQ ID NO: 5849489 - DNA, 18 bp, Homo sapiens
atggtggagggcacttca

SEQ ID NO: 5849490 - DNA, 23 bp, Homo sapiens
atggtggagtgagagcctttgcc

SEQ ID NO: 5849491 - DNA, 23 bp, Homo sapiens
atggtggatgaggcttcttcctg

SEQ ID NO: 5849492 - DNA, 17 bp, Homo sapiens
atggtggcacaggcact

SEQ ID NO: 5849493 - DNA, 19 bp, Homo sapiens
atggtggcacaggcactga

SEQ ID NO: 5849494 - DNA, 18 bp, Homo sapiens
atggtggcacattccttt

SEQ ID NO: 5849495 - DNA, 14 bp, Homo sapiens
atggtggccctggg

SEQ ID NO: 5849496 - DNA, 16 bp, Homo sapiens
atggtggccctgggga

SEQ ID NO: 5849497 - DNA, 12 bp, Homo sapiens
atggtggcctca

SEQ ID NO: 5849498 - DNA, 13 bp, Homo sapiens
atggtggctgggt

SEQ ID NO: 5849499 - DNA, 15 bp, Homo sapiens
atggtggctgggttg

SEQ ID NO: 5849500 - DNA, 18 bp, Homo sapiens
atggtggcttcagctcca

SEQ ID NO: 5849501 - DNA, 15 bp, Homo sapiens
atggtgggctccaga

SEQ ID NO: 5849502 - DNA, 23 bp, Homo sapiens
atggtgggcttgtggtggctgct

SEQ ID NO: 5849503 - DNA, 19 bp, Homo sapiens
atggtggggatatttttaa

SEQ ID NO: 5849504 - DNA, 16 bp, Homo sapiens
atggtggggcccccag

SEQ ID NO: 5849505 - DNA, 17 bp, Homo sapiens
atggtggggcccccagc

SEQ ID NO: 5849506 - DNA, 16 bp, Homo sapiens
atggtggtgatgtcca

SEQ ID NO: 5849507 - DNA, 21 bp, Homo sapiens
atggtggtttcagaaagggca

SEQ ID NO: 5849508 - DNA, 23 bp, Homo sapiens
atggtggtttgtcatatattcat

SEQ ID NO: 5849509 - DNA, 16 bp, Homo sapiens
atggtgtaataagaca

SEQ ID NO: 5849510 - DNA, 22 bp, Homo sapiens
atggtgtagccctcccactttg

SEQ ID NO: 5849511 - DNA, 22 bp, Homo sapiens
atggtgtcattctgcctgctcc

SEQ ID NO: 5849512 - DNA, 17 bp, Homo sapiens
atggtgtcctgcatgta

SEQ ID NO: 5849513 - DNA, 16 bp, Homo sapiens
atggtgtccttccctg

SEQ ID NO: 5849514 - DNA, 12 bp, Homo sapiens
atggtgtctccc

SEQ ID NO: 5849515 - DNA, 14 bp, Homo sapiens
atggtgtctcccaa

SEQ ID NO: 5849516 - DNA, 19 bp, Homo sapiens
atggtgtctcccaacatgg

SEQ ID NO: 5849517 - DNA, 18 bp, Homo sapiens
atggtgtgaacccgggag

SEQ ID NO: 5849518 - DNA, 17 bp, Homo sapiens
atggtgtgccacaggct

SEQ ID NO: 5849519 - DNA, 20 bp, Homo sapiens
atggtgtggggggctggggg

SEQ ID NO: 5849520 - DNA, 19 bp, Homo sapiens
atggtgtgtgtctctgaca

SEQ ID NO: 5849521 - DNA, 14 bp, Homo sapiens
atggtgtgttacac

SEQ ID NO: 5849522 - DNA, 16 bp, Homo sapiens
atggtgtgtttgtaat

SEQ ID NO: 5849523 - DNA, 20 bp, Homo sapiens
atggtgttaaagctgtacac

SEQ ID NO: 5849524 - DNA, 21 bp, Homo sapiens
atggtgttaaagctgtacacc

SEQ ID NO: 5849525 - DNA, 14 bp, Homo sapiens
atggtgttactgca

SEQ ID NO: 5849526 - DNA, 19 bp, Homo sapiens
atggtgttcaaaaaacttg

SEQ ID NO: 5849527 - DNA, 15 bp, Homo sapiens
atggtgttggtgaaa

SEQ ID NO: 5849528 - DNA, 18 bp, Homo sapiens
atggtgttggtgaaaata

SEQ ID NO: 5849529 - DNA, 21 bp, Homo sapiens
atggtgttgtcacaaactgtg

SEQ ID NO: 5849530 - DNA, 15 bp, Homo sapiens
atggtgtttgggaat

SEQ ID NO: 5849531 - DNA, 16 bp, Homo sapiens
atggtgttttcatgta

SEQ ID NO: 5849532 - DNA, 19 bp, Homo sapiens
atggtgtttttcttgtaaa

SEQ ID NO: 5849533 - DNA, 22 bp, Homo sapiens
atggttaaaaaggccaaagata

SEQ ID NO: 5849534 - DNA, 13 bp, Homo sapiens
atggttaaatttt

SEQ ID NO: 5849535 - DNA, 23 bp, Homo sapiens
atggttaagagtccaagaatcca

SEQ ID NO: 5849536 - DNA, 18 bp, Homo sapiens
atggttaagtaattgcat

SEQ ID NO: 5849537 - DNA, 15 bp, Homo sapiens
atggttaatactatt

SEQ ID NO: 5849538 - DNA, 22 bp, Homo sapiens
atggttaatttttcctgcatgt

SEQ ID NO: 5849539 - DNA, 17 bp, Homo sapiens
atggttacaaactacag

SEQ ID NO: 5849540 - DNA, 16 bp, Homo sapiens
atggttacatatcaaa

SEQ ID NO: 5849541 - DNA, 14 bp, Homo sapiens
atggttaccatggg

SEQ ID NO: 5849542 - DNA, 13 bp, Homo sapiens
atggttactaaaa

SEQ ID NO: 5849543 - DNA, 16 bp, Homo sapiens
atggttataaaagtga

SEQ ID NO: 5849544 - DNA, 22 bp, Homo sapiens
atggttatctttgagaccatcc

SEQ ID NO: 5849545 - DNA, 15 bp, Homo sapiens
atggttatgaaagaa

SEQ ID NO: 5849546 - DNA, 16 bp, Homo sapiens
atggttatgaaagaat

SEQ ID NO: 5849547 - DNA, 19 bp, Homo sapiens
atggttatgaaagaatata

SEQ ID NO: 5849548 - DNA, 20 bp, Homo sapiens
atggttatgaaagaatatat

SEQ ID NO: 5849549 - DNA, 14 bp, Homo sapiens
atggttatgaattt

SEQ ID NO: 5849550 - DNA, 12 bp, Homo sapiens
atggttcaagta

SEQ ID NO: 5849551 - DNA, 19 bp, Homo sapiens
atggttcaagtattaagca

SEQ ID NO: 5849552 - DNA, 15 bp, Homo sapiens
atggttcaagtcttc

SEQ ID NO: 5849553 - DNA, 14 bp, Homo sapiens
atggttcatatttt

SEQ ID NO: 5849554 - DNA, 20 bp, Homo sapiens
atggttccacagaagctttg

SEQ ID NO: 5849555 - DNA, 18 bp, Homo sapiens
atggttccatgcctgagg

SEQ ID NO: 5849556 - DNA, 22 bp, Homo sapiens
atggttccatgcctgagggtgg

SEQ ID NO: 5849557 - DNA, 22 bp, Homo sapiens
atggttcccaatatcatgtgat

SEQ ID NO: 5849558 - DNA, 15 bp, Homo sapiens
atggttccccaggag

SEQ ID NO: 5849559 - DNA, 19 bp, Homo sapiens
atggttcccctgttcactc

SEQ ID NO: 5849560 - DNA, 20 bp, Homo sapiens
atggttcctctcttggcaat

SEQ ID NO: 5849561 - DNA, 13 bp, Homo sapiens
atggttctagaag

SEQ ID NO: 5849562 - DNA, 15 bp, Homo sapiens
atggttctgcagtca

SEQ ID NO: 5849563 - DNA, 14 bp, Homo sapiens
atggttcttcacct

SEQ ID NO: 5849564 - DNA, 16 bp, Homo sapiens
atggttcttctccagt

SEQ ID NO: 5849565 - DNA, 16 bp, Homo sapiens
atggttgagaaatgaa

SEQ ID NO: 5849566 - DNA, 16 bp, Homo sapiens
atggttgagttacatt

SEQ ID NO: 5849567 - DNA, 13 bp, Homo sapiens
atggttgatggaa

SEQ ID NO: 5849568 - DNA, 15 bp, Homo sapiens
atggttgatggaaaa

SEQ ID NO: 5849569 - DNA, 18 bp, Homo sapiens
atggttgattcacacttg

SEQ ID NO: 5849570 - DNA, 16 bp, Homo sapiens
atggttgcaaagtgtt

SEQ ID NO: 5849571 - DNA, 18 bp, Homo sapiens
atggttgcacgttaaaaa

SEQ ID NO: 5849572 - DNA, 13 bp, Homo sapiens
atggttggaacta

SEQ ID NO: 5849573 - DNA, 18 bp, Homo sapiens
atggttgggacaatggca

SEQ ID NO: 5849574 - DNA, 17 bp, Homo sapiens
atggttgggggaatgca

SEQ ID NO: 5849575 - DNA, 20 bp, Homo sapiens
atggttgggggaatgcacct

SEQ ID NO: 5849576 - DNA, 23 bp, Homo sapiens
atggttggtaacacaaattttca

SEQ ID NO: 5849577 - DNA, 17 bp, Homo sapiens
atggttggttagtgcat

SEQ ID NO: 5849578 - DNA, 13 bp, Homo sapiens
atggttggtttta

SEQ ID NO: 5849579 - DNA, 18 bp, Homo sapiens
atggttgtctgtttttgt

SEQ ID NO: 5849580 - DNA, 16 bp, Homo sapiens
atggttgtgaaatgta

SEQ ID NO: 5849581 - DNA, 21 bp, Homo sapiens
atggttgtgaaatgtaacatg

SEQ ID NO: 5849582 - DNA, 16 bp, Homo sapiens
atggttgttgcatata

SEQ ID NO: 5849583 - DNA, 15 bp, Homo sapiens
atggtttactgctgt

SEQ ID NO: 5849584 - DNA, 16 bp, Homo sapiens
atggtttagataaagg

SEQ ID NO: 5849585 - DNA, 15 bp, Homo sapiens
atggtttattcccaa

SEQ ID NO: 5849586 - DNA, 23 bp, Homo sapiens
atggtttattcccaagtatgcct

SEQ ID NO: 5849587 - DNA, 15 bp, Homo sapiens
atggtttcaaagaaa

SEQ ID NO: 5849588 - DNA, 19 bp, Homo sapiens
atggtttcaaagaaagact

SEQ ID NO: 5849589 - DNA, 14 bp, Homo sapiens
atggtttcagcact

SEQ ID NO: 5849590 - DNA, 21 bp, Homo sapiens
atggtttcctcattttactaa

SEQ ID NO: 5849591 - DNA, 16 bp, Homo sapiens
atggtttcctctggat

SEQ ID NO: 5849592 - DNA, 19 bp, Homo sapiens
atggtttctgcgtgcttta

SEQ ID NO: 5849593 - DNA, 23 bp, Homo sapiens
atggtttgactcatcttatatgg

SEQ ID NO: 5849594 - DNA, 17 bp, Homo sapiens
atggtttgcaaggaagc

SEQ ID NO: 5849595 - DNA, 22 bp, Homo sapiens
atggtttggtgctttttataaa

SEQ ID NO: 5849596 - DNA, 13 bp, Homo sapiens
atggttttataac

SEQ ID NO: 5849597 - DNA, 16 bp, Homo sapiens
atggttttcaaaataa

SEQ ID NO: 5849598 - DNA, 14 bp, Homo sapiens
atggttttcttgtg

SEQ ID NO: 5849599 - DNA, 21 bp, Homo sapiens
atggttttgaatagatcttta

SEQ ID NO: 5849600 - DNA, 23 bp, Homo sapiens
atggttttgccctccctctctgc

SEQ ID NO: 5849601 - DNA, 22 bp, Homo sapiens
atggttttggctctcccacccc

SEQ ID NO: 5849602 - DNA, 15 bp, Homo sapiens
atggttttgtgccat

SEQ ID NO: 5849603 - DNA, 22 bp, Homo sapiens
atggttttgttttcaatgaatt

SEQ ID NO: 5849604 - DNA, 16 bp, Homo sapiens
atggttttgttttgca

SEQ ID NO: 5849605 - DNA, 18 bp, Homo sapiens
atggtttttaaattttgt

SEQ ID NO: 5849606 - DNA, 19 bp, Homo sapiens
atggtttttcttttcttta

SEQ ID NO: 5849607 - DNA, 18 bp, Homo sapiens
atggtttttgagatatta

SEQ ID NO: 5849608 - DNA, 20 bp, Homo sapiens
atggtttttgcctaaaatat

SEQ ID NO: 5849609 - DNA, 16 bp, Homo sapiens
atgtaaaaaacaaaaa

SEQ ID NO: 5849610 - DNA, 20 bp, Homo sapiens
atgtaaaaaacaaaaaaaac

SEQ ID NO: 5849611 - DNA, 17 bp, Homo sapiens
atgtaaaaaacaaaaac

SEQ ID NO: 5849612 - DNA, 19 bp, Homo sapiens
atgtaaaaaagaaaaacac

SEQ ID NO: 5849613 - DNA, 14 bp, Homo sapiens
atgtaaaaagacaa

SEQ ID NO: 5849614 - DNA, 15 bp, Homo sapiens
atgtaaaaagacaaa

SEQ ID NO: 5849615 - DNA, 11 bp, Homo sapiens
atgtaaaaagg

SEQ ID NO: 5849616 - DNA, 22 bp, Homo sapiens
atgtaaaaatccttttgaatga

SEQ ID NO: 5849617 - DNA, 20 bp, Homo sapiens
atgtaaaaatgaaggaatta

SEQ ID NO: 5849618 - DNA, 14 bp, Homo sapiens
atgtaaaaatgctt

SEQ ID NO: 5849619 - DNA, 11 bp, Homo sapiens
atgtaaaacaa

SEQ ID NO: 5849620 - DNA, 22 bp, Homo sapiens
atgtaaaacacaagactgtcat

SEQ ID NO: 5849621 - DNA, 19 bp, Homo sapiens
atgtaaaacagattttttg

SEQ ID NO: 5849622 - DNA, 14 bp, Homo sapiens
atgtaaaacattta

SEQ ID NO: 5849623 - DNA, 11 bp, Homo sapiens
atgtaaaactc

SEQ ID NO: 5849624 - DNA, 17 bp, Homo sapiens
atgtaaaagaaaatcca

SEQ ID NO: 5849625 - DNA, 15 bp, Homo sapiens
atgtaaaagaaaatt

SEQ ID NO: 5849626 - DNA, 14 bp, Homo sapiens
atgtaaaagacact

SEQ ID NO: 5849627 - DNA, 17 bp, Homo sapiens
atgtaaaagactttttt

SEQ ID NO: 5849628 - DNA, 15 bp, Homo sapiens
atgtaaaaggccaaa

SEQ ID NO: 5849629 - DNA, 19 bp, Homo sapiens
atgtaaaataaaggctctg

SEQ ID NO: 5849630 - DNA, 13 bp, Homo sapiens
atgtaaaataaga

SEQ ID NO: 5849631 - DNA, 22 bp, Homo sapiens
atgtaaaatatttataaatgaa

SEQ ID NO: 5849632 - DNA, 19 bp, Homo sapiens
atgtaaaatcaataaaagt

SEQ ID NO: 5849633 - DNA, 18 bp, Homo sapiens
atgtaaaatcttcagctg

SEQ ID NO: 5849634 - DNA, 21 bp, Homo sapiens
atgtaaaatcttcagctggtg

SEQ ID NO: 5849635 - DNA, 21 bp, Homo sapiens
atgtaaaatcttgatagctaa

SEQ ID NO: 5849636 - DNA, 21 bp, Homo sapiens
atgtaaaatcttgtcatgtgt

SEQ ID NO: 5849637 - DNA, 22 bp, Homo sapiens
atgtaaaatcttgtcatgtgta

SEQ ID NO: 5849638 - DNA, 21 bp, Homo sapiens
atgtagcaaaatacatgacat

SEQ ID NO: 5849639 - DNA, 20 bp, Homo sapiens
atgtagcaaaccctgtcaaa

SEQ ID NO: 5849640 - DNA, 23 bp, Homo sapiens
atgtagcaaaccctgtcaaacat

SEQ ID NO: 5849641 - DNA, 22 bp, Homo sapiens
atgtagcaaattccaatacatt

SEQ ID NO: 5849642 - DNA, 15 bp, Homo sapiens
atgtagcacataaac

SEQ ID NO: 5849643 - DNA, 19 bp, Homo sapiens
atgtagcacataaactttg

SEQ ID NO: 5849644 - DNA, 12 bp, Homo sapiens
atgtagcagaca

SEQ ID NO: 5849645 - DNA, 19 bp, Homo sapiens
atgtagcagcttcttagtt

SEQ ID NO: 5849646 - DNA, 14 bp, Homo sapiens
atgtagcattaaat

SEQ ID NO: 5849647 - DNA, 15 bp, Homo sapiens
atgtagcattaaata

SEQ ID NO: 5849648 - DNA, 21 bp, Homo sapiens
atgtagcattaaatataaaat

SEQ ID NO: 5849649 - DNA, 23 bp, Homo sapiens
atgtagcattgttccacacattt

SEQ ID NO: 5849650 - DNA, 24 bp, Homo sapiens
atgtagcattgttccacacattta

SEQ ID NO: 5849651 - DNA, 14 bp, Homo sapiens
atgtagccacccaa

SEQ ID NO: 5849652 - DNA, 20 bp, Homo sapiens
atgtagccagcagaactgaa

SEQ ID NO: 5849653 - DNA, 14 bp, Homo sapiens
atgtagccagctgt

SEQ ID NO: 5849654 - DNA, 20 bp, Homo sapiens
atgtagccagttaaggaaag

SEQ ID NO: 5849655 - DNA, 13 bp, Homo sapiens
atgtagcccatcc

SEQ ID NO: 5849656 - DNA, 16 bp, Homo sapiens
atgtagcccatccttc

SEQ ID NO: 5849657 - DNA, 20 bp, Homo sapiens
atgtagcccatccttccctt

SEQ ID NO: 5849658 - DNA, 19 bp, Homo sapiens
atgtagccccctggcctct

SEQ ID NO: 5849659 - DNA, 21 bp, Homo sapiens
atgtagcccggccagggcctg

SEQ ID NO: 5849660 - DNA, 23 bp, Homo sapiens
atgtagcccggccagggcctggt

SEQ ID NO: 5849661 - DNA, 14 bp, Homo sapiens
atgtagccctcatg

SEQ ID NO: 5849662 - DNA, 22 bp, Homo sapiens
atgtagccttcacacagataga

SEQ ID NO: 5849663 - DNA, 16 bp, Homo sapiens
atgtagccttttatcc

SEQ ID NO: 5849664 - DNA, 21 bp, Homo sapiens
atgtagcgctttgaatatgaa

SEQ ID NO: 5849665 - DNA, 17 bp, Homo sapiens
atgtagcgtgtaagctt

SEQ ID NO: 5849666 - DNA, 19 bp, Homo sapiens
atgtagcgtgtaagcttgt

SEQ ID NO: 5849667 - DNA, 23 bp, Homo sapiens
atgtagcgtgtaagcttgtgttt

SEQ ID NO: 5849668 - DNA, 16 bp, Homo sapiens
atgtagcgtgtttaca

SEQ ID NO: 5849669 - DNA, 14 bp, Homo sapiens
atgtagctaaacat

SEQ ID NO: 5849670 - DNA, 14 bp, Homo sapiens
atgtagctatgggc

SEQ ID NO: 5849671 - DNA, 14 bp, Homo sapiens
atgtagctgaaaat

SEQ ID NO: 5849672 - DNA, 14 bp, Homo sapiens
atgtagctgaaaca

SEQ ID NO: 5849673 - DNA, 21 bp, Homo sapiens
atgtagctgaaacaaaaatgc

SEQ ID NO: 5849674 - DNA, 15 bp, Homo sapiens
atgtagctggcaagc

SEQ ID NO: 5849675 - DNA, 15 bp, Homo sapiens
atgtaggaaaatttt

SEQ ID NO: 5849676 - DNA, 17 bp, Homo sapiens
atgtaggcattctggag

SEQ ID NO: 5849677 - DNA, 14 bp, Homo sapiens
atgtaggctccacc

SEQ ID NO: 5849678 - DNA, 15 bp, Homo sapiens
atgtaggctccacct

SEQ ID NO: 5849679 - DNA, 15 bp, Homo sapiens
atgtagggcaagagg

SEQ ID NO: 5849680 - DNA, 19 bp, Homo sapiens
atgtagggcaagaggatga

SEQ ID NO: 5849681 - DNA, 19 bp, Homo sapiens
atgtaggtaagactgtaga

SEQ ID NO: 5849682 - DNA, 16 bp, Homo sapiens
atgtaggtatgaataa

SEQ ID NO: 5849683 - DNA, 15 bp, Homo sapiens
atgtaggtgtctgca

SEQ ID NO: 5849684 - DNA, 14 bp, Homo sapiens
atgtagtaagattt

SEQ ID NO: 5849685 - DNA, 16 bp, Homo sapiens
atgtagtaagtaaatt

SEQ ID NO: 5849686 - DNA, 17 bp, Homo sapiens
atgtagtaattgacatg

SEQ ID NO: 5849687 - DNA, 17 bp, Homo sapiens
atgtagtataaagaaaa

SEQ ID NO: 5849688 - DNA, 19 bp, Homo sapiens
atgtagtattgttctattt

SEQ ID NO: 5849689 - DNA, 21 bp, Homo sapiens
atgtagtattttttgtataat

SEQ ID NO: 5849690 - DNA, 23 bp, Homo sapiens
atgtagtattttttgtataattg

SEQ ID NO: 5849691 - DNA, 23 bp, Homo sapiens
atgtagtctcacactgtttttca

SEQ ID NO: 5849692 - DNA, 15 bp, Homo sapiens
atgtagtgattaaat

SEQ ID NO: 5849693 - DNA, 22 bp, Homo sapiens
atgtagtggttttaggatactt

SEQ ID NO: 5849694 - DNA, 18 bp, Homo sapiens
atgtagttatctattgaa

SEQ ID NO: 5849695 - DNA, 14 bp, Homo sapiens
atgtagttctttgt

SEQ ID NO: 5849696 - DNA, 15 bp, Homo sapiens
atgtagttgatgtat

SEQ ID NO: 5849697 - DNA, 17 bp, Homo sapiens
atgtagttgatgtatcc

SEQ ID NO: 5849698 - DNA, 22 bp, Homo sapiens
atgtagttgatgtatccaacaa

SEQ ID NO: 5849699 - DNA, 23 bp, Homo sapiens
atgtagttgtcacactaaaattt

SEQ ID NO: 5849700 - DNA, 14 bp, Homo sapiens
atgtagtttgagga

SEQ ID NO: 5849701 - DNA, 24 bp, Homo sapiens
atgtagtttgaggaaatttgcagc

SEQ ID NO: 5849702 - DNA, 17 bp, Homo sapiens
atgtagttttaaataaa

SEQ ID NO: 5849703 - DNA, 13 bp, Homo sapiens
atgtagttttaac

SEQ ID NO: 5849704 - DNA, 21 bp, Homo sapiens
atgtagttttcttttttaaat

SEQ ID NO: 5849705 - DNA, 22 bp, Homo sapiens
atgtagttttcttttttaaatt

SEQ ID NO: 5849706 - DNA, 21 bp, Homo sapiens
atgtagttttgtgatgcattt

SEQ ID NO: 5849707 - DNA, 22 bp, Homo sapiens
atgtataaaaattatcaaaaag

SEQ ID NO: 5849708 - DNA, 15 bp, Homo sapiens
atgtataaaatacat

SEQ ID NO: 5849709 - DNA, 22 bp, Homo sapiens
atgtataaaatacatagtgaaa

SEQ ID NO: 5849710 - DNA, 20 bp, Homo sapiens
atgtataaacataagttgca

SEQ ID NO: 5849711 - DNA, 17 bp, Homo sapiens
atgtataaagaacaagg

SEQ ID NO: 5849712 - DNA, 12 bp, Homo sapiens
atgtataaagat

SEQ ID NO: 5849713 - DNA, 18 bp, Homo sapiens
atgtataaagattgtact

SEQ ID NO: 5849714 - DNA, 23 bp, Homo sapiens
atgtataaatgtaaaaatgaagg

SEQ ID NO: 5849715 - DNA, 16 bp, Homo sapiens
atgtataaatgtgata

SEQ ID NO: 5849716 - DNA, 17 bp, Homo sapiens
atgtataaattaataca

SEQ ID NO: 5849717 - DNA, 21 bp, Homo sapiens
atgtataaattaatacagagt

SEQ ID NO: 5849718 - DNA, 13 bp, Homo sapiens
atgtataaattat

SEQ ID NO: 5849719 - DNA, 17 bp, Homo sapiens
atgtataaccaagtgtg

SEQ ID NO: 5849720 - DNA, 19 bp, Homo sapiens
atgtataaccaagtgtgct

SEQ ID NO: 5849721 - DNA, 22 bp, Homo sapiens
atgtataaccaagtgtgctctt

SEQ ID NO: 5849722 - DNA, 17 bp, Homo sapiens
atgtataatatatatct

SEQ ID NO: 5849723 - DNA, 19 bp, Homo sapiens
atgtataatgacttttaaa

SEQ ID NO: 5849724 - DNA, 21 bp, Homo sapiens
atgtataatgacttttaaaat

SEQ ID NO: 5849725 - DNA, 20 bp, Homo sapiens
atgtataatgtgcagaaaat

SEQ ID NO: 5849726 - DNA, 21 bp, Homo sapiens
atgtataattcaaagcaccaa

SEQ ID NO: 5849727 - DNA, 14 bp, Homo sapiens
atgtataatttttt

SEQ ID NO: 5849728 - DNA, 18 bp, Homo sapiens
atgtataatttttttctt

SEQ ID NO: 5849729 - DNA, 19 bp, Homo sapiens
atgtataatttttttcttg

SEQ ID NO: 5849730 - DNA, 21 bp, Homo sapiens
atgtataatttttttcttgta

SEQ ID NO: 5849731 - DNA, 14 bp, Homo sapiens
atgtatacacacat

SEQ ID NO: 5849732 - DNA, 16 bp, Homo sapiens
atgtatacacacatat

SEQ ID NO: 5849733 - DNA, 17 bp, Homo sapiens
atgtatacacacatata

SEQ ID NO: 5849734 - DNA, 19 bp, Homo sapiens
atgtatacacacatataca

SEQ ID NO: 5849735 - DNA, 14 bp, Homo sapiens
atgtatacatgtgc

SEQ ID NO: 5849736 - DNA, 21 bp, Homo sapiens
atgtatacgcacgcacccaca

SEQ ID NO: 5849737 - DNA, 21 bp, Homo sapiens
atgtatactccatagaaacta

SEQ ID NO: 5849738 - DNA, 13 bp, Homo sapiens
atgtatacttcag

SEQ ID NO: 5849739 - DNA, 16 bp, Homo sapiens
atgtatacttgaaaaa

SEQ ID NO: 5849740 - DNA, 12 bp, Homo sapiens
atgtatagaaaa

SEQ ID NO: 5849741 - DNA, 13 bp, Homo sapiens
atgtatagaaaat

SEQ ID NO: 5849742 - DNA, 14 bp, Homo sapiens
atgtatagctttaa

SEQ ID NO: 5849743 - DNA, 15 bp, Homo sapiens
atgtatagtaaatca

SEQ ID NO: 5849744 - DNA, 14 bp, Homo sapiens
atgtatagtatttg

SEQ ID NO: 5849745 - DNA, 16 bp, Homo sapiens
atgtatagtatttgaa

SEQ ID NO: 5849746 - DNA, 15 bp, Homo sapiens
atgtatagttgcttt

SEQ ID NO: 5849747 - DNA, 15 bp, Homo sapiens
atgtatataaaaatg

SEQ ID NO: 5849748 - DNA, 14 bp, Homo sapiens
atgtatataaaatg

SEQ ID NO: 5849749 - DNA, 14 bp, Homo sapiens
atgtatataaactg

SEQ ID NO: 5849750 - DNA, 16 bp, Homo sapiens
atgtatatacacacat

SEQ ID NO: 5849751 - DNA, 20 bp, Homo sapiens
atgtatatacccacacacat

SEQ ID NO: 5849752 - DNA, 18 bp, Homo sapiens
atgtatatagatatattt

SEQ ID NO: 5849753 - DNA, 14 bp, Homo sapiens
atgtatatagatgt

SEQ ID NO: 5849754 - DNA, 17 bp, Homo sapiens
atgtatatatatatagt

SEQ ID NO: 5849755 - DNA, 16 bp, Homo sapiens
atgtatatatattctc

SEQ ID NO: 5849756 - DNA, 17 bp, Homo sapiens
atgtatatatgtatttc

SEQ ID NO: 5849757 - DNA, 14 bp, Homo sapiens
atgtatatatttat

SEQ ID NO: 5849758 - DNA, 23 bp, Homo sapiens
atgtatatcattctacagaataa

SEQ ID NO: 5849759 - DNA, 13 bp, Homo sapiens
atgtatatctata

SEQ ID NO: 5849760 - DNA, 20 bp, Homo sapiens
atgtatatctatatctctaa

SEQ ID NO: 5849761 - DNA, 17 bp, Homo sapiens
atgtatatctttgcact

SEQ ID NO: 5849762 - DNA, 19 bp, Homo sapiens
atgtatatgaagctcttga

SEQ ID NO: 5849763 - DNA, 15 bp, Homo sapiens
atgtatatgccatta

SEQ ID NO: 5849764 - DNA, 15 bp, Homo sapiens
atgtatatgtatata

SEQ ID NO: 5849765 - DNA, 17 bp, Homo sapiens
atgtatatgtatatata

SEQ ID NO: 5849766 - DNA, 19 bp, Homo sapiens
atgtatatgtatatctata

SEQ ID NO: 5849767 - DNA, 20 bp, Homo sapiens
atgtatatgtcatttatttt

SEQ ID NO: 5849768 - DNA, 16 bp, Homo sapiens
atgtatatgtgttcat

SEQ ID NO: 5849769 - DNA, 14 bp, Homo sapiens
atgtatattaaaaa

SEQ ID NO: 5849770 - DNA, 20 bp, Homo sapiens
atgtatattaaaaaagagac

SEQ ID NO: 5849771 - DNA, 15 bp, Homo sapiens
atgtatattcctttg

SEQ ID NO: 5849772 - DNA, 22 bp, Homo sapiens
atgtatattcttccttgattgt

SEQ ID NO: 5849773 - DNA, 19 bp, Homo sapiens
atgtatatttaattaaagc

SEQ ID NO: 5849774 - DNA, 15 bp, Homo sapiens
atgtatatttgcata

SEQ ID NO: 5849775 - DNA, 18 bp, Homo sapiens
atgtatatttgcatattt

SEQ ID NO: 5849776 - DNA, 16 bp, Homo sapiens
atgtatatttgctgca

SEQ ID NO: 5849777 - DNA, 17 bp, Homo sapiens
atgtatattttaataga

SEQ ID NO: 5849778 - DNA, 19 bp, Homo sapiens
atgtatattttatatcaat

SEQ ID NO: 5849779 - DNA, 22 bp, Homo sapiens
atgtatattttgtgttattcgt

SEQ ID NO: 5849780 - DNA, 22 bp, Homo sapiens
atgtatatttttgatctttgag

SEQ ID NO: 5849781 - DNA, 17 bp, Homo sapiens
atgtatcaaatacattt

SEQ ID NO: 5849782 - DNA, 15 bp, Homo sapiens
atgtatcaatgagta

SEQ ID NO: 5849783 - DNA, 18 bp, Homo sapiens
atgtatcagccagccttc

SEQ ID NO: 5849784 - DNA, 21 bp, Homo sapiens
atgtatcagccagccttcccc

SEQ ID NO: 5849785 - DNA, 17 bp, Homo sapiens
atgtatcataattacca

SEQ ID NO: 5849786 - DNA, 21 bp, Homo sapiens
atgtatcataattaccaagtg

SEQ ID NO: 5849787 - DNA, 17 bp, Homo sapiens
atgtatcatttttgtgc

SEQ ID NO: 5849788 - DNA, 20 bp, Homo sapiens
atgtatccaaggaaacattt

SEQ ID NO: 5849789 - DNA, 22 bp, Homo sapiens
atgtatccaaggaaacatttta

SEQ ID NO: 5849790 - DNA, 15 bp, Homo sapiens
atgtatcctgataaa

SEQ ID NO: 5849791 - DNA, 22 bp, Homo sapiens
atgtatcgcatattagttaatc

SEQ ID NO: 5849792 - DNA, 15 bp, Homo sapiens
atgtatctaaatgaa

SEQ ID NO: 5849793 - DNA, 16 bp, Homo sapiens
atgtatctaaatgaaa

SEQ ID NO: 5849794 - DNA, 19 bp, Homo sapiens
atgtatctaatttcattca

SEQ ID NO: 5849795 - DNA, 19 bp, Homo sapiens
atgtatctagtggtctgat

SEQ ID NO: 5849796 - DNA, 22 bp, Homo sapiens
atgtatctagtgtgtcctgtga

SEQ ID NO: 5849797 - DNA, 15 bp, Homo sapiens
atgtatctatttgta

SEQ ID NO: 5849798 - DNA, 17 bp, Homo sapiens
atgtatctatttgtaca

SEQ ID NO: 5849799 - DNA, 19 bp, Homo sapiens
atgtatctatttgtacaat

SEQ ID NO: 5849800 - DNA, 20 bp, Homo sapiens
atgtatctatttgtacaatt

SEQ ID NO: 5849801 - DNA, 17 bp, Homo sapiens
atgtatctctaatgaaa

SEQ ID NO: 5849802 - DNA, 21 bp, Homo sapiens
atgtatctctaatgaaattgt

SEQ ID NO: 5849803 - DNA, 16 bp, Homo sapiens
atgtatctgaaagtca

SEQ ID NO: 5849804 - DNA, 14 bp, Homo sapiens
atgtatctgagttg

SEQ ID NO: 5849805 - DNA, 22 bp, Homo sapiens
atgtatctgcatatgttttcca

SEQ ID NO: 5849806 - DNA, 15 bp, Homo sapiens
atgtatctgtctact

SEQ ID NO: 5849807 - DNA, 17 bp, Homo sapiens
atgtatctgtctacttt

SEQ ID NO: 5849808 - DNA, 21 bp, Homo sapiens
atgtatctgtctactttctct

SEQ ID NO: 5849809 - DNA, 17 bp, Homo sapiens
atgtatcttaaaggaca

SEQ ID NO: 5849810 - DNA, 16 bp, Homo sapiens
atgtatcttatttata

SEQ ID NO: 5849811 - DNA, 14 bp, Homo sapiens
atgtatctttataa

SEQ ID NO: 5849812 - DNA, 18 bp, Homo sapiens
atgtatctttattaaaac

SEQ ID NO: 5849813 - DNA, 12 bp, Homo sapiens
atgtatctttgg

SEQ ID NO: 5849814 - DNA, 19 bp, Homo sapiens
atgtatctttggggaaact

SEQ ID NO: 5849815 - DNA, 13 bp, Homo sapiens
atgtcctatgtgt

SEQ ID NO: 5849816 - DNA, 21 bp, Homo sapiens
atgtcctcagcatttcttttc

SEQ ID NO: 5849817 - DNA, 16 bp, Homo sapiens
atgtcctccagaagcc

SEQ ID NO: 5849818 - DNA, 20 bp, Homo sapiens
atgtcctccagaagcctctg

SEQ ID NO: 5849819 - DNA, 11 bp, Homo sapiens
atgtcctgcat

SEQ ID NO: 5849820 - DNA, 19 bp, Homo sapiens
atgtcctgctggcttccag

SEQ ID NO: 5849821 - DNA, 18 bp, Homo sapiens
atgtcctggaagtgtgtg

SEQ ID NO: 5849822 - DNA, 22 bp, Homo sapiens
atgtcctgtaaacactcagctg

SEQ ID NO: 5849823 - DNA, 23 bp, Homo sapiens
atgtcctgtaaacactcagctgt

SEQ ID NO: 5849824 - DNA, 13 bp, Homo sapiens
atgtcctgtaaag

SEQ ID NO: 5849825 - DNA, 14 bp, Homo sapiens
atgtcctgtaaagg

SEQ ID NO: 5849826 - DNA, 20 bp, Homo sapiens
atgtcctgtgagatgtgtat

SEQ ID NO: 5849827 - DNA, 17 bp, Homo sapiens
atgtccttcagctgact

SEQ ID NO: 5849828 - DNA, 15 bp, Homo sapiens
atgtcctttctcaga

SEQ ID NO: 5849829 - DNA, 16 bp, Homo sapiens
atgtcctttctccagt

SEQ ID NO: 5849830 - DNA, 17 bp, Homo sapiens
atgtcctttctccagtg

SEQ ID NO: 5849831 - DNA, 16 bp, Homo sapiens
atgtcctttgtgtcca

SEQ ID NO: 5849832 - DNA, 19 bp, Homo sapiens
atgtcgaaacctacaagat

SEQ ID NO: 5849833 - DNA, 16 bp, Homo sapiens
atgtcgaggctagagg

SEQ ID NO: 5849834 - DNA, 17 bp, Homo sapiens
atgtcgatcaagagaat

SEQ ID NO: 5849835 - DNA, 15 bp, Homo sapiens
atgtcgcctctgcat

SEQ ID NO: 5849836 - DNA, 14 bp, Homo sapiens
atgtcgcctgcccc

SEQ ID NO: 5849837 - DNA, 19 bp, Homo sapiens
atgtcgctgggtcctctgc

SEQ ID NO: 5849838 - DNA, 16 bp, Homo sapiens
atgtcggggcccctgc

SEQ ID NO: 5849839 - DNA, 17 bp, Homo sapiens
atgtcggggttggggtg

SEQ ID NO: 5849840 - DNA, 23 bp, Homo sapiens
atgtcggggttggggtgggaggg

SEQ ID NO: 5849841 - DNA, 21 bp, Homo sapiens
atgtcggtcatagtttcctga

SEQ ID NO: 5849842 - DNA, 19 bp, Homo sapiens
atgtcgtagaattccttcg

SEQ ID NO: 5849843 - DNA, 19 bp, Homo sapiens
atgtcgtagttactctcag

SEQ ID NO: 5849844 - DNA, 21 bp, Homo sapiens
atgtcgtgaccaactagacat

SEQ ID NO: 5849845 - DNA, 16 bp, Homo sapiens
atgtcgtgttttcaag

SEQ ID NO: 5849846 - DNA, 22 bp, Homo sapiens
atgtcgtgttttcaaggaagaa

SEQ ID NO: 5849847 - DNA, 12 bp, Homo sapiens
atgtctaaaatt

SEQ ID NO: 5849848 - DNA, 14 bp, Homo sapiens
atgtctaaaattgt

SEQ ID NO: 5849849 - DNA, 13 bp, Homo sapiens
atgtctaaagagc

SEQ ID NO: 5849850 - DNA, 19 bp, Homo sapiens
atgtctaaatgctgaaaaa

SEQ ID NO: 5849851 - DNA, 13 bp, Homo sapiens
atgtctaacttaa

SEQ ID NO: 5849852 - DNA, 15 bp, Homo sapiens
atgtctaacttaaat

SEQ ID NO: 5849853 - DNA, 22 bp, Homo sapiens
atgtctacaaaagcaaagtgaa

SEQ ID NO: 5849854 - DNA, 19 bp, Homo sapiens
atgtctacagaaaatgctg

SEQ ID NO: 5849855 - DNA, 20 bp, Homo sapiens
atgtctacagaaaatgctgg

SEQ ID NO: 5849856 - DNA, 22 bp, Homo sapiens
atgtctacagaaaatgctggct

SEQ ID NO: 5849857 - DNA, 19 bp, Homo sapiens
atgtctactcagcatttga

SEQ ID NO: 5849858 - DNA, 20 bp, Homo sapiens
atgtctactcagcatttgat

SEQ ID NO: 5849859 - DNA, 20 bp, Homo sapiens
atgtctagagcctcttgggg

SEQ ID NO: 5849860 - DNA, 17 bp, Homo sapiens
atgtctagattttgaaa

SEQ ID NO: 5849861 - DNA, 16 bp, Homo sapiens
atgtctagtttctagt

SEQ ID NO: 5849862 - DNA, 22 bp, Homo sapiens
atgtctagtttctagtgtcact

SEQ ID NO: 5849863 - DNA, 23 bp, Homo sapiens
atgtctagtttctagtgtcactg

SEQ ID NO: 5849864 - DNA, 13 bp, Homo sapiens
atgtctataaatg

SEQ ID NO: 5849865 - DNA, 16 bp, Homo sapiens
atgtctataagtatat

SEQ ID NO: 5849866 - DNA, 22 bp, Homo sapiens
atgtctataatcccagcacttt

SEQ ID NO: 5849867 - DNA, 16 bp, Homo sapiens
atgtctatgctccctc

SEQ ID NO: 5849868 - DNA, 21 bp, Homo sapiens
atgtctatgtgtatatattat

SEQ ID NO: 5849869 - DNA, 20 bp, Homo sapiens
atgtctatgttttctactcc

SEQ ID NO: 5849870 - DNA, 13 bp, Homo sapiens
atgtctattatta

SEQ ID NO: 5849871 - DNA, 16 bp, Homo sapiens
atgtctattattatga

SEQ ID NO: 5849872 - DNA, 20 bp, Homo sapiens
atgtctattattatgaagaa

SEQ ID NO: 5849873 - DNA, 14 bp, Homo sapiens
atgtctattcagct

SEQ ID NO: 5849874 - DNA, 15 bp, Homo sapiens
atgtctattcagctt

SEQ ID NO: 5849875 - DNA, 16 bp, Homo sapiens
atgtctattcagcttc

SEQ ID NO: 5849876 - DNA, 20 bp, Homo sapiens
atgtctattccattcccttc

SEQ ID NO: 5849877 - DNA, 23 bp, Homo sapiens
atgtctatttaagcctcatattt

SEQ ID NO: 5849878 - DNA, 22 bp, Homo sapiens
atgtctcaaaataaaaccagaa

SEQ ID NO: 5849879 - DNA, 14 bp, Homo sapiens
atgtctcaagtgca

SEQ ID NO: 5849880 - DNA, 22 bp, Homo sapiens
atgtctcaagtgcaatgccccc

SEQ ID NO: 5849881 - DNA, 23 bp, Homo sapiens
atgtctcaagtgcaatgccccct

SEQ ID NO: 5849882 - DNA, 23 bp, Homo sapiens
atgtctcaggtttgttttgtgaa

SEQ ID NO: 5849883 - DNA, 19 bp, Homo sapiens
atgtctcagttttcagcta

SEQ ID NO: 5849884 - DNA, 18 bp, Homo sapiens
atgtctccaagtagtcca

SEQ ID NO: 5849885 - DNA, 14 bp, Homo sapiens
atgtctcccacacc

SEQ ID NO: 5849886 - DNA, 16 bp, Homo sapiens
atgtctcccacaccca

SEQ ID NO: 5849887 - DNA, 14 bp, Homo sapiens
atgtctcctaagca

SEQ ID NO: 5849888 - DNA, 18 bp, Homo sapiens
atgtctcctaagcacctg

SEQ ID NO: 5849889 - DNA, 13 bp, Homo sapiens
atgtctcctcaag

SEQ ID NO: 5849890 - DNA, 15 bp, Homo sapiens
atgtctcgctagtga

SEQ ID NO: 5849891 - DNA, 14 bp, Homo sapiens
atgtctctaaagca

SEQ ID NO: 5849892 - DNA, 13 bp, Homo sapiens
atgtctctcagaa

SEQ ID NO: 5849893 - DNA, 17 bp, Homo sapiens
atgtctctcagaattct

SEQ ID NO: 5849894 - DNA, 15 bp, Homo sapiens
atgtctctctgccaa

SEQ ID NO: 5849895 - DNA, 16 bp, Homo sapiens
atgtctctgcttccat

SEQ ID NO: 5849896 - DNA, 11 bp, Homo sapiens
atgtctctggg

SEQ ID NO: 5849897 - DNA, 13 bp, Homo sapiens
atgtctctggggc

SEQ ID NO: 5849898 - DNA, 15 bp, Homo sapiens
atgtctcttcctctg

SEQ ID NO: 5849899 - DNA, 13 bp, Homo sapiens
atgtctcttctga

SEQ ID NO: 5849900 - DNA, 16 bp, Homo sapiens
atgtctcttgagcatc

SEQ ID NO: 5849901 - DNA, 15 bp, Homo sapiens
atgtctctttaagtt

SEQ ID NO: 5849902 - DNA, 19 bp, Homo sapiens
atgtctctttggagttgga

SEQ ID NO: 5849903 - DNA, 16 bp, Homo sapiens
atgtctctttggggag

SEQ ID NO: 5849904 - DNA, 19 bp, Homo sapiens
atgtctctttggggagagc

SEQ ID NO: 5849905 - DNA, 18 bp, Homo sapiens
atgtctgaaacagagaac

SEQ ID NO: 5849906 - DNA, 20 bp, Homo sapiens
atgtctgagagaccatctcc

SEQ ID NO: 5849907 - DNA, 15 bp, Homo sapiens
atgtctgagtgaacc

SEQ ID NO: 5849908 - DNA, 16 bp, Homo sapiens
atgtctgagtgaacct

SEQ ID NO: 5849909 - DNA, 22 bp, Homo sapiens
atgtctgagtgaacctgtataa

SEQ ID NO: 5849910 - DNA, 12 bp, Homo sapiens
atgtctgcacct

SEQ ID NO: 5849911 - DNA, 13 bp, Homo sapiens
atgtctgcactga

SEQ ID NO: 5849912 - DNA, 17 bp, Homo sapiens
atgtctgcactgaggat

SEQ ID NO: 5849913 - DNA, 19 bp, Homo sapiens
atgtctgcactgaggattt

SEQ ID NO: 5849914 - DNA, 13 bp, Homo sapiens
atgtctgcagccc

SEQ ID NO: 5849915 - DNA, 14 bp, Homo sapiens
atgtctgcagccct

SEQ ID NO: 5849916 - DNA, 14 bp, Homo sapiens
atgtctgcaggtgt

SEQ ID NO: 5849917 - DNA, 18 bp, Homo sapiens
atgtctgcaggtttctcc

SEQ ID NO: 5849918 - DNA, 15 bp, Homo sapiens
atgtctgcatggcag

SEQ ID NO: 5849919 - DNA, 14 bp, Homo sapiens
atgtctgcatttcg

SEQ ID NO: 5849920 - DNA, 17 bp, Homo sapiens
atgtctgccaaaatgca

SEQ ID NO: 5849921 - DNA, 14 bp, Homo sapiens
atgtctgccaattt

SEQ ID NO: 5849922 - DNA, 16 bp, Homo sapiens
atgtctgcctatgcac

SEQ ID NO: 5849923 - DNA, 22 bp, Homo sapiens
atgtctgcctggagtgctgtgc

SEQ ID NO: 5849924 - DNA, 20 bp, Homo sapiens
atgtctgctgaataataaac

SEQ ID NO: 5849925 - DNA, 20 bp, Homo sapiens
atgtctgctgagttggcctg

SEQ ID NO: 5849926 - DNA, 12 bp, Homo sapiens
atgtctgctggt

SEQ ID NO: 5849927 - DNA, 19 bp, Homo sapiens
atgtctgcttctgtccagg

SEQ ID NO: 5849928 - DNA, 21 bp, Homo sapiens
atgtctgcttgtcaaaagaaa

SEQ ID NO: 5849929 - DNA, 18 bp, Homo sapiens
atgtctggagaccaccag

SEQ ID NO: 5849930 - DNA, 18 bp, Homo sapiens
atgtctggcagatgaggg

SEQ ID NO: 5849931 - DNA, 19 bp, Homo sapiens
atgtctggcagatgagggc

SEQ ID NO: 5849932 - DNA, 21 bp, Homo sapiens
atgtctggcagatgagggctg

SEQ ID NO: 5849933 - DNA, 18 bp, Homo sapiens
atgtctgggaaagcagag

SEQ ID NO: 5849934 - DNA, 12 bp, Homo sapiens
atgtctggggca

SEQ ID NO: 5849935 - DNA, 15 bp, Homo sapiens
atgtctggtgtttgt

SEQ ID NO: 5849936 - DNA, 23 bp, Homo sapiens
atgtctggtgtttgtcatggtga

SEQ ID NO: 5849937 - DNA, 16 bp, Homo sapiens
atgtctggttctcaat

SEQ ID NO: 5849938 - DNA, 22 bp, Homo sapiens
atgtctgtaataaataaatata

SEQ ID NO: 5849939 - DNA, 20 bp, Homo sapiens
atgtctgtaatcatgtactt

SEQ ID NO: 5849940 - DNA, 16 bp, Homo sapiens
atgtctgtagctcctc

SEQ ID NO: 5849941 - DNA, 18 bp, Homo sapiens
atgtctgtagctcctcaa

SEQ ID NO: 5849942 - DNA, 15 bp, Homo sapiens
atgtctgtcagaaga

SEQ ID NO: 5849943 - DNA, 17 bp, Homo sapiens
atgtctgtcagaagaca

SEQ ID NO: 5849944 - DNA, 19 bp, Homo sapiens
atgtctgtcagaagacact

SEQ ID NO: 5849945 - DNA, 13 bp, Homo sapiens
atgtctgtcattg

SEQ ID NO: 5849946 - DNA, 19 bp, Homo sapiens
atgtctgtccctaaacata

SEQ ID NO: 5849947 - DNA, 21 bp, Homo sapiens
atgtctgtccctaaacatagt

SEQ ID NO: 5849948 - DNA, 18 bp, Homo sapiens
atgtctgtcctcagagca

SEQ ID NO: 5849949 - DNA, 19 bp, Homo sapiens
atgtctgtcctcagagcag

SEQ ID NO: 5849950 - DNA, 20 bp, Homo sapiens
atgtctgtctttgcaaagga

SEQ ID NO: 5849951 - DNA, 9 bp, Homo sapiens
atgtctgtg

SEQ ID NO: 5849952 - DNA, 12 bp, Homo sapiens
atgtctgtgcca

SEQ ID NO: 5849953 - DNA, 13 bp, Homo sapiens
atgtctgtgccat

SEQ ID NO: 5849954 - DNA, 15 bp, Homo sapiens
atgtctgtgctgtgt

SEQ ID NO: 5849955 - DNA, 21 bp, Homo sapiens
atgtctgtggccttgttctct

SEQ ID NO: 5849956 - DNA, 13 bp, Homo sapiens
atgtctgtgtatg

SEQ ID NO: 5849957 - DNA, 14 bp, Homo sapiens
atgtctgtttgctg

SEQ ID NO: 5849958 - DNA, 15 bp, Homo sapiens
atgtctgtttgctga

SEQ ID NO: 5849959 - DNA, 24 bp, Homo sapiens
atgtctgtttgctgatggtctggt

SEQ ID NO: 5849960 - DNA, 17 bp, Homo sapiens
atgtctgtttttgtatc

SEQ ID NO: 5849961 - DNA, 19 bp, Homo sapiens
atgtctgtttttgtatctt

SEQ ID NO: 5849962 - DNA, 19 bp, Homo sapiens
atgtcttaacctcagggag

SEQ ID NO: 5849963 - DNA, 16 bp, Homo sapiens
atgtcttaatgaagtt

SEQ ID NO: 5849964 - DNA, 19 bp, Homo sapiens
atgtcttaatgaagtttga

SEQ ID NO: 5849965 - DNA, 20 bp, Homo sapiens
atgtcttactactttaaatc

SEQ ID NO: 5849966 - DNA, 23 bp, Homo sapiens
atgtcttataagaaaacatgtaa

SEQ ID NO: 5849967 - DNA, 16 bp, Homo sapiens
atgtcttatttttaga

SEQ ID NO: 5849968 - DNA, 17 bp, Homo sapiens
atgtcttcaatggaata

SEQ ID NO: 5849969 - DNA, 19 bp, Homo sapiens
atgtcttcataaagtactt

SEQ ID NO: 5849970 - DNA, 14 bp, Homo sapiens
atgtcttcatgttg

SEQ ID NO: 5849971 - DNA, 19 bp, Homo sapiens
atgtcttcatgttgatgtg

SEQ ID NO: 5849972 - DNA, 20 bp, Homo sapiens
atgtcttcatttcattgtat

SEQ ID NO: 5849973 - DNA, 11 bp, Homo sapiens
atgtcttccct

SEQ ID NO: 5849974 - DNA, 14 bp, Homo sapiens
atgtcttccctggg

SEQ ID NO: 5849975 - DNA, 13 bp, Homo sapiens
atgtcttcctgga

SEQ ID NO: 5849976 - DNA, 20 bp, Homo sapiens
atgtcttctcacaagccagc

SEQ ID NO: 5849977 - DNA, 22 bp, Homo sapiens
atgtcttctcacaagccagcca

SEQ ID NO: 5849978 - DNA, 14 bp, Homo sapiens
atgtcttctccctg

SEQ ID NO: 5849979 - DNA, 12 bp, Homo sapiens
atgtcttctgct

SEQ ID NO: 5849980 - DNA, 13 bp, Homo sapiens
atgtcttctgctg

SEQ ID NO: 5849981 - DNA, 17 bp, Homo sapiens
atgtcttctgctgttct

SEQ ID NO: 5849982 - DNA, 21 bp, Homo sapiens
atgtcttctgctgttcttcac

SEQ ID NO: 5849983 - DNA, 16 bp, Homo sapiens
atgtcttcttgggggc

SEQ ID NO: 5849984 - DNA, 22 bp, Homo sapiens
atgtcttcttgggggcagacca

SEQ ID NO: 5849985 - DNA, 13 bp, Homo sapiens
atgtcttgagagg

SEQ ID NO: 5849986 - DNA, 15 bp, Homo sapiens
atgtcttgagctcta

SEQ ID NO: 5849987 - DNA, 20 bp, Homo sapiens
atgtcttgcaaagcctttaa

SEQ ID NO: 5849988 - DNA, 21 bp, Homo sapiens
atgtcttgcaaagcctttaaa

SEQ ID NO: 5849989 - DNA, 19 bp, Homo sapiens
atgtcttgctgttgacata

SEQ ID NO: 5849990 - DNA, 20 bp, Homo sapiens
atgtcttgctgttgacatat

SEQ ID NO: 5849991 - DNA, 22 bp, Homo sapiens
atgtcttgctgttgacatattt

SEQ ID NO: 5849992 - DNA, 19 bp, Homo sapiens
atgtcttggacactgtaca

SEQ ID NO: 5849993 - DNA, 17 bp, Homo sapiens
atgtgcttgtgtgtatg

SEQ ID NO: 5849994 - DNA, 19 bp, Homo sapiens
atgtgcttgtgtgtatgtc

SEQ ID NO: 5849995 - DNA, 20 bp, Homo sapiens
atgtgcttgtgtgtatgtct

SEQ ID NO: 5849996 - DNA, 22 bp, Homo sapiens
atgtgcttgtgtgtatgtctat

SEQ ID NO: 5849997 - DNA, 14 bp, Homo sapiens
atgtgctttgagaa

SEQ ID NO: 5849998 - DNA, 14 bp, Homo sapiens
atgtgctttgtagc

SEQ ID NO: 5849999 - DNA, 17 bp, Homo sapiens
atgtgcttttctccaat

SEQ ID NO: 5850000 - DNA, 13 bp, Homo sapiens
atgtggaaaacag

SEQ ID NO: 5850001 - DNA, 15 bp, Homo sapiens
atgtggaaagtgaat

SEQ ID NO: 5850002 - DNA, 19 bp, Homo sapiens
atgtggaaagtgaatttga

SEQ ID NO: 5850003 - DNA, 20 bp, Homo sapiens
atgtggaaatgacccaaaca

SEQ ID NO: 5850004 - DNA, 17 bp, Homo sapiens
atgtggaactgctgcca

SEQ ID NO: 5850005 - DNA, 21 bp, Homo sapiens
atgtggaagaaaatggtttat

SEQ ID NO: 5850006 - DNA, 22 bp, Homo sapiens
atgtggaaggaaaatatttcat

SEQ ID NO: 5850007 - DNA, 23 bp, Homo sapiens
atgtggaaggaaaatatttcatt

SEQ ID NO: 5850008 - DNA, 22 bp, Homo sapiens
atgtggaagtgtgggtctgtgt

SEQ ID NO: 5850009 - DNA, 23 bp, Homo sapiens
atgtggaagtgtgggtctgtgtg

SEQ ID NO: 5850010 - DNA, 16 bp, Homo sapiens
atgtggaataatacat

SEQ ID NO: 5850011 - DNA, 23 bp, Homo sapiens
atgtggaataatacatactaatg

SEQ ID NO: 5850012 - DNA, 14 bp, Homo sapiens
atgtggaattacat

SEQ ID NO: 5850013 - DNA, 17 bp, Homo sapiens
atgtggacgtgcactga

SEQ ID NO: 5850014 - DNA, 20 bp, Homo sapiens
atgtggacgtgcactgacag

SEQ ID NO: 5850015 - DNA, 16 bp, Homo sapiens
atgtggactaaatatc

SEQ ID NO: 5850016 - DNA, 18 bp, Homo sapiens
atgtggactggaacatgg

SEQ ID NO: 5850017 - DNA, 18 bp, Homo sapiens
atgtggacttattcattc

SEQ ID NO: 5850018 - DNA, 17 bp, Homo sapiens
atgtggacttgtatgct

SEQ ID NO: 5850019 - DNA, 14 bp, Homo sapiens
atgtggaggaagag

SEQ ID NO: 5850020 - DNA, 17 bp, Homo sapiens
atgtggaggaagagcca

SEQ ID NO: 5850021 - DNA, 18 bp, Homo sapiens
atgtggaggaagagccac

SEQ ID NO: 5850022 - DNA, 21 bp, Homo sapiens
atgtggaggaagagccacctg

SEQ ID NO: 5850023 - DNA, 16 bp, Homo sapiens
atgtggagtgtattaa

SEQ ID NO: 5850024 - DNA, 24 bp, Homo sapiens
atgtggagttcatcttgaattgta

SEQ ID NO: 5850025 - DNA, 17 bp, Homo sapiens
atgtggatacagtcatt

SEQ ID NO: 5850026 - DNA, 14 bp, Homo sapiens
atgtggatctgggg

SEQ ID NO: 5850027 - DNA, 16 bp, Homo sapiens
atgtggatgacacaat

SEQ ID NO: 5850028 - DNA, 18 bp, Homo sapiens
atgtggatggaggtgatg

SEQ ID NO: 5850029 - DNA, 20 bp, Homo sapiens
atgtggatttcctattttaa

SEQ ID NO: 5850030 - DNA, 17 bp, Homo sapiens
atgtggattttgtagat

SEQ ID NO: 5850031 - DNA, 23 bp, Homo sapiens
atgtggcaataaattttttttaa

SEQ ID NO: 5850032 - DNA, 22 bp, Homo sapiens
atgtggcagatctacatgtcta

SEQ ID NO: 5850033 - DNA, 11 bp, Homo sapiens
atgtggcagct

SEQ ID NO: 5850034 - DNA, 15 bp, Homo sapiens
atgtggcaggagggc

SEQ ID NO: 5850035 - DNA, 18 bp, Homo sapiens
atgtggcaggagggcagt

SEQ ID NO: 5850036 - DNA, 18 bp, Homo sapiens
atgtggcaggggcagtgg

SEQ ID NO: 5850037 - DNA, 20 bp, Homo sapiens
atgtggcattctctctgctc

SEQ ID NO: 5850038 - DNA, 23 bp, Homo sapiens
atgtggcattctctctgctcagt

SEQ ID NO: 5850039 - DNA, 17 bp, Homo sapiens
atgtggcattggggggc

SEQ ID NO: 5850040 - DNA, 16 bp, Homo sapiens
atgtggcatttgtgat

SEQ ID NO: 5850041 - DNA, 14 bp, Homo sapiens
atgtggccccaccc

SEQ ID NO: 5850042 - DNA, 18 bp, Homo sapiens
atgtggccccaggtgcca

SEQ ID NO: 5850043 - DNA, 18 bp, Homo sapiens
atgtggcccctgaacaag

SEQ ID NO: 5850044 - DNA, 20 bp, Homo sapiens
atgtggcccctgaacaagaa

SEQ ID NO: 5850045 - DNA, 13 bp, Homo sapiens
atgtggccctggc

SEQ ID NO: 5850046 - DNA, 22 bp, Homo sapiens
atgtggccctggctgccggcac

SEQ ID NO: 5850047 - DNA, 17 bp, Homo sapiens
atgtggcctaatattga

SEQ ID NO: 5850048 - DNA, 17 bp, Homo sapiens
atgtggcctccatgtgg

SEQ ID NO: 5850049 - DNA, 19 bp, Homo sapiens
atgtggcctgtggcctgtg

SEQ ID NO: 5850050 - DNA, 20 bp, Homo sapiens
atgtggcctttagcaaaact

SEQ ID NO: 5850051 - DNA, 16 bp, Homo sapiens
atgtggcctttgaatt

SEQ ID NO: 5850052 - DNA, 13 bp, Homo sapiens
atgtggctcctcc

SEQ ID NO: 5850053 - DNA, 15 bp, Homo sapiens
atgtggctgcagcag

SEQ ID NO: 5850054 - DNA, 13 bp, Homo sapiens
atgtggctgtatc

SEQ ID NO: 5850055 - DNA, 16 bp, Homo sapiens
atgtggcttgagaaat

SEQ ID NO: 5850056 - DNA, 15 bp, Homo sapiens
atgtgggaaaaaaag

SEQ ID NO: 5850057 - DNA, 16 bp, Homo sapiens
atgtgggaagttacct

SEQ ID NO: 5850058 - DNA, 22 bp, Homo sapiens
atgtgggaagttaccttttata

SEQ ID NO: 5850059 - DNA, 10 bp, Homo sapiens
atgtgggagg

SEQ ID NO: 5850060 - DNA, 21 bp, Homo sapiens
atgtgggatgagtttttaaat

SEQ ID NO: 5850061 - DNA, 13 bp, Homo sapiens
atgtgggattatg

SEQ ID NO: 5850062 - DNA, 14 bp, Homo sapiens
atgtgggattatgg

SEQ ID NO: 5850063 - DNA, 18 bp, Homo sapiens
atgtgggattatgggtca

SEQ ID NO: 5850064 - DNA, 11 bp, Homo sapiens
atgtgggcagc

SEQ ID NO: 5850065 - DNA, 20 bp, Homo sapiens
atgtgggcgcccaccctggg

SEQ ID NO: 5850066 - DNA, 21 bp, Homo sapiens
atgtgggcgcccaccctgggc

SEQ ID NO: 5850067 - DNA, 19 bp, Homo sapiens
atgtgggcgtttgtaaatt

SEQ ID NO: 5850068 - DNA, 23 bp, Homo sapiens
atgtgggctatgtagtcataata

SEQ ID NO: 5850069 - DNA, 13 bp, Homo sapiens
atgtggggccagg

SEQ ID NO: 5850070 - DNA, 23 bp, Homo sapiens
atgtgggggaaggccttgctgtc

SEQ ID NO: 5850071 - DNA, 22 bp, Homo sapiens
atgtgggggaggagggagagag

SEQ ID NO: 5850072 - DNA, 16 bp, Homo sapiens
atgtgggggtctgtgt

SEQ ID NO: 5850073 - DNA, 23 bp, Homo sapiens
atgtggggttgctgaagatgcct

SEQ ID NO: 5850074 - DNA, 20 bp, Homo sapiens
atgtgggtaagaggagcaga

SEQ ID NO: 5850075 - DNA, 16 bp, Homo sapiens
atgtgggtcaaggaat

SEQ ID NO: 5850076 - DNA, 14 bp, Homo sapiens
atgtgggtcttcca

SEQ ID NO: 5850077 - DNA, 18 bp, Homo sapiens
atgtgggtctttttctct

SEQ ID NO: 5850078 - DNA, 19 bp, Homo sapiens
atgtgggtgaagtgcctgc

SEQ ID NO: 5850079 - DNA, 15 bp, Homo sapiens
atgtgggtgagccag

SEQ ID NO: 5850080 - DNA, 14 bp, Homo sapiens
atgtgggtgctagg

SEQ ID NO: 5850081 - DNA, 13 bp, Homo sapiens
atgtgggtggaga

SEQ ID NO: 5850082 - DNA, 15 bp, Homo sapiens
atgtgggtggagaag

SEQ ID NO: 5850083 - DNA, 19 bp, Homo sapiens
atgtgggtggcttctagtt

SEQ ID NO: 5850084 - DNA, 17 bp, Homo sapiens
atgtgggttccacagac

SEQ ID NO: 5850085 - DNA, 15 bp, Homo sapiens
atgtggtatgtagcc

SEQ ID NO: 5850086 - DNA, 21 bp, Homo sapiens
atgtggtattggtgctttgtg

SEQ ID NO: 5850087 - DNA, 19 bp, Homo sapiens
atgtggtcgttagagacag

SEQ ID NO: 5850088 - DNA, 23 bp, Homo sapiens
atgtggtcgttagagacagagcg

SEQ ID NO: 5850089 - DNA, 15 bp, Homo sapiens
atgtggtctgccaat

SEQ ID NO: 5850090 - DNA, 19 bp, Homo sapiens
atgtggtctgccaatctgt

SEQ ID NO: 5850091 - DNA, 22 bp, Homo sapiens
atgtggtctgccaatctgtaca

SEQ ID NO: 5850092 - DNA, 23 bp, Homo sapiens
atgtggtcttatgattttattac

SEQ ID NO: 5850093 - DNA, 18 bp, Homo sapiens
atgtggtgacacctcccc

SEQ ID NO: 5850094 - DNA, 21 bp, Homo sapiens
atgtggtgggacagggaccca

SEQ ID NO: 5850095 - DNA, 21 bp, Homo sapiens
atgtggttacttcctactgta

SEQ ID NO: 5850096 - DNA, 13 bp, Homo sapiens
atgtggtttatag

SEQ ID NO: 5850097 - DNA, 17 bp, Homo sapiens
atgtggtttggttcctc

SEQ ID NO: 5850098 - DNA, 19 bp, Homo sapiens
atgtggtttggttcctctc

SEQ ID NO: 5850099 - DNA, 22 bp, Homo sapiens
atgtggtttggttcctctctgg

SEQ ID NO: 5850100 - DNA, 22 bp, Homo sapiens
atgtggtttgtacatatcaaat

SEQ ID NO: 5850101 - DNA, 16 bp, Homo sapiens
atgtggttttagattt

SEQ ID NO: 5850102 - DNA, 21 bp, Homo sapiens
atgtgtaaacaattttatata

SEQ ID NO: 5850103 - DNA, 19 bp, Homo sapiens
atgtgtaaagatctacatg

SEQ ID NO: 5850104 - DNA, 19 bp, Homo sapiens
atgtgtaaatggagcttgt

SEQ ID NO: 5850105 - DNA, 22 bp, Homo sapiens
atgtgtaacacagtgccttcaa

SEQ ID NO: 5850106 - DNA, 17 bp, Homo sapiens
atgtgtaagacaaaaag

SEQ ID NO: 5850107 - DNA, 19 bp, Homo sapiens
atgtgtaagacaaaaagct

SEQ ID NO: 5850108 - DNA, 13 bp, Homo sapiens
atgtgtaagtatt

SEQ ID NO: 5850109 - DNA, 14 bp, Homo sapiens
atgtgtaagtattc

SEQ ID NO: 5850110 - DNA, 13 bp, Homo sapiens
atgtgtaatatca

SEQ ID NO: 5850111 - DNA, 15 bp, Homo sapiens
atgtgtaatgatttg

SEQ ID NO: 5850112 - DNA, 15 bp, Homo sapiens
atgtgtacacatatg

SEQ ID NO: 5850113 - DNA, 17 bp, Homo sapiens
atgtgtacacatatgaa

SEQ ID NO: 5850114 - DNA, 15 bp, Homo sapiens
atgtgtacagaaaca

SEQ ID NO: 5850115 - DNA, 14 bp, Homo sapiens
atgtgtacagtgaa

SEQ ID NO: 5850116 - DNA, 21 bp, Homo sapiens
atgtgtacagtgaattgtctt

SEQ ID NO: 5850117 - DNA, 11 bp, Homo sapiens
atgtgtacata

SEQ ID NO: 5850118 - DNA, 18 bp, Homo sapiens
atgtgtacatatatgtat

SEQ ID NO: 5850119 - DNA, 16 bp, Homo sapiens
atgtgtacatggcaga

SEQ ID NO: 5850120 - DNA, 21 bp, Homo sapiens
atgtgtagatattatgtatag

SEQ ID NO: 5850121 - DNA, 15 bp, Homo sapiens
atgtgtagcctgtgc

SEQ ID NO: 5850122 - DNA, 16 bp, Homo sapiens
atgtgtagccttctcc

SEQ ID NO: 5850123 - DNA, 20 bp, Homo sapiens
atgtgtaggatgtatgctgt

SEQ ID NO: 5850124 - DNA, 16 bp, Homo sapiens
atgtgtagggaaagtt

SEQ ID NO: 5850125 - DNA, 13 bp, Homo sapiens
atgtgtagggctg

SEQ ID NO: 5850126 - DNA, 14 bp, Homo sapiens
atgtgtagttaatt

SEQ ID NO: 5850127 - DNA, 14 bp, Homo sapiens
atgtgtagttataa

SEQ ID NO: 5850128 - DNA, 18 bp, Homo sapiens
atgtgtagttcatgtaaa

SEQ ID NO: 5850129 - DNA, 12 bp, Homo sapiens
atgtgtataaac

SEQ ID NO: 5850130 - DNA, 14 bp, Homo sapiens
atgtgtataaacaa

SEQ ID NO: 5850131 - DNA, 13 bp, Homo sapiens
atgtgtataaact

SEQ ID NO: 5850132 - DNA, 19 bp, Homo sapiens
atgtgtataaactgctgtc

SEQ ID NO: 5850133 - DNA, 19 bp, Homo sapiens
atgtgtataaattgtcttt

SEQ ID NO: 5850134 - DNA, 17 bp, Homo sapiens
atgtgtatacacttaaa

SEQ ID NO: 5850135 - DNA, 14 bp, Homo sapiens
atgtgtatacagaa

SEQ ID NO: 5850136 - DNA, 10 bp, Homo sapiens
atgtgtatat

SEQ ID NO: 5850137 - DNA, 12 bp, Homo sapiens
atgtgtatatat

SEQ ID NO: 5850138 - DNA, 18 bp, Homo sapiens
atgtgtatatattatata

SEQ ID NO: 5850139 - DNA, 22 bp, Homo sapiens
atgtgtatatattatatataca

SEQ ID NO: 5850140 - DNA, 20 bp, Homo sapiens
atgtgtatatgtttatacac

SEQ ID NO: 5850141 - DNA, 16 bp, Homo sapiens
atgtgtatcagtgttt

SEQ ID NO: 5850142 - DNA, 19 bp, Homo sapiens
atgtgtatgagaagtactt

SEQ ID NO: 5850143 - DNA, 15 bp, Homo sapiens
atgtgtatgcacagt

SEQ ID NO: 5850144 - DNA, 19 bp, Homo sapiens
atgtgtatgcacagtaaaa

SEQ ID NO: 5850145 - DNA, 22 bp, Homo sapiens
atgtgtatggaagacaaataca

SEQ ID NO: 5850146 - DNA, 20 bp, Homo sapiens
atgtgtatgggcaaaaaact

SEQ ID NO: 5850147 - DNA, 14 bp, Homo sapiens
atgtgtatgtactt

SEQ ID NO: 5850148 - DNA, 18 bp, Homo sapiens
atgtgtatgtacttacat

SEQ ID NO: 5850149 - DNA, 12 bp, Homo sapiens
atgtgtatgtga

SEQ ID NO: 5850150 - DNA, 21 bp, Homo sapiens
atgtgtattaggattggggga

SEQ ID NO: 5850151 - DNA, 15 bp, Homo sapiens
atgtgtattctggct

SEQ ID NO: 5850152 - DNA, 19 bp, Homo sapiens
atgtgtattctggctgcaa

SEQ ID NO: 5850153 - DNA, 21 bp, Homo sapiens
atgtgtcaacttcaacattta

SEQ ID NO: 5850154 - DNA, 16 bp, Homo sapiens
atgtgtcacagctctg

SEQ ID NO: 5850155 - DNA, 15 bp, Homo sapiens
atgtgtcacttgtgc

SEQ ID NO: 5850156 - DNA, 17 bp, Homo sapiens
atgtgtcacttgtgctt

SEQ ID NO: 5850157 - DNA, 22 bp, Homo sapiens
atgtgtcagaataggaaaacat

SEQ ID NO: 5850158 - DNA, 23 bp, Homo sapiens
atgtgtcagaataggaaaacatt

SEQ ID NO: 5850159 - DNA, 18 bp, Homo sapiens
atgtgtcagctgtagaaa

SEQ ID NO: 5850160 - DNA, 21 bp, Homo sapiens
atgtgtcagtggggctctctg

SEQ ID NO: 5850161 - DNA, 15 bp, Homo sapiens
atgtgtcatgaagaa

SEQ ID NO: 5850162 - DNA, 14 bp, Homo sapiens
atgtgtcatgtaat

SEQ ID NO: 5850163 - DNA, 17 bp, Homo sapiens
atgtgtcatgtaatact

SEQ ID NO: 5850164 - DNA, 18 bp, Homo sapiens
atgtgtcatttataactt

SEQ ID NO: 5850165 - DNA, 21 bp, Homo sapiens
atgtgtcatttataacttctg

SEQ ID NO: 5850166 - DNA, 16 bp, Homo sapiens
atgtgtccatcccagc

SEQ ID NO: 5850167 - DNA, 16 bp, Homo sapiens
atgtgtcccagtgaac

SEQ ID NO: 5850168 - DNA, 21 bp, Homo sapiens
atgtgtcccagtgaacagttt

SEQ ID NO: 5850169 - DNA, 20 bp, Homo sapiens
atgtgtcccccctgtggtct

SEQ ID NO: 5850170 - DNA, 18 bp, Homo sapiens
attacgtgcatttaaact

SEQ ID NO: 5850171 - DNA, 23 bp, Homo sapiens
attacgtgcatttaaactctgcc

SEQ ID NO: 5850172 - DNA, 13 bp, Homo sapiens
attacgtgctctg

SEQ ID NO: 5850173 - DNA, 21 bp, Homo sapiens
attacgtgggtgccctctcca

SEQ ID NO: 5850174 - DNA, 19 bp, Homo sapiens
attacgtgtatgtttcttc

SEQ ID NO: 5850175 - DNA, 21 bp, Homo sapiens
attacgtgtatgtttcttctt

SEQ ID NO: 5850176 - DNA, 16 bp, Homo sapiens
attacgttgtttctta

SEQ ID NO: 5850177 - DNA, 22 bp, Homo sapiens
attactaacttctaaaactgta

SEQ ID NO: 5850178 - DNA, 16 bp, Homo sapiens
attactaataaattga

SEQ ID NO: 5850179 - DNA, 16 bp, Homo sapiens
attactaataactttt

SEQ ID NO: 5850180 - DNA, 18 bp, Homo sapiens
attactaattctatttct

SEQ ID NO: 5850181 - DNA, 12 bp, Homo sapiens
attactaatttt

SEQ ID NO: 5850182 - DNA, 15 bp, Homo sapiens
attactaattttaca

SEQ ID NO: 5850183 - DNA, 19 bp, Homo sapiens
attactaattttacacatt

SEQ ID NO: 5850184 - DNA, 20 bp, Homo sapiens
attactacaaaatttgaaat

SEQ ID NO: 5850185 - DNA, 16 bp, Homo sapiens
attactacaaatggat

SEQ ID NO: 5850186 - DNA, 16 bp, Homo sapiens
attactactaggtaat

SEQ ID NO: 5850187 - DNA, 15 bp, Homo sapiens
attactactcctttg

SEQ ID NO: 5850188 - DNA, 14 bp, Homo sapiens
attactactgtaca

SEQ ID NO: 5850189 - DNA, 17 bp, Homo sapiens
attactagtgtttaagt

SEQ ID NO: 5850190 - DNA, 18 bp, Homo sapiens
attactagtgtttaagtc

SEQ ID NO: 5850191 - DNA, 22 bp, Homo sapiens
attactagttagcatacacatt

SEQ ID NO: 5850192 - DNA, 18 bp, Homo sapiens
attactatgactgctccc

SEQ ID NO: 5850193 - DNA, 13 bp, Homo sapiens
attactcagcaca

SEQ ID NO: 5850194 - DNA, 17 bp, Homo sapiens
attactcagcacagaga

SEQ ID NO: 5850195 - DNA, 14 bp, Homo sapiens
attactcaggtttg

SEQ ID NO: 5850196 - DNA, 11 bp, Homo sapiens
attactccaag

SEQ ID NO: 5850197 - DNA, 21 bp, Homo sapiens
attactcccaggatcagcaga

SEQ ID NO: 5850198 - DNA, 20 bp, Homo sapiens
attactcctatttttgtaaa

SEQ ID NO: 5850199 - DNA, 15 bp, Homo sapiens
attactccttcagct

SEQ ID NO: 5850200 - DNA, 23 bp, Homo sapiens
attactcgatcaaaaccttcctt

SEQ ID NO: 5850201 - DNA, 16 bp, Homo sapiens
attactctacactgaa

SEQ ID NO: 5850202 - DNA, 18 bp, Homo sapiens
attactctacactgaaac

SEQ ID NO: 5850203 - DNA, 21 bp, Homo sapiens
attactctcattctttgaaca

SEQ ID NO: 5850204 - DNA, 17 bp, Homo sapiens
attactctgacataaac

SEQ ID NO: 5850205 - DNA, 14 bp, Homo sapiens
attactctggtgga

SEQ ID NO: 5850206 - DNA, 12 bp, Homo sapiens
attactcttgta

SEQ ID NO: 5850207 - DNA, 19 bp, Homo sapiens
attactcttgtaagatttt

SEQ ID NO: 5850208 - DNA, 13 bp, Homo sapiens
attactctttctc

SEQ ID NO: 5850209 - DNA, 18 bp, Homo sapiens
attactctttgctttgta

SEQ ID NO: 5850210 - DNA, 22 bp, Homo sapiens
attactgaaaacaaaatatctg

SEQ ID NO: 5850211 - DNA, 16 bp, Homo sapiens
attactgaataatatc

SEQ ID NO: 5850212 - DNA, 21 bp, Homo sapiens
attactgaataatatcaaata

SEQ ID NO: 5850213 - DNA, 21 bp, Homo sapiens
attactgacatttcttctagt

SEQ ID NO: 5850214 - DNA, 21 bp, Homo sapiens
attactgagagtgcaaattgt

SEQ ID NO: 5850215 - DNA, 15 bp, Homo sapiens
attactgatgtgata

SEQ ID NO: 5850216 - DNA, 22 bp, Homo sapiens
attactgatttagaagcaaaga

SEQ ID NO: 5850217 - DNA, 18 bp, Homo sapiens
attactgcaaattgattg

SEQ ID NO: 5850218 - DNA, 19 bp, Homo sapiens
attactgcagactataaaa

SEQ ID NO: 5850219 - DNA, 14 bp, Homo sapiens
attactgcatgcac

SEQ ID NO: 5850220 - DNA, 12 bp, Homo sapiens
attactgccttc

SEQ ID NO: 5850221 - DNA, 14 bp, Homo sapiens
attactgccttcag

SEQ ID NO: 5850222 - DNA, 23 bp, Homo sapiens
attactgcctttggaagaaacag

SEQ ID NO: 5850223 - DNA, 23 bp, Homo sapiens
attactgctaagtatttcccagc

SEQ ID NO: 5850224 - DNA, 16 bp, Homo sapiens
attactgcttcatttt

SEQ ID NO: 5850225 - DNA, 22 bp, Homo sapiens
attactgcttcatttttgtaat

SEQ ID NO: 5850226 - DNA, 17 bp, Homo sapiens
attactggaagtaagaa

SEQ ID NO: 5850227 - DNA, 17 bp, Homo sapiens
attactggaattcttct

SEQ ID NO: 5850228 - DNA, 19 bp, Homo sapiens
attactggaattcttctgc

SEQ ID NO: 5850229 - DNA, 17 bp, Homo sapiens
attactggataaattgt

SEQ ID NO: 5850230 - DNA, 17 bp, Homo sapiens
attactggatctcttaa

SEQ ID NO: 5850231 - DNA, 15 bp, Homo sapiens
attactgggccttag

SEQ ID NO: 5850232 - DNA, 23 bp, Homo sapiens
attactgggccttagtgggccag

SEQ ID NO: 5850233 - DNA, 15 bp, Homo sapiens
attactgtacacatt

SEQ ID NO: 5850234 - DNA, 20 bp, Homo sapiens
attactgtatataaactcct

SEQ ID NO: 5850235 - DNA, 20 bp, Homo sapiens
attactgtatgtataaatta

SEQ ID NO: 5850236 - DNA, 17 bp, Homo sapiens
attactgtcaataaaca

SEQ ID NO: 5850237 - DNA, 18 bp, Homo sapiens
attactgtctctggcatt

SEQ ID NO: 5850238 - DNA, 14 bp, Homo sapiens
attactgtgagaac

SEQ ID NO: 5850239 - DNA, 17 bp, Homo sapiens
attactgtgagaactgt

SEQ ID NO: 5850240 - DNA, 19 bp, Homo sapiens
attactgtgagaactgtga

SEQ ID NO: 5850241 - DNA, 23 bp, Homo sapiens
attactgtgagaactgtgaatat

SEQ ID NO: 5850242 - DNA, 13 bp, Homo sapiens
attactgtgagga

SEQ ID NO: 5850243 - DNA, 13 bp, Homo sapiens
attactgtgtaaa

SEQ ID NO: 5850244 - DNA, 15 bp, Homo sapiens
attactgtgtaaata

SEQ ID NO: 5850245 - DNA, 17 bp, Homo sapiens
attactgtgtaaatata

SEQ ID NO: 5850246 - DNA, 14 bp, Homo sapiens
attactgttccaga

SEQ ID NO: 5850247 - DNA, 19 bp, Homo sapiens
attactgttccagattcct

SEQ ID NO: 5850248 - DNA, 19 bp, Homo sapiens
attactgttgcatttactt

SEQ ID NO: 5850249 - DNA, 20 bp, Homo sapiens
attactgttgcatttacttt

SEQ ID NO: 5850250 - DNA, 20 bp, Homo sapiens
attactgtttattacttcca

SEQ ID NO: 5850251 - DNA, 17 bp, Homo sapiens
attactgtttatttctg

SEQ ID NO: 5850252 - DNA, 18 bp, Homo sapiens
attactgtttatttctgt

SEQ ID NO: 5850253 - DNA, 16 bp, Homo sapiens
attactgtttgttctc

SEQ ID NO: 5850254 - DNA, 16 bp, Homo sapiens
attactgttttgggcc

SEQ ID NO: 5850255 - DNA, 12 bp, Homo sapiens
attacttaaaaa

SEQ ID NO: 5850256 - DNA, 12 bp, Homo sapiens
attacttactgt

SEQ ID NO: 5850257 - DNA, 20 bp, Homo sapiens
attacttaggttattttgct

SEQ ID NO: 5850258 - DNA, 22 bp, Homo sapiens
attacttaggttattttgcttt

SEQ ID NO: 5850259 - DNA, 23 bp, Homo sapiens
attacttaggttattttgctttg

SEQ ID NO: 5850260 - DNA, 15 bp, Homo sapiens
attacttagtattgc

SEQ ID NO: 5850261 - DNA, 18 bp, Homo sapiens
attacttagtattgcaaa

SEQ ID NO: 5850262 - DNA, 22 bp, Homo sapiens
attacttagtattgcaaagtca

SEQ ID NO: 5850263 - DNA, 15 bp, Homo sapiens
attacttatcatcca

SEQ ID NO: 5850264 - DNA, 18 bp, Homo sapiens
attacttatccctgccca

SEQ ID NO: 5850265 - DNA, 21 bp, Homo sapiens
attacttatttaactgattaa

SEQ ID NO: 5850266 - DNA, 17 bp, Homo sapiens
attacttatttttgaca

SEQ ID NO: 5850267 - DNA, 18 bp, Homo sapiens
attacttatttttgacag

SEQ ID NO: 5850268 - DNA, 19 bp, Homo sapiens
attacttatttttgacagt

SEQ ID NO: 5850269 - DNA, 17 bp, Homo sapiens
attacttccatgaattt

SEQ ID NO: 5850270 - DNA, 16 bp, Homo sapiens
attacttctctataaa

SEQ ID NO: 5850271 - DNA, 17 bp, Homo sapiens
attacttctgagcccca

SEQ ID NO: 5850272 - DNA, 14 bp, Homo sapiens
attacttctgtttc

SEQ ID NO: 5850273 - DNA, 19 bp, Homo sapiens
attacttggcaaattctga

SEQ ID NO: 5850274 - DNA, 17 bp, Homo sapiens
attacttgtaaatataa

SEQ ID NO: 5850275 - DNA, 15 bp, Homo sapiens
attacttgtgcactt

SEQ ID NO: 5850276 - DNA, 20 bp, Homo sapiens
attacttgttgcaaaggtct

SEQ ID NO: 5850277 - DNA, 15 bp, Homo sapiens
attacttgttgccta

SEQ ID NO: 5850278 - DNA, 17 bp, Homo sapiens
attacttgttgcctata

SEQ ID NO: 5850279 - DNA, 18 bp, Homo sapiens
attactttaaattatatg

SEQ ID NO: 5850280 - DNA, 19 bp, Homo sapiens
attactttaaattatatga

SEQ ID NO: 5850281 - DNA, 14 bp, Homo sapiens
attactttaacatt

SEQ ID NO: 5850282 - DNA, 15 bp, Homo sapiens
attactttaacattt

SEQ ID NO: 5850283 - DNA, 16 bp, Homo sapiens
attactttaacatttt

SEQ ID NO: 5850284 - DNA, 17 bp, Homo sapiens
attactttaacattttg

SEQ ID NO: 5850285 - DNA, 18 bp, Homo sapiens
attactttaacattttgg

SEQ ID NO: 5850286 - DNA, 13 bp, Homo sapiens
attactttaacct

SEQ ID NO: 5850287 - DNA, 15 bp, Homo sapiens
attactttaatactc

SEQ ID NO: 5850288 - DNA, 14 bp, Homo sapiens
attactttaatgat

SEQ ID NO: 5850289 - DNA, 23 bp, Homo sapiens
attactttatcactttttgaact

SEQ ID NO: 5850290 - DNA, 14 bp, Homo sapiens
attactttatgaac

SEQ ID NO: 5850291 - DNA, 18 bp, Homo sapiens
attactttcagaatgttg

SEQ ID NO: 5850292 - DNA, 22 bp, Homo sapiens
attactttcgtaatagctcaga

SEQ ID NO: 5850293 - DNA, 19 bp, Homo sapiens
attactttgtagatgtatt

SEQ ID NO: 5850294 - DNA, 15 bp, Homo sapiens
attactttgtctttt

SEQ ID NO: 5850295 - DNA, 18 bp, Homo sapiens
attactttgtcttttcaa

SEQ ID NO: 5850296 - DNA, 12 bp, Homo sapiens
attacttttaaa

SEQ ID NO: 5850297 - DNA, 16 bp, Homo sapiens
attacttttaaatatt

SEQ ID NO: 5850298 - DNA, 23 bp, Homo sapiens
attacttttcatctaacgtgcat

SEQ ID NO: 5850299 - DNA, 21 bp, Homo sapiens
attacttttccacaaatcagt

SEQ ID NO: 5850300 - DNA, 13 bp, Homo sapiens
attacttttgaaa

SEQ ID NO: 5850301 - DNA, 17 bp, Homo sapiens
attacttttgaaaaagg

SEQ ID NO: 5850302 - DNA, 13 bp, Homo sapiens
attacttttgtaa

SEQ ID NO: 5850303 - DNA, 15 bp, Homo sapiens
attacttttgtaaat

SEQ ID NO: 5850304 - DNA, 19 bp, Homo sapiens
attacttttgtaaatattc

SEQ ID NO: 5850305 - DNA, 14 bp, Homo sapiens
attactttttatgg

SEQ ID NO: 5850306 - DNA, 11 bp, Homo sapiens
attagaaaaaa

SEQ ID NO: 5850307 - DNA, 22 bp, Homo sapiens
attagaaaaaaattactaattt

SEQ ID NO: 5850308 - DNA, 20 bp, Homo sapiens
attagaaaaatatatgctta

SEQ ID NO: 5850309 - DNA, 14 bp, Homo sapiens
attagaaaaggaaa

SEQ ID NO: 5850310 - DNA, 13 bp, Homo sapiens
attagaaaatatt

SEQ ID NO: 5850311 - DNA, 17 bp, Homo sapiens
attagaaaatattctct

SEQ ID NO: 5850312 - DNA, 21 bp, Homo sapiens
attagaaaatattctctattt

SEQ ID NO: 5850313 - DNA, 14 bp, Homo sapiens
attagaaaatccta

SEQ ID NO: 5850314 - DNA, 22 bp, Homo sapiens
attagaaaatgttatttaacag

SEQ ID NO: 5850315 - DNA, 16 bp, Homo sapiens
attagaaacaaacaaa

SEQ ID NO: 5850316 - DNA, 22 bp, Homo sapiens
attagaaacacacttttgcaca

SEQ ID NO: 5850317 - DNA, 17 bp, Homo sapiens
attagaaacataaataa

SEQ ID NO: 5850318 - DNA, 20 bp, Homo sapiens
attagaaacccaaattggga

SEQ ID NO: 5850319 - DNA, 21 bp, Homo sapiens
attagaaacgtgataaatata

SEQ ID NO: 5850320 - DNA, 23 bp, Homo sapiens
attagaaactgaaaactgtaaat

SEQ ID NO: 5850321 - DNA, 19 bp, Homo sapiens
attagaaagattagtgatt

SEQ ID NO: 5850322 - DNA, 22 bp, Homo sapiens
attagaaagtgctgaatttaca

SEQ ID NO: 5850323 - DNA, 14 bp, Homo sapiens
attagaaatatttt

SEQ ID NO: 5850324 - DNA, 17 bp, Homo sapiens
attagaaatattttaaa

SEQ ID NO: 5850325 - DNA, 21 bp, Homo sapiens
attagaaatattttaaaatca

SEQ ID NO: 5850326 - DNA, 13 bp, Homo sapiens
attagaaatcaac

SEQ ID NO: 5850327 - DNA, 22 bp, Homo sapiens
attagaaattacctgtggatat

SEQ ID NO: 5850328 - DNA, 17 bp, Homo sapiens
attagaaattggctgga

SEQ ID NO: 5850329 - DNA, 14 bp, Homo sapiens
attagaaatttaac

SEQ ID NO: 5850330 - DNA, 15 bp, Homo sapiens
attagaaatttatat

SEQ ID NO: 5850331 - DNA, 18 bp, Homo sapiens
attagaacaatagctatt

SEQ ID NO: 5850332 - DNA, 18 bp, Homo sapiens
attagaacaggcaagtga

SEQ ID NO: 5850333 - DNA, 19 bp, Homo sapiens
attagaacaggcaagtgaa

SEQ ID NO: 5850334 - DNA, 23 bp, Homo sapiens
attagaacaggcaagtgaagaaa

SEQ ID NO: 5850335 - DNA, 16 bp, Homo sapiens
attagaacattcactt

SEQ ID NO: 5850336 - DNA, 17 bp, Homo sapiens
attagaacattcacttt

SEQ ID NO: 5850337 - DNA, 17 bp, Homo sapiens
attagaacatttaataa

SEQ ID NO: 5850338 - DNA, 18 bp, Homo sapiens
attagaacttagttttgt

SEQ ID NO: 5850339 - DNA, 11 bp, Homo sapiens
attagaacttc

SEQ ID NO: 5850340 - DNA, 12 bp, Homo sapiens
attagaagaaaa

SEQ ID NO: 5850341 - DNA, 14 bp, Homo sapiens
attagaagaaaaca

SEQ ID NO: 5850342 - DNA, 16 bp, Homo sapiens
attagaagaaaacata

SEQ ID NO: 5850343 - DNA, 17 bp, Homo sapiens
attagaagaaaacatat

SEQ ID NO: 5850344 - DNA, 18 bp, Homo sapiens
attagaagaaaacatata

SEQ ID NO: 5850345 - DNA, 21 bp, Homo sapiens
attagaagacaattgacaaca

SEQ ID NO: 5850346 - DNA, 17 bp, Homo sapiens
attagaagccaagacag

SEQ ID NO: 5850347 - DNA, 19 bp, Homo sapiens
attagaagccaagacagtg

SEQ ID NO: 5850348 - DNA, 19 bp, Homo sapiens
attatataacaaaaaaggt

SEQ ID NO: 5850349 - DNA, 22 bp, Homo sapiens
attatataacccactgctgaaa

SEQ ID NO: 5850350 - DNA, 16 bp, Homo sapiens
attatataactctttg

SEQ ID NO: 5850351 - DNA, 17 bp, Homo sapiens
attatataactctttga

SEQ ID NO: 5850352 - DNA, 19 bp, Homo sapiens
attatataactgtatttga

SEQ ID NO: 5850353 - DNA, 13 bp, Homo sapiens
attatataagcaa

SEQ ID NO: 5850354 - DNA, 17 bp, Homo sapiens
attatataagtattcta

SEQ ID NO: 5850355 - DNA, 14 bp, Homo sapiens
attatatacaaagc

SEQ ID NO: 5850356 - DNA, 17 bp, Homo sapiens
attatatacaaagctgt

SEQ ID NO: 5850357 - DNA, 17 bp, Homo sapiens
attatatagcagtaaaa

SEQ ID NO: 5850358 - DNA, 20 bp, Homo sapiens
attatataggatattgctaa

SEQ ID NO: 5850359 - DNA, 20 bp, Homo sapiens
attatataggttgtgcaaat

SEQ ID NO: 5850360 - DNA, 15 bp, Homo sapiens
attatatatacatta

SEQ ID NO: 5850361 - DNA, 16 bp, Homo sapiens
attatatatataatat

SEQ ID NO: 5850362 - DNA, 14 bp, Homo sapiens
attatatatatcta

SEQ ID NO: 5850363 - DNA, 12 bp, Homo sapiens
attatatatcat

SEQ ID NO: 5850364 - DNA, 17 bp, Homo sapiens
attatatatcataaagt

SEQ ID NO: 5850365 - DNA, 19 bp, Homo sapiens
attatatatcataaagtat

SEQ ID NO: 5850366 - DNA, 18 bp, Homo sapiens
attatatattgcaaggtg

SEQ ID NO: 5850367 - DNA, 19 bp, Homo sapiens
attatatattgcaaggtgt

SEQ ID NO: 5850368 - DNA, 18 bp, Homo sapiens
attatatatttacagaag

SEQ ID NO: 5850369 - DNA, 15 bp, Homo sapiens
attatatcaaagtat

SEQ ID NO: 5850370 - DNA, 18 bp, Homo sapiens
attatatcaaagtatttg

SEQ ID NO: 5850371 - DNA, 18 bp, Homo sapiens
attatatcagactgcttt

SEQ ID NO: 5850372 - DNA, 19 bp, Homo sapiens
attatatctaatttataca

SEQ ID NO: 5850373 - DNA, 21 bp, Homo sapiens
attatatctaatttatacaaa

SEQ ID NO: 5850374 - DNA, 22 bp, Homo sapiens
attatatctaatttatacaaaa

SEQ ID NO: 5850375 - DNA, 23 bp, Homo sapiens
attatatctcccccactccacta

SEQ ID NO: 5850376 - DNA, 15 bp, Homo sapiens
attatatctctgtat

SEQ ID NO: 5850377 - DNA, 12 bp, Homo sapiens
attatatgaagt

SEQ ID NO: 5850378 - DNA, 20 bp, Homo sapiens
attatatgaccatatttact

SEQ ID NO: 5850379 - DNA, 15 bp, Homo sapiens
attatatgatatgca

SEQ ID NO: 5850380 - DNA, 16 bp, Homo sapiens
attatatgatatgcat

SEQ ID NO: 5850381 - DNA, 16 bp, Homo sapiens
attatatgcctgattc

SEQ ID NO: 5850382 - DNA, 17 bp, Homo sapiens
attatatgcctgattca

SEQ ID NO: 5850383 - DNA, 16 bp, Homo sapiens
attatatgctatttct

SEQ ID NO: 5850384 - DNA, 17 bp, Homo sapiens
attatatgctatttcta

SEQ ID NO: 5850385 - DNA, 16 bp, Homo sapiens
attatatggaaatata

SEQ ID NO: 5850386 - DNA, 16 bp, Homo sapiens
attatatggcaggagc

SEQ ID NO: 5850387 - DNA, 13 bp, Homo sapiens
attatatgtatta

SEQ ID NO: 5850388 - DNA, 14 bp, Homo sapiens
attatattaatata

SEQ ID NO: 5850389 - DNA, 15 bp, Homo sapiens
attatattataataa

SEQ ID NO: 5850390 - DNA, 14 bp, Homo sapiens
attatattatgaag

SEQ ID NO: 5850391 - DNA, 15 bp, Homo sapiens
attatattatgaata

SEQ ID NO: 5850392 - DNA, 20 bp, Homo sapiens
attatattatgaataaaatt

SEQ ID NO: 5850393 - DNA, 13 bp, Homo sapiens
attatattcacag

SEQ ID NO: 5850394 - DNA, 14 bp, Homo sapiens
attatattcacaga

SEQ ID NO: 5850395 - DNA, 16 bp, Homo sapiens
attatattcattcttt

SEQ ID NO: 5850396 - DNA, 18 bp, Homo sapiens
attatattctaattaaaa

SEQ ID NO: 5850397 - DNA, 22 bp, Homo sapiens
attatattctaattaaaattgt

SEQ ID NO: 5850398 - DNA, 14 bp, Homo sapiens
attatattctctta

SEQ ID NO: 5850399 - DNA, 12 bp, Homo sapiens
attatattctgt

SEQ ID NO: 5850400 - DNA, 15 bp, Homo sapiens
attatattgcaatga

SEQ ID NO: 5850401 - DNA, 13 bp, Homo sapiens
attatattggtgg

SEQ ID NO: 5850402 - DNA, 20 bp, Homo sapiens
attatattggtggttctcag

SEQ ID NO: 5850403 - DNA, 12 bp, Homo sapiens
attatattgttt

SEQ ID NO: 5850404 - DNA, 19 bp, Homo sapiens
attatattgttttataaat

SEQ ID NO: 5850405 - DNA, 20 bp, Homo sapiens
attatattgttttataaatg

SEQ ID NO: 5850406 - DNA, 16 bp, Homo sapiens
attatattgttttttt

SEQ ID NO: 5850407 - DNA, 11 bp, Homo sapiens
attatatttac

SEQ ID NO: 5850408 - DNA, 18 bp, Homo sapiens
attatatttattactgta

SEQ ID NO: 5850409 - DNA, 20 bp, Homo sapiens
attatatttgacatgggtat

SEQ ID NO: 5850410 - DNA, 20 bp, Homo sapiens
attatatttgagtttctttc

SEQ ID NO: 5850411 - DNA, 12 bp, Homo sapiens
attatatttgca

SEQ ID NO: 5850412 - DNA, 18 bp, Homo sapiens
attatatttgcattatgt

SEQ ID NO: 5850413 - DNA, 17 bp, Homo sapiens
attatatttggatgcag

SEQ ID NO: 5850414 - DNA, 19 bp, Homo sapiens
attatatttgtgctatagt

SEQ ID NO: 5850415 - DNA, 18 bp, Homo sapiens
attatcaaaaaacagaaa

SEQ ID NO: 5850416 - DNA, 20 bp, Homo sapiens
attatcaaagggataaagaa

SEQ ID NO: 5850417 - DNA, 19 bp, Homo sapiens
attatcaatatctaatata

SEQ ID NO: 5850418 - DNA, 14 bp, Homo sapiens
attatcacatcaag

SEQ ID NO: 5850419 - DNA, 21 bp, Homo sapiens
attatcacatgattatagaag

SEQ ID NO: 5850420 - DNA, 20 bp, Homo sapiens
attatcacattaatctcaaa

SEQ ID NO: 5850421 - DNA, 19 bp, Homo sapiens
attatcaccaggatttata

SEQ ID NO: 5850422 - DNA, 11 bp, Homo sapiens
attatcactgt

SEQ ID NO: 5850423 - DNA, 16 bp, Homo sapiens
attatcagcaaagaaa

SEQ ID NO: 5850424 - DNA, 21 bp, Homo sapiens
attatcaggcaaatttgcatt

SEQ ID NO: 5850425 - DNA, 17 bp, Homo sapiens
attatcagtagaaagag

SEQ ID NO: 5850426 - DNA, 16 bp, Homo sapiens
attatcagtgaatata

SEQ ID NO: 5850427 - DNA, 18 bp, Homo sapiens
attatcagtgaatataaa

SEQ ID NO: 5850428 - DNA, 22 bp, Homo sapiens
attatcagtgaatataaatgta

SEQ ID NO: 5850429 - DNA, 21 bp, Homo sapiens
attatcagttaaaatcacatt

SEQ ID NO: 5850430 - DNA, 15 bp, Homo sapiens
attatcagttatatt

SEQ ID NO: 5850431 - DNA, 15 bp, Homo sapiens
attatcataagaatt

SEQ ID NO: 5850432 - DNA, 22 bp, Homo sapiens
attatcatatatgcttttttgc

SEQ ID NO: 5850433 - DNA, 22 bp, Homo sapiens
attatcatcctataaagaaacg

SEQ ID NO: 5850434 - DNA, 17 bp, Homo sapiens
attatcatgcaaatgct

SEQ ID NO: 5850435 - DNA, 12 bp, Homo sapiens
attatcatgtgt

SEQ ID NO: 5850436 - DNA, 13 bp, Homo sapiens
attatcatgtgta

SEQ ID NO: 5850437 - DNA, 21 bp, Homo sapiens
attatcatgtgtaatcaataa

SEQ ID NO: 5850438 - DNA, 17 bp, Homo sapiens
attatcattcaaaacaa

SEQ ID NO: 5850439 - DNA, 19 bp, Homo sapiens
attatccatcctctgagat

SEQ ID NO: 5850440 - DNA, 20 bp, Homo sapiens
attatccattacgtgcattt

SEQ ID NO: 5850441 - DNA, 21 bp, Homo sapiens
attatccattcccaagatgcc

SEQ ID NO: 5850442 - DNA, 22 bp, Homo sapiens
attatccattcccaagatgcct

SEQ ID NO: 5850443 - DNA, 16 bp, Homo sapiens
attatcctaagggaag

SEQ ID NO: 5850444 - DNA, 16 bp, Homo sapiens
attatcctagattata

SEQ ID NO: 5850445 - DNA, 23 bp, Homo sapiens
attatcctcaagttgtgtgctat

SEQ ID NO: 5850446 - DNA, 18 bp, Homo sapiens
attatcctcctgttctga

SEQ ID NO: 5850447 - DNA, 17 bp, Homo sapiens
attatcctctttgtaat

SEQ ID NO: 5850448 - DNA, 21 bp, Homo sapiens
attatcctgaactcttctgca

SEQ ID NO: 5850449 - DNA, 14 bp, Homo sapiens
attatcctgtgtga

SEQ ID NO: 5850450 - DNA, 19 bp, Homo sapiens
attatccttcacaatttca

SEQ ID NO: 5850451 - DNA, 18 bp, Homo sapiens
attatcgccttttgacag

SEQ ID NO: 5850452 - DNA, 16 bp, Homo sapiens
attatcggaagcagtg

SEQ ID NO: 5850453 - DNA, 20 bp, Homo sapiens
attatcgggaacagtgtttc

SEQ ID NO: 5850454 - DNA, 20 bp, Homo sapiens
attatcgggagcagtgtctt

SEQ ID NO: 5850455 - DNA, 19 bp, Homo sapiens
attatcgttttcttaaagt

SEQ ID NO: 5850456 - DNA, 17 bp, Homo sapiens
attatctaaagtgtgtt

SEQ ID NO: 5850457 - DNA, 23 bp, Homo sapiens
attatctaaagtgtgttgttgct

SEQ ID NO: 5850458 - DNA, 14 bp, Homo sapiens
attatctaaatgaa

SEQ ID NO: 5850459 - DNA, 16 bp, Homo sapiens
attatctaaatgaatg

SEQ ID NO: 5850460 - DNA, 14 bp, Homo sapiens
attatctagatact

SEQ ID NO: 5850461 - DNA, 14 bp, Homo sapiens
attatctatacata

SEQ ID NO: 5850462 - DNA, 20 bp, Homo sapiens
attatctatacatatcttta

SEQ ID NO: 5850463 - DNA, 18 bp, Homo sapiens
attatctatggaaatgtg

SEQ ID NO: 5850464 - DNA, 15 bp, Homo sapiens
attatctatttgtat

SEQ ID NO: 5850465 - DNA, 19 bp, Homo sapiens
attatctatttgtgtgtgt

SEQ ID NO: 5850466 - DNA, 23 bp, Homo sapiens
attatctcaaaactgcactgtca

SEQ ID NO: 5850467 - DNA, 14 bp, Homo sapiens
attatctcaagtaa

SEQ ID NO: 5850468 - DNA, 13 bp, Homo sapiens
attatctcacttt

SEQ ID NO: 5850469 - DNA, 20 bp, Homo sapiens
attatctcctttgaagaagg

SEQ ID NO: 5850470 - DNA, 16 bp, Homo sapiens
attatctctttctctc

SEQ ID NO: 5850471 - DNA, 12 bp, Homo sapiens
attatctctttg

SEQ ID NO: 5850472 - DNA, 22 bp, Homo sapiens
attatctgatcgggataacaaa

SEQ ID NO: 5850473 - DNA, 12 bp, Homo sapiens
attatctgcctt

SEQ ID NO: 5850474 - DNA, 14 bp, Homo sapiens
attatctgggctta

SEQ ID NO: 5850475 - DNA, 23 bp, Homo sapiens
attatctgggttttagaaattct

SEQ ID NO: 5850476 - DNA, 16 bp, Homo sapiens
attatctgtaaaaatt

SEQ ID NO: 5850477 - DNA, 15 bp, Homo sapiens
attatctgtactgaa

SEQ ID NO: 5850478 - DNA, 23 bp, Homo sapiens
attatctgtactgaaagcaaatg

SEQ ID NO: 5850479 - DNA, 14 bp, Homo sapiens
attatctgttctat

SEQ ID NO: 5850480 - DNA, 18 bp, Homo sapiens
attatctgttctatggac

SEQ ID NO: 5850481 - DNA, 12 bp, Homo sapiens
attatcttaaaa

SEQ ID NO: 5850482 - DNA, 13 bp, Homo sapiens
attatcttaaacc

SEQ ID NO: 5850483 - DNA, 21 bp, Homo sapiens
attatcttaaacccacataaa

SEQ ID NO: 5850484 - DNA, 22 bp, Homo sapiens
attatcttaaacccacataaac

SEQ ID NO: 5850485 - DNA, 14 bp, Homo sapiens
attatcttacgttt

SEQ ID NO: 5850486 - DNA, 22 bp, Homo sapiens
attatcttacttgcaaaatgga

SEQ ID NO: 5850487 - DNA, 20 bp, Homo sapiens
attatcttagtctatagaaa

SEQ ID NO: 5850488 - DNA, 13 bp, Homo sapiens
attatcttatgaa

SEQ ID NO: 5850489 - DNA, 21 bp, Homo sapiens
attatcttcaccctcatcctt

SEQ ID NO: 5850490 - DNA, 14 bp, Homo sapiens
attatcttcatgtt

SEQ ID NO: 5850491 - DNA, 19 bp, Homo sapiens
attatcttctggtgcatgt

SEQ ID NO: 5850492 - DNA, 23 bp, Homo sapiens
attatcttctggtgcatgttctt

SEQ ID NO: 5850493 - DNA, 12 bp, Homo sapiens
attatcttgaaa

SEQ ID NO: 5850494 - DNA, 17 bp, Homo sapiens
attatcttgatttccca

SEQ ID NO: 5850495 - DNA, 17 bp, Homo sapiens
attatcttgctcattct

SEQ ID NO: 5850496 - DNA, 22 bp, Homo sapiens
attatctttagttgaattccaa

SEQ ID NO: 5850497 - DNA, 15 bp, Homo sapiens
attatctttgctgtt

SEQ ID NO: 5850498 - DNA, 22 bp, Homo sapiens
attatcttttcaaaggtacttg

SEQ ID NO: 5850499 - DNA, 18 bp, Homo sapiens
attatcttttggctctga

SEQ ID NO: 5850500 - DNA, 13 bp, Homo sapiens
attatgaaaaaca

SEQ ID NO: 5850501 - DNA, 17 bp, Homo sapiens
attatgaaaagaaataa

SEQ ID NO: 5850502 - DNA, 13 bp, Homo sapiens
attatgaaaataa

SEQ ID NO: 5850503 - DNA, 14 bp, Homo sapiens
attatgaaaatctt

SEQ ID NO: 5850504 - DNA, 21 bp, Homo sapiens
attatgaaaatgtaagttatg

SEQ ID NO: 5850505 - DNA, 18 bp, Homo sapiens
attatgaaacttgtgtaa

SEQ ID NO: 5850506 - DNA, 14 bp, Homo sapiens
attatgaaatgcca

SEQ ID NO: 5850507 - DNA, 16 bp, Homo sapiens
attatgaaatgccaga

SEQ ID NO: 5850508 - DNA, 12 bp, Homo sapiens
attatgaagaat

SEQ ID NO: 5850509 - DNA, 14 bp, Homo sapiens
attatgaagatgtt

SEQ ID NO: 5850510 - DNA, 16 bp, Homo sapiens
attatgaagatgtttt

SEQ ID NO: 5850511 - DNA, 16 bp, Homo sapiens
attatgaagctcatat

SEQ ID NO: 5850512 - DNA, 20 bp, Homo sapiens
attatgaaggaatttgattg

SEQ ID NO: 5850513 - DNA, 21 bp, Homo sapiens
attatgaaggaatttgattgc

SEQ ID NO: 5850514 - DNA, 20 bp, Homo sapiens
attatgaattacatttgtat

SEQ ID NO: 5850515 - DNA, 12 bp, Homo sapiens
attatgacagtt

SEQ ID NO: 5850516 - DNA, 17 bp, Homo sapiens
attatgacatttcttaa

SEQ ID NO: 5850517 - DNA, 23 bp, Homo sapiens
attatgacatttcttaaaacttt

SEQ ID NO: 5850518 - DNA, 23 bp, Homo sapiens
attatgagacacaggatgaagca

SEQ ID NO: 5850519 - DNA, 22 bp, Homo sapiens
attatgagctatcctttcaaac

SEQ ID NO: 5850520 - DNA, 14 bp, Homo sapiens
attatgaggaaact

SEQ ID NO: 5850521 - DNA, 22 bp, Homo sapiens
attatgaggaaacttggacatt

SEQ ID NO: 5850522 - DNA, 20 bp, Homo sapiens
attatgagtctctatgatct

SEQ ID NO: 5850523 - DNA, 19 bp, Homo sapiens
attatgagttttaagaagg

SEQ ID NO: 5850524 - DNA, 12 bp, Homo sapiens
attatgataaag

SEQ ID NO: 5850525 - DNA, 12 bp, Homo sapiens
attatgatattt

SEQ ID NO: 5850526 - DNA, 21 bp, Homo sapiens
attcaaaaaactctctcccag

SEQ ID NO: 5850527 - DNA, 22 bp, Homo sapiens
attcaaaaaactctctcccagg

SEQ ID NO: 5850528 - DNA, 23 bp, Homo sapiens
attcaaaaagacagcagacaaaa

SEQ ID NO: 5850529 - DNA, 19 bp, Homo sapiens
attcaaaaagtcacagtta

SEQ ID NO: 5850530 - DNA, 14 bp, Homo sapiens
attcaaaaagtgtt

SEQ ID NO: 5850531 - DNA, 12 bp, Homo sapiens
attcaaaaatgt

SEQ ID NO: 5850532 - DNA, 16 bp, Homo sapiens
attcaaaaatgtacaa

SEQ ID NO: 5850533 - DNA, 14 bp, Homo sapiens
attcaaaaattata

SEQ ID NO: 5850534 - DNA, 19 bp, Homo sapiens
attcaaaaattatattttg

SEQ ID NO: 5850535 - DNA, 22 bp, Homo sapiens
attcaaaaattatattttgaac

SEQ ID NO: 5850536 - DNA, 15 bp, Homo sapiens
attcaaaagattaat

SEQ ID NO: 5850537 - DNA, 19 bp, Homo sapiens
attcaaaagattaatgtgt

SEQ ID NO: 5850538 - DNA, 13 bp, Homo sapiens
attcaaaagcaca

SEQ ID NO: 5850539 - DNA, 14 bp, Homo sapiens
attcaaaagcacaa

SEQ ID NO: 5850540 - DNA, 21 bp, Homo sapiens
attcaaaagtaagaatgcaaa

SEQ ID NO: 5850541 - DNA, 21 bp, Homo sapiens
attcaaaagtattgaaagcca

SEQ ID NO: 5850542 - DNA, 22 bp, Homo sapiens
attcaaaagtgaacttgatttt

SEQ ID NO: 5850543 - DNA, 16 bp, Homo sapiens
attcaaaagttccaag

SEQ ID NO: 5850544 - DNA, 18 bp, Homo sapiens
attcaaaataaacaataa

SEQ ID NO: 5850545 - DNA, 18 bp, Homo sapiens
attcaaaatactttttaa

SEQ ID NO: 5850546 - DNA, 20 bp, Homo sapiens
attcaaaatagggtatattt

SEQ ID NO: 5850547 - DNA, 22 bp, Homo sapiens
attcaaaatatttaaaaatgtc

SEQ ID NO: 5850548 - DNA, 16 bp, Homo sapiens
attcaaaatcttcact

SEQ ID NO: 5850549 - DNA, 16 bp, Homo sapiens
attcaaaatgctctaa

SEQ ID NO: 5850550 - DNA, 21 bp, Homo sapiens
attcaaaattgacattgcttt

SEQ ID NO: 5850551 - DNA, 21 bp, Homo sapiens
attcaaacaattcaatcaaag

SEQ ID NO: 5850552 - DNA, 13 bp, Homo sapiens
attcaaacacaca

SEQ ID NO: 5850553 - DNA, 14 bp, Homo sapiens
attcaaacacacag

SEQ ID NO: 5850554 - DNA, 15 bp, Homo sapiens
attcaaacagtctca

SEQ ID NO: 5850555 - DNA, 16 bp, Homo sapiens
attcaaacagtctcag

SEQ ID NO: 5850556 - DNA, 18 bp, Homo sapiens
attcaaacagtctcagga

SEQ ID NO: 5850557 - DNA, 13 bp, Homo sapiens
attcaaacatatt

SEQ ID NO: 5850558 - DNA, 16 bp, Homo sapiens
attcaaacatattctt

SEQ ID NO: 5850559 - DNA, 20 bp, Homo sapiens
attcaaaccaaagctgcctg

SEQ ID NO: 5850560 - DNA, 20 bp, Homo sapiens
attcaaaccaatttcttcct

SEQ ID NO: 5850561 - DNA, 21 bp, Homo sapiens
attcaaaccaatttcttcctt

SEQ ID NO: 5850562 - DNA, 12 bp, Homo sapiens
attcaaaccatt

SEQ ID NO: 5850563 - DNA, 13 bp, Homo sapiens
attcaaaccattt

SEQ ID NO: 5850564 - DNA, 17 bp, Homo sapiens
attcaaacccaggctgt

SEQ ID NO: 5850565 - DNA, 16 bp, Homo sapiens
attcaaacctgcatat

SEQ ID NO: 5850566 - DNA, 18 bp, Homo sapiens
attcaaactgaaaagctg

SEQ ID NO: 5850567 - DNA, 12 bp, Homo sapiens
attcaaactgca

SEQ ID NO: 5850568 - DNA, 19 bp, Homo sapiens
attcaaactgcacttttag

SEQ ID NO: 5850569 - DNA, 18 bp, Homo sapiens
attcaaactgctccaagt

SEQ ID NO: 5850570 - DNA, 23 bp, Homo sapiens
attcaaagaaaaccctaagtgtg

SEQ ID NO: 5850571 - DNA, 13 bp, Homo sapiens
attcaaagaagta

SEQ ID NO: 5850572 - DNA, 21 bp, Homo sapiens
attcaaagaatcacctaatta

SEQ ID NO: 5850573 - DNA, 13 bp, Homo sapiens
attcaaagagaaa

SEQ ID NO: 5850574 - DNA, 14 bp, Homo sapiens
attcaaagagacta

SEQ ID NO: 5850575 - DNA, 13 bp, Homo sapiens
attcaaagcataa

SEQ ID NO: 5850576 - DNA, 19 bp, Homo sapiens
attcaaagcataaaacttt

SEQ ID NO: 5850577 - DNA, 15 bp, Homo sapiens
attcaaaggttctag

SEQ ID NO: 5850578 - DNA, 21 bp, Homo sapiens
attcaaagtgttgtgttcctg

SEQ ID NO: 5850579 - DNA, 18 bp, Homo sapiens
attcaaagttgcctaaat

SEQ ID NO: 5850580 - DNA, 20 bp, Homo sapiens
attcaaagttgcctaaatcc

SEQ ID NO: 5850581 - DNA, 22 bp, Homo sapiens
attcaaataaccctgaatcaga

SEQ ID NO: 5850582 - DNA, 14 bp, Homo sapiens
attcaaatatcaaa

SEQ ID NO: 5850583 - DNA, 15 bp, Homo sapiens
attcaaatcagtgat

SEQ ID NO: 5850584 - DNA, 15 bp, Homo sapiens
attcaaatcctcttt

SEQ ID NO: 5850585 - DNA, 16 bp, Homo sapiens
attcaaatcctctttt

SEQ ID NO: 5850586 - DNA, 17 bp, Homo sapiens
attcaaatcctcttttg

SEQ ID NO: 5850587 - DNA, 18 bp, Homo sapiens
attcaaatgaactttaaa

SEQ ID NO: 5850588 - DNA, 14 bp, Homo sapiens
attcaaatgaagat

SEQ ID NO: 5850589 - DNA, 11 bp, Homo sapiens
attcaaatgca

SEQ ID NO: 5850590 - DNA, 13 bp, Homo sapiens
attcaaatgcatg

SEQ ID NO: 5850591 - DNA, 14 bp, Homo sapiens
attcaaatgcatga

SEQ ID NO: 5850592 - DNA, 15 bp, Homo sapiens
attcaaatgcatgat

SEQ ID NO: 5850593 - DNA, 16 bp, Homo sapiens
attcaaatgcatgata

SEQ ID NO: 5850594 - DNA, 15 bp, Homo sapiens
attcaaatgcttttt

SEQ ID NO: 5850595 - DNA, 15 bp, Homo sapiens
attcaaatgttacaa

SEQ ID NO: 5850596 - DNA, 14 bp, Homo sapiens
attcaaatgtttta

SEQ ID NO: 5850597 - DNA, 18 bp, Homo sapiens
attcaaattgctgcttgg

SEQ ID NO: 5850598 - DNA, 16 bp, Homo sapiens
attcaaatttgatgat

SEQ ID NO: 5850599 - DNA, 14 bp, Homo sapiens
attcaaatttgtaa

SEQ ID NO: 5850600 - DNA, 14 bp, Homo sapiens
attcaaatttgtac

SEQ ID NO: 5850601 - DNA, 16 bp, Homo sapiens
attcaacaaagtattt

SEQ ID NO: 5850602 - DNA, 17 bp, Homo sapiens
attcaacaatttcaata

SEQ ID NO: 5850603 - DNA, 12 bp, Homo sapiens
attcaacacact

SEQ ID NO: 5850604 - DNA, 22 bp, Homo sapiens
attcaacacactgccttattac

SEQ ID NO: 5850605 - DNA, 15 bp, Homo sapiens
attcaacacattact

SEQ ID NO: 5850606 - DNA, 21 bp, Homo sapiens
attcaacacattacttgcaca

SEQ ID NO: 5850607 - DNA, 14 bp, Homo sapiens
attcaacacttatt

SEQ ID NO: 5850608 - DNA, 18 bp, Homo sapiens
attcaacacttattttct

SEQ ID NO: 5850609 - DNA, 19 bp, Homo sapiens
attcaacacttattttctg

SEQ ID NO: 5850610 - DNA, 14 bp, Homo sapiens
attcaacatcaatt

SEQ ID NO: 5850611 - DNA, 17 bp, Homo sapiens
attcaaccatggacttt

SEQ ID NO: 5850612 - DNA, 21 bp, Homo sapiens
attcaaccatggactttataa

SEQ ID NO: 5850613 - DNA, 23 bp, Homo sapiens
attcaacccatttactttggtca

SEQ ID NO: 5850614 - DNA, 14 bp, Homo sapiens
attcaacctgtgtc

SEQ ID NO: 5850615 - DNA, 18 bp, Homo sapiens
attcaaccttaccaaaaa

SEQ ID NO: 5850616 - DNA, 20 bp, Homo sapiens
attcaactaatacatggttt

SEQ ID NO: 5850617 - DNA, 14 bp, Homo sapiens
attcaactattctt

SEQ ID NO: 5850618 - DNA, 18 bp, Homo sapiens
attcaactttgtaaaaat

SEQ ID NO: 5850619 - DNA, 19 bp, Homo sapiens
attcaagaaaagtaagccc

SEQ ID NO: 5850620 - DNA, 13 bp, Homo sapiens
attcaagaaagat

SEQ ID NO: 5850621 - DNA, 23 bp, Homo sapiens
attcaagaaagccagtcttaaca

SEQ ID NO: 5850622 - DNA, 12 bp, Homo sapiens
attcaagaacat

SEQ ID NO: 5850623 - DNA, 21 bp, Homo sapiens
attcaagaagatagttgtaaa

SEQ ID NO: 5850624 - DNA, 16 bp, Homo sapiens
attcaagaatgaaaaa

SEQ ID NO: 5850625 - DNA, 18 bp, Homo sapiens
attcaagaatgaaaaata

SEQ ID NO: 5850626 - DNA, 18 bp, Homo sapiens
attcaagacaagagctgt

SEQ ID NO: 5850627 - DNA, 13 bp, Homo sapiens
attcaagattccc

SEQ ID NO: 5850628 - DNA, 13 bp, Homo sapiens
attcaagcaaaca

SEQ ID NO: 5850629 - DNA, 15 bp, Homo sapiens
attcaagcaaacatc

SEQ ID NO: 5850630 - DNA, 22 bp, Homo sapiens
attcaagcaaacatcaaataaa

SEQ ID NO: 5850631 - DNA, 17 bp, Homo sapiens
attcaagcaacagcact

SEQ ID NO: 5850632 - DNA, 16 bp, Homo sapiens
attcaagcctgtgaat

SEQ ID NO: 5850633 - DNA, 22 bp, Homo sapiens
attcaagcctgtgaataaaaac

SEQ ID NO: 5850634 - DNA, 18 bp, Homo sapiens
attcaagctatttaatat

SEQ ID NO: 5850635 - DNA, 21 bp, Homo sapiens
attcaagctatttaatatctg

SEQ ID NO: 5850636 - DNA, 20 bp, Homo sapiens
attcaagcttcatatatgct

SEQ ID NO: 5850637 - DNA, 16 bp, Homo sapiens
attcaaggaatttctt

SEQ ID NO: 5850638 - DNA, 20 bp, Homo sapiens
attcaaggaatttcttaact

SEQ ID NO: 5850639 - DNA, 22 bp, Homo sapiens
attcaaggaatttcttaacttc

SEQ ID NO: 5850640 - DNA, 19 bp, Homo sapiens
attcaaggagaatatgata

SEQ ID NO: 5850641 - DNA, 19 bp, Homo sapiens
attcaaggagatataaaat

SEQ ID NO: 5850642 - DNA, 17 bp, Homo sapiens
attcaaggcattatttg

SEQ ID NO: 5850643 - DNA, 21 bp, Homo sapiens
attcaaggcatttctatcaca

SEQ ID NO: 5850644 - DNA, 21 bp, Homo sapiens
attcaaggccacaaaaacaat

SEQ ID NO: 5850645 - DNA, 10 bp, Homo sapiens
attcaagtaa

SEQ ID NO: 5850646 - DNA, 16 bp, Homo sapiens
attcaagtaacacttt

SEQ ID NO: 5850647 - DNA, 12 bp, Homo sapiens
attcaagtatta

SEQ ID NO: 5850648 - DNA, 21 bp, Homo sapiens
attcaagtgacacattaatga

SEQ ID NO: 5850649 - DNA, 21 bp, Homo sapiens
attcaagtgataggataaagt

SEQ ID NO: 5850650 - DNA, 21 bp, Homo sapiens
attcaagtgcctcttgttgca

SEQ ID NO: 5850651 - DNA, 20 bp, Homo sapiens
attcaagtgtaaaatatttt

SEQ ID NO: 5850652 - DNA, 16 bp, Homo sapiens
attcaagtgtacagtg

SEQ ID NO: 5850653 - DNA, 14 bp, Homo sapiens
attcaagttaccaa

SEQ ID NO: 5850654 - DNA, 15 bp, Homo sapiens
attcaagttattgta

SEQ ID NO: 5850655 - DNA, 16 bp, Homo sapiens
attcaagttattgtac

SEQ ID NO: 5850656 - DNA, 12 bp, Homo sapiens
attcaataaaaa

SEQ ID NO: 5850657 - DNA, 21 bp, Homo sapiens
attcaataaaaaaaagaaatg

SEQ ID NO: 5850658 - DNA, 22 bp, Homo sapiens
attcaataaaaaaaagaaatga

SEQ ID NO: 5850659 - DNA, 17 bp, Homo sapiens
attcaataaagtattta

SEQ ID NO: 5850660 - DNA, 21 bp, Homo sapiens
attcaatacaaacaatctctt

SEQ ID NO: 5850661 - DNA, 13 bp, Homo sapiens
attcaataccgct

SEQ ID NO: 5850662 - DNA, 19 bp, Homo sapiens
attcaatatcctttgcctc

SEQ ID NO: 5850663 - DNA, 13 bp, Homo sapiens
attcaatatctga

SEQ ID NO: 5850664 - DNA, 14 bp, Homo sapiens
attcaatattgaat

SEQ ID NO: 5850665 - DNA, 21 bp, Homo sapiens
attcaatattgaatttttcct

SEQ ID NO: 5850666 - DNA, 13 bp, Homo sapiens
attcaatattgac

SEQ ID NO: 5850667 - DNA, 16 bp, Homo sapiens
attcaatattgacatt

SEQ ID NO: 5850668 - DNA, 18 bp, Homo sapiens
attcaatcaaagctacct

SEQ ID NO: 5850669 - DNA, 20 bp, Homo sapiens
attcaatcagagctccagtt

SEQ ID NO: 5850670 - DNA, 18 bp, Homo sapiens
attcaatcatttattcat

SEQ ID NO: 5850671 - DNA, 18 bp, Homo sapiens
attcaatcattttgggaa

SEQ ID NO: 5850672 - DNA, 18 bp, Homo sapiens
attcaatctgtaaactgt

SEQ ID NO: 5850673 - DNA, 17 bp, Homo sapiens
attcaatgcatttaaaa

SEQ ID NO: 5850674 - DNA, 20 bp, Homo sapiens
attcaatgcccctgaattta

SEQ ID NO: 5850675 - DNA, 18 bp, Homo sapiens
attcaatgcttgatgtta

SEQ ID NO: 5850676 - DNA, 20 bp, Homo sapiens
attcaatgcttgatgttaca

SEQ ID NO: 5850677 - DNA, 19 bp, Homo sapiens
attcaatgggtaaataaat

SEQ ID NO: 5850678 - DNA, 13 bp, Homo sapiens
attcaatgtgaat

SEQ ID NO: 5850679 - DNA, 16 bp, Homo sapiens
attcaattaaaaccat

SEQ ID NO: 5850680 - DNA, 17 bp, Homo sapiens
attcaattaaagaaata

SEQ ID NO: 5850681 - DNA, 19 bp, Homo sapiens
attcaattaaagaaataat

SEQ ID NO: 5850682 - DNA, 21 bp, Homo sapiens
attcaattaaagaaataattt

SEQ ID NO: 5850683 - DNA, 22 bp, Homo sapiens
attcaattaaagaaataatttt

SEQ ID NO: 5850684 - DNA, 12 bp, Homo sapiens
attcaattagtg

SEQ ID NO: 5850685 - DNA, 22 bp, Homo sapiens
attcaattagtggtcataaaat

SEQ ID NO: 5850686 - DNA, 18 bp, Homo sapiens
attcaattataattgtaa

SEQ ID NO: 5850687 - DNA, 16 bp, Homo sapiens
attcaattcaaagctg

SEQ ID NO: 5850688 - DNA, 18 bp, Homo sapiens
attcaattgtaaattgaa

SEQ ID NO: 5850689 - DNA, 15 bp, Homo sapiens
attcaatttctcaca

SEQ ID NO: 5850690 - DNA, 20 bp, Homo sapiens
attcaatttctcacaataga

SEQ ID NO: 5850691 - DNA, 16 bp, Homo sapiens
attcaatttgatgtgg

SEQ ID NO: 5850692 - DNA, 22 bp, Homo sapiens
attcaatttgattctatgactg

SEQ ID NO: 5850693 - DNA, 21 bp, Homo sapiens
attcaatttgctatttacaaa

SEQ ID NO: 5850694 - DNA, 14 bp, Homo sapiens
attcaatttggcaa

SEQ ID NO: 5850695 - DNA, 15 bp, Homo sapiens
attcacaaaaattga

SEQ ID NO: 5850696 - DNA, 13 bp, Homo sapiens
attcacaaacttt

SEQ ID NO: 5850697 - DNA, 14 bp, Homo sapiens
attcacaaactttt

SEQ ID NO: 5850698 - DNA, 17 bp, Homo sapiens
attcacaaagtaatttg

SEQ ID NO: 5850699 - DNA, 17 bp, Homo sapiens
attcacaacctcaccaa

SEQ ID NO: 5850700 - DNA, 19 bp, Homo sapiens
attcacaacctcaccaaac

SEQ ID NO: 5850701 - DNA, 21 bp, Homo sapiens
attcacaacctcaccaaacta

SEQ ID NO: 5850702 - DNA, 18 bp, Homo sapiens
attcacaactaggacctc

SEQ ID NO: 5850703 - DNA, 19 bp, Homo sapiens
attcacaactaggacctca

SEQ ID NO: 5850704 - DNA, 14 bp, Homo sapiens
attcatgtaacagt

SEQ ID NO: 5850705 - DNA, 15 bp, Homo sapiens
attcatgtaataaat

SEQ ID NO: 5850706 - DNA, 18 bp, Homo sapiens
attcatgtaataaatctg

SEQ ID NO: 5850707 - DNA, 20 bp, Homo sapiens
attcatgtacaatgatgtaa

SEQ ID NO: 5850708 - DNA, 21 bp, Homo sapiens
attcatgtacaatgatgtaaa

SEQ ID NO: 5850709 - DNA, 16 bp, Homo sapiens
attcatgtagtttctg

SEQ ID NO: 5850710 - DNA, 16 bp, Homo sapiens
attcatgtgcttgtgc

SEQ ID NO: 5850711 - DNA, 19 bp, Homo sapiens
attcatgtgtaggaagagg

SEQ ID NO: 5850712 - DNA, 17 bp, Homo sapiens
attcatgttatatttaa

SEQ ID NO: 5850713 - DNA, 13 bp, Homo sapiens
attcatgttcatg

SEQ ID NO: 5850714 - DNA, 14 bp, Homo sapiens
attcatgttcatgt

SEQ ID NO: 5850715 - DNA, 22 bp, Homo sapiens
attcatgtttaacgtttctcat

SEQ ID NO: 5850716 - DNA, 21 bp, Homo sapiens
attcatgttttgagacataaa

SEQ ID NO: 5850717 - DNA, 17 bp, Homo sapiens
attcattaaaaacattt

SEQ ID NO: 5850718 - DNA, 17 bp, Homo sapiens
attcattaaaagtttta

SEQ ID NO: 5850719 - DNA, 15 bp, Homo sapiens
attcattaaatgttt

SEQ ID NO: 5850720 - DNA, 18 bp, Homo sapiens
attcattaatctgtttgt

SEQ ID NO: 5850721 - DNA, 24 bp, Homo sapiens
attcattaatctgtttgtttggca

SEQ ID NO: 5850722 - DNA, 15 bp, Homo sapiens
attcattagtcatgt

SEQ ID NO: 5850723 - DNA, 19 bp, Homo sapiens
attcattatgtcaattcat

SEQ ID NO: 5850724 - DNA, 15 bp, Homo sapiens
attcattattcctca

SEQ ID NO: 5850725 - DNA, 16 bp, Homo sapiens
attcattattcctcag

SEQ ID NO: 5850726 - DNA, 16 bp, Homo sapiens
attcattatttgtcaa

SEQ ID NO: 5850727 - DNA, 18 bp, Homo sapiens
attcattcactcttcctg

SEQ ID NO: 5850728 - DNA, 16 bp, Homo sapiens
attcattcactgtata

SEQ ID NO: 5850729 - DNA, 23 bp, Homo sapiens
attcattcagtgagttaaacacg

SEQ ID NO: 5850730 - DNA, 16 bp, Homo sapiens
attcattcatacttaa

SEQ ID NO: 5850731 - DNA, 12 bp, Homo sapiens
attcattccatt

SEQ ID NO: 5850732 - DNA, 17 bp, Homo sapiens
attcattccattctgga

SEQ ID NO: 5850733 - DNA, 22 bp, Homo sapiens
attcattccccagctccatact

SEQ ID NO: 5850734 - DNA, 13 bp, Homo sapiens
attcattcctcac

SEQ ID NO: 5850735 - DNA, 22 bp, Homo sapiens
attcattctgaaccctccaaag

SEQ ID NO: 5850736 - DNA, 22 bp, Homo sapiens
attcattctgtgatcatttatt

SEQ ID NO: 5850737 - DNA, 21 bp, Homo sapiens
attcattctttttgaaatgtc

SEQ ID NO: 5850738 - DNA, 12 bp, Homo sapiens
attcattggtga

SEQ ID NO: 5850739 - DNA, 20 bp, Homo sapiens
attcattggttaacaataaa

SEQ ID NO: 5850740 - DNA, 16 bp, Homo sapiens
attcattgtataaaaa

SEQ ID NO: 5850741 - DNA, 18 bp, Homo sapiens
attcattgtctcagtgaa

SEQ ID NO: 5850742 - DNA, 20 bp, Homo sapiens
attcattgtgaacagaagtc

SEQ ID NO: 5850743 - DNA, 20 bp, Homo sapiens
attcattgtggttattttta

SEQ ID NO: 5850744 - DNA, 21 bp, Homo sapiens
attcattgtggttatttttat

SEQ ID NO: 5850745 - DNA, 15 bp, Homo sapiens
attcattgttttgca

SEQ ID NO: 5850746 - DNA, 17 bp, Homo sapiens
attcattgttttgcaaa

SEQ ID NO: 5850747 - DNA, 10 bp, Homo sapiens
attcatttaa

SEQ ID NO: 5850748 - DNA, 16 bp, Homo sapiens
attcatttaaaatgat

SEQ ID NO: 5850749 - DNA, 17 bp, Homo sapiens
attcatttaaaatgatt

SEQ ID NO: 5850750 - DNA, 14 bp, Homo sapiens
attcatttacaact

SEQ ID NO: 5850751 - DNA, 19 bp, Homo sapiens
attcatttataagaagaga

SEQ ID NO: 5850752 - DNA, 15 bp, Homo sapiens
attcatttattaagt

SEQ ID NO: 5850753 - DNA, 16 bp, Homo sapiens
attcatttattaagta

SEQ ID NO: 5850754 - DNA, 17 bp, Homo sapiens
attcatttcactttaaa

SEQ ID NO: 5850755 - DNA, 15 bp, Homo sapiens
attcatttcctgccc

SEQ ID NO: 5850756 - DNA, 12 bp, Homo sapiens
attcatttctaa

SEQ ID NO: 5850757 - DNA, 19 bp, Homo sapiens
attcatttgagttatttta

SEQ ID NO: 5850758 - DNA, 18 bp, Homo sapiens
attcatttgtattgctta

SEQ ID NO: 5850759 - DNA, 20 bp, Homo sapiens
attcatttgtattgcttatt

SEQ ID NO: 5850760 - DNA, 18 bp, Homo sapiens
attcatttgttttttcaa

SEQ ID NO: 5850761 - DNA, 15 bp, Homo sapiens
attcattttattctt

SEQ ID NO: 5850762 - DNA, 14 bp, Homo sapiens
attcattttcctgt

SEQ ID NO: 5850763 - DNA, 17 bp, Homo sapiens
attcattttcctgttca

SEQ ID NO: 5850764 - DNA, 24 bp, Homo sapiens
attcattttcctgttcagtgagat

SEQ ID NO: 5850765 - DNA, 14 bp, Homo sapiens
attcattttctcta

SEQ ID NO: 5850766 - DNA, 15 bp, Homo sapiens
attcattttctctaa

SEQ ID NO: 5850767 - DNA, 15 bp, Homo sapiens
attcattttctcttt

SEQ ID NO: 5850768 - DNA, 13 bp, Homo sapiens
attcattttctga

SEQ ID NO: 5850769 - DNA, 15 bp, Homo sapiens
attcattttgcaact

SEQ ID NO: 5850770 - DNA, 12 bp, Homo sapiens
attcattttgtg

SEQ ID NO: 5850771 - DNA, 15 bp, Homo sapiens
attccaaaataaaag

SEQ ID NO: 5850772 - DNA, 13 bp, Homo sapiens
attccaaaatatt

SEQ ID NO: 5850773 - DNA, 22 bp, Homo sapiens
attccaaacatcggggctaaca

SEQ ID NO: 5850774 - DNA, 14 bp, Homo sapiens
attccaaacatggt

SEQ ID NO: 5850775 - DNA, 14 bp, Homo sapiens
attccaaaccaaat

SEQ ID NO: 5850776 - DNA, 16 bp, Homo sapiens
attccaaaccaggaca

SEQ ID NO: 5850777 - DNA, 17 bp, Homo sapiens
attccaaacttctaaat

SEQ ID NO: 5850778 - DNA, 18 bp, Homo sapiens
attccaaacttctaaatg

SEQ ID NO: 5850779 - DNA, 20 bp, Homo sapiens
attccaaacttctaaatgtt

SEQ ID NO: 5850780 - DNA, 13 bp, Homo sapiens
attccaaagcaaa

SEQ ID NO: 5850781 - DNA, 21 bp, Homo sapiens
attccaaagctttattaccag

SEQ ID NO: 5850782 - DNA, 14 bp, Homo sapiens
attccaaaggggac

SEQ ID NO: 5850783 - DNA, 18 bp, Homo sapiens
attccaaagtctctaatt

SEQ ID NO: 5850784 - DNA, 23 bp, Homo sapiens
attccaaagttttgaagtcatct

SEQ ID NO: 5850785 - DNA, 22 bp, Homo sapiens
attccaaattaggaagtgtttc

SEQ ID NO: 5850786 - DNA, 19 bp, Homo sapiens
attccaacaaagggtttta

SEQ ID NO: 5850787 - DNA, 23 bp, Homo sapiens
attccaacaaagggttttaatgt

SEQ ID NO: 5850788 - DNA, 16 bp, Homo sapiens
attccaacagtttaat

SEQ ID NO: 5850789 - DNA, 19 bp, Homo sapiens
attccaacagtttaatgaa

SEQ ID NO: 5850790 - DNA, 20 bp, Homo sapiens
attccaacagtttaatgaag

SEQ ID NO: 5850791 - DNA, 22 bp, Homo sapiens
attccaacccaggtctgctttg

SEQ ID NO: 5850792 - DNA, 11 bp, Homo sapiens
attccaacctt

SEQ ID NO: 5850793 - DNA, 17 bp, Homo sapiens
attccaaccttcctttt

SEQ ID NO: 5850794 - DNA, 19 bp, Homo sapiens
attccaaccttcctttttt

SEQ ID NO: 5850795 - DNA, 16 bp, Homo sapiens
attccaactcctgatg

SEQ ID NO: 5850796 - DNA, 21 bp, Homo sapiens
attccaactgggcatttcaat

SEQ ID NO: 5850797 - DNA, 17 bp, Homo sapiens
attccaacttgaaggat

SEQ ID NO: 5850798 - DNA, 19 bp, Homo sapiens
attccaacttgaaggattg

SEQ ID NO: 5850799 - DNA, 15 bp, Homo sapiens
attccaagaaaatat

SEQ ID NO: 5850800 - DNA, 19 bp, Homo sapiens
attccaagccttattttga

SEQ ID NO: 5850801 - DNA, 19 bp, Homo sapiens
attccaagcttcatattaa

SEQ ID NO: 5850802 - DNA, 18 bp, Homo sapiens
attccaaggaaaattgaa

SEQ ID NO: 5850803 - DNA, 21 bp, Homo sapiens
attccaaggaaaattgaaagt

SEQ ID NO: 5850804 - DNA, 22 bp, Homo sapiens
attccaaggctttaaagctgag

SEQ ID NO: 5850805 - DNA, 15 bp, Homo sapiens
attccaagggcccag

SEQ ID NO: 5850806 - DNA, 18 bp, Homo sapiens
attccaagggcccagagg

SEQ ID NO: 5850807 - DNA, 13 bp, Homo sapiens
attccaagtgtat

SEQ ID NO: 5850808 - DNA, 23 bp, Homo sapiens
attccaagtgtatatttgtatca

SEQ ID NO: 5850809 - DNA, 17 bp, Homo sapiens
attccaagtgtatttta

SEQ ID NO: 5850810 - DNA, 20 bp, Homo sapiens
attccaatacattattggac

SEQ ID NO: 5850811 - DNA, 15 bp, Homo sapiens
attccaatatttata

SEQ ID NO: 5850812 - DNA, 18 bp, Homo sapiens
attccaatatttataatt

SEQ ID NO: 5850813 - DNA, 21 bp, Homo sapiens
attccaatatttataattaaa

SEQ ID NO: 5850814 - DNA, 13 bp, Homo sapiens
attccaatctaca

SEQ ID NO: 5850815 - DNA, 14 bp, Homo sapiens
attccaatctctgt

SEQ ID NO: 5850816 - DNA, 17 bp, Homo sapiens
attccaatttcaaaatg

SEQ ID NO: 5850817 - DNA, 15 bp, Homo sapiens
attccacaaacacat

SEQ ID NO: 5850818 - DNA, 16 bp, Homo sapiens
attccacacaaaatgt

SEQ ID NO: 5850819 - DNA, 16 bp, Homo sapiens
attccacactgcaggg

SEQ ID NO: 5850820 - DNA, 19 bp, Homo sapiens
attccacagatatcttttt

SEQ ID NO: 5850821 - DNA, 14 bp, Homo sapiens
attccacaggacac

SEQ ID NO: 5850822 - DNA, 22 bp, Homo sapiens
attccacaggacacgaaggctg

SEQ ID NO: 5850823 - DNA, 22 bp, Homo sapiens
attccacagggataccttaatt

SEQ ID NO: 5850824 - DNA, 15 bp, Homo sapiens
attccacatcatgtt

SEQ ID NO: 5850825 - DNA, 15 bp, Homo sapiens
attccaccagggcca

SEQ ID NO: 5850826 - DNA, 19 bp, Homo sapiens
attccaccagggccagagc

SEQ ID NO: 5850827 - DNA, 22 bp, Homo sapiens
attccaccagggccagagcagc

SEQ ID NO: 5850828 - DNA, 24 bp, Homo sapiens
attccaccagggccagagcagctc

SEQ ID NO: 5850829 - DNA, 16 bp, Homo sapiens
attccaccctgttact

SEQ ID NO: 5850830 - DNA, 16 bp, Homo sapiens
attccacctgcaatca

SEQ ID NO: 5850831 - DNA, 21 bp, Homo sapiens
attccacctggaaagccaggt

SEQ ID NO: 5850832 - DNA, 14 bp, Homo sapiens
attccaccttaaat

SEQ ID NO: 5850833 - DNA, 18 bp, Homo sapiens
attccaccttaaattaaa

SEQ ID NO: 5850834 - DNA, 22 bp, Homo sapiens
attccaccttaaattaaacaat

SEQ ID NO: 5850835 - DNA, 22 bp, Homo sapiens
attccactacacctggctgagg

SEQ ID NO: 5850836 - DNA, 22 bp, Homo sapiens
attccactcaatatgtgatttt

SEQ ID NO: 5850837 - DNA, 18 bp, Homo sapiens
attccactgcgttgtcca

SEQ ID NO: 5850838 - DNA, 15 bp, Homo sapiens
attccacttcctgcc

SEQ ID NO: 5850839 - DNA, 17 bp, Homo sapiens
attccacttcctgcccc

SEQ ID NO: 5850840 - DNA, 21 bp, Homo sapiens
attccacttcctgccccaact

SEQ ID NO: 5850841 - DNA, 22 bp, Homo sapiens
attccacttgttcattctgtga

SEQ ID NO: 5850842 - DNA, 15 bp, Homo sapiens
attccagaacaaatt

SEQ ID NO: 5850843 - DNA, 22 bp, Homo sapiens
attccagaacgccctgtgtcca

SEQ ID NO: 5850844 - DNA, 19 bp, Homo sapiens
attccagaagaagagaagc

SEQ ID NO: 5850845 - DNA, 21 bp, Homo sapiens
attccagaagaagagaagctg

SEQ ID NO: 5850846 - DNA, 22 bp, Homo sapiens
attccagaagaagagaagctgc

SEQ ID NO: 5850847 - DNA, 19 bp, Homo sapiens
attccagaatcttgacttt

SEQ ID NO: 5850848 - DNA, 15 bp, Homo sapiens
attccagaatgctgt

SEQ ID NO: 5850849 - DNA, 23 bp, Homo sapiens
attccagaccaaaataatacaac

SEQ ID NO: 5850850 - DNA, 19 bp, Homo sapiens
attccagagagtggctcct

SEQ ID NO: 5850851 - DNA, 21 bp, Homo sapiens
attccagagagtggctcctcc

SEQ ID NO: 5850852 - DNA, 19 bp, Homo sapiens
attccagagctctttgatc

SEQ ID NO: 5850853 - DNA, 15 bp, Homo sapiens
attccagagctgcag

SEQ ID NO: 5850854 - DNA, 16 bp, Homo sapiens
attccagagctgcaga

SEQ ID NO: 5850855 - DNA, 13 bp, Homo sapiens
attccagagctgt

SEQ ID NO: 5850856 - DNA, 21 bp, Homo sapiens
attccagaggactctgcttaa

SEQ ID NO: 5850857 - DNA, 20 bp, Homo sapiens
attccagatctttcagaaat

SEQ ID NO: 5850858 - DNA, 11 bp, Homo sapiens
attccagcaat

SEQ ID NO: 5850859 - DNA, 20 bp, Homo sapiens
attccagcacttcaggaggc

SEQ ID NO: 5850860 - DNA, 11 bp, Homo sapiens
attccagcagc

SEQ ID NO: 5850861 - DNA, 16 bp, Homo sapiens
attccagcagctgcac

SEQ ID NO: 5850862 - DNA, 10 bp, Homo sapiens
attccagcca

SEQ ID NO: 5850863 - DNA, 21 bp, Homo sapiens
attccagccaggcccaggcca

SEQ ID NO: 5850864 - DNA, 22 bp, Homo sapiens
attccagccaggcccaggccag

SEQ ID NO: 5850865 - DNA, 20 bp, Homo sapiens
attccagcgtctgctgttga

SEQ ID NO: 5850866 - DNA, 19 bp, Homo sapiens
attccagcgtcttctagag

SEQ ID NO: 5850867 - DNA, 11 bp, Homo sapiens
attccagctct

SEQ ID NO: 5850868 - DNA, 20 bp, Homo sapiens
attccagctctcccatggag

SEQ ID NO: 5850869 - DNA, 12 bp, Homo sapiens
attccagctctg

SEQ ID NO: 5850870 - DNA, 15 bp, Homo sapiens
attccagctctgccc

SEQ ID NO: 5850871 - DNA, 22 bp, Homo sapiens
attccagctgtcactctgtgcc

SEQ ID NO: 5850872 - DNA, 15 bp, Homo sapiens
attccaggaattcct

SEQ ID NO: 5850873 - DNA, 22 bp, Homo sapiens
attccaggaggagttagccaaa

SEQ ID NO: 5850874 - DNA, 19 bp, Homo sapiens
attccaggatggtttggaa

SEQ ID NO: 5850875 - DNA, 17 bp, Homo sapiens
attccaggctgagccat

SEQ ID NO: 5850876 - DNA, 19 bp, Homo sapiens
attccaggctgagccatga

SEQ ID NO: 5850877 - DNA, 13 bp, Homo sapiens
attccagggatga

SEQ ID NO: 5850878 - DNA, 12 bp, Homo sapiens
attccagggctg

SEQ ID NO: 5850879 - DNA, 16 bp, Homo sapiens
attccagggctggggt

SEQ ID NO: 5850880 - DNA, 21 bp, Homo sapiens
attccaggtgtgcacagaaaa

SEQ ID NO: 5850881 - DNA, 22 bp, Homo sapiens
attcgcctttgtcttgtacttc

SEQ ID NO: 5850882 - DNA, 15 bp, Homo sapiens
attcgctagtgttta

SEQ ID NO: 5850883 - DNA, 14 bp, Homo sapiens
attcgctgtcccct

SEQ ID NO: 5850884 - DNA, 20 bp, Homo sapiens
attcggaactgtcctttcct

SEQ ID NO: 5850885 - DNA, 21 bp, Homo sapiens
attcggaactgtcctttcctt

SEQ ID NO: 5850886 - DNA, 14 bp, Homo sapiens
attcggacggccaa

SEQ ID NO: 5850887 - DNA, 22 bp, Homo sapiens
attcggacggccaatggtgctt

SEQ ID NO: 5850888 - DNA, 15 bp, Homo sapiens
attcggcatttaact

SEQ ID NO: 5850889 - DNA, 21 bp, Homo sapiens
attcggcatttaacttacatt

SEQ ID NO: 5850890 - DNA, 22 bp, Homo sapiens
attcggggctgacctttcaaac

SEQ ID NO: 5850891 - DNA, 16 bp, Homo sapiens
attcggggctgacgat

SEQ ID NO: 5850892 - DNA, 12 bp, Homo sapiens
attcggtgtgaa

SEQ ID NO: 5850893 - DNA, 14 bp, Homo sapiens
attcggtgtgctgc

SEQ ID NO: 5850894 - DNA, 23 bp, Homo sapiens
attcggtgtggtgcagtgtgaaa

SEQ ID NO: 5850895 - DNA, 14 bp, Homo sapiens
attcgtaagttctg

SEQ ID NO: 5850896 - DNA, 15 bp, Homo sapiens
attcgtaagttctgt

SEQ ID NO: 5850897 - DNA, 20 bp, Homo sapiens
attcgtaagttctgtgcagt

SEQ ID NO: 5850898 - DNA, 16 bp, Homo sapiens
attcgtacataatact

SEQ ID NO: 5850899 - DNA, 18 bp, Homo sapiens
attcgtatccagctcttt

SEQ ID NO: 5850900 - DNA, 16 bp, Homo sapiens
attcgtcctttgacaa

SEQ ID NO: 5850901 - DNA, 19 bp, Homo sapiens
attcgtctgtcccagagct

SEQ ID NO: 5850902 - DNA, 14 bp, Homo sapiens
attcgtgagctggg

SEQ ID NO: 5850903 - DNA, 20 bp, Homo sapiens
attcgtgcatttttggatca

SEQ ID NO: 5850904 - DNA, 16 bp, Homo sapiens
attcgtgttatgaatc

SEQ ID NO: 5850905 - DNA, 19 bp, Homo sapiens
attcgttgtgttttttaag

SEQ ID NO: 5850906 - DNA, 22 bp, Homo sapiens
attcgttgtgttttttaagata

SEQ ID NO: 5850907 - DNA, 23 bp, Homo sapiens
attcgttgttcccactgaaatgg

SEQ ID NO: 5850908 - DNA, 16 bp, Homo sapiens
attctaaaatgattgt

SEQ ID NO: 5850909 - DNA, 16 bp, Homo sapiens
attctaaaatgtctca

SEQ ID NO: 5850910 - DNA, 12 bp, Homo sapiens
attctaaacaga

SEQ ID NO: 5850911 - DNA, 23 bp, Homo sapiens
attctaaagagcacttactgtaa

SEQ ID NO: 5850912 - DNA, 15 bp, Homo sapiens
attctaaagattcta

SEQ ID NO: 5850913 - DNA, 16 bp, Homo sapiens
attctaaagctttctg

SEQ ID NO: 5850914 - DNA, 17 bp, Homo sapiens
attctaaagctttctga

SEQ ID NO: 5850915 - DNA, 17 bp, Homo sapiens
attctaaagttttgcaa

SEQ ID NO: 5850916 - DNA, 18 bp, Homo sapiens
attctaaagttttgcaac

SEQ ID NO: 5850917 - DNA, 21 bp, Homo sapiens
attctaaataaaatataattg

SEQ ID NO: 5850918 - DNA, 23 bp, Homo sapiens
attctaaatccgacttgaatatt

SEQ ID NO: 5850919 - DNA, 15 bp, Homo sapiens
attctaaatgaatgt

SEQ ID NO: 5850920 - DNA, 18 bp, Homo sapiens
attctaaatgaatgttta

SEQ ID NO: 5850921 - DNA, 17 bp, Homo sapiens
attctaaattacaaagg

SEQ ID NO: 5850922 - DNA, 14 bp, Homo sapiens
attctaaattcact

SEQ ID NO: 5850923 - DNA, 16 bp, Homo sapiens
attctaacatttgata

SEQ ID NO: 5850924 - DNA, 15 bp, Homo sapiens
attctaacctggagg

SEQ ID NO: 5850925 - DNA, 19 bp, Homo sapiens
attctaacttaatgtagtt

SEQ ID NO: 5850926 - DNA, 14 bp, Homo sapiens
attctaagatttgg

SEQ ID NO: 5850927 - DNA, 18 bp, Homo sapiens
attctaagccagttttca

SEQ ID NO: 5850928 - DNA, 21 bp, Homo sapiens
attctaagccagttttcattt

SEQ ID NO: 5850929 - DNA, 15 bp, Homo sapiens
attctaagtgaaatt

SEQ ID NO: 5850930 - DNA, 17 bp, Homo sapiens
attctaagtgagatgtt

SEQ ID NO: 5850931 - DNA, 23 bp, Homo sapiens
attctaagtgagatgtttggcaa

SEQ ID NO: 5850932 - DNA, 19 bp, Homo sapiens
attctaagttagactcttc

SEQ ID NO: 5850933 - DNA, 17 bp, Homo sapiens
attctaagttatttact

SEQ ID NO: 5850934 - DNA, 20 bp, Homo sapiens
attctaagttatttactttt

SEQ ID NO: 5850935 - DNA, 21 bp, Homo sapiens
attctaagttatttactttta

SEQ ID NO: 5850936 - DNA, 14 bp, Homo sapiens
attctaatcatctg

SEQ ID NO: 5850937 - DNA, 21 bp, Homo sapiens
attctaatgatggcccattct

SEQ ID NO: 5850938 - DNA, 13 bp, Homo sapiens
attctaatggtaa

SEQ ID NO: 5850939 - DNA, 14 bp, Homo sapiens
attctaatgtcttc

SEQ ID NO: 5850940 - DNA, 16 bp, Homo sapiens
attctaatgtcttcat

SEQ ID NO: 5850941 - DNA, 12 bp, Homo sapiens
attctaattaaa

SEQ ID NO: 5850942 - DNA, 16 bp, Homo sapiens
attctaattaaaattg

SEQ ID NO: 5850943 - DNA, 14 bp, Homo sapiens
attctaattcttca

SEQ ID NO: 5850944 - DNA, 17 bp, Homo sapiens
attctaattgtcagtga

SEQ ID NO: 5850945 - DNA, 19 bp, Homo sapiens
attctacacatgtaaaata

SEQ ID NO: 5850946 - DNA, 15 bp, Homo sapiens
attctacacctggac

SEQ ID NO: 5850947 - DNA, 22 bp, Homo sapiens
attctacagaaagaaaaatgca

SEQ ID NO: 5850948 - DNA, 12 bp, Homo sapiens
attctacagaat

SEQ ID NO: 5850949 - DNA, 15 bp, Homo sapiens
attctaccaagctgt

SEQ ID NO: 5850950 - DNA, 20 bp, Homo sapiens
attctaccaagctgtcacag

SEQ ID NO: 5850951 - DNA, 15 bp, Homo sapiens
attctaccctggaaa

SEQ ID NO: 5850952 - DNA, 15 bp, Homo sapiens
attctactaagttat

SEQ ID NO: 5850953 - DNA, 21 bp, Homo sapiens
attctactaagttattttatg

SEQ ID NO: 5850954 - DNA, 16 bp, Homo sapiens
attctactcttgtcat

SEQ ID NO: 5850955 - DNA, 17 bp, Homo sapiens
attctactcttgtcatt

SEQ ID NO: 5850956 - DNA, 22 bp, Homo sapiens
attctactcttgtcatttttaa

SEQ ID NO: 5850957 - DNA, 13 bp, Homo sapiens
attctacttgctc

SEQ ID NO: 5850958 - DNA, 18 bp, Homo sapiens
attctacttgctctggac

SEQ ID NO: 5850959 - DNA, 19 bp, Homo sapiens
attctacttgctctggacc

SEQ ID NO: 5850960 - DNA, 20 bp, Homo sapiens
attctacttgctctggacct

SEQ ID NO: 5850961 - DNA, 16 bp, Homo sapiens
attctagaaagagcct

SEQ ID NO: 5850962 - DNA, 22 bp, Homo sapiens
attctagaaagtactttggcct

SEQ ID NO: 5850963 - DNA, 13 bp, Homo sapiens
attctagaagcag

SEQ ID NO: 5850964 - DNA, 22 bp, Homo sapiens
attctagataaccttgtttatt

SEQ ID NO: 5850965 - DNA, 23 bp, Homo sapiens
attctagatcagatgctccaaga

SEQ ID NO: 5850966 - DNA, 22 bp, Homo sapiens
attctagatcctgcaccccagc

SEQ ID NO: 5850967 - DNA, 20 bp, Homo sapiens
attctagatgcaagtctctt

SEQ ID NO: 5850968 - DNA, 15 bp, Homo sapiens
attctagattacttt

SEQ ID NO: 5850969 - DNA, 17 bp, Homo sapiens
attctagccaaactatt

SEQ ID NO: 5850970 - DNA, 20 bp, Homo sapiens
attctagccaaactattcta

SEQ ID NO: 5850971 - DNA, 17 bp, Homo sapiens
attctagcctgcacttt

SEQ ID NO: 5850972 - DNA, 19 bp, Homo sapiens
attctagctgtatgatttg

SEQ ID NO: 5850973 - DNA, 17 bp, Homo sapiens
attctaggacctgtgtc

SEQ ID NO: 5850974 - DNA, 21 bp, Homo sapiens
attctaggatgaacaatgtat

SEQ ID NO: 5850975 - DNA, 23 bp, Homo sapiens
attctagggtttcttaaatatat

SEQ ID NO: 5850976 - DNA, 23 bp, Homo sapiens
attctaggtggaggttgtgcatg

SEQ ID NO: 5850977 - DNA, 16 bp, Homo sapiens
attctaggtgtttcaa

SEQ ID NO: 5850978 - DNA, 14 bp, Homo sapiens
attctagtattctt

SEQ ID NO: 5850979 - DNA, 17 bp, Homo sapiens
attctagtcaactgctg

SEQ ID NO: 5850980 - DNA, 23 bp, Homo sapiens
attctagtctctgatttgcaaat

SEQ ID NO: 5850981 - DNA, 17 bp, Homo sapiens
attctagtctgtttcat

SEQ ID NO: 5850982 - DNA, 17 bp, Homo sapiens
attctagtgctgctgaa

SEQ ID NO: 5850983 - DNA, 13 bp, Homo sapiens
attctagtggctg

SEQ ID NO: 5850984 - DNA, 14 bp, Homo sapiens
attctagtggctgt

SEQ ID NO: 5850985 - DNA, 19 bp, Homo sapiens
attctagtgtaacactgca

SEQ ID NO: 5850986 - DNA, 15 bp, Homo sapiens
attctagtgtccata

SEQ ID NO: 5850987 - DNA, 23 bp, Homo sapiens
attctagtgtccataaataaagt

SEQ ID NO: 5850988 - DNA, 21 bp, Homo sapiens
attctagttaaggaaatgttg

SEQ ID NO: 5850989 - DNA, 18 bp, Homo sapiens
attctagttcagagccaa

SEQ ID NO: 5850990 - DNA, 13 bp, Homo sapiens
attctataaaaac

SEQ ID NO: 5850991 - DNA, 15 bp, Homo sapiens
attctataaaactct

SEQ ID NO: 5850992 - DNA, 17 bp, Homo sapiens
attctataaattcaaca

SEQ ID NO: 5850993 - DNA, 18 bp, Homo sapiens
attctataagttttatgt

SEQ ID NO: 5850994 - DNA, 20 bp, Homo sapiens
attctatacacaccctgccc

SEQ ID NO: 5850995 - DNA, 14 bp, Homo sapiens
attctatagttcta

SEQ ID NO: 5850996 - DNA, 14 bp, Homo sapiens
attctatatgaatt

SEQ ID NO: 5850997 - DNA, 17 bp, Homo sapiens
attctatatgaatttaa

SEQ ID NO: 5850998 - DNA, 20 bp, Homo sapiens
attctatattattatatata

SEQ ID NO: 5850999 - DNA, 15 bp, Homo sapiens
attctatatttcata

SEQ ID NO: 5851000 - DNA, 16 bp, Homo sapiens
attctatatttcatat

SEQ ID NO: 5851001 - DNA, 19 bp, Homo sapiens
attctatccatctcctggt

SEQ ID NO: 5851002 - DNA, 21 bp, Homo sapiens
attctatccccaatcagctcc

SEQ ID NO: 5851003 - DNA, 19 bp, Homo sapiens
attctatcggccaggctgg

SEQ ID NO: 5851004 - DNA, 22 bp, Homo sapiens
attctatcgttattataaatgt

SEQ ID NO: 5851005 - DNA, 17 bp, Homo sapiens
attctatctactgattt

SEQ ID NO: 5851006 - DNA, 21 bp, Homo sapiens
attctatgacaataaatttta

SEQ ID NO: 5851007 - DNA, 16 bp, Homo sapiens
attctatgattaaact

SEQ ID NO: 5851008 - DNA, 23 bp, Homo sapiens
attctatggaatagttctgtata

SEQ ID NO: 5851009 - DNA, 17 bp, Homo sapiens
attctatgtaacttgtt

SEQ ID NO: 5851010 - DNA, 13 bp, Homo sapiens
attctatgtagtg

SEQ ID NO: 5851011 - DNA, 19 bp, Homo sapiens
attctatgtagtggtttta

SEQ ID NO: 5851012 - DNA, 23 bp, Homo sapiens
attctatgtagtggttttaggat

SEQ ID NO: 5851013 - DNA, 16 bp, Homo sapiens
attctatgtatgttaa

SEQ ID NO: 5851014 - DNA, 14 bp, Homo sapiens
attctatgtgtcat

SEQ ID NO: 5851015 - DNA, 20 bp, Homo sapiens
attctatgttaaatactgtg

SEQ ID NO: 5851016 - DNA, 13 bp, Homo sapiens
attctatgttaat

SEQ ID NO: 5851017 - DNA, 15 bp, Homo sapiens
attctattaaaagcc

SEQ ID NO: 5851018 - DNA, 17 bp, Homo sapiens
attctattctccagaca

SEQ ID NO: 5851019 - DNA, 13 bp, Homo sapiens
attctattgaaaa

SEQ ID NO: 5851020 - DNA, 16 bp, Homo sapiens
attctattgaaaacag

SEQ ID NO: 5851021 - DNA, 22 bp, Homo sapiens
attctattgccttctttgaaga

SEQ ID NO: 5851022 - DNA, 18 bp, Homo sapiens
attctattgtattatttg

SEQ ID NO: 5851023 - DNA, 23 bp, Homo sapiens
attctattgtattatttggagtt

SEQ ID NO: 5851024 - DNA, 18 bp, Homo sapiens
attctatttaattgaaac

SEQ ID NO: 5851025 - DNA, 22 bp, Homo sapiens
attctatttatatgtacatgag

SEQ ID NO: 5851026 - DNA, 12 bp, Homo sapiens
attctatttcaa

SEQ ID NO: 5851027 - DNA, 15 bp, Homo sapiens
attctatttctctat

SEQ ID NO: 5851028 - DNA, 16 bp, Homo sapiens
attctatttctctatg

SEQ ID NO: 5851029 - DNA, 16 bp, Homo sapiens
attctattttagaata

SEQ ID NO: 5851030 - DNA, 18 bp, Homo sapiens
attctattttcattttct

SEQ ID NO: 5851031 - DNA, 19 bp, Homo sapiens
attctattttgcagataga

SEQ ID NO: 5851032 - DNA, 16 bp, Homo sapiens
attctcaaagatgcat

SEQ ID NO: 5851033 - DNA, 18 bp, Homo sapiens
attctcaaagatgcattt

SEQ ID NO: 5851034 - DNA, 19 bp, Homo sapiens
attctcaaagatgcatttt

SEQ ID NO: 5851035 - DNA, 17 bp, Homo sapiens
attctcaaaggagcgag

SEQ ID NO: 5851036 - DNA, 16 bp, Homo sapiens
attctcaaagttttat

SEQ ID NO: 5851037 - DNA, 21 bp, Homo sapiens
attctcaacctaccacccctt

SEQ ID NO: 5851038 - DNA, 20 bp, Homo sapiens
attctcaagccgcatcccag

SEQ ID NO: 5851039 - DNA, 21 bp, Homo sapiens
attctcaagggacgtcctcca

SEQ ID NO: 5851040 - DNA, 21 bp, Homo sapiens
attctcacagctccaagaatt

SEQ ID NO: 5851041 - DNA, 22 bp, Homo sapiens
attctcacagctccaagaattt

SEQ ID NO: 5851042 - DNA, 20 bp, Homo sapiens
attctcacaggttcacccag

SEQ ID NO: 5851043 - DNA, 16 bp, Homo sapiens
attctcaccaggaagg

SEQ ID NO: 5851044 - DNA, 12 bp, Homo sapiens
attctcactgct

SEQ ID NO: 5851045 - DNA, 19 bp, Homo sapiens
attctcagaacaccaagta

SEQ ID NO: 5851046 - DNA, 22 bp, Homo sapiens
attctcagaacaccaagtaaat

SEQ ID NO: 5851047 - DNA, 13 bp, Homo sapiens
attctcagagtgt

SEQ ID NO: 5851048 - DNA, 14 bp, Homo sapiens
attctcagcagagt

SEQ ID NO: 5851049 - DNA, 15 bp, Homo sapiens
attctcagcagagtg

SEQ ID NO: 5851050 - DNA, 16 bp, Homo sapiens
attctcagcagagtgc

SEQ ID NO: 5851051 - DNA, 11 bp, Homo sapiens
attctcagggc

SEQ ID NO: 5851052 - DNA, 17 bp, Homo sapiens
attctcagggtctctgc

SEQ ID NO: 5851053 - DNA, 18 bp, Homo sapiens
attctcagggtctctgct

SEQ ID NO: 5851054 - DNA, 20 bp, Homo sapiens
attctcagggtctctgctgc

SEQ ID NO: 5851055 - DNA, 22 bp, Homo sapiens
attctcagggtctctgctgccg

SEQ ID NO: 5851056 - DNA, 18 bp, Homo sapiens
attctcagtaacttttaa

SEQ ID NO: 5851057 - DNA, 20 bp, Homo sapiens
attctcagtaacttttaaaa

SEQ ID NO: 5851058 - DNA, 23 bp, Homo sapiens
attctgattattgagttccagtt

SEQ ID NO: 5851059 - DNA, 21 bp, Homo sapiens
attctgattctggctttaagc

SEQ ID NO: 5851060 - DNA, 20 bp, Homo sapiens
attctgattgctatcagcaa

SEQ ID NO: 5851061 - DNA, 22 bp, Homo sapiens
attctgattgctatcagcaatg

SEQ ID NO: 5851062 - DNA, 12 bp, Homo sapiens
attctgattggt

SEQ ID NO: 5851063 - DNA, 14 bp, Homo sapiens
attctgatttcagt

SEQ ID NO: 5851064 - DNA, 22 bp, Homo sapiens
attctgatttcagtttttcatt

SEQ ID NO: 5851065 - DNA, 19 bp, Homo sapiens
attctgatttggaaaaaga

SEQ ID NO: 5851066 - DNA, 14 bp, Homo sapiens
attctgatttgtat

SEQ ID NO: 5851067 - DNA, 20 bp, Homo sapiens
attctgcaacagcctgtttg

SEQ ID NO: 5851068 - DNA, 16 bp, Homo sapiens
attctgcaactagcca

SEQ ID NO: 5851069 - DNA, 22 bp, Homo sapiens
attctgcaagcacatctgcatt

SEQ ID NO: 5851070 - DNA, 23 bp, Homo sapiens
attctgcagaaaattaattgaaa

SEQ ID NO: 5851071 - DNA, 22 bp, Homo sapiens
attctgcagcatgacctgtgac

SEQ ID NO: 5851072 - DNA, 21 bp, Homo sapiens
attctgcagcccgatgtccct

SEQ ID NO: 5851073 - DNA, 20 bp, Homo sapiens
attctgcagtaaatctttta

SEQ ID NO: 5851074 - DNA, 19 bp, Homo sapiens
attctgcatactaacctat

SEQ ID NO: 5851075 - DNA, 17 bp, Homo sapiens
attctgcatgccctccc

SEQ ID NO: 5851076 - DNA, 12 bp, Homo sapiens
attctgcattaa

SEQ ID NO: 5851077 - DNA, 12 bp, Homo sapiens
attctgcattta

SEQ ID NO: 5851078 - DNA, 13 bp, Homo sapiens
attctgccaaagt

SEQ ID NO: 5851079 - DNA, 14 bp, Homo sapiens
attctgccaggccc

SEQ ID NO: 5851080 - DNA, 21 bp, Homo sapiens
attctgccatgggagagtcca

SEQ ID NO: 5851081 - DNA, 16 bp, Homo sapiens
attctgcccaaaaata

SEQ ID NO: 5851082 - DNA, 18 bp, Homo sapiens
attctgcccaaaaatatg

SEQ ID NO: 5851083 - DNA, 23 bp, Homo sapiens
attctgccccacacccagccagc

SEQ ID NO: 5851084 - DNA, 15 bp, Homo sapiens
attctgccccagagt

SEQ ID NO: 5851085 - DNA, 14 bp, Homo sapiens
attctgcctaataa

SEQ ID NO: 5851086 - DNA, 21 bp, Homo sapiens
attctgcctacgttctcttta

SEQ ID NO: 5851087 - DNA, 18 bp, Homo sapiens
attctgcctatgtaaaat

SEQ ID NO: 5851088 - DNA, 15 bp, Homo sapiens
attctgcctctctag

SEQ ID NO: 5851089 - DNA, 15 bp, Homo sapiens
attctgcctctctgg

SEQ ID NO: 5851090 - DNA, 14 bp, Homo sapiens
attctgcctgccca

SEQ ID NO: 5851091 - DNA, 15 bp, Homo sapiens
attctgcctgcccag

SEQ ID NO: 5851092 - DNA, 17 bp, Homo sapiens
attctgcctgcccaggc

SEQ ID NO: 5851093 - DNA, 16 bp, Homo sapiens
attctgcctgcctggg

SEQ ID NO: 5851094 - DNA, 18 bp, Homo sapiens
attctgcctgcctgggaa

SEQ ID NO: 5851095 - DNA, 13 bp, Homo sapiens
attctgcctgctc

SEQ ID NO: 5851096 - DNA, 17 bp, Homo sapiens
attctgccttggttctg

SEQ ID NO: 5851097 - DNA, 22 bp, Homo sapiens
attctgccttggttctggccac

SEQ ID NO: 5851098 - DNA, 23 bp, Homo sapiens
attctgccttggttctggccacc

SEQ ID NO: 5851099 - DNA, 22 bp, Homo sapiens
attctgcctttgcagaaacaga

SEQ ID NO: 5851100 - DNA, 24 bp, Homo sapiens
attctgctacttcactgtcatctt

SEQ ID NO: 5851101 - DNA, 15 bp, Homo sapiens
attctgctatgaatt

SEQ ID NO: 5851102 - DNA, 21 bp, Homo sapiens
attctgctcacatatctgtca

SEQ ID NO: 5851103 - DNA, 17 bp, Homo sapiens
attctgctctattatat

SEQ ID NO: 5851104 - DNA, 16 bp, Homo sapiens
attctgctctgcccat

SEQ ID NO: 5851105 - DNA, 13 bp, Homo sapiens
attctgctgcccc

SEQ ID NO: 5851106 - DNA, 17 bp, Homo sapiens
attctgctgcttctcca

SEQ ID NO: 5851107 - DNA, 13 bp, Homo sapiens
attctgctggcct

SEQ ID NO: 5851108 - DNA, 20 bp, Homo sapiens
attctgcttaaagttgtaac

SEQ ID NO: 5851109 - DNA, 13 bp, Homo sapiens
attctgcttctct

SEQ ID NO: 5851110 - DNA, 23 bp, Homo sapiens
attctggaaaaaaaatatatata

SEQ ID NO: 5851111 - DNA, 20 bp, Homo sapiens
attctggaaatgtctttcta

SEQ ID NO: 5851112 - DNA, 22 bp, Homo sapiens
attctggaagctgattaaaaca

SEQ ID NO: 5851113 - DNA, 21 bp, Homo sapiens
attctggaatacatattccat

SEQ ID NO: 5851114 - DNA, 18 bp, Homo sapiens
attctggatctcctgctg

SEQ ID NO: 5851115 - DNA, 20 bp, Homo sapiens
attctggatggccgggctgc

SEQ ID NO: 5851116 - DNA, 19 bp, Homo sapiens
attctggccagactcgatg

SEQ ID NO: 5851117 - DNA, 23 bp, Homo sapiens
attctggctgcaagggccagagt

SEQ ID NO: 5851118 - DNA, 10 bp, Homo sapiens
attctgggaa

SEQ ID NO: 5851119 - DNA, 16 bp, Homo sapiens
attctgggaaaggtgc

SEQ ID NO: 5851120 - DNA, 17 bp, Homo sapiens
attctgggaaaggtgct

SEQ ID NO: 5851121 - DNA, 21 bp, Homo sapiens
attctgggaaaggtgctcaaa

SEQ ID NO: 5851122 - DNA, 14 bp, Homo sapiens
attctgggaaggga

SEQ ID NO: 5851123 - DNA, 19 bp, Homo sapiens
attctgggaggcaagaaaa

SEQ ID NO: 5851124 - DNA, 10 bp, Homo sapiens
attctgggat

SEQ ID NO: 5851125 - DNA, 22 bp, Homo sapiens
attctgggcaccacaaaatata

SEQ ID NO: 5851126 - DNA, 23 bp, Homo sapiens
attctgggcctaattttttaaag

SEQ ID NO: 5851127 - DNA, 19 bp, Homo sapiens
attctgggctcctggaacc

SEQ ID NO: 5851128 - DNA, 16 bp, Homo sapiens
attctggggtggggct

SEQ ID NO: 5851129 - DNA, 18 bp, Homo sapiens
attctggggtggggcttg

SEQ ID NO: 5851130 - DNA, 20 bp, Homo sapiens
attctggggtggggcttgga

SEQ ID NO: 5851131 - DNA, 11 bp, Homo sapiens
attctgggtga

SEQ ID NO: 5851132 - DNA, 16 bp, Homo sapiens
attctgggttttgtag

SEQ ID NO: 5851133 - DNA, 17 bp, Homo sapiens
attctggtatacattga

SEQ ID NO: 5851134 - DNA, 18 bp, Homo sapiens
attctggtcctgttttct

SEQ ID NO: 5851135 - DNA, 16 bp, Homo sapiens
attctggttccagggt

SEQ ID NO: 5851136 - DNA, 18 bp, Homo sapiens
attctggttccctgctgc

SEQ ID NO: 5851137 - DNA, 18 bp, Homo sapiens
attctggttcttgaaaat

SEQ ID NO: 5851138 - DNA, 14 bp, Homo sapiens
attctggttgtaaa

SEQ ID NO: 5851139 - DNA, 14 bp, Homo sapiens
attctgtaattaca

SEQ ID NO: 5851140 - DNA, 12 bp, Homo sapiens
attctgtacata

SEQ ID NO: 5851141 - DNA, 15 bp, Homo sapiens
attctgtacatagcc

SEQ ID NO: 5851142 - DNA, 15 bp, Homo sapiens
attctgtactgattt

SEQ ID NO: 5851143 - DNA, 21 bp, Homo sapiens
attctgtactgatttttgtaa

SEQ ID NO: 5851144 - DNA, 16 bp, Homo sapiens
attctgtataaatgca

SEQ ID NO: 5851145 - DNA, 15 bp, Homo sapiens
attctgtatagatta

SEQ ID NO: 5851146 - DNA, 23 bp, Homo sapiens
attctgtatccgtgaattgcttt

SEQ ID NO: 5851147 - DNA, 18 bp, Homo sapiens
attctgtcatagaaagtg

SEQ ID NO: 5851148 - DNA, 22 bp, Homo sapiens
attctgtcattggttacaaatt

SEQ ID NO: 5851149 - DNA, 19 bp, Homo sapiens
attctgtctcccccaaaaa

SEQ ID NO: 5851150 - DNA, 13 bp, Homo sapiens
attctgtctctgc

SEQ ID NO: 5851151 - DNA, 21 bp, Homo sapiens
attctgtcttgttcattttga

SEQ ID NO: 5851152 - DNA, 16 bp, Homo sapiens
attctgtgaaactaat

SEQ ID NO: 5851153 - DNA, 14 bp, Homo sapiens
attctgtgaagaat

SEQ ID NO: 5851154 - DNA, 16 bp, Homo sapiens
attctgtgaagaatga

SEQ ID NO: 5851155 - DNA, 17 bp, Homo sapiens
attctgtgaagaatgaa

SEQ ID NO: 5851156 - DNA, 21 bp, Homo sapiens
attctgtgaccaaaatacctt

SEQ ID NO: 5851157 - DNA, 13 bp, Homo sapiens
attctgtgcaggc

SEQ ID NO: 5851158 - DNA, 17 bp, Homo sapiens
attctgtgcaggctgca

SEQ ID NO: 5851159 - DNA, 14 bp, Homo sapiens
attctgtgccattt

SEQ ID NO: 5851160 - DNA, 20 bp, Homo sapiens
attctgtgccttgttttttg

SEQ ID NO: 5851161 - DNA, 22 bp, Homo sapiens
attctgtggaaaaataaaggaa

SEQ ID NO: 5851162 - DNA, 23 bp, Homo sapiens
attctgtggaaaaataaaggaaa

SEQ ID NO: 5851163 - DNA, 15 bp, Homo sapiens
attctgtggattcta

SEQ ID NO: 5851164 - DNA, 19 bp, Homo sapiens
attctgtggattctatatt

SEQ ID NO: 5851165 - DNA, 23 bp, Homo sapiens
attctgtgggcagctggctctga

SEQ ID NO: 5851166 - DNA, 17 bp, Homo sapiens
attctgtggtgggaaca

SEQ ID NO: 5851167 - DNA, 17 bp, Homo sapiens
attctgtggttctataa

SEQ ID NO: 5851168 - DNA, 20 bp, Homo sapiens
attctgtggttctataataa

SEQ ID NO: 5851169 - DNA, 23 bp, Homo sapiens
attctgtgtatcttttttataac

SEQ ID NO: 5851170 - DNA, 15 bp, Homo sapiens
attctgtgtcccatg

SEQ ID NO: 5851171 - DNA, 15 bp, Homo sapiens
attctgtgtggtata

SEQ ID NO: 5851172 - DNA, 22 bp, Homo sapiens
attctgtgtggtatattgttta

SEQ ID NO: 5851173 - DNA, 13 bp, Homo sapiens
attctgtgttgaa

SEQ ID NO: 5851174 - DNA, 17 bp, Homo sapiens
attctgtgttttcagac

SEQ ID NO: 5851175 - DNA, 15 bp, Homo sapiens
attctgttagctgct

SEQ ID NO: 5851176 - DNA, 21 bp, Homo sapiens
attctgttagctgctcactta

SEQ ID NO: 5851177 - DNA, 23 bp, Homo sapiens
attctgttagctgctcacttaaa

SEQ ID NO: 5851178 - DNA, 19 bp, Homo sapiens
attctgttctacttgatat

SEQ ID NO: 5851179 - DNA, 19 bp, Homo sapiens
attctgttctgatattaat

SEQ ID NO: 5851180 - DNA, 14 bp, Homo sapiens
attctgttgcccag

SEQ ID NO: 5851181 - DNA, 15 bp, Homo sapiens
attctgttgcccagg

SEQ ID NO: 5851182 - DNA, 16 bp, Homo sapiens
attctgttgcccaggc

SEQ ID NO: 5851183 - DNA, 19 bp, Homo sapiens
attctgttggccagtgtga

SEQ ID NO: 5851184 - DNA, 16 bp, Homo sapiens
attctgttgtaattta

SEQ ID NO: 5851185 - DNA, 23 bp, Homo sapiens
attctgttgtgttcaccagagaa

SEQ ID NO: 5851186 - DNA, 23 bp, Homo sapiens
attctgttgttccattttatgca

SEQ ID NO: 5851187 - DNA, 15 bp, Homo sapiens
attctgtttaaatcc

SEQ ID NO: 5851188 - DNA, 21 bp, Homo sapiens
attctgtttatgttcttgcag

SEQ ID NO: 5851189 - DNA, 12 bp, Homo sapiens
attctgtttctt

SEQ ID NO: 5851190 - DNA, 15 bp, Homo sapiens
attctgtttgccttt

SEQ ID NO: 5851191 - DNA, 12 bp, Homo sapiens
attctgttttct

SEQ ID NO: 5851192 - DNA, 13 bp, Homo sapiens
attctgttttctt

SEQ ID NO: 5851193 - DNA, 18 bp, Homo sapiens
attctgttttgtaaatgt

SEQ ID NO: 5851194 - DNA, 20 bp, Homo sapiens
attcttaaaatatatttcag

SEQ ID NO: 5851195 - DNA, 20 bp, Homo sapiens
attcttaaaatgcaatattt

SEQ ID NO: 5851196 - DNA, 20 bp, Homo sapiens
attcttaaaattcaagaaaa

SEQ ID NO: 5851197 - DNA, 21 bp, Homo sapiens
attcttaaagttgaatttatt

SEQ ID NO: 5851198 - DNA, 14 bp, Homo sapiens
attcttaaatatgt

SEQ ID NO: 5851199 - DNA, 24 bp, Homo sapiens
attcttaacacagccttccttctg

SEQ ID NO: 5851200 - DNA, 14 bp, Homo sapiens
attcttaagcactt

SEQ ID NO: 5851201 - DNA, 15 bp, Homo sapiens
attcttaagcacttt

SEQ ID NO: 5851202 - DNA, 22 bp, Homo sapiens
attcttaagcactttgaaaata

SEQ ID NO: 5851203 - DNA, 19 bp, Homo sapiens
attcttaataaaactcact

SEQ ID NO: 5851204 - DNA, 17 bp, Homo sapiens
attcttaattctctgca

SEQ ID NO: 5851205 - DNA, 19 bp, Homo sapiens
attcttaatttggatctat

SEQ ID NO: 5851206 - DNA, 15 bp, Homo sapiens
attcttacactgcct

SEQ ID NO: 5851207 - DNA, 15 bp, Homo sapiens
attcttacagccaag

SEQ ID NO: 5851208 - DNA, 23 bp, Homo sapiens
attcttaccctgtacatatgtaa

SEQ ID NO: 5851209 - DNA, 20 bp, Homo sapiens
attcttaccgaaatgaaaat

SEQ ID NO: 5851210 - DNA, 21 bp, Homo sapiens
attcttaccgaaatgaaaatg

SEQ ID NO: 5851211 - DNA, 20 bp, Homo sapiens
attcttaccgagaaaaggag

SEQ ID NO: 5851212 - DNA, 17 bp, Homo sapiens
attcttacctcatttgc

SEQ ID NO: 5851213 - DNA, 17 bp, Homo sapiens
attcttactaaaaagta

SEQ ID NO: 5851214 - DNA, 22 bp, Homo sapiens
attcttactaaaaagtataaaa

SEQ ID NO: 5851215 - DNA, 20 bp, Homo sapiens
attcttactgttctgaaatt

SEQ ID NO: 5851216 - DNA, 18 bp, Homo sapiens
attcttagcctgtggcag

SEQ ID NO: 5851217 - DNA, 20 bp, Homo sapiens
attcttagctgtaacttaac

SEQ ID NO: 5851218 - DNA, 16 bp, Homo sapiens
attcttagttaatctt

SEQ ID NO: 5851219 - DNA, 14 bp, Homo sapiens
attcttataaatat

SEQ ID NO: 5851220 - DNA, 18 bp, Homo sapiens
attcttataaatatgaag

SEQ ID NO: 5851221 - DNA, 22 bp, Homo sapiens
attcttataacattgtatgtta

SEQ ID NO: 5851222 - DNA, 18 bp, Homo sapiens
attcttataactcaacat

SEQ ID NO: 5851223 - DNA, 15 bp, Homo sapiens
attcttatacacatt

SEQ ID NO: 5851224 - DNA, 13 bp, Homo sapiens
attcttatgctta

SEQ ID NO: 5851225 - DNA, 20 bp, Homo sapiens
attcttatgttccagatggc

SEQ ID NO: 5851226 - DNA, 13 bp, Homo sapiens
attcttattccat

SEQ ID NO: 5851227 - DNA, 23 bp, Homo sapiens
attcttattccatattagaaaac

SEQ ID NO: 5851228 - DNA, 14 bp, Homo sapiens
attcttattggaaa

SEQ ID NO: 5851229 - DNA, 16 bp, Homo sapiens
attcttatttcattta

SEQ ID NO: 5851230 - DNA, 12 bp, Homo sapiens
attcttatttct

SEQ ID NO: 5851231 - DNA, 18 bp, Homo sapiens
attcttatttgatggtgg

SEQ ID NO: 5851232 - DNA, 20 bp, Homo sapiens
attcttattttataatttta

SEQ ID NO: 5851233 - DNA, 15 bp, Homo sapiens
attcttatttttaat

SEQ ID NO: 5851234 - DNA, 20 bp, Homo sapiens
attgacaccaaatattttca

SEQ ID NO: 5851235 - DNA, 12 bp, Homo sapiens
attgacactgaa

SEQ ID NO: 5851236 - DNA, 14 bp, Homo sapiens
attgacactgacta

SEQ ID NO: 5851237 - DNA, 17 bp, Homo sapiens
attgacacttaaaaatg

SEQ ID NO: 5851238 - DNA, 19 bp, Homo sapiens
attgacacttagcagtcat

SEQ ID NO: 5851239 - DNA, 16 bp, Homo sapiens
attgacagaacccttt

SEQ ID NO: 5851240 - DNA, 13 bp, Homo sapiens
attgacagaagct

SEQ ID NO: 5851241 - DNA, 20 bp, Homo sapiens
attgacagctttctaactca

SEQ ID NO: 5851242 - DNA, 14 bp, Homo sapiens
attgacagctttgc

SEQ ID NO: 5851243 - DNA, 16 bp, Homo sapiens
attgacagctttgctg

SEQ ID NO: 5851244 - DNA, 18 bp, Homo sapiens
attgacaggattattgga

SEQ ID NO: 5851245 - DNA, 16 bp, Homo sapiens
attgacagggactttg

SEQ ID NO: 5851246 - DNA, 23 bp, Homo sapiens
attgacagtaacttggttataca

SEQ ID NO: 5851247 - DNA, 23 bp, Homo sapiens
attgacagttgaacagagctaga

SEQ ID NO: 5851248 - DNA, 20 bp, Homo sapiens
attgacataggtcataaagc

SEQ ID NO: 5851249 - DNA, 14 bp, Homo sapiens
attgacatgtacag

SEQ ID NO: 5851250 - DNA, 17 bp, Homo sapiens
attgacatgtacagaga

SEQ ID NO: 5851251 - DNA, 17 bp, Homo sapiens
attgacattgaaatcta

SEQ ID NO: 5851252 - DNA, 21 bp, Homo sapiens
attgacatttgaatttggact

SEQ ID NO: 5851253 - DNA, 18 bp, Homo sapiens
attgacatttgtagttga

SEQ ID NO: 5851254 - DNA, 18 bp, Homo sapiens
attgacattttgtagcta

SEQ ID NO: 5851255 - DNA, 20 bp, Homo sapiens
attgaccaagatgatcacat

SEQ ID NO: 5851256 - DNA, 17 bp, Homo sapiens
attgaccatgtgattat

SEQ ID NO: 5851257 - DNA, 17 bp, Homo sapiens
attgaccatgtggttca

SEQ ID NO: 5851258 - DNA, 22 bp, Homo sapiens
attgaccattttttaatttact

SEQ ID NO: 5851259 - DNA, 21 bp, Homo sapiens
attgacccaaatgtgtaatat

SEQ ID NO: 5851260 - DNA, 23 bp, Homo sapiens
attgaccgcgactaatttcaaaa

SEQ ID NO: 5851261 - DNA, 18 bp, Homo sapiens
attgaccgtgctggcccc

SEQ ID NO: 5851262 - DNA, 21 bp, Homo sapiens
attgaccgtgttggtctgtac

SEQ ID NO: 5851263 - DNA, 20 bp, Homo sapiens
attgacctagttcagataca

SEQ ID NO: 5851264 - DNA, 15 bp, Homo sapiens
attgacctataaaac

SEQ ID NO: 5851265 - DNA, 18 bp, Homo sapiens
attgacctataaaacaaa

SEQ ID NO: 5851266 - DNA, 13 bp, Homo sapiens
attgacctcagct

SEQ ID NO: 5851267 - DNA, 16 bp, Homo sapiens
attgacctcagctgca

SEQ ID NO: 5851268 - DNA, 23 bp, Homo sapiens
attgacctcagctgcacattcct

SEQ ID NO: 5851269 - DNA, 20 bp, Homo sapiens
attgacctcatcattaataa

SEQ ID NO: 5851270 - DNA, 18 bp, Homo sapiens
attgacctctcagggcct

SEQ ID NO: 5851271 - DNA, 17 bp, Homo sapiens
attgacctgaggagaca

SEQ ID NO: 5851272 - DNA, 13 bp, Homo sapiens
attgacctgaggc

SEQ ID NO: 5851273 - DNA, 12 bp, Homo sapiens
attgacctgctc

SEQ ID NO: 5851274 - DNA, 21 bp, Homo sapiens
attgacctgctccgctgctcc

SEQ ID NO: 5851275 - DNA, 16 bp, Homo sapiens
attgacctggagggga

SEQ ID NO: 5851276 - DNA, 22 bp, Homo sapiens
attgacctggaggggagaggtc

SEQ ID NO: 5851277 - DNA, 15 bp, Homo sapiens
attgaccttaatttc

SEQ ID NO: 5851278 - DNA, 14 bp, Homo sapiens
attgacgaactggc

SEQ ID NO: 5851279 - DNA, 15 bp, Homo sapiens
attgacgaactggct

SEQ ID NO: 5851280 - DNA, 16 bp, Homo sapiens
attgacgaactggcta

SEQ ID NO: 5851281 - DNA, 21 bp, Homo sapiens
attgacgacaagtgctgaaca

SEQ ID NO: 5851282 - DNA, 22 bp, Homo sapiens
attgacgacaagtgctgaacag

SEQ ID NO: 5851283 - DNA, 19 bp, Homo sapiens
attgacgacctacatctga

SEQ ID NO: 5851284 - DNA, 21 bp, Homo sapiens
attgacgacctacatctgaaa

SEQ ID NO: 5851285 - DNA, 16 bp, Homo sapiens
attgacgattccttct

SEQ ID NO: 5851286 - DNA, 15 bp, Homo sapiens
attgacggtttttta

SEQ ID NO: 5851287 - DNA, 21 bp, Homo sapiens
attgacggttttttattattg

SEQ ID NO: 5851288 - DNA, 23 bp, Homo sapiens
attgacgtctagctatgctgtat

SEQ ID NO: 5851289 - DNA, 19 bp, Homo sapiens
attgactaactcaaataca

SEQ ID NO: 5851290 - DNA, 22 bp, Homo sapiens
attgactcctttccaatagaaa

SEQ ID NO: 5851291 - DNA, 13 bp, Homo sapiens
attgactctgggt

SEQ ID NO: 5851292 - DNA, 16 bp, Homo sapiens
attgactctgggtcct

SEQ ID NO: 5851293 - DNA, 23 bp, Homo sapiens
attgactctgggtccttcctgaa

SEQ ID NO: 5851294 - DNA, 13 bp, Homo sapiens
attgactgaaatt

SEQ ID NO: 5851295 - DNA, 19 bp, Homo sapiens
attgactgaagcacagcac

SEQ ID NO: 5851296 - DNA, 15 bp, Homo sapiens
attgactgatgattt

SEQ ID NO: 5851297 - DNA, 13 bp, Homo sapiens
attgactgcagtt

SEQ ID NO: 5851298 - DNA, 19 bp, Homo sapiens
attgactggtcccccatgg

SEQ ID NO: 5851299 - DNA, 14 bp, Homo sapiens
attgacttcaatga

SEQ ID NO: 5851300 - DNA, 18 bp, Homo sapiens
attgacttcaatgatagt

SEQ ID NO: 5851301 - DNA, 15 bp, Homo sapiens
attgacttcagaaac

SEQ ID NO: 5851302 - DNA, 15 bp, Homo sapiens
attgacttcagcagg

SEQ ID NO: 5851303 - DNA, 16 bp, Homo sapiens
attgacttcagcaggg

SEQ ID NO: 5851304 - DNA, 11 bp, Homo sapiens
attgacttcat

SEQ ID NO: 5851305 - DNA, 21 bp, Homo sapiens
attgacttcattttatattta

SEQ ID NO: 5851306 - DNA, 16 bp, Homo sapiens
attgacttcgactgtg

SEQ ID NO: 5851307 - DNA, 14 bp, Homo sapiens
attgacttctcttg

SEQ ID NO: 5851308 - DNA, 17 bp, Homo sapiens
attgacttctcttgaat

SEQ ID NO: 5851309 - DNA, 21 bp, Homo sapiens
attgacttcttggtgctgttg

SEQ ID NO: 5851310 - DNA, 14 bp, Homo sapiens
attgacttgtatat

SEQ ID NO: 5851311 - DNA, 21 bp, Homo sapiens
attgactttagaaagctgaca

SEQ ID NO: 5851312 - DNA, 19 bp, Homo sapiens
attgactttcagtaaacat

SEQ ID NO: 5851313 - DNA, 22 bp, Homo sapiens
attgactttccccaccagatgc

SEQ ID NO: 5851314 - DNA, 13 bp, Homo sapiens
attgactttgaca

SEQ ID NO: 5851315 - DNA, 18 bp, Homo sapiens
attgacttttataaagca

SEQ ID NO: 5851316 - DNA, 18 bp, Homo sapiens
attgactttttatggcac

SEQ ID NO: 5851317 - DNA, 13 bp, Homo sapiens
attgagaaaagag

SEQ ID NO: 5851318 - DNA, 22 bp, Homo sapiens
attgagaaaagagtgagaacta

SEQ ID NO: 5851319 - DNA, 16 bp, Homo sapiens
attgagaaagaaacta

SEQ ID NO: 5851320 - DNA, 12 bp, Homo sapiens
attgagaaagag

SEQ ID NO: 5851321 - DNA, 17 bp, Homo sapiens
attgagaaagagcactt

SEQ ID NO: 5851322 - DNA, 21 bp, Homo sapiens
attgagaaagagcacttaaga

SEQ ID NO: 5851323 - DNA, 17 bp, Homo sapiens
attgagaaagatgttcc

SEQ ID NO: 5851324 - DNA, 21 bp, Homo sapiens
attgagaactgacaaaggagc

SEQ ID NO: 5851325 - DNA, 23 bp, Homo sapiens
attgagaaggaactgatacatct

SEQ ID NO: 5851326 - DNA, 17 bp, Homo sapiens
attgagaaggagagaaa

SEQ ID NO: 5851327 - DNA, 16 bp, Homo sapiens
attgagaagttcattg

SEQ ID NO: 5851328 - DNA, 20 bp, Homo sapiens
attgagaagttttgtacaga

SEQ ID NO: 5851329 - DNA, 21 bp, Homo sapiens
attgagaataattatttcaga

SEQ ID NO: 5851330 - DNA, 16 bp, Homo sapiens
attgagaatagaaatt

SEQ ID NO: 5851331 - DNA, 13 bp, Homo sapiens
attgagaatttta

SEQ ID NO: 5851332 - DNA, 21 bp, Homo sapiens
attgagaattttaaattataa

SEQ ID NO: 5851333 - DNA, 15 bp, Homo sapiens
attgagacaaaaatt

SEQ ID NO: 5851334 - DNA, 18 bp, Homo sapiens
attgagacaaaaattatc

SEQ ID NO: 5851335 - DNA, 14 bp, Homo sapiens
attgagacagtgca

SEQ ID NO: 5851336 - DNA, 20 bp, Homo sapiens
attgagaccgtgaagatact

SEQ ID NO: 5851337 - DNA, 23 bp, Homo sapiens
attgagaccgtgaagatactttg

SEQ ID NO: 5851338 - DNA, 20 bp, Homo sapiens
attgagactgaaagaaacta

SEQ ID NO: 5851339 - DNA, 19 bp, Homo sapiens
attgagactgctagaacca

SEQ ID NO: 5851340 - DNA, 22 bp, Homo sapiens
attgagagaatggaaaacagac

SEQ ID NO: 5851341 - DNA, 20 bp, Homo sapiens
attgagagagatgtgtaatt

SEQ ID NO: 5851342 - DNA, 20 bp, Homo sapiens
attgagataatatctgtgag

SEQ ID NO: 5851343 - DNA, 21 bp, Homo sapiens
attgagataatgatacttaac

SEQ ID NO: 5851344 - DNA, 22 bp, Homo sapiens
attgagatactttttcttttgt

SEQ ID NO: 5851345 - DNA, 23 bp, Homo sapiens
attgagatcagcattcaaaatag

SEQ ID NO: 5851346 - DNA, 9 bp, Homo sapiens
attgagatt

SEQ ID NO: 5851347 - DNA, 15 bp, Homo sapiens
attgagattattaaa

SEQ ID NO: 5851348 - DNA, 16 bp, Homo sapiens
attgagattattaaaa

SEQ ID NO: 5851349 - DNA, 22 bp, Homo sapiens
attgagattgtcctcatttctc

SEQ ID NO: 5851350 - DNA, 21 bp, Homo sapiens
attgagattttccattaacta

SEQ ID NO: 5851351 - DNA, 23 bp, Homo sapiens
attgagcatattttcttactttt

SEQ ID NO: 5851352 - DNA, 22 bp, Homo sapiens
attgagcatggctctctattcc

SEQ ID NO: 5851353 - DNA, 17 bp, Homo sapiens
attgagcctaaaaataa

SEQ ID NO: 5851354 - DNA, 23 bp, Homo sapiens
attgagccttgcatgtacttgaa

SEQ ID NO: 5851355 - DNA, 15 bp, Homo sapiens
attgagcgtgattct

SEQ ID NO: 5851356 - DNA, 16 bp, Homo sapiens
attgagctagaaatca

SEQ ID NO: 5851357 - DNA, 19 bp, Homo sapiens
attgagctgcagaaacgaa

SEQ ID NO: 5851358 - DNA, 19 bp, Homo sapiens
attgagctgcctccagcct

SEQ ID NO: 5851359 - DNA, 20 bp, Homo sapiens
attgagctgcctccagcctg

SEQ ID NO: 5851360 - DNA, 21 bp, Homo sapiens
attgagctggacctcaccaag

SEQ ID NO: 5851361 - DNA, 14 bp, Homo sapiens
attgagctgtttcc

SEQ ID NO: 5851362 - DNA, 21 bp, Homo sapiens
attgaggaaaaactgacagat

SEQ ID NO: 5851363 - DNA, 20 bp, Homo sapiens
attgaggaaaaatatgtgaa

SEQ ID NO: 5851364 - DNA, 15 bp, Homo sapiens
attgaggaagagtct

SEQ ID NO: 5851365 - DNA, 22 bp, Homo sapiens
attgaggacactgatatgggtc

SEQ ID NO: 5851366 - DNA, 16 bp, Homo sapiens
attgaggataaattgc

SEQ ID NO: 5851367 - DNA, 13 bp, Homo sapiens
attgaggatggaa

SEQ ID NO: 5851368 - DNA, 15 bp, Homo sapiens
attgaggctttgtgt

SEQ ID NO: 5851369 - DNA, 14 bp, Homo sapiens
attgagggaaaaca

SEQ ID NO: 5851370 - DNA, 17 bp, Homo sapiens
attgagggaaaacataa

SEQ ID NO: 5851371 - DNA, 18 bp, Homo sapiens
attgagggcattagtact

SEQ ID NO: 5851372 - DNA, 16 bp, Homo sapiens
attgagggccagtgat

SEQ ID NO: 5851373 - DNA, 18 bp, Homo sapiens
attgaggggaggtggcca

SEQ ID NO: 5851374 - DNA, 22 bp, Homo sapiens
attgaggggattaatatgaaaa

SEQ ID NO: 5851375 - DNA, 15 bp, Homo sapiens
attgaggggccctgg

SEQ ID NO: 5851376 - DNA, 20 bp, Homo sapiens
attgagggtcattctttatt

SEQ ID NO: 5851377 - DNA, 14 bp, Homo sapiens
attgagtaagaaca

SEQ ID NO: 5851378 - DNA, 21 bp, Homo sapiens
attgagtaatattacatttca

SEQ ID NO: 5851379 - DNA, 19 bp, Homo sapiens
attgagtaatggtgtagaa

SEQ ID NO: 5851380 - DNA, 20 bp, Homo sapiens
attgagtacctactgtgtgc

SEQ ID NO: 5851381 - DNA, 13 bp, Homo sapiens
attgagtattgtt

SEQ ID NO: 5851382 - DNA, 14 bp, Homo sapiens
attgagtattgttt

SEQ ID NO: 5851383 - DNA, 20 bp, Homo sapiens
attgagtattgtttaaaatg

SEQ ID NO: 5851384 - DNA, 15 bp, Homo sapiens
attgagtcaaatggt

SEQ ID NO: 5851385 - DNA, 19 bp, Homo sapiens
attgagtccagctttcctt

SEQ ID NO: 5851386 - DNA, 16 bp, Homo sapiens
attgagttacagggga

SEQ ID NO: 5851387 - DNA, 19 bp, Homo sapiens
attgagtttaagtctctga

SEQ ID NO: 5851388 - DNA, 18 bp, Homo sapiens
attgagtttcagaataaa

SEQ ID NO: 5851389 - DNA, 21 bp, Homo sapiens
attgagtttgtaggtaaaatg

SEQ ID NO: 5851390 - DNA, 21 bp, Homo sapiens
attgataaaagagttccctgc

SEQ ID NO: 5851391 - DNA, 19 bp, Homo sapiens
attgataacagcactgact

SEQ ID NO: 5851392 - DNA, 21 bp, Homo sapiens
attgataagaaccttttgagt

SEQ ID NO: 5851393 - DNA, 16 bp, Homo sapiens
attgataagagggcac

SEQ ID NO: 5851394 - DNA, 14 bp, Homo sapiens
attgataagatggt

SEQ ID NO: 5851395 - DNA, 19 bp, Homo sapiens
attgataagttcatacatt

SEQ ID NO: 5851396 - DNA, 18 bp, Homo sapiens
attgataataaaattcat

SEQ ID NO: 5851397 - DNA, 21 bp, Homo sapiens
attgataattcgagcaaacaa

SEQ ID NO: 5851398 - DNA, 23 bp, Homo sapiens
attgatacctgttcctttttctg

SEQ ID NO: 5851399 - DNA, 13 bp, Homo sapiens
attgatacgttta

SEQ ID NO: 5851400 - DNA, 13 bp, Homo sapiens
attgatagaacta

SEQ ID NO: 5851401 - DNA, 18 bp, Homo sapiens
attgatagagtgttatca

SEQ ID NO: 5851402 - DNA, 16 bp, Homo sapiens
attgatagtttcattt

SEQ ID NO: 5851403 - DNA, 21 bp, Homo sapiens
attgatagtttcatttacaat

SEQ ID NO: 5851404 - DNA, 14 bp, Homo sapiens
attgatatgaaaaa

SEQ ID NO: 5851405 - DNA, 16 bp, Homo sapiens
attgatatgaaaaata

SEQ ID NO: 5851406 - DNA, 22 bp, Homo sapiens
attgatattatattaaacatac

SEQ ID NO: 5851407 - DNA, 20 bp, Homo sapiens
attgatattcaataaagcag

SEQ ID NO: 5851408 - DNA, 14 bp, Homo sapiens
attgatattctaag

SEQ ID NO: 5851409 - DNA, 14 bp, Homo sapiens
attgatattgtgaa

SEQ ID NO: 5851410 - DNA, 22 bp, Homo sapiens
attgctgaagggcattctttcc

SEQ ID NO: 5851411 - DNA, 14 bp, Homo sapiens
attgctgaatccca

SEQ ID NO: 5851412 - DNA, 21 bp, Homo sapiens
attgctgaatggagttaaact

SEQ ID NO: 5851413 - DNA, 15 bp, Homo sapiens
attgctgacagagcc

SEQ ID NO: 5851414 - DNA, 16 bp, Homo sapiens
attgctgacagagccc

SEQ ID NO: 5851415 - DNA, 16 bp, Homo sapiens
attgctgactgtagct

SEQ ID NO: 5851416 - DNA, 15 bp, Homo sapiens
attgctgactgtgta

SEQ ID NO: 5851417 - DNA, 22 bp, Homo sapiens
attgctgagagaaatatggaac

SEQ ID NO: 5851418 - DNA, 23 bp, Homo sapiens
attgctgagagaaatatggaact

SEQ ID NO: 5851419 - DNA, 13 bp, Homo sapiens
attgctgagatgt

SEQ ID NO: 5851420 - DNA, 23 bp, Homo sapiens
attgctgagatgtttagtagctg

SEQ ID NO: 5851421 - DNA, 23 bp, Homo sapiens
attgctgataccatatgaatgaa

SEQ ID NO: 5851422 - DNA, 18 bp, Homo sapiens
attgctgatggtgcaatg

SEQ ID NO: 5851423 - DNA, 16 bp, Homo sapiens
attgctgatgtagtat

SEQ ID NO: 5851424 - DNA, 12 bp, Homo sapiens
attgctgatttt

SEQ ID NO: 5851425 - DNA, 17 bp, Homo sapiens
attgctgattttaatgg

SEQ ID NO: 5851426 - DNA, 16 bp, Homo sapiens
attgctgcatatttga

SEQ ID NO: 5851427 - DNA, 20 bp, Homo sapiens
attgctgcatatttgacctt

SEQ ID NO: 5851428 - DNA, 17 bp, Homo sapiens
attgctgcattttaagc

SEQ ID NO: 5851429 - DNA, 22 bp, Homo sapiens
attgctgcattttaagcataat

SEQ ID NO: 5851430 - DNA, 10 bp, Homo sapiens
attgctgcca

SEQ ID NO: 5851431 - DNA, 18 bp, Homo sapiens
attgctgccaaaaccaca

SEQ ID NO: 5851432 - DNA, 19 bp, Homo sapiens
attgctgccaaaaccacat

SEQ ID NO: 5851433 - DNA, 14 bp, Homo sapiens
attgctgccagaga

SEQ ID NO: 5851434 - DNA, 17 bp, Homo sapiens
attgctgccagagaagt

SEQ ID NO: 5851435 - DNA, 14 bp, Homo sapiens
attgctgccaggca

SEQ ID NO: 5851436 - DNA, 21 bp, Homo sapiens
attgctgccccatcagtgctc

SEQ ID NO: 5851437 - DNA, 21 bp, Homo sapiens
attgctgcccgtttgtacatg

SEQ ID NO: 5851438 - DNA, 20 bp, Homo sapiens
attgctgcctttgtccccac

SEQ ID NO: 5851439 - DNA, 15 bp, Homo sapiens
attgctgctgctacc

SEQ ID NO: 5851440 - DNA, 15 bp, Homo sapiens
attgctgctggtaat

SEQ ID NO: 5851441 - DNA, 21 bp, Homo sapiens
attgctgctgtgcgtggaaaa

SEQ ID NO: 5851442 - DNA, 18 bp, Homo sapiens
attgctggaaaccaagtc

SEQ ID NO: 5851443 - DNA, 23 bp, Homo sapiens
attgctggagacagtagaggcat

SEQ ID NO: 5851444 - DNA, 19 bp, Homo sapiens
attgctggcaaagacagaa

SEQ ID NO: 5851445 - DNA, 20 bp, Homo sapiens
attgctggcaaagacagaag

SEQ ID NO: 5851446 - DNA, 22 bp, Homo sapiens
attgctggcaaagacagaagcc

SEQ ID NO: 5851447 - DNA, 13 bp, Homo sapiens
attgctggctgcc

SEQ ID NO: 5851448 - DNA, 18 bp, Homo sapiens
attgctggctggaaggga

SEQ ID NO: 5851449 - DNA, 16 bp, Homo sapiens
attgctggggccaggc

SEQ ID NO: 5851450 - DNA, 19 bp, Homo sapiens
attgctggggccaggcccc

SEQ ID NO: 5851451 - DNA, 21 bp, Homo sapiens
attgctggggccaggccccat

SEQ ID NO: 5851452 - DNA, 23 bp, Homo sapiens
attgctggggccaggccccatgg

SEQ ID NO: 5851453 - DNA, 21 bp, Homo sapiens
attgctggtagagacccccag

SEQ ID NO: 5851454 - DNA, 18 bp, Homo sapiens
attgctggtcttgtaaga

SEQ ID NO: 5851455 - DNA, 21 bp, Homo sapiens
attgctgtaccacatctgctc

SEQ ID NO: 5851456 - DNA, 14 bp, Homo sapiens
attgctgtcctgga

SEQ ID NO: 5851457 - DNA, 14 bp, Homo sapiens
attgctgtccttgg

SEQ ID NO: 5851458 - DNA, 17 bp, Homo sapiens
attgctgtctagcctta

SEQ ID NO: 5851459 - DNA, 15 bp, Homo sapiens
attgctgtctgcagc

SEQ ID NO: 5851460 - DNA, 17 bp, Homo sapiens
attgctgtgagccttgc

SEQ ID NO: 5851461 - DNA, 22 bp, Homo sapiens
attgctgtgtccaactccagta

SEQ ID NO: 5851462 - DNA, 23 bp, Homo sapiens
attgctgtgtccaactccagtac

SEQ ID NO: 5851463 - DNA, 12 bp, Homo sapiens
attgctgtgtga

SEQ ID NO: 5851464 - DNA, 17 bp, Homo sapiens
attgctgtgtgtcccag

SEQ ID NO: 5851465 - DNA, 20 bp, Homo sapiens
attgctgttatgtctgttta

SEQ ID NO: 5851466 - DNA, 17 bp, Homo sapiens
attgctgttgaaagcaa

SEQ ID NO: 5851467 - DNA, 15 bp, Homo sapiens
attgctgttgcttga

SEQ ID NO: 5851468 - DNA, 21 bp, Homo sapiens
attgctgttgtccaactattt

SEQ ID NO: 5851469 - DNA, 17 bp, Homo sapiens
attgctgttgtccctct

SEQ ID NO: 5851470 - DNA, 12 bp, Homo sapiens
attgctgttgtt

SEQ ID NO: 5851471 - DNA, 13 bp, Homo sapiens
attgctgttgttg

SEQ ID NO: 5851472 - DNA, 14 bp, Homo sapiens
attgctgttgttgc

SEQ ID NO: 5851473 - DNA, 16 bp, Homo sapiens
attgctgttgttgcag

SEQ ID NO: 5851474 - DNA, 23 bp, Homo sapiens
attgctgtttggtttgtttataa

SEQ ID NO: 5851475 - DNA, 20 bp, Homo sapiens
attgcttaaaagacattttt

SEQ ID NO: 5851476 - DNA, 13 bp, Homo sapiens
attgcttaaaagc

SEQ ID NO: 5851477 - DNA, 14 bp, Homo sapiens
attgcttaaaagca

SEQ ID NO: 5851478 - DNA, 16 bp, Homo sapiens
attgcttaaaatagca

SEQ ID NO: 5851479 - DNA, 17 bp, Homo sapiens
attgcttaaaatagcaa

SEQ ID NO: 5851480 - DNA, 18 bp, Homo sapiens
attgcttaatttctgcct

SEQ ID NO: 5851481 - DNA, 20 bp, Homo sapiens
attgcttacatttttacaat

SEQ ID NO: 5851482 - DNA, 14 bp, Homo sapiens
attgcttactgata

SEQ ID NO: 5851483 - DNA, 18 bp, Homo sapiens
attgcttactgtgttaaa

SEQ ID NO: 5851484 - DNA, 23 bp, Homo sapiens
attgcttagtaaaatttatttca

SEQ ID NO: 5851485 - DNA, 16 bp, Homo sapiens
attgcttattcttgag

SEQ ID NO: 5851486 - DNA, 20 bp, Homo sapiens
attgcttatttattgtattc

SEQ ID NO: 5851487 - DNA, 23 bp, Homo sapiens
attgcttatttattgtattctgg

SEQ ID NO: 5851488 - DNA, 17 bp, Homo sapiens
attgcttcaatttcaaa

SEQ ID NO: 5851489 - DNA, 20 bp, Homo sapiens
attgcttcattaaaacaaga

SEQ ID NO: 5851490 - DNA, 19 bp, Homo sapiens
attgcttcctcctccccaa

SEQ ID NO: 5851491 - DNA, 15 bp, Homo sapiens
attgcttcctgtgta

SEQ ID NO: 5851492 - DNA, 10 bp, Homo sapiens
attgcttcta

SEQ ID NO: 5851493 - DNA, 15 bp, Homo sapiens
attgcttctgtagta

SEQ ID NO: 5851494 - DNA, 13 bp, Homo sapiens
attgcttcttctg

SEQ ID NO: 5851495 - DNA, 14 bp, Homo sapiens
attgcttcttctga

SEQ ID NO: 5851496 - DNA, 11 bp, Homo sapiens
attgcttcttg

SEQ ID NO: 5851497 - DNA, 23 bp, Homo sapiens
attgcttgaaagaaaatatgcat

SEQ ID NO: 5851498 - DNA, 19 bp, Homo sapiens
attgcttgaaccggggaga

SEQ ID NO: 5851499 - DNA, 15 bp, Homo sapiens
attgcttgagcatgc

SEQ ID NO: 5851500 - DNA, 23 bp, Homo sapiens
attgcttgagcctggctgtccaa

SEQ ID NO: 5851501 - DNA, 16 bp, Homo sapiens
attgcttgagcttggg

SEQ ID NO: 5851502 - DNA, 13 bp, Homo sapiens
attgcttgggtct

SEQ ID NO: 5851503 - DNA, 15 bp, Homo sapiens
attgcttgggtctct

SEQ ID NO: 5851504 - DNA, 17 bp, Homo sapiens
attgcttgggtctctct

SEQ ID NO: 5851505 - DNA, 22 bp, Homo sapiens
attgcttgggtctctctccatt

SEQ ID NO: 5851506 - DNA, 14 bp, Homo sapiens
attgctttaaatct

SEQ ID NO: 5851507 - DNA, 13 bp, Homo sapiens
attgctttataaa

SEQ ID NO: 5851508 - DNA, 15 bp, Homo sapiens
attgctttataaata

SEQ ID NO: 5851509 - DNA, 16 bp, Homo sapiens
attgctttataaataa

SEQ ID NO: 5851510 - DNA, 17 bp, Homo sapiens
attgctttataaataaa

SEQ ID NO: 5851511 - DNA, 23 bp, Homo sapiens
attgctttatgggggggagggag

SEQ ID NO: 5851512 - DNA, 14 bp, Homo sapiens
attgctttccactg

SEQ ID NO: 5851513 - DNA, 22 bp, Homo sapiens
attgctttcctgcctccttgaa

SEQ ID NO: 5851514 - DNA, 18 bp, Homo sapiens
attgctttcgtgtaaatt

SEQ ID NO: 5851515 - DNA, 13 bp, Homo sapiens
attgctttctgaa

SEQ ID NO: 5851516 - DNA, 17 bp, Homo sapiens
attgctttctgaaatta

SEQ ID NO: 5851517 - DNA, 16 bp, Homo sapiens
attgctttctgctctt

SEQ ID NO: 5851518 - DNA, 16 bp, Homo sapiens
attgctttgaaaaagt

SEQ ID NO: 5851519 - DNA, 13 bp, Homo sapiens
attgctttgaagc

SEQ ID NO: 5851520 - DNA, 21 bp, Homo sapiens
attgctttgattaatccagaa

SEQ ID NO: 5851521 - DNA, 14 bp, Homo sapiens
attgctttgccaaa

SEQ ID NO: 5851522 - DNA, 14 bp, Homo sapiens
attgctttggtcat

SEQ ID NO: 5851523 - DNA, 17 bp, Homo sapiens
attgctttgtgacttct

SEQ ID NO: 5851524 - DNA, 18 bp, Homo sapiens
attgctttgtgacttctt

SEQ ID NO: 5851525 - DNA, 20 bp, Homo sapiens
attgctttgtggttatcact

SEQ ID NO: 5851526 - DNA, 18 bp, Homo sapiens
attgcttttaaaactact

SEQ ID NO: 5851527 - DNA, 16 bp, Homo sapiens
attgcttttattttga

SEQ ID NO: 5851528 - DNA, 20 bp, Homo sapiens
attgcttttgtgcattggat

SEQ ID NO: 5851529 - DNA, 14 bp, Homo sapiens
attgcttttttaaa

SEQ ID NO: 5851530 - DNA, 18 bp, Homo sapiens
attgcttttttgtattgg

SEQ ID NO: 5851531 - DNA, 13 bp, Homo sapiens
attggaaaaatca

SEQ ID NO: 5851532 - DNA, 14 bp, Homo sapiens
attggaaaaatcac

SEQ ID NO: 5851533 - DNA, 20 bp, Homo sapiens
attggaaaataataaaagaa

SEQ ID NO: 5851534 - DNA, 14 bp, Homo sapiens
attggaaaatttaa

SEQ ID NO: 5851535 - DNA, 17 bp, Homo sapiens
attggaaagacaggaag

SEQ ID NO: 5851536 - DNA, 22 bp, Homo sapiens
attggaaagacaggaagaccaa

SEQ ID NO: 5851537 - DNA, 16 bp, Homo sapiens
attggaaagacttctc

SEQ ID NO: 5851538 - DNA, 13 bp, Homo sapiens
attggaaaggact

SEQ ID NO: 5851539 - DNA, 16 bp, Homo sapiens
attggaaatttagcat

SEQ ID NO: 5851540 - DNA, 18 bp, Homo sapiens
attggaactggaggcagg

SEQ ID NO: 5851541 - DNA, 14 bp, Homo sapiens
attggaagacttgg

SEQ ID NO: 5851542 - DNA, 14 bp, Homo sapiens
attggaagagagaa

SEQ ID NO: 5851543 - DNA, 21 bp, Homo sapiens
attggaagagcagcacctcct

SEQ ID NO: 5851544 - DNA, 21 bp, Homo sapiens
attggaagcaggttaaatgtt

SEQ ID NO: 5851545 - DNA, 14 bp, Homo sapiens
attggaaggagaca

SEQ ID NO: 5851546 - DNA, 16 bp, Homo sapiens
attggaaggagacaca

SEQ ID NO: 5851547 - DNA, 20 bp, Homo sapiens
attggaaggagacacagatg

SEQ ID NO: 5851548 - DNA, 23 bp, Homo sapiens
attggaagtatagatggtagaaa

SEQ ID NO: 5851549 - DNA, 14 bp, Homo sapiens
attggaatagcagc

SEQ ID NO: 5851550 - DNA, 18 bp, Homo sapiens
attggaatctgatatact

SEQ ID NO: 5851551 - DNA, 15 bp, Homo sapiens
attggaatcttcacc

SEQ ID NO: 5851552 - DNA, 20 bp, Homo sapiens
attggaatcttcacctcaga

SEQ ID NO: 5851553 - DNA, 22 bp, Homo sapiens
attggaatgcagaggtctccaa

SEQ ID NO: 5851554 - DNA, 15 bp, Homo sapiens
attggaattaacctg

SEQ ID NO: 5851555 - DNA, 19 bp, Homo sapiens
attggaattaacctggtgc

SEQ ID NO: 5851556 - DNA, 15 bp, Homo sapiens
attggaattataaat

SEQ ID NO: 5851557 - DNA, 18 bp, Homo sapiens
attggaattctactggaa

SEQ ID NO: 5851558 - DNA, 14 bp, Homo sapiens
attggaattctttc

SEQ ID NO: 5851559 - DNA, 12 bp, Homo sapiens
attggaattttc

SEQ ID NO: 5851560 - DNA, 15 bp, Homo sapiens
attggaattttctta

SEQ ID NO: 5851561 - DNA, 17 bp, Homo sapiens
attggaattttctttca

SEQ ID NO: 5851562 - DNA, 14 bp, Homo sapiens
attggacagaaaat

SEQ ID NO: 5851563 - DNA, 16 bp, Homo sapiens
attggacagacacaga

SEQ ID NO: 5851564 - DNA, 16 bp, Homo sapiens
attggacatagatatt

SEQ ID NO: 5851565 - DNA, 19 bp, Homo sapiens
attggacatggtctcctct

SEQ ID NO: 5851566 - DNA, 15 bp, Homo sapiens
attggaccaggccat

SEQ ID NO: 5851567 - DNA, 14 bp, Homo sapiens
attggacccttcca

SEQ ID NO: 5851568 - DNA, 22 bp, Homo sapiens
attggacggtttctagcctctg

SEQ ID NO: 5851569 - DNA, 16 bp, Homo sapiens
attggactccaggcct

SEQ ID NO: 5851570 - DNA, 18 bp, Homo sapiens
attggactgagggctggg

SEQ ID NO: 5851571 - DNA, 13 bp, Homo sapiens
attggacttccat

SEQ ID NO: 5851572 - DNA, 19 bp, Homo sapiens
attggagaaaagcacttaa

SEQ ID NO: 5851573 - DNA, 23 bp, Homo sapiens
attggagaaaagcacttaaagtt

SEQ ID NO: 5851574 - DNA, 22 bp, Homo sapiens
attggagaagtaatcctaggga

SEQ ID NO: 5851575 - DNA, 22 bp, Homo sapiens
attggagaatactttgcttcat

SEQ ID NO: 5851576 - DNA, 18 bp, Homo sapiens
attggagcacctgggccc

SEQ ID NO: 5851577 - DNA, 22 bp, Homo sapiens
attggagcacctgggccccact

SEQ ID NO: 5851578 - DNA, 21 bp, Homo sapiens
attggagcggtgggcactgtt

SEQ ID NO: 5851579 - DNA, 19 bp, Homo sapiens
attggagctcgtgggacag

SEQ ID NO: 5851580 - DNA, 17 bp, Homo sapiens
attggagctgactgttc

SEQ ID NO: 5851581 - DNA, 22 bp, Homo sapiens
attggaggaccaaaaaaataag

SEQ ID NO: 5851582 - DNA, 23 bp, Homo sapiens
attggagggtgggagagcccagc

SEQ ID NO: 5851583 - DNA, 23 bp, Homo sapiens
attggaggtgagatcacagcctc

SEQ ID NO: 5851584 - DNA, 15 bp, Homo sapiens
attggagtcctggtt

SEQ ID NO: 5851585 - DNA, 21 bp, Homo sapiens
attggagtgcagctaacatga

SEQ ID NO: 5851586 - DNA, 20 bp, Homo sapiens
attggagttggagtagaatg

SEQ ID NO: 5851587 - DNA, 13 bp, Homo sapiens
attgtatctcctt

SEQ ID NO: 5851588 - DNA, 21 bp, Homo sapiens
attgtatctccttcagaagtt

SEQ ID NO: 5851589 - DNA, 14 bp, Homo sapiens
attgtatctcttaa

SEQ ID NO: 5851590 - DNA, 16 bp, Homo sapiens
attgtatctcttaaag

SEQ ID NO: 5851591 - DNA, 16 bp, Homo sapiens
attgtatctgtctttc

SEQ ID NO: 5851592 - DNA, 13 bp, Homo sapiens
attgtatgaaaat

SEQ ID NO: 5851593 - DNA, 14 bp, Homo sapiens
attgtatgatgtgt

SEQ ID NO: 5851594 - DNA, 15 bp, Homo sapiens
attgtatgcagggag

SEQ ID NO: 5851595 - DNA, 13 bp, Homo sapiens
attgtattaacgc

SEQ ID NO: 5851596 - DNA, 14 bp, Homo sapiens
attgtattacaaat

SEQ ID NO: 5851597 - DNA, 21 bp, Homo sapiens
attgtattagtattgtgaata

SEQ ID NO: 5851598 - DNA, 15 bp, Homo sapiens
attgtattatcatat

SEQ ID NO: 5851599 - DNA, 17 bp, Homo sapiens
attgtattatttggagt

SEQ ID NO: 5851600 - DNA, 12 bp, Homo sapiens
attgtattctgg

SEQ ID NO: 5851601 - DNA, 17 bp, Homo sapiens
attgtattgaaaacact

SEQ ID NO: 5851602 - DNA, 19 bp, Homo sapiens
attgtattgaaaacactta

SEQ ID NO: 5851603 - DNA, 12 bp, Homo sapiens
attgtattgctg

SEQ ID NO: 5851604 - DNA, 14 bp, Homo sapiens
attgtattgctgtc

SEQ ID NO: 5851605 - DNA, 13 bp, Homo sapiens
attgtattgttag

SEQ ID NO: 5851606 - DNA, 21 bp, Homo sapiens
attgtatttaaaacatttcat

SEQ ID NO: 5851607 - DNA, 16 bp, Homo sapiens
attgtatttaagacat

SEQ ID NO: 5851608 - DNA, 17 bp, Homo sapiens
attgtatttaagacata

SEQ ID NO: 5851609 - DNA, 19 bp, Homo sapiens
attgtatttaagacataaa

SEQ ID NO: 5851610 - DNA, 13 bp, Homo sapiens
attgtatttatat

SEQ ID NO: 5851611 - DNA, 18 bp, Homo sapiens
attgtatttattcaataa

SEQ ID NO: 5851612 - DNA, 14 bp, Homo sapiens
attgtatttattcc

SEQ ID NO: 5851613 - DNA, 18 bp, Homo sapiens
attgtatttattccatat

SEQ ID NO: 5851614 - DNA, 15 bp, Homo sapiens
attgtatttgtttct

SEQ ID NO: 5851615 - DNA, 21 bp, Homo sapiens
attgtattttactttgtgcaa

SEQ ID NO: 5851616 - DNA, 15 bp, Homo sapiens
attgtattttagtat

SEQ ID NO: 5851617 - DNA, 21 bp, Homo sapiens
attgtattttgtttgtggcat

SEQ ID NO: 5851618 - DNA, 17 bp, Homo sapiens
attgtcaaaaaccagaa

SEQ ID NO: 5851619 - DNA, 14 bp, Homo sapiens
attgtcaaagagta

SEQ ID NO: 5851620 - DNA, 23 bp, Homo sapiens
attgtcaaagtggtgagaggcat

SEQ ID NO: 5851621 - DNA, 21 bp, Homo sapiens
attgtcaaatgtaaatttact

SEQ ID NO: 5851622 - DNA, 18 bp, Homo sapiens
attgtcaacactatataa

SEQ ID NO: 5851623 - DNA, 19 bp, Homo sapiens
attgtcacatcaagcatca

SEQ ID NO: 5851624 - DNA, 14 bp, Homo sapiens
attgtcacatctat

SEQ ID NO: 5851625 - DNA, 16 bp, Homo sapiens
attgtcacctcagcac

SEQ ID NO: 5851626 - DNA, 18 bp, Homo sapiens
attgtcacctcagcactg

SEQ ID NO: 5851627 - DNA, 19 bp, Homo sapiens
attgtcacctctgttaagg

SEQ ID NO: 5851628 - DNA, 14 bp, Homo sapiens
attgtcagaatgtt

SEQ ID NO: 5851629 - DNA, 12 bp, Homo sapiens
attgtcagaatt

SEQ ID NO: 5851630 - DNA, 14 bp, Homo sapiens
attgtcagccacct

SEQ ID NO: 5851631 - DNA, 12 bp, Homo sapiens
attgtcagccat

SEQ ID NO: 5851632 - DNA, 18 bp, Homo sapiens
attgtcagttttgttcac

SEQ ID NO: 5851633 - DNA, 15 bp, Homo sapiens
attgtcatcaggaga

SEQ ID NO: 5851634 - DNA, 19 bp, Homo sapiens
attgtcatctttttctaga

SEQ ID NO: 5851635 - DNA, 20 bp, Homo sapiens
attgtcattactgcctttgg

SEQ ID NO: 5851636 - DNA, 14 bp, Homo sapiens
attgtccaccttct

SEQ ID NO: 5851637 - DNA, 14 bp, Homo sapiens
attgtccagctggg

SEQ ID NO: 5851638 - DNA, 15 bp, Homo sapiens
attgtccaggaaaga

SEQ ID NO: 5851639 - DNA, 14 bp, Homo sapiens
attgtccagtttgt

SEQ ID NO: 5851640 - DNA, 12 bp, Homo sapiens
attgtccatatc

SEQ ID NO: 5851641 - DNA, 11 bp, Homo sapiens
attgtccatgt

SEQ ID NO: 5851642 - DNA, 15 bp, Homo sapiens
attgtccatgtgctt

SEQ ID NO: 5851643 - DNA, 13 bp, Homo sapiens
attgtccattcca

SEQ ID NO: 5851644 - DNA, 19 bp, Homo sapiens
attgtccccgacccttgcc

SEQ ID NO: 5851645 - DNA, 17 bp, Homo sapiens
attgtccggccgctttg

SEQ ID NO: 5851646 - DNA, 16 bp, Homo sapiens
attgtcctaagtgtca

SEQ ID NO: 5851647 - DNA, 18 bp, Homo sapiens
attgtcctattagtgtta

SEQ ID NO: 5851648 - DNA, 22 bp, Homo sapiens
attgtcctgtgaaatattctta

SEQ ID NO: 5851649 - DNA, 13 bp, Homo sapiens
attgtccttcaga

SEQ ID NO: 5851650 - DNA, 15 bp, Homo sapiens
attgtccttcagagc

SEQ ID NO: 5851651 - DNA, 17 bp, Homo sapiens
attgtccttcagagctc

SEQ ID NO: 5851652 - DNA, 18 bp, Homo sapiens
attgtccttcagagctct

SEQ ID NO: 5851653 - DNA, 13 bp, Homo sapiens
attgtccttgaag

SEQ ID NO: 5851654 - DNA, 18 bp, Homo sapiens
attgtccttgaagcttgt

SEQ ID NO: 5851655 - DNA, 15 bp, Homo sapiens
attgtccttgtgtat

SEQ ID NO: 5851656 - DNA, 22 bp, Homo sapiens
attgtccttttctaggaagcac

SEQ ID NO: 5851657 - DNA, 21 bp, Homo sapiens
attgtccttttctcccatttc

SEQ ID NO: 5851658 - DNA, 15 bp, Homo sapiens
attgtccttttgcaa

SEQ ID NO: 5851659 - DNA, 16 bp, Homo sapiens
attgtccttttgcaaa

SEQ ID NO: 5851660 - DNA, 17 bp, Homo sapiens
attgtccttttgcaaag

SEQ ID NO: 5851661 - DNA, 18 bp, Homo sapiens
attgtccttttgcaaaga

SEQ ID NO: 5851662 - DNA, 22 bp, Homo sapiens
attgtcgtataggcatgtaaac

SEQ ID NO: 5851663 - DNA, 14 bp, Homo sapiens
attgtcgtttttat

SEQ ID NO: 5851664 - DNA, 17 bp, Homo sapiens
attgtctaaaatgtcag

SEQ ID NO: 5851665 - DNA, 21 bp, Homo sapiens
attgtctaaccaattgtgaga

SEQ ID NO: 5851666 - DNA, 15 bp, Homo sapiens
attgtctaatgacag

SEQ ID NO: 5851667 - DNA, 20 bp, Homo sapiens
attgtctactcctagaagaa

SEQ ID NO: 5851668 - DNA, 21 bp, Homo sapiens
attgtctactcctagaagaac

SEQ ID NO: 5851669 - DNA, 15 bp, Homo sapiens
attgtctactctgaa

SEQ ID NO: 5851670 - DNA, 12 bp, Homo sapiens
attgtctattta

SEQ ID NO: 5851671 - DNA, 23 bp, Homo sapiens
attgtctcaacgcctccccctcc

SEQ ID NO: 5851672 - DNA, 18 bp, Homo sapiens
attgtctcccgcccccca

SEQ ID NO: 5851673 - DNA, 19 bp, Homo sapiens
attgtctcccgccccccac

SEQ ID NO: 5851674 - DNA, 20 bp, Homo sapiens
attgtctcctatatatttct

SEQ ID NO: 5851675 - DNA, 15 bp, Homo sapiens
attgtctctgggctg

SEQ ID NO: 5851676 - DNA, 18 bp, Homo sapiens
attgtctgaaattttcta

SEQ ID NO: 5851677 - DNA, 18 bp, Homo sapiens
attgtctgaacttgcatt

SEQ ID NO: 5851678 - DNA, 18 bp, Homo sapiens
attgtctgattgaaacat

SEQ ID NO: 5851679 - DNA, 21 bp, Homo sapiens
attgtctgattgaaacatgaa

SEQ ID NO: 5851680 - DNA, 17 bp, Homo sapiens
attgtctgctgcctcca

SEQ ID NO: 5851681 - DNA, 17 bp, Homo sapiens
attgtctgtctgctctt

SEQ ID NO: 5851682 - DNA, 11 bp, Homo sapiens
attgtcttaaa

SEQ ID NO: 5851683 - DNA, 19 bp, Homo sapiens
attgtcttaatggatgaaa

SEQ ID NO: 5851684 - DNA, 11 bp, Homo sapiens
attgtcttcca

SEQ ID NO: 5851685 - DNA, 16 bp, Homo sapiens
attgtcttccaacccc

SEQ ID NO: 5851686 - DNA, 20 bp, Homo sapiens
attgtcttccaaccccagct

SEQ ID NO: 5851687 - DNA, 18 bp, Homo sapiens
attgtcttcggaaacctt

SEQ ID NO: 5851688 - DNA, 18 bp, Homo sapiens
attgtcttgttctgtccc

SEQ ID NO: 5851689 - DNA, 20 bp, Homo sapiens
attgtctttactaaacagat

SEQ ID NO: 5851690 - DNA, 22 bp, Homo sapiens
attgtctttatgagctaaaaat

SEQ ID NO: 5851691 - DNA, 23 bp, Homo sapiens
attgtctttatgagctaaaaata

SEQ ID NO: 5851692 - DNA, 22 bp, Homo sapiens
attgtctttcattttgcctgag

SEQ ID NO: 5851693 - DNA, 14 bp, Homo sapiens
attgtctttgctgt

SEQ ID NO: 5851694 - DNA, 15 bp, Homo sapiens
attgtcttttagaca

SEQ ID NO: 5851695 - DNA, 20 bp, Homo sapiens
attgtcttttgtcatgtggc

SEQ ID NO: 5851696 - DNA, 18 bp, Homo sapiens
attgtcttttttttcctt

SEQ ID NO: 5851697 - DNA, 19 bp, Homo sapiens
attgtcttttttttccttt

SEQ ID NO: 5851698 - DNA, 20 bp, Homo sapiens
attgtcttttttttcctttg

SEQ ID NO: 5851699 - DNA, 13 bp, Homo sapiens
attgtgaaaaaaa

SEQ ID NO: 5851700 - DNA, 23 bp, Homo sapiens
attgtgaaaaatgagcttgtaaa

SEQ ID NO: 5851701 - DNA, 23 bp, Homo sapiens
attgtgaaataaaactggctttg

SEQ ID NO: 5851702 - DNA, 15 bp, Homo sapiens
attgtgaaattattc

SEQ ID NO: 5851703 - DNA, 21 bp, Homo sapiens
attgtgaacagaagtccttaa

SEQ ID NO: 5851704 - DNA, 13 bp, Homo sapiens
attgtgaacatga

SEQ ID NO: 5851705 - DNA, 16 bp, Homo sapiens
attgtgaacatttgtg

SEQ ID NO: 5851706 - DNA, 15 bp, Homo sapiens
attgtgaagtacata

SEQ ID NO: 5851707 - DNA, 17 bp, Homo sapiens
attgtgaataatgattt

SEQ ID NO: 5851708 - DNA, 11 bp, Homo sapiens
attgtgaatgc

SEQ ID NO: 5851709 - DNA, 15 bp, Homo sapiens
attgtgaattgcctg

SEQ ID NO: 5851710 - DNA, 17 bp, Homo sapiens
attgtgaattgcctgcc

SEQ ID NO: 5851711 - DNA, 21 bp, Homo sapiens
attgtgaattgcctgccatgg

SEQ ID NO: 5851712 - DNA, 16 bp, Homo sapiens
attgtgacaaacagct

SEQ ID NO: 5851713 - DNA, 23 bp, Homo sapiens
attgtgaccaatacatttgtatt

SEQ ID NO: 5851714 - DNA, 14 bp, Homo sapiens
attgtgacttcact

SEQ ID NO: 5851715 - DNA, 19 bp, Homo sapiens
attgtgacttcactgtata

SEQ ID NO: 5851716 - DNA, 20 bp, Homo sapiens
attgtgacttcactgtatat

SEQ ID NO: 5851717 - DNA, 22 bp, Homo sapiens
attgtgacttcactgtatataa

SEQ ID NO: 5851718 - DNA, 20 bp, Homo sapiens
attgtgactttgctttgaga

SEQ ID NO: 5851719 - DNA, 12 bp, Homo sapiens
attgtgagaaat

SEQ ID NO: 5851720 - DNA, 14 bp, Homo sapiens
attgtgagatgatt

SEQ ID NO: 5851721 - DNA, 17 bp, Homo sapiens
attgtgagatgatttgt

SEQ ID NO: 5851722 - DNA, 16 bp, Homo sapiens
attgtgagccaccacg

SEQ ID NO: 5851723 - DNA, 14 bp, Homo sapiens
attgtgagctcctt

SEQ ID NO: 5851724 - DNA, 14 bp, Homo sapiens
attgtgagctctgg

SEQ ID NO: 5851725 - DNA, 19 bp, Homo sapiens
attgtgagctctggttatt

SEQ ID NO: 5851726 - DNA, 17 bp, Homo sapiens
attgtgaggcttctaat

SEQ ID NO: 5851727 - DNA, 19 bp, Homo sapiens
attgtgagttaatttgata

SEQ ID NO: 5851728 - DNA, 21 bp, Homo sapiens
attgtgatatttgacagacat

SEQ ID NO: 5851729 - DNA, 24 bp, Homo sapiens
attgtgattacgtgtatgtttctt

SEQ ID NO: 5851730 - DNA, 15 bp, Homo sapiens
attgtgattattgtt

SEQ ID NO: 5851731 - DNA, 15 bp, Homo sapiens
attgtgattctgttt

SEQ ID NO: 5851732 - DNA, 23 bp, Homo sapiens
attgtgatttcccgtggccccag

SEQ ID NO: 5851733 - DNA, 17 bp, Homo sapiens
attgtgatttgactgtt

SEQ ID NO: 5851734 - DNA, 19 bp, Homo sapiens
attgtgatttgactgtttt

SEQ ID NO: 5851735 - DNA, 15 bp, Homo sapiens
attgtgcaaaggata

SEQ ID NO: 5851736 - DNA, 19 bp, Homo sapiens
attgtgcaaaggataaatt

SEQ ID NO: 5851737 - DNA, 20 bp, Homo sapiens
attgtgcaaaggataaattt

SEQ ID NO: 5851738 - DNA, 22 bp, Homo sapiens
attgtgcaaaggataaattttt

SEQ ID NO: 5851739 - DNA, 20 bp, Homo sapiens
attgtgcaatgtaaatattt

SEQ ID NO: 5851740 - DNA, 15 bp, Homo sapiens
attgtgcaatgtgta

SEQ ID NO: 5851741 - DNA, 16 bp, Homo sapiens
attgtgcaatgtgtat

SEQ ID NO: 5851742 - DNA, 21 bp, Homo sapiens
attgtgcaatgtgtataaaca

SEQ ID NO: 5851743 - DNA, 22 bp, Homo sapiens
attgtgcaatgtgtataaacaa

SEQ ID NO: 5851744 - DNA, 19 bp, Homo sapiens
attgtgcacatacttgaga

SEQ ID NO: 5851745 - DNA, 17 bp, Homo sapiens
attgtgcacatttaata

SEQ ID NO: 5851746 - DNA, 17 bp, Homo sapiens
attgtgcataatgcttt

SEQ ID NO: 5851747 - DNA, 19 bp, Homo sapiens
attgtgcatgctagtgttg

SEQ ID NO: 5851748 - DNA, 13 bp, Homo sapiens
attgtgccaagcc

SEQ ID NO: 5851749 - DNA, 15 bp, Homo sapiens
attgtgccaagcctt

SEQ ID NO: 5851750 - DNA, 16 bp, Homo sapiens
attgtgccaagccttc

SEQ ID NO: 5851751 - DNA, 19 bp, Homo sapiens
attgtgcccacccagggaa

SEQ ID NO: 5851752 - DNA, 17 bp, Homo sapiens
attgtgcccacttaccc

SEQ ID NO: 5851753 - DNA, 23 bp, Homo sapiens
attgtgcccacttaccctgggct

SEQ ID NO: 5851754 - DNA, 13 bp, Homo sapiens
attgtgcccctgc

SEQ ID NO: 5851755 - DNA, 19 bp, Homo sapiens
attgtgctccaaatgtcta

SEQ ID NO: 5851756 - DNA, 11 bp, Homo sapiens
attgtgctgcc

SEQ ID NO: 5851757 - DNA, 13 bp, Homo sapiens
attgtgctgccat

SEQ ID NO: 5851758 - DNA, 15 bp, Homo sapiens
attgtgctgccattt

SEQ ID NO: 5851759 - DNA, 21 bp, Homo sapiens
attgtgctgggtcccagcctg

SEQ ID NO: 5851760 - DNA, 15 bp, Homo sapiens
attgtgcttaataat

SEQ ID NO: 5851761 - DNA, 19 bp, Homo sapiens
attgtgcttactcaagtgt

SEQ ID NO: 5851762 - DNA, 18 bp, Homo sapiens
attgtgcttctccccaga

SEQ ID NO: 5851763 - DNA, 15 bp, Homo sapiens
attgtgcttctttct

SEQ ID NO: 5851764 - DNA, 21 bp, Homo sapiens
attgtgctttcaccagaattt

SEQ ID NO: 5851765 - DNA, 11 bp, Homo sapiens
attgtggaaaa

SEQ ID NO: 5851766 - DNA, 12 bp, Homo sapiens
atttaaactatt

SEQ ID NO: 5851767 - DNA, 18 bp, Homo sapiens
atttaaactcaagacaat

SEQ ID NO: 5851768 - DNA, 18 bp, Homo sapiens
atttaaactctgaattta

SEQ ID NO: 5851769 - DNA, 21 bp, Homo sapiens
atttaaactctgccagaaaaa

SEQ ID NO: 5851770 - DNA, 15 bp, Homo sapiens
atttaaactgtgttt

SEQ ID NO: 5851771 - DNA, 18 bp, Homo sapiens
atttaaactgttctgtgt

SEQ ID NO: 5851772 - DNA, 16 bp, Homo sapiens
atttaaactttcaata

SEQ ID NO: 5851773 - DNA, 16 bp, Homo sapiens
atttaaactttttaaa

SEQ ID NO: 5851774 - DNA, 22 bp, Homo sapiens
atttaaactttttaaaatactt

SEQ ID NO: 5851775 - DNA, 19 bp, Homo sapiens
atttaaagaaaataaacac

SEQ ID NO: 5851776 - DNA, 15 bp, Homo sapiens
atttaaagaaacact

SEQ ID NO: 5851777 - DNA, 19 bp, Homo sapiens
atttaaagaaacactaaat

SEQ ID NO: 5851778 - DNA, 21 bp, Homo sapiens
atttaaagaaacactaaatta

SEQ ID NO: 5851779 - DNA, 19 bp, Homo sapiens
atttaaagactacaataaa

SEQ ID NO: 5851780 - DNA, 19 bp, Homo sapiens
atttaaagatattgttcaa

SEQ ID NO: 5851781 - DNA, 13 bp, Homo sapiens
atttaaagcacat

SEQ ID NO: 5851782 - DNA, 11 bp, Homo sapiens
atttaaagcag

SEQ ID NO: 5851783 - DNA, 15 bp, Homo sapiens
atttaaagcaggttc

SEQ ID NO: 5851784 - DNA, 20 bp, Homo sapiens
atttaaagcaggttcttgtt

SEQ ID NO: 5851785 - DNA, 21 bp, Homo sapiens
atttaaagccaaatgtaaata

SEQ ID NO: 5851786 - DNA, 21 bp, Homo sapiens
atttaaagctaaattttgtta

SEQ ID NO: 5851787 - DNA, 21 bp, Homo sapiens
atttaaagctttcaacatgta

SEQ ID NO: 5851788 - DNA, 16 bp, Homo sapiens
atttaaaggaaacact

SEQ ID NO: 5851789 - DNA, 17 bp, Homo sapiens
atttaaaggaaacacta

SEQ ID NO: 5851790 - DNA, 16 bp, Homo sapiens
atttaaaggaaagttc

SEQ ID NO: 5851791 - DNA, 22 bp, Homo sapiens
atttaaaggctaccttattgta

SEQ ID NO: 5851792 - DNA, 22 bp, Homo sapiens
atttaaaggcttaggcatgttc

SEQ ID NO: 5851793 - DNA, 23 bp, Homo sapiens
atttaaaggttgagtatgtgaag

SEQ ID NO: 5851794 - DNA, 18 bp, Homo sapiens
atttaaagtattctccat

SEQ ID NO: 5851795 - DNA, 15 bp, Homo sapiens
atttaaagtatttta

SEQ ID NO: 5851796 - DNA, 21 bp, Homo sapiens
atttaaagtgtggaaagcaaa

SEQ ID NO: 5851797 - DNA, 16 bp, Homo sapiens
atttaaagttgtatct

SEQ ID NO: 5851798 - DNA, 18 bp, Homo sapiens
atttaaataaaatcacca

SEQ ID NO: 5851799 - DNA, 21 bp, Homo sapiens
atttaaatacagtcttccatt

SEQ ID NO: 5851800 - DNA, 16 bp, Homo sapiens
atttaaatagcttttt

SEQ ID NO: 5851801 - DNA, 18 bp, Homo sapiens
atttaaatataattctgt

SEQ ID NO: 5851802 - DNA, 22 bp, Homo sapiens
atttaaatataattctgtaaat

SEQ ID NO: 5851803 - DNA, 22 bp, Homo sapiens
atttaaatatctgttattcaaa

SEQ ID NO: 5851804 - DNA, 16 bp, Homo sapiens
atttaaatattaaata

SEQ ID NO: 5851805 - DNA, 22 bp, Homo sapiens
atttaaatcattttaacttcta

SEQ ID NO: 5851806 - DNA, 18 bp, Homo sapiens
atttaaatgatatttagg

SEQ ID NO: 5851807 - DNA, 22 bp, Homo sapiens
atttaaatgcaaccagaattgt

SEQ ID NO: 5851808 - DNA, 12 bp, Homo sapiens
atttaaatgcat

SEQ ID NO: 5851809 - DNA, 16 bp, Homo sapiens
atttaaatgcatgtct

SEQ ID NO: 5851810 - DNA, 12 bp, Homo sapiens
atttaaatgctt

SEQ ID NO: 5851811 - DNA, 13 bp, Homo sapiens
atttaaatgtact

SEQ ID NO: 5851812 - DNA, 15 bp, Homo sapiens
atttaaatgtgtaca

SEQ ID NO: 5851813 - DNA, 24 bp, Homo sapiens
atttaaatgtgtacaatgtacaca

SEQ ID NO: 5851814 - DNA, 23 bp, Homo sapiens
atttaaatgttatgactatgtaa

SEQ ID NO: 5851815 - DNA, 15 bp, Homo sapiens
atttaaatgtttact

SEQ ID NO: 5851816 - DNA, 17 bp, Homo sapiens
atttaaatgtttactat

SEQ ID NO: 5851817 - DNA, 20 bp, Homo sapiens
atttaaatgtttactataga

SEQ ID NO: 5851818 - DNA, 15 bp, Homo sapiens
atttaaattatattt

SEQ ID NO: 5851819 - DNA, 19 bp, Homo sapiens
atttaaattcttttttaaa

SEQ ID NO: 5851820 - DNA, 17 bp, Homo sapiens
atttaaattgcagacag

SEQ ID NO: 5851821 - DNA, 14 bp, Homo sapiens
atttaaattggtca

SEQ ID NO: 5851822 - DNA, 14 bp, Homo sapiens
atttaaattgttat

SEQ ID NO: 5851823 - DNA, 19 bp, Homo sapiens
atttaaattgttataactt

SEQ ID NO: 5851824 - DNA, 16 bp, Homo sapiens
atttaaatttaaagat

SEQ ID NO: 5851825 - DNA, 13 bp, Homo sapiens
atttaacaaacta

SEQ ID NO: 5851826 - DNA, 21 bp, Homo sapiens
atttaacaatgcgaatggtag

SEQ ID NO: 5851827 - DNA, 19 bp, Homo sapiens
atttaacaatttattctga

SEQ ID NO: 5851828 - DNA, 21 bp, Homo sapiens
atttaacactttttgtgaatt

SEQ ID NO: 5851829 - DNA, 16 bp, Homo sapiens
atttaacagaaatgta

SEQ ID NO: 5851830 - DNA, 17 bp, Homo sapiens
atttaacagaaatgtac

SEQ ID NO: 5851831 - DNA, 19 bp, Homo sapiens
atttaacagaaatgtacag

SEQ ID NO: 5851832 - DNA, 20 bp, Homo sapiens
atttaacagaaatgtacagc

SEQ ID NO: 5851833 - DNA, 16 bp, Homo sapiens
atttaacagaaattgt

SEQ ID NO: 5851834 - DNA, 18 bp, Homo sapiens
atttaacagaaattgtat

SEQ ID NO: 5851835 - DNA, 20 bp, Homo sapiens
atttaacagaaattgtatat

SEQ ID NO: 5851836 - DNA, 17 bp, Homo sapiens
atttaacagaagttgtg

SEQ ID NO: 5851837 - DNA, 21 bp, Homo sapiens
atttaacagaagttgtgaaac

SEQ ID NO: 5851838 - DNA, 13 bp, Homo sapiens
atttaacagcatg

SEQ ID NO: 5851839 - DNA, 19 bp, Homo sapiens
atttaacagcatgacaaaa

SEQ ID NO: 5851840 - DNA, 16 bp, Homo sapiens
atttaacagtcattta

SEQ ID NO: 5851841 - DNA, 13 bp, Homo sapiens
atttaacataatg

SEQ ID NO: 5851842 - DNA, 21 bp, Homo sapiens
atttaacatagtaattcttaa

SEQ ID NO: 5851843 - DNA, 13 bp, Homo sapiens
atttaacatgcaa

SEQ ID NO: 5851844 - DNA, 13 bp, Homo sapiens
atttaacatgtgg

SEQ ID NO: 5851845 - DNA, 20 bp, Homo sapiens
atttaacatgtggaagaaaa

SEQ ID NO: 5851846 - DNA, 17 bp, Homo sapiens
atttaacattatttata

SEQ ID NO: 5851847 - DNA, 20 bp, Homo sapiens
atttaacattatttatatgg

SEQ ID NO: 5851848 - DNA, 18 bp, Homo sapiens
atttaaccaaagaacgta

SEQ ID NO: 5851849 - DNA, 17 bp, Homo sapiens
atttaaccataaatcaa

SEQ ID NO: 5851850 - DNA, 14 bp, Homo sapiens
atttaacccagctc

SEQ ID NO: 5851851 - DNA, 23 bp, Homo sapiens
atttaacccccctgtacacaact

SEQ ID NO: 5851852 - DNA, 16 bp, Homo sapiens
atttaaccctgcctct

SEQ ID NO: 5851853 - DNA, 17 bp, Homo sapiens
atttaaccctgcctctc

SEQ ID NO: 5851854 - DNA, 13 bp, Homo sapiens
atttaacctattt

SEQ ID NO: 5851855 - DNA, 22 bp, Homo sapiens
atttaacctatttccacattct

SEQ ID NO: 5851856 - DNA, 23 bp, Homo sapiens
atttaacctatttccacattctc

SEQ ID NO: 5851857 - DNA, 20 bp, Homo sapiens
atttaacgttgatgtaatga

SEQ ID NO: 5851858 - DNA, 13 bp, Homo sapiens
atttaactaattt

SEQ ID NO: 5851859 - DNA, 20 bp, Homo sapiens
atttaactaatttaaaccag

SEQ ID NO: 5851860 - DNA, 18 bp, Homo sapiens
atttaactacccttaatt

SEQ ID NO: 5851861 - DNA, 17 bp, Homo sapiens
atttaactagcacttta

SEQ ID NO: 5851862 - DNA, 19 bp, Homo sapiens
atttaactcttaactgaag

SEQ ID NO: 5851863 - DNA, 12 bp, Homo sapiens
atttaactgaac

SEQ ID NO: 5851864 - DNA, 18 bp, Homo sapiens
atttaactgattaaaaat

SEQ ID NO: 5851865 - DNA, 13 bp, Homo sapiens
atttaactggctt

SEQ ID NO: 5851866 - DNA, 20 bp, Homo sapiens
atttaacttaacattctgta

SEQ ID NO: 5851867 - DNA, 21 bp, Homo sapiens
atttaacttaacattctgtaa

SEQ ID NO: 5851868 - DNA, 18 bp, Homo sapiens
atttaacttgagggtaat

SEQ ID NO: 5851869 - DNA, 12 bp, Homo sapiens
atttaactttta

SEQ ID NO: 5851870 - DNA, 13 bp, Homo sapiens
atttaactttttt

SEQ ID NO: 5851871 - DNA, 15 bp, Homo sapiens
atttaagaaaagcac

SEQ ID NO: 5851872 - DNA, 21 bp, Homo sapiens
atttaagaaaagcacttttgt

SEQ ID NO: 5851873 - DNA, 21 bp, Homo sapiens
atttaagaaaatacaataaac

SEQ ID NO: 5851874 - DNA, 21 bp, Homo sapiens
atttaagaaagggaaagctgt

SEQ ID NO: 5851875 - DNA, 13 bp, Homo sapiens
atttaagaacaga

SEQ ID NO: 5851876 - DNA, 21 bp, Homo sapiens
atttaagaaggagttctgaca

SEQ ID NO: 5851877 - DNA, 20 bp, Homo sapiens
atttaagaatgaaactataa

SEQ ID NO: 5851878 - DNA, 17 bp, Homo sapiens
atttaagaatttaccag

SEQ ID NO: 5851879 - DNA, 20 bp, Homo sapiens
atttaagaatttaccagaaa

SEQ ID NO: 5851880 - DNA, 14 bp, Homo sapiens
atttaagacacatt

SEQ ID NO: 5851881 - DNA, 13 bp, Homo sapiens
atttaagacataa

SEQ ID NO: 5851882 - DNA, 14 bp, Homo sapiens
atttaagacataaa

SEQ ID NO: 5851883 - DNA, 17 bp, Homo sapiens
atttaagacataaacaa

SEQ ID NO: 5851884 - DNA, 22 bp, Homo sapiens
atttaagacataaacaaagaca

SEQ ID NO: 5851885 - DNA, 23 bp, Homo sapiens
atttaagacataaacaaagacat

SEQ ID NO: 5851886 - DNA, 13 bp, Homo sapiens
atttaagactgat

SEQ ID NO: 5851887 - DNA, 16 bp, Homo sapiens
atttaagagacagtca

SEQ ID NO: 5851888 - DNA, 15 bp, Homo sapiens
atttaagagtcctga

SEQ ID NO: 5851889 - DNA, 18 bp, Homo sapiens
atttaagatgtacattta

SEQ ID NO: 5851890 - DNA, 14 bp, Homo sapiens
atttaagatgtgaa

SEQ ID NO: 5851891 - DNA, 15 bp, Homo sapiens
atttaagatgtgaaa

SEQ ID NO: 5851892 - DNA, 14 bp, Homo sapiens
atttaagcaaacgt

SEQ ID NO: 5851893 - DNA, 13 bp, Homo sapiens
atttaagcaaata

SEQ ID NO: 5851894 - DNA, 15 bp, Homo sapiens
atttaagcaaatact

SEQ ID NO: 5851895 - DNA, 17 bp, Homo sapiens
atttaagcaaatactta

SEQ ID NO: 5851896 - DNA, 19 bp, Homo sapiens
atttaagcacaaaaaattt

SEQ ID NO: 5851897 - DNA, 14 bp, Homo sapiens
atttaagcatgagt

SEQ ID NO: 5851898 - DNA, 19 bp, Homo sapiens
atttaagcatgagtggcct

SEQ ID NO: 5851899 - DNA, 11 bp, Homo sapiens
atttaagcatt

SEQ ID NO: 5851900 - DNA, 14 bp, Homo sapiens
atttaagcattgtt

SEQ ID NO: 5851901 - DNA, 17 bp, Homo sapiens
atttaagccaataaata

SEQ ID NO: 5851902 - DNA, 15 bp, Homo sapiens
atttaagccccctct

SEQ ID NO: 5851903 - DNA, 16 bp, Homo sapiens
atttaagcctaaagat

SEQ ID NO: 5851904 - DNA, 19 bp, Homo sapiens
atttaagcctcatatttaa

SEQ ID NO: 5851905 - DNA, 23 bp, Homo sapiens
atttaagccttataaaccaatct

SEQ ID NO: 5851906 - DNA, 21 bp, Homo sapiens
atttaagccttgacacactgt

SEQ ID NO: 5851907 - DNA, 15 bp, Homo sapiens
atttaagctgtaaat

SEQ ID NO: 5851908 - DNA, 17 bp, Homo sapiens
atttaagctgtaaatta

SEQ ID NO: 5851909 - DNA, 15 bp, Homo sapiens
atttaagctttaaat

SEQ ID NO: 5851910 - DNA, 17 bp, Homo sapiens
atttaagctttaaatga

SEQ ID NO: 5851911 - DNA, 16 bp, Homo sapiens
atttaagctttcctgt

SEQ ID NO: 5851912 - DNA, 19 bp, Homo sapiens
atttaaggagatgtaagag

SEQ ID NO: 5851913 - DNA, 16 bp, Homo sapiens
atttaaggatggatgg

SEQ ID NO: 5851914 - DNA, 17 bp, Homo sapiens
atttaaggatggatggc

SEQ ID NO: 5851915 - DNA, 20 bp, Homo sapiens
atttaaggatggatggcacc

SEQ ID NO: 5851916 - DNA, 14 bp, Homo sapiens
atttaaggcaaaaa

SEQ ID NO: 5851917 - DNA, 16 bp, Homo sapiens
atttaaggcaaaaaag

SEQ ID NO: 5851918 - DNA, 21 bp, Homo sapiens
atttaaggtgtgcaattttct

SEQ ID NO: 5851919 - DNA, 18 bp, Homo sapiens
atttaagtaaatacagta

SEQ ID NO: 5851920 - DNA, 16 bp, Homo sapiens
atttaagtaactttaa

SEQ ID NO: 5851921 - DNA, 12 bp, Homo sapiens
atttaagtacta

SEQ ID NO: 5851922 - DNA, 19 bp, Homo sapiens
atttaagtactatctttgt

SEQ ID NO: 5851923 - DNA, 22 bp, Homo sapiens
atttaagtagaaaagttgcaga

SEQ ID NO: 5851924 - DNA, 16 bp, Homo sapiens
atttaagtatggaata

SEQ ID NO: 5851925 - DNA, 15 bp, Homo sapiens
atttaagtattcaag

SEQ ID NO: 5851926 - DNA, 18 bp, Homo sapiens
atttaagtattcaagaaa

SEQ ID NO: 5851927 - DNA, 23 bp, Homo sapiens
atttaagtcgggaaattctgctg

SEQ ID NO: 5851928 - DNA, 13 bp, Homo sapiens
atttaagtgacac

SEQ ID NO: 5851929 - DNA, 16 bp, Homo sapiens
atttaagtgacacaga

SEQ ID NO: 5851930 - DNA, 17 bp, Homo sapiens
atttaagtgacacagac

SEQ ID NO: 5851931 - DNA, 19 bp, Homo sapiens
atttaagtgacacagacat

SEQ ID NO: 5851932 - DNA, 20 bp, Homo sapiens
atttaagtgacacagacatt

SEQ ID NO: 5851933 - DNA, 14 bp, Homo sapiens
atttaagtgcaatt

SEQ ID NO: 5851934 - DNA, 17 bp, Homo sapiens
atttaagtgcaattaac

SEQ ID NO: 5851935 - DNA, 20 bp, Homo sapiens
atttaagtgcgtgtgtagag

SEQ ID NO: 5851936 - DNA, 22 bp, Homo sapiens
atttaagtgcgtgtgtagagtt

SEQ ID NO: 5851937 - DNA, 23 bp, Homo sapiens
atttaagtggactgtatttcggc

SEQ ID NO: 5851938 - DNA, 16 bp, Homo sapiens
atttaagtgtatttaa

SEQ ID NO: 5851939 - DNA, 22 bp, Homo sapiens
atttaagtgttggaaaaaattt

SEQ ID NO: 5851940 - DNA, 12 bp, Homo sapiens
atttaagttgta

SEQ ID NO: 5851941 - DNA, 13 bp, Homo sapiens
atttaagttgtaa

SEQ ID NO: 5851942 - DNA, 15 bp, Homo sapiens
atttaagttgtaaac

SEQ ID NO: 5851943 - DNA, 17 bp, Homo sapiens
atttaagttgtaaacgt

SEQ ID NO: 5851944 - DNA, 17 bp, Homo sapiens
atttatcgcaacatgaa

SEQ ID NO: 5851945 - DNA, 19 bp, Homo sapiens
atttatcgcaacatgaatt

SEQ ID NO: 5851946 - DNA, 21 bp, Homo sapiens
atttatcgctgggaaatgaga

SEQ ID NO: 5851947 - DNA, 20 bp, Homo sapiens
atttatctaaattaaagcct

SEQ ID NO: 5851948 - DNA, 22 bp, Homo sapiens
atttatctaaggtccccagcag

SEQ ID NO: 5851949 - DNA, 23 bp, Homo sapiens
atttatctaaggtccccagcaga

SEQ ID NO: 5851950 - DNA, 17 bp, Homo sapiens
atttatctattgtaaga

SEQ ID NO: 5851951 - DNA, 23 bp, Homo sapiens
atttatctattgtaagataaaaa

SEQ ID NO: 5851952 - DNA, 16 bp, Homo sapiens
atttatctctatttaa

SEQ ID NO: 5851953 - DNA, 23 bp, Homo sapiens
atttatctgagcaataacttcta

SEQ ID NO: 5851954 - DNA, 18 bp, Homo sapiens
atttatctggatttttat

SEQ ID NO: 5851955 - DNA, 17 bp, Homo sapiens
atttatctgtctgagcc

SEQ ID NO: 5851956 - DNA, 16 bp, Homo sapiens
atttatctgtgcaaat

SEQ ID NO: 5851957 - DNA, 14 bp, Homo sapiens
atttatcttatcta

SEQ ID NO: 5851958 - DNA, 21 bp, Homo sapiens
atttatcttccatatgctctt

SEQ ID NO: 5851959 - DNA, 15 bp, Homo sapiens
atttatcttctgttt

SEQ ID NO: 5851960 - DNA, 19 bp, Homo sapiens
atttatcttctgtttttct

SEQ ID NO: 5851961 - DNA, 22 bp, Homo sapiens
atttatcttctgtttttctcaa

SEQ ID NO: 5851962 - DNA, 23 bp, Homo sapiens
atttatcttctgtttttctcaaa

SEQ ID NO: 5851963 - DNA, 16 bp, Homo sapiens
atttatcttgaaggaa

SEQ ID NO: 5851964 - DNA, 12 bp, Homo sapiens
atttatctttac

SEQ ID NO: 5851965 - DNA, 14 bp, Homo sapiens
atttatctttacca

SEQ ID NO: 5851966 - DNA, 22 bp, Homo sapiens
atttatctttacttttaaacag

SEQ ID NO: 5851967 - DNA, 11 bp, Homo sapiens
atttatctttg

SEQ ID NO: 5851968 - DNA, 14 bp, Homo sapiens
atttatctttgata

SEQ ID NO: 5851969 - DNA, 16 bp, Homo sapiens
atttatctttgataac

SEQ ID NO: 5851970 - DNA, 21 bp, Homo sapiens
atttatgaaagtattaaaatg

SEQ ID NO: 5851971 - DNA, 15 bp, Homo sapiens
atttatgaagcagat

SEQ ID NO: 5851972 - DNA, 18 bp, Homo sapiens
atttatgaagcagattta

SEQ ID NO: 5851973 - DNA, 19 bp, Homo sapiens
atttatgaagcagatttat

SEQ ID NO: 5851974 - DNA, 13 bp, Homo sapiens
atttatgaatata

SEQ ID NO: 5851975 - DNA, 18 bp, Homo sapiens
atttatgaatattaaaaa

SEQ ID NO: 5851976 - DNA, 18 bp, Homo sapiens
atttatgaatgtgcattt

SEQ ID NO: 5851977 - DNA, 23 bp, Homo sapiens
atttatgaatgtgcatttcttga

SEQ ID NO: 5851978 - DNA, 13 bp, Homo sapiens
atttatgaccaga

SEQ ID NO: 5851979 - DNA, 20 bp, Homo sapiens
atttatgacctcaacaaaga

SEQ ID NO: 5851980 - DNA, 15 bp, Homo sapiens
atttatgactagcaa

SEQ ID NO: 5851981 - DNA, 18 bp, Homo sapiens
atttatgatcacttggaa

SEQ ID NO: 5851982 - DNA, 22 bp, Homo sapiens
atttatgatttctccagaaatt

SEQ ID NO: 5851983 - DNA, 23 bp, Homo sapiens
atttatgatttctccagaaattt

SEQ ID NO: 5851984 - DNA, 23 bp, Homo sapiens
atttatgcagaaggtatttttga

SEQ ID NO: 5851985 - DNA, 14 bp, Homo sapiens
atttatgcatgaga

SEQ ID NO: 5851986 - DNA, 14 bp, Homo sapiens
atttatgcatttca

SEQ ID NO: 5851987 - DNA, 16 bp, Homo sapiens
atttatgcatttcatt

SEQ ID NO: 5851988 - DNA, 20 bp, Homo sapiens
atttatgcgaacctatgtct

SEQ ID NO: 5851989 - DNA, 12 bp, Homo sapiens
atttatggaaga

SEQ ID NO: 5851990 - DNA, 19 bp, Homo sapiens
atttatggaattaaccatt

SEQ ID NO: 5851991 - DNA, 17 bp, Homo sapiens
atttatggaccactttt

SEQ ID NO: 5851992 - DNA, 18 bp, Homo sapiens
atttatggctgttcctga

SEQ ID NO: 5851993 - DNA, 17 bp, Homo sapiens
atttatggcttataaat

SEQ ID NO: 5851994 - DNA, 16 bp, Homo sapiens
atttatgggtggattt

SEQ ID NO: 5851995 - DNA, 12 bp, Homo sapiens
atttatggtacc

SEQ ID NO: 5851996 - DNA, 14 bp, Homo sapiens
atttatggtttctg

SEQ ID NO: 5851997 - DNA, 18 bp, Homo sapiens
atttatgtaaaaggatta

SEQ ID NO: 5851998 - DNA, 15 bp, Homo sapiens
atttatgtaatttgt

SEQ ID NO: 5851999 - DNA, 12 bp, Homo sapiens
atttatgtacaa

SEQ ID NO: 5852000 - DNA, 15 bp, Homo sapiens
atttatgtagacatt

SEQ ID NO: 5852001 - DNA, 20 bp, Homo sapiens
atttatgtagacattgtaaa

SEQ ID NO: 5852002 - DNA, 14 bp, Homo sapiens
atttatgtatggtg

SEQ ID NO: 5852003 - DNA, 19 bp, Homo sapiens
atttatgtattgtgcaatg

SEQ ID NO: 5852004 - DNA, 22 bp, Homo sapiens
atttatgtattgtgcaatgtgt

SEQ ID NO: 5852005 - DNA, 15 bp, Homo sapiens
atttatgtattttga

SEQ ID NO: 5852006 - DNA, 23 bp, Homo sapiens
atttatgtattttgaaaaagaga

SEQ ID NO: 5852007 - DNA, 16 bp, Homo sapiens
atttatgtcattttca

SEQ ID NO: 5852008 - DNA, 18 bp, Homo sapiens
atttatgtctcatgtaat

SEQ ID NO: 5852009 - DNA, 12 bp, Homo sapiens
atttatgtgcta

SEQ ID NO: 5852010 - DNA, 14 bp, Homo sapiens
atttatgtgctgtt

SEQ ID NO: 5852011 - DNA, 20 bp, Homo sapiens
atttatgtgctgttagaata

SEQ ID NO: 5852012 - DNA, 15 bp, Homo sapiens
atttatgtgtatatg

SEQ ID NO: 5852013 - DNA, 18 bp, Homo sapiens
atttatgtgtgaggagct

SEQ ID NO: 5852014 - DNA, 19 bp, Homo sapiens
atttatgtgttttaataaa

SEQ ID NO: 5852015 - DNA, 20 bp, Homo sapiens
atttatgttatttatgatgt

SEQ ID NO: 5852016 - DNA, 22 bp, Homo sapiens
atttatgttccttttaaagaaa

SEQ ID NO: 5852017 - DNA, 15 bp, Homo sapiens
atttatgttgggtca

SEQ ID NO: 5852018 - DNA, 21 bp, Homo sapiens
atttatgttgttgaactaata

SEQ ID NO: 5852019 - DNA, 22 bp, Homo sapiens
atttatgttgttgaactaatat

SEQ ID NO: 5852020 - DNA, 18 bp, Homo sapiens
atttatgtttaagtgctt

SEQ ID NO: 5852021 - DNA, 21 bp, Homo sapiens
atttattaaaaacatgaccac

SEQ ID NO: 5852022 - DNA, 17 bp, Homo sapiens
atttattaaaaatgttc

SEQ ID NO: 5852023 - DNA, 19 bp, Homo sapiens
atttattaaaaatgttctc

SEQ ID NO: 5852024 - DNA, 23 bp, Homo sapiens
atttattaaaaatgttctcaaat

SEQ ID NO: 5852025 - DNA, 23 bp, Homo sapiens
atttattaaaatgattgtaaaat

SEQ ID NO: 5852026 - DNA, 23 bp, Homo sapiens
atttattaaacagatttttacaa

SEQ ID NO: 5852027 - DNA, 14 bp, Homo sapiens
atttattaaacttc

SEQ ID NO: 5852028 - DNA, 15 bp, Homo sapiens
atttattaaacttca

SEQ ID NO: 5852029 - DNA, 16 bp, Homo sapiens
atttattaaagaaaaa

SEQ ID NO: 5852030 - DNA, 23 bp, Homo sapiens
atttattaaagaaaaaaatgtat

SEQ ID NO: 5852031 - DNA, 17 bp, Homo sapiens
atttattaaataaaatc

SEQ ID NO: 5852032 - DNA, 18 bp, Homo sapiens
atttattaaataaaatca

SEQ ID NO: 5852033 - DNA, 20 bp, Homo sapiens
atttattaaatgcccagccc

SEQ ID NO: 5852034 - DNA, 12 bp, Homo sapiens
atttattaaatt

SEQ ID NO: 5852035 - DNA, 21 bp, Homo sapiens
atttattaaatttttttgtat

SEQ ID NO: 5852036 - DNA, 22 bp, Homo sapiens
atttattaactaggtatgaagt

SEQ ID NO: 5852037 - DNA, 22 bp, Homo sapiens
atttattaactgctcagtgttt

SEQ ID NO: 5852038 - DNA, 16 bp, Homo sapiens
atttattaacttaata

SEQ ID NO: 5852039 - DNA, 21 bp, Homo sapiens
atttattaacttaataatcaa

SEQ ID NO: 5852040 - DNA, 23 bp, Homo sapiens
atttattaacttaataatcaaga

SEQ ID NO: 5852041 - DNA, 20 bp, Homo sapiens
atttattaaggttacagatt

SEQ ID NO: 5852042 - DNA, 15 bp, Homo sapiens
atttattaagtatat

SEQ ID NO: 5852043 - DNA, 20 bp, Homo sapiens
atttattaagtatatttgta

SEQ ID NO: 5852044 - DNA, 12 bp, Homo sapiens
atttattaatat

SEQ ID NO: 5852045 - DNA, 15 bp, Homo sapiens
atttattaattgctt

SEQ ID NO: 5852046 - DNA, 16 bp, Homo sapiens
atttattaatttgaaa

SEQ ID NO: 5852047 - DNA, 17 bp, Homo sapiens
atttattaatttgaaac

SEQ ID NO: 5852048 - DNA, 13 bp, Homo sapiens
atttattacaaat

SEQ ID NO: 5852049 - DNA, 19 bp, Homo sapiens
atttattactaacctccct

SEQ ID NO: 5852050 - DNA, 19 bp, Homo sapiens
atttattactgtaagaaaa

SEQ ID NO: 5852051 - DNA, 22 bp, Homo sapiens
atttattactgtaagaaaatat

SEQ ID NO: 5852052 - DNA, 15 bp, Homo sapiens
atttattactgtccc

SEQ ID NO: 5852053 - DNA, 15 bp, Homo sapiens
atttattacttgtgc

SEQ ID NO: 5852054 - DNA, 16 bp, Homo sapiens
atttattacttgtgca

SEQ ID NO: 5852055 - DNA, 18 bp, Homo sapiens
atttattacttgtgcact

SEQ ID NO: 5852056 - DNA, 16 bp, Homo sapiens
atttattagccaactg

SEQ ID NO: 5852057 - DNA, 18 bp, Homo sapiens
atttattagctgtaaata

SEQ ID NO: 5852058 - DNA, 10 bp, Homo sapiens
atttattatg

SEQ ID NO: 5852059 - DNA, 16 bp, Homo sapiens
atttattatggcacat

SEQ ID NO: 5852060 - DNA, 11 bp, Homo sapiens
atttattatgt

SEQ ID NO: 5852061 - DNA, 21 bp, Homo sapiens
atttattattaaatcagtttt

SEQ ID NO: 5852062 - DNA, 21 bp, Homo sapiens
atttattattaatttattggg

SEQ ID NO: 5852063 - DNA, 17 bp, Homo sapiens
atttattattttaatat

SEQ ID NO: 5852064 - DNA, 14 bp, Homo sapiens
atttattattttca

SEQ ID NO: 5852065 - DNA, 21 bp, Homo sapiens
atttattattttcacctgttt

SEQ ID NO: 5852066 - DNA, 23 bp, Homo sapiens
atttattcaacaaatgtgggtga

SEQ ID NO: 5852067 - DNA, 11 bp, Homo sapiens
atttattcaat

SEQ ID NO: 5852068 - DNA, 15 bp, Homo sapiens
atttattcaataaag

SEQ ID NO: 5852069 - DNA, 21 bp, Homo sapiens
atttattcaataaagtattta

SEQ ID NO: 5852070 - DNA, 22 bp, Homo sapiens
atttattcaataaagtatttaa

SEQ ID NO: 5852071 - DNA, 15 bp, Homo sapiens
atttattcactgtaa

SEQ ID NO: 5852072 - DNA, 16 bp, Homo sapiens
atttattcactgtaag

SEQ ID NO: 5852073 - DNA, 13 bp, Homo sapiens
atttattcagcaa

SEQ ID NO: 5852074 - DNA, 20 bp, Homo sapiens
atttattcagcttcatttgt

SEQ ID NO: 5852075 - DNA, 13 bp, Homo sapiens
atttattcataga

SEQ ID NO: 5852076 - DNA, 15 bp, Homo sapiens
atttattcatagata

SEQ ID NO: 5852077 - DNA, 23 bp, Homo sapiens
atttattcatgtgtacagaaaca

SEQ ID NO: 5852078 - DNA, 13 bp, Homo sapiens
atttattcattca

SEQ ID NO: 5852079 - DNA, 19 bp, Homo sapiens
atttattccatattcatgt

SEQ ID NO: 5852080 - DNA, 20 bp, Homo sapiens
atttattccatattcatgta

SEQ ID NO: 5852081 - DNA, 13 bp, Homo sapiens
atttattcctttg

SEQ ID NO: 5852082 - DNA, 17 bp, Homo sapiens
atttattctacttttaa

SEQ ID NO: 5852083 - DNA, 18 bp, Homo sapiens
atttattctacttttaaa

SEQ ID NO: 5852084 - DNA, 13 bp, Homo sapiens
atttattctcaga

SEQ ID NO: 5852085 - DNA, 21 bp, Homo sapiens
atttattctcagaacaccaag

SEQ ID NO: 5852086 - DNA, 21 bp, Homo sapiens
atttattctctatttattggg

SEQ ID NO: 5852087 - DNA, 14 bp, Homo sapiens
atttattctgctca

SEQ ID NO: 5852088 - DNA, 15 bp, Homo sapiens
atttattcttatctt

SEQ ID NO: 5852089 - DNA, 11 bp, Homo sapiens
atttattcttt

SEQ ID NO: 5852090 - DNA, 20 bp, Homo sapiens
atttattgaaatgatttcac

SEQ ID NO: 5852091 - DNA, 14 bp, Homo sapiens
atttattgaaattt

SEQ ID NO: 5852092 - DNA, 20 bp, Homo sapiens
atttattgaaatttttctct

SEQ ID NO: 5852093 - DNA, 13 bp, Homo sapiens
atttattgactct

SEQ ID NO: 5852094 - DNA, 14 bp, Homo sapiens
atttattgactctt

SEQ ID NO: 5852095 - DNA, 18 bp, Homo sapiens
atttattgaggaaaaata

SEQ ID NO: 5852096 - DNA, 14 bp, Homo sapiens
atttattgagtttt

SEQ ID NO: 5852097 - DNA, 15 bp, Homo sapiens
atttattgatgtttt

SEQ ID NO: 5852098 - DNA, 21 bp, Homo sapiens
atttattgcaggatggtgtct

SEQ ID NO: 5852099 - DNA, 18 bp, Homo sapiens
atttattgctacttcctg

SEQ ID NO: 5852100 - DNA, 19 bp, Homo sapiens
atttattgcttgatacttt

SEQ ID NO: 5852101 - DNA, 21 bp, Homo sapiens
atttattggcagccaaggaat

SEQ ID NO: 5852102 - DNA, 22 bp, Homo sapiens
atttattggcagccaaggaatg

SEQ ID NO: 5852103 - DNA, 12 bp, Homo sapiens
atttattggggt

SEQ ID NO: 5852104 - DNA, 17 bp, Homo sapiens
atttattgtattaggaa

SEQ ID NO: 5852105 - DNA, 18 bp, Homo sapiens
atttattgtcagttttgt

SEQ ID NO: 5852106 - DNA, 17 bp, Homo sapiens
atttattgtcattactg

SEQ ID NO: 5852107 - DNA, 23 bp, Homo sapiens
atttattgtctgtctacatttct

SEQ ID NO: 5852108 - DNA, 14 bp, Homo sapiens
atttattgttaaat

SEQ ID NO: 5852109 - DNA, 16 bp, Homo sapiens
atttattgttaaatta

SEQ ID NO: 5852110 - DNA, 18 bp, Homo sapiens
atttattgttaaattaca

SEQ ID NO: 5852111 - DNA, 20 bp, Homo sapiens
atttattgttaaattacatt

SEQ ID NO: 5852112 - DNA, 13 bp, Homo sapiens
atttatttaaaag

SEQ ID NO: 5852113 - DNA, 16 bp, Homo sapiens
atttatttaaaatagc

SEQ ID NO: 5852114 - DNA, 17 bp, Homo sapiens
atttatttaaacaaatg

SEQ ID NO: 5852115 - DNA, 20 bp, Homo sapiens
atttatttaaacaaatgtgt

SEQ ID NO: 5852116 - DNA, 20 bp, Homo sapiens
atttatttaaagcattgctt

SEQ ID NO: 5852117 - DNA, 12 bp, Homo sapiens
atttatttaaat

SEQ ID NO: 5852118 - DNA, 18 bp, Homo sapiens
atttatttaatatttaat

SEQ ID NO: 5852119 - DNA, 21 bp, Homo sapiens
atttatttaatgtgagtttgg

SEQ ID NO: 5852120 - DNA, 17 bp, Homo sapiens
atttatttaatgttatg

SEQ ID NO: 5852121 - DNA, 20 bp, Homo sapiens
atttccagtgaaatcagtta

SEQ ID NO: 5852122 - DNA, 17 bp, Homo sapiens
atttccagtgagtgtaa

SEQ ID NO: 5852123 - DNA, 18 bp, Homo sapiens
atttccagtgagtgtaaa

SEQ ID NO: 5852124 - DNA, 19 bp, Homo sapiens
atttccagtgagtgtaaat

SEQ ID NO: 5852125 - DNA, 14 bp, Homo sapiens
atttccatatagtc

SEQ ID NO: 5852126 - DNA, 15 bp, Homo sapiens
atttccatatggatt

SEQ ID NO: 5852127 - DNA, 13 bp, Homo sapiens
atttccatattaa

SEQ ID NO: 5852128 - DNA, 18 bp, Homo sapiens
atttccatattaaaatca

SEQ ID NO: 5852129 - DNA, 12 bp, Homo sapiens
atttccatattt

SEQ ID NO: 5852130 - DNA, 16 bp, Homo sapiens
atttccatctctggta

SEQ ID NO: 5852131 - DNA, 12 bp, Homo sapiens
atttccatctta

SEQ ID NO: 5852132 - DNA, 18 bp, Homo sapiens
atttccatcttaatgtta

SEQ ID NO: 5852133 - DNA, 18 bp, Homo sapiens
atttccatgtatgcataa

SEQ ID NO: 5852134 - DNA, 16 bp, Homo sapiens
atttccattaaaggtg

SEQ ID NO: 5852135 - DNA, 17 bp, Homo sapiens
atttccattaaaggtgg

SEQ ID NO: 5852136 - DNA, 19 bp, Homo sapiens
atttccattcatggatatt

SEQ ID NO: 5852137 - DNA, 20 bp, Homo sapiens
atttccattcccaaaataac

SEQ ID NO: 5852138 - DNA, 15 bp, Homo sapiens
atttccattctttta

SEQ ID NO: 5852139 - DNA, 19 bp, Homo sapiens
atttccattcttttaaatg

SEQ ID NO: 5852140 - DNA, 21 bp, Homo sapiens
atttccattgtgtggcctggt

SEQ ID NO: 5852141 - DNA, 23 bp, Homo sapiens
atttccattgtgtggcctggtgg

SEQ ID NO: 5852142 - DNA, 13 bp, Homo sapiens
atttccatttctg

SEQ ID NO: 5852143 - DNA, 14 bp, Homo sapiens
atttccatttctga

SEQ ID NO: 5852144 - DNA, 15 bp, Homo sapiens
atttccatttctgat

SEQ ID NO: 5852145 - DNA, 13 bp, Homo sapiens
atttccatttctt

SEQ ID NO: 5852146 - DNA, 14 bp, Homo sapiens
atttcccaaaaaca

SEQ ID NO: 5852147 - DNA, 14 bp, Homo sapiens
atttcccaaagcag

SEQ ID NO: 5852148 - DNA, 20 bp, Homo sapiens
atttcccaaagtcctctgct

SEQ ID NO: 5852149 - DNA, 19 bp, Homo sapiens
atttcccaacacaaagatt

SEQ ID NO: 5852150 - DNA, 14 bp, Homo sapiens
atttcccaagctgg

SEQ ID NO: 5852151 - DNA, 18 bp, Homo sapiens
atttcccaattaggaagt

SEQ ID NO: 5852152 - DNA, 14 bp, Homo sapiens
atttcccacatctt

SEQ ID NO: 5852153 - DNA, 15 bp, Homo sapiens
atttcccacatcttt

SEQ ID NO: 5852154 - DNA, 18 bp, Homo sapiens
atttcccacccatctcca

SEQ ID NO: 5852155 - DNA, 15 bp, Homo sapiens
atttcccagaaggga

SEQ ID NO: 5852156 - DNA, 13 bp, Homo sapiens
atttcccaggacc

SEQ ID NO: 5852157 - DNA, 19 bp, Homo sapiens
atttcccaggaccctgaag

SEQ ID NO: 5852158 - DNA, 18 bp, Homo sapiens
atttcccagttaaagatt

SEQ ID NO: 5852159 - DNA, 21 bp, Homo sapiens
atttcccagttaaagattatt

SEQ ID NO: 5852160 - DNA, 18 bp, Homo sapiens
atttcccatgatttcatg

SEQ ID NO: 5852161 - DNA, 22 bp, Homo sapiens
atttcccatttgtgccagagga

SEQ ID NO: 5852162 - DNA, 16 bp, Homo sapiens
atttccccaacagtgt

SEQ ID NO: 5852163 - DNA, 17 bp, Homo sapiens
atttccccaacagtgtg

SEQ ID NO: 5852164 - DNA, 23 bp, Homo sapiens
atttccccagacctgagctcccc

SEQ ID NO: 5852165 - DNA, 11 bp, Homo sapiens
atttccccagc

SEQ ID NO: 5852166 - DNA, 12 bp, Homo sapiens
atttccccagcc

SEQ ID NO: 5852167 - DNA, 14 bp, Homo sapiens
atttccccagccac

SEQ ID NO: 5852168 - DNA, 16 bp, Homo sapiens
atttccccagccacag

SEQ ID NO: 5852169 - DNA, 20 bp, Homo sapiens
atttccccaggggaaaatga

SEQ ID NO: 5852170 - DNA, 20 bp, Homo sapiens
atttccccatctgccacagg

SEQ ID NO: 5852171 - DNA, 23 bp, Homo sapiens
atttcccccaccccatttctctc

SEQ ID NO: 5852172 - DNA, 17 bp, Homo sapiens
atttcccccacctgcag

SEQ ID NO: 5852173 - DNA, 14 bp, Homo sapiens
atttcccccaggga

SEQ ID NO: 5852174 - DNA, 20 bp, Homo sapiens
atttcccccatttttcccag

SEQ ID NO: 5852175 - DNA, 15 bp, Homo sapiens
atttccccctcctca

SEQ ID NO: 5852176 - DNA, 16 bp, Homo sapiens
atttccccctcctcag

SEQ ID NO: 5852177 - DNA, 17 bp, Homo sapiens
atttccccctcctcaga

SEQ ID NO: 5852178 - DNA, 20 bp, Homo sapiens
atttccccctttcttcctca

SEQ ID NO: 5852179 - DNA, 22 bp, Homo sapiens
atttcccctcccaatcctctct

SEQ ID NO: 5852180 - DNA, 16 bp, Homo sapiens
atttcccctccttccc

SEQ ID NO: 5852181 - DNA, 16 bp, Homo sapiens
atttccccttttgcat

SEQ ID NO: 5852182 - DNA, 15 bp, Homo sapiens
atttcccgtggcccc

SEQ ID NO: 5852183 - DNA, 22 bp, Homo sapiens
atttcccgtggccccagcctgg

SEQ ID NO: 5852184 - DNA, 15 bp, Homo sapiens
atttccctacattaa

SEQ ID NO: 5852185 - DNA, 20 bp, Homo sapiens
atttccctcaggttctattt

SEQ ID NO: 5852186 - DNA, 19 bp, Homo sapiens
atttccctccagagaaagc

SEQ ID NO: 5852187 - DNA, 15 bp, Homo sapiens
atttccctcccggga

SEQ ID NO: 5852188 - DNA, 15 bp, Homo sapiens
atttccctgaagcta

SEQ ID NO: 5852189 - DNA, 11 bp, Homo sapiens
atttccctgca

SEQ ID NO: 5852190 - DNA, 23 bp, Homo sapiens
atttccctgggggcatcctgctt

SEQ ID NO: 5852191 - DNA, 21 bp, Homo sapiens
atttcccttcatttaaactaa

SEQ ID NO: 5852192 - DNA, 15 bp, Homo sapiens
atttcccttccaaag

SEQ ID NO: 5852193 - DNA, 16 bp, Homo sapiens
atttcccttccaaaga

SEQ ID NO: 5852194 - DNA, 16 bp, Homo sapiens
atttcccttccttcct

SEQ ID NO: 5852195 - DNA, 13 bp, Homo sapiens
atttcccttcttg

SEQ ID NO: 5852196 - DNA, 16 bp, Homo sapiens
atttccctttagctgt

SEQ ID NO: 5852197 - DNA, 13 bp, Homo sapiens
atttcccttttct

SEQ ID NO: 5852198 - DNA, 13 bp, Homo sapiens
atttccctttttt

SEQ ID NO: 5852199 - DNA, 18 bp, Homo sapiens
atttcccttttttcttcc

SEQ ID NO: 5852200 - DNA, 23 bp, Homo sapiens
atttccgaagaccttctgaagat

SEQ ID NO: 5852201 - DNA, 22 bp, Homo sapiens
atttccgcacttcagaattcca

SEQ ID NO: 5852202 - DNA, 23 bp, Homo sapiens
atttccgcacttcagaattccat

SEQ ID NO: 5852203 - DNA, 13 bp, Homo sapiens
atttccggctgct

SEQ ID NO: 5852204 - DNA, 14 bp, Homo sapiens
atttccgggtggaa

SEQ ID NO: 5852205 - DNA, 20 bp, Homo sapiens
atttccgtccccccccaggc

SEQ ID NO: 5852206 - DNA, 22 bp, Homo sapiens
atttccgtccccccccaggccc

SEQ ID NO: 5852207 - DNA, 20 bp, Homo sapiens
atttccgtgaactctggtgc

SEQ ID NO: 5852208 - DNA, 15 bp, Homo sapiens
atttccgttttgcct

SEQ ID NO: 5852209 - DNA, 14 bp, Homo sapiens
atttcctaaacata

SEQ ID NO: 5852210 - DNA, 14 bp, Homo sapiens
atttcctaaatata

SEQ ID NO: 5852211 - DNA, 15 bp, Homo sapiens
atttcctaaggcatg

SEQ ID NO: 5852212 - DNA, 22 bp, Homo sapiens
atttcctaatgagatatatctt

SEQ ID NO: 5852213 - DNA, 23 bp, Homo sapiens
atttcctaatgagatatatcttt

SEQ ID NO: 5852214 - DNA, 19 bp, Homo sapiens
atttcctaattttgagaaa

SEQ ID NO: 5852215 - DNA, 13 bp, Homo sapiens
atttcctagtgga

SEQ ID NO: 5852216 - DNA, 22 bp, Homo sapiens
atttcctagttctgtagaaatg

SEQ ID NO: 5852217 - DNA, 15 bp, Homo sapiens
atttcctataccatt

SEQ ID NO: 5852218 - DNA, 18 bp, Homo sapiens
atttcctatcacctattt

SEQ ID NO: 5852219 - DNA, 18 bp, Homo sapiens
atttcctattttaaaacc

SEQ ID NO: 5852220 - DNA, 21 bp, Homo sapiens
atttcctattttaaaaccatg

SEQ ID NO: 5852221 - DNA, 24 bp, Homo sapiens
atttcctcaacgttgctccccatc

SEQ ID NO: 5852222 - DNA, 13 bp, Homo sapiens
atttcctcacgtg

SEQ ID NO: 5852223 - DNA, 15 bp, Homo sapiens
atttcctcatctggg

SEQ ID NO: 5852224 - DNA, 16 bp, Homo sapiens
atttcctccacaaatt

SEQ ID NO: 5852225 - DNA, 23 bp, Homo sapiens
atttcctccatggtggaaggggg

SEQ ID NO: 5852226 - DNA, 14 bp, Homo sapiens
atttcctcccaatt

SEQ ID NO: 5852227 - DNA, 11 bp, Homo sapiens
atttcctcctt

SEQ ID NO: 5852228 - DNA, 17 bp, Homo sapiens
atttcctcgcagcctct

SEQ ID NO: 5852229 - DNA, 17 bp, Homo sapiens
atttcctctccactgct

SEQ ID NO: 5852230 - DNA, 21 bp, Homo sapiens
atttcctctgagctgttatct

SEQ ID NO: 5852231 - DNA, 19 bp, Homo sapiens
atttcctctgtaatctatt

SEQ ID NO: 5852232 - DNA, 18 bp, Homo sapiens
atttcctctgttcttttc

SEQ ID NO: 5852233 - DNA, 18 bp, Homo sapiens
atttcctcttccttctct

SEQ ID NO: 5852234 - DNA, 21 bp, Homo sapiens
atttcctcttgaacgttatgt

SEQ ID NO: 5852235 - DNA, 20 bp, Homo sapiens
atttcctgaaataaatgttt

SEQ ID NO: 5852236 - DNA, 15 bp, Homo sapiens
atttcctgatctagc

SEQ ID NO: 5852237 - DNA, 16 bp, Homo sapiens
atttcctgcttccctg

SEQ ID NO: 5852238 - DNA, 17 bp, Homo sapiens
atttcctggagtgccct

SEQ ID NO: 5852239 - DNA, 22 bp, Homo sapiens
atttcctggagtgccctgcagg

SEQ ID NO: 5852240 - DNA, 13 bp, Homo sapiens
atttcctggccct

SEQ ID NO: 5852241 - DNA, 23 bp, Homo sapiens
atttcctgggagcttttgtagaa

SEQ ID NO: 5852242 - DNA, 16 bp, Homo sapiens
atttcctgtgaggata

SEQ ID NO: 5852243 - DNA, 12 bp, Homo sapiens
atttcctgtgtc

SEQ ID NO: 5852244 - DNA, 16 bp, Homo sapiens
atttcctgtgtcaatc

SEQ ID NO: 5852245 - DNA, 19 bp, Homo sapiens
atttcctgtgtgtgttgcc

SEQ ID NO: 5852246 - DNA, 23 bp, Homo sapiens
atttcctgtgtttgtcctgggtt

SEQ ID NO: 5852247 - DNA, 21 bp, Homo sapiens
atttccttaaaatctctaata

SEQ ID NO: 5852248 - DNA, 14 bp, Homo sapiens
atttccttatgtgt

SEQ ID NO: 5852249 - DNA, 13 bp, Homo sapiens
atttccttcaggc

SEQ ID NO: 5852250 - DNA, 23 bp, Homo sapiens
atttccttcaggcagctgaaatt

SEQ ID NO: 5852251 - DNA, 11 bp, Homo sapiens
atttccttcca

SEQ ID NO: 5852252 - DNA, 19 bp, Homo sapiens
atttccttccactgtagct

SEQ ID NO: 5852253 - DNA, 16 bp, Homo sapiens
atttccttccagccca

SEQ ID NO: 5852254 - DNA, 14 bp, Homo sapiens
atttccttctgtta

SEQ ID NO: 5852255 - DNA, 12 bp, Homo sapiens
atttccttgtct

SEQ ID NO: 5852256 - DNA, 19 bp, Homo sapiens
atttccttgtgctcctgcc

SEQ ID NO: 5852257 - DNA, 16 bp, Homo sapiens
atttcctttatactgt

SEQ ID NO: 5852258 - DNA, 19 bp, Homo sapiens
atttcctttatactgtgaa

SEQ ID NO: 5852259 - DNA, 18 bp, Homo sapiens
atttcctttatgtgaatt

SEQ ID NO: 5852260 - DNA, 20 bp, Homo sapiens
atttcctttatgtgaatttt

SEQ ID NO: 5852261 - DNA, 20 bp, Homo sapiens
atttccttttgtaaagtaaa

SEQ ID NO: 5852262 - DNA, 15 bp, Homo sapiens
atttcctttttgaca

SEQ ID NO: 5852263 - DNA, 20 bp, Homo sapiens
atttcctttttgacactgaa

SEQ ID NO: 5852264 - DNA, 21 bp, Homo sapiens
atttcgccgttgaagaggaag

SEQ ID NO: 5852265 - DNA, 13 bp, Homo sapiens
atttcgccttaaa

SEQ ID NO: 5852266 - DNA, 22 bp, Homo sapiens
atttcgccttaaactctggaca

SEQ ID NO: 5852267 - DNA, 16 bp, Homo sapiens
atttcggaaatacact

SEQ ID NO: 5852268 - DNA, 17 bp, Homo sapiens
atttcggattttttcca

SEQ ID NO: 5852269 - DNA, 17 bp, Homo sapiens
atttcggtcataaagaa

SEQ ID NO: 5852270 - DNA, 13 bp, Homo sapiens
atttcgtatttct

SEQ ID NO: 5852271 - DNA, 17 bp, Homo sapiens
atttcgtatttctcata

SEQ ID NO: 5852272 - DNA, 21 bp, Homo sapiens
atttcgtctgtttataaacat

SEQ ID NO: 5852273 - DNA, 14 bp, Homo sapiens
atttcgtgagcccc

SEQ ID NO: 5852274 - DNA, 20 bp, Homo sapiens
atttcgtgggtctgttttcc

SEQ ID NO: 5852275 - DNA, 17 bp, Homo sapiens
atttcgtgtaatattct

SEQ ID NO: 5852276 - DNA, 20 bp, Homo sapiens
atttcgtgtaatattctctg

SEQ ID NO: 5852277 - DNA, 17 bp, Homo sapiens
atttcgtgtgccgctgc

SEQ ID NO: 5852278 - DNA, 18 bp, Homo sapiens
atttcgtgttgtgttctt

SEQ ID NO: 5852279 - DNA, 12 bp, Homo sapiens
atttcgttccct

SEQ ID NO: 5852280 - DNA, 19 bp, Homo sapiens
atttcgttgtccaatttgt

SEQ ID NO: 5852281 - DNA, 17 bp, Homo sapiens
atttctaaaatataaga

SEQ ID NO: 5852282 - DNA, 14 bp, Homo sapiens
atttctaaaatgtt

SEQ ID NO: 5852283 - DNA, 21 bp, Homo sapiens
atttctaaagtaaaattgaag

SEQ ID NO: 5852284 - DNA, 23 bp, Homo sapiens
atttctaaagtaaaattgaagca

SEQ ID NO: 5852285 - DNA, 14 bp, Homo sapiens
atttctaaagttgt

SEQ ID NO: 5852286 - DNA, 15 bp, Homo sapiens
atttctaaagttgta

SEQ ID NO: 5852287 - DNA, 23 bp, Homo sapiens
atttctaaataaggaatttcctc

SEQ ID NO: 5852288 - DNA, 18 bp, Homo sapiens
atttctaacagtccttgc

SEQ ID NO: 5852289 - DNA, 18 bp, Homo sapiens
atttctaacatatgtatt

SEQ ID NO: 5852290 - DNA, 19 bp, Homo sapiens
atttctaacatatgtatta

SEQ ID NO: 5852291 - DNA, 20 bp, Homo sapiens
atttctaacatatgtattaa

SEQ ID NO: 5852292 - DNA, 14 bp, Homo sapiens
atttctaactatat

SEQ ID NO: 5852293 - DNA, 19 bp, Homo sapiens
atttctaactctgatgtaa

SEQ ID NO: 5852294 - DNA, 22 bp, Homo sapiens
atttctaactctgatgtaaatg

SEQ ID NO: 5852295 - DNA, 17 bp, Homo sapiens
atttctaagaagttgtt

SEQ ID NO: 5852296 - DNA, 22 bp, Homo sapiens
atttctaagaagttgtttgagg

SEQ ID NO: 5852297 - DNA, 23 bp, Homo sapiens
atttctaagaagttgtttgaggc

SEQ ID NO: 5852298 - DNA, 16 bp, Homo sapiens
atttctaagcctttga

SEQ ID NO: 5852299 - DNA, 13 bp, Homo sapiens
atttgaaatacta

SEQ ID NO: 5852300 - DNA, 22 bp, Homo sapiens
atttgaaatactaaaagcaaat

SEQ ID NO: 5852301 - DNA, 18 bp, Homo sapiens
atttgaaatcaccttttc

SEQ ID NO: 5852302 - DNA, 16 bp, Homo sapiens
atttgaaatcgttgga

SEQ ID NO: 5852303 - DNA, 14 bp, Homo sapiens
atttgaaatgtttt

SEQ ID NO: 5852304 - DNA, 11 bp, Homo sapiens
atttgaaattt

SEQ ID NO: 5852305 - DNA, 18 bp, Homo sapiens
atttgaacaaagcagaag

SEQ ID NO: 5852306 - DNA, 14 bp, Homo sapiens
atttgaacacatta

SEQ ID NO: 5852307 - DNA, 22 bp, Homo sapiens
atttgaacagggcaaaatgaac

SEQ ID NO: 5852308 - DNA, 17 bp, Homo sapiens
atttgaaccaaaacatt

SEQ ID NO: 5852309 - DNA, 14 bp, Homo sapiens
atttgaaccccctc

SEQ ID NO: 5852310 - DNA, 16 bp, Homo sapiens
atttgaacctggatcc

SEQ ID NO: 5852311 - DNA, 15 bp, Homo sapiens
atttgaactttggaa

SEQ ID NO: 5852312 - DNA, 22 bp, Homo sapiens
atttgaagaaggaggaatttta

SEQ ID NO: 5852313 - DNA, 21 bp, Homo sapiens
atttgaagacaaaaatactct

SEQ ID NO: 5852314 - DNA, 16 bp, Homo sapiens
atttgaagacttcaaa

SEQ ID NO: 5852315 - DNA, 16 bp, Homo sapiens
atttgaagatagaagg

SEQ ID NO: 5852316 - DNA, 17 bp, Homo sapiens
atttgaagatctgattt

SEQ ID NO: 5852317 - DNA, 20 bp, Homo sapiens
atttgaagatctgatttata

SEQ ID NO: 5852318 - DNA, 16 bp, Homo sapiens
atttgaagatgtggat

SEQ ID NO: 5852319 - DNA, 16 bp, Homo sapiens
atttgaaggacctaaa

SEQ ID NO: 5852320 - DNA, 24 bp, Homo sapiens
atttgaagtaacttatttgactat

SEQ ID NO: 5852321 - DNA, 14 bp, Homo sapiens
atttgaagtggaaa

SEQ ID NO: 5852322 - DNA, 15 bp, Homo sapiens
atttgaataaaaatc

SEQ ID NO: 5852323 - DNA, 14 bp, Homo sapiens
atttgaataaatga

SEQ ID NO: 5852324 - DNA, 15 bp, Homo sapiens
atttgaataaattat

SEQ ID NO: 5852325 - DNA, 20 bp, Homo sapiens
atttgaataaattatgagct

SEQ ID NO: 5852326 - DNA, 22 bp, Homo sapiens
atttgaataagatccaattcat

SEQ ID NO: 5852327 - DNA, 18 bp, Homo sapiens
atttgaataataaatcga

SEQ ID NO: 5852328 - DNA, 22 bp, Homo sapiens
atttgaatatcattaaattgga

SEQ ID NO: 5852329 - DNA, 16 bp, Homo sapiens
atttgaatcagagaaa

SEQ ID NO: 5852330 - DNA, 16 bp, Homo sapiens
atttgaatctcaattt

SEQ ID NO: 5852331 - DNA, 14 bp, Homo sapiens
atttgaatcttgtc

SEQ ID NO: 5852332 - DNA, 16 bp, Homo sapiens
atttgaatcttgtctc

SEQ ID NO: 5852333 - DNA, 19 bp, Homo sapiens
atttgaatgaaaaatttaa

SEQ ID NO: 5852334 - DNA, 16 bp, Homo sapiens
atttgaatgactgctg

SEQ ID NO: 5852335 - DNA, 12 bp, Homo sapiens
atttgaatgaga

SEQ ID NO: 5852336 - DNA, 17 bp, Homo sapiens
atttgaatgatttttct

SEQ ID NO: 5852337 - DNA, 22 bp, Homo sapiens
atttgaatgatttttctttaca

SEQ ID NO: 5852338 - DNA, 14 bp, Homo sapiens
atttgaatgcattt

SEQ ID NO: 5852339 - DNA, 15 bp, Homo sapiens
atttgaatgcatttt

SEQ ID NO: 5852340 - DNA, 21 bp, Homo sapiens
atttgaatggattaaatggca

SEQ ID NO: 5852341 - DNA, 14 bp, Homo sapiens
atttgaatggtgca

SEQ ID NO: 5852342 - DNA, 17 bp, Homo sapiens
atttgaatgtatgcttc

SEQ ID NO: 5852343 - DNA, 21 bp, Homo sapiens
atttgaatgtatgcttcatac

SEQ ID NO: 5852344 - DNA, 19 bp, Homo sapiens
atttgaatgttaagcagat

SEQ ID NO: 5852345 - DNA, 19 bp, Homo sapiens
atttgaattaaaacttctt

SEQ ID NO: 5852346 - DNA, 21 bp, Homo sapiens
atttgaattaaaacttcttaa

SEQ ID NO: 5852347 - DNA, 19 bp, Homo sapiens
atttgaattagaagaaaat

SEQ ID NO: 5852348 - DNA, 18 bp, Homo sapiens
atttgaattcatttgctg

SEQ ID NO: 5852349 - DNA, 15 bp, Homo sapiens
atttgaattgacagg

SEQ ID NO: 5852350 - DNA, 11 bp, Homo sapiens
atttgaattgg

SEQ ID NO: 5852351 - DNA, 17 bp, Homo sapiens
atttgaattggcctgaa

SEQ ID NO: 5852352 - DNA, 23 bp, Homo sapiens
atttgacaaaatttgttgaaatt

SEQ ID NO: 5852353 - DNA, 14 bp, Homo sapiens
atttgacacataaa

SEQ ID NO: 5852354 - DNA, 19 bp, Homo sapiens
atttgacagacatccttgc

SEQ ID NO: 5852355 - DNA, 22 bp, Homo sapiens
atttgacagacatccttgcagt

SEQ ID NO: 5852356 - DNA, 14 bp, Homo sapiens
atttgacagtgtgg

SEQ ID NO: 5852357 - DNA, 19 bp, Homo sapiens
atttgacattcttcactgt

SEQ ID NO: 5852358 - DNA, 21 bp, Homo sapiens
atttgacattgtcagaatgtt

SEQ ID NO: 5852359 - DNA, 12 bp, Homo sapiens
atttgaccaaat

SEQ ID NO: 5852360 - DNA, 15 bp, Homo sapiens
atttgaccattcttt

SEQ ID NO: 5852361 - DNA, 13 bp, Homo sapiens
atttgacccccac

SEQ ID NO: 5852362 - DNA, 21 bp, Homo sapiens
atttgacctcctccctgttat

SEQ ID NO: 5852363 - DNA, 15 bp, Homo sapiens
atttgactaatttta

SEQ ID NO: 5852364 - DNA, 13 bp, Homo sapiens
atttgactatgaa

SEQ ID NO: 5852365 - DNA, 14 bp, Homo sapiens
atttgactcctcca

SEQ ID NO: 5852366 - DNA, 15 bp, Homo sapiens
atttgactctttcaa

SEQ ID NO: 5852367 - DNA, 17 bp, Homo sapiens
atttgactctttcaaag

SEQ ID NO: 5852368 - DNA, 11 bp, Homo sapiens
atttgactgta

SEQ ID NO: 5852369 - DNA, 15 bp, Homo sapiens
atttgactgttattt

SEQ ID NO: 5852370 - DNA, 13 bp, Homo sapiens
atttgactgtttt

SEQ ID NO: 5852371 - DNA, 17 bp, Homo sapiens
atttgactgtttttacc

SEQ ID NO: 5852372 - DNA, 19 bp, Homo sapiens
atttgactgtttttaccca

SEQ ID NO: 5852373 - DNA, 22 bp, Homo sapiens
atttgacttgaaaagaaagaaa

SEQ ID NO: 5852374 - DNA, 18 bp, Homo sapiens
atttgacttgcatgaaga

SEQ ID NO: 5852375 - DNA, 15 bp, Homo sapiens
atttgacttgtggtt

SEQ ID NO: 5852376 - DNA, 17 bp, Homo sapiens
atttgactttagtgaaa

SEQ ID NO: 5852377 - DNA, 16 bp, Homo sapiens
atttgacttttctgta

SEQ ID NO: 5852378 - DNA, 11 bp, Homo sapiens
atttgagaaaa

SEQ ID NO: 5852379 - DNA, 14 bp, Homo sapiens
atttgagaaaatat

SEQ ID NO: 5852380 - DNA, 15 bp, Homo sapiens
atttgagaaaatata

SEQ ID NO: 5852381 - DNA, 14 bp, Homo sapiens
atttgagaaatgca

SEQ ID NO: 5852382 - DNA, 16 bp, Homo sapiens
atttgagaaatgcata

SEQ ID NO: 5852383 - DNA, 12 bp, Homo sapiens
atttgagaagtt

SEQ ID NO: 5852384 - DNA, 19 bp, Homo sapiens
atttgagaagttctcagaa

SEQ ID NO: 5852385 - DNA, 17 bp, Homo sapiens
atttgagagaaatatga

SEQ ID NO: 5852386 - DNA, 14 bp, Homo sapiens
atttgagagaagcc

SEQ ID NO: 5852387 - DNA, 22 bp, Homo sapiens
atttgagagaatctactaagtt

SEQ ID NO: 5852388 - DNA, 18 bp, Homo sapiens
atttgagataaagtcaaa

SEQ ID NO: 5852389 - DNA, 21 bp, Homo sapiens
atttgagatcgtccactgtca

SEQ ID NO: 5852390 - DNA, 20 bp, Homo sapiens
atttgagcacacattttaat

SEQ ID NO: 5852391 - DNA, 16 bp, Homo sapiens
atttgagcatatcagt

SEQ ID NO: 5852392 - DNA, 15 bp, Homo sapiens
atttgagccatgtca

SEQ ID NO: 5852393 - DNA, 15 bp, Homo sapiens
atttgaggaaactca

SEQ ID NO: 5852394 - DNA, 17 bp, Homo sapiens
atttgaggactgaagct

SEQ ID NO: 5852395 - DNA, 20 bp, Homo sapiens
atttgaggactgaagctggg

SEQ ID NO: 5852396 - DNA, 12 bp, Homo sapiens
atttgaggactt

SEQ ID NO: 5852397 - DNA, 12 bp, Homo sapiens
atttgaggagac

SEQ ID NO: 5852398 - DNA, 19 bp, Homo sapiens
atttgaggagataacattt

SEQ ID NO: 5852399 - DNA, 20 bp, Homo sapiens
atttgaggagtgttaagatt

SEQ ID NO: 5852400 - DNA, 19 bp, Homo sapiens
atttgagggcccagccagg

SEQ ID NO: 5852401 - DNA, 20 bp, Homo sapiens
atttgagggcccagccagga

SEQ ID NO: 5852402 - DNA, 22 bp, Homo sapiens
atttgaggggaaaacaccataa

SEQ ID NO: 5852403 - DNA, 17 bp, Homo sapiens
atttgaggtgaaattca

SEQ ID NO: 5852404 - DNA, 18 bp, Homo sapiens
atttgaggttaagacaaa

SEQ ID NO: 5852405 - DNA, 22 bp, Homo sapiens
atttgagtaatctgatcgttct

SEQ ID NO: 5852406 - DNA, 18 bp, Homo sapiens
atttgagtgattatttgt

SEQ ID NO: 5852407 - DNA, 16 bp, Homo sapiens
atttgagtgctctgat

SEQ ID NO: 5852408 - DNA, 18 bp, Homo sapiens
atttgagtgtatatatat

SEQ ID NO: 5852409 - DNA, 12 bp, Homo sapiens
atttgagtgttt

SEQ ID NO: 5852410 - DNA, 17 bp, Homo sapiens
atttgagttggccaaga

SEQ ID NO: 5852411 - DNA, 18 bp, Homo sapiens
atttgagttggccaagaa

SEQ ID NO: 5852412 - DNA, 17 bp, Homo sapiens
atttgagtttcctttaa

SEQ ID NO: 5852413 - DNA, 13 bp, Homo sapiens
atttgataaactg

SEQ ID NO: 5852414 - DNA, 13 bp, Homo sapiens
atttgataaagat

SEQ ID NO: 5852415 - DNA, 15 bp, Homo sapiens
atttgataacatttt

SEQ ID NO: 5852416 - DNA, 19 bp, Homo sapiens
atttgataatgataaaaca

SEQ ID NO: 5852417 - DNA, 20 bp, Homo sapiens
atttgataatgataaaacac

SEQ ID NO: 5852418 - DNA, 22 bp, Homo sapiens
atttgataattttgaaatgatt

SEQ ID NO: 5852419 - DNA, 15 bp, Homo sapiens
atttgatacataata

SEQ ID NO: 5852420 - DNA, 19 bp, Homo sapiens
atttgatacttatattttc

SEQ ID NO: 5852421 - DNA, 18 bp, Homo sapiens
atttgatagaaaggaaca

SEQ ID NO: 5852422 - DNA, 22 bp, Homo sapiens
atttgatatacagacctccaga

SEQ ID NO: 5852423 - DNA, 15 bp, Homo sapiens
atttgatatcacagt

SEQ ID NO: 5852424 - DNA, 16 bp, Homo sapiens
atttgatatttttcca

SEQ ID NO: 5852425 - DNA, 23 bp, Homo sapiens
atttgatcacttaaaacttttaa

SEQ ID NO: 5852426 - DNA, 13 bp, Homo sapiens
atttgatctttgt

SEQ ID NO: 5852427 - DNA, 21 bp, Homo sapiens
atttgatctttgtttaaatgc

SEQ ID NO: 5852428 - DNA, 21 bp, Homo sapiens
atttgatgagttaactgtgaa

SEQ ID NO: 5852429 - DNA, 16 bp, Homo sapiens
atttgatgattttcat

SEQ ID NO: 5852430 - DNA, 15 bp, Homo sapiens
atttgatgccaggac

SEQ ID NO: 5852431 - DNA, 24 bp, Homo sapiens
atttgatgcccagataatatatta

SEQ ID NO: 5852432 - DNA, 14 bp, Homo sapiens
atttgatgctaaat

SEQ ID NO: 5852433 - DNA, 17 bp, Homo sapiens
atttgatgctggagagg

SEQ ID NO: 5852434 - DNA, 19 bp, Homo sapiens
atttgatgctggagaggtt

SEQ ID NO: 5852435 - DNA, 17 bp, Homo sapiens
atttgatggactaatta

SEQ ID NO: 5852436 - DNA, 18 bp, Homo sapiens
atttgatggcttgggaaa

SEQ ID NO: 5852437 - DNA, 22 bp, Homo sapiens
atttgatggtatttctttctcg

SEQ ID NO: 5852438 - DNA, 18 bp, Homo sapiens
atttgatggtgaatatta

SEQ ID NO: 5852439 - DNA, 18 bp, Homo sapiens
atttgatggttgaataca

SEQ ID NO: 5852440 - DNA, 17 bp, Homo sapiens
atttgatgtaagttact

SEQ ID NO: 5852441 - DNA, 21 bp, Homo sapiens
atttgatgtaagttactgaca

SEQ ID NO: 5852442 - DNA, 16 bp, Homo sapiens
atttgatgtacatgtg

SEQ ID NO: 5852443 - DNA, 14 bp, Homo sapiens
atttgatgtagttt

SEQ ID NO: 5852444 - DNA, 20 bp, Homo sapiens
atttgatgtctagataacat

SEQ ID NO: 5852445 - DNA, 21 bp, Homo sapiens
atttgatgtctagataacatt

SEQ ID NO: 5852446 - DNA, 12 bp, Homo sapiens
atttgatgtctt

SEQ ID NO: 5852447 - DNA, 20 bp, Homo sapiens
atttgatgtttacaggtgga

SEQ ID NO: 5852448 - DNA, 14 bp, Homo sapiens
atttgattaacatt

SEQ ID NO: 5852449 - DNA, 16 bp, Homo sapiens
atttgattaataaaat

SEQ ID NO: 5852450 - DNA, 19 bp, Homo sapiens
atttgattaataaaatatc

SEQ ID NO: 5852451 - DNA, 21 bp, Homo sapiens
atttgattaataaaatatcta

SEQ ID NO: 5852452 - DNA, 18 bp, Homo sapiens
atttgattagcatattaa

SEQ ID NO: 5852453 - DNA, 22 bp, Homo sapiens
atttgattaggtatgtttgtaa

SEQ ID NO: 5852454 - DNA, 17 bp, Homo sapiens
atttgattcattttcct

SEQ ID NO: 5852455 - DNA, 19 bp, Homo sapiens
atttgattcattttcctgt

SEQ ID NO: 5852456 - DNA, 20 bp, Homo sapiens
atttgattcattttcctgtt

SEQ ID NO: 5852457 - DNA, 18 bp, Homo sapiens
atttgattcgtatgatca

SEQ ID NO: 5852458 - DNA, 14 bp, Homo sapiens
atttgattctaaat

SEQ ID NO: 5852459 - DNA, 19 bp, Homo sapiens
atttgattgctttgctgca

SEQ ID NO: 5852460 - DNA, 20 bp, Homo sapiens
atttgattgctttgctgcac

SEQ ID NO: 5852461 - DNA, 21 bp, Homo sapiens
atttgattgtaaaaacaaaaa

SEQ ID NO: 5852462 - DNA, 15 bp, Homo sapiens
atttgatttattaac

SEQ ID NO: 5852463 - DNA, 17 bp, Homo sapiens
atttgatttccatctta

SEQ ID NO: 5852464 - DNA, 15 bp, Homo sapiens
atttgatttctaatt

SEQ ID NO: 5852465 - DNA, 17 bp, Homo sapiens
atttgatttctattcaa

SEQ ID NO: 5852466 - DNA, 18 bp, Homo sapiens
atttgatttgcaacactg

SEQ ID NO: 5852467 - DNA, 20 bp, Homo sapiens
atttgcaaaatcacttagca

SEQ ID NO: 5852468 - DNA, 23 bp, Homo sapiens
atttgcaaaatcacttagcagca

SEQ ID NO: 5852469 - DNA, 20 bp, Homo sapiens
atttgcaaaatggaaatgta

SEQ ID NO: 5852470 - DNA, 18 bp, Homo sapiens
atttgcaaaccctttgta

SEQ ID NO: 5852471 - DNA, 16 bp, Homo sapiens
atttgcaaagtactgt

SEQ ID NO: 5852472 - DNA, 19 bp, Homo sapiens
atttgcaaagtactgtaag

SEQ ID NO: 5852473 - DNA, 20 bp, Homo sapiens
atttgcaaatatactttact

SEQ ID NO: 5852474 - DNA, 19 bp, Homo sapiens
atttgcaacactgccaaac

SEQ ID NO: 5852475 - DNA, 23 bp, Homo sapiens
atttgcaacactgccaaacatca

SEQ ID NO: 5852476 - DNA, 17 bp, Homo sapiens
atttgcaacagcaaatt

SEQ ID NO: 5852477 - DNA, 21 bp, Homo sapiens
atttgtattgtacataaaatt

SEQ ID NO: 5852478 - DNA, 14 bp, Homo sapiens
atttgtatttatat

SEQ ID NO: 5852479 - DNA, 19 bp, Homo sapiens
atttgtatttctcttgtcc

SEQ ID NO: 5852480 - DNA, 22 bp, Homo sapiens
atttgtattttgcttaaaattt

SEQ ID NO: 5852481 - DNA, 21 bp, Homo sapiens
atttgtatttttttgcaagtg

SEQ ID NO: 5852482 - DNA, 14 bp, Homo sapiens
atttgtcaaattgt

SEQ ID NO: 5852483 - DNA, 13 bp, Homo sapiens
atttgtcaacaaa

SEQ ID NO: 5852484 - DNA, 15 bp, Homo sapiens
atttgtcaacagatt

SEQ ID NO: 5852485 - DNA, 17 bp, Homo sapiens
atttgtcaatgacagtt

SEQ ID NO: 5852486 - DNA, 20 bp, Homo sapiens
atttgtcaatttatgaatat

SEQ ID NO: 5852487 - DNA, 22 bp, Homo sapiens
atttgtcacagaaatcagagga

SEQ ID NO: 5852488 - DNA, 16 bp, Homo sapiens
atttgtcactgcttca

SEQ ID NO: 5852489 - DNA, 22 bp, Homo sapiens
atttgtcagtgtagatcaactc

SEQ ID NO: 5852490 - DNA, 21 bp, Homo sapiens
atttgtcatcgttccccaccc

SEQ ID NO: 5852491 - DNA, 23 bp, Homo sapiens
atttgtcatcgttccccacccct

SEQ ID NO: 5852492 - DNA, 13 bp, Homo sapiens
atttgtcatgaca

SEQ ID NO: 5852493 - DNA, 19 bp, Homo sapiens
atttgtcatgctgggattt

SEQ ID NO: 5852494 - DNA, 17 bp, Homo sapiens
atttgtcattttcatta

SEQ ID NO: 5852495 - DNA, 19 bp, Homo sapiens
atttgtccaaacaggtgct

SEQ ID NO: 5852496 - DNA, 13 bp, Homo sapiens
atttgtccaaata

SEQ ID NO: 5852497 - DNA, 19 bp, Homo sapiens
atttgtccatttaaaaatg

SEQ ID NO: 5852498 - DNA, 14 bp, Homo sapiens
atttgtcccaagtg

SEQ ID NO: 5852499 - DNA, 19 bp, Homo sapiens
atttgtcccagaattttct

SEQ ID NO: 5852500 - DNA, 13 bp, Homo sapiens
atttgtcccagcc

SEQ ID NO: 5852501 - DNA, 21 bp, Homo sapiens
atttgtcctgactgtctgcta

SEQ ID NO: 5852502 - DNA, 18 bp, Homo sapiens
atttgtccttttatttct

SEQ ID NO: 5852503 - DNA, 13 bp, Homo sapiens
atttgtctcattt

SEQ ID NO: 5852504 - DNA, 22 bp, Homo sapiens
atttgtctcattttgtatgtat

SEQ ID NO: 5852505 - DNA, 20 bp, Homo sapiens
atttgtctcctactctgtgt

SEQ ID NO: 5852506 - DNA, 20 bp, Homo sapiens
atttgtctctgtcacccttg

SEQ ID NO: 5852507 - DNA, 17 bp, Homo sapiens
atttgtctcttacatct

SEQ ID NO: 5852508 - DNA, 19 bp, Homo sapiens
atttgtctggactagaaaa

SEQ ID NO: 5852509 - DNA, 19 bp, Homo sapiens
atttgtctgtaaaaaatgg

SEQ ID NO: 5852510 - DNA, 12 bp, Homo sapiens
atttgtctgtgt

SEQ ID NO: 5852511 - DNA, 13 bp, Homo sapiens
atttgtctgtgtg

SEQ ID NO: 5852512 - DNA, 19 bp, Homo sapiens
atttgtctgtgtgctacta

SEQ ID NO: 5852513 - DNA, 21 bp, Homo sapiens
atttgtctgtgtgctactaac

SEQ ID NO: 5852514 - DNA, 20 bp, Homo sapiens
atttgtcttaaaaaatgtga

SEQ ID NO: 5852515 - DNA, 16 bp, Homo sapiens
atttgtcttagagaga

SEQ ID NO: 5852516 - DNA, 13 bp, Homo sapiens
atttgtcttccct

SEQ ID NO: 5852517 - DNA, 15 bp, Homo sapiens
atttgtcttctcctt

SEQ ID NO: 5852518 - DNA, 15 bp, Homo sapiens
atttgtcttgcctta

SEQ ID NO: 5852519 - DNA, 18 bp, Homo sapiens
atttgtcttggtagtata

SEQ ID NO: 5852520 - DNA, 15 bp, Homo sapiens
atttgtctttgtaat

SEQ ID NO: 5852521 - DNA, 23 bp, Homo sapiens
atttgtctttgtaatattttcca

SEQ ID NO: 5852522 - DNA, 16 bp, Homo sapiens
atttgtgaaaatgtaa

SEQ ID NO: 5852523 - DNA, 14 bp, Homo sapiens
atttgtgaagaatt

SEQ ID NO: 5852524 - DNA, 12 bp, Homo sapiens
atttgtgaattt

SEQ ID NO: 5852525 - DNA, 13 bp, Homo sapiens
atttgtgaatttg

SEQ ID NO: 5852526 - DNA, 15 bp, Homo sapiens
atttgtgacaaaaaa

SEQ ID NO: 5852527 - DNA, 19 bp, Homo sapiens
atttgtgactaattgtata

SEQ ID NO: 5852528 - DNA, 20 bp, Homo sapiens
atttgtgactaattgtataa

SEQ ID NO: 5852529 - DNA, 15 bp, Homo sapiens
atttgtgactctttc

SEQ ID NO: 5852530 - DNA, 18 bp, Homo sapiens
atttgtgacttttaaaaa

SEQ ID NO: 5852531 - DNA, 12 bp, Homo sapiens
atttgtgagact

SEQ ID NO: 5852532 - DNA, 18 bp, Homo sapiens
atttgtgagccaaagaga

SEQ ID NO: 5852533 - DNA, 23 bp, Homo sapiens
atttgtgagccaaagagaaaaga

SEQ ID NO: 5852534 - DNA, 20 bp, Homo sapiens
atttgtgatacaatgctgtg

SEQ ID NO: 5852535 - DNA, 15 bp, Homo sapiens
atttgtgatagcact

SEQ ID NO: 5852536 - DNA, 17 bp, Homo sapiens
atttgtgatagcacttt

SEQ ID NO: 5852537 - DNA, 21 bp, Homo sapiens
atttgtgatgacaactggaat

SEQ ID NO: 5852538 - DNA, 15 bp, Homo sapiens
atttgtgcacactca

SEQ ID NO: 5852539 - DNA, 14 bp, Homo sapiens
atttgtgccagaat

SEQ ID NO: 5852540 - DNA, 14 bp, Homo sapiens
atttgtgccgtaat

SEQ ID NO: 5852541 - DNA, 18 bp, Homo sapiens
atttgtgctatagtattt

SEQ ID NO: 5852542 - DNA, 14 bp, Homo sapiens
atttgtgctttgaa

SEQ ID NO: 5852543 - DNA, 18 bp, Homo sapiens
atttgtggaaaataactc

SEQ ID NO: 5852544 - DNA, 11 bp, Homo sapiens
atttgtggaat

SEQ ID NO: 5852545 - DNA, 22 bp, Homo sapiens
atttgtggcaattttatgtttt

SEQ ID NO: 5852546 - DNA, 21 bp, Homo sapiens
atttgtggcactatgacagct

SEQ ID NO: 5852547 - DNA, 22 bp, Homo sapiens
atttgtgggaggagtgacatga

SEQ ID NO: 5852548 - DNA, 22 bp, Homo sapiens
atttgtggggacctcagcctgc

SEQ ID NO: 5852549 - DNA, 22 bp, Homo sapiens
atttgtggtaatctacaccaat

SEQ ID NO: 5852550 - DNA, 19 bp, Homo sapiens
atttgtggttagaatcttg

SEQ ID NO: 5852551 - DNA, 19 bp, Homo sapiens
atttgtggttgtagaagga

SEQ ID NO: 5852552 - DNA, 14 bp, Homo sapiens
atttgtgtaactga

SEQ ID NO: 5852553 - DNA, 15 bp, Homo sapiens
atttgtgtaactgaa

SEQ ID NO: 5852554 - DNA, 20 bp, Homo sapiens
atttgtgtaataaagtgttt

SEQ ID NO: 5852555 - DNA, 22 bp, Homo sapiens
atttgtgtaataaagtgttttc

SEQ ID NO: 5852556 - DNA, 21 bp, Homo sapiens
atttgtgtaatagaaaactga

SEQ ID NO: 5852557 - DNA, 23 bp, Homo sapiens
atttgtgtagaagtccacagaca

SEQ ID NO: 5852558 - DNA, 16 bp, Homo sapiens
atttgtgtatgtgtat

SEQ ID NO: 5852559 - DNA, 22 bp, Homo sapiens
atttgtgtattttcctggattt

SEQ ID NO: 5852560 - DNA, 21 bp, Homo sapiens
atttgtgtcacaaagaattta

SEQ ID NO: 5852561 - DNA, 18 bp, Homo sapiens
atttgtgtcactgtacag

SEQ ID NO: 5852562 - DNA, 19 bp, Homo sapiens
atttgtgtcactgtacagt

SEQ ID NO: 5852563 - DNA, 21 bp, Homo sapiens
atttgtgtccatttcaagtgt

SEQ ID NO: 5852564 - DNA, 15 bp, Homo sapiens
atttgtgtgctaaac

SEQ ID NO: 5852565 - DNA, 20 bp, Homo sapiens
atttgtgtgctaaacgtgta

SEQ ID NO: 5852566 - DNA, 18 bp, Homo sapiens
atttgtgtgcttcacaca

SEQ ID NO: 5852567 - DNA, 14 bp, Homo sapiens
atttgtgtgcttct

SEQ ID NO: 5852568 - DNA, 17 bp, Homo sapiens
atttgtgtggaaatcat

SEQ ID NO: 5852569 - DNA, 14 bp, Homo sapiens
atttgtgtgtgtgc

SEQ ID NO: 5852570 - DNA, 22 bp, Homo sapiens
atttgtgtgttcactaaactct

SEQ ID NO: 5852571 - DNA, 18 bp, Homo sapiens
atttgtgttcccatttta

SEQ ID NO: 5852572 - DNA, 14 bp, Homo sapiens
atttgtgttgaaga

SEQ ID NO: 5852573 - DNA, 22 bp, Homo sapiens
atttgtgttgaagaggttttaa

SEQ ID NO: 5852574 - DNA, 20 bp, Homo sapiens
atttgtgttttaatttaaac

SEQ ID NO: 5852575 - DNA, 20 bp, Homo sapiens
atttgtgttttacagtatat

SEQ ID NO: 5852576 - DNA, 23 bp, Homo sapiens
atttgtgttttacagtatatctt

SEQ ID NO: 5852577 - DNA, 12 bp, Homo sapiens
atttgtgttttg

SEQ ID NO: 5852578 - DNA, 13 bp, Homo sapiens
atttgtgtttttc

SEQ ID NO: 5852579 - DNA, 15 bp, Homo sapiens
atttgttaaactagc

SEQ ID NO: 5852580 - DNA, 18 bp, Homo sapiens
atttgttaatagttcctg

SEQ ID NO: 5852581 - DNA, 21 bp, Homo sapiens
atttgttaatatatataatac

SEQ ID NO: 5852582 - DNA, 16 bp, Homo sapiens
atttgttaatatttct

SEQ ID NO: 5852583 - DNA, 17 bp, Homo sapiens
atttgttaatgattctt

SEQ ID NO: 5852584 - DNA, 12 bp, Homo sapiens
atttgttaatgg

SEQ ID NO: 5852585 - DNA, 13 bp, Homo sapiens
atttgttaattaa

SEQ ID NO: 5852586 - DNA, 19 bp, Homo sapiens
atttgttaattcctatgaa

SEQ ID NO: 5852587 - DNA, 19 bp, Homo sapiens
atttgttaatttagaaaac

SEQ ID NO: 5852588 - DNA, 11 bp, Homo sapiens
atttgttacag

SEQ ID NO: 5852589 - DNA, 23 bp, Homo sapiens
atttgttacagtttcttcatgca

SEQ ID NO: 5852590 - DNA, 22 bp, Homo sapiens
atttgttactcatcgggcccag

SEQ ID NO: 5852591 - DNA, 15 bp, Homo sapiens
atttgttactttact

SEQ ID NO: 5852592 - DNA, 20 bp, Homo sapiens
atttgttagactagttctct

SEQ ID NO: 5852593 - DNA, 14 bp, Homo sapiens
atttgttataatga

SEQ ID NO: 5852594 - DNA, 17 bp, Homo sapiens
atttgttatatataata

SEQ ID NO: 5852595 - DNA, 21 bp, Homo sapiens
atttgttatatataataaata

SEQ ID NO: 5852596 - DNA, 23 bp, Homo sapiens
atttgttatatataataaatact

SEQ ID NO: 5852597 - DNA, 14 bp, Homo sapiens
atttgttatggtta

SEQ ID NO: 5852598 - DNA, 16 bp, Homo sapiens
atttgttatggttaca

SEQ ID NO: 5852599 - DNA, 15 bp, Homo sapiens
atttgttattcttaa

SEQ ID NO: 5852600 - DNA, 16 bp, Homo sapiens
atttgttattttgcaa

SEQ ID NO: 5852601 - DNA, 16 bp, Homo sapiens
atttgttcacatgcat

SEQ ID NO: 5852602 - DNA, 18 bp, Homo sapiens
atttgttcactgaaggtg

SEQ ID NO: 5852603 - DNA, 12 bp, Homo sapiens
atttgttcctgg

SEQ ID NO: 5852604 - DNA, 13 bp, Homo sapiens
atttgttcctgga

SEQ ID NO: 5852605 - DNA, 19 bp, Homo sapiens
atttgttctatagcttttc

SEQ ID NO: 5852606 - DNA, 15 bp, Homo sapiens
atttgttgaaatctt

SEQ ID NO: 5852607 - DNA, 16 bp, Homo sapiens
atttgttgaaatcttt

SEQ ID NO: 5852608 - DNA, 14 bp, Homo sapiens
atttgttgaaatta

SEQ ID NO: 5852609 - DNA, 19 bp, Homo sapiens
atttgttgacaaaattttc

SEQ ID NO: 5852610 - DNA, 20 bp, Homo sapiens
atttgttgacagcaaaatgt

SEQ ID NO: 5852611 - DNA, 13 bp, Homo sapiens
atttgttgctgct

SEQ ID NO: 5852612 - DNA, 20 bp, Homo sapiens
atttgttgctgctgctgctc

SEQ ID NO: 5852613 - DNA, 20 bp, Homo sapiens
atttgttggagagttaaatg

SEQ ID NO: 5852614 - DNA, 20 bp, Homo sapiens
atttgttggggctttacata

SEQ ID NO: 5852615 - DNA, 13 bp, Homo sapiens
atttgttgtactt

SEQ ID NO: 5852616 - DNA, 17 bp, Homo sapiens
atttgttgtcatgtgta

SEQ ID NO: 5852617 - DNA, 12 bp, Homo sapiens
atttgtttaaaa

SEQ ID NO: 5852618 - DNA, 14 bp, Homo sapiens
atttgtttaaaagg

SEQ ID NO: 5852619 - DNA, 14 bp, Homo sapiens
atttgtttaaaatt

SEQ ID NO: 5852620 - DNA, 18 bp, Homo sapiens
atttgtttaaacaatctt

SEQ ID NO: 5852621 - DNA, 16 bp, Homo sapiens
atttgtttaaagaata

SEQ ID NO: 5852622 - DNA, 21 bp, Homo sapiens
atttgtttaaggttaattatg

SEQ ID NO: 5852623 - DNA, 21 bp, Homo sapiens
atttgtttaataccctgtaca

SEQ ID NO: 5852624 - DNA, 14 bp, Homo sapiens
atttgtttaatcta

SEQ ID NO: 5852625 - DNA, 15 bp, Homo sapiens
atttgtttagaagta

SEQ ID NO: 5852626 - DNA, 22 bp, Homo sapiens
atttgtttatccttaagaattc

SEQ ID NO: 5852627 - DNA, 17 bp, Homo sapiens
atttgtttatgtaattt

SEQ ID NO: 5852628 - DNA, 18 bp, Homo sapiens
atttgtttatgtaatttc

SEQ ID NO: 5852629 - DNA, 17 bp, Homo sapiens
atttgtttcattaaaga

SEQ ID NO: 5852630 - DNA, 13 bp, Homo sapiens
atttgtttccccc

SEQ ID NO: 5852631 - DNA, 13 bp, Homo sapiens
atttgtttctact

SEQ ID NO: 5852632 - DNA, 18 bp, Homo sapiens
atttgtttcttctgtctt

SEQ ID NO: 5852633 - DNA, 14 bp, Homo sapiens
atttgtttgaactg

SEQ ID NO: 5852634 - DNA, 22 bp, Homo sapiens
atttgtttgaactgataaagat

SEQ ID NO: 5852635 - DNA, 23 bp, Homo sapiens
atttgtttgaactgataaagatg

SEQ ID NO: 5852636 - DNA, 11 bp, Homo sapiens
atttgtttgac

SEQ ID NO: 5852637 - DNA, 14 bp, Homo sapiens
atttgtttgcaata

SEQ ID NO: 5852638 - DNA, 19 bp, Homo sapiens
atttgtttgctgaaattta

SEQ ID NO: 5852639 - DNA, 14 bp, Homo sapiens
atttgtttgtattt

SEQ ID NO: 5852640 - DNA, 22 bp, Homo sapiens
atttgtttgtctgtttttactc

SEQ ID NO: 5852641 - DNA, 20 bp, Homo sapiens
atttgtttgtgacaactaaa

SEQ ID NO: 5852642 - DNA, 15 bp, Homo sapiens
atttgtttgtgcttc

SEQ ID NO: 5852643 - DNA, 16 bp, Homo sapiens
atttgtttgtgcttca

SEQ ID NO: 5852644 - DNA, 17 bp, Homo sapiens
atttgtttgtgtttatg

SEQ ID NO: 5852645 - DNA, 21 bp, Homo sapiens
atttgtttgtgtttatgaaac

SEQ ID NO: 5852646 - DNA, 16 bp, Homo sapiens
atttgttttaggtaga

SEQ ID NO: 5852647 - DNA, 14 bp, Homo sapiens
atttgttttatgct

SEQ ID NO: 5852648 - DNA, 17 bp, Homo sapiens
atttgttttcaacaatt

SEQ ID NO: 5852649 - DNA, 15 bp, Homo sapiens
atttgttttcatggt

SEQ ID NO: 5852650 - DNA, 22 bp, Homo sapiens
atttgttttcatttgtataagt

SEQ ID NO: 5852651 - DNA, 19 bp, Homo sapiens
atttgttttcccgccaagc

SEQ ID NO: 5852652 - DNA, 21 bp, Homo sapiens
atttgttttgacggatgattg

SEQ ID NO: 5852653 - DNA, 18 bp, Homo sapiens
atttgttttgcattcctt

SEQ ID NO: 5852654 - DNA, 23 bp, Homo sapiens
atttgttttgccaatttgcacat

SEQ ID NO: 5852655 - DNA, 16 bp, Homo sapiens
attttatatcttgtag

SEQ ID NO: 5852656 - DNA, 13 bp, Homo sapiens
attttatatgatg

SEQ ID NO: 5852657 - DNA, 16 bp, Homo sapiens
attttatatgcttact

SEQ ID NO: 5852658 - DNA, 23 bp, Homo sapiens
attttatatgcttactgatatat

SEQ ID NO: 5852659 - DNA, 14 bp, Homo sapiens
attttatatgtaaa

SEQ ID NO: 5852660 - DNA, 18 bp, Homo sapiens
attttatattaaaataag

SEQ ID NO: 5852661 - DNA, 15 bp, Homo sapiens
attttatattacact

SEQ ID NO: 5852662 - DNA, 22 bp, Homo sapiens
attttatatttttgtacatatt

SEQ ID NO: 5852663 - DNA, 19 bp, Homo sapiens
attttatcaaggaagtctt

SEQ ID NO: 5852664 - DNA, 15 bp, Homo sapiens
attttatcagacaat

SEQ ID NO: 5852665 - DNA, 20 bp, Homo sapiens
attttatcatcctttcagtt

SEQ ID NO: 5852666 - DNA, 13 bp, Homo sapiens
attttatcattaa

SEQ ID NO: 5852667 - DNA, 19 bp, Homo sapiens
attttatcattaaaaatta

SEQ ID NO: 5852668 - DNA, 18 bp, Homo sapiens
attttatcctgtattctt

SEQ ID NO: 5852669 - DNA, 22 bp, Homo sapiens
attttatcctgtattcttgttt

SEQ ID NO: 5852670 - DNA, 14 bp, Homo sapiens
attttatctcttct

SEQ ID NO: 5852671 - DNA, 22 bp, Homo sapiens
attttatctggaacaacttgta

SEQ ID NO: 5852672 - DNA, 21 bp, Homo sapiens
attttatctgtgttgtctctc

SEQ ID NO: 5852673 - DNA, 22 bp, Homo sapiens
attttatctgtttcctgacatt

SEQ ID NO: 5852674 - DNA, 21 bp, Homo sapiens
attttatctttgattctcctt

SEQ ID NO: 5852675 - DNA, 22 bp, Homo sapiens
attttatctttgattctccttc

SEQ ID NO: 5852676 - DNA, 24 bp, Homo sapiens
attttatgaacattgtactgttgc

SEQ ID NO: 5852677 - DNA, 19 bp, Homo sapiens
attttatgaatatcattga

SEQ ID NO: 5852678 - DNA, 16 bp, Homo sapiens
attttatgaatgtctt

SEQ ID NO: 5852679 - DNA, 15 bp, Homo sapiens
attttatgacagtat

SEQ ID NO: 5852680 - DNA, 15 bp, Homo sapiens
attttatgagaaatg

SEQ ID NO: 5852681 - DNA, 15 bp, Homo sapiens
attttatgagacagg

SEQ ID NO: 5852682 - DNA, 12 bp, Homo sapiens
attttatgagtt

SEQ ID NO: 5852683 - DNA, 17 bp, Homo sapiens
attttatgatcagtgtt

SEQ ID NO: 5852684 - DNA, 12 bp, Homo sapiens
attttatgatct

SEQ ID NO: 5852685 - DNA, 16 bp, Homo sapiens
attttatgatttaaaa

SEQ ID NO: 5852686 - DNA, 13 bp, Homo sapiens
attttatgcacag

SEQ ID NO: 5852687 - DNA, 19 bp, Homo sapiens
attttatgctttaaacatt

SEQ ID NO: 5852688 - DNA, 19 bp, Homo sapiens
attttatggtactaatgaa

SEQ ID NO: 5852689 - DNA, 22 bp, Homo sapiens
attttatggtgcctagtattga

SEQ ID NO: 5852690 - DNA, 16 bp, Homo sapiens
attttatgtatgttta

SEQ ID NO: 5852691 - DNA, 18 bp, Homo sapiens
attttatgtcatagaaat

SEQ ID NO: 5852692 - DNA, 15 bp, Homo sapiens
attttatgtctatat

SEQ ID NO: 5852693 - DNA, 13 bp, Homo sapiens
attttatgtcttt

SEQ ID NO: 5852694 - DNA, 18 bp, Homo sapiens
attttatgtgactatgaa

SEQ ID NO: 5852695 - DNA, 12 bp, Homo sapiens
attttatgttat

SEQ ID NO: 5852696 - DNA, 18 bp, Homo sapiens
attttatgttatatataa

SEQ ID NO: 5852697 - DNA, 20 bp, Homo sapiens
attttatgttgacatttgtt

SEQ ID NO: 5852698 - DNA, 21 bp, Homo sapiens
attttatgttgcatagaataa

SEQ ID NO: 5852699 - DNA, 14 bp, Homo sapiens
attttatgtttaaa

SEQ ID NO: 5852700 - DNA, 21 bp, Homo sapiens
attttatgtttaaaatggcat

SEQ ID NO: 5852701 - DNA, 15 bp, Homo sapiens
attttatgtttagat

SEQ ID NO: 5852702 - DNA, 20 bp, Homo sapiens
attttattaaaaataaaata

SEQ ID NO: 5852703 - DNA, 22 bp, Homo sapiens
attttattaaacaattttgtta

SEQ ID NO: 5852704 - DNA, 16 bp, Homo sapiens
attttattaaacacag

SEQ ID NO: 5852705 - DNA, 17 bp, Homo sapiens
attttattaaagcaaca

SEQ ID NO: 5852706 - DNA, 18 bp, Homo sapiens
attttattaaagcaacat

SEQ ID NO: 5852707 - DNA, 19 bp, Homo sapiens
attttattaaagcaacatt

SEQ ID NO: 5852708 - DNA, 12 bp, Homo sapiens
attttattaaat

SEQ ID NO: 5852709 - DNA, 13 bp, Homo sapiens
attttattaataa

SEQ ID NO: 5852710 - DNA, 20 bp, Homo sapiens
attttattacatctttcaca

SEQ ID NO: 5852711 - DNA, 11 bp, Homo sapiens
attttattatg

SEQ ID NO: 5852712 - DNA, 18 bp, Homo sapiens
attttattatgaaacttg

SEQ ID NO: 5852713 - DNA, 22 bp, Homo sapiens
attttattatgaagaaggtgaa

SEQ ID NO: 5852714 - DNA, 22 bp, Homo sapiens
attttattatgagctacaacaa

SEQ ID NO: 5852715 - DNA, 13 bp, Homo sapiens
attttattatgca

SEQ ID NO: 5852716 - DNA, 16 bp, Homo sapiens
attttattatgtaaat

SEQ ID NO: 5852717 - DNA, 14 bp, Homo sapiens
attttattattcag

SEQ ID NO: 5852718 - DNA, 14 bp, Homo sapiens
attttattatttct

SEQ ID NO: 5852719 - DNA, 16 bp, Homo sapiens
attttattcaaggtaa

SEQ ID NO: 5852720 - DNA, 23 bp, Homo sapiens
attttattcaaggtaaaattcta

SEQ ID NO: 5852721 - DNA, 13 bp, Homo sapiens
attttattcagta

SEQ ID NO: 5852722 - DNA, 19 bp, Homo sapiens
attttattcagtagtttga

SEQ ID NO: 5852723 - DNA, 14 bp, Homo sapiens
attttattcttgat

SEQ ID NO: 5852724 - DNA, 15 bp, Homo sapiens
attttattcttgatc

SEQ ID NO: 5852725 - DNA, 20 bp, Homo sapiens
attttattctttaagttcac

SEQ ID NO: 5852726 - DNA, 17 bp, Homo sapiens
attttattgaaagctca

SEQ ID NO: 5852727 - DNA, 13 bp, Homo sapiens
attttattgaaat

SEQ ID NO: 5852728 - DNA, 15 bp, Homo sapiens
attttattgaatata

SEQ ID NO: 5852729 - DNA, 16 bp, Homo sapiens
attttattgaatataa

SEQ ID NO: 5852730 - DNA, 15 bp, Homo sapiens
attttattgggaggg

SEQ ID NO: 5852731 - DNA, 16 bp, Homo sapiens
attttattgtaacaga

SEQ ID NO: 5852732 - DNA, 18 bp, Homo sapiens
attttattgtaacagaca

SEQ ID NO: 5852733 - DNA, 22 bp, Homo sapiens
attttattgtaacagacattgt

SEQ ID NO: 5852734 - DNA, 15 bp, Homo sapiens
attttattgtataaa

SEQ ID NO: 5852735 - DNA, 15 bp, Homo sapiens
attttattgtatttt

SEQ ID NO: 5852736 - DNA, 22 bp, Homo sapiens
attttattgtgtaattgattta

SEQ ID NO: 5852737 - DNA, 11 bp, Homo sapiens
attttatttat

SEQ ID NO: 5852738 - DNA, 13 bp, Homo sapiens
attttatttatat

SEQ ID NO: 5852739 - DNA, 18 bp, Homo sapiens
attttatttatctttgta

SEQ ID NO: 5852740 - DNA, 22 bp, Homo sapiens
attttatttattagctgtaaat

SEQ ID NO: 5852741 - DNA, 16 bp, Homo sapiens
attttatttcaatgta

SEQ ID NO: 5852742 - DNA, 16 bp, Homo sapiens
attttatttccatcat

SEQ ID NO: 5852743 - DNA, 15 bp, Homo sapiens
attttatttgaaaaa

SEQ ID NO: 5852744 - DNA, 17 bp, Homo sapiens
attttatttgaaaaaag

SEQ ID NO: 5852745 - DNA, 12 bp, Homo sapiens
attttatttgct

SEQ ID NO: 5852746 - DNA, 16 bp, Homo sapiens
attttatttgcttatt

SEQ ID NO: 5852747 - DNA, 22 bp, Homo sapiens
attttatttgttctttttctga

SEQ ID NO: 5852748 - DNA, 17 bp, Homo sapiens
attttatttgtttttca

SEQ ID NO: 5852749 - DNA, 15 bp, Homo sapiens
attttattttatagt

SEQ ID NO: 5852750 - DNA, 15 bp, Homo sapiens
attttattttattga

SEQ ID NO: 5852751 - DNA, 14 bp, Homo sapiens
attttattttctaa

SEQ ID NO: 5852752 - DNA, 21 bp, Homo sapiens
attttattttggcttcatttc

SEQ ID NO: 5852753 - DNA, 12 bp, Homo sapiens
attttattttgt

SEQ ID NO: 5852754 - DNA, 22 bp, Homo sapiens
attttattttgtgctcatttaa

SEQ ID NO: 5852755 - DNA, 23 bp, Homo sapiens
attttattttgtgctcatttaag

SEQ ID NO: 5852756 - DNA, 15 bp, Homo sapiens
attttatttttctgt

SEQ ID NO: 5852757 - DNA, 14 bp, Homo sapiens
attttatttttgca

SEQ ID NO: 5852758 - DNA, 15 bp, Homo sapiens
attttatttttgcaa

SEQ ID NO: 5852759 - DNA, 15 bp, Homo sapiens
attttattttttaaa

SEQ ID NO: 5852760 - DNA, 19 bp, Homo sapiens
attttattttttccctcct

SEQ ID NO: 5852761 - DNA, 16 bp, Homo sapiens
attttattttttgggc

SEQ ID NO: 5852762 - DNA, 16 bp, Homo sapiens
attttattttttgtga

SEQ ID NO: 5852763 - DNA, 20 bp, Homo sapiens
attttatttttttctctctg

SEQ ID NO: 5852764 - DNA, 21 bp, Homo sapiens
attttatttttttctgaatta

SEQ ID NO: 5852765 - DNA, 20 bp, Homo sapiens
attttattttttttcaaaat

SEQ ID NO: 5852766 - DNA, 12 bp, Homo sapiens
attttcaaaaaa

SEQ ID NO: 5852767 - DNA, 16 bp, Homo sapiens
attttcaaaaccaggt

SEQ ID NO: 5852768 - DNA, 15 bp, Homo sapiens
attttcaaaagaaaa

SEQ ID NO: 5852769 - DNA, 13 bp, Homo sapiens
attttcaaaagat

SEQ ID NO: 5852770 - DNA, 15 bp, Homo sapiens
attttcaaaagataa

SEQ ID NO: 5852771 - DNA, 19 bp, Homo sapiens
attttcaaaagataatatt

SEQ ID NO: 5852772 - DNA, 16 bp, Homo sapiens
attttcaaatatgtaa

SEQ ID NO: 5852773 - DNA, 19 bp, Homo sapiens
attttcaaatatgtaaact

SEQ ID NO: 5852774 - DNA, 14 bp, Homo sapiens
attttcaaatcctt

SEQ ID NO: 5852775 - DNA, 17 bp, Homo sapiens
attttcaaatctggtcc

SEQ ID NO: 5852776 - DNA, 18 bp, Homo sapiens
attttcaaattgtatcta

SEQ ID NO: 5852777 - DNA, 18 bp, Homo sapiens
attttcaacaacatcaga

SEQ ID NO: 5852778 - DNA, 16 bp, Homo sapiens
attttcaacaattaga

SEQ ID NO: 5852779 - DNA, 21 bp, Homo sapiens
attttcaacattgatttttga

SEQ ID NO: 5852780 - DNA, 17 bp, Homo sapiens
attttcaacatttcaaa

SEQ ID NO: 5852781 - DNA, 21 bp, Homo sapiens
attttcaaccataaaagaagt

SEQ ID NO: 5852782 - DNA, 13 bp, Homo sapiens
attttcaagaaac

SEQ ID NO: 5852783 - DNA, 20 bp, Homo sapiens
attttcaagactgaattcca

SEQ ID NO: 5852784 - DNA, 17 bp, Homo sapiens
attttcaagagaagaaa

SEQ ID NO: 5852785 - DNA, 20 bp, Homo sapiens
attttcaagagaagaaaaaa

SEQ ID NO: 5852786 - DNA, 15 bp, Homo sapiens
attttcaagatacat

SEQ ID NO: 5852787 - DNA, 21 bp, Homo sapiens
attttcaagcagcatcttctg

SEQ ID NO: 5852788 - DNA, 22 bp, Homo sapiens
attttcaagcatctcctgagga

SEQ ID NO: 5852789 - DNA, 15 bp, Homo sapiens
attttcaaggccttc

SEQ ID NO: 5852790 - DNA, 18 bp, Homo sapiens
attttcaaggccttcagt

SEQ ID NO: 5852791 - DNA, 11 bp, Homo sapiens
attttcaagtt

SEQ ID NO: 5852792 - DNA, 14 bp, Homo sapiens
attttcaagttttt

SEQ ID NO: 5852793 - DNA, 15 bp, Homo sapiens
attttcaataaagaa

SEQ ID NO: 5852794 - DNA, 16 bp, Homo sapiens
attttcaataaagaaa

SEQ ID NO: 5852795 - DNA, 20 bp, Homo sapiens
attttcaataaatttctgct

SEQ ID NO: 5852796 - DNA, 23 bp, Homo sapiens
attttcaataacaaaacgaaact

SEQ ID NO: 5852797 - DNA, 15 bp, Homo sapiens
attttcaatgaaaca

SEQ ID NO: 5852798 - DNA, 20 bp, Homo sapiens
attttcacaatgtcagtatt

SEQ ID NO: 5852799 - DNA, 20 bp, Homo sapiens
attttcacacaatacaataa

SEQ ID NO: 5852800 - DNA, 13 bp, Homo sapiens
attttcacagatg

SEQ ID NO: 5852801 - DNA, 15 bp, Homo sapiens
attttcacagcacta

SEQ ID NO: 5852802 - DNA, 20 bp, Homo sapiens
attttcacagctttgaggaa

SEQ ID NO: 5852803 - DNA, 15 bp, Homo sapiens
attttcacataaaat

SEQ ID NO: 5852804 - DNA, 16 bp, Homo sapiens
attttcacatgaacat

SEQ ID NO: 5852805 - DNA, 17 bp, Homo sapiens
attttcacatgaacata

SEQ ID NO: 5852806 - DNA, 18 bp, Homo sapiens
attttcaccctctgtacc

SEQ ID NO: 5852807 - DNA, 14 bp, Homo sapiens
attttcaccgagca

SEQ ID NO: 5852808 - DNA, 15 bp, Homo sapiens
attttcactgctgct

SEQ ID NO: 5852809 - DNA, 18 bp, Homo sapiens
attttcactgctgctcct

SEQ ID NO: 5852810 - DNA, 13 bp, Homo sapiens
attttcactgtag

SEQ ID NO: 5852811 - DNA, 13 bp, Homo sapiens
attttcactgtgt

SEQ ID NO: 5852812 - DNA, 12 bp, Homo sapiens
attttcacttgc

SEQ ID NO: 5852813 - DNA, 14 bp, Homo sapiens
attttcacttttaa

SEQ ID NO: 5852814 - DNA, 22 bp, Homo sapiens
attttcacttttggcaatgact

SEQ ID NO: 5852815 - DNA, 17 bp, Homo sapiens
attttcagaaagcatct

SEQ ID NO: 5852816 - DNA, 16 bp, Homo sapiens
attttcagaagttaac

SEQ ID NO: 5852817 - DNA, 20 bp, Homo sapiens
attttcagaagttaacatca

SEQ ID NO: 5852818 - DNA, 23 bp, Homo sapiens
attttcagagccggcccgcctct

SEQ ID NO: 5852819 - DNA, 17 bp, Homo sapiens
attttcagatagcacat

SEQ ID NO: 5852820 - DNA, 15 bp, Homo sapiens
attttcagatgaaat

SEQ ID NO: 5852821 - DNA, 13 bp, Homo sapiens
attttcagatttg

SEQ ID NO: 5852822 - DNA, 17 bp, Homo sapiens
attttcagatttgcaca

SEQ ID NO: 5852823 - DNA, 17 bp, Homo sapiens
attttcagcaaactctt

SEQ ID NO: 5852824 - DNA, 20 bp, Homo sapiens
attttcagcattaagctgtt

SEQ ID NO: 5852825 - DNA, 21 bp, Homo sapiens
attttcagctcaattgttaat

SEQ ID NO: 5852826 - DNA, 20 bp, Homo sapiens
attttcaggaaatctacttc

SEQ ID NO: 5852827 - DNA, 20 bp, Homo sapiens
attttcaggtagtactaaga

SEQ ID NO: 5852828 - DNA, 11 bp, Homo sapiens
attttcagtat

SEQ ID NO: 5852829 - DNA, 19 bp, Homo sapiens
attttcagtataatttaac

SEQ ID NO: 5852830 - DNA, 23 bp, Homo sapiens
attttcagtatactgtgtgggat

SEQ ID NO: 5852831 - DNA, 12 bp, Homo sapiens
attttcagtatt

SEQ ID NO: 5852832 - DNA, 20 bp, Homo sapiens
attttcagtcaaaactttaa

SEQ ID NO: 5852833 - DNA, 21 bp, Homo sapiens
attttcagtcccctctctctg

SEQ ID NO: 5852834 - DNA, 17 bp, Homo sapiens
attttggagagatagga

SEQ ID NO: 5852835 - DNA, 18 bp, Homo sapiens
attttggagagataggaa

SEQ ID NO: 5852836 - DNA, 20 bp, Homo sapiens
attttggagagataggaagg

SEQ ID NO: 5852837 - DNA, 18 bp, Homo sapiens
attttggagattataata

SEQ ID NO: 5852838 - DNA, 16 bp, Homo sapiens
attttggagtaacgtt

SEQ ID NO: 5852839 - DNA, 18 bp, Homo sapiens
attttggataatattcat

SEQ ID NO: 5852840 - DNA, 21 bp, Homo sapiens
attttggatctatcacctgtc

SEQ ID NO: 5852841 - DNA, 22 bp, Homo sapiens
attttggatctatcacctgtca

SEQ ID NO: 5852842 - DNA, 15 bp, Homo sapiens
attttggattaattt

SEQ ID NO: 5852843 - DNA, 20 bp, Homo sapiens
attttggattaatttgtgaa

SEQ ID NO: 5852844 - DNA, 17 bp, Homo sapiens
attttggattttgcaag

SEQ ID NO: 5852845 - DNA, 16 bp, Homo sapiens
attttggccactttgc

SEQ ID NO: 5852846 - DNA, 21 bp, Homo sapiens
attttggccatgaaagcatgg

SEQ ID NO: 5852847 - DNA, 21 bp, Homo sapiens
attttggcgaatctcaaaatt

SEQ ID NO: 5852848 - DNA, 22 bp, Homo sapiens
attttggcgaatctcaaaatta

SEQ ID NO: 5852849 - DNA, 20 bp, Homo sapiens
attttggcgctattacaaat

SEQ ID NO: 5852850 - DNA, 20 bp, Homo sapiens
attttggcttcatttcaatc

SEQ ID NO: 5852851 - DNA, 22 bp, Homo sapiens
attttgggaaattcttgcactg

SEQ ID NO: 5852852 - DNA, 15 bp, Homo sapiens
attttgggaatcttt

SEQ ID NO: 5852853 - DNA, 16 bp, Homo sapiens
attttgggaatctttt

SEQ ID NO: 5852854 - DNA, 18 bp, Homo sapiens
attttggggattttcaaa

SEQ ID NO: 5852855 - DNA, 22 bp, Homo sapiens
attttggggggttttgtgtgtt

SEQ ID NO: 5852856 - DNA, 23 bp, Homo sapiens
attttggggtacccactgctctg

SEQ ID NO: 5852857 - DNA, 11 bp, Homo sapiens
attttggggtc

SEQ ID NO: 5852858 - DNA, 13 bp, Homo sapiens
attttggggtctc

SEQ ID NO: 5852859 - DNA, 23 bp, Homo sapiens
attttggggtgtgacacttttga

SEQ ID NO: 5852860 - DNA, 14 bp, Homo sapiens
attttgggtactgg

SEQ ID NO: 5852861 - DNA, 22 bp, Homo sapiens
attttggtaaaatacttcttga

SEQ ID NO: 5852862 - DNA, 21 bp, Homo sapiens
attttggtaagagacagaatg

SEQ ID NO: 5852863 - DNA, 15 bp, Homo sapiens
attttggtactttta

SEQ ID NO: 5852864 - DNA, 20 bp, Homo sapiens
attttggtccaaattcttta

SEQ ID NO: 5852865 - DNA, 15 bp, Homo sapiens
attttggtctgtttt

SEQ ID NO: 5852866 - DNA, 14 bp, Homo sapiens
attttggtgagaaa

SEQ ID NO: 5852867 - DNA, 17 bp, Homo sapiens
attttggtgatgtaaaa

SEQ ID NO: 5852868 - DNA, 18 bp, Homo sapiens
attttggtgatgtaaaac

SEQ ID NO: 5852869 - DNA, 23 bp, Homo sapiens
attttggtgcaatattcttgact

SEQ ID NO: 5852870 - DNA, 18 bp, Homo sapiens
attttggtgcacaaatac

SEQ ID NO: 5852871 - DNA, 22 bp, Homo sapiens
attttggtgtgcatctgtgtgt

SEQ ID NO: 5852872 - DNA, 17 bp, Homo sapiens
attttggttgtattctt

SEQ ID NO: 5852873 - DNA, 13 bp, Homo sapiens
attttggttttct

SEQ ID NO: 5852874 - DNA, 16 bp, Homo sapiens
attttggttttgttcc

SEQ ID NO: 5852875 - DNA, 23 bp, Homo sapiens
attttggttttgttcccctcctc

SEQ ID NO: 5852876 - DNA, 10 bp, Homo sapiens
attttgtaaa

SEQ ID NO: 5852877 - DNA, 11 bp, Homo sapiens
attttgtaaaa

SEQ ID NO: 5852878 - DNA, 12 bp, Homo sapiens
attttgtaaaat

SEQ ID NO: 5852879 - DNA, 19 bp, Homo sapiens
attttgtaaaatgtattat

SEQ ID NO: 5852880 - DNA, 20 bp, Homo sapiens
attttgtaaactcaaaatat

SEQ ID NO: 5852881 - DNA, 14 bp, Homo sapiens
attttgtaaatctg

SEQ ID NO: 5852882 - DNA, 15 bp, Homo sapiens
attttgtaaatctgt

SEQ ID NO: 5852883 - DNA, 17 bp, Homo sapiens
attttgtaaatctgtac

SEQ ID NO: 5852884 - DNA, 20 bp, Homo sapiens
attttgtaaatgttcttggt

SEQ ID NO: 5852885 - DNA, 19 bp, Homo sapiens
attttgtaactgtaaagat

SEQ ID NO: 5852886 - DNA, 22 bp, Homo sapiens
attttgtaactgtaaagatgaa

SEQ ID NO: 5852887 - DNA, 17 bp, Homo sapiens
attttgtaagaaggcaa

SEQ ID NO: 5852888 - DNA, 21 bp, Homo sapiens
attttgtaagaaggcaatatt

SEQ ID NO: 5852889 - DNA, 22 bp, Homo sapiens
attttgtaagagtgagctctgg

SEQ ID NO: 5852890 - DNA, 22 bp, Homo sapiens
attttgtaagctataacatatt

SEQ ID NO: 5852891 - DNA, 12 bp, Homo sapiens
attttgtaagtt

SEQ ID NO: 5852892 - DNA, 11 bp, Homo sapiens
attttgtaata

SEQ ID NO: 5852893 - DNA, 14 bp, Homo sapiens
attttgtaataaac

SEQ ID NO: 5852894 - DNA, 15 bp, Homo sapiens
attttgtaataaact

SEQ ID NO: 5852895 - DNA, 20 bp, Homo sapiens
attttgtaataaactctcta

SEQ ID NO: 5852896 - DNA, 15 bp, Homo sapiens
attttgtaatattct

SEQ ID NO: 5852897 - DNA, 20 bp, Homo sapiens
attttgtaatattctgtttt

SEQ ID NO: 5852898 - DNA, 12 bp, Homo sapiens
attttgtaatga

SEQ ID NO: 5852899 - DNA, 20 bp, Homo sapiens
attttgtaatgtatcaaata

SEQ ID NO: 5852900 - DNA, 21 bp, Homo sapiens
attttgtaattattgtgattt

SEQ ID NO: 5852901 - DNA, 22 bp, Homo sapiens
attttgtaattattgtgatttc

SEQ ID NO: 5852902 - DNA, 16 bp, Homo sapiens
attttgtaattttctt

SEQ ID NO: 5852903 - DNA, 20 bp, Homo sapiens
attttgtacaaagatatgct

SEQ ID NO: 5852904 - DNA, 21 bp, Homo sapiens
attttgtacaaagatatgcta

SEQ ID NO: 5852905 - DNA, 20 bp, Homo sapiens
attttgtacaaatttgttat

SEQ ID NO: 5852906 - DNA, 13 bp, Homo sapiens
attttgtacagaa

SEQ ID NO: 5852907 - DNA, 14 bp, Homo sapiens
attttgtacagaat

SEQ ID NO: 5852908 - DNA, 16 bp, Homo sapiens
attttgtacagaattt

SEQ ID NO: 5852909 - DNA, 18 bp, Homo sapiens
attttgtacagaattttt

SEQ ID NO: 5852910 - DNA, 16 bp, Homo sapiens
attttgtacatactgt

SEQ ID NO: 5852911 - DNA, 13 bp, Homo sapiens
attttgtacattg

SEQ ID NO: 5852912 - DNA, 20 bp, Homo sapiens
attttgtacatttttgatca

SEQ ID NO: 5852913 - DNA, 15 bp, Homo sapiens
attttgtaggttatt

SEQ ID NO: 5852914 - DNA, 19 bp, Homo sapiens
attttgtaggttattttat

SEQ ID NO: 5852915 - DNA, 20 bp, Homo sapiens
attttgtaggttattttata

SEQ ID NO: 5852916 - DNA, 18 bp, Homo sapiens
attttgtatccatttaaa

SEQ ID NO: 5852917 - DNA, 21 bp, Homo sapiens
attttgtatctttttgaaaat

SEQ ID NO: 5852918 - DNA, 16 bp, Homo sapiens
attttgtatgaaatat

SEQ ID NO: 5852919 - DNA, 15 bp, Homo sapiens
attttgtatgctgaa

SEQ ID NO: 5852920 - DNA, 22 bp, Homo sapiens
attttgtatgtaaataccaaga

SEQ ID NO: 5852921 - DNA, 13 bp, Homo sapiens
attttgtatgtat

SEQ ID NO: 5852922 - DNA, 19 bp, Homo sapiens
attttgtattattgctgtt

SEQ ID NO: 5852923 - DNA, 22 bp, Homo sapiens
attttgtattattgctgttgct

SEQ ID NO: 5852924 - DNA, 23 bp, Homo sapiens
attttgtattattgctgttgctt

SEQ ID NO: 5852925 - DNA, 15 bp, Homo sapiens
attttgtattgtggt

SEQ ID NO: 5852926 - DNA, 17 bp, Homo sapiens
attttgtattgtggtat

SEQ ID NO: 5852927 - DNA, 17 bp, Homo sapiens
attttgtattttaagat

SEQ ID NO: 5852928 - DNA, 22 bp, Homo sapiens
attttgtattttcaactttata

SEQ ID NO: 5852929 - DNA, 16 bp, Homo sapiens
attttgtattttccaa

SEQ ID NO: 5852930 - DNA, 20 bp, Homo sapiens
attttgtcaaatcatggcca

SEQ ID NO: 5852931 - DNA, 20 bp, Homo sapiens
attttgtcacagctcttgtt

SEQ ID NO: 5852932 - DNA, 21 bp, Homo sapiens
attttgtcacagctcttgttt

SEQ ID NO: 5852933 - DNA, 19 bp, Homo sapiens
attttgtcacattatttat

SEQ ID NO: 5852934 - DNA, 17 bp, Homo sapiens
attttgtcactgctgta

SEQ ID NO: 5852935 - DNA, 19 bp, Homo sapiens
attttgtcataaaatgcta

SEQ ID NO: 5852936 - DNA, 21 bp, Homo sapiens
attttgtcataaaatgctatt

SEQ ID NO: 5852937 - DNA, 23 bp, Homo sapiens
attttgtcatataagattcatat

SEQ ID NO: 5852938 - DNA, 19 bp, Homo sapiens
attttgtcatatcaaataa

SEQ ID NO: 5852939 - DNA, 19 bp, Homo sapiens
attttgtccaagttcacag

SEQ ID NO: 5852940 - DNA, 15 bp, Homo sapiens
attttgtccatttta

SEQ ID NO: 5852941 - DNA, 19 bp, Homo sapiens
attttgtccattttaaaaa

SEQ ID NO: 5852942 - DNA, 21 bp, Homo sapiens
attttgtcctttcatgtaact

SEQ ID NO: 5852943 - DNA, 21 bp, Homo sapiens
attttgtctaaaatgcctcag

SEQ ID NO: 5852944 - DNA, 12 bp, Homo sapiens
attttgtctacc

SEQ ID NO: 5852945 - DNA, 22 bp, Homo sapiens
attttgtctaggagatgctttc

SEQ ID NO: 5852946 - DNA, 22 bp, Homo sapiens
attttgtctcctacctgctgct

SEQ ID NO: 5852947 - DNA, 12 bp, Homo sapiens
attttgtctcta

SEQ ID NO: 5852948 - DNA, 19 bp, Homo sapiens
attttgtctctgagatttt

SEQ ID NO: 5852949 - DNA, 17 bp, Homo sapiens
attttgtctggctgtgg

SEQ ID NO: 5852950 - DNA, 22 bp, Homo sapiens
attttgtcttaagtgtttctca

SEQ ID NO: 5852951 - DNA, 16 bp, Homo sapiens
attttgtcttattctt

SEQ ID NO: 5852952 - DNA, 18 bp, Homo sapiens
attttgtcttattcttaa

SEQ ID NO: 5852953 - DNA, 12 bp, Homo sapiens
attttgtcttta

SEQ ID NO: 5852954 - DNA, 12 bp, Homo sapiens
attttgtgaaat

SEQ ID NO: 5852955 - DNA, 15 bp, Homo sapiens
attttgtgaaatttc

SEQ ID NO: 5852956 - DNA, 13 bp, Homo sapiens
attttgtgaatgg

SEQ ID NO: 5852957 - DNA, 17 bp, Homo sapiens
attttgtgacattcctt

SEQ ID NO: 5852958 - DNA, 22 bp, Homo sapiens
attttgtgacccctttcactta

SEQ ID NO: 5852959 - DNA, 19 bp, Homo sapiens
attttgtgatatggagccc

SEQ ID NO: 5852960 - DNA, 22 bp, Homo sapiens
attttgtgatgaatctacattt

SEQ ID NO: 5852961 - DNA, 23 bp, Homo sapiens
attttgtgatgaatctacatttg

SEQ ID NO: 5852962 - DNA, 20 bp, Homo sapiens
attttgtgatgatgctgtga

SEQ ID NO: 5852963 - DNA, 23 bp, Homo sapiens
attttgtgcaaaaaggactggaa

SEQ ID NO: 5852964 - DNA, 13 bp, Homo sapiens
attttgtgcattc

SEQ ID NO: 5852965 - DNA, 14 bp, Homo sapiens
attttgtgcattct

SEQ ID NO: 5852966 - DNA, 20 bp, Homo sapiens
attttgtgctcatttaagtt

SEQ ID NO: 5852967 - DNA, 23 bp, Homo sapiens
attttgtggaggcagtgtcattt

SEQ ID NO: 5852968 - DNA, 13 bp, Homo sapiens
attttgtggatat

SEQ ID NO: 5852969 - DNA, 20 bp, Homo sapiens
attttgtggctgatttcaaa

SEQ ID NO: 5852970 - DNA, 14 bp, Homo sapiens
attttgtggctgtt

SEQ ID NO: 5852971 - DNA, 20 bp, Homo sapiens
attttgtggctttctttctt

SEQ ID NO: 5852972 - DNA, 20 bp, Homo sapiens
attttgtggcttttaaagaa

SEQ ID NO: 5852973 - DNA, 20 bp, Homo sapiens
attttgtgggaatttaagag

SEQ ID NO: 5852974 - DNA, 14 bp, Homo sapiens
attttgtgggctta

SEQ ID NO: 5852975 - DNA, 21 bp, Homo sapiens
attttgtgggcttaattgaaa

SEQ ID NO: 5852976 - DNA, 12 bp, Homo sapiens
attttgtgtaaa

SEQ ID NO: 5852977 - DNA, 14 bp, Homo sapiens
attttgtgtaaaaa

SEQ ID NO: 5852978 - DNA, 20 bp, Homo sapiens
attttgtgtaaaaaaaccac

SEQ ID NO: 5852979 - DNA, 20 bp, Homo sapiens
attttgtgtaaatttctcaa

SEQ ID NO: 5852980 - DNA, 20 bp, Homo sapiens
attttgtgtaagaaatacag

SEQ ID NO: 5852981 - DNA, 23 bp, Homo sapiens
attttgtgtacaagttgttattg

SEQ ID NO: 5852982 - DNA, 16 bp, Homo sapiens
attttgtgtacagtaa

SEQ ID NO: 5852983 - DNA, 20 bp, Homo sapiens
attttgtgtataatgtgctt

SEQ ID NO: 5852984 - DNA, 21 bp, Homo sapiens
attttgtgtcctccaggagct

SEQ ID NO: 5852985 - DNA, 17 bp, Homo sapiens
attttgtgtgaccaact

SEQ ID NO: 5852986 - DNA, 20 bp, Homo sapiens
attttgtgtgaccaactgtg

SEQ ID NO: 5852987 - DNA, 13 bp, Homo sapiens
attttgtgtgaga

SEQ ID NO: 5852988 - DNA, 14 bp, Homo sapiens
attttgtgttgtac

SEQ ID NO: 5852989 - DNA, 20 bp, Homo sapiens
attttgtgttgtacaattaa

SEQ ID NO: 5852990 - DNA, 21 bp, Homo sapiens
attttgtgttgtacaattaag

SEQ ID NO: 5852991 - DNA, 14 bp, Homo sapiens
attttgttaaagct

SEQ ID NO: 5852992 - DNA, 21 bp, Homo sapiens
attttgttaaagctggaacat

SEQ ID NO: 5852993 - DNA, 14 bp, Homo sapiens
attttgttaagaag

SEQ ID NO: 5852994 - DNA, 18 bp, Homo sapiens
attttgttaagaatttca

SEQ ID NO: 5852995 - DNA, 16 bp, Homo sapiens
attttgttatagaata

SEQ ID NO: 5852996 - DNA, 22 bp, Homo sapiens
attttgttatagaatacttttt

SEQ ID NO: 5852997 - DNA, 21 bp, Homo sapiens
attttgttcaagtttgctgca

SEQ ID NO: 5852998 - DNA, 12 bp, Homo sapiens
attttgttcata

SEQ ID NO: 5852999 - DNA, 15 bp, Homo sapiens
attttgttcatacat

SEQ ID NO: 5853000 - DNA, 18 bp, Homo sapiens
attttgttctctgggaga

SEQ ID NO: 5853001 - DNA, 12 bp, Homo sapiens
attttgttctgt

SEQ ID NO: 5853002 - DNA, 16 bp, Homo sapiens
attttgttcttacaca

SEQ ID NO: 5853003 - DNA, 18 bp, Homo sapiens
attttgttcttacacata

SEQ ID NO: 5853004 - DNA, 19 bp, Homo sapiens
attttgttgcttttgtgaa

SEQ ID NO: 5853005 - DNA, 14 bp, Homo sapiens
attttgttgtaaaa

SEQ ID NO: 5853006 - DNA, 19 bp, Homo sapiens
attttgttgtaaaaagaaa

SEQ ID NO: 5853007 - DNA, 21 bp, Homo sapiens
attttgttgtgattttgtaca

SEQ ID NO: 5853008 - DNA, 17 bp, Homo sapiens
attttgttgttcctcta

SEQ ID NO: 5853009 - DNA, 14 bp, Homo sapiens
attttgtttataag

SEQ ID NO: 5853010 - DNA, 21 bp, Homo sapiens
attttttaaaaaaaactattt

SEQ ID NO: 5853011 - DNA, 17 bp, Homo sapiens
attttttaaaaaagctt

SEQ ID NO: 5853012 - DNA, 17 bp, Homo sapiens
attttttaaaaaatttg

SEQ ID NO: 5853013 - DNA, 23 bp, Homo sapiens
attttttaaaaatctatattttg

SEQ ID NO: 5853014 - DNA, 16 bp, Homo sapiens
attttttaaaaattgg

SEQ ID NO: 5853015 - DNA, 16 bp, Homo sapiens
attttttaaaacacta

SEQ ID NO: 5853016 - DNA, 18 bp, Homo sapiens
attttttaaaacactaaa

SEQ ID NO: 5853017 - DNA, 17 bp, Homo sapiens
attttttaaaagaaatt

SEQ ID NO: 5853018 - DNA, 20 bp, Homo sapiens
attttttaaaagccttccag

SEQ ID NO: 5853019 - DNA, 17 bp, Homo sapiens
attttttaaaataattt

SEQ ID NO: 5853020 - DNA, 14 bp, Homo sapiens
attttttaaacaat

SEQ ID NO: 5853021 - DNA, 13 bp, Homo sapiens
attttttaaacca

SEQ ID NO: 5853022 - DNA, 18 bp, Homo sapiens
attttttaaagaatccaa

SEQ ID NO: 5853023 - DNA, 23 bp, Homo sapiens
attttttaaagaatccaagacaa

SEQ ID NO: 5853024 - DNA, 12 bp, Homo sapiens
attttttaaagc

SEQ ID NO: 5853025 - DNA, 20 bp, Homo sapiens
attttttaaagttactttgt

SEQ ID NO: 5853026 - DNA, 18 bp, Homo sapiens
attttttaaataaaatag

SEQ ID NO: 5853027 - DNA, 19 bp, Homo sapiens
attttttaaatatttgaga

SEQ ID NO: 5853028 - DNA, 18 bp, Homo sapiens
attttttaaatgaaaatg

SEQ ID NO: 5853029 - DNA, 19 bp, Homo sapiens
attttttaaatgaaagaag

SEQ ID NO: 5853030 - DNA, 17 bp, Homo sapiens
attttttaaatgtaaaa

SEQ ID NO: 5853031 - DNA, 18 bp, Homo sapiens
attttttaaatgtaaaat

SEQ ID NO: 5853032 - DNA, 13 bp, Homo sapiens
attttttaaattc

SEQ ID NO: 5853033 - DNA, 18 bp, Homo sapiens
attttttaaattgaattc

SEQ ID NO: 5853034 - DNA, 23 bp, Homo sapiens
attttttaacctcctaagtatca

SEQ ID NO: 5853035 - DNA, 13 bp, Homo sapiens
attttttaagaaa

SEQ ID NO: 5853036 - DNA, 23 bp, Homo sapiens
attttttaagggatgttgcaaag

SEQ ID NO: 5853037 - DNA, 11 bp, Homo sapiens
attttttaagt

SEQ ID NO: 5853038 - DNA, 19 bp, Homo sapiens
attttttaagtatttatat

SEQ ID NO: 5853039 - DNA, 12 bp, Homo sapiens
attttttaataa

SEQ ID NO: 5853040 - DNA, 14 bp, Homo sapiens
attttttaataaaa

SEQ ID NO: 5853041 - DNA, 14 bp, Homo sapiens
attttttaataatt

SEQ ID NO: 5853042 - DNA, 15 bp, Homo sapiens
attttttaatcattt

SEQ ID NO: 5853043 - DNA, 20 bp, Homo sapiens
attttttaatgtattccctt

SEQ ID NO: 5853044 - DNA, 13 bp, Homo sapiens
attttttaatgtg

SEQ ID NO: 5853045 - DNA, 23 bp, Homo sapiens
attttttaatttctatgaaggat

SEQ ID NO: 5853046 - DNA, 19 bp, Homo sapiens
attttttacagctgcctgc

SEQ ID NO: 5853047 - DNA, 23 bp, Homo sapiens
attttttacttttcacactgtct

SEQ ID NO: 5853048 - DNA, 14 bp, Homo sapiens
attttttagtctgt

SEQ ID NO: 5853049 - DNA, 14 bp, Homo sapiens
attttttatactgt

SEQ ID NO: 5853050 - DNA, 20 bp, Homo sapiens
attttttatatatatgcata

SEQ ID NO: 5853051 - DNA, 22 bp, Homo sapiens
attttttatgggcattgacaaa

SEQ ID NO: 5853052 - DNA, 17 bp, Homo sapiens
attttttatgtacaacc

SEQ ID NO: 5853053 - DNA, 15 bp, Homo sapiens
attttttattatttt

SEQ ID NO: 5853054 - DNA, 13 bp, Homo sapiens
attttttattgct

SEQ ID NO: 5853055 - DNA, 14 bp, Homo sapiens
attttttattgcta

SEQ ID NO: 5853056 - DNA, 12 bp, Homo sapiens
attttttattgt

SEQ ID NO: 5853057 - DNA, 16 bp, Homo sapiens
attttttcagaccgaa

SEQ ID NO: 5853058 - DNA, 21 bp, Homo sapiens
attttttcatttcaaaatgct

SEQ ID NO: 5853059 - DNA, 14 bp, Homo sapiens
attttttccaaaat

SEQ ID NO: 5853060 - DNA, 23 bp, Homo sapiens
attttttccaaaatctcccattt

SEQ ID NO: 5853061 - DNA, 20 bp, Homo sapiens
attttttccctcctgacaaa

SEQ ID NO: 5853062 - DNA, 12 bp, Homo sapiens
attttttccctt

SEQ ID NO: 5853063 - DNA, 11 bp, Homo sapiens
attttttcctg

SEQ ID NO: 5853064 - DNA, 12 bp, Homo sapiens
attttttcctta

SEQ ID NO: 5853065 - DNA, 13 bp, Homo sapiens
attttttccttaa

SEQ ID NO: 5853066 - DNA, 21 bp, Homo sapiens
attttttccttcaaagtttaa

SEQ ID NO: 5853067 - DNA, 23 bp, Homo sapiens
attttttccttcaaagtttaata

SEQ ID NO: 5853068 - DNA, 15 bp, Homo sapiens
attttttctacacag

SEQ ID NO: 5853069 - DNA, 15 bp, Homo sapiens
attttttctatgaac

SEQ ID NO: 5853070 - DNA, 20 bp, Homo sapiens
attttttctctaggaaatat

SEQ ID NO: 5853071 - DNA, 13 bp, Homo sapiens
attttttctcttt

SEQ ID NO: 5853072 - DNA, 16 bp, Homo sapiens
attttttctgaggaat

SEQ ID NO: 5853073 - DNA, 14 bp, Homo sapiens
attttttcttgcat

SEQ ID NO: 5853074 - DNA, 13 bp, Homo sapiens
attttttgaaatg

SEQ ID NO: 5853075 - DNA, 15 bp, Homo sapiens
attttttgaaatgct

SEQ ID NO: 5853076 - DNA, 16 bp, Homo sapiens
attttttgaaatgctg

SEQ ID NO: 5853077 - DNA, 11 bp, Homo sapiens
attttttgaat

SEQ ID NO: 5853078 - DNA, 13 bp, Homo sapiens
attttttgacact

SEQ ID NO: 5853079 - DNA, 18 bp, Homo sapiens
attttttgacacttccat

SEQ ID NO: 5853080 - DNA, 13 bp, Homo sapiens
attttttgattaa

SEQ ID NO: 5853081 - DNA, 17 bp, Homo sapiens
attttttgcagtctttt

SEQ ID NO: 5853082 - DNA, 22 bp, Homo sapiens
attttttgctataatcattagt

SEQ ID NO: 5853083 - DNA, 16 bp, Homo sapiens
attttttggcacttgc

SEQ ID NO: 5853084 - DNA, 18 bp, Homo sapiens
attttttgggccattacc

SEQ ID NO: 5853085 - DNA, 18 bp, Homo sapiens
attttttgggcggcccct

SEQ ID NO: 5853086 - DNA, 18 bp, Homo sapiens
attttttggtattggcca

SEQ ID NO: 5853087 - DNA, 19 bp, Homo sapiens
attttttggtggtgaaatt

SEQ ID NO: 5853088 - DNA, 17 bp, Homo sapiens
attttttggtgtgccct

SEQ ID NO: 5853089 - DNA, 13 bp, Homo sapiens
attttttgtaact

SEQ ID NO: 5853090 - DNA, 16 bp, Homo sapiens
attttttgtaactctt

SEQ ID NO: 5853091 - DNA, 15 bp, Homo sapiens
attttttgtataatt

SEQ ID NO: 5853092 - DNA, 16 bp, Homo sapiens
attttttgtataattg

SEQ ID NO: 5853093 - DNA, 14 bp, Homo sapiens
attttttgtgaatg

SEQ ID NO: 5853094 - DNA, 15 bp, Homo sapiens
attttttgttgaata

SEQ ID NO: 5853095 - DNA, 14 bp, Homo sapiens
attttttgttgaca

SEQ ID NO: 5853096 - DNA, 17 bp, Homo sapiens
attttttgttgacatta

SEQ ID NO: 5853097 - DNA, 16 bp, Homo sapiens
attttttgtttgttta

SEQ ID NO: 5853098 - DNA, 22 bp, Homo sapiens
atttttttaaaatcactaacat

SEQ ID NO: 5853099 - DNA, 14 bp, Homo sapiens
atttttttaaacaa

SEQ ID NO: 5853100 - DNA, 15 bp, Homo sapiens
atttttttaaacata

SEQ ID NO: 5853101 - DNA, 14 bp, Homo sapiens
atttttttaaagta

SEQ ID NO: 5853102 - DNA, 15 bp, Homo sapiens
atttttttaaccaaa

SEQ ID NO: 5853103 - DNA, 21 bp, Homo sapiens
atttttttaaccaaaggtgaa

SEQ ID NO: 5853104 - DNA, 15 bp, Homo sapiens
atttttttaactgtg

SEQ ID NO: 5853105 - DNA, 13 bp, Homo sapiens
atttttttaagca

SEQ ID NO: 5853106 - DNA, 14 bp, Homo sapiens
atttttttaagcaa

SEQ ID NO: 5853107 - DNA, 18 bp, Homo sapiens
atttttttaagctatcag

SEQ ID NO: 5853108 - DNA, 13 bp, Homo sapiens
atttttttaagtc

SEQ ID NO: 5853109 - DNA, 18 bp, Homo sapiens
atttttttaatagtgctt

SEQ ID NO: 5853110 - DNA, 22 bp, Homo sapiens
atttttttagtaaattaagagc

SEQ ID NO: 5853111 - DNA, 14 bp, Homo sapiens
atttttttagtttg

SEQ ID NO: 5853112 - DNA, 16 bp, Homo sapiens
atttttttagtttgtt

SEQ ID NO: 5853113 - DNA, 23 bp, Homo sapiens
atttttttatataagttaaagag

SEQ ID NO: 5853114 - DNA, 16 bp, Homo sapiens
atttttttatgctctt

SEQ ID NO: 5853115 - DNA, 13 bp, Homo sapiens
atttttttattct

SEQ ID NO: 5853116 - DNA, 23 bp, Homo sapiens
atttttttcaaagactcaaattt

SEQ ID NO: 5853117 - DNA, 14 bp, Homo sapiens
atttttttcacctc

SEQ ID NO: 5853118 - DNA, 20 bp, Homo sapiens
atttttttccaagtgtataa

SEQ ID NO: 5853119 - DNA, 22 bp, Homo sapiens
atttttttccaagtgtataatg

SEQ ID NO: 5853120 - DNA, 13 bp, Homo sapiens
atttttttccaga

SEQ ID NO: 5853121 - DNA, 14 bp, Homo sapiens
atttttttcccatg

SEQ ID NO: 5853122 - DNA, 20 bp, Homo sapiens
atttttttcctaagacattt

SEQ ID NO: 5853123 - DNA, 21 bp, Homo sapiens
atttttttcctaagacatttt

SEQ ID NO: 5853124 - DNA, 12 bp, Homo sapiens
atttttttcctt

SEQ ID NO: 5853125 - DNA, 15 bp, Homo sapiens
atttttttccttaca

SEQ ID NO: 5853126 - DNA, 16 bp, Homo sapiens
atttttttccttgcaa

SEQ ID NO: 5853127 - DNA, 16 bp, Homo sapiens
atttttttcctttgca

SEQ ID NO: 5853128 - DNA, 13 bp, Homo sapiens
atttttttctaat

SEQ ID NO: 5853129 - DNA, 20 bp, Homo sapiens
atttttttctacataattgt

SEQ ID NO: 5853130 - DNA, 13 bp, Homo sapiens
atttttttctacc

SEQ ID NO: 5853131 - DNA, 15 bp, Homo sapiens
atttttttctagcta

SEQ ID NO: 5853132 - DNA, 21 bp, Homo sapiens
atttttttctagctataacaa

SEQ ID NO: 5853133 - DNA, 16 bp, Homo sapiens
atttttttctgaaatt

SEQ ID NO: 5853134 - DNA, 17 bp, Homo sapiens
atttttttctgaaattt

SEQ ID NO: 5853135 - DNA, 21 bp, Homo sapiens
atttttttctgattgtaacgt

SEQ ID NO: 5853136 - DNA, 15 bp, Homo sapiens
atttttttctgcaca

SEQ ID NO: 5853137 - DNA, 17 bp, Homo sapiens
atttttttctgcacagc

SEQ ID NO: 5853138 - DNA, 18 bp, Homo sapiens
atttttttctgcacagct

SEQ ID NO: 5853139 - DNA, 15 bp, Homo sapiens
atttttttctttact

SEQ ID NO: 5853140 - DNA, 23 bp, Homo sapiens
atttttttgaactcttctcatta

SEQ ID NO: 5853141 - DNA, 14 bp, Homo sapiens
atttttttgatggc

SEQ ID NO: 5853142 - DNA, 14 bp, Homo sapiens
atttttttgcaagt

SEQ ID NO: 5853143 - DNA, 22 bp, Homo sapiens
atttttttgcatgcatgcaaat

SEQ ID NO: 5853144 - DNA, 22 bp, Homo sapiens
atttttttggtacctatttgac

SEQ ID NO: 5853145 - DNA, 14 bp, Homo sapiens
atttttttgtaata

SEQ ID NO: 5853146 - DNA, 14 bp, Homo sapiens
atttttttgtatga

SEQ ID NO: 5853147 - DNA, 17 bp, Homo sapiens
atttttttgtcattaaa

SEQ ID NO: 5853148 - DNA, 22 bp, Homo sapiens
atttttttgtcattaaaattgt

SEQ ID NO: 5853149 - DNA, 16 bp, Homo sapiens
atttttttgtctttca

SEQ ID NO: 5853150 - DNA, 15 bp, Homo sapiens
atttttttgtgtatg

SEQ ID NO: 5853151 - DNA, 15 bp, Homo sapiens
atttttttgttccaa

SEQ ID NO: 5853152 - DNA, 19 bp, Homo sapiens
attttttttaaagtttggt

SEQ ID NO: 5853153 - DNA, 15 bp, Homo sapiens
attttttttaactgc

SEQ ID NO: 5853154 - DNA, 16 bp, Homo sapiens
attttttttaatgctt

SEQ ID NO: 5853155 - DNA, 20 bp, Homo sapiens
attttttttaattgtatttt

SEQ ID NO: 5853156 - DNA, 16 bp, Homo sapiens
attttttttagaacaa

SEQ ID NO: 5853157 - DNA, 13 bp, Homo sapiens
attttttttcaaa

SEQ ID NO: 5853158 - DNA, 15 bp, Homo sapiens
attttttttcaaaat

SEQ ID NO: 5853159 - DNA, 18 bp, Homo sapiens
attttttttcaaacaagt

SEQ ID NO: 5853160 - DNA, 15 bp, Homo sapiens
attttttttcatgtt

SEQ ID NO: 5853161 - DNA, 14 bp, Homo sapiens
attttttttctgaa

SEQ ID NO: 5853162 - DNA, 21 bp, Homo sapiens
attttttttctgaacaaaagc

SEQ ID NO: 5853163 - DNA, 15 bp, Homo sapiens
attttttttcttcca

SEQ ID NO: 5853164 - DNA, 22 bp, Homo sapiens
attttttttggttgtttgctgt

SEQ ID NO: 5853165 - DNA, 23 bp, Homo sapiens
atttttttttaaagaagaaaaaa

SEQ ID NO: 5853166 - DNA, 19 bp, Homo sapiens
atttttttttaagctctga

SEQ ID NO: 5853167 - DNA, 21 bp, Homo sapiens
atttttttttaattttgatat

SEQ ID NO: 5853168 - DNA, 16 bp, Homo sapiens
atttttttttcaatca

SEQ ID NO: 5853169 - DNA, 14 bp, Homo sapiens
atttttttttcata

SEQ ID NO: 5853170 - DNA, 13 bp, Homo sapiens
atttttttttcct

SEQ ID NO: 5853171 - DNA, 19 bp, Homo sapiens
atttttttttcctggaatt

SEQ ID NO: 5853172 - DNA, 16 bp, Homo sapiens
atttttttttccttca

SEQ ID NO: 5853173 - DNA, 18 bp, Homo sapiens
atttttttttccttcagt

SEQ ID NO: 5853174 - DNA, 14 bp, Homo sapiens
atttttttttctct

SEQ ID NO: 5853175 - DNA, 16 bp, Homo sapiens
attttttttttaaatc

SEQ ID NO: 5853176 - DNA, 23 bp, Homo sapiens
attttttttttaaatgattccaa

SEQ ID NO: 5853177 - DNA, 16 bp, Homo sapiens
attttttttttaagtg

SEQ ID NO: 5853178 - DNA, 17 bp, Homo sapiens
attttttttttaatctc

SEQ ID NO: 5853179 - DNA, 17 bp, Homo sapiens
attttttttttcaggtt

SEQ ID NO: 5853180 - DNA, 17 bp, Homo sapiens
attttttttttcattgg

SEQ ID NO: 5853181 - DNA, 17 bp, Homo sapiens
attttttttttcctctt

SEQ ID NO: 5853182 - DNA, 17 bp, Homo sapiens
attttttttttcttttt

SEQ ID NO: 5853183 - DNA, 18 bp, Homo sapiens
attttttttttttaggaa

SEQ ID NO: 5853184 - DNA, 19 bp, Homo sapiens
attttttttttttctctca

SEQ ID NO: 5853185 - DNA, 21 bp, Homo sapiens
attttttttttttgaaaaaag

SEQ ID NO: 5853186 - DNA, 20 bp, Homo sapiens
caaaaaaaaaaaaaaagact

SEQ ID NO: 5853187 - DNA, 21 bp, Homo sapiens
caaaaaaaaaaaaaaagactg

SEQ ID NO: 5853188 - DNA, 22 bp, Homo sapiens
caaaaaaaaaaaaaaagactgt

SEQ ID NO: 5853189 - DNA, 23 bp, Homo sapiens
caaaaaaaaaaaaaaagactgtc

SEQ ID NO: 5853190 - DNA, 12 bp, Homo sapiens
caaaagaactta

SEQ ID NO: 5853191 - DNA, 14 bp, Homo sapiens
caaaagaagaaata

SEQ ID NO: 5853192 - DNA, 22 bp, Homo sapiens
caaaagaagaaataaataatct

SEQ ID NO: 5853193 - DNA, 13 bp, Homo sapiens
caaaagaagacat

SEQ ID NO: 5853194 - DNA, 14 bp, Homo sapiens
caaaagaagagttt

SEQ ID NO: 5853195 - DNA, 13 bp, Homo sapiens
caaaagaagcccc

SEQ ID NO: 5853196 - DNA, 21 bp, Homo sapiens
caaaagaagggtaagtgcttg

SEQ ID NO: 5853197 - DNA, 16 bp, Homo sapiens
caaaagaataagacaa

SEQ ID NO: 5853198 - DNA, 12 bp, Homo sapiens
caaaagaatcta

SEQ ID NO: 5853199 - DNA, 20 bp, Homo sapiens
caaaagaatggcagaaaagt

SEQ ID NO: 5853200 - DNA, 15 bp, Homo sapiens
caaaagacaaaaatc

SEQ ID NO: 5853201 - DNA, 15 bp, Homo sapiens
caaaagacaattctt

SEQ ID NO: 5853202 - DNA, 21 bp, Homo sapiens
caaaagacaattctttataca

SEQ ID NO: 5853203 - DNA, 23 bp, Homo sapiens
caaaagacaattctttatacaac

SEQ ID NO: 5853204 - DNA, 15 bp, Homo sapiens
caaaagacatgttgt

SEQ ID NO: 5853205 - DNA, 16 bp, Homo sapiens
caaaagacatgttgta

SEQ ID NO: 5853206 - DNA, 11 bp, Homo sapiens
caaaagacatt

SEQ ID NO: 5853207 - DNA, 12 bp, Homo sapiens
caaaagacatta

SEQ ID NO: 5853208 - DNA, 19 bp, Homo sapiens
caaaagaccaaatctcagt

SEQ ID NO: 5853209 - DNA, 18 bp, Homo sapiens
caaaagacttgagccatc

SEQ ID NO: 5853210 - DNA, 19 bp, Homo sapiens
caaaagacttgagccatcc

SEQ ID NO: 5853211 - DNA, 14 bp, Homo sapiens
caaaagagaaaaag

SEQ ID NO: 5853212 - DNA, 16 bp, Homo sapiens
caaaagagagaatgag

SEQ ID NO: 5853213 - DNA, 17 bp, Homo sapiens
caaaagagcatggatgc

SEQ ID NO: 5853214 - DNA, 15 bp, Homo sapiens
caaaagagccctggc

SEQ ID NO: 5853215 - DNA, 17 bp, Homo sapiens
caaaagagccctggctc

SEQ ID NO: 5853216 - DNA, 23 bp, Homo sapiens
caaaagagccctggctctgcccc

SEQ ID NO: 5853217 - DNA, 16 bp, Homo sapiens
caaaagaggtgtcatg

SEQ ID NO: 5853218 - DNA, 23 bp, Homo sapiens
caaaagaggtgtcatgctttggg

SEQ ID NO: 5853219 - DNA, 18 bp, Homo sapiens
caaaagagtgtaaaatat

SEQ ID NO: 5853220 - DNA, 15 bp, Homo sapiens
caaaagatctcctgt

SEQ ID NO: 5853221 - DNA, 18 bp, Homo sapiens
caaaagatgcttctcact

SEQ ID NO: 5853222 - DNA, 18 bp, Homo sapiens
caaaagattaatctttaa

SEQ ID NO: 5853223 - DNA, 21 bp, Homo sapiens
caaaagattcccttgaaattt

SEQ ID NO: 5853224 - DNA, 17 bp, Homo sapiens
caaaagatttattgtaa

SEQ ID NO: 5853225 - DNA, 21 bp, Homo sapiens
caaaagcaaaacatctctgca

SEQ ID NO: 5853226 - DNA, 23 bp, Homo sapiens
caaaagcaaaacatctctgcagt

SEQ ID NO: 5853227 - DNA, 15 bp, Homo sapiens
caaaagcaaaatttt

SEQ ID NO: 5853228 - DNA, 21 bp, Homo sapiens
caaaagcaaaccctacattaa

SEQ ID NO: 5853229 - DNA, 15 bp, Homo sapiens
caaaagcaaagatgc

SEQ ID NO: 5853230 - DNA, 19 bp, Homo sapiens
caaaagcaaagtgaagtga

SEQ ID NO: 5853231 - DNA, 16 bp, Homo sapiens
caaaagcaagactgtt

SEQ ID NO: 5853232 - DNA, 13 bp, Homo sapiens
caaaagcacaaac

SEQ ID NO: 5853233 - DNA, 18 bp, Homo sapiens
caaaagcacaaaccctgg

SEQ ID NO: 5853234 - DNA, 19 bp, Homo sapiens
caaaagcacaaaccctggg

SEQ ID NO: 5853235 - DNA, 18 bp, Homo sapiens
caaaagcacttacttttt

SEQ ID NO: 5853236 - DNA, 19 bp, Homo sapiens
caaaagcagcacaaggaat

SEQ ID NO: 5853237 - DNA, 11 bp, Homo sapiens
caaaagcaggc

SEQ ID NO: 5853238 - DNA, 19 bp, Homo sapiens
caaaagcaggcttgtgctt

SEQ ID NO: 5853239 - DNA, 15 bp, Homo sapiens
caaaagccaaaaggt

SEQ ID NO: 5853240 - DNA, 12 bp, Homo sapiens
caaaagccacat

SEQ ID NO: 5853241 - DNA, 23 bp, Homo sapiens
caaaagccatgtatttcagggac

SEQ ID NO: 5853242 - DNA, 19 bp, Homo sapiens
caaaagcccattcattcca

SEQ ID NO: 5853243 - DNA, 20 bp, Homo sapiens
caaaagcccgcttgctcgct

SEQ ID NO: 5853244 - DNA, 20 bp, Homo sapiens
caaaagccttgtgtatattt

SEQ ID NO: 5853245 - DNA, 20 bp, Homo sapiens
caaaagcgactcccagctcc

SEQ ID NO: 5853246 - DNA, 19 bp, Homo sapiens
caaaagctagacagatccc

SEQ ID NO: 5853247 - DNA, 16 bp, Homo sapiens
caaaagctcagggccc

SEQ ID NO: 5853248 - DNA, 23 bp, Homo sapiens
caaaagctcagggccctgtgcca

SEQ ID NO: 5853249 - DNA, 14 bp, Homo sapiens
caaaagctgaaatt

SEQ ID NO: 5853250 - DNA, 16 bp, Homo sapiens
caaaagctgaacacat

SEQ ID NO: 5853251 - DNA, 11 bp, Homo sapiens
caaaagctgct

SEQ ID NO: 5853252 - DNA, 17 bp, Homo sapiens
caaaagctgtaaattac

SEQ ID NO: 5853253 - DNA, 17 bp, Homo sapiens
caaaagctgtgtctctg

SEQ ID NO: 5853254 - DNA, 13 bp, Homo sapiens
caaaagcttccct

SEQ ID NO: 5853255 - DNA, 16 bp, Homo sapiens
caaaagcttgtgtatc

SEQ ID NO: 5853256 - DNA, 15 bp, Homo sapiens
caaaagctttttaaa

SEQ ID NO: 5853257 - DNA, 16 bp, Homo sapiens
caaaagctttttaaaa

SEQ ID NO: 5853258 - DNA, 11 bp, Homo sapiens
caaaaggaaaa

SEQ ID NO: 5853259 - DNA, 12 bp, Homo sapiens
caaaaggaaaaa

SEQ ID NO: 5853260 - DNA, 15 bp, Homo sapiens
caaaaggaaagaaac

SEQ ID NO: 5853261 - DNA, 17 bp, Homo sapiens
caaaaggaagactggag

SEQ ID NO: 5853262 - DNA, 22 bp, Homo sapiens
caaaaggagagactcccatgaa

SEQ ID NO: 5853263 - DNA, 21 bp, Homo sapiens
caaaaggagagattattaaat

SEQ ID NO: 5853264 - DNA, 20 bp, Homo sapiens
caaaaggatctttgtggcca

SEQ ID NO: 5853265 - DNA, 21 bp, Homo sapiens
caaaaggatgatttaacatta

SEQ ID NO: 5853266 - DNA, 14 bp, Homo sapiens
caaaaggcagctca

SEQ ID NO: 5853267 - DNA, 23 bp, Homo sapiens
caaaaggcagctcacccctgggc

SEQ ID NO: 5853268 - DNA, 20 bp, Homo sapiens
caaaaggcagtggggctggg

SEQ ID NO: 5853269 - DNA, 12 bp, Homo sapiens
caaaaggcccct

SEQ ID NO: 5853270 - DNA, 18 bp, Homo sapiens
caaaaggctgagaaggaa

SEQ ID NO: 5853271 - DNA, 23 bp, Homo sapiens
caaaaggctggatgtgctttcat

SEQ ID NO: 5853272 - DNA, 14 bp, Homo sapiens
caaaagggaaaaaa

SEQ ID NO: 5853273 - DNA, 18 bp, Homo sapiens
caaaagggaaaaaagcaa

SEQ ID NO: 5853274 - DNA, 19 bp, Homo sapiens
caaaagggaaaaaataaaa

SEQ ID NO: 5853275 - DNA, 23 bp, Homo sapiens
caaaagggagaacatggccaata

SEQ ID NO: 5853276 - DNA, 17 bp, Homo sapiens
caaaagggcagccaggg

SEQ ID NO: 5853277 - DNA, 16 bp, Homo sapiens
caaaagggcagctgtg

SEQ ID NO: 5853278 - DNA, 15 bp, Homo sapiens
caaaagggccaggtg

SEQ ID NO: 5853279 - DNA, 21 bp, Homo sapiens
caaaagggccaggtgcggcct

SEQ ID NO: 5853280 - DNA, 24 bp, Homo sapiens
caaaagggggattccctgatggaa

SEQ ID NO: 5853281 - DNA, 15 bp, Homo sapiens
caaaagggtgtatag

SEQ ID NO: 5853282 - DNA, 20 bp, Homo sapiens
caaaagggtgtctgagccct

SEQ ID NO: 5853283 - DNA, 15 bp, Homo sapiens
caaaaggtgcctgtg

SEQ ID NO: 5853284 - DNA, 18 bp, Homo sapiens
caaaaggttaagccatat

SEQ ID NO: 5853285 - DNA, 19 bp, Homo sapiens
caaaagtaatcacttaaag

SEQ ID NO: 5853286 - DNA, 14 bp, Homo sapiens
caaaagtagaactt

SEQ ID NO: 5853287 - DNA, 22 bp, Homo sapiens
caaaagtagaactttgtatagt

SEQ ID NO: 5853288 - DNA, 20 bp, Homo sapiens
caaaagtattttcctgtaaa

SEQ ID NO: 5853289 - DNA, 16 bp, Homo sapiens
caaaagtcacccaggg

SEQ ID NO: 5853290 - DNA, 22 bp, Homo sapiens
caaaagtcagcgtgacaatata

SEQ ID NO: 5853291 - DNA, 22 bp, Homo sapiens
caaaagtcattgctgacagagc

SEQ ID NO: 5853292 - DNA, 17 bp, Homo sapiens
caaaagtccttagaatg

SEQ ID NO: 5853293 - DNA, 18 bp, Homo sapiens
caaaagtccttagaatga

SEQ ID NO: 5853294 - DNA, 19 bp, Homo sapiens
caaaagtccttagaatgag

SEQ ID NO: 5853295 - DNA, 15 bp, Homo sapiens
caaaagtctattttt

SEQ ID NO: 5853296 - DNA, 19 bp, Homo sapiens
caaaagtctgtctttcctg

SEQ ID NO: 5853297 - DNA, 22 bp, Homo sapiens
caaaagtgaaccatctcagacc

SEQ ID NO: 5853298 - DNA, 22 bp, Homo sapiens
caaaagtgatcagcaatgaaga

SEQ ID NO: 5853299 - DNA, 21 bp, Homo sapiens
caaaagtgatctgtcccctct

SEQ ID NO: 5853300 - DNA, 22 bp, Homo sapiens
caaaagtgatctgtcccctctc

SEQ ID NO: 5853301 - DNA, 22 bp, Homo sapiens
caaaagtgcagtagtgtcactt

SEQ ID NO: 5853302 - DNA, 21 bp, Homo sapiens
caaaagtgcctcaagaggaat

SEQ ID NO: 5853303 - DNA, 14 bp, Homo sapiens
caaaagtgctttgg

SEQ ID NO: 5853304 - DNA, 11 bp, Homo sapiens
caaaagtggag

SEQ ID NO: 5853305 - DNA, 20 bp, Homo sapiens
caaaagtggattttcctgaa

SEQ ID NO: 5853306 - DNA, 13 bp, Homo sapiens
caaaagtggtcag

SEQ ID NO: 5853307 - DNA, 16 bp, Homo sapiens
caaaagttaatgaata

SEQ ID NO: 5853308 - DNA, 16 bp, Homo sapiens
caaaagttacatgttt

SEQ ID NO: 5853309 - DNA, 18 bp, Homo sapiens
caaaagttccaagagtct

SEQ ID NO: 5853310 - DNA, 21 bp, Homo sapiens
caaaagttccctgaaacacga

SEQ ID NO: 5853311 - DNA, 15 bp, Homo sapiens
caaaagttgatttct

SEQ ID NO: 5853312 - DNA, 21 bp, Homo sapiens
caaaagttgatttcttcttca

SEQ ID NO: 5853313 - DNA, 19 bp, Homo sapiens
caaaagttggactaaatgc

SEQ ID NO: 5853314 - DNA, 21 bp, Homo sapiens
caaaataaaaagcctcagtga

SEQ ID NO: 5853315 - DNA, 19 bp, Homo sapiens
caaaataaaaagtgacaca

SEQ ID NO: 5853316 - DNA, 17 bp, Homo sapiens
caaaataaaaatgaggt

SEQ ID NO: 5853317 - DNA, 13 bp, Homo sapiens
caaaataaaacaa

SEQ ID NO: 5853318 - DNA, 14 bp, Homo sapiens
caaaataaaacaaa

SEQ ID NO: 5853319 - DNA, 17 bp, Homo sapiens
caaaataaaacatagca

SEQ ID NO: 5853320 - DNA, 19 bp, Homo sapiens
caaaataaaacatagcaaa

SEQ ID NO: 5853321 - DNA, 20 bp, Homo sapiens
caaaataaaaccagaaagag

SEQ ID NO: 5853322 - DNA, 14 bp, Homo sapiens
caaaataaaacttt

SEQ ID NO: 5853323 - DNA, 18 bp, Homo sapiens
caaaataaaattatggtg

SEQ ID NO: 5853324 - DNA, 21 bp, Homo sapiens
caaaataaaattatggtgaaa

SEQ ID NO: 5853325 - DNA, 19 bp, Homo sapiens
caaaataaagattctcaca

SEQ ID NO: 5853326 - DNA, 20 bp, Homo sapiens
caaaataaagcaatgtgttt

SEQ ID NO: 5853327 - DNA, 18 bp, Homo sapiens
caaaataaagctgttctc

SEQ ID NO: 5853328 - DNA, 14 bp, Homo sapiens
caaaataaagcttt

SEQ ID NO: 5853329 - DNA, 18 bp, Homo sapiens
caaaataaagttacattg

SEQ ID NO: 5853330 - DNA, 22 bp, Homo sapiens
caaaataaatcagtgggatttg

SEQ ID NO: 5853331 - DNA, 22 bp, Homo sapiens
caaaataaatggactgaagtta

SEQ ID NO: 5853332 - DNA, 18 bp, Homo sapiens
caaaataaattgaaatat

SEQ ID NO: 5853333 - DNA, 22 bp, Homo sapiens
caaaataacaaaaaagagaaac

SEQ ID NO: 5853334 - DNA, 14 bp, Homo sapiens
caaaataagaaaag

SEQ ID NO: 5853335 - DNA, 15 bp, Homo sapiens
caaaataagaaaaga

SEQ ID NO: 5853336 - DNA, 18 bp, Homo sapiens
caaaataagaaaagatgt

SEQ ID NO: 5853337 - DNA, 22 bp, Homo sapiens
caaaataagaaaagatgtagat

SEQ ID NO: 5853338 - DNA, 21 bp, Homo sapiens
caaaataagccatgctgcttt

SEQ ID NO: 5853339 - DNA, 22 bp, Homo sapiens
caaaataaggaagagggctgag

SEQ ID NO: 5853340 - DNA, 19 bp, Homo sapiens
caaaataaggatgacttta

SEQ ID NO: 5853341 - DNA, 20 bp, Homo sapiens
caaaataaggggcacctggg

SEQ ID NO: 5853342 - DNA, 20 bp, Homo sapiens
caaaataagtttttctttaa

SEQ ID NO: 5853343 - DNA, 14 bp, Homo sapiens
caaaataataaaaa

SEQ ID NO: 5853344 - DNA, 17 bp, Homo sapiens
caaaataataaaaatca

SEQ ID NO: 5853345 - DNA, 19 bp, Homo sapiens
caaaataatctatattaaa

SEQ ID NO: 5853346 - DNA, 20 bp, Homo sapiens
caaaataatctatattaaat

SEQ ID NO: 5853347 - DNA, 14 bp, Homo sapiens
caaaataatgtctt

SEQ ID NO: 5853348 - DNA, 15 bp, Homo sapiens
caaaataatttaact

SEQ ID NO: 5853349 - DNA, 16 bp, Homo sapiens
caaaataatttaacta

SEQ ID NO: 5853350 - DNA, 20 bp, Homo sapiens
caaaataatttaactaattt

SEQ ID NO: 5853351 - DNA, 16 bp, Homo sapiens
caaaatacaatcctgt

SEQ ID NO: 5853352 - DNA, 20 bp, Homo sapiens
caaaatacaatgttatcaac

SEQ ID NO: 5853353 - DNA, 17 bp, Homo sapiens
caaaatacatgaagctt

SEQ ID NO: 5853354 - DNA, 22 bp, Homo sapiens
caaaatacatgaagcttcatgc

SEQ ID NO: 5853355 - DNA, 22 bp, Homo sapiens
caaaatacatgatgatttcaga

SEQ ID NO: 5853356 - DNA, 20 bp, Homo sapiens
caaaatacattctttttgct

SEQ ID NO: 5853357 - DNA, 15 bp, Homo sapiens
caaaatacatttgta

SEQ ID NO: 5853358 - DNA, 18 bp, Homo sapiens
caaaatacatttgtaagt

SEQ ID NO: 5853359 - DNA, 23 bp, Homo sapiens
caaaataccaaatgcctgttgta

SEQ ID NO: 5853360 - DNA, 15 bp, Homo sapiens
caaaataccacccta

SEQ ID NO: 5853361 - DNA, 23 bp, Homo sapiens
caaaataccagagccttcaagtg

SEQ ID NO: 5853362 - DNA, 15 bp, Homo sapiens
caaaatactccaaag

SEQ ID NO: 5853363 - DNA, 14 bp, Homo sapiens
caaaatacttttta

SEQ ID NO: 5853364 - DNA, 12 bp, Homo sapiens
caaaatagaaaa

SEQ ID NO: 5853365 - DNA, 17 bp, Homo sapiens
caaaatagaagaagagg

SEQ ID NO: 5853366 - DNA, 14 bp, Homo sapiens
caaacccagccact

SEQ ID NO: 5853367 - DNA, 17 bp, Homo sapiens
caaacccagcccctgcg

SEQ ID NO: 5853368 - DNA, 13 bp, Homo sapiens
caaacccagtgtt

SEQ ID NO: 5853369 - DNA, 24 bp, Homo sapiens
caaacccagtgttttaggagcatg

SEQ ID NO: 5853370 - DNA, 14 bp, Homo sapiens
caaacccatcagac

SEQ ID NO: 5853371 - DNA, 13 bp, Homo sapiens
caaacccatgaag

SEQ ID NO: 5853372 - DNA, 19 bp, Homo sapiens
caaacccatgaagctggcc

SEQ ID NO: 5853373 - DNA, 16 bp, Homo sapiens
caaacccatggctcta

SEQ ID NO: 5853374 - DNA, 12 bp, Homo sapiens
caaaccccagcc

SEQ ID NO: 5853375 - DNA, 14 bp, Homo sapiens
caaaccccagcccc

SEQ ID NO: 5853376 - DNA, 15 bp, Homo sapiens
caaaccccagcccca

SEQ ID NO: 5853377 - DNA, 22 bp, Homo sapiens
caaacccccaaaatccaaaact

SEQ ID NO: 5853378 - DNA, 19 bp, Homo sapiens
caaacccccattctgtcct

SEQ ID NO: 5853379 - DNA, 13 bp, Homo sapiens
caaaccccctgca

SEQ ID NO: 5853380 - DNA, 19 bp, Homo sapiens
caaaccccctgcagcccag

SEQ ID NO: 5853381 - DNA, 22 bp, Homo sapiens
caaaccccctgcagcccaggcc

SEQ ID NO: 5853382 - DNA, 17 bp, Homo sapiens
caaaccccctttgtgct

SEQ ID NO: 5853383 - DNA, 14 bp, Homo sapiens
caaaccccttccca

SEQ ID NO: 5853384 - DNA, 18 bp, Homo sapiens
caaaccctagccttgctt

SEQ ID NO: 5853385 - DNA, 20 bp, Homo sapiens
caaaccctagccttgcttgt

SEQ ID NO: 5853386 - DNA, 21 bp, Homo sapiens
caaaccctaggttcccggtcc

SEQ ID NO: 5853387 - DNA, 21 bp, Homo sapiens
caaaccctcccagaaacatct

SEQ ID NO: 5853388 - DNA, 14 bp, Homo sapiens
caaaccctcctggg

SEQ ID NO: 5853389 - DNA, 20 bp, Homo sapiens
caaaccctgcttctgctgcc

SEQ ID NO: 5853390 - DNA, 24 bp, Homo sapiens
caaaccctgcttctgctgccctga

SEQ ID NO: 5853391 - DNA, 15 bp, Homo sapiens
caaaccctggtgctt

SEQ ID NO: 5853392 - DNA, 18 bp, Homo sapiens
caaaccctgtcaaacatt

SEQ ID NO: 5853393 - DNA, 23 bp, Homo sapiens
caaaccctgtggggcctgatggt

SEQ ID NO: 5853394 - DNA, 23 bp, Homo sapiens
caaaccctgttcaggctggctcg

SEQ ID NO: 5853395 - DNA, 15 bp, Homo sapiens
caaacccttaactga

SEQ ID NO: 5853396 - DNA, 18 bp, Homo sapiens
caaacccttagcagccca

SEQ ID NO: 5853397 - DNA, 13 bp, Homo sapiens
caaacccttcaac

SEQ ID NO: 5853398 - DNA, 17 bp, Homo sapiens
caaacccttcaactcct

SEQ ID NO: 5853399 - DNA, 19 bp, Homo sapiens
caaacccttcaactcctgg

SEQ ID NO: 5853400 - DNA, 22 bp, Homo sapiens
caaacccttgctttcctgggcc

SEQ ID NO: 5853401 - DNA, 17 bp, Homo sapiens
caaaccctttaaatggg

SEQ ID NO: 5853402 - DNA, 17 bp, Homo sapiens
caaaccgccagcgaact

SEQ ID NO: 5853403 - DNA, 19 bp, Homo sapiens
caaacctaaaaatcaagtt

SEQ ID NO: 5853404 - DNA, 17 bp, Homo sapiens
caaacctaaatgcagtc

SEQ ID NO: 5853405 - DNA, 22 bp, Homo sapiens
caaacctaagtccttccacctg

SEQ ID NO: 5853406 - DNA, 13 bp, Homo sapiens
caaacctactgcc

SEQ ID NO: 5853407 - DNA, 19 bp, Homo sapiens
caaacctactgcccacatt

SEQ ID NO: 5853408 - DNA, 18 bp, Homo sapiens
caaacctatggaagttgt

SEQ ID NO: 5853409 - DNA, 17 bp, Homo sapiens
caaacctcactgagagg

SEQ ID NO: 5853410 - DNA, 19 bp, Homo sapiens
caaacctccagcctccctg

SEQ ID NO: 5853411 - DNA, 20 bp, Homo sapiens
caaacctccagcctccctgt

SEQ ID NO: 5853412 - DNA, 15 bp, Homo sapiens
caaacctcctcttct

SEQ ID NO: 5853413 - DNA, 20 bp, Homo sapiens
caaacctctccttcctcaga

SEQ ID NO: 5853414 - DNA, 11 bp, Homo sapiens
caaacctctgt

SEQ ID NO: 5853415 - DNA, 20 bp, Homo sapiens
caaacctgacccctgctcag

SEQ ID NO: 5853416 - DNA, 17 bp, Homo sapiens
caaacctgcaaggcaaa

SEQ ID NO: 5853417 - DNA, 20 bp, Homo sapiens
caaacctgcagtttttaatt

SEQ ID NO: 5853418 - DNA, 21 bp, Homo sapiens
caaacctgcagtttttaattt

SEQ ID NO: 5853419 - DNA, 13 bp, Homo sapiens
caaacctgcccca

SEQ ID NO: 5853420 - DNA, 13 bp, Homo sapiens
caaacctgcctgg

SEQ ID NO: 5853421 - DNA, 15 bp, Homo sapiens
caaacctgcctgggt

SEQ ID NO: 5853422 - DNA, 16 bp, Homo sapiens
caaacctgcctgggtt

SEQ ID NO: 5853423 - DNA, 12 bp, Homo sapiens
caaacctgctgg

SEQ ID NO: 5853424 - DNA, 12 bp, Homo sapiens
caaacctgggaa

SEQ ID NO: 5853425 - DNA, 14 bp, Homo sapiens
caaacctgtaattt

SEQ ID NO: 5853426 - DNA, 13 bp, Homo sapiens
caaacctgtgaag

SEQ ID NO: 5853427 - DNA, 15 bp, Homo sapiens
caaaccttactctga

SEQ ID NO: 5853428 - DNA, 19 bp, Homo sapiens
caaaccttactctgagctc

SEQ ID NO: 5853429 - DNA, 17 bp, Homo sapiens
caaaccttatctccaca

SEQ ID NO: 5853430 - DNA, 21 bp, Homo sapiens
caaaccttcttttcaatgcaa

SEQ ID NO: 5853431 - DNA, 16 bp, Homo sapiens
caaaccttgccttgaa

SEQ ID NO: 5853432 - DNA, 15 bp, Homo sapiens
caaacctttaactaa

SEQ ID NO: 5853433 - DNA, 12 bp, Homo sapiens
caaacctttccc

SEQ ID NO: 5853434 - DNA, 15 bp, Homo sapiens
caaacctttcctgta

SEQ ID NO: 5853435 - DNA, 19 bp, Homo sapiens
caaacctttctataatttt

SEQ ID NO: 5853436 - DNA, 14 bp, Homo sapiens
caaacgaaatggct

SEQ ID NO: 5853437 - DNA, 22 bp, Homo sapiens
caaacgactaacctatctatga

SEQ ID NO: 5853438 - DNA, 23 bp, Homo sapiens
caaacgactaacctatctatgaa

SEQ ID NO: 5853439 - DNA, 17 bp, Homo sapiens
caaacgagactttctcc

SEQ ID NO: 5853440 - DNA, 23 bp, Homo sapiens
caaacgatgtgcaatacattttt

SEQ ID NO: 5853441 - DNA, 22 bp, Homo sapiens
caaacgccctttcctcctcagg

SEQ ID NO: 5853442 - DNA, 13 bp, Homo sapiens
caaacgctaaaga

SEQ ID NO: 5853443 - DNA, 14 bp, Homo sapiens
caaacgctgcctgc

SEQ ID NO: 5853444 - DNA, 18 bp, Homo sapiens
caaacgctgcctgcccac

SEQ ID NO: 5853445 - DNA, 19 bp, Homo sapiens
caaacggaggaagcccaca

SEQ ID NO: 5853446 - DNA, 14 bp, Homo sapiens
caaacgggagcttt

SEQ ID NO: 5853447 - DNA, 18 bp, Homo sapiens
caaacgtaatttgttata

SEQ ID NO: 5853448 - DNA, 19 bp, Homo sapiens
caaacgtatgtaaatgtat

SEQ ID NO: 5853449 - DNA, 18 bp, Homo sapiens
caaacgtctattttgtat

SEQ ID NO: 5853450 - DNA, 14 bp, Homo sapiens
caaacgtgaaattc

SEQ ID NO: 5853451 - DNA, 21 bp, Homo sapiens
caaacgtgaaattctattgaa

SEQ ID NO: 5853452 - DNA, 13 bp, Homo sapiens
caaacgtttctca

SEQ ID NO: 5853453 - DNA, 20 bp, Homo sapiens
caaactaaaagacatttgtt

SEQ ID NO: 5853454 - DNA, 13 bp, Homo sapiens
caaactaaaccct

SEQ ID NO: 5853455 - DNA, 13 bp, Homo sapiens
caaactaaacttt

SEQ ID NO: 5853456 - DNA, 15 bp, Homo sapiens
caaactaaattcaaa

SEQ ID NO: 5853457 - DNA, 16 bp, Homo sapiens
caaactaacaggctta

SEQ ID NO: 5853458 - DNA, 19 bp, Homo sapiens
caaactaagcccccgctgt

SEQ ID NO: 5853459 - DNA, 20 bp, Homo sapiens
caaactaagcccccgctgta

SEQ ID NO: 5853460 - DNA, 18 bp, Homo sapiens
caaactaaggtgctaaat

SEQ ID NO: 5853461 - DNA, 17 bp, Homo sapiens
caaactacagaataatg

SEQ ID NO: 5853462 - DNA, 20 bp, Homo sapiens
caaactacagacctgctttt

SEQ ID NO: 5853463 - DNA, 20 bp, Homo sapiens
caaactacctatattccttg

SEQ ID NO: 5853464 - DNA, 23 bp, Homo sapiens
caaactactgaatgaagcagtat

SEQ ID NO: 5853465 - DNA, 15 bp, Homo sapiens
caaactactgtacat

SEQ ID NO: 5853466 - DNA, 11 bp, Homo sapiens
caaactacttc

SEQ ID NO: 5853467 - DNA, 13 bp, Homo sapiens
caaactacttcat

SEQ ID NO: 5853468 - DNA, 14 bp, Homo sapiens
caaactacttgatt

SEQ ID NO: 5853469 - DNA, 16 bp, Homo sapiens
caaactacttgatttt

SEQ ID NO: 5853470 - DNA, 14 bp, Homo sapiens
caaactactttctt

SEQ ID NO: 5853471 - DNA, 14 bp, Homo sapiens
caaactaggagatg

SEQ ID NO: 5853472 - DNA, 13 bp, Homo sapiens
caaactaggagga

SEQ ID NO: 5853473 - DNA, 14 bp, Homo sapiens
caaactaggaggaa

SEQ ID NO: 5853474 - DNA, 16 bp, Homo sapiens
caaactaggaggaaaa

SEQ ID NO: 5853475 - DNA, 18 bp, Homo sapiens
caaactaggaggaaaaga

SEQ ID NO: 5853476 - DNA, 20 bp, Homo sapiens
caaactaggaggaaaagaca

SEQ ID NO: 5853477 - DNA, 17 bp, Homo sapiens
caaactagtaactagtg

SEQ ID NO: 5853478 - DNA, 21 bp, Homo sapiens
caaactatattttaataattt

SEQ ID NO: 5853479 - DNA, 22 bp, Homo sapiens
caaactatggtgtgcttatgtt

SEQ ID NO: 5853480 - DNA, 15 bp, Homo sapiens
caaactatttcagaa

SEQ ID NO: 5853481 - DNA, 23 bp, Homo sapiens
caaactcaatgctttatttgtaa

SEQ ID NO: 5853482 - DNA, 17 bp, Homo sapiens
caaactcacctgcccct

SEQ ID NO: 5853483 - DNA, 14 bp, Homo sapiens
caaactcagatcct

SEQ ID NO: 5853484 - DNA, 18 bp, Homo sapiens
caaactcagatccttggt

SEQ ID NO: 5853485 - DNA, 14 bp, Homo sapiens
caaactcaggccca

SEQ ID NO: 5853486 - DNA, 23 bp, Homo sapiens
caaactcataacagtcttactgc

SEQ ID NO: 5853487 - DNA, 17 bp, Homo sapiens
caaactcatccattaat

SEQ ID NO: 5853488 - DNA, 18 bp, Homo sapiens
caaactcattgcagcaga

SEQ ID NO: 5853489 - DNA, 20 bp, Homo sapiens
caaactcattgcagcagata

SEQ ID NO: 5853490 - DNA, 11 bp, Homo sapiens
caaactccagg

SEQ ID NO: 5853491 - DNA, 14 bp, Homo sapiens
caaactccaggctg

SEQ ID NO: 5853492 - DNA, 18 bp, Homo sapiens
caaactccaggctggaag

SEQ ID NO: 5853493 - DNA, 17 bp, Homo sapiens
caaactcccaggacctg

SEQ ID NO: 5853494 - DNA, 19 bp, Homo sapiens
caaactccccttccctggg

SEQ ID NO: 5853495 - DNA, 20 bp, Homo sapiens
caaactccccttccctgggg

SEQ ID NO: 5853496 - DNA, 21 bp, Homo sapiens
caaactccccttccctgggga

SEQ ID NO: 5853497 - DNA, 11 bp, Homo sapiens
caaactcccta

SEQ ID NO: 5853498 - DNA, 15 bp, Homo sapiens
caaactcctatttca

SEQ ID NO: 5853499 - DNA, 16 bp, Homo sapiens
caaactcctatttcaa

SEQ ID NO: 5853500 - DNA, 18 bp, Homo sapiens
caaactcctgacctcagg

SEQ ID NO: 5853501 - DNA, 12 bp, Homo sapiens
caaactcctgcc

SEQ ID NO: 5853502 - DNA, 15 bp, Homo sapiens
caaactcctgcctgt

SEQ ID NO: 5853503 - DNA, 22 bp, Homo sapiens
caaactcctttactgcagcctg

SEQ ID NO: 5853504 - DNA, 22 bp, Homo sapiens
caaactcgcttaggtagaaact

SEQ ID NO: 5853505 - DNA, 20 bp, Homo sapiens
caaactctataaagaaactt

SEQ ID NO: 5853506 - DNA, 22 bp, Homo sapiens
caaactctatctgaaatcccaa

SEQ ID NO: 5853507 - DNA, 20 bp, Homo sapiens
caaactctcaaatcatgaag

SEQ ID NO: 5853508 - DNA, 16 bp, Homo sapiens
caaactctgccagcca

SEQ ID NO: 5853509 - DNA, 12 bp, Homo sapiens
caaactctgctg

SEQ ID NO: 5853510 - DNA, 13 bp, Homo sapiens
caaactctgctgt

SEQ ID NO: 5853511 - DNA, 13 bp, Homo sapiens
caaactctgtgtc

SEQ ID NO: 5853512 - DNA, 12 bp, Homo sapiens
caaactcttcag

SEQ ID NO: 5853513 - DNA, 14 bp, Homo sapiens
caaactctttggtc

SEQ ID NO: 5853514 - DNA, 16 bp, Homo sapiens
caaactgaaaagctga

SEQ ID NO: 5853515 - DNA, 23 bp, Homo sapiens
caaactgaaattagtgttttcat

SEQ ID NO: 5853516 - DNA, 19 bp, Homo sapiens
caaactgaaattcagagca

SEQ ID NO: 5853517 - DNA, 17 bp, Homo sapiens
caaactgaagcagcctc

SEQ ID NO: 5853518 - DNA, 23 bp, Homo sapiens
caaactgaagcagcctctcccca

SEQ ID NO: 5853519 - DNA, 14 bp, Homo sapiens
caaactgaagccag

SEQ ID NO: 5853520 - DNA, 22 bp, Homo sapiens
caaactgaatgaaacccccaca

SEQ ID NO: 5853521 - DNA, 14 bp, Homo sapiens
caaactgaatttgt

SEQ ID NO: 5853522 - DNA, 16 bp, Homo sapiens
caaactgaatttgttc

SEQ ID NO: 5853523 - DNA, 12 bp, Homo sapiens
caaactgacaat

SEQ ID NO: 5853524 - DNA, 17 bp, Homo sapiens
caaactgactcaacagt

SEQ ID NO: 5853525 - DNA, 16 bp, Homo sapiens
caaactgagactctta

SEQ ID NO: 5853526 - DNA, 14 bp, Homo sapiens
caaactgatctaaa

SEQ ID NO: 5853527 - DNA, 17 bp, Homo sapiens
caaactgatctaaaatg

SEQ ID NO: 5853528 - DNA, 14 bp, Homo sapiens
caaactgatgctga

SEQ ID NO: 5853529 - DNA, 20 bp, Homo sapiens
caaactgatgctgaggatga

SEQ ID NO: 5853530 - DNA, 19 bp, Homo sapiens
caaactgatggaccgggtg

SEQ ID NO: 5853531 - DNA, 13 bp, Homo sapiens
caaactgcaatag

SEQ ID NO: 5853532 - DNA, 22 bp, Homo sapiens
caaactgcacacacagctcctc

SEQ ID NO: 5853533 - DNA, 14 bp, Homo sapiens
caaactgcagctgt

SEQ ID NO: 5853534 - DNA, 13 bp, Homo sapiens
caaactgcatgcc

SEQ ID NO: 5853535 - DNA, 14 bp, Homo sapiens
caaactgcatgccc

SEQ ID NO: 5853536 - DNA, 18 bp, Homo sapiens
caaactgcatgcccagag

SEQ ID NO: 5853537 - DNA, 20 bp, Homo sapiens
caaactgcatgcccagagac

SEQ ID NO: 5853538 - DNA, 21 bp, Homo sapiens
caaactgcctgttaagtctga

SEQ ID NO: 5853539 - DNA, 22 bp, Homo sapiens
caaactgcctgttaagtctgag

SEQ ID NO: 5853540 - DNA, 19 bp, Homo sapiens
caaactgccttggcttcag

SEQ ID NO: 5853541 - DNA, 13 bp, Homo sapiens
caaactgctccaa

SEQ ID NO: 5853542 - DNA, 20 bp, Homo sapiens
caaactggaatgagcagctt

SEQ ID NO: 5853543 - DNA, 23 bp, Homo sapiens
caaactggagtctggagtgggca

SEQ ID NO: 5853544 - DNA, 13 bp, Homo sapiens
caaactggggctg

SEQ ID NO: 5853545 - DNA, 15 bp, Homo sapiens
caaagctaggcctgg

SEQ ID NO: 5853546 - DNA, 22 bp, Homo sapiens
caaagctagggtggcccttgca

SEQ ID NO: 5853547 - DNA, 22 bp, Homo sapiens
caaagctatttaagtggactgt

SEQ ID NO: 5853548 - DNA, 14 bp, Homo sapiens
caaagctcaaagta

SEQ ID NO: 5853549 - DNA, 18 bp, Homo sapiens
caaagctcaaataaaaat

SEQ ID NO: 5853550 - DNA, 20 bp, Homo sapiens
caaagctcaaataaaaataa

SEQ ID NO: 5853551 - DNA, 23 bp, Homo sapiens
caaagctcaagatgacagctctt

SEQ ID NO: 5853552 - DNA, 11 bp, Homo sapiens
caaagctcata

SEQ ID NO: 5853553 - DNA, 16 bp, Homo sapiens
caaagctctaaggtaa

SEQ ID NO: 5853554 - DNA, 19 bp, Homo sapiens
caaagctctgaatagttaa

SEQ ID NO: 5853555 - DNA, 17 bp, Homo sapiens
caaagctgaaaatgtgt

SEQ ID NO: 5853556 - DNA, 20 bp, Homo sapiens
caaagctgaagaaaatgaag

SEQ ID NO: 5853557 - DNA, 23 bp, Homo sapiens
caaagctgaagaccatggatttc

SEQ ID NO: 5853558 - DNA, 22 bp, Homo sapiens
caaagctgacgaggctgggcca

SEQ ID NO: 5853559 - DNA, 12 bp, Homo sapiens
caaagctgagcc

SEQ ID NO: 5853560 - DNA, 13 bp, Homo sapiens
caaagctgagcct

SEQ ID NO: 5853561 - DNA, 17 bp, Homo sapiens
caaagctgagcctgcag

SEQ ID NO: 5853562 - DNA, 22 bp, Homo sapiens
caaagctgagcctgcagggaag

SEQ ID NO: 5853563 - DNA, 18 bp, Homo sapiens
caaagctgatttcccttt

SEQ ID NO: 5853564 - DNA, 21 bp, Homo sapiens
caaagctgatttccctttttt

SEQ ID NO: 5853565 - DNA, 17 bp, Homo sapiens
caaagctgcaggtgcca

SEQ ID NO: 5853566 - DNA, 14 bp, Homo sapiens
caaagctgcccact

SEQ ID NO: 5853567 - DNA, 16 bp, Homo sapiens
caaagctgcctgtgcc

SEQ ID NO: 5853568 - DNA, 16 bp, Homo sapiens
caaagctgctaaatct

SEQ ID NO: 5853569 - DNA, 21 bp, Homo sapiens
caaagctgctgggccagtggc

SEQ ID NO: 5853570 - DNA, 22 bp, Homo sapiens
caaagctgctgggccagtggca

SEQ ID NO: 5853571 - DNA, 13 bp, Homo sapiens
caaagctgctttc

SEQ ID NO: 5853572 - DNA, 18 bp, Homo sapiens
caaagctgctttcttctc

SEQ ID NO: 5853573 - DNA, 21 bp, Homo sapiens
caaagctgctttcttctctgc

SEQ ID NO: 5853574 - DNA, 11 bp, Homo sapiens
caaagctggag

SEQ ID NO: 5853575 - DNA, 19 bp, Homo sapiens
caaagctggaggcatcacg

SEQ ID NO: 5853576 - DNA, 17 bp, Homo sapiens
caaagctgttaaactgt

SEQ ID NO: 5853577 - DNA, 19 bp, Homo sapiens
caaagctgttaaactgtta

SEQ ID NO: 5853578 - DNA, 20 bp, Homo sapiens
caaagctgttaaactgttag

SEQ ID NO: 5853579 - DNA, 13 bp, Homo sapiens
caaagctgttcca

SEQ ID NO: 5853580 - DNA, 16 bp, Homo sapiens
caaagctgttcttcct

SEQ ID NO: 5853581 - DNA, 17 bp, Homo sapiens
caaagctgttcttcctg

SEQ ID NO: 5853582 - DNA, 14 bp, Homo sapiens
caaagcttaaaaag

SEQ ID NO: 5853583 - DNA, 16 bp, Homo sapiens
caaagcttaaatgcct

SEQ ID NO: 5853584 - DNA, 15 bp, Homo sapiens
caaagcttccattcc

SEQ ID NO: 5853585 - DNA, 16 bp, Homo sapiens
caaagcttccattcca

SEQ ID NO: 5853586 - DNA, 20 bp, Homo sapiens
caaagcttcccgattaactg

SEQ ID NO: 5853587 - DNA, 18 bp, Homo sapiens
caaagcttctatcccagg

SEQ ID NO: 5853588 - DNA, 19 bp, Homo sapiens
caaagcttctatcccagga

SEQ ID NO: 5853589 - DNA, 21 bp, Homo sapiens
caaagcttctatcccaggagg

SEQ ID NO: 5853590 - DNA, 19 bp, Homo sapiens
caaagcttgaagatcgtta

SEQ ID NO: 5853591 - DNA, 22 bp, Homo sapiens
caaagcttggaagagcctgcag

SEQ ID NO: 5853592 - DNA, 21 bp, Homo sapiens
caaagcttggattaaatacat

SEQ ID NO: 5853593 - DNA, 17 bp, Homo sapiens
caaagctttactactgt

SEQ ID NO: 5853594 - DNA, 14 bp, Homo sapiens
caaagctttcctgc

SEQ ID NO: 5853595 - DNA, 16 bp, Homo sapiens
caaagctttcctggag

SEQ ID NO: 5853596 - DNA, 17 bp, Homo sapiens
caaagctttctttgttt

SEQ ID NO: 5853597 - DNA, 23 bp, Homo sapiens
caaagctttgctacaaatttatg

SEQ ID NO: 5853598 - DNA, 15 bp, Homo sapiens
caaagctttggctga

SEQ ID NO: 5853599 - DNA, 20 bp, Homo sapiens
caaagcttttagaaatactg

SEQ ID NO: 5853600 - DNA, 16 bp, Homo sapiens
caaagctttttccaga

SEQ ID NO: 5853601 - DNA, 10 bp, Homo sapiens
caaaggaaaa

SEQ ID NO: 5853602 - DNA, 18 bp, Homo sapiens
caaaggaaaaagcacaag

SEQ ID NO: 5853603 - DNA, 22 bp, Homo sapiens
caaaggaaaacacctttatttt

SEQ ID NO: 5853604 - DNA, 23 bp, Homo sapiens
caaaggaaaactcttggcctctg

SEQ ID NO: 5853605 - DNA, 22 bp, Homo sapiens
caaaggaaaatagtaatgtttt

SEQ ID NO: 5853606 - DNA, 13 bp, Homo sapiens
caaaggaaaccaa

SEQ ID NO: 5853607 - DNA, 20 bp, Homo sapiens
caaaggaaggggttttccca

SEQ ID NO: 5853608 - DNA, 14 bp, Homo sapiens
caaaggaagtgagg

SEQ ID NO: 5853609 - DNA, 20 bp, Homo sapiens
caaaggaagtgccccctccc

SEQ ID NO: 5853610 - DNA, 14 bp, Homo sapiens
caaaggaagtttta

SEQ ID NO: 5853611 - DNA, 18 bp, Homo sapiens
caaaggaatataagaaaa

SEQ ID NO: 5853612 - DNA, 23 bp, Homo sapiens
caaaggaatttgcatccagcagc

SEQ ID NO: 5853613 - DNA, 22 bp, Homo sapiens
caaaggacagtgggcaggaggc

SEQ ID NO: 5853614 - DNA, 20 bp, Homo sapiens
caaaggactgtaagcagatt

SEQ ID NO: 5853615 - DNA, 18 bp, Homo sapiens
caaaggagaagcacagct

SEQ ID NO: 5853616 - DNA, 20 bp, Homo sapiens
caaaggagacaaagcaggag

SEQ ID NO: 5853617 - DNA, 17 bp, Homo sapiens
caaaggagagtcctggg

SEQ ID NO: 5853618 - DNA, 20 bp, Homo sapiens
caaaggagattggaaggaac

SEQ ID NO: 5853619 - DNA, 10 bp, Homo sapiens
caaaggagca

SEQ ID NO: 5853620 - DNA, 23 bp, Homo sapiens
caaaggagcattaagcccaatct

SEQ ID NO: 5853621 - DNA, 17 bp, Homo sapiens
caaaggaggctggcagg

SEQ ID NO: 5853622 - DNA, 14 bp, Homo sapiens
caaaggagggcctc

SEQ ID NO: 5853623 - DNA, 20 bp, Homo sapiens
caaaggagggcctcagagac

SEQ ID NO: 5853624 - DNA, 22 bp, Homo sapiens
caaaggagggcctcagagacag

SEQ ID NO: 5853625 - DNA, 23 bp, Homo sapiens
caaaggagggcctcagagacagc

SEQ ID NO: 5853626 - DNA, 19 bp, Homo sapiens
caaaggaggggaaacaatg

SEQ ID NO: 5853627 - DNA, 21 bp, Homo sapiens
caaaggaggggaaacaatgaa

SEQ ID NO: 5853628 - DNA, 20 bp, Homo sapiens
caaaggagtgcatggccaca

SEQ ID NO: 5853629 - DNA, 16 bp, Homo sapiens
caaaggataaattttt

SEQ ID NO: 5853630 - DNA, 18 bp, Homo sapiens
caaaggataaattttttg

SEQ ID NO: 5853631 - DNA, 16 bp, Homo sapiens
caaaggatacttattt

SEQ ID NO: 5853632 - DNA, 23 bp, Homo sapiens
caaaggatccagagacttgggga

SEQ ID NO: 5853633 - DNA, 22 bp, Homo sapiens
caaaggatccagatagcctagg

SEQ ID NO: 5853634 - DNA, 19 bp, Homo sapiens
caaaggatgagaatgtgac

SEQ ID NO: 5853635 - DNA, 20 bp, Homo sapiens
caaaggatgggggaaagaag

SEQ ID NO: 5853636 - DNA, 17 bp, Homo sapiens
caaaggatgtgatatat

SEQ ID NO: 5853637 - DNA, 21 bp, Homo sapiens
caaaggatgtgttttcagtct

SEQ ID NO: 5853638 - DNA, 19 bp, Homo sapiens
caaaggattaattgctgca

SEQ ID NO: 5853639 - DNA, 20 bp, Homo sapiens
caaaggattaattgctgcaa

SEQ ID NO: 5853640 - DNA, 20 bp, Homo sapiens
caaaggcaagttaagagaaa

SEQ ID NO: 5853641 - DNA, 23 bp, Homo sapiens
caaaggcacatggaatatatttt

SEQ ID NO: 5853642 - DNA, 15 bp, Homo sapiens
caaaggcagaaagga

SEQ ID NO: 5853643 - DNA, 11 bp, Homo sapiens
caaaggcagcg

SEQ ID NO: 5853644 - DNA, 21 bp, Homo sapiens
caaaggcagcgtgccgagcca

SEQ ID NO: 5853645 - DNA, 11 bp, Homo sapiens
caaaggcagct

SEQ ID NO: 5853646 - DNA, 13 bp, Homo sapiens
caaaggcagctgt

SEQ ID NO: 5853647 - DNA, 24 bp, Homo sapiens
caaaggcagctgtgtctgagccca

SEQ ID NO: 5853648 - DNA, 18 bp, Homo sapiens
caaaggcatccaggccag

SEQ ID NO: 5853649 - DNA, 13 bp, Homo sapiens
caaaggcatccca

SEQ ID NO: 5853650 - DNA, 19 bp, Homo sapiens
caaaggcatcccagcctgg

SEQ ID NO: 5853651 - DNA, 22 bp, Homo sapiens
caaaggcatcccagcctggggg

SEQ ID NO: 5853652 - DNA, 12 bp, Homo sapiens
caaaggcatgct

SEQ ID NO: 5853653 - DNA, 14 bp, Homo sapiens
caaaggccaaactg

SEQ ID NO: 5853654 - DNA, 16 bp, Homo sapiens
caaaggccaaactgct

SEQ ID NO: 5853655 - DNA, 19 bp, Homo sapiens
caaaggccaaactgctgga

SEQ ID NO: 5853656 - DNA, 16 bp, Homo sapiens
caaaggccaacagcat

SEQ ID NO: 5853657 - DNA, 18 bp, Homo sapiens
caaaggccagacctgcag

SEQ ID NO: 5853658 - DNA, 13 bp, Homo sapiens
caaaggccagggt

SEQ ID NO: 5853659 - DNA, 13 bp, Homo sapiens
caaaggccagtgg

SEQ ID NO: 5853660 - DNA, 19 bp, Homo sapiens
caaaggccagtggaagaaa

SEQ ID NO: 5853661 - DNA, 20 bp, Homo sapiens
caaaggccagtggaagaaac

SEQ ID NO: 5853662 - DNA, 13 bp, Homo sapiens
caaaggccatgga

SEQ ID NO: 5853663 - DNA, 23 bp, Homo sapiens
caaaggccatggagagctggagc

SEQ ID NO: 5853664 - DNA, 22 bp, Homo sapiens
caaaggcccagggaggcagcgt

SEQ ID NO: 5853665 - DNA, 11 bp, Homo sapiens
caaaggcccat

SEQ ID NO: 5853666 - DNA, 13 bp, Homo sapiens
caaaggcccatgc

SEQ ID NO: 5853667 - DNA, 19 bp, Homo sapiens
caaaggcccatgccccctt

SEQ ID NO: 5853668 - DNA, 13 bp, Homo sapiens
caaaggcccccta

SEQ ID NO: 5853669 - DNA, 14 bp, Homo sapiens
caaaggccctgggt

SEQ ID NO: 5853670 - DNA, 18 bp, Homo sapiens
caaaggccgtgcctggtg

SEQ ID NO: 5853671 - DNA, 20 bp, Homo sapiens
caaaggccgtgcctggtggg

SEQ ID NO: 5853672 - DNA, 11 bp, Homo sapiens
caaaggcctgg

SEQ ID NO: 5853673 - DNA, 21 bp, Homo sapiens
caaaggcctggcgtcggccag

SEQ ID NO: 5853674 - DNA, 23 bp, Homo sapiens
caaaggcgggaggatcacttgag

SEQ ID NO: 5853675 - DNA, 20 bp, Homo sapiens
caaaggctcagcttggattt

SEQ ID NO: 5853676 - DNA, 13 bp, Homo sapiens
caaaggctccctc

SEQ ID NO: 5853677 - DNA, 16 bp, Homo sapiens
caaaggctccctcgcc

SEQ ID NO: 5853678 - DNA, 12 bp, Homo sapiens
caaaggctctgt

SEQ ID NO: 5853679 - DNA, 11 bp, Homo sapiens
caaaggctggg

SEQ ID NO: 5853680 - DNA, 12 bp, Homo sapiens
caaaggctggga

SEQ ID NO: 5853681 - DNA, 15 bp, Homo sapiens
caaaggctggtggca

SEQ ID NO: 5853682 - DNA, 18 bp, Homo sapiens
caaaggctgtattcagca

SEQ ID NO: 5853683 - DNA, 19 bp, Homo sapiens
caaaggctgtattcagcaa

SEQ ID NO: 5853684 - DNA, 18 bp, Homo sapiens
caaaggcttgtggtttgt

SEQ ID NO: 5853685 - DNA, 23 bp, Homo sapiens
caaaggctttgccctgctgccct

SEQ ID NO: 5853686 - DNA, 18 bp, Homo sapiens
caaagggaaaaaagagtt

SEQ ID NO: 5853687 - DNA, 17 bp, Homo sapiens
caaagggaaatatcatt

SEQ ID NO: 5853688 - DNA, 20 bp, Homo sapiens
caaagggaagcagagcctgg

SEQ ID NO: 5853689 - DNA, 21 bp, Homo sapiens
caaagggaagcagagcctggg

SEQ ID NO: 5853690 - DNA, 19 bp, Homo sapiens
caaagggaagtgaggccca

SEQ ID NO: 5853691 - DNA, 15 bp, Homo sapiens
caaagggaatactca

SEQ ID NO: 5853692 - DNA, 19 bp, Homo sapiens
caaagggacacacagtgac

SEQ ID NO: 5853693 - DNA, 15 bp, Homo sapiens
caaagggacattgaa

SEQ ID NO: 5853694 - DNA, 15 bp, Homo sapiens
caaagggagagaaaa

SEQ ID NO: 5853695 - DNA, 24 bp, Homo sapiens
caaagggagagaaaagctggacct

SEQ ID NO: 5853696 - DNA, 17 bp, Homo sapiens
caaagggagggagcaag

SEQ ID NO: 5853697 - DNA, 20 bp, Homo sapiens
caaagggagggagcaagccc

SEQ ID NO: 5853698 - DNA, 22 bp, Homo sapiens
caaagggatggtattgagaaga

SEQ ID NO: 5853699 - DNA, 21 bp, Homo sapiens
caaagggcagccctccacttc

SEQ ID NO: 5853700 - DNA, 17 bp, Homo sapiens
caaagggcaggcctgtt

SEQ ID NO: 5853701 - DNA, 20 bp, Homo sapiens
caaagggcagtaaagttttc

SEQ ID NO: 5853702 - DNA, 18 bp, Homo sapiens
caaagggccaaatagagt

SEQ ID NO: 5853703 - DNA, 12 bp, Homo sapiens
caaagggccagg

SEQ ID NO: 5853704 - DNA, 17 bp, Homo sapiens
caaagggccatcgttca

SEQ ID NO: 5853705 - DNA, 14 bp, Homo sapiens
caaagggcctcctc

SEQ ID NO: 5853706 - DNA, 15 bp, Homo sapiens
caaagggcctcctca

SEQ ID NO: 5853707 - DNA, 20 bp, Homo sapiens
caaagggcctgcccagacaa

SEQ ID NO: 5853708 - DNA, 22 bp, Homo sapiens
caaagggctcctctccagtctg

SEQ ID NO: 5853709 - DNA, 17 bp, Homo sapiens
caaagggctgaaagcca

SEQ ID NO: 5853710 - DNA, 18 bp, Homo sapiens
caaagggctgaaagccat

SEQ ID NO: 5853711 - DNA, 18 bp, Homo sapiens
caaagggctgccttgctg

SEQ ID NO: 5853712 - DNA, 21 bp, Homo sapiens
caaaggggacaggcctcacct

SEQ ID NO: 5853713 - DNA, 20 bp, Homo sapiens
caaaggggatcataaagtta

SEQ ID NO: 5853714 - DNA, 23 bp, Homo sapiens
caaaggggatcataaagttagaa

SEQ ID NO: 5853715 - DNA, 19 bp, Homo sapiens
caaaggggcctctcctttt

SEQ ID NO: 5853716 - DNA, 20 bp, Homo sapiens
caaaggggctgctggggcat

SEQ ID NO: 5853717 - DNA, 13 bp, Homo sapiens
caaaggggggagg

SEQ ID NO: 5853718 - DNA, 16 bp, Homo sapiens
caaagggtatcaggtg

SEQ ID NO: 5853719 - DNA, 21 bp, Homo sapiens
caaagggtgaagctatttatc

SEQ ID NO: 5853720 - DNA, 23 bp, Homo sapiens
caaagggttgggagctgatgaaa

SEQ ID NO: 5853721 - DNA, 19 bp, Homo sapiens
caaatgaatttcatgtgaa

SEQ ID NO: 5853722 - DNA, 12 bp, Homo sapiens
caaatgacagat

SEQ ID NO: 5853723 - DNA, 16 bp, Homo sapiens
caaatgacagatcttt

SEQ ID NO: 5853724 - DNA, 15 bp, Homo sapiens
caaatgacatgcact

SEQ ID NO: 5853725 - DNA, 18 bp, Homo sapiens
caaatgacatgcactgac

SEQ ID NO: 5853726 - DNA, 20 bp, Homo sapiens
caaatgacatgcactgaccc

SEQ ID NO: 5853727 - DNA, 22 bp, Homo sapiens
caaatgaccagcagattcaaat

SEQ ID NO: 5853728 - DNA, 18 bp, Homo sapiens
caaatgaccgagccctgg

SEQ ID NO: 5853729 - DNA, 15 bp, Homo sapiens
caaatgaccttccaa

SEQ ID NO: 5853730 - DNA, 15 bp, Homo sapiens
caaatgacttcattt

SEQ ID NO: 5853731 - DNA, 15 bp, Homo sapiens
caaatgactttatta

SEQ ID NO: 5853732 - DNA, 21 bp, Homo sapiens
caaatgactttattatttatt

SEQ ID NO: 5853733 - DNA, 21 bp, Homo sapiens
caaatgactttgcacctgcaa

SEQ ID NO: 5853734 - DNA, 22 bp, Homo sapiens
caaatgagaaaatgtctttatt

SEQ ID NO: 5853735 - DNA, 22 bp, Homo sapiens
caaatgagatttctttgaatgt

SEQ ID NO: 5853736 - DNA, 21 bp, Homo sapiens
caaatgagcatctcaaatgtt

SEQ ID NO: 5853737 - DNA, 22 bp, Homo sapiens
caaatgagcatctcaaatgttt

SEQ ID NO: 5853738 - DNA, 20 bp, Homo sapiens
caaatgagcattagctactt

SEQ ID NO: 5853739 - DNA, 13 bp, Homo sapiens
caaatgagccatg

SEQ ID NO: 5853740 - DNA, 21 bp, Homo sapiens
caaatgagctctgaaatcttc

SEQ ID NO: 5853741 - DNA, 21 bp, Homo sapiens
caaatgagggaagaacattat

SEQ ID NO: 5853742 - DNA, 15 bp, Homo sapiens
caaatgagggagggg

SEQ ID NO: 5853743 - DNA, 18 bp, Homo sapiens
caaatgaggtcataaaca

SEQ ID NO: 5853744 - DNA, 18 bp, Homo sapiens
caaatgatacagtcagga

SEQ ID NO: 5853745 - DNA, 18 bp, Homo sapiens
caaatgatagaaacagac

SEQ ID NO: 5853746 - DNA, 15 bp, Homo sapiens
caaatgatccttcct

SEQ ID NO: 5853747 - DNA, 16 bp, Homo sapiens
caaatgatccttccta

SEQ ID NO: 5853748 - DNA, 21 bp, Homo sapiens
caaatgatgtgcaaaaccttt

SEQ ID NO: 5853749 - DNA, 17 bp, Homo sapiens
caaatgatgtgcctgct

SEQ ID NO: 5853750 - DNA, 18 bp, Homo sapiens
caaatgattatgattagt

SEQ ID NO: 5853751 - DNA, 22 bp, Homo sapiens
caaatgattcatttttctgtta

SEQ ID NO: 5853752 - DNA, 15 bp, Homo sapiens
caaatgattgctttt

SEQ ID NO: 5853753 - DNA, 19 bp, Homo sapiens
caaatgattgcttttaaaa

SEQ ID NO: 5853754 - DNA, 11 bp, Homo sapiens
caaatgatttc

SEQ ID NO: 5853755 - DNA, 16 bp, Homo sapiens
caaatgatttcgtgac

SEQ ID NO: 5853756 - DNA, 20 bp, Homo sapiens
caaatgattttcatcaattt

SEQ ID NO: 5853757 - DNA, 23 bp, Homo sapiens
caaatgcaaatttctataaattt

SEQ ID NO: 5853758 - DNA, 18 bp, Homo sapiens
caaatgcacacacctcat

SEQ ID NO: 5853759 - DNA, 18 bp, Homo sapiens
caaatgcacatttgtcac

SEQ ID NO: 5853760 - DNA, 22 bp, Homo sapiens
caaatgcagaaccacaaacaat

SEQ ID NO: 5853761 - DNA, 17 bp, Homo sapiens
caaatgcagcaatccca

SEQ ID NO: 5853762 - DNA, 19 bp, Homo sapiens
caaatgcagcaatcccact

SEQ ID NO: 5853763 - DNA, 16 bp, Homo sapiens
caaatgcagcttcagg

SEQ ID NO: 5853764 - DNA, 15 bp, Homo sapiens
caaatgcagggaggg

SEQ ID NO: 5853765 - DNA, 23 bp, Homo sapiens
caaatgcagggattgctgccact

SEQ ID NO: 5853766 - DNA, 20 bp, Homo sapiens
caaatgcagtgtatttaatg

SEQ ID NO: 5853767 - DNA, 17 bp, Homo sapiens
caaatgcataaatgcat

SEQ ID NO: 5853768 - DNA, 15 bp, Homo sapiens
caaatgcatctttga

SEQ ID NO: 5853769 - DNA, 17 bp, Homo sapiens
caaatgcatctttgatg

SEQ ID NO: 5853770 - DNA, 22 bp, Homo sapiens
caaatgcatctttgatgtgttg

SEQ ID NO: 5853771 - DNA, 11 bp, Homo sapiens
caaatgcatga

SEQ ID NO: 5853772 - DNA, 17 bp, Homo sapiens
caaatgcatgaacaagt

SEQ ID NO: 5853773 - DNA, 22 bp, Homo sapiens
caaatgcatgatattgtatgta

SEQ ID NO: 5853774 - DNA, 20 bp, Homo sapiens
caaatgcatgcttcttctca

SEQ ID NO: 5853775 - DNA, 21 bp, Homo sapiens
caaatgccaaattaaaaaaga

SEQ ID NO: 5853776 - DNA, 20 bp, Homo sapiens
caaatgccaactgttggaat

SEQ ID NO: 5853777 - DNA, 20 bp, Homo sapiens
caaatgccactctgggcagt

SEQ ID NO: 5853778 - DNA, 20 bp, Homo sapiens
caaatgccaggacagctgca

SEQ ID NO: 5853779 - DNA, 21 bp, Homo sapiens
caaatgccaggacagctgcag

SEQ ID NO: 5853780 - DNA, 14 bp, Homo sapiens
caaatgcccaagga

SEQ ID NO: 5853781 - DNA, 15 bp, Homo sapiens
caaatgcccaaggat

SEQ ID NO: 5853782 - DNA, 18 bp, Homo sapiens
caaatgcccaagggaaag

SEQ ID NO: 5853783 - DNA, 15 bp, Homo sapiens
caaatgcctgccaaa

SEQ ID NO: 5853784 - DNA, 17 bp, Homo sapiens
caaatgcctgccaaatt

SEQ ID NO: 5853785 - DNA, 18 bp, Homo sapiens
caaatgcctgccaaattt

SEQ ID NO: 5853786 - DNA, 14 bp, Homo sapiens
caaatgcctgttgt

SEQ ID NO: 5853787 - DNA, 18 bp, Homo sapiens
caaatgccttaaaatgga

SEQ ID NO: 5853788 - DNA, 15 bp, Homo sapiens
caaatgccttcatga

SEQ ID NO: 5853789 - DNA, 21 bp, Homo sapiens
caaatgccttcatgaatcttt

SEQ ID NO: 5853790 - DNA, 21 bp, Homo sapiens
caaatgctagaaaaattgtta

SEQ ID NO: 5853791 - DNA, 22 bp, Homo sapiens
caaatgctctctcaaattgtca

SEQ ID NO: 5853792 - DNA, 19 bp, Homo sapiens
caaatgctgcgcccttccc

SEQ ID NO: 5853793 - DNA, 20 bp, Homo sapiens
caaatgctgcgcccttcccc

SEQ ID NO: 5853794 - DNA, 14 bp, Homo sapiens
caaatgctggggca

SEQ ID NO: 5853795 - DNA, 15 bp, Homo sapiens
caaatgctgtattct

SEQ ID NO: 5853796 - DNA, 21 bp, Homo sapiens
caaatgctgtgcaaacagtgt

SEQ ID NO: 5853797 - DNA, 22 bp, Homo sapiens
caaatgctgtgcaaacagtgta

SEQ ID NO: 5853798 - DNA, 21 bp, Homo sapiens
caaatggaaaatgtatatttt

SEQ ID NO: 5853799 - DNA, 21 bp, Homo sapiens
caaatggaaacagaggaccag

SEQ ID NO: 5853800 - DNA, 21 bp, Homo sapiens
caaatggaaatgggcagagca

SEQ ID NO: 5853801 - DNA, 22 bp, Homo sapiens
caaatggaaatgggcagagcag

SEQ ID NO: 5853802 - DNA, 23 bp, Homo sapiens
caaatggaaatgggcagagcaga

SEQ ID NO: 5853803 - DNA, 21 bp, Homo sapiens
caaatggaactccccagggcc

SEQ ID NO: 5853804 - DNA, 19 bp, Homo sapiens
caaatggaagacacattga

SEQ ID NO: 5853805 - DNA, 17 bp, Homo sapiens
caaatggactatacata

SEQ ID NO: 5853806 - DNA, 20 bp, Homo sapiens
caaatggactgttacagact

SEQ ID NO: 5853807 - DNA, 19 bp, Homo sapiens
caaatggagaagctgcagg

SEQ ID NO: 5853808 - DNA, 19 bp, Homo sapiens
caaatggagctttctgtat

SEQ ID NO: 5853809 - DNA, 20 bp, Homo sapiens
caaatggagctttctgtata

SEQ ID NO: 5853810 - DNA, 16 bp, Homo sapiens
caaatggaggcttttc

SEQ ID NO: 5853811 - DNA, 19 bp, Homo sapiens
caaatggaggcttttcact

SEQ ID NO: 5853812 - DNA, 18 bp, Homo sapiens
caaatggagttggagttc

SEQ ID NO: 5853813 - DNA, 22 bp, Homo sapiens
caaatggatggggataagaata

SEQ ID NO: 5853814 - DNA, 14 bp, Homo sapiens
caaatggatgtaat

SEQ ID NO: 5853815 - DNA, 19 bp, Homo sapiens
caaatggattcctgtttca

SEQ ID NO: 5853816 - DNA, 19 bp, Homo sapiens
caaatggccattttaaaat

SEQ ID NO: 5853817 - DNA, 21 bp, Homo sapiens
caaatggctacatctccaaat

SEQ ID NO: 5853818 - DNA, 22 bp, Homo sapiens
caaatggctacatctccaaata

SEQ ID NO: 5853819 - DNA, 12 bp, Homo sapiens
caaatggctctg

SEQ ID NO: 5853820 - DNA, 16 bp, Homo sapiens
caaatggctctgtgaa

SEQ ID NO: 5853821 - DNA, 15 bp, Homo sapiens
caaatggctgagatg

SEQ ID NO: 5853822 - DNA, 13 bp, Homo sapiens
caaatgggaaaaa

SEQ ID NO: 5853823 - DNA, 17 bp, Homo sapiens
caaatgggactgatgtc

SEQ ID NO: 5853824 - DNA, 18 bp, Homo sapiens
caaatgggatggtatgtg

SEQ ID NO: 5853825 - DNA, 22 bp, Homo sapiens
caaatgggcagctccatcctct

SEQ ID NO: 5853826 - DNA, 17 bp, Homo sapiens
caaatgggcattttaca

SEQ ID NO: 5853827 - DNA, 14 bp, Homo sapiens
caaatggggccaga

SEQ ID NO: 5853828 - DNA, 17 bp, Homo sapiens
caaatggggccagatcc

SEQ ID NO: 5853829 - DNA, 18 bp, Homo sapiens
caaatggggccagatcca

SEQ ID NO: 5853830 - DNA, 20 bp, Homo sapiens
caaatgggggcggctggaaa

SEQ ID NO: 5853831 - DNA, 23 bp, Homo sapiens
caaatgggtgcccgtatccagag

SEQ ID NO: 5853832 - DNA, 15 bp, Homo sapiens
caaatggtacaaaac

SEQ ID NO: 5853833 - DNA, 13 bp, Homo sapiens
caaatggtaggca

SEQ ID NO: 5853834 - DNA, 13 bp, Homo sapiens
caaatggtatctt

SEQ ID NO: 5853835 - DNA, 15 bp, Homo sapiens
caaatggtatctttt

SEQ ID NO: 5853836 - DNA, 23 bp, Homo sapiens
caaatggtggaggattgctgcca

SEQ ID NO: 5853837 - DNA, 20 bp, Homo sapiens
caaatggtggttgtttcttc

SEQ ID NO: 5853838 - DNA, 23 bp, Homo sapiens
caaatggttccagatacttcagc

SEQ ID NO: 5853839 - DNA, 23 bp, Homo sapiens
caaatggttcttacttttcctgg

SEQ ID NO: 5853840 - DNA, 12 bp, Homo sapiens
caaatgtaaaat

SEQ ID NO: 5853841 - DNA, 18 bp, Homo sapiens
caaatgtaaaataagtat

SEQ ID NO: 5853842 - DNA, 14 bp, Homo sapiens
caaatgtaaaatta

SEQ ID NO: 5853843 - DNA, 15 bp, Homo sapiens
caaatgtaaaattat

SEQ ID NO: 5853844 - DNA, 16 bp, Homo sapiens
caaatgtaaaattatg

SEQ ID NO: 5853845 - DNA, 14 bp, Homo sapiens
caaatgtaaacatt

SEQ ID NO: 5853846 - DNA, 18 bp, Homo sapiens
caaatgtaaactctcttc

SEQ ID NO: 5853847 - DNA, 12 bp, Homo sapiens
caaatgtaaagt

SEQ ID NO: 5853848 - DNA, 15 bp, Homo sapiens
caaatgtaaagtcta

SEQ ID NO: 5853849 - DNA, 12 bp, Homo sapiens
caaatgtaacta

SEQ ID NO: 5853850 - DNA, 19 bp, Homo sapiens
caaatgtaactatgtttta

SEQ ID NO: 5853851 - DNA, 18 bp, Homo sapiens
caaatgtaattgaataaa

SEQ ID NO: 5853852 - DNA, 12 bp, Homo sapiens
caaatgtacatc

SEQ ID NO: 5853853 - DNA, 21 bp, Homo sapiens
caaatgtatagaataaacctt

SEQ ID NO: 5853854 - DNA, 12 bp, Homo sapiens
caaatgtattga

SEQ ID NO: 5853855 - DNA, 15 bp, Homo sapiens
caaatgtcagagcta

SEQ ID NO: 5853856 - DNA, 17 bp, Homo sapiens
caaatgtcatcagaact

SEQ ID NO: 5853857 - DNA, 18 bp, Homo sapiens
caaatgtcatcagaactt

SEQ ID NO: 5853858 - DNA, 19 bp, Homo sapiens
caaatgtcatgctgcctta

SEQ ID NO: 5853859 - DNA, 12 bp, Homo sapiens
caaatgtcattt

SEQ ID NO: 5853860 - DNA, 13 bp, Homo sapiens
caaatgtcatttc

SEQ ID NO: 5853861 - DNA, 12 bp, Homo sapiens
caaatgtccaag

SEQ ID NO: 5853862 - DNA, 21 bp, Homo sapiens
caaatgtcctaacagagaaat

SEQ ID NO: 5853863 - DNA, 16 bp, Homo sapiens
caaatgtctaattgtc

SEQ ID NO: 5853864 - DNA, 14 bp, Homo sapiens
caaatgtctataaa

SEQ ID NO: 5853865 - DNA, 15 bp, Homo sapiens
caaatgtgaaacgga

SEQ ID NO: 5853866 - DNA, 11 bp, Homo sapiens
caaatgtgaag

SEQ ID NO: 5853867 - DNA, 14 bp, Homo sapiens
caaatgtgaagatg

SEQ ID NO: 5853868 - DNA, 15 bp, Homo sapiens
caaatgtgaagatgc

SEQ ID NO: 5853869 - DNA, 16 bp, Homo sapiens
caaatgtgatcaactg

SEQ ID NO: 5853870 - DNA, 13 bp, Homo sapiens
caaatgtgatttt

SEQ ID NO: 5853871 - DNA, 19 bp, Homo sapiens
caaatgtgatttttgtaat

SEQ ID NO: 5853872 - DNA, 19 bp, Homo sapiens
caaatgtgccatactaatg

SEQ ID NO: 5853873 - DNA, 14 bp, Homo sapiens
caaatgtgctttga

SEQ ID NO: 5853874 - DNA, 17 bp, Homo sapiens
caaatgtggcatttgtg

SEQ ID NO: 5853875 - DNA, 15 bp, Homo sapiens
caaatgtggccaagc

SEQ ID NO: 5853876 - DNA, 14 bp, Homo sapiens
caaatgtggctcct

SEQ ID NO: 5853877 - DNA, 21 bp, Homo sapiens
caaatgtgggtgaagtgcctg

SEQ ID NO: 5853878 - DNA, 20 bp, Homo sapiens
caaatgtgtaatattccagt

SEQ ID NO: 5853879 - DNA, 23 bp, Homo sapiens
caaatgtgtacatggcagagttt

SEQ ID NO: 5853880 - DNA, 15 bp, Homo sapiens
caaatgtgtcagaat

SEQ ID NO: 5853881 - DNA, 23 bp, Homo sapiens
caaatgtgtcagaataggaaaac

SEQ ID NO: 5853882 - DNA, 17 bp, Homo sapiens
caaatgtgtgcccagct

SEQ ID NO: 5853883 - DNA, 19 bp, Homo sapiens
caaatgtgtttttctatat

SEQ ID NO: 5853884 - DNA, 20 bp, Homo sapiens
caaatgtgtttttctatata

SEQ ID NO: 5853885 - DNA, 21 bp, Homo sapiens
caaatgtgtttttctatatag

SEQ ID NO: 5853886 - DNA, 20 bp, Homo sapiens
caaatgttaaaatgtgttgt

SEQ ID NO: 5853887 - DNA, 13 bp, Homo sapiens
caaatgttacaaa

SEQ ID NO: 5853888 - DNA, 14 bp, Homo sapiens
caaatgttacatag

SEQ ID NO: 5853889 - DNA, 14 bp, Homo sapiens
caaatgttagactt

SEQ ID NO: 5853890 - DNA, 15 bp, Homo sapiens
caaatgttagacttg

SEQ ID NO: 5853891 - DNA, 17 bp, Homo sapiens
caaatgttatccttgtt

SEQ ID NO: 5853892 - DNA, 13 bp, Homo sapiens
caaatgttatgca

SEQ ID NO: 5853893 - DNA, 21 bp, Homo sapiens
caaatgttattcaataactat

SEQ ID NO: 5853894 - DNA, 21 bp, Homo sapiens
caaatgttctaagtttctaag

SEQ ID NO: 5853895 - DNA, 22 bp, Homo sapiens
caaatgttctaagtttctaaga

SEQ ID NO: 5853896 - DNA, 23 bp, Homo sapiens
caaatgttgacctttgaggtcta

SEQ ID NO: 5853897 - DNA, 19 bp, Homo sapiens
caacagacctggtgctcta

SEQ ID NO: 5853898 - DNA, 18 bp, Homo sapiens
caacagactgttgagtta

SEQ ID NO: 5853899 - DNA, 18 bp, Homo sapiens
caacagagaaggcaggaa

SEQ ID NO: 5853900 - DNA, 17 bp, Homo sapiens
caacagagacagtgaaa

SEQ ID NO: 5853901 - DNA, 22 bp, Homo sapiens
caacagagaggaccaacatcca

SEQ ID NO: 5853902 - DNA, 13 bp, Homo sapiens
caacagagcactt

SEQ ID NO: 5853903 - DNA, 15 bp, Homo sapiens
caacagagggagttt

SEQ ID NO: 5853904 - DNA, 14 bp, Homo sapiens
caacagagtggtgt

SEQ ID NO: 5853905 - DNA, 18 bp, Homo sapiens
caacagagtggtgtctag

SEQ ID NO: 5853906 - DNA, 23 bp, Homo sapiens
caacagatctggaacctcagcct

SEQ ID NO: 5853907 - DNA, 15 bp, Homo sapiens
caacagatgagcgaa

SEQ ID NO: 5853908 - DNA, 15 bp, Homo sapiens
caacagatttgtgaa

SEQ ID NO: 5853909 - DNA, 17 bp, Homo sapiens
caacagatttgtgaact

SEQ ID NO: 5853910 - DNA, 19 bp, Homo sapiens
caacagatttgtgaactca

SEQ ID NO: 5853911 - DNA, 14 bp, Homo sapiens
caacagcaaattaa

SEQ ID NO: 5853912 - DNA, 16 bp, Homo sapiens
caacagcaacaacaac

SEQ ID NO: 5853913 - DNA, 22 bp, Homo sapiens
caacagcaacaacaacagaaca

SEQ ID NO: 5853914 - DNA, 15 bp, Homo sapiens
caacagcaagaaata

SEQ ID NO: 5853915 - DNA, 14 bp, Homo sapiens
caacagcaagtgtt

SEQ ID NO: 5853916 - DNA, 13 bp, Homo sapiens
caacagcacacag

SEQ ID NO: 5853917 - DNA, 14 bp, Homo sapiens
caacagcacacagg

SEQ ID NO: 5853918 - DNA, 17 bp, Homo sapiens
caacagcacctccccgc

SEQ ID NO: 5853919 - DNA, 18 bp, Homo sapiens
caacagcacctccccgct

SEQ ID NO: 5853920 - DNA, 20 bp, Homo sapiens
caacagcacctccccgctgg

SEQ ID NO: 5853921 - DNA, 18 bp, Homo sapiens
caacagcagatggcacca

SEQ ID NO: 5853922 - DNA, 14 bp, Homo sapiens
caacagcaggaggc

SEQ ID NO: 5853923 - DNA, 16 bp, Homo sapiens
caacagcaggaggcac

SEQ ID NO: 5853924 - DNA, 14 bp, Homo sapiens
caacagcagtctcc

SEQ ID NO: 5853925 - DNA, 22 bp, Homo sapiens
caacagcagtctccttcagcac

SEQ ID NO: 5853926 - DNA, 17 bp, Homo sapiens
caacagccaagctggca

SEQ ID NO: 5853927 - DNA, 23 bp, Homo sapiens
caacagccaagctggcacaaaag

SEQ ID NO: 5853928 - DNA, 17 bp, Homo sapiens
caacagccaagtgtgac

SEQ ID NO: 5853929 - DNA, 12 bp, Homo sapiens
caacagccatgc

SEQ ID NO: 5853930 - DNA, 23 bp, Homo sapiens
caacagcccaggcatctccttgg

SEQ ID NO: 5853931 - DNA, 12 bp, Homo sapiens
caacagcctggg

SEQ ID NO: 5853932 - DNA, 19 bp, Homo sapiens
caacagcctttgaatgtaa

SEQ ID NO: 5853933 - DNA, 21 bp, Homo sapiens
caacagctacaacagcctcac

SEQ ID NO: 5853934 - DNA, 12 bp, Homo sapiens
caacagctcaga

SEQ ID NO: 5853935 - DNA, 23 bp, Homo sapiens
caacagctccccattaccctcag

SEQ ID NO: 5853936 - DNA, 18 bp, Homo sapiens
caacagctcgatccaaat

SEQ ID NO: 5853937 - DNA, 21 bp, Homo sapiens
caacagctctcgttctccttc

SEQ ID NO: 5853938 - DNA, 17 bp, Homo sapiens
caacagctggacacccc

SEQ ID NO: 5853939 - DNA, 16 bp, Homo sapiens
caacagctggaccctg

SEQ ID NO: 5853940 - DNA, 20 bp, Homo sapiens
caacagctggaccctgacca

SEQ ID NO: 5853941 - DNA, 13 bp, Homo sapiens
caacagcttccct

SEQ ID NO: 5853942 - DNA, 18 bp, Homo sapiens
caacagcttgaccagacc

SEQ ID NO: 5853943 - DNA, 20 bp, Homo sapiens
caacagcttgaccagaccta

SEQ ID NO: 5853944 - DNA, 21 bp, Homo sapiens
caacagcttgaccagacctag

SEQ ID NO: 5853945 - DNA, 19 bp, Homo sapiens
caacagcttttcccaggag

SEQ ID NO: 5853946 - DNA, 19 bp, Homo sapiens
caacaggaatcaagagctg

SEQ ID NO: 5853947 - DNA, 21 bp, Homo sapiens
caacaggaatcaagagctgcc

SEQ ID NO: 5853948 - DNA, 23 bp, Homo sapiens
caacaggaatcaagagctgccct

SEQ ID NO: 5853949 - DNA, 16 bp, Homo sapiens
caacaggaatctcaga

SEQ ID NO: 5853950 - DNA, 20 bp, Homo sapiens
caacaggaatctcagagaca

SEQ ID NO: 5853951 - DNA, 23 bp, Homo sapiens
caacaggacagagttcacaggag

SEQ ID NO: 5853952 - DNA, 17 bp, Homo sapiens
caacaggaccaggagcc

SEQ ID NO: 5853953 - DNA, 15 bp, Homo sapiens
caacaggagaatttt

SEQ ID NO: 5853954 - DNA, 14 bp, Homo sapiens
caacaggagctggg

SEQ ID NO: 5853955 - DNA, 22 bp, Homo sapiens
caacaggaggacaattcatgaa

SEQ ID NO: 5853956 - DNA, 14 bp, Homo sapiens
caacaggagggcag

SEQ ID NO: 5853957 - DNA, 18 bp, Homo sapiens
caacaggagggcagcccg

SEQ ID NO: 5853958 - DNA, 20 bp, Homo sapiens
caacaggcattccagaatta

SEQ ID NO: 5853959 - DNA, 21 bp, Homo sapiens
caacaggccattgtgaaccaa

SEQ ID NO: 5853960 - DNA, 15 bp, Homo sapiens
caacaggcccaggga

SEQ ID NO: 5853961 - DNA, 19 bp, Homo sapiens
caacaggcccagggaggga

SEQ ID NO: 5853962 - DNA, 16 bp, Homo sapiens
caacaggcctcagggc

SEQ ID NO: 5853963 - DNA, 20 bp, Homo sapiens
caacaggcctcagggctcct

SEQ ID NO: 5853964 - DNA, 13 bp, Homo sapiens
caacaggctgggc

SEQ ID NO: 5853965 - DNA, 23 bp, Homo sapiens
caacaggctgggcttcagtggca

SEQ ID NO: 5853966 - DNA, 21 bp, Homo sapiens
caacagggccatgtgctgccc

SEQ ID NO: 5853967 - DNA, 23 bp, Homo sapiens
caacagggccatgtgctgccctg

SEQ ID NO: 5853968 - DNA, 15 bp, Homo sapiens
caacaggggaaacta

SEQ ID NO: 5853969 - DNA, 17 bp, Homo sapiens
caacaggggaggaaaaa

SEQ ID NO: 5853970 - DNA, 20 bp, Homo sapiens
caacagggtagatttctctt

SEQ ID NO: 5853971 - DNA, 22 bp, Homo sapiens
caacagggtagatttctcttgg

SEQ ID NO: 5853972 - DNA, 18 bp, Homo sapiens
caacagggtttttttcca

SEQ ID NO: 5853973 - DNA, 21 bp, Homo sapiens
caacaggtagcatagctctgt

SEQ ID NO: 5853974 - DNA, 16 bp, Homo sapiens
caacaggtcacttgat

SEQ ID NO: 5853975 - DNA, 20 bp, Homo sapiens
caacaggtcatgttcaattt

SEQ ID NO: 5853976 - DNA, 21 bp, Homo sapiens
caacaggtgctgaactgtgca

SEQ ID NO: 5853977 - DNA, 21 bp, Homo sapiens
caacaggttgaggctaaaaca

SEQ ID NO: 5853978 - DNA, 22 bp, Homo sapiens
caacaggttgaggctaaaacaa

SEQ ID NO: 5853979 - DNA, 15 bp, Homo sapiens
caacaggttttcctg

SEQ ID NO: 5853980 - DNA, 17 bp, Homo sapiens
caacagtaaaccactga

SEQ ID NO: 5853981 - DNA, 20 bp, Homo sapiens
caacagtaattattatttaa

SEQ ID NO: 5853982 - DNA, 19 bp, Homo sapiens
caacagtcagccagcttgg

SEQ ID NO: 5853983 - DNA, 16 bp, Homo sapiens
caacagtgagagactc

SEQ ID NO: 5853984 - DNA, 12 bp, Homo sapiens
caacagtgagtc

SEQ ID NO: 5853985 - DNA, 12 bp, Homo sapiens
caacagtgctaa

SEQ ID NO: 5853986 - DNA, 16 bp, Homo sapiens
caacagtgctaaaaat

SEQ ID NO: 5853987 - DNA, 18 bp, Homo sapiens
caacagtgctaaaaatgg

SEQ ID NO: 5853988 - DNA, 22 bp, Homo sapiens
caacagtgtgaagttagaattc

SEQ ID NO: 5853989 - DNA, 15 bp, Homo sapiens
caacagtgtgatcat

SEQ ID NO: 5853990 - DNA, 23 bp, Homo sapiens
caacagtgttaggcctggcacag

SEQ ID NO: 5853991 - DNA, 17 bp, Homo sapiens
caacagtgttctgagcc

SEQ ID NO: 5853992 - DNA, 18 bp, Homo sapiens
caacagtgttctgagccc

SEQ ID NO: 5853993 - DNA, 21 bp, Homo sapiens
caacagttactatagtggtga

SEQ ID NO: 5853994 - DNA, 12 bp, Homo sapiens
caacagttattg

SEQ ID NO: 5853995 - DNA, 22 bp, Homo sapiens
caacagttattgggcttaaaaa

SEQ ID NO: 5853996 - DNA, 16 bp, Homo sapiens
caacagttcaaagaag

SEQ ID NO: 5853997 - DNA, 22 bp, Homo sapiens
caacagttgtatgtttgctgat

SEQ ID NO: 5853998 - DNA, 21 bp, Homo sapiens
caacagtttctcaagtttaaa

SEQ ID NO: 5853999 - DNA, 18 bp, Homo sapiens
caacagtttgatgctgag

SEQ ID NO: 5854000 - DNA, 12 bp, Homo sapiens
caacagttttcc

SEQ ID NO: 5854001 - DNA, 15 bp, Homo sapiens
caacagtttttaaaa

SEQ ID NO: 5854002 - DNA, 20 bp, Homo sapiens
caacataaaacaaaaccaag

SEQ ID NO: 5854003 - DNA, 21 bp, Homo sapiens
caacataaaacaaaaccaagc

SEQ ID NO: 5854004 - DNA, 22 bp, Homo sapiens
caacataaaacaaaaccaagcc

SEQ ID NO: 5854005 - DNA, 12 bp, Homo sapiens
caacataaaact

SEQ ID NO: 5854006 - DNA, 17 bp, Homo sapiens
caacataacccacttgt

SEQ ID NO: 5854007 - DNA, 13 bp, Homo sapiens
caacataataaga

SEQ ID NO: 5854008 - DNA, 15 bp, Homo sapiens
caacatacaatttac

SEQ ID NO: 5854009 - DNA, 17 bp, Homo sapiens
caacatacccttcttta

SEQ ID NO: 5854010 - DNA, 20 bp, Homo sapiens
caacatacgggaagtttatt

SEQ ID NO: 5854011 - DNA, 20 bp, Homo sapiens
caacatactcccatctgtga

SEQ ID NO: 5854012 - DNA, 20 bp, Homo sapiens
caacatagtgagacactgtc

SEQ ID NO: 5854013 - DNA, 12 bp, Homo sapiens
caacatatacaa

SEQ ID NO: 5854014 - DNA, 14 bp, Homo sapiens
caacatatatttat

SEQ ID NO: 5854015 - DNA, 17 bp, Homo sapiens
caacatatatttattga

SEQ ID NO: 5854016 - DNA, 21 bp, Homo sapiens
caacatatatttattgagtac

SEQ ID NO: 5854017 - DNA, 13 bp, Homo sapiens
caacatatcagac

SEQ ID NO: 5854018 - DNA, 15 bp, Homo sapiens
caacatatcagactt

SEQ ID NO: 5854019 - DNA, 16 bp, Homo sapiens
caacatatctctgccg

SEQ ID NO: 5854020 - DNA, 16 bp, Homo sapiens
caacatcaatgttcat

SEQ ID NO: 5854021 - DNA, 18 bp, Homo sapiens
caacatcaatgttcattg

SEQ ID NO: 5854022 - DNA, 17 bp, Homo sapiens
caacatcacagcccagc

SEQ ID NO: 5854023 - DNA, 20 bp, Homo sapiens
caacatcacagcccagcccg

SEQ ID NO: 5854024 - DNA, 17 bp, Homo sapiens
caacatcaccagtgcca

SEQ ID NO: 5854025 - DNA, 13 bp, Homo sapiens
caacatcagcttg

SEQ ID NO: 5854026 - DNA, 12 bp, Homo sapiens
caacatccagat

SEQ ID NO: 5854027 - DNA, 23 bp, Homo sapiens
caacatccatgtcctatgtgtga

SEQ ID NO: 5854028 - DNA, 15 bp, Homo sapiens
caacatcccttacct

SEQ ID NO: 5854029 - DNA, 19 bp, Homo sapiens
caacatctcgagccccctg

SEQ ID NO: 5854030 - DNA, 13 bp, Homo sapiens
caacatctcttga

SEQ ID NO: 5854031 - DNA, 14 bp, Homo sapiens
caacatctcttgag

SEQ ID NO: 5854032 - DNA, 18 bp, Homo sapiens
caacatctcttgagtgtc

SEQ ID NO: 5854033 - DNA, 17 bp, Homo sapiens
caacatcttctctcttt

SEQ ID NO: 5854034 - DNA, 15 bp, Homo sapiens
caacatctttctttt

SEQ ID NO: 5854035 - DNA, 21 bp, Homo sapiens
caacatctttgcgaaaagata

SEQ ID NO: 5854036 - DNA, 23 bp, Homo sapiens
caacatctttttcctccctttcc

SEQ ID NO: 5854037 - DNA, 16 bp, Homo sapiens
caacatcttttttatt

SEQ ID NO: 5854038 - DNA, 17 bp, Homo sapiens
caacatgaattaagaac

SEQ ID NO: 5854039 - DNA, 18 bp, Homo sapiens
caacatgagtgtattttt

SEQ ID NO: 5854040 - DNA, 21 bp, Homo sapiens
caacatgcatgttctcctcta

SEQ ID NO: 5854041 - DNA, 23 bp, Homo sapiens
caacatgccagccactgtgatag

SEQ ID NO: 5854042 - DNA, 20 bp, Homo sapiens
caacatgcctgcacctgcag

SEQ ID NO: 5854043 - DNA, 19 bp, Homo sapiens
caacatgctccaaatataa

SEQ ID NO: 5854044 - DNA, 22 bp, Homo sapiens
caacatgcttcatgaaaatcct

SEQ ID NO: 5854045 - DNA, 19 bp, Homo sapiens
caacatggatacatatttc

SEQ ID NO: 5854046 - DNA, 15 bp, Homo sapiens
caacatggcttctcc

SEQ ID NO: 5854047 - DNA, 13 bp, Homo sapiens
caacatggctttg

SEQ ID NO: 5854048 - DNA, 18 bp, Homo sapiens
caacatggggcccctctc

SEQ ID NO: 5854049 - DNA, 13 bp, Homo sapiens
caacatggtccag

SEQ ID NO: 5854050 - DNA, 20 bp, Homo sapiens
caacatggtgaaaccctgtc

SEQ ID NO: 5854051 - DNA, 13 bp, Homo sapiens
caacatgtatctg

SEQ ID NO: 5854052 - DNA, 15 bp, Homo sapiens
caacatgtatctgtc

SEQ ID NO: 5854053 - DNA, 20 bp, Homo sapiens
caacatgtatctgtctactt

SEQ ID NO: 5854054 - DNA, 17 bp, Homo sapiens
caacatgtatgtggata

SEQ ID NO: 5854055 - DNA, 13 bp, Homo sapiens
caacatgtgatgt

SEQ ID NO: 5854056 - DNA, 18 bp, Homo sapiens
caacatgtggctcctccc

SEQ ID NO: 5854057 - DNA, 18 bp, Homo sapiens
caacatgttactgaccag

SEQ ID NO: 5854058 - DNA, 20 bp, Homo sapiens
caacatgttactgaccagca

SEQ ID NO: 5854059 - DNA, 16 bp, Homo sapiens
caacatgttcagaaaa

SEQ ID NO: 5854060 - DNA, 15 bp, Homo sapiens
caacatgttttatgt

SEQ ID NO: 5854061 - DNA, 13 bp, Homo sapiens
caacattaaaact

SEQ ID NO: 5854062 - DNA, 21 bp, Homo sapiens
caacattaaaactcataatta

SEQ ID NO: 5854063 - DNA, 15 bp, Homo sapiens
caacattaaacacaa

SEQ ID NO: 5854064 - DNA, 14 bp, Homo sapiens
caacattaatttta

SEQ ID NO: 5854065 - DNA, 19 bp, Homo sapiens
caacattaccttgtctttc

SEQ ID NO: 5854066 - DNA, 16 bp, Homo sapiens
caacattatcctgtgt

SEQ ID NO: 5854067 - DNA, 19 bp, Homo sapiens
caacattatcctgtgtgat

SEQ ID NO: 5854068 - DNA, 22 bp, Homo sapiens
caacattatcctgtgtgattac

SEQ ID NO: 5854069 - DNA, 19 bp, Homo sapiens
caacattatgatctaataa

SEQ ID NO: 5854070 - DNA, 20 bp, Homo sapiens
caacattatgatctaataaa

SEQ ID NO: 5854071 - DNA, 22 bp, Homo sapiens
caacattatgatctaataaact

SEQ ID NO: 5854072 - DNA, 14 bp, Homo sapiens
caacattattttaa

SEQ ID NO: 5854073 - DNA, 17 bp, Homo sapiens
caacattcaaaagcaca

SEQ ID NO: 5854074 - DNA, 21 bp, Homo sapiens
caacgcaaacctctccttcct

SEQ ID NO: 5854075 - DNA, 22 bp, Homo sapiens
caacgcaggaggagaaaagaaa

SEQ ID NO: 5854076 - DNA, 14 bp, Homo sapiens
caacgcattgccac

SEQ ID NO: 5854077 - DNA, 21 bp, Homo sapiens
caacgcccctccaaacctcca

SEQ ID NO: 5854078 - DNA, 16 bp, Homo sapiens
caacgcccctgtggcc

SEQ ID NO: 5854079 - DNA, 17 bp, Homo sapiens
caacgcccctgtggcca

SEQ ID NO: 5854080 - DNA, 16 bp, Homo sapiens
caacgcctccccctcc

SEQ ID NO: 5854081 - DNA, 21 bp, Homo sapiens
caacgcctgccttctgggcaa

SEQ ID NO: 5854082 - DNA, 21 bp, Homo sapiens
caacgctgattcctaaggccc

SEQ ID NO: 5854083 - DNA, 18 bp, Homo sapiens
caacgctgctgcctgctt

SEQ ID NO: 5854084 - DNA, 16 bp, Homo sapiens
caacggaagccaggcc

SEQ ID NO: 5854085 - DNA, 22 bp, Homo sapiens
caacggaagccccctcttcctc

SEQ ID NO: 5854086 - DNA, 12 bp, Homo sapiens
caacggccaggg

SEQ ID NO: 5854087 - DNA, 13 bp, Homo sapiens
caacggccagggt

SEQ ID NO: 5854088 - DNA, 18 bp, Homo sapiens
caacggccctgcagccag

SEQ ID NO: 5854089 - DNA, 19 bp, Homo sapiens
caacggccctgcagccagc

SEQ ID NO: 5854090 - DNA, 15 bp, Homo sapiens
caacgggaaaggaaa

SEQ ID NO: 5854091 - DNA, 16 bp, Homo sapiens
caacgggaacacctgc

SEQ ID NO: 5854092 - DNA, 17 bp, Homo sapiens
caacgggaagcaacctc

SEQ ID NO: 5854093 - DNA, 19 bp, Homo sapiens
caacggggggctcctgccc

SEQ ID NO: 5854094 - DNA, 23 bp, Homo sapiens
caacggggggctcctgcccaggc

SEQ ID NO: 5854095 - DNA, 15 bp, Homo sapiens
caacgggtctgtggg

SEQ ID NO: 5854096 - DNA, 23 bp, Homo sapiens
caacggtctcctgactggtgctg

SEQ ID NO: 5854097 - DNA, 15 bp, Homo sapiens
caacggtctggcagg

SEQ ID NO: 5854098 - DNA, 17 bp, Homo sapiens
caacgtaaaaataaaag

SEQ ID NO: 5854099 - DNA, 21 bp, Homo sapiens
caacgtactatggaagccaca

SEQ ID NO: 5854100 - DNA, 14 bp, Homo sapiens
caacgtcccctcaa

SEQ ID NO: 5854101 - DNA, 18 bp, Homo sapiens
caacgtcccctcaagccc

SEQ ID NO: 5854102 - DNA, 14 bp, Homo sapiens
caacgtcccctccg

SEQ ID NO: 5854103 - DNA, 19 bp, Homo sapiens
caacgtctttttgtttgtt

SEQ ID NO: 5854104 - DNA, 23 bp, Homo sapiens
caacgtgagagaaagagagaagc

SEQ ID NO: 5854105 - DNA, 13 bp, Homo sapiens
caacgtgcaactg

SEQ ID NO: 5854106 - DNA, 17 bp, Homo sapiens
caacgtgcattgtgctt

SEQ ID NO: 5854107 - DNA, 18 bp, Homo sapiens
caacgtgcattgtgcttc

SEQ ID NO: 5854108 - DNA, 14 bp, Homo sapiens
caacgtgcgtgtct

SEQ ID NO: 5854109 - DNA, 17 bp, Homo sapiens
caacgtggacctgccta

SEQ ID NO: 5854110 - DNA, 19 bp, Homo sapiens
caacgtggcccagagaagc

SEQ ID NO: 5854111 - DNA, 20 bp, Homo sapiens
caacgtggcccagagaagcc

SEQ ID NO: 5854112 - DNA, 17 bp, Homo sapiens
caacgtggcttaattgt

SEQ ID NO: 5854113 - DNA, 18 bp, Homo sapiens
caacgtggggcagcacag

SEQ ID NO: 5854114 - DNA, 23 bp, Homo sapiens
caacgtgtaaccagttataaata

SEQ ID NO: 5854115 - DNA, 13 bp, Homo sapiens
caacgtgttaatt

SEQ ID NO: 5854116 - DNA, 15 bp, Homo sapiens
caacgttactcaggg

SEQ ID NO: 5854117 - DNA, 23 bp, Homo sapiens
caacgttgtactgtatgtgatga

SEQ ID NO: 5854118 - DNA, 23 bp, Homo sapiens
caactaaaaaaatttttgacact

SEQ ID NO: 5854119 - DNA, 16 bp, Homo sapiens
caactaaaaataaatt

SEQ ID NO: 5854120 - DNA, 13 bp, Homo sapiens
caactaaaattag

SEQ ID NO: 5854121 - DNA, 17 bp, Homo sapiens
caactaaaatttgaagt

SEQ ID NO: 5854122 - DNA, 22 bp, Homo sapiens
caactaaagaatagtgcctcag

SEQ ID NO: 5854123 - DNA, 20 bp, Homo sapiens
caactaaagttgtactttaa

SEQ ID NO: 5854124 - DNA, 12 bp, Homo sapiens
caactaaataac

SEQ ID NO: 5854125 - DNA, 17 bp, Homo sapiens
caactaaataacacaga

SEQ ID NO: 5854126 - DNA, 14 bp, Homo sapiens
caactaacaatgcc

SEQ ID NO: 5854127 - DNA, 14 bp, Homo sapiens
caactaagccctcg

SEQ ID NO: 5854128 - DNA, 14 bp, Homo sapiens
caactaaggacaaa

SEQ ID NO: 5854129 - DNA, 13 bp, Homo sapiens
caactaattataa

SEQ ID NO: 5854130 - DNA, 14 bp, Homo sapiens
caactaatttttgt

SEQ ID NO: 5854131 - DNA, 18 bp, Homo sapiens
caactacacaaagcaggc

SEQ ID NO: 5854132 - DNA, 20 bp, Homo sapiens
caactacagccaaattgcag

SEQ ID NO: 5854133 - DNA, 19 bp, Homo sapiens
caactacagtctaaagctg

SEQ ID NO: 5854134 - DNA, 22 bp, Homo sapiens
caactacccaaaacaagcctgg

SEQ ID NO: 5854135 - DNA, 17 bp, Homo sapiens
caactacccccagctgt

SEQ ID NO: 5854136 - DNA, 20 bp, Homo sapiens
caactacccccagctgtgct

SEQ ID NO: 5854137 - DNA, 15 bp, Homo sapiens
caactacctgagcta

SEQ ID NO: 5854138 - DNA, 19 bp, Homo sapiens
caactactagtgtgactcc

SEQ ID NO: 5854139 - DNA, 14 bp, Homo sapiens
caactactcagaag

SEQ ID NO: 5854140 - DNA, 23 bp, Homo sapiens
caactactcagaaggccgaggca

SEQ ID NO: 5854141 - DNA, 17 bp, Homo sapiens
caactactgtgttatgc

SEQ ID NO: 5854142 - DNA, 21 bp, Homo sapiens
caactagacattctgtcgcct

SEQ ID NO: 5854143 - DNA, 21 bp, Homo sapiens
caactagatcaaggagcccag

SEQ ID NO: 5854144 - DNA, 12 bp, Homo sapiens
caactagatttg

SEQ ID NO: 5854145 - DNA, 22 bp, Homo sapiens
caactagatttgtccttttatt

SEQ ID NO: 5854146 - DNA, 18 bp, Homo sapiens
caactagcccctggggtg

SEQ ID NO: 5854147 - DNA, 13 bp, Homo sapiens
caactagctggga

SEQ ID NO: 5854148 - DNA, 15 bp, Homo sapiens
caactaggacctcat

SEQ ID NO: 5854149 - DNA, 15 bp, Homo sapiens
caactaggatcagaa

SEQ ID NO: 5854150 - DNA, 17 bp, Homo sapiens
caactaggcttcagcat

SEQ ID NO: 5854151 - DNA, 16 bp, Homo sapiens
caactaggggaggaga

SEQ ID NO: 5854152 - DNA, 18 bp, Homo sapiens
caactaggggaggagaga

SEQ ID NO: 5854153 - DNA, 19 bp, Homo sapiens
caactaggtatttaagact

SEQ ID NO: 5854154 - DNA, 19 bp, Homo sapiens
caactataagcccactgtt

SEQ ID NO: 5854155 - DNA, 19 bp, Homo sapiens
caactatattatcatgcaa

SEQ ID NO: 5854156 - DNA, 19 bp, Homo sapiens
caactatgatttggaaaat

SEQ ID NO: 5854157 - DNA, 17 bp, Homo sapiens
caactatggatcagaat

SEQ ID NO: 5854158 - DNA, 13 bp, Homo sapiens
caactatggcctg

SEQ ID NO: 5854159 - DNA, 16 bp, Homo sapiens
caactatggctgttga

SEQ ID NO: 5854160 - DNA, 13 bp, Homo sapiens
caactatgtaggt

SEQ ID NO: 5854161 - DNA, 18 bp, Homo sapiens
caactattaaagtgccat

SEQ ID NO: 5854162 - DNA, 22 bp, Homo sapiens
caactatttattgactctgggt

SEQ ID NO: 5854163 - DNA, 17 bp, Homo sapiens
caactatttcaataagt

SEQ ID NO: 5854164 - DNA, 15 bp, Homo sapiens
caactatttctttca

SEQ ID NO: 5854165 - DNA, 20 bp, Homo sapiens
caactatttttccaaaataa

SEQ ID NO: 5854166 - DNA, 19 bp, Homo sapiens
caactcaagttataggaaa

SEQ ID NO: 5854167 - DNA, 22 bp, Homo sapiens
caactcacacattcccccacca

SEQ ID NO: 5854168 - DNA, 21 bp, Homo sapiens
caactcacattgttcaactcc

SEQ ID NO: 5854169 - DNA, 22 bp, Homo sapiens
caactcacattgttcaactccc

SEQ ID NO: 5854170 - DNA, 16 bp, Homo sapiens
caactcaccccagccc

SEQ ID NO: 5854171 - DNA, 16 bp, Homo sapiens
caactcactcctttta

SEQ ID NO: 5854172 - DNA, 20 bp, Homo sapiens
caactcactccttttaaaga

SEQ ID NO: 5854173 - DNA, 21 bp, Homo sapiens
caactcactccttttaaagaa

SEQ ID NO: 5854174 - DNA, 12 bp, Homo sapiens
caactcactgtg

SEQ ID NO: 5854175 - DNA, 13 bp, Homo sapiens
caactcactgtgc

SEQ ID NO: 5854176 - DNA, 15 bp, Homo sapiens
caactcacttccagt

SEQ ID NO: 5854177 - DNA, 16 bp, Homo sapiens
caactcagagcacagc

SEQ ID NO: 5854178 - DNA, 11 bp, Homo sapiens
caactcagcct

SEQ ID NO: 5854179 - DNA, 17 bp, Homo sapiens
caactcagcctgttcct

SEQ ID NO: 5854180 - DNA, 21 bp, Homo sapiens
caactcaggttcacagcagct

SEQ ID NO: 5854181 - DNA, 22 bp, Homo sapiens
caactcagtctgtgggagctca

SEQ ID NO: 5854182 - DNA, 13 bp, Homo sapiens
caactcatcattt

SEQ ID NO: 5854183 - DNA, 21 bp, Homo sapiens
caactcatccagaactgtctt

SEQ ID NO: 5854184 - DNA, 15 bp, Homo sapiens
caactcattctgatc

SEQ ID NO: 5854185 - DNA, 20 bp, Homo sapiens
caactccaaacaattctgat

SEQ ID NO: 5854186 - DNA, 21 bp, Homo sapiens
caactccaaacaattctgatg

SEQ ID NO: 5854187 - DNA, 20 bp, Homo sapiens
caactccaacatccactctc

SEQ ID NO: 5854188 - DNA, 22 bp, Homo sapiens
caactccaaggcaaatgtccaa

SEQ ID NO: 5854189 - DNA, 11 bp, Homo sapiens
caactccacag

SEQ ID NO: 5854190 - DNA, 22 bp, Homo sapiens
caactccagcaacttcttctcc

SEQ ID NO: 5854191 - DNA, 22 bp, Homo sapiens
caactccagccacccagccagg

SEQ ID NO: 5854192 - DNA, 13 bp, Homo sapiens
caactccagctcc

SEQ ID NO: 5854193 - DNA, 18 bp, Homo sapiens
caactccaggaaaactgt

SEQ ID NO: 5854194 - DNA, 19 bp, Homo sapiens
caactccaggaaaactgtt

SEQ ID NO: 5854195 - DNA, 15 bp, Homo sapiens
caactccaggattta

SEQ ID NO: 5854196 - DNA, 14 bp, Homo sapiens
caactccaggggca

SEQ ID NO: 5854197 - DNA, 23 bp, Homo sapiens
caactccagggttaaagaaaggc

SEQ ID NO: 5854198 - DNA, 19 bp, Homo sapiens
caactccagtactggagct

SEQ ID NO: 5854199 - DNA, 20 bp, Homo sapiens
caactccatgaccaggccac

SEQ ID NO: 5854200 - DNA, 12 bp, Homo sapiens
caactccatgcc

SEQ ID NO: 5854201 - DNA, 14 bp, Homo sapiens
caactccatgccta

SEQ ID NO: 5854202 - DNA, 15 bp, Homo sapiens
caactcccaacttct

SEQ ID NO: 5854203 - DNA, 17 bp, Homo sapiens
caactcccacgactgtt

SEQ ID NO: 5854204 - DNA, 12 bp, Homo sapiens
caactcccagcc

SEQ ID NO: 5854205 - DNA, 22 bp, Homo sapiens
caactcccttaaggtctccaaa

SEQ ID NO: 5854206 - DNA, 22 bp, Homo sapiens
caactcccttctgcttgtccca

SEQ ID NO: 5854207 - DNA, 19 bp, Homo sapiens
caactccgcccagcctctc

SEQ ID NO: 5854208 - DNA, 17 bp, Homo sapiens
caactccgtgtgcctgg

SEQ ID NO: 5854209 - DNA, 16 bp, Homo sapiens
caactcctagttctag

SEQ ID NO: 5854210 - DNA, 19 bp, Homo sapiens
caactcctagttctagaaa

SEQ ID NO: 5854211 - DNA, 20 bp, Homo sapiens
caactcctagttctagaaaa

SEQ ID NO: 5854212 - DNA, 22 bp, Homo sapiens
caactcctagttctagaaaaac

SEQ ID NO: 5854213 - DNA, 17 bp, Homo sapiens
caactcctggaagctgt

SEQ ID NO: 5854214 - DNA, 11 bp, Homo sapiens
caactcctggc

SEQ ID NO: 5854215 - DNA, 13 bp, Homo sapiens
caactcctggctc

SEQ ID NO: 5854216 - DNA, 12 bp, Homo sapiens
caactccttcct

SEQ ID NO: 5854217 - DNA, 15 bp, Homo sapiens
caactccttcctctt

SEQ ID NO: 5854218 - DNA, 22 bp, Homo sapiens
caactcgggagcattctgcctg

SEQ ID NO: 5854219 - DNA, 21 bp, Homo sapiens
caactcgggggcgcctggagg

SEQ ID NO: 5854220 - DNA, 14 bp, Homo sapiens
caactcgtgacagc

SEQ ID NO: 5854221 - DNA, 22 bp, Homo sapiens
caactcgtgacagcctctgact

SEQ ID NO: 5854222 - DNA, 16 bp, Homo sapiens
caactctaacaggcac

SEQ ID NO: 5854223 - DNA, 18 bp, Homo sapiens
caactctaactctgagag

SEQ ID NO: 5854224 - DNA, 17 bp, Homo sapiens
caactctaatattgctt

SEQ ID NO: 5854225 - DNA, 15 bp, Homo sapiens
caactctacccctgc

SEQ ID NO: 5854226 - DNA, 12 bp, Homo sapiens
caactctccaaa

SEQ ID NO: 5854227 - DNA, 16 bp, Homo sapiens
caactctccactccat

SEQ ID NO: 5854228 - DNA, 14 bp, Homo sapiens
caactctccccagt

SEQ ID NO: 5854229 - DNA, 19 bp, Homo sapiens
caactctccccagtgcctg

SEQ ID NO: 5854230 - DNA, 22 bp, Homo sapiens
caactctccccagtgcctgcca

SEQ ID NO: 5854231 - DNA, 23 bp, Homo sapiens
caactctccccagtgcctgccac

SEQ ID NO: 5854232 - DNA, 18 bp, Homo sapiens
caactctcccctgacctg

SEQ ID NO: 5854233 - DNA, 17 bp, Homo sapiens
caactctctctgccccc

SEQ ID NO: 5854234 - DNA, 16 bp, Homo sapiens
caactctcttattgcc

SEQ ID NO: 5854235 - DNA, 21 bp, Homo sapiens
caactctgaagggtaattata

SEQ ID NO: 5854236 - DNA, 13 bp, Homo sapiens
caactctgactgt

SEQ ID NO: 5854237 - DNA, 13 bp, Homo sapiens
caactctgagccc

SEQ ID NO: 5854238 - DNA, 14 bp, Homo sapiens
caactctgagccca

SEQ ID NO: 5854239 - DNA, 16 bp, Homo sapiens
caactctgatgtggaa

SEQ ID NO: 5854240 - DNA, 13 bp, Homo sapiens
caactctgcactc

SEQ ID NO: 5854241 - DNA, 19 bp, Homo sapiens
caactctgcactccatggc

SEQ ID NO: 5854242 - DNA, 23 bp, Homo sapiens
caactctgcactccatggccacc

SEQ ID NO: 5854243 - DNA, 16 bp, Homo sapiens
caactctgctgagggt

SEQ ID NO: 5854244 - DNA, 22 bp, Homo sapiens
caactctgctgagggtccagaa

SEQ ID NO: 5854245 - DNA, 21 bp, Homo sapiens
caactctggctccaggcagaa

SEQ ID NO: 5854246 - DNA, 13 bp, Homo sapiens
caactctgtattt

SEQ ID NO: 5854247 - DNA, 13 bp, Homo sapiens
caactctgtgagg

SEQ ID NO: 5854248 - DNA, 19 bp, Homo sapiens
caactcttatttctttcct

SEQ ID NO: 5854249 - DNA, 16 bp, Homo sapiens
caactcttcctcccct

SEQ ID NO: 5854250 - DNA, 19 bp, Homo sapiens
caactcttcgaagccttgc

SEQ ID NO: 5854251 - DNA, 15 bp, Homo sapiens
caagacagaggggag

SEQ ID NO: 5854252 - DNA, 11 bp, Homo sapiens
caagacagagt

SEQ ID NO: 5854253 - DNA, 13 bp, Homo sapiens
caagacagagtct

SEQ ID NO: 5854254 - DNA, 16 bp, Homo sapiens
caagacagcagcagcc

SEQ ID NO: 5854255 - DNA, 22 bp, Homo sapiens
caagacagcagcagcctgcacc

SEQ ID NO: 5854256 - DNA, 14 bp, Homo sapiens
caagacagcagtct

SEQ ID NO: 5854257 - DNA, 14 bp, Homo sapiens
caagacagccttca

SEQ ID NO: 5854258 - DNA, 21 bp, Homo sapiens
caagacagtgagacagtctgg

SEQ ID NO: 5854259 - DNA, 19 bp, Homo sapiens
caagacagtggcactaaaa

SEQ ID NO: 5854260 - DNA, 21 bp, Homo sapiens
caagacagtggcagcaaagga

SEQ ID NO: 5854261 - DNA, 23 bp, Homo sapiens
caagacagtggcagcaaaggaag

SEQ ID NO: 5854262 - DNA, 21 bp, Homo sapiens
caagacataatttaaaataaa

SEQ ID NO: 5854263 - DNA, 17 bp, Homo sapiens
caagacatgtctgttct

SEQ ID NO: 5854264 - DNA, 11 bp, Homo sapiens
caagacattgt

SEQ ID NO: 5854265 - DNA, 14 bp, Homo sapiens
caagacattgtcaa

SEQ ID NO: 5854266 - DNA, 17 bp, Homo sapiens
caagacattgtcaataa

SEQ ID NO: 5854267 - DNA, 11 bp, Homo sapiens
caagacatttg

SEQ ID NO: 5854268 - DNA, 13 bp, Homo sapiens
caagacatttgct

SEQ ID NO: 5854269 - DNA, 16 bp, Homo sapiens
caagacatttgctgaa

SEQ ID NO: 5854270 - DNA, 18 bp, Homo sapiens
caagaccaaaatgacaat

SEQ ID NO: 5854271 - DNA, 15 bp, Homo sapiens
caagaccaaatggaa

SEQ ID NO: 5854272 - DNA, 21 bp, Homo sapiens
caagaccaagtcctcaaagca

SEQ ID NO: 5854273 - DNA, 21 bp, Homo sapiens
caagaccaccagggtcccagg

SEQ ID NO: 5854274 - DNA, 18 bp, Homo sapiens
caagaccacgtttctaaa

SEQ ID NO: 5854275 - DNA, 15 bp, Homo sapiens
caagaccagcctggc

SEQ ID NO: 5854276 - DNA, 22 bp, Homo sapiens
caagaccagcctgggcaacacg

SEQ ID NO: 5854277 - DNA, 14 bp, Homo sapiens
caagaccagcctgt

SEQ ID NO: 5854278 - DNA, 17 bp, Homo sapiens
caagaccaggctgcagc

SEQ ID NO: 5854279 - DNA, 18 bp, Homo sapiens
caagaccatttcacagaa

SEQ ID NO: 5854280 - DNA, 15 bp, Homo sapiens
caagaccatttgtag

SEQ ID NO: 5854281 - DNA, 12 bp, Homo sapiens
caagacccccag

SEQ ID NO: 5854282 - DNA, 15 bp, Homo sapiens
caagacccccagcac

SEQ ID NO: 5854283 - DNA, 16 bp, Homo sapiens
caagacccccagcact

SEQ ID NO: 5854284 - DNA, 17 bp, Homo sapiens
caagacccccaggaagg

SEQ ID NO: 5854285 - DNA, 21 bp, Homo sapiens
caagacccccatttgtcccag

SEQ ID NO: 5854286 - DNA, 21 bp, Homo sapiens
caagacccggttattcgccca

SEQ ID NO: 5854287 - DNA, 22 bp, Homo sapiens
caagacccggttattcgcccac

SEQ ID NO: 5854288 - DNA, 12 bp, Homo sapiens
caagaccctctc

SEQ ID NO: 5854289 - DNA, 23 bp, Homo sapiens
caagaccctctcaggctgtccca

SEQ ID NO: 5854290 - DNA, 14 bp, Homo sapiens
caagaccctgtctc

SEQ ID NO: 5854291 - DNA, 22 bp, Homo sapiens
caagacccttgtggtcccaccc

SEQ ID NO: 5854292 - DNA, 17 bp, Homo sapiens
caagaccgccccagggc

SEQ ID NO: 5854293 - DNA, 16 bp, Homo sapiens
caagacctcacacaca

SEQ ID NO: 5854294 - DNA, 14 bp, Homo sapiens
caagacctcatctc

SEQ ID NO: 5854295 - DNA, 16 bp, Homo sapiens
caagacctcatctcta

SEQ ID NO: 5854296 - DNA, 15 bp, Homo sapiens
caagacctcatctgc

SEQ ID NO: 5854297 - DNA, 17 bp, Homo sapiens
caagacctcatctgtgg

SEQ ID NO: 5854298 - DNA, 23 bp, Homo sapiens
caagacctcatctgtggagctgc

SEQ ID NO: 5854299 - DNA, 19 bp, Homo sapiens
caagacctcttccctctgg

SEQ ID NO: 5854300 - DNA, 21 bp, Homo sapiens
caagacctcttccctctgggc

SEQ ID NO: 5854301 - DNA, 23 bp, Homo sapiens
caagacctcttccctctgggcct

SEQ ID NO: 5854302 - DNA, 20 bp, Homo sapiens
caagaccttcaccaaacata

SEQ ID NO: 5854303 - DNA, 22 bp, Homo sapiens
caagaccttggcctctccttgg

SEQ ID NO: 5854304 - DNA, 13 bp, Homo sapiens
caagacgaggggc

SEQ ID NO: 5854305 - DNA, 17 bp, Homo sapiens
caagacgaggggcaggg

SEQ ID NO: 5854306 - DNA, 20 bp, Homo sapiens
caagacgaggggcagggaag

SEQ ID NO: 5854307 - DNA, 15 bp, Homo sapiens
caagacgctgtgctg

SEQ ID NO: 5854308 - DNA, 17 bp, Homo sapiens
caagacgctgtgctgcc

SEQ ID NO: 5854309 - DNA, 23 bp, Homo sapiens
caagacgctgtgctgccctgccc

SEQ ID NO: 5854310 - DNA, 15 bp, Homo sapiens
caagacgtcctggaa

SEQ ID NO: 5854311 - DNA, 17 bp, Homo sapiens
caagacgtttaactgca

SEQ ID NO: 5854312 - DNA, 22 bp, Homo sapiens
caagactagactactcaatatt

SEQ ID NO: 5854313 - DNA, 19 bp, Homo sapiens
caagactatctacaaaaat

SEQ ID NO: 5854314 - DNA, 20 bp, Homo sapiens
caagactcagatgatgccag

SEQ ID NO: 5854315 - DNA, 15 bp, Homo sapiens
caagactccatttca

SEQ ID NO: 5854316 - DNA, 19 bp, Homo sapiens
caagactccgtctcaaaaa

SEQ ID NO: 5854317 - DNA, 15 bp, Homo sapiens
caagactcctcaggc

SEQ ID NO: 5854318 - DNA, 17 bp, Homo sapiens
caagactctagagtcca

SEQ ID NO: 5854319 - DNA, 16 bp, Homo sapiens
caagactctatgctct

SEQ ID NO: 5854320 - DNA, 23 bp, Homo sapiens
caagactctgccttaatttttga

SEQ ID NO: 5854321 - DNA, 13 bp, Homo sapiens
caagactctgctc

SEQ ID NO: 5854322 - DNA, 14 bp, Homo sapiens
caagactctgtctc

SEQ ID NO: 5854323 - DNA, 22 bp, Homo sapiens
caagactgaagatggcttttcc

SEQ ID NO: 5854324 - DNA, 16 bp, Homo sapiens
caagactgacgccagg

SEQ ID NO: 5854325 - DNA, 11 bp, Homo sapiens
caagactgatc

SEQ ID NO: 5854326 - DNA, 13 bp, Homo sapiens
caagactgcaaac

SEQ ID NO: 5854327 - DNA, 17 bp, Homo sapiens
caagactgcctccctct

SEQ ID NO: 5854328 - DNA, 20 bp, Homo sapiens
caagactgctgtggccagga

SEQ ID NO: 5854329 - DNA, 23 bp, Homo sapiens
caagactgctgtggccaggaggt

SEQ ID NO: 5854330 - DNA, 15 bp, Homo sapiens
caagactgggctgta

SEQ ID NO: 5854331 - DNA, 22 bp, Homo sapiens
caagactgtaaattccaaagat

SEQ ID NO: 5854332 - DNA, 23 bp, Homo sapiens
caagactgtggtattggggtctt

SEQ ID NO: 5854333 - DNA, 16 bp, Homo sapiens
caagactgttagccct

SEQ ID NO: 5854334 - DNA, 16 bp, Homo sapiens
caagactgttgctcaa

SEQ ID NO: 5854335 - DNA, 17 bp, Homo sapiens
caagactgttgctcaaa

SEQ ID NO: 5854336 - DNA, 16 bp, Homo sapiens
caagactgttgtgatc

SEQ ID NO: 5854337 - DNA, 17 bp, Homo sapiens
caagacttcactgcagc

SEQ ID NO: 5854338 - DNA, 20 bp, Homo sapiens
caagacttcactgcagcctt

SEQ ID NO: 5854339 - DNA, 21 bp, Homo sapiens
caagacttcactgcagccttt

SEQ ID NO: 5854340 - DNA, 21 bp, Homo sapiens
caagacttcagattcagccga

SEQ ID NO: 5854341 - DNA, 19 bp, Homo sapiens
caagacttcgggaaggtgt

SEQ ID NO: 5854342 - DNA, 20 bp, Homo sapiens
caagacttctctttgcctca

SEQ ID NO: 5854343 - DNA, 17 bp, Homo sapiens
caagacttgaaggtgcc

SEQ ID NO: 5854344 - DNA, 19 bp, Homo sapiens
caagactttagcttttcct

SEQ ID NO: 5854345 - DNA, 15 bp, Homo sapiens
caagactttgatcct

SEQ ID NO: 5854346 - DNA, 18 bp, Homo sapiens
caagacttttaaaagact

SEQ ID NO: 5854347 - DNA, 18 bp, Homo sapiens
caagagaaaattcctaga

SEQ ID NO: 5854348 - DNA, 17 bp, Homo sapiens
caagagaaacaaataaa

SEQ ID NO: 5854349 - DNA, 22 bp, Homo sapiens
caagagaaacattctttcctaa

SEQ ID NO: 5854350 - DNA, 12 bp, Homo sapiens
caagagaaactt

SEQ ID NO: 5854351 - DNA, 20 bp, Homo sapiens
caagagaaaggcctgcacac

SEQ ID NO: 5854352 - DNA, 22 bp, Homo sapiens
caagagaaaggcctgcacacaa

SEQ ID NO: 5854353 - DNA, 20 bp, Homo sapiens
caagagaaatgaggaagaat

SEQ ID NO: 5854354 - DNA, 22 bp, Homo sapiens
caagagaaatgaggaagaatcc

SEQ ID NO: 5854355 - DNA, 16 bp, Homo sapiens
caagagaacatttcta

SEQ ID NO: 5854356 - DNA, 15 bp, Homo sapiens
caagagaacatttta

SEQ ID NO: 5854357 - DNA, 18 bp, Homo sapiens
caagagaacattttactg

SEQ ID NO: 5854358 - DNA, 24 bp, Homo sapiens
caagagaactcgcgctcagtaaac

SEQ ID NO: 5854359 - DNA, 13 bp, Homo sapiens
caagagaagcatt

SEQ ID NO: 5854360 - DNA, 14 bp, Homo sapiens
caagagaagcattc

SEQ ID NO: 5854361 - DNA, 16 bp, Homo sapiens
caagagaagcattctc

SEQ ID NO: 5854362 - DNA, 22 bp, Homo sapiens
caagagaagcattctcattgga

SEQ ID NO: 5854363 - DNA, 14 bp, Homo sapiens
caagagaaggagat

SEQ ID NO: 5854364 - DNA, 16 bp, Homo sapiens
caagagaaggagatgt

SEQ ID NO: 5854365 - DNA, 18 bp, Homo sapiens
caagagaaggcttttcta

SEQ ID NO: 5854366 - DNA, 11 bp, Homo sapiens
caagagaaggg

SEQ ID NO: 5854367 - DNA, 12 bp, Homo sapiens
caagagaagggc

SEQ ID NO: 5854368 - DNA, 15 bp, Homo sapiens
caagagaagggctta

SEQ ID NO: 5854369 - DNA, 12 bp, Homo sapiens
caagagaatcaa

SEQ ID NO: 5854370 - DNA, 12 bp, Homo sapiens
caagagaatctg

SEQ ID NO: 5854371 - DNA, 15 bp, Homo sapiens
caagagaattcactt

SEQ ID NO: 5854372 - DNA, 16 bp, Homo sapiens
caagagacacaattac

SEQ ID NO: 5854373 - DNA, 21 bp, Homo sapiens
caagagacagagcccccaagc

SEQ ID NO: 5854374 - DNA, 16 bp, Homo sapiens
caagagacatggaaga

SEQ ID NO: 5854375 - DNA, 16 bp, Homo sapiens
caagagaccaactttt

SEQ ID NO: 5854376 - DNA, 16 bp, Homo sapiens
caagagaccacttcct

SEQ ID NO: 5854377 - DNA, 21 bp, Homo sapiens
caagagaccacttccttaaca

SEQ ID NO: 5854378 - DNA, 19 bp, Homo sapiens
caagagacccttcaaactt

SEQ ID NO: 5854379 - DNA, 18 bp, Homo sapiens
caagagactactctgcct

SEQ ID NO: 5854380 - DNA, 15 bp, Homo sapiens
caagagactgagtca

SEQ ID NO: 5854381 - DNA, 18 bp, Homo sapiens
caagagactgcttgacaa

SEQ ID NO: 5854382 - DNA, 17 bp, Homo sapiens
caagagagaaagaagta

SEQ ID NO: 5854383 - DNA, 10 bp, Homo sapiens
caagagagac

SEQ ID NO: 5854384 - DNA, 22 bp, Homo sapiens
caagagagacagcacaggcagc

SEQ ID NO: 5854385 - DNA, 18 bp, Homo sapiens
caagagagacatggaaaa

SEQ ID NO: 5854386 - DNA, 23 bp, Homo sapiens
caagagagagagagaatgagaga

SEQ ID NO: 5854387 - DNA, 23 bp, Homo sapiens
caagagagagctcgctcttggga

SEQ ID NO: 5854388 - DNA, 15 bp, Homo sapiens
caagagagatgtttt

SEQ ID NO: 5854389 - DNA, 19 bp, Homo sapiens
caagagagcagcgcccagg

SEQ ID NO: 5854390 - DNA, 12 bp, Homo sapiens
caagagagcctc

SEQ ID NO: 5854391 - DNA, 16 bp, Homo sapiens
caagagagcctcttgt

SEQ ID NO: 5854392 - DNA, 18 bp, Homo sapiens
caagagagcctcttgtgg

SEQ ID NO: 5854393 - DNA, 20 bp, Homo sapiens
caagagagcgagaccctgtc

SEQ ID NO: 5854394 - DNA, 12 bp, Homo sapiens
caagagaggaag

SEQ ID NO: 5854395 - DNA, 20 bp, Homo sapiens
caagagaggaggaaaaacag

SEQ ID NO: 5854396 - DNA, 14 bp, Homo sapiens
caagagagggcaag

SEQ ID NO: 5854397 - DNA, 16 bp, Homo sapiens
caagagataagtcttt

SEQ ID NO: 5854398 - DNA, 18 bp, Homo sapiens
caagagatattttgggca

SEQ ID NO: 5854399 - DNA, 14 bp, Homo sapiens
caagagatctacac

SEQ ID NO: 5854400 - DNA, 19 bp, Homo sapiens
caagagatctacacatgtt

SEQ ID NO: 5854401 - DNA, 14 bp, Homo sapiens
caagagcaaaatga

SEQ ID NO: 5854402 - DNA, 14 bp, Homo sapiens
caagagcaaagtag

SEQ ID NO: 5854403 - DNA, 14 bp, Homo sapiens
caagagcaagggct

SEQ ID NO: 5854404 - DNA, 18 bp, Homo sapiens
caagagcaatcaaagcag

SEQ ID NO: 5854405 - DNA, 14 bp, Homo sapiens
caagagcacacttg

SEQ ID NO: 5854406 - DNA, 22 bp, Homo sapiens
caagagcacattcttaaaggaa

SEQ ID NO: 5854407 - DNA, 14 bp, Homo sapiens
caagagcagagtct

SEQ ID NO: 5854408 - DNA, 19 bp, Homo sapiens
caagagcagagtctgggcc

SEQ ID NO: 5854409 - DNA, 20 bp, Homo sapiens
caagagcagagtctgggcct

SEQ ID NO: 5854410 - DNA, 15 bp, Homo sapiens
caagagcagcctgtg

SEQ ID NO: 5854411 - DNA, 16 bp, Homo sapiens
caagagcagcctgtgg

SEQ ID NO: 5854412 - DNA, 17 bp, Homo sapiens
caagagcagcctgtggc

SEQ ID NO: 5854413 - DNA, 12 bp, Homo sapiens
caagagccaagt

SEQ ID NO: 5854414 - DNA, 13 bp, Homo sapiens
caagagccagggg

SEQ ID NO: 5854415 - DNA, 22 bp, Homo sapiens
caagagccatgtaccagtgtac

SEQ ID NO: 5854416 - DNA, 20 bp, Homo sapiens
caagagccatgtagaagctg

SEQ ID NO: 5854417 - DNA, 15 bp, Homo sapiens
caagagcccagatca

SEQ ID NO: 5854418 - DNA, 15 bp, Homo sapiens
caagagcccaggcct

SEQ ID NO: 5854419 - DNA, 16 bp, Homo sapiens
caagagcccaggcctc

SEQ ID NO: 5854420 - DNA, 13 bp, Homo sapiens
caagagccctgtc

SEQ ID NO: 5854421 - DNA, 17 bp, Homo sapiens
caagagcccttccagga

SEQ ID NO: 5854422 - DNA, 17 bp, Homo sapiens
caagagcctgagactgg

SEQ ID NO: 5854423 - DNA, 14 bp, Homo sapiens
caagagcctgatct

SEQ ID NO: 5854424 - DNA, 16 bp, Homo sapiens
caagagcctgatctct

SEQ ID NO: 5854425 - DNA, 19 bp, Homo sapiens
caagagcctgatctcttcc

SEQ ID NO: 5854426 - DNA, 18 bp, Homo sapiens
caagagcctgattttttg

SEQ ID NO: 5854427 - DNA, 15 bp, Homo sapiens
caagagccttaaaac

SEQ ID NO: 5854428 - DNA, 12 bp, Homo sapiens
caagagccttgg

SEQ ID NO: 5854429 - DNA, 18 bp, Homo sapiens
caagagccttggtgtcca

SEQ ID NO: 5854430 - DNA, 17 bp, Homo sapiens
caagctcctcctccctg

SEQ ID NO: 5854431 - DNA, 23 bp, Homo sapiens
caagctcctcctccctgcatctg

SEQ ID NO: 5854432 - DNA, 22 bp, Homo sapiens
caagctccttgggaggccccac

SEQ ID NO: 5854433 - DNA, 17 bp, Homo sapiens
caagctctagtgggaag

SEQ ID NO: 5854434 - DNA, 23 bp, Homo sapiens
caagctctcagcaagtgcccagt

SEQ ID NO: 5854435 - DNA, 13 bp, Homo sapiens
caagctctctgca

SEQ ID NO: 5854436 - DNA, 23 bp, Homo sapiens
caagctctgagggaaagggccct

SEQ ID NO: 5854437 - DNA, 15 bp, Homo sapiens
caagctctgccctgg

SEQ ID NO: 5854438 - DNA, 16 bp, Homo sapiens
caagctctgcctcccg

SEQ ID NO: 5854439 - DNA, 20 bp, Homo sapiens
caagctctgcctcccgggtt

SEQ ID NO: 5854440 - DNA, 13 bp, Homo sapiens
caagctctgctcc

SEQ ID NO: 5854441 - DNA, 15 bp, Homo sapiens
caagctctgctcctc

SEQ ID NO: 5854442 - DNA, 17 bp, Homo sapiens
caagctctggggatggg

SEQ ID NO: 5854443 - DNA, 18 bp, Homo sapiens
caagctcttcccttgctc

SEQ ID NO: 5854444 - DNA, 19 bp, Homo sapiens
caagctcttcccttgctca

SEQ ID NO: 5854445 - DNA, 22 bp, Homo sapiens
caagctcttgccccactccctg

SEQ ID NO: 5854446 - DNA, 11 bp, Homo sapiens
caagctcttgt

SEQ ID NO: 5854447 - DNA, 15 bp, Homo sapiens
caagctcttgtttct

SEQ ID NO: 5854448 - DNA, 16 bp, Homo sapiens
caagctcttgtttctg

SEQ ID NO: 5854449 - DNA, 15 bp, Homo sapiens
caagctgaagctaca

SEQ ID NO: 5854450 - DNA, 13 bp, Homo sapiens
caagctgaagtga

SEQ ID NO: 5854451 - DNA, 15 bp, Homo sapiens
caagctgacttggca

SEQ ID NO: 5854452 - DNA, 17 bp, Homo sapiens
caagctgacttggcact

SEQ ID NO: 5854453 - DNA, 13 bp, Homo sapiens
caagctgagctgg

SEQ ID NO: 5854454 - DNA, 14 bp, Homo sapiens
caagctgagctggc

SEQ ID NO: 5854455 - DNA, 17 bp, Homo sapiens
caagctgaggtgcccag

SEQ ID NO: 5854456 - DNA, 20 bp, Homo sapiens
caagctgaggtgcccaggag

SEQ ID NO: 5854457 - DNA, 15 bp, Homo sapiens
caagctgagtgactg

SEQ ID NO: 5854458 - DNA, 14 bp, Homo sapiens
caagctgagtttcc

SEQ ID NO: 5854459 - DNA, 23 bp, Homo sapiens
caagctgagtttcctatgggaac

SEQ ID NO: 5854460 - DNA, 15 bp, Homo sapiens
caagctgattaaatg

SEQ ID NO: 5854461 - DNA, 19 bp, Homo sapiens
caagctgattaaatgacac

SEQ ID NO: 5854462 - DNA, 14 bp, Homo sapiens
caagctgattttat

SEQ ID NO: 5854463 - DNA, 15 bp, Homo sapiens
caagctgattttatt

SEQ ID NO: 5854464 - DNA, 17 bp, Homo sapiens
caagctgattttattca

SEQ ID NO: 5854465 - DNA, 9 bp, Homo sapiens
caagctgca

SEQ ID NO: 5854466 - DNA, 18 bp, Homo sapiens
caagctgcaaaaggcctg

SEQ ID NO: 5854467 - DNA, 18 bp, Homo sapiens
caagctgcaccctcaggc

SEQ ID NO: 5854468 - DNA, 22 bp, Homo sapiens
caagctgcaccctcaggcaggt

SEQ ID NO: 5854469 - DNA, 15 bp, Homo sapiens
caagctgcactgaca

SEQ ID NO: 5854470 - DNA, 13 bp, Homo sapiens
caagctgcaggga

SEQ ID NO: 5854471 - DNA, 12 bp, Homo sapiens
caagctgcaggt

SEQ ID NO: 5854472 - DNA, 21 bp, Homo sapiens
caagctgccatcccctccccg

SEQ ID NO: 5854473 - DNA, 23 bp, Homo sapiens
caagctgcccagccctggcccag

SEQ ID NO: 5854474 - DNA, 12 bp, Homo sapiens
caagctgcctcc

SEQ ID NO: 5854475 - DNA, 14 bp, Homo sapiens
caagctgcctccct

SEQ ID NO: 5854476 - DNA, 15 bp, Homo sapiens
caagctgcctctgac

SEQ ID NO: 5854477 - DNA, 17 bp, Homo sapiens
caagctgcctctgggcc

SEQ ID NO: 5854478 - DNA, 12 bp, Homo sapiens
caagctgctgcc

SEQ ID NO: 5854479 - DNA, 21 bp, Homo sapiens
caagctgctgccgcctcacct

SEQ ID NO: 5854480 - DNA, 23 bp, Homo sapiens
caagctgcttgtcctgggcctgc

SEQ ID NO: 5854481 - DNA, 23 bp, Homo sapiens
caagctggaagaagtgagcagtg

SEQ ID NO: 5854482 - DNA, 12 bp, Homo sapiens
caagctggaagc

SEQ ID NO: 5854483 - DNA, 13 bp, Homo sapiens
caagctggaagca

SEQ ID NO: 5854484 - DNA, 14 bp, Homo sapiens
caagctggaagcac

SEQ ID NO: 5854485 - DNA, 19 bp, Homo sapiens
caagctggatgcagtggct

SEQ ID NO: 5854486 - DNA, 14 bp, Homo sapiens
caagctggcacaaa

SEQ ID NO: 5854487 - DNA, 22 bp, Homo sapiens
caagctggcacaaaagacagct

SEQ ID NO: 5854488 - DNA, 12 bp, Homo sapiens
caagctggcagg

SEQ ID NO: 5854489 - DNA, 18 bp, Homo sapiens
caagctggcaggagggtg

SEQ ID NO: 5854490 - DNA, 21 bp, Homo sapiens
caagctggccactatcacata

SEQ ID NO: 5854491 - DNA, 14 bp, Homo sapiens
caagctggctgggg

SEQ ID NO: 5854492 - DNA, 22 bp, Homo sapiens
caagctggctggggtggcctgt

SEQ ID NO: 5854493 - DNA, 17 bp, Homo sapiens
caagctgggaacttcta

SEQ ID NO: 5854494 - DNA, 11 bp, Homo sapiens
caagctgggcc

SEQ ID NO: 5854495 - DNA, 12 bp, Homo sapiens
caagctgggccc

SEQ ID NO: 5854496 - DNA, 15 bp, Homo sapiens
caagctgggccccag

SEQ ID NO: 5854497 - DNA, 19 bp, Homo sapiens
caagctgggccccagccca

SEQ ID NO: 5854498 - DNA, 16 bp, Homo sapiens
caagctgggctccctt

SEQ ID NO: 5854499 - DNA, 21 bp, Homo sapiens
caagctggtcccactcagtcc

SEQ ID NO: 5854500 - DNA, 22 bp, Homo sapiens
caagctggtcccactcagtcca

SEQ ID NO: 5854501 - DNA, 18 bp, Homo sapiens
caagctgtataaacagaa

SEQ ID NO: 5854502 - DNA, 16 bp, Homo sapiens
caagctgtatcactgc

SEQ ID NO: 5854503 - DNA, 19 bp, Homo sapiens
caagctgtcccctctgtca

SEQ ID NO: 5854504 - DNA, 19 bp, Homo sapiens
caagctgtccctgcagggc

SEQ ID NO: 5854505 - DNA, 23 bp, Homo sapiens
caagctgtgagacagtgggaaat

SEQ ID NO: 5854506 - DNA, 12 bp, Homo sapiens
caagctgtgcag

SEQ ID NO: 5854507 - DNA, 14 bp, Homo sapiens
caagctgtgcaggc

SEQ ID NO: 5854508 - DNA, 17 bp, Homo sapiens
caagctgtgccaccctg

SEQ ID NO: 5854509 - DNA, 20 bp, Homo sapiens
caagctgtgccaccctgggc

SEQ ID NO: 5854510 - DNA, 12 bp, Homo sapiens
caagctgtggca

SEQ ID NO: 5854511 - DNA, 22 bp, Homo sapiens
caagctgtggcagccgtcccag

SEQ ID NO: 5854512 - DNA, 14 bp, Homo sapiens
caagctgtgttact

SEQ ID NO: 5854513 - DNA, 21 bp, Homo sapiens
caagctgtgttacttgaagta

SEQ ID NO: 5854514 - DNA, 14 bp, Homo sapiens
caagctgtgttcat

SEQ ID NO: 5854515 - DNA, 20 bp, Homo sapiens
caagctgttatttcttccct

SEQ ID NO: 5854516 - DNA, 14 bp, Homo sapiens
caagctgttttctt

SEQ ID NO: 5854517 - DNA, 16 bp, Homo sapiens
caagctgttttcttct

SEQ ID NO: 5854518 - DNA, 14 bp, Homo sapiens
caagcttaaagctt

SEQ ID NO: 5854519 - DNA, 17 bp, Homo sapiens
caagcttaaggagagga

SEQ ID NO: 5854520 - DNA, 18 bp, Homo sapiens
caagcttaaggagaggag

SEQ ID NO: 5854521 - DNA, 21 bp, Homo sapiens
caagcttaaggagaggagagc

SEQ ID NO: 5854522 - DNA, 15 bp, Homo sapiens
caagcttaatagccc

SEQ ID NO: 5854523 - DNA, 16 bp, Homo sapiens
caagcttagaagccac

SEQ ID NO: 5854524 - DNA, 17 bp, Homo sapiens
caagcttaggtcatgaa

SEQ ID NO: 5854525 - DNA, 15 bp, Homo sapiens
caagcttagtcctgg

SEQ ID NO: 5854526 - DNA, 22 bp, Homo sapiens
caagcttagtcctgggagagga

SEQ ID NO: 5854527 - DNA, 19 bp, Homo sapiens
caagcttattctttccttc

SEQ ID NO: 5854528 - DNA, 21 bp, Homo sapiens
caagcttcaaagccatatgga

SEQ ID NO: 5854529 - DNA, 20 bp, Homo sapiens
caagcttcaaccctcagcct

SEQ ID NO: 5854530 - DNA, 13 bp, Homo sapiens
caagcttcagagc

SEQ ID NO: 5854531 - DNA, 14 bp, Homo sapiens
caagcttcagagcc

SEQ ID NO: 5854532 - DNA, 15 bp, Homo sapiens
caagcttcagagcct

SEQ ID NO: 5854533 - DNA, 12 bp, Homo sapiens
caagcttcccaa

SEQ ID NO: 5854534 - DNA, 16 bp, Homo sapiens
caagcttcccaacaga

SEQ ID NO: 5854535 - DNA, 13 bp, Homo sapiens
caagcttcctgtg

SEQ ID NO: 5854536 - DNA, 15 bp, Homo sapiens
caagcttctgagacg

SEQ ID NO: 5854537 - DNA, 16 bp, Homo sapiens
caagcttctgtcctgc

SEQ ID NO: 5854538 - DNA, 15 bp, Homo sapiens
caagcttgaggccaa

SEQ ID NO: 5854539 - DNA, 14 bp, Homo sapiens
caagcttggcagcc

SEQ ID NO: 5854540 - DNA, 16 bp, Homo sapiens
caagcttggcagccga

SEQ ID NO: 5854541 - DNA, 19 bp, Homo sapiens
caagcttgtatatacatat

SEQ ID NO: 5854542 - DNA, 14 bp, Homo sapiens
caagcttgtcttta

SEQ ID NO: 5854543 - DNA, 18 bp, Homo sapiens
caagcttgtgagagctgg

SEQ ID NO: 5854544 - DNA, 20 bp, Homo sapiens
caagcttgtgtacttgaccg

SEQ ID NO: 5854545 - DNA, 14 bp, Homo sapiens
caagctttaaatta

SEQ ID NO: 5854546 - DNA, 23 bp, Homo sapiens
caagctttcttctacaaccagag

SEQ ID NO: 5854547 - DNA, 21 bp, Homo sapiens
caagctttgaatacccccaga

SEQ ID NO: 5854548 - DNA, 14 bp, Homo sapiens
caagctttgctcct

SEQ ID NO: 5854549 - DNA, 15 bp, Homo sapiens
caagctttgctcctt

SEQ ID NO: 5854550 - DNA, 21 bp, Homo sapiens
caagcttttacaacagtgctg

SEQ ID NO: 5854551 - DNA, 15 bp, Homo sapiens
caagcttttcctttc

SEQ ID NO: 5854552 - DNA, 21 bp, Homo sapiens
caagcttttgcttgatccaga

SEQ ID NO: 5854553 - DNA, 18 bp, Homo sapiens
caaggaaaaaataacaat

SEQ ID NO: 5854554 - DNA, 12 bp, Homo sapiens
caaggaaaaaga

SEQ ID NO: 5854555 - DNA, 23 bp, Homo sapiens
caaggaaaaatgccactccctac

SEQ ID NO: 5854556 - DNA, 23 bp, Homo sapiens
caaggaaaaatgctgcttctcct

SEQ ID NO: 5854557 - DNA, 14 bp, Homo sapiens
caaggaaaactgca

SEQ ID NO: 5854558 - DNA, 13 bp, Homo sapiens
caaggaaaagatg

SEQ ID NO: 5854559 - DNA, 13 bp, Homo sapiens
caaggaaaagttc

SEQ ID NO: 5854560 - DNA, 17 bp, Homo sapiens
caaggaaaataagtgaa

SEQ ID NO: 5854561 - DNA, 22 bp, Homo sapiens
caaggaaaatagtttaggagaa

SEQ ID NO: 5854562 - DNA, 14 bp, Homo sapiens
caaggaaaattgaa

SEQ ID NO: 5854563 - DNA, 18 bp, Homo sapiens
caaggaaaattgaaagta

SEQ ID NO: 5854564 - DNA, 15 bp, Homo sapiens
caaggaaacatttta

SEQ ID NO: 5854565 - DNA, 14 bp, Homo sapiens
caaggaaaccacag

SEQ ID NO: 5854566 - DNA, 18 bp, Homo sapiens
caaggaaaccacagctgc

SEQ ID NO: 5854567 - DNA, 20 bp, Homo sapiens
caaggaaaccacagctgctg

SEQ ID NO: 5854568 - DNA, 20 bp, Homo sapiens
caaggaaacgctacctctct

SEQ ID NO: 5854569 - DNA, 22 bp, Homo sapiens
caaggaaactttcctttaactc

SEQ ID NO: 5854570 - DNA, 17 bp, Homo sapiens
caaggaaagccccagca

SEQ ID NO: 5854571 - DNA, 13 bp, Homo sapiens
caaggaaaggcac

SEQ ID NO: 5854572 - DNA, 13 bp, Homo sapiens
caaggaaagggca

SEQ ID NO: 5854573 - DNA, 15 bp, Homo sapiens
caaggaaataaagcg

SEQ ID NO: 5854574 - DNA, 20 bp, Homo sapiens
caaggaaatgtcctgcatgg

SEQ ID NO: 5854575 - DNA, 19 bp, Homo sapiens
caaggaaattaagaactga

SEQ ID NO: 5854576 - DNA, 20 bp, Homo sapiens
caaggaaattaagaactgaa

SEQ ID NO: 5854577 - DNA, 18 bp, Homo sapiens
caaggaacaaaaaaacca

SEQ ID NO: 5854578 - DNA, 17 bp, Homo sapiens
caaggaacaagagaaaa

SEQ ID NO: 5854579 - DNA, 20 bp, Homo sapiens
caaggaacctaattgaaatt

SEQ ID NO: 5854580 - DNA, 13 bp, Homo sapiens
caaggaagaaaac

SEQ ID NO: 5854581 - DNA, 16 bp, Homo sapiens
caaggaagatatacat

SEQ ID NO: 5854582 - DNA, 17 bp, Homo sapiens
caaggaagatatacatg

SEQ ID NO: 5854583 - DNA, 15 bp, Homo sapiens
caaggaagcagaaga

SEQ ID NO: 5854584 - DNA, 18 bp, Homo sapiens
caaggaagcagcctcaga

SEQ ID NO: 5854585 - DNA, 14 bp, Homo sapiens
caaggaagccaaag

SEQ ID NO: 5854586 - DNA, 18 bp, Homo sapiens
caaggaagccaaagtttt

SEQ ID NO: 5854587 - DNA, 21 bp, Homo sapiens
caaggaagccaaagttttcaa

SEQ ID NO: 5854588 - DNA, 15 bp, Homo sapiens
caaggaagctttgga

SEQ ID NO: 5854589 - DNA, 21 bp, Homo sapiens
caaggaaggaaacaatggtca

SEQ ID NO: 5854590 - DNA, 16 bp, Homo sapiens
caaggaaggaaagaaa

SEQ ID NO: 5854591 - DNA, 23 bp, Homo sapiens
caaggaaggaaagaaagaaggaa

SEQ ID NO: 5854592 - DNA, 13 bp, Homo sapiens
caaggaaggacat

SEQ ID NO: 5854593 - DNA, 15 bp, Homo sapiens
caaggaaggacttac

SEQ ID NO: 5854594 - DNA, 14 bp, Homo sapiens
caaggaaggatgcc

SEQ ID NO: 5854595 - DNA, 18 bp, Homo sapiens
caaggaagggatgtattt

SEQ ID NO: 5854596 - DNA, 19 bp, Homo sapiens
caaggaagggtgggaagct

SEQ ID NO: 5854597 - DNA, 23 bp, Homo sapiens
caaggaaggttcatgtagagaaa

SEQ ID NO: 5854598 - DNA, 15 bp, Homo sapiens
caaggaagtcttcaa

SEQ ID NO: 5854599 - DNA, 19 bp, Homo sapiens
caaggaagtgggggccgct

SEQ ID NO: 5854600 - DNA, 22 bp, Homo sapiens
caaggaagtgggggccgctggc

SEQ ID NO: 5854601 - DNA, 23 bp, Homo sapiens
caaggaagtgggggccgctggcc

SEQ ID NO: 5854602 - DNA, 14 bp, Homo sapiens
caaggaataaatga

SEQ ID NO: 5854603 - DNA, 18 bp, Homo sapiens
caaggaatccatcctgca

SEQ ID NO: 5854604 - DNA, 22 bp, Homo sapiens
caaggaatccatcctgcaaagg

SEQ ID NO: 5854605 - DNA, 23 bp, Homo sapiens
caaggaatccatcctgcaaaggc

SEQ ID NO: 5854606 - DNA, 23 bp, Homo sapiens
caaggaatgactcatgcctctga

SEQ ID NO: 5854607 - DNA, 13 bp, Homo sapiens
caaggaatttaaa

SEQ ID NO: 5854608 - DNA, 18 bp, Homo sapiens
caaggaatttaaaactgt

SEQ ID NO: 5854609 - DNA, 16 bp, Homo sapiens
caaggggcctgagcag

SEQ ID NO: 5854610 - DNA, 22 bp, Homo sapiens
caaggggctgcgctagcagccc

SEQ ID NO: 5854611 - DNA, 19 bp, Homo sapiens
caaggggctggctggagtc

SEQ ID NO: 5854612 - DNA, 15 bp, Homo sapiens
caagggggatgttgt

SEQ ID NO: 5854613 - DNA, 22 bp, Homo sapiens
caagggggcggggactgctggc

SEQ ID NO: 5854614 - DNA, 20 bp, Homo sapiens
caagggggctgctgctcctc

SEQ ID NO: 5854615 - DNA, 22 bp, Homo sapiens
caagggggtgtcatctgaggag

SEQ ID NO: 5854616 - DNA, 20 bp, Homo sapiens
caaggggtcccctccaggag

SEQ ID NO: 5854617 - DNA, 17 bp, Homo sapiens
caaggggtctgctcctg

SEQ ID NO: 5854618 - DNA, 23 bp, Homo sapiens
caaggggtctgtatatacatttc

SEQ ID NO: 5854619 - DNA, 22 bp, Homo sapiens
caaggggtgaggataggacaga

SEQ ID NO: 5854620 - DNA, 14 bp, Homo sapiens
caaggggtgcctgg

SEQ ID NO: 5854621 - DNA, 18 bp, Homo sapiens
caaggggtgcctgggaac

SEQ ID NO: 5854622 - DNA, 15 bp, Homo sapiens
caaggggtggaaggg

SEQ ID NO: 5854623 - DNA, 18 bp, Homo sapiens
caaggggtggaagggcag

SEQ ID NO: 5854624 - DNA, 19 bp, Homo sapiens
caaggggtggccgggcaca

SEQ ID NO: 5854625 - DNA, 20 bp, Homo sapiens
caaggggtggccgggcacag
